United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 187

SEQ ID NO: 7789796 - DNA, 22 bp, Homo sapiens
gagcagtggtctgatcttctaa

SEQ ID NO: 7789797 - DNA, 22 bp, Homo sapiens
gagcagtggtggtgtgttagag

SEQ ID NO: 7789798 - DNA, 22 bp, Homo sapiens
gaatatttgtaattactgttga

SEQ ID NO: 7789799 - DNA, 22 bp, Homo sapiens
ctgtccttactgcttctggctt

SEQ ID NO: 7789800 - DNA, 22 bp, Homo sapiens
ctttgaaaacacacgaatagac

SEQ ID NO: 7789801 - DNA, 22 bp, Homo sapiens
ctttgaaaaatggtttcctaga

SEQ ID NO: 7789802 - DNA, 22 bp, Homo sapiens
ctttgaaaacttaaataacagc

SEQ ID NO: 7789803 - DNA, 22 bp, Homo sapiens
cttcatttcaggctgaagaata

SEQ ID NO: 7789804 - DNA, 22 bp, Homo sapiens
cttccttcaatataatttttac

SEQ ID NO: 7789805 - DNA, 22 bp, Homo sapiens
cttccttccacaccttcagaat

SEQ ID NO: 7789806 - DNA, 20 bp, Homo sapiens
cttaaaacctctttttctgt

SEQ ID NO: 7789807 - DNA, 22 bp, Homo sapiens
ggtgcctttggcccctggctag

SEQ ID NO: 7789808 - DNA, 22 bp, Homo sapiens
gcctggcttggggctcagtggt

SEQ ID NO: 7789809 - DNA, 22 bp, Homo sapiens
gcctggctggtagagggggctc

SEQ ID NO: 7789810 - DNA, 22 bp, Homo sapiens
gcctggctggtcactgcctggc

SEQ ID NO: 7789811 - DNA, 22 bp, Homo sapiens
gcctggctgtcaaacccagaag

SEQ ID NO: 7789812 - DNA, 22 bp, Homo sapiens
gcctggctgggcaccaggggag

SEQ ID NO: 7789813 - DNA, 22 bp, Homo sapiens
gcctggctgggctgaatgctta

SEQ ID NO: 7789814 - DNA, 19 bp, Homo sapiens
gcctggctgggatgagccc

SEQ ID NO: 7789815 - DNA, 22 bp, Homo sapiens
gcctggcttgccagccctggcg

SEQ ID NO: 7789816 - DNA, 22 bp, Homo sapiens
gcctggcttcccttggagcatt

SEQ ID NO: 7789817 - DNA, 23 bp, Homo sapiens
gcctggcttccaaggtaggggag

SEQ ID NO: 7789818 - DNA, 18 bp, Homo sapiens
gcctggcttcggagccgc

SEQ ID NO: 7789819 - DNA, 21 bp, Homo sapiens
gcctggcttcacaggcactga

SEQ ID NO: 7789820 - DNA, 22 bp, Homo sapiens
gcctggctgtctggcaaggttc

SEQ ID NO: 7789821 - DNA, 22 bp, Homo sapiens
gcctggctatggcctcccccat

SEQ ID NO: 7789822 - DNA, 18 bp, Homo sapiens
gcctggctgccaacccag

SEQ ID NO: 7789823 - DNA, 22 bp, Homo sapiens
gcctggctgccggccttggcaa

SEQ ID NO: 7789824 - DNA, 22 bp, Homo sapiens
gcctggctagttagtgtcaggt

SEQ ID NO: 7789825 - DNA, 21 bp, Homo sapiens
gcctggctagaagctcctagc

SEQ ID NO: 7789826 - DNA, 22 bp, Homo sapiens
gcctggctgctagccagaggca

SEQ ID NO: 7789827 - DNA, 22 bp, Homo sapiens
gcctggctgctcagccactcac

SEQ ID NO: 7789828 - DNA, 22 bp, Homo sapiens
gcctggctgcttagcctacttc

SEQ ID NO: 7789829 - DNA, 22 bp, Homo sapiens
gcctggctgctggttctgagga

SEQ ID NO: 7789830 - DNA, 22 bp, Homo sapiens
gcctggctaagcagaaggaccc

SEQ ID NO: 7789831 - DNA, 22 bp, Homo sapiens
gcctggctaattttggtatttt

SEQ ID NO: 7789832 - DNA, 22 bp, Homo sapiens
gcctggctacccactgaaatat

SEQ ID NO: 7789833 - DNA, 17 bp, Homo sapiens
gctccttctaacttcca

SEQ ID NO: 7789834 - DNA, 22 bp, Homo sapiens
taaagacaataggaaagttgtt

SEQ ID NO: 7789835 - DNA, 22 bp, Homo sapiens
taaagtgtgtgggttctaaatt

SEQ ID NO: 7789836 - DNA, 21 bp, Homo sapiens
taaacataaccttgtatggct

SEQ ID NO: 7789837 - DNA, 22 bp, Homo sapiens
gttttataattgcttcataaga

SEQ ID NO: 7789838 - DNA, 22 bp, Homo sapiens
taacaatagtgtttgctagtca

SEQ ID NO: 7789839 - DNA, 22 bp, Homo sapiens
taacacatggttagtacacaat

SEQ ID NO: 7789840 - DNA, 22 bp, Homo sapiens
taacacatatctacaacatgtg

SEQ ID NO: 7789841 - DNA, 22 bp, Homo sapiens
taagataataagtatgtctatg

SEQ ID NO: 7789842 - DNA, 22 bp, Homo sapiens
taagataatccattataatgtt

SEQ ID NO: 7789843 - DNA, 22 bp, Homo sapiens
gtttataaggcccaatatttct

SEQ ID NO: 7789844 - DNA, 22 bp, Homo sapiens
gttccttcctatcccgagagcc

SEQ ID NO: 7789845 - DNA, 16 bp, Homo sapiens
gttccttcccacacct

SEQ ID NO: 7789846 - DNA, 23 bp, Homo sapiens
gttccttcatgtggtcattggtt

SEQ ID NO: 7789847 - DNA, 20 bp, Homo sapiens
taatttgatatctataagtt

SEQ ID NO: 7789848 - DNA, 22 bp, Homo sapiens
tacacatgtatttatgtgtaca

SEQ ID NO: 7789849 - DNA, 22 bp, Homo sapiens
taagtttaaatgtacatgaagc

SEQ ID NO: 7789850 - DNA, 22 bp, Homo sapiens
taatttcactgatatgaagtca

SEQ ID NO: 7789851 - DNA, 22 bp, Homo sapiens
tacagtttttcactgaagatgt

SEQ ID NO: 7789852 - DNA, 22 bp, Homo sapiens
tactgaaagactgaatatttag

SEQ ID NO: 7789853 - DNA, 22 bp, Homo sapiens
tatttcactattctctgtaact

SEQ ID NO: 7789854 - DNA, 22 bp, Homo sapiens
tatttctaagagatatctgtac

SEQ ID NO: 7789855 - DNA, 22 bp, Homo sapiens
tatttcctgtggatacttttag

SEQ ID NO: 7789856 - DNA, 22 bp, Homo sapiens
tatttctaagctgtaagtctga

SEQ ID NO: 7789857 - DNA, 22 bp, Homo sapiens
tattttcattctgtgtgactgt

SEQ ID NO: 7789858 - DNA, 22 bp, Homo sapiens
tattttcaccttctctggatat

SEQ ID NO: 7789859 - DNA, 22 bp, Homo sapiens
tagttaaagccctaaattgata

SEQ ID NO: 7789860 - DNA, 22 bp, Homo sapiens
tagtatttcctgtaagctatag

SEQ ID NO: 7789861 - DNA, 22 bp, Homo sapiens
tagtcaaaaggaaggatatgct

SEQ ID NO: 7789862 - DNA, 22 bp, Homo sapiens
tagaataagttgatgatatatg

SEQ ID NO: 7789863 - DNA, 22 bp, Homo sapiens
tcctccctgtaccattcctctg

SEQ ID NO: 7789864 - DNA, 18 bp, Homo sapiens
tcccttctcccttgcctc

SEQ ID NO: 7789865 - DNA, 22 bp, Homo sapiens
tcccttctggcagcagtgtgag

SEQ ID NO: 7789866 - DNA, 22 bp, Homo sapiens
tcatgttttagtaaagtgaagg

SEQ ID NO: 7789867 - DNA, 22 bp, Homo sapiens
tcagtttttaaatgatataatt

SEQ ID NO: 7789868 - DNA, 22 bp, Homo sapiens
tcacagcattgagtgtactaga

SEQ ID NO: 7789869 - DNA, 22 bp, Homo sapiens
tcacagcagtaaagaaaacact

SEQ ID NO: 7789870 - DNA, 22 bp, Homo sapiens
tttctatatgaggagctaaagt

SEQ ID NO: 7789871 - DNA, 22 bp, Homo sapiens
ttttggtagaatcaacaatgta

SEQ ID NO: 7789872 - DNA, 22 bp, Homo sapiens
ttttttagttaggtcagaatgt

SEQ ID NO: 7789873 - DNA, 23 bp, Homo sapiens
ttttaatttggacataagaagat

SEQ ID NO: 7789874 - DNA, 20 bp, Homo sapiens
ttgaaaatgcattgtgcagt

SEQ ID NO: 7789875 - DNA, 22 bp, Homo sapiens
ttgaaaatatcacaggagcagc

SEQ ID NO: 7789876 - DNA, 22 bp, Homo sapiens
ttgaaaatggtaagcatgatat

SEQ ID NO: 7789877 - DNA, 23 bp, Homo sapiens
ttgaaaaatatagtcccattgtc

SEQ ID NO: 7789878 - DNA, 22 bp, Homo sapiens
ttgaaaacagcgtagattcaca

SEQ ID NO: 7789879 - DNA, 22 bp, Homo sapiens
ttgaaaaaattggtagaggatg

SEQ ID NO: 7789880 - DNA, 22 bp, Homo sapiens
ttgaaagatatgttaatctttc

SEQ ID NO: 7789881 - DNA, 22 bp, Homo sapiens
ttgaaactcccttttgtctagt

SEQ ID NO: 7789882 - DNA, 22 bp, Homo sapiens
ttgaaacattctcctattgatt

SEQ ID NO: 7789883 - DNA, 22 bp, Homo sapiens
ttcctttagtgtcatatacttt

SEQ ID NO: 7789884 - DNA, 22 bp, Homo sapiens
ttcatactgtttaagttctgtt

SEQ ID NO: 7789885 - DNA, 22 bp, Homo sapiens
ttcatagacccatgtgaggaag

SEQ ID NO: 7789886 - DNA, 23 bp, Homo sapiens
tcctccttttgcttgtgcttccc

SEQ ID NO: 7789887 - DNA, 22 bp, Homo sapiens
tcctccttgttttgtctctgct

SEQ ID NO: 7789888 - DNA, 22 bp, Homo sapiens
tcctccttgttttcctgtttac

SEQ ID NO: 7789889 - DNA, 19 bp, Homo sapiens
tcctccttacttcctcttg

SEQ ID NO: 7789890 - DNA, 22 bp, Homo sapiens
tcctccttcgggactgcttgac

SEQ ID NO: 7789891 - DNA, 21 bp, Homo sapiens
tcctccttcaagtcctggcct

SEQ ID NO: 7789892 - DNA, 22 bp, Homo sapiens
tcctccttgttcttttgcctac

SEQ ID NO: 7789893 - DNA, 21 bp, Homo sapiens
ttcaaaatggtgtgtttgtct

SEQ ID NO: 7789894 - DNA, 22 bp, Homo sapiens
ttgtgctcctatgagaatctaa

SEQ ID NO: 7789895 - DNA, 22 bp, Homo sapiens
ttgtgctcctgtgagaatctag

SEQ ID NO: 7789896 - DNA, 22 bp, Homo sapiens
ttggaatatgtgtatgaaaagc

SEQ ID NO: 7789897 - DNA, 22 bp, Homo sapiens
tttaaattatagttaatgtctg

SEQ ID NO: 7789898 - DNA, 22 bp, Homo sapiens
ttgttgaatggataaataaatt

SEQ ID NO: 7789899 - DNA, 22 bp, Homo sapiens
tttatgaactacagatataact

SEQ ID NO: 7789900 - DNA, 22 bp, Homo sapiens
tttcataatgtcacagtcaaaa

SEQ ID NO: 7789901 - DNA, 22 bp, Homo sapiens
tttcataatctgtcaagtgggg

SEQ ID NO: 7789902 - DNA, 22 bp, Homo sapiens
tttcataatatccagagatttt

SEQ ID NO: 7789903 - DNA, 22 bp, Homo sapiens
tttcataatagtgcagtttgtt

SEQ ID NO: 7789904 - DNA, 22 bp, Homo sapiens
tttcataatactgtacatgaaa

SEQ ID NO: 7789905 - DNA, 22 bp, Homo sapiens
tttcataacctcaagctacagt

SEQ ID NO: 7789906 - DNA, 22 bp, Homo sapiens
tttcataagggtttctagactt

SEQ ID NO: 7789907 - DNA, 22 bp, Homo sapiens
tttcatcaccccaaatctatgg

SEQ ID NO: 7789908 - DNA, 22 bp, Homo sapiens
tttccttcttagcggtgttctt

SEQ ID NO: 7789909 - DNA, 22 bp, Homo sapiens
tttcacaatcaaatggtgaaat

SEQ ID NO: 7789910 - DNA, 22 bp, Homo sapiens
tttcacattcttctgaatctac

SEQ ID NO: 7789911 - DNA, 22 bp, Homo sapiens
tttcacatttaggcgtgaattg

SEQ ID NO: 7789912 - DNA, 22 bp, Homo sapiens
tttcataaacagtagaagacta

SEQ ID NO: 7789913 - DNA, 22 bp, Homo sapiens
aatgtcaattaccagaacagaa

SEQ ID NO: 7789914 - DNA, 22 bp, Homo sapiens
aatgttcattgttttccatatg

SEQ ID NO: 7789915 - DNA, 22 bp, Homo sapiens
aattggaaaaagacttaattgc

SEQ ID NO: 7789916 - DNA, 22 bp, Homo sapiens
acagataaaagttgtttaaaat

SEQ ID NO: 7789917 - DNA, 22 bp, Homo sapiens
aagtacatgctttattcagagt

SEQ ID NO: 7789918 - DNA, 22 bp, Homo sapiens
aagctgcactacttgagggacc

SEQ ID NO: 7789919 - DNA, 22 bp, Homo sapiens
actaagacctagatactagggg

SEQ ID NO: 7789920 - DNA, 22 bp, Homo sapiens
actaagcaccatgcctgttggg

SEQ ID NO: 7789921 - DNA, 22 bp, Homo sapiens
aataagatcctgaagatatgtt

SEQ ID NO: 7789922 - DNA, 22 bp, Homo sapiens
aataattttagctcagagttgt

SEQ ID NO: 7789923 - DNA, 22 bp, Homo sapiens
aataatttccagccaactggaa

SEQ ID NO: 7789924 - DNA, 22 bp, Homo sapiens
aatatcaacagtgtccttctaa

SEQ ID NO: 7789925 - DNA, 19 bp, Homo sapiens
aatattttagcctcttcct

SEQ ID NO: 7789926 - DNA, 22 bp, Homo sapiens
aatcaaaacctacagaggtaat

SEQ ID NO: 7789927 - DNA, 22 bp, Homo sapiens
aatattttaggctttccaggct

SEQ ID NO: 7789928 - DNA, 22 bp, Homo sapiens
aatatttttgaggccctgttat

SEQ ID NO: 7789929 - DNA, 22 bp, Homo sapiens
aatgacatggagcatcttttca

SEQ ID NO: 7789930 - DNA, 22 bp, Homo sapiens
aaataacttggtttcatcagag

SEQ ID NO: 7789931 - DNA, 20 bp, Homo sapiens
aaagtgtaagcatataatta

SEQ ID NO: 7789932 - DNA, 22 bp, Homo sapiens
aaagccatgaatgttatagagg

SEQ ID NO: 7789933 - DNA, 22 bp, Homo sapiens
aaagataatgtttccttattct

SEQ ID NO: 7789934 - DNA, 22 bp, Homo sapiens
aaagccatcagtaaaatgattt

SEQ ID NO: 7789935 - DNA, 22 bp, Homo sapiens
aaagacattagcttagatgtca

SEQ ID NO: 7789936 - DNA, 22 bp, Homo sapiens
aaagacattagattaacgtaca

SEQ ID NO: 7789937 - DNA, 22 bp, Homo sapiens
aaagacattgaagaaggactta

SEQ ID NO: 7789938 - DNA, 22 bp, Homo sapiens
aaaatctaagtagcgagtaagg

SEQ ID NO: 7789939 - DNA, 22 bp, Homo sapiens
aaaagtatggtggtccttttta

SEQ ID NO: 7789940 - DNA, 22 bp, Homo sapiens
aagcatttggttctgaagactc

SEQ ID NO: 7789941 - DNA, 22 bp, Homo sapiens
aagcatttggcatgaaactctt

SEQ ID NO: 7789942 - DNA, 22 bp, Homo sapiens
aagcatttcaggtagagatatt

SEQ ID NO: 7789943 - DNA, 22 bp, Homo sapiens
aagcattgtaagcagaagatgc

SEQ ID NO: 7789944 - DNA, 22 bp, Homo sapiens
aagcatttatagataagaattt

SEQ ID NO: 7789945 - DNA, 22 bp, Homo sapiens
aagcatttcaatataatattca

SEQ ID NO: 7789946 - DNA, 22 bp, Homo sapiens
acagaattctctctgcagaggc

SEQ ID NO: 7789947 - DNA, 22 bp, Homo sapiens
acagaatttaaagctctagact

SEQ ID NO: 7789948 - DNA, 22 bp, Homo sapiens
aattggaaaatgctacatatca

SEQ ID NO: 7789949 - DNA, 22 bp, Homo sapiens
aagaataagaggatttagaaca

SEQ ID NO: 7789950 - DNA, 22 bp, Homo sapiens
aagaataacacttaggttttgc

SEQ ID NO: 7789951 - DNA, 23 bp, Homo sapiens
aagaataaatgacattaaaggtg

SEQ ID NO: 7789952 - DNA, 22 bp, Homo sapiens
aatcatgacaggaatagaaggg

SEQ ID NO: 7789953 - DNA, 22 bp, Homo sapiens
aatataatgctgttttatgcca

SEQ ID NO: 7789954 - DNA, 22 bp, Homo sapiens
aatgatcattataaagtgctct

SEQ ID NO: 7789955 - DNA, 20 bp, Homo sapiens
aatgatcagcatagcaagga

SEQ ID NO: 7789956 - DNA, 22 bp, Homo sapiens
aataagaactccatttactcgt

SEQ ID NO: 7789957 - DNA, 22 bp, Homo sapiens
aacatttttaagaccaagtgct

SEQ ID NO: 7789958 - DNA, 22 bp, Homo sapiens
aaatgttaggttgtactgagtc

SEQ ID NO: 7789959 - DNA, 22 bp, Homo sapiens
aaatgtgtcatattcaaagtca

SEQ ID NO: 7789960 - DNA, 22 bp, Homo sapiens
aacagcataccaatgtacatat

SEQ ID NO: 7789961 - DNA, 22 bp, Homo sapiens
atgaacaatctgttgacttctg

SEQ ID NO: 7789962 - DNA, 22 bp, Homo sapiens
atgaaagatgatttaaagtact

SEQ ID NO: 7789963 - DNA, 22 bp, Homo sapiens
atttccttcagtgtttaatact

SEQ ID NO: 7789964 - DNA, 22 bp, Homo sapiens
atttccttcatcagcctatcct

SEQ ID NO: 7789965 - DNA, 22 bp, Homo sapiens
agataaattcctaagatttcag

SEQ ID NO: 7789966 - DNA, 22 bp, Homo sapiens
agataaaatggttcaaaggcta

SEQ ID NO: 7789967 - DNA, 20 bp, Homo sapiens
attcatgtctttataaaagc

SEQ ID NO: 7789968 - DNA, 22 bp, Homo sapiens
agagctgtttggacatctgagt

SEQ ID NO: 7789969 - DNA, 22 bp, Homo sapiens
atgtgtatatttggtgtcaata

SEQ ID NO: 7789970 - DNA, 20 bp, Homo sapiens
acctggctctcaggagcaac

SEQ ID NO: 7789971 - DNA, 22 bp, Homo sapiens
acctggctgagaacgtgcagct

SEQ ID NO: 7789972 - DNA, 22 bp, Homo sapiens
agtattttcgccatcacaagaa

SEQ ID NO: 7789973 - DNA, 22 bp, Homo sapiens
actgtgagtgatttccttctgg

SEQ ID NO: 7789974 - DNA, 22 bp, Homo sapiens
atcatctgtctccttgtatgtt

SEQ ID NO: 7789975 - DNA, 22 bp, Homo sapiens
atattcttccaaaacatcattt

SEQ ID NO: 7789976 - DNA, 22 bp, Homo sapiens
atattcatcgtgtagaaatact

SEQ ID NO: 7789977 - DNA, 20 bp, Homo sapiens
acatttgagtatcatctact

SEQ ID NO: 7789978 - DNA, 22 bp, Homo sapiens
acatgtttaagtttaatgaaaa

SEQ ID NO: 7789979 - DNA, 22 bp, Homo sapiens
acagtaaaacatttttattagg

SEQ ID NO: 7789980 - DNA, 22 bp, Homo sapiens
acatattttgaaagctttctaa

SEQ ID NO: 7789981 - DNA, 22 bp, Homo sapiens
catataaatacaacatgtgtta

SEQ ID NO: 7789982 - DNA, 22 bp, Homo sapiens
cagtttccctgcttgaaaacgt

SEQ ID NO: 7789983 - DNA, 22 bp, Homo sapiens
cagtttcctgaagagaaagaat

SEQ ID NO: 7789984 - DNA, 22 bp, Homo sapiens
ccatggctgcaattcttctgga

SEQ ID NO: 7789985 - DNA, 22 bp, Homo sapiens
ctcctcctaaatgattcttcct

SEQ ID NO: 7789986 - DNA, 22 bp, Homo sapiens
cctttatactaaggcatacaat

SEQ ID NO: 7789987 - DNA, 22 bp, Homo sapiens
agtttctctcagtatagaatag

SEQ ID NO: 7789988 - DNA, 22 bp, Homo sapiens
agttttctgttctacaatttga

SEQ ID NO: 7789989 - DNA, 21 bp, Homo sapiens
agttttctgagttataaaata

SEQ ID NO: 7789990 - DNA, 17 bp, Homo sapiens
agttttgatataatggc

SEQ ID NO: 7789991 - DNA, 22 bp, Homo sapiens
ataatttaaattagtatgtgat

SEQ ID NO: 7789992 - DNA, 22 bp, Homo sapiens
atatcacagatgcagaaagaga

SEQ ID NO: 7789993 - DNA, 22 bp, Homo sapiens
atccttctaagagggacgtatg

SEQ ID NO: 7789994 - DNA, 22 bp, Homo sapiens
atccttctacctaggactattt

SEQ ID NO: 7789995 - DNA, 22 bp, Homo sapiens
atccttcttctgctagtgtcta

SEQ ID NO: 7789996 - DNA, 22 bp, Homo sapiens
atccttctccaaaactggctcc

SEQ ID NO: 7789997 - DNA, 22 bp, Homo sapiens
atccttctccagtcgtattttt

SEQ ID NO: 7789998 - DNA, 17 bp, Homo sapiens
atccttctgttctttct

SEQ ID NO: 7789999 - DNA, 22 bp, Homo sapiens
atccttcttcaaagagggaaaa

SEQ ID NO: 7790000 - DNA, 21 bp, Homo sapiens
atctggaaattctgccagaga

SEQ ID NO: 7790001 - DNA, 22 bp, Homo sapiens
atttcttatgaatattgactgt

SEQ ID NO: 7790002 - DNA, 22 bp, Homo sapiens
atttcaacgttagatgtaatag

SEQ ID NO: 7790003 - DNA, 22 bp, Homo sapiens
atttatgacaaccaaagagtga

SEQ ID NO: 7790004 - DNA, 22 bp, Homo sapiens
atttatgactggtgaatagaac

SEQ ID NO: 7790005 - DNA, 22 bp, Homo sapiens
atttcttcctctgtcagtaact

SEQ ID NO: 7790006 - DNA, 21 bp, Homo sapiens
attttcattaattcagtgtgg

SEQ ID NO: 7790007 - DNA, 22 bp, Homo sapiens
attttcatcatgggtttaacat

SEQ ID NO: 7790008 - DNA, 22 bp, Homo sapiens
attctgaattctgagcctttca

SEQ ID NO: 7790009 - DNA, 23 bp, Homo sapiens
atgttaaacataactgaagagcc

SEQ ID NO: 7790010 - DNA, 22 bp, Homo sapiens
cttctccctggcttctgcacac

SEQ ID NO: 7790011 - DNA, 22 bp, Homo sapiens
cttctccctgggggctctttat

SEQ ID NO: 7790012 - DNA, 18 bp, Homo sapiens
cttctcccatcttggcca

SEQ ID NO: 7790013 - DNA, 22 bp, Homo sapiens
cttctcccaagtatgcagtttg

SEQ ID NO: 7790014 - DNA, 22 bp, Homo sapiens
cttctcccgaagccggttctgc

SEQ ID NO: 7790015 - DNA, 22 bp, Homo sapiens
gtgaatttctgactaaaagtgc

SEQ ID NO: 7790016 - DNA, 22 bp, Homo sapiens
gtgaatttagtttgtaagaagg

SEQ ID NO: 7790017 - DNA, 22 bp, Homo sapiens
tatttgaaagtgtacaaaaact

SEQ ID NO: 7790018 - DNA, 22 bp, Homo sapiens
tatttcatctggaacaaggtaa

SEQ ID NO: 7790019 - DNA, 22 bp, Homo sapiens
tagaacatcaggttgaatttgg

SEQ ID NO: 7790020 - DNA, 22 bp, Homo sapiens
tagaatatgattaattttctta

SEQ ID NO: 7790021 - DNA, 22 bp, Homo sapiens
tatcatttaacagaatcattgc

SEQ ID NO: 7790022 - DNA, 22 bp, Homo sapiens
tcattcattctttctgaatata

SEQ ID NO: 7790023 - DNA, 22 bp, Homo sapiens
tcctctccatattttctgattt

SEQ ID NO: 7790024 - DNA, 22 bp, Homo sapiens
tctgaatagttctattttaaag

SEQ ID NO: 7790025 - DNA, 22 bp, Homo sapiens
tctccctctttgtctgctttgg

SEQ ID NO: 7790026 - DNA, 22 bp, Homo sapiens
tctccctcattcctgcttccat

SEQ ID NO: 7790027 - DNA, 17 bp, Homo sapiens
cccgttctcttcgctgg

SEQ ID NO: 7790028 - DNA, 22 bp, Homo sapiens
tgtaatttcctgatgttagaac

SEQ ID NO: 7790029 - DNA, 22 bp, Homo sapiens
tgatgaattagtaacaaatgag

SEQ ID NO: 7790030 - DNA, 22 bp, Homo sapiens
tgaaagcagtgatttctccttc

SEQ ID NO: 7790031 - DNA, 22 bp, Homo sapiens
tcttgcctcttcccctttccat

SEQ ID NO: 7790032 - DNA, 22 bp, Homo sapiens
tgagataaggaagtaattagga

SEQ ID NO: 7790033 - DNA, 22 bp, Homo sapiens
tgagataactctgatttatgtt

SEQ ID NO: 7790034 - DNA, 22 bp, Homo sapiens
tttgaaaagaaccatcgcctta

SEQ ID NO: 7790035 - DNA, 22 bp, Homo sapiens
tttgaaaacttaatttggtcgt

SEQ ID NO: 7790036 - DNA, 22 bp, Homo sapiens
tttgaaaattagacacaggcta

SEQ ID NO: 7790037 - DNA, 22 bp, Homo sapiens
tttgaaaatttaagtgctacac

SEQ ID NO: 7790038 - DNA, 22 bp, Homo sapiens
tttgaaagaatttatgtacttt

SEQ ID NO: 7790039 - DNA, 22 bp, Homo sapiens
ttttgcctgcactgtatatata

SEQ ID NO: 7790040 - DNA, 22 bp, Homo sapiens
ctctgaaagacaagctctcatt

SEQ ID NO: 7790041 - DNA, 22 bp, Homo sapiens
tttcattaaagtcaaatctggt

SEQ ID NO: 7790042 - DNA, 18 bp, Homo sapiens
tttcattataaagcaggc

SEQ ID NO: 7790043 - DNA, 22 bp, Homo sapiens
ctcttcctacagtctgctatgc

SEQ ID NO: 7790044 - DNA, 22 bp, Homo sapiens
ctcttcctctcatgcggtcata

SEQ ID NO: 7790045 - DNA, 22 bp, Homo sapiens
ctcttcctagtgtgcagcgtgg

SEQ ID NO: 7790046 - DNA, 22 bp, Homo sapiens
ctcttccttaagactataaaga

SEQ ID NO: 7790047 - DNA, 22 bp, Homo sapiens
ctcttcctttcccttgagggtg

SEQ ID NO: 7790048 - DNA, 22 bp, Homo sapiens
ttataaaggtttgtgcatattt

SEQ ID NO: 7790049 - DNA, 22 bp, Homo sapiens
ttataacatcaatcagagttaa

SEQ ID NO: 7790050 - DNA, 22 bp, Homo sapiens
ttataacactgccttgtcacca

SEQ ID NO: 7790051 - DNA, 22 bp, Homo sapiens
gaaatgttttacaaggcatact

SEQ ID NO: 7790052 - DNA, 22 bp, Homo sapiens
gaaatatacattgcaggaagag

SEQ ID NO: 7790053 - DNA, 20 bp, Homo sapiens
cttcactaggagaaagagaa

SEQ ID NO: 7790054 - DNA, 20 bp, Homo sapiens
cttcttcagcctatgcttca

SEQ ID NO: 7790055 - DNA, 22 bp, Homo sapiens
ctttccttctcgtggttctcac

SEQ ID NO: 7790056 - DNA, 22 bp, Homo sapiens
cttcttcctgctgcagcctcca

SEQ ID NO: 7790057 - DNA, 22 bp, Homo sapiens
cttcttcccagcttccctcacc

SEQ ID NO: 7790058 - DNA, 22 bp, Homo sapiens
ggaaaaatagagtatactttaa

SEQ ID NO: 7790059 - DNA, 22 bp, Homo sapiens
gcagttctagcaaactaatact

SEQ ID NO: 7790060 - DNA, 22 bp, Homo sapiens
gtagttttctgaaaattacttt

SEQ ID NO: 7790061 - DNA, 22 bp, Homo sapiens
tcatttttagcgcgcaaaagtt

SEQ ID NO: 7790062 - DNA, 22 bp, Homo sapiens
tcatttttctcttacacgtaga

SEQ ID NO: 7790063 - DNA, 22 bp, Homo sapiens
tcatttctcctaagtgaaatat

SEQ ID NO: 7790064 - DNA, 22 bp, Homo sapiens
tcatttaattggttttgctcgt

SEQ ID NO: 7790065 - DNA, 22 bp, Homo sapiens
tcatttaatagcttttgtcttt

SEQ ID NO: 7790066 - DNA, 22 bp, Homo sapiens
tcatctttcctcaaaagatcca

SEQ ID NO: 7790067 - DNA, 22 bp, Homo sapiens
tcatacattcagcagatatttg

SEQ ID NO: 7790068 - DNA, 22 bp, Homo sapiens
tccattctttttacctctcaga

SEQ ID NO: 7790069 - DNA, 22 bp, Homo sapiens
taagacatttgacaaaccattt

SEQ ID NO: 7790070 - DNA, 22 bp, Homo sapiens
taagacatagccaagagcatcc

SEQ ID NO: 7790071 - DNA, 22 bp, Homo sapiens
taagacatcattaaacagcaat

SEQ ID NO: 7790072 - DNA, 22 bp, Homo sapiens
taaaagattttataggaacaag

SEQ ID NO: 7790073 - DNA, 21 bp, Homo sapiens
taaaagatgacaagacagctc

SEQ ID NO: 7790074 - DNA, 22 bp, Homo sapiens
taaagacataggatcagggaga

SEQ ID NO: 7790075 - DNA, 22 bp, Homo sapiens
taaagacatggtgtaggtgaac

SEQ ID NO: 7790076 - DNA, 22 bp, Homo sapiens
taaaagtatactttcaaaggag

SEQ ID NO: 7790077 - DNA, 22 bp, Homo sapiens
taaagcacagtatgagcattgg

SEQ ID NO: 7790078 - DNA, 22 bp, Homo sapiens
gttgaaaatgactttataccat

SEQ ID NO: 7790079 - DNA, 22 bp, Homo sapiens
gttgaaatttgtgataatttag

SEQ ID NO: 7790080 - DNA, 22 bp, Homo sapiens
gttgaaaatacagattcctagg

SEQ ID NO: 7790081 - DNA, 22 bp, Homo sapiens
gtttgaaagttcaacaggaaaa

SEQ ID NO: 7790082 - DNA, 22 bp, Homo sapiens
gtttgaaagaccaattagattt

SEQ ID NO: 7790083 - DNA, 22 bp, Homo sapiens
taagcattgtttctgaggatgg

SEQ ID NO: 7790084 - DNA, 22 bp, Homo sapiens
taagcattcaatgcttagcact

SEQ ID NO: 7790085 - DNA, 22 bp, Homo sapiens
taagcattaactctgctgcaag

SEQ ID NO: 7790086 - DNA, 22 bp, Homo sapiens
taagcattatggtaaagaagta

SEQ ID NO: 7790087 - DNA, 22 bp, Homo sapiens
taatttatatggaattgttgct

SEQ ID NO: 7790088 - DNA, 22 bp, Homo sapiens
taatttatgatgcaaagaaaag

SEQ ID NO: 7790089 - DNA, 22 bp, Homo sapiens
tagttttataatgttaacatct

SEQ ID NO: 7790090 - DNA, 22 bp, Homo sapiens
tagaacatgctcatgtataaat

SEQ ID NO: 7790091 - DNA, 22 bp, Homo sapiens
tagaacatgtgaaaatatagcc

SEQ ID NO: 7790092 - DNA, 22 bp, Homo sapiens
tagatataaggtccttagaaca

SEQ ID NO: 7790093 - DNA, 22 bp, Homo sapiens
tagatgaattagcaattatctt

SEQ ID NO: 7790094 - DNA, 22 bp, Homo sapiens
tagatgaatgacttatatgtca

SEQ ID NO: 7790095 - DNA, 22 bp, Homo sapiens
tatcattttactgtgacatttt

SEQ ID NO: 7790096 - DNA, 22 bp, Homo sapiens
tatcatttagagtatttcttca

SEQ ID NO: 7790097 - DNA, 22 bp, Homo sapiens
tatcatttgttattattagtgg

SEQ ID NO: 7790098 - DNA, 22 bp, Homo sapiens
tatgaaaaggtggccaatgtag

SEQ ID NO: 7790099 - DNA, 22 bp, Homo sapiens
tatcttttgagttctcaagatg

SEQ ID NO: 7790100 - DNA, 22 bp, Homo sapiens
tatgaaatgatggggaaaatag

SEQ ID NO: 7790101 - DNA, 22 bp, Homo sapiens
tatgaaattgccatttttatgg

SEQ ID NO: 7790102 - DNA, 22 bp, Homo sapiens
tatttgaaggcatacattttga

SEQ ID NO: 7790103 - DNA, 22 bp, Homo sapiens
tatttaaaaagaggccagctgg

SEQ ID NO: 7790104 - DNA, 22 bp, Homo sapiens
tatttaaaataagccccagtgg

SEQ ID NO: 7790105 - DNA, 22 bp, Homo sapiens
tatttaaaatagtgctccagca

SEQ ID NO: 7790106 - DNA, 22 bp, Homo sapiens
tttttcatctgattgataactc

SEQ ID NO: 7790107 - DNA, 22 bp, Homo sapiens
tttttataactcttttgtgaca

SEQ ID NO: 7790108 - DNA, 22 bp, Homo sapiens
tttttagaattggctgagaatt

SEQ ID NO: 7790109 - DNA, 22 bp, Homo sapiens
ttttcttactgtctgtgatcct

SEQ ID NO: 7790110 - DNA, 22 bp, Homo sapiens
ttttcttatggtgaagcacaaa

SEQ ID NO: 7790111 - DNA, 22 bp, Homo sapiens
ttttcatttttgtagatgcaag

SEQ ID NO: 7790112 - DNA, 22 bp, Homo sapiens
ttttctgaagtttaagacattt

SEQ ID NO: 7790113 - DNA, 22 bp, Homo sapiens
ttttcattagaatgactgagaa

SEQ ID NO: 7790114 - DNA, 22 bp, Homo sapiens
tttgaaaaaggcctttggtatg

SEQ ID NO: 7790115 - DNA, 22 bp, Homo sapiens
tttcccttgaataaagatatct

SEQ ID NO: 7790116 - DNA, 22 bp, Homo sapiens
tttgaatatgtgcttgttaaat

SEQ ID NO: 7790117 - DNA, 22 bp, Homo sapiens
tttgaaagggaaataaactcct

SEQ ID NO: 7790118 - DNA, 22 bp, Homo sapiens
tttgaaaggaagttaatacttt

SEQ ID NO: 7790119 - DNA, 22 bp, Homo sapiens
tttgataacagtgaatatcatg

SEQ ID NO: 7790120 - DNA, 19 bp, Homo sapiens
tttgatatctgaattatgc

SEQ ID NO: 7790121 - DNA, 22 bp, Homo sapiens
tttgtaaaagcccaagctgtag

SEQ ID NO: 7790122 - DNA, 22 bp, Homo sapiens
tcctgctgccatttcaagtgct

SEQ ID NO: 7790123 - DNA, 22 bp, Homo sapiens
ttcacagatgagaaaattgagg

SEQ ID NO: 7790124 - DNA, 22 bp, Homo sapiens
ttcatacaatgggatattatga

SEQ ID NO: 7790125 - DNA, 22 bp, Homo sapiens
ttcataatcaccaaaaactgga

SEQ ID NO: 7790126 - DNA, 22 bp, Homo sapiens
ttcatttgttgacagagacatg

SEQ ID NO: 7790127 - DNA, 22 bp, Homo sapiens
ttccttcttccaaacccatcat

SEQ ID NO: 7790128 - DNA, 22 bp, Homo sapiens
ttccttcttccagaggctgccc

SEQ ID NO: 7790129 - DNA, 22 bp, Homo sapiens
ttccttcttcctttagtaacca

SEQ ID NO: 7790130 - DNA, 22 bp, Homo sapiens
ttccttcttgtaatgatctgcc

SEQ ID NO: 7790131 - DNA, 18 bp, Homo sapiens
ttccttctgatgtatatg

SEQ ID NO: 7790132 - DNA, 22 bp, Homo sapiens
ttccttctggaagcttcagggg

SEQ ID NO: 7790133 - DNA, 22 bp, Homo sapiens
ttccttcttcattgtgttacag

SEQ ID NO: 7790134 - DNA, 22 bp, Homo sapiens
ttccttctggagcccggggagc

SEQ ID NO: 7790135 - DNA, 22 bp, Homo sapiens
ttccttctggaggctccagggg

SEQ ID NO: 7790136 - DNA, 22 bp, Homo sapiens
ttccttctttgtggtagaaagt

SEQ ID NO: 7790137 - DNA, 22 bp, Homo sapiens
ttccttcttttacaccataaat

SEQ ID NO: 7790138 - DNA, 22 bp, Homo sapiens
ttctgtaattctgttagtttca

SEQ ID NO: 7790139 - DNA, 22 bp, Homo sapiens
ttctgtaagggatttattctga

SEQ ID NO: 7790140 - DNA, 22 bp, Homo sapiens
ttgaagaaagtcatatataatg

SEQ ID NO: 7790141 - DNA, 22 bp, Homo sapiens
ttgaacaatttggtatacaaac

SEQ ID NO: 7790142 - DNA, 22 bp, Homo sapiens
tttcatgaggtctttcagcaag

SEQ ID NO: 7790143 - DNA, 17 bp, Homo sapiens
tttagaatacaatgttt

SEQ ID NO: 7790144 - DNA, 22 bp, Homo sapiens
ttgtaaatgaccttttctaatt

SEQ ID NO: 7790145 - DNA, 22 bp, Homo sapiens
acatttcagcgtgcatgacatg

SEQ ID NO: 7790146 - DNA, 22 bp, Homo sapiens
aagtcctgccacctataagcct

SEQ ID NO: 7790147 - DNA, 22 bp, Homo sapiens
aaggatgaacattaatacatca

SEQ ID NO: 7790148 - DNA, 22 bp, Homo sapiens
agaaactgaattatttctgagg

SEQ ID NO: 7790149 - DNA, 22 bp, Homo sapiens
aatttcctgggataaaaagcca

SEQ ID NO: 7790150 - DNA, 22 bp, Homo sapiens
aatttgtatacatgttacattt

SEQ ID NO: 7790151 - DNA, 22 bp, Homo sapiens
aatttctgtatgaatagagaaa

SEQ ID NO: 7790152 - DNA, 22 bp, Homo sapiens
acaacattcttaaatacactga

SEQ ID NO: 7790153 - DNA, 22 bp, Homo sapiens
acagataattagcataaatgct

SEQ ID NO: 7790154 - DNA, 22 bp, Homo sapiens
agctaaatcacttattctttca

SEQ ID NO: 7790155 - DNA, 19 bp, Homo sapiens
acacaatgacacatatata

SEQ ID NO: 7790156 - DNA, 22 bp, Homo sapiens
acacataagaaactacaaagag

SEQ ID NO: 7790157 - DNA, 22 bp, Homo sapiens
aagtgaaacatgtatctcttta

SEQ ID NO: 7790158 - DNA, 22 bp, Homo sapiens
aatataattttattcctagagt

SEQ ID NO: 7790159 - DNA, 22 bp, Homo sapiens
acacagcaaggtctgactttgg

SEQ ID NO: 7790160 - DNA, 22 bp, Homo sapiens
acacagcaacttgcagtatgga

SEQ ID NO: 7790161 - DNA, 22 bp, Homo sapiens
aagaacatttatgatggcattt

SEQ ID NO: 7790162 - DNA, 22 bp, Homo sapiens
acagacattttaagacacttta

SEQ ID NO: 7790163 - DNA, 22 bp, Homo sapiens
aaaagcaggtactcagcttggg

SEQ ID NO: 7790164 - DNA, 22 bp, Homo sapiens
aaaagcattacatggtacgtat

SEQ ID NO: 7790165 - DNA, 22 bp, Homo sapiens
aaaagcagtttatagtcagttg

SEQ ID NO: 7790166 - DNA, 22 bp, Homo sapiens
aaaagcagagactctggagcta

SEQ ID NO: 7790167 - DNA, 22 bp, Homo sapiens
aaaagcagatctccaaagtcta

SEQ ID NO: 7790168 - DNA, 22 bp, Homo sapiens
aaaagcagaccacgctttgtgg

SEQ ID NO: 7790169 - DNA, 22 bp, Homo sapiens
aaaacactgcaaagctgattgg

SEQ ID NO: 7790170 - DNA, 22 bp, Homo sapiens
aaaacatgtccatacagaaact

SEQ ID NO: 7790171 - DNA, 22 bp, Homo sapiens
aaaacattttactgccatctca

SEQ ID NO: 7790172 - DNA, 22 bp, Homo sapiens
aaaacattgaattgcacactat

SEQ ID NO: 7790173 - DNA, 22 bp, Homo sapiens
aaaagttacctctgtaatataa

SEQ ID NO: 7790174 - DNA, 22 bp, Homo sapiens
aaaataacttctactatttgca

SEQ ID NO: 7790175 - DNA, 22 bp, Homo sapiens
aaaatactactgtcttcttccc

SEQ ID NO: 7790176 - DNA, 18 bp, Homo sapiens
aaagctatcatggaacac

SEQ ID NO: 7790177 - DNA, 22 bp, Homo sapiens
aaagctctgggaatgcttatct

SEQ ID NO: 7790178 - DNA, 22 bp, Homo sapiens
aaatgtgagactgagttttcct

SEQ ID NO: 7790179 - DNA, 22 bp, Homo sapiens
aaatgtgagttatagcaataga

SEQ ID NO: 7790180 - DNA, 22 bp, Homo sapiens
aaagacatcagaaccagctgag

SEQ ID NO: 7790181 - DNA, 22 bp, Homo sapiens
aaatacagagttgcttaaaagc

SEQ ID NO: 7790182 - DNA, 22 bp, Homo sapiens
aaatatagtgacacttatagtc

SEQ ID NO: 7790183 - DNA, 22 bp, Homo sapiens
aaatatagtaaatgcatagttc

SEQ ID NO: 7790184 - DNA, 22 bp, Homo sapiens
aaagcatattaggactgaatta

SEQ ID NO: 7790185 - DNA, 22 bp, Homo sapiens
aaagcatgactcaagaattact

SEQ ID NO: 7790186 - DNA, 22 bp, Homo sapiens
aaagcatgctactttatatagg

SEQ ID NO: 7790187 - DNA, 22 bp, Homo sapiens
aaagcatggcatgaagaacatg

SEQ ID NO: 7790188 - DNA, 22 bp, Homo sapiens
aaagcatggttaaagacagtgg

SEQ ID NO: 7790189 - DNA, 22 bp, Homo sapiens
aaagcatgtgaatagaatatgg

SEQ ID NO: 7790190 - DNA, 22 bp, Homo sapiens
aaagcattactagactggattt

SEQ ID NO: 7790191 - DNA, 22 bp, Homo sapiens
aaagcattattctgtggaaaaa

SEQ ID NO: 7790192 - DNA, 22 bp, Homo sapiens
aaagcattgtttcaagattaac

SEQ ID NO: 7790193 - DNA, 20 bp, Homo sapiens
aaagcatttacttgtgattg

SEQ ID NO: 7790194 - DNA, 22 bp, Homo sapiens
aaagcatttcatgtctagaaag

SEQ ID NO: 7790195 - DNA, 22 bp, Homo sapiens
aacatgaaacccaaacagaata

SEQ ID NO: 7790196 - DNA, 22 bp, Homo sapiens
aaagcagtctgttttaacctga

SEQ ID NO: 7790197 - DNA, 22 bp, Homo sapiens
aaagcagtctcagacttaagca

SEQ ID NO: 7790198 - DNA, 22 bp, Homo sapiens
atgttcaaactttttacacacc

SEQ ID NO: 7790199 - DNA, 22 bp, Homo sapiens
agacatagggaggcatataaat

SEQ ID NO: 7790200 - DNA, 22 bp, Homo sapiens
atgattcagggagttttcagga

SEQ ID NO: 7790201 - DNA, 22 bp, Homo sapiens
attgaaaataaggccagaaaca

SEQ ID NO: 7790202 - DNA, 22 bp, Homo sapiens
attgaaaaattcacaattctgg

SEQ ID NO: 7790203 - DNA, 22 bp, Homo sapiens
attgaaaatataattctaggag

SEQ ID NO: 7790204 - DNA, 22 bp, Homo sapiens
attgaaaatgacatttgtgccc

SEQ ID NO: 7790205 - DNA, 22 bp, Homo sapiens
attctctggaagaagataaaaa

SEQ ID NO: 7790206 - DNA, 22 bp, Homo sapiens
attttctgtgtgcagataaata

SEQ ID NO: 7790207 - DNA, 23 bp, Homo sapiens
atttgaaactttcttgtttccag

SEQ ID NO: 7790208 - DNA, 19 bp, Homo sapiens
atttgaaagctgtgcttgc

SEQ ID NO: 7790209 - DNA, 22 bp, Homo sapiens
atttgaaatcccttctactgta

SEQ ID NO: 7790210 - DNA, 22 bp, Homo sapiens
atttgaaatctgggttactctg

SEQ ID NO: 7790211 - DNA, 22 bp, Homo sapiens
attttttatataccaaggtggg

SEQ ID NO: 7790212 - DNA, 22 bp, Homo sapiens
cacagaaaggctcaaatcccaa

SEQ ID NO: 7790213 - DNA, 22 bp, Homo sapiens
agcatttatttcttagaaattg

SEQ ID NO: 7790214 - DNA, 22 bp, Homo sapiens
agcatttatagataccctatgg

SEQ ID NO: 7790215 - DNA, 22 bp, Homo sapiens
agcatttatgactaatgtaaaa

SEQ ID NO: 7790216 - DNA, 22 bp, Homo sapiens
agcatttagtctttattgcagc

SEQ ID NO: 7790217 - DNA, 22 bp, Homo sapiens
agcatttagttagtaaatgttt

SEQ ID NO: 7790218 - DNA, 22 bp, Homo sapiens
agtcctgtgcaaatgcatctga

SEQ ID NO: 7790219 - DNA, 22 bp, Homo sapiens
atatagaatacacagggaaagt

SEQ ID NO: 7790220 - DNA, 22 bp, Homo sapiens
atatagaaggtgctatttacat

SEQ ID NO: 7790221 - DNA, 22 bp, Homo sapiens
atcaattcttaggaaaatagct

SEQ ID NO: 7790222 - DNA, 22 bp, Homo sapiens
atagtgttgtatgtacagtctg

SEQ ID NO: 7790223 - DNA, 22 bp, Homo sapiens
ataaggcatctctcagttagca

SEQ ID NO: 7790224 - DNA, 19 bp, Homo sapiens
ataaggcaggaggaaattt

SEQ ID NO: 7790225 - DNA, 22 bp, Homo sapiens
ataaggcagaaatagggaaagt

SEQ ID NO: 7790226 - DNA, 22 bp, Homo sapiens
agttgaaagccttatttctctg

SEQ ID NO: 7790227 - DNA, 22 bp, Homo sapiens
cctccttctggggccttctgct

SEQ ID NO: 7790228 - DNA, 22 bp, Homo sapiens
catttctgattacagaatacta

SEQ ID NO: 7790229 - DNA, 22 bp, Homo sapiens
ctgaaatatagatgtgaacagt

SEQ ID NO: 7790230 - DNA, 22 bp, Homo sapiens
cctgggcttctgtctagatgtt

SEQ ID NO: 7790231 - DNA, 22 bp, Homo sapiens
cctgggcttgcatctgtgctgg

SEQ ID NO: 7790232 - DNA, 22 bp, Homo sapiens
agtatttagagacacaagatgg

SEQ ID NO: 7790233 - DNA, 22 bp, Homo sapiens
ctagaatactcgtattattccc

SEQ ID NO: 7790234 - DNA, 22 bp, Homo sapiens
agtaaaaagttcagaatggttg

SEQ ID NO: 7790235 - DNA, 22 bp, Homo sapiens
ataaatgtttgttgaatgaata

SEQ ID NO: 7790236 - DNA, 22 bp, Homo sapiens
atacaaatttatagatgcattt

SEQ ID NO: 7790237 - DNA, 22 bp, Homo sapiens
atctgaaatagtcttatctgag

SEQ ID NO: 7790238 - DNA, 22 bp, Homo sapiens
atctgaaactctgacattgtct

SEQ ID NO: 7790239 - DNA, 22 bp, Homo sapiens
atattcttgtgattataaagta

SEQ ID NO: 7790240 - DNA, 22 bp, Homo sapiens
atgacatatgattctgaagaca

SEQ ID NO: 7790241 - DNA, 22 bp, Homo sapiens
atgacataagtgaaaaacatca

SEQ ID NO: 7790242 - DNA, 22 bp, Homo sapiens
atgacataaagctatgctaggt

SEQ ID NO: 7790243 - DNA, 22 bp, Homo sapiens
gaaacatagttgagacactgct

SEQ ID NO: 7790244 - DNA, 22 bp, Homo sapiens
gaaacatgtctgacaatttacc

SEQ ID NO: 7790245 - DNA, 22 bp, Homo sapiens
gaaacatattaatccagtgaaa

SEQ ID NO: 7790246 - DNA, 22 bp, Homo sapiens
gaaacatacgatttaggagaaa

SEQ ID NO: 7790247 - DNA, 22 bp, Homo sapiens
ctttcttcatcaagtgccacgt

SEQ ID NO: 7790248 - DNA, 22 bp, Homo sapiens
atgaaacagtgtgtatagcaaa

SEQ ID NO: 7790249 - DNA, 22 bp, Homo sapiens
atgaaaatgtacatgtgtataa

SEQ ID NO: 7790250 - DNA, 22 bp, Homo sapiens
atgaaaatactgtggttgatag

SEQ ID NO: 7790251 - DNA, 19 bp, Homo sapiens
atgaaacacagtggcctgg

SEQ ID NO: 7790252 - DNA, 22 bp, Homo sapiens
gaacaatacaggctttattcct

SEQ ID NO: 7790253 - DNA, 22 bp, Homo sapiens
gaacaaattctcatcaacttgt

SEQ ID NO: 7790254 - DNA, 22 bp, Homo sapiens
gaataactccatgatatgcttt

SEQ ID NO: 7790255 - DNA, 22 bp, Homo sapiens
gaataactgctatctttctggc

SEQ ID NO: 7790256 - DNA, 22 bp, Homo sapiens
atgtgaatgcagttatctataa

SEQ ID NO: 7790257 - DNA, 22 bp, Homo sapiens
atgtagaagtgggcattataga

SEQ ID NO: 7790258 - DNA, 21 bp, Homo sapiens
atggtgagatactgggtgtgg

SEQ ID NO: 7790259 - DNA, 22 bp, Homo sapiens
attccttctttgagaataagca

SEQ ID NO: 7790260 - DNA, 22 bp, Homo sapiens
attcataagtaaatgattacct

SEQ ID NO: 7790261 - DNA, 22 bp, Homo sapiens
attcataacggcaaatgtcacc

SEQ ID NO: 7790262 - DNA, 22 bp, Homo sapiens
caaacatagtgaagcaatgaca

SEQ ID NO: 7790263 - DNA, 22 bp, Homo sapiens
caaacaatttgcatttccttag

SEQ ID NO: 7790264 - DNA, 22 bp, Homo sapiens
atttttgagctgtgaacatagc

SEQ ID NO: 7790265 - DNA, 22 bp, Homo sapiens
atttttcagcttcattgaggca

SEQ ID NO: 7790266 - DNA, 22 bp, Homo sapiens
cacagaatctgtgactccaaga

SEQ ID NO: 7790267 - DNA, 22 bp, Homo sapiens
caagcatttattataattatca

SEQ ID NO: 7790268 - DNA, 22 bp, Homo sapiens
cagaaataaagtggacagagta

SEQ ID NO: 7790269 - DNA, 22 bp, Homo sapiens
gtcataattccataacagatat

SEQ ID NO: 7790270 - DNA, 22 bp, Homo sapiens
gtctggaaggaggagatggagc

SEQ ID NO: 7790271 - DNA, 22 bp, Homo sapiens
gtctggaagaactagggatgtt

SEQ ID NO: 7790272 - DNA, 22 bp, Homo sapiens
gtctggaaatttaaggtatgag

SEQ ID NO: 7790273 - DNA, 23 bp, Homo sapiens
cagacctttctgtatcagttatc

SEQ ID NO: 7790274 - DNA, 21 bp, Homo sapiens
tcttccctcaggatgtcctgc

SEQ ID NO: 7790275 - DNA, 19 bp, Homo sapiens
tcttccctggctgtcagtc

SEQ ID NO: 7790276 - DNA, 19 bp, Homo sapiens
tgacatagcaagacaaaac

SEQ ID NO: 7790277 - DNA, 21 bp, Homo sapiens
tgacataatccatagtacaaa

SEQ ID NO: 7790278 - DNA, 22 bp, Homo sapiens
tgagaataactgatttaaatgc

SEQ ID NO: 7790279 - DNA, 22 bp, Homo sapiens
tgagaatagtaataatttctgg

SEQ ID NO: 7790280 - DNA, 22 bp, Homo sapiens
tggagcagggcatcactgtgcg

SEQ ID NO: 7790281 - DNA, 22 bp, Homo sapiens
cccttcctgggtgtcccggagt

SEQ ID NO: 7790282 - DNA, 22 bp, Homo sapiens
cccttcctcctcgcctgtcaga

SEQ ID NO: 7790283 - DNA, 22 bp, Homo sapiens
cctcttctaggtttcagcctgc

SEQ ID NO: 7790284 - DNA, 22 bp, Homo sapiens
cctcttccagctgttgcttcca

SEQ ID NO: 7790285 - DNA, 22 bp, Homo sapiens
tactttaaaaactgataattca

SEQ ID NO: 7790286 - DNA, 22 bp, Homo sapiens
tagggaaaagacttcactgttt

SEQ ID NO: 7790287 - DNA, 22 bp, Homo sapiens
catgaattttaagactgttttt

SEQ ID NO: 7790288 - DNA, 22 bp, Homo sapiens
catgaaaataacattgttgtga

SEQ ID NO: 7790289 - DNA, 22 bp, Homo sapiens
cataatcagatgtgtacataag

SEQ ID NO: 7790290 - DNA, 18 bp, Homo sapiens
cataattttctttcttta

SEQ ID NO: 7790291 - DNA, 22 bp, Homo sapiens
cataatttctgtatcagcacca

SEQ ID NO: 7790292 - DNA, 22 bp, Homo sapiens
cataatttgatatgcttgatgg

SEQ ID NO: 7790293 - DNA, 22 bp, Homo sapiens
cataattagtcatgttatgcat

SEQ ID NO: 7790294 - DNA, 22 bp, Homo sapiens
cataatttcccaagagattgaa

SEQ ID NO: 7790295 - DNA, 22 bp, Homo sapiens
tcaatctgttccattagaacat

SEQ ID NO: 7790296 - DNA, 22 bp, Homo sapiens
cataaaagccacctatttaaag

SEQ ID NO: 7790297 - DNA, 22 bp, Homo sapiens
cagttttctatggtagaagcat

SEQ ID NO: 7790298 - DNA, 22 bp, Homo sapiens
catttaaaggttgtgggtaaaa

SEQ ID NO: 7790299 - DNA, 22 bp, Homo sapiens
tccttcctgctctaacattcag

SEQ ID NO: 7790300 - DNA, 22 bp, Homo sapiens
tccttcctgcaggccaagtcct

SEQ ID NO: 7790301 - DNA, 22 bp, Homo sapiens
tcctggctcctgatctgtcact

SEQ ID NO: 7790302 - DNA, 22 bp, Homo sapiens
tcctggctccagcagctcttcc

SEQ ID NO: 7790303 - DNA, 22 bp, Homo sapiens
cctgggctgggcgtctcatggg

SEQ ID NO: 7790304 - DNA, 22 bp, Homo sapiens
ttagaaaaaacgtcttctagtg

SEQ ID NO: 7790305 - DNA, 22 bp, Homo sapiens
ccttcctttgcatcatttctag

SEQ ID NO: 7790306 - DNA, 22 bp, Homo sapiens
ccttccttttactgtctccgga

SEQ ID NO: 7790307 - DNA, 22 bp, Homo sapiens
ccttcctttcagggctatgcct

SEQ ID NO: 7790308 - DNA, 22 bp, Homo sapiens
ccttccttgagaagcaattcct

SEQ ID NO: 7790309 - DNA, 22 bp, Homo sapiens
ttagaaaatttgcttctttgga

SEQ ID NO: 7790310 - DNA, 22 bp, Homo sapiens
ccttcctcatccatttctcttg

SEQ ID NO: 7790311 - DNA, 17 bp, Homo sapiens
ccttcctcatctccttc

SEQ ID NO: 7790312 - DNA, 22 bp, Homo sapiens
ctagaaaaatactttattgtga

SEQ ID NO: 7790313 - DNA, 18 bp, Homo sapiens
tttccttgtatgaacata

SEQ ID NO: 7790314 - DNA, 22 bp, Homo sapiens
ttcttttaatttctgtctgcag

SEQ ID NO: 7790315 - DNA, 22 bp, Homo sapiens
tttaatatctcacacttccatg

SEQ ID NO: 7790316 - DNA, 22 bp, Homo sapiens
ctctttctcattgtcagcagaa

SEQ ID NO: 7790317 - DNA, 22 bp, Homo sapiens
tttcctttccaaaattctgcct

SEQ ID NO: 7790318 - DNA, 22 bp, Homo sapiens
ctctggaatgtttacatgccct

SEQ ID NO: 7790319 - DNA, 22 bp, Homo sapiens
ctctggaatgggtgtttctaac

SEQ ID NO: 7790320 - DNA, 22 bp, Homo sapiens
ctctggaagaatacacttagaa

SEQ ID NO: 7790321 - DNA, 20 bp, Homo sapiens
ctctggaagagtttaaatgg

SEQ ID NO: 7790322 - DNA, 22 bp, Homo sapiens
ctctggaagtgatggcaggtca

SEQ ID NO: 7790323 - DNA, 22 bp, Homo sapiens
ctctggaagatgacctgggtaa

SEQ ID NO: 7790324 - DNA, 22 bp, Homo sapiens
ctctggaaaaccactagcagga

SEQ ID NO: 7790325 - DNA, 22 bp, Homo sapiens
ctctggaaaattgtgtgggggt

SEQ ID NO: 7790326 - DNA, 22 bp, Homo sapiens
ctctggaaatggccatagtcat

SEQ ID NO: 7790327 - DNA, 22 bp, Homo sapiens
ttttcacttaaggaatttcatg

SEQ ID NO: 7790328 - DNA, 22 bp, Homo sapiens
ctgtgtatctctgtgggacaga

SEQ ID NO: 7790329 - DNA, 22 bp, Homo sapiens
cttcctgctcccctgccaattc

SEQ ID NO: 7790330 - DNA, 22 bp, Homo sapiens
cttcctgcccacttcctgctgg

SEQ ID NO: 7790331 - DNA, 22 bp, Homo sapiens
cttcctctgcctcccgtgctca

SEQ ID NO: 7790332 - DNA, 22 bp, Homo sapiens
cttccctttctggtgacttctc

SEQ ID NO: 7790333 - DNA, 22 bp, Homo sapiens
gagatggagtctttttctgtca

SEQ ID NO: 7790334 - DNA, 22 bp, Homo sapiens
gaagataattcctacttataac

SEQ ID NO: 7790335 - DNA, 22 bp, Homo sapiens
gaacatttggatttgtaaattt

SEQ ID NO: 7790336 - DNA, 22 bp, Homo sapiens
gtaaaacaagctttatggttcc

SEQ ID NO: 7790337 - DNA, 22 bp, Homo sapiens
gtaaaacatgttttaactagga

SEQ ID NO: 7790338 - DNA, 22 bp, Homo sapiens
ggagcagttgttgagcaagcca

SEQ ID NO: 7790339 - DNA, 22 bp, Homo sapiens
tcatataagtttaaaactatct

SEQ ID NO: 7790340 - DNA, 22 bp, Homo sapiens
tcatgcttttatgatatttact

SEQ ID NO: 7790341 - DNA, 20 bp, Homo sapiens
tatttctgggcaaccattta

SEQ ID NO: 7790342 - DNA, 22 bp, Homo sapiens
tcacagaaggagggaagctagt

SEQ ID NO: 7790343 - DNA, 22 bp, Homo sapiens
tcacagaagcttgaagattttc

SEQ ID NO: 7790344 - DNA, 22 bp, Homo sapiens
tcagaaaagaccacattattct

SEQ ID NO: 7790345 - DNA, 22 bp, Homo sapiens
gtttcataattcaatcaaatga

SEQ ID NO: 7790346 - DNA, 22 bp, Homo sapiens
gtttcatacagattattcatgg

SEQ ID NO: 7790347 - DNA, 22 bp, Homo sapiens
gtttcataggcatgtgacctat

SEQ ID NO: 7790348 - DNA, 22 bp, Homo sapiens
gtttcatataccaagcacttga

SEQ ID NO: 7790349 - DNA, 22 bp, Homo sapiens
gtttcatatgcagttaacagca

SEQ ID NO: 7790350 - DNA, 22 bp, Homo sapiens
gtttttatctaatagcagttat

SEQ ID NO: 7790351 - DNA, 22 bp, Homo sapiens
taaattatgtcacatgactctg

SEQ ID NO: 7790352 - DNA, 22 bp, Homo sapiens
taaattatgttccatgtccttt

SEQ ID NO: 7790353 - DNA, 22 bp, Homo sapiens
taaattatggctggcagagcag

SEQ ID NO: 7790354 - DNA, 22 bp, Homo sapiens
taactgattcctttttgaaaat

SEQ ID NO: 7790355 - DNA, 22 bp, Homo sapiens
taatgtttccagtctatgatgg

SEQ ID NO: 7790356 - DNA, 22 bp, Homo sapiens
taggaaaaagaggctggcaagg

SEQ ID NO: 7790357 - DNA, 22 bp, Homo sapiens
tagaaaagaattttatttgata

SEQ ID NO: 7790358 - DNA, 22 bp, Homo sapiens
tatacacacctccaaagcagga

SEQ ID NO: 7790359 - DNA, 22 bp, Homo sapiens
tatacacatcctccaaagatag

SEQ ID NO: 7790360 - DNA, 22 bp, Homo sapiens
tataaatgcacttttgaaatat

SEQ ID NO: 7790361 - DNA, 22 bp, Homo sapiens
tatgacattatgtattacatgt

SEQ ID NO: 7790362 - DNA, 22 bp, Homo sapiens
tatgagaaagtcgtatgtctcc

SEQ ID NO: 7790363 - DNA, 22 bp, Homo sapiens
tattccttggcaaaaaatatat

SEQ ID NO: 7790364 - DNA, 22 bp, Homo sapiens
tatttctcagcattttacatcc

SEQ ID NO: 7790365 - DNA, 19 bp, Homo sapiens
ttgaagaataaaaacacat

SEQ ID NO: 7790366 - DNA, 22 bp, Homo sapiens
ttctgagaaatgggttcacata

SEQ ID NO: 7790367 - DNA, 22 bp, Homo sapiens
ttcttgaaggggatataaatag

SEQ ID NO: 7790368 - DNA, 22 bp, Homo sapiens
ttcttgaatagggattgataaa

SEQ ID NO: 7790369 - DNA, 22 bp, Homo sapiens
ttctttaaaatagtgagaaaga

SEQ ID NO: 7790370 - DNA, 22 bp, Homo sapiens
ttagagtttttgtaagtacaat

SEQ ID NO: 7790371 - DNA, 22 bp, Homo sapiens
ttcatcattacagtcatgttat

SEQ ID NO: 7790372 - DNA, 22 bp, Homo sapiens
ttccttctcagccctcgaggat

SEQ ID NO: 7790373 - DNA, 22 bp, Homo sapiens
ttccttctattcagctccaaga

SEQ ID NO: 7790374 - DNA, 22 bp, Homo sapiens
ttccttctagcccaagtattgg

SEQ ID NO: 7790375 - DNA, 22 bp, Homo sapiens
ttccttctccagaacttctagg

SEQ ID NO: 7790376 - DNA, 22 bp, Homo sapiens
ttccttctctgtggggaaggca

SEQ ID NO: 7790377 - DNA, 22 bp, Homo sapiens
ttccttctgaagcctttgtgtt

SEQ ID NO: 7790378 - DNA, 22 bp, Homo sapiens
ttccttctagagcttgtttagg

SEQ ID NO: 7790379 - DNA, 22 bp, Homo sapiens
ttaaatattttcagcagggtca

SEQ ID NO: 7790380 - DNA, 17 bp, Homo sapiens
ttacacaggagagctct

SEQ ID NO: 7790381 - DNA, 22 bp, Homo sapiens
ttacacagatggttagtagagg

SEQ ID NO: 7790382 - DNA, 22 bp, Homo sapiens
ttacatattatccaaaactgct

SEQ ID NO: 7790383 - DNA, 22 bp, Homo sapiens
ttaccaaatcccgtgcacattc

SEQ ID NO: 7790384 - DNA, 22 bp, Homo sapiens
ttactacattgtaacacagtac

SEQ ID NO: 7790385 - DNA, 22 bp, Homo sapiens
tttttggaaggagatccacact

SEQ ID NO: 7790386 - DNA, 22 bp, Homo sapiens
tttttcatgagactagaagtca

SEQ ID NO: 7790387 - DNA, 22 bp, Homo sapiens
ttttgatatcatgatgaacaga

SEQ ID NO: 7790388 - DNA, 22 bp, Homo sapiens
ttttgaaagccaggtttgtatg

SEQ ID NO: 7790389 - DNA, 22 bp, Homo sapiens
ttttgaaagggtgatttggctt

SEQ ID NO: 7790390 - DNA, 22 bp, Homo sapiens
ttttcctttcatcaggacaaag

SEQ ID NO: 7790391 - DNA, 22 bp, Homo sapiens
ttttgaaagagtcctgctacag

SEQ ID NO: 7790392 - DNA, 22 bp, Homo sapiens
ttttataaagagagtcagttgg

SEQ ID NO: 7790393 - DNA, 22 bp, Homo sapiens
tttctgcatgcatttaattaaa

SEQ ID NO: 7790394 - DNA, 22 bp, Homo sapiens
tttctgcatttacaaaatgagg

SEQ ID NO: 7790395 - DNA, 22 bp, Homo sapiens
tttctgaaacatggtctttgta

SEQ ID NO: 7790396 - DNA, 22 bp, Homo sapiens
tttctgaagatacagctttgct

SEQ ID NO: 7790397 - DNA, 22 bp, Homo sapiens
tttctgtaggggatatctttga

SEQ ID NO: 7790398 - DNA, 22 bp, Homo sapiens
tttctgtagtgtggtatgtagg

SEQ ID NO: 7790399 - DNA, 22 bp, Homo sapiens
tttcttcagcaggtttgtgaga

SEQ ID NO: 7790400 - DNA, 22 bp, Homo sapiens
tttctttaaaggaactctgttt

SEQ ID NO: 7790401 - DNA, 22 bp, Homo sapiens
tttccttccatgttgggcaaaa

SEQ ID NO: 7790402 - DNA, 22 bp, Homo sapiens
tttccttccaggttcctaaggc

SEQ ID NO: 7790403 - DNA, 22 bp, Homo sapiens
tttccttccaaatgcccgggag

SEQ ID NO: 7790404 - DNA, 22 bp, Homo sapiens
tttccttcatcatctgagagct

SEQ ID NO: 7790405 - DNA, 22 bp, Homo sapiens
tttccttcctaaggtgaagcaa

SEQ ID NO: 7790406 - DNA, 22 bp, Homo sapiens
tttccttccctggatgagaagt

SEQ ID NO: 7790407 - DNA, 22 bp, Homo sapiens
tttccttccttgctagcctgag

SEQ ID NO: 7790408 - DNA, 22 bp, Homo sapiens
tttccttctcagggagcttcaa

SEQ ID NO: 7790409 - DNA, 22 bp, Homo sapiens
tttcattttggttatgccataa

SEQ ID NO: 7790410 - DNA, 22 bp, Homo sapiens
tttactttgtgtcaagtcaaga

SEQ ID NO: 7790411 - DNA, 22 bp, Homo sapiens
tttcaaactccagctcaccaat

SEQ ID NO: 7790412 - DNA, 22 bp, Homo sapiens
cagccccttcctggcatctgga

SEQ ID NO: 7790413 - DNA, 22 bp, Homo sapiens
cacagaggaaaggcagttggta

SEQ ID NO: 7790414 - DNA, 19 bp, Homo sapiens
ggagccgccgcccttcatt

SEQ ID NO: 7790415 - DNA, 22 bp, Homo sapiens
caaaatgtgagtcccacctcaa

SEQ ID NO: 7790416 - DNA, 22 bp, Homo sapiens
caaaatgttctggcacctttaa

SEQ ID NO: 7790417 - DNA, 22 bp, Homo sapiens
gccaggctggccagcaccttct

SEQ ID NO: 7790418 - DNA, 22 bp, Homo sapiens
gacgtgggtcgccatcgatatg

SEQ ID NO: 7790419 - DNA, 22 bp, Homo sapiens
ctttccagtaccaggaagcgga

SEQ ID NO: 7790420 - DNA, 22 bp, Homo sapiens
cttcctcccggcccatgctctg

SEQ ID NO: 7790421 - DNA, 22 bp, Homo sapiens
atccaggctgtctaatgggaga

SEQ ID NO: 7790422 - DNA, 22 bp, Homo sapiens
atccaggcttaatgggagccac

SEQ ID NO: 7790423 - DNA, 22 bp, Homo sapiens
ctgaggagccccctctcagcat

SEQ ID NO: 7790424 - DNA, 22 bp, Homo sapiens
ctggctcccatgagctctcacg

SEQ ID NO: 7790425 - DNA, 17 bp, Homo sapiens
cgggcatggagggcagg

SEQ ID NO: 7790426 - DNA, 22 bp, Homo sapiens
agtccagggctctctgtgggat

SEQ ID NO: 7790427 - DNA, 22 bp, Homo sapiens
aggcaggaaaatcgcttgaacc

SEQ ID NO: 7790428 - DNA, 22 bp, Homo sapiens
caggcccattctaggcttgcta

SEQ ID NO: 7790429 - DNA, 22 bp, Homo sapiens
aggaatagaccacttcactgag

SEQ ID NO: 7790430 - DNA, 22 bp, Homo sapiens
ccctgatctcagcttacccatc

SEQ ID NO: 7790431 - DNA, 21 bp, Homo sapiens
aggccctggaggtcagagaaa

SEQ ID NO: 7790432 - DNA, 22 bp, Homo sapiens
ccaggtgttctttgtccctgtt

SEQ ID NO: 7790433 - DNA, 22 bp, Homo sapiens
ccaggtgctagcaatcactgtc

SEQ ID NO: 7790434 - DNA, 22 bp, Homo sapiens
ccaggcctgtgcaaggagggag

SEQ ID NO: 7790435 - DNA, 22 bp, Homo sapiens
agtccaggcaagttgttgtgta

SEQ ID NO: 7790436 - DNA, 22 bp, Homo sapiens
agtccaggcattccagccattc

SEQ ID NO: 7790437 - DNA, 22 bp, Homo sapiens
agtccaggagttgggtgacatt

SEQ ID NO: 7790438 - DNA, 21 bp, Homo sapiens
aggaggccagtactgctgaac

SEQ ID NO: 7790439 - DNA, 22 bp, Homo sapiens
aggaggccctagagctctagag

SEQ ID NO: 7790440 - DNA, 22 bp, Homo sapiens
cactgcacttcagcctgggtga

SEQ ID NO: 7790441 - DNA, 22 bp, Homo sapiens
agcaggcccaagctggggggaa

SEQ ID NO: 7790442 - DNA, 21 bp, Homo sapiens
agcaggcccaatggagggggc

SEQ ID NO: 7790443 - DNA, 20 bp, Homo sapiens
agcaggccttggggagagga

SEQ ID NO: 7790444 - DNA, 22 bp, Homo sapiens
agcaggcctgccacctcggggt

SEQ ID NO: 7790445 - DNA, 22 bp, Homo sapiens
agcaggccactgcagctggagc

SEQ ID NO: 7790446 - DNA, 22 bp, Homo sapiens
cagcactgttcccagaccactg

SEQ ID NO: 7790447 - DNA, 22 bp, Homo sapiens
cagcactgtgataactgagcca

SEQ ID NO: 7790448 - DNA, 22 bp, Homo sapiens
cagcactgggaccactagaaca

SEQ ID NO: 7790449 - DNA, 22 bp, Homo sapiens
attctctggaagaagataaaaa

SEQ ID NO: 7790450 - DNA, 22 bp, Homo sapiens
attctctgctgcactgataaca

SEQ ID NO: 7790451 - DNA, 22 bp, Homo sapiens
attctctgggttccagtaaatg

SEQ ID NO: 7790452 - DNA, 22 bp, Homo sapiens
attctctgtgcagatttaagac

SEQ ID NO: 7790453 - DNA, 22 bp, Homo sapiens
attgaaaaattcacaattctgg

SEQ ID NO: 7790454 - DNA, 22 bp, Homo sapiens
attgaaagatatactgttctca

SEQ ID NO: 7790455 - DNA, 22 bp, Homo sapiens
agagccaggatgtcttctgggg

SEQ ID NO: 7790456 - DNA, 22 bp, Homo sapiens
agagccagcatttgacactggc

SEQ ID NO: 7790457 - DNA, 22 bp, Homo sapiens
agagattataacagtttggacc

SEQ ID NO: 7790458 - DNA, 18 bp, Homo sapiens
atgggaggggccaagaga

SEQ ID NO: 7790459 - DNA, 19 bp, Homo sapiens
aaagcagtgcatcctcttt

SEQ ID NO: 7790460 - DNA, 22 bp, Homo sapiens
aacttgaaaacctcatgaattg

SEQ ID NO: 7790461 - DNA, 22 bp, Homo sapiens
aaatggaactgggctactaggt

SEQ ID NO: 7790462 - DNA, 22 bp, Homo sapiens
aaagacacatgtctcttagatt

SEQ ID NO: 7790463 - DNA, 22 bp, Homo sapiens
aaagacacacagtgcttcagtt

SEQ ID NO: 7790464 - DNA, 22 bp, Homo sapiens
aaagtacacatttatcccttat

SEQ ID NO: 7790465 - DNA, 22 bp, Homo sapiens
aaaatgtatgatggaggtgcta

SEQ ID NO: 7790466 - DNA, 22 bp, Homo sapiens
aagccaggttccatggaggagc

SEQ ID NO: 7790467 - DNA, 22 bp, Homo sapiens
agcacagaatgaggtggaagtg

SEQ ID NO: 7790468 - DNA, 22 bp, Homo sapiens
agacattatggctttcactggg

SEQ ID NO: 7790469 - DNA, 22 bp, Homo sapiens
actgaaaatgaattagaaacag

SEQ ID NO: 7790470 - DNA, 22 bp, Homo sapiens
tacagaaattgccaccagctct

SEQ ID NO: 7790471 - DNA, 22 bp, Homo sapiens
taactaggattacaagcgtgcg

SEQ ID NO: 7790472 - DNA, 22 bp, Homo sapiens
gtttccagctttctgatgcttg

SEQ ID NO: 7790473 - DNA, 22 bp, Homo sapiens
gtttccagggctctcttcatga

SEQ ID NO: 7790474 - DNA, 22 bp, Homo sapiens
gtttccaggcccctccctagac

SEQ ID NO: 7790475 - DNA, 22 bp, Homo sapiens
gttcaggaagtctcagctggga

SEQ ID NO: 7790476 - DNA, 19 bp, Homo sapiens
tcacttctgttagcatgga

SEQ ID NO: 7790477 - DNA, 22 bp, Homo sapiens
tcaggaagggctcagtctgtgc

SEQ ID NO: 7790478 - DNA, 22 bp, Homo sapiens
tccagagctgggtctgtgctca

SEQ ID NO: 7790479 - DNA, 18 bp, Homo sapiens
tccagagcagtctttggc

SEQ ID NO: 7790480 - DNA, 18 bp, Homo sapiens
tccagagcagtctttggc

SEQ ID NO: 7790481 - DNA, 22 bp, Homo sapiens
tccagagcctgcgcactggctg

SEQ ID NO: 7790482 - DNA, 22 bp, Homo sapiens
tccaggcagggttaagggtcct

SEQ ID NO: 7790483 - DNA, 22 bp, Homo sapiens
tccaggcatcccccaggacaga

SEQ ID NO: 7790484 - DNA, 22 bp, Homo sapiens
tccaggctctaggctgctctcc

SEQ ID NO: 7790485 - DNA, 22 bp, Homo sapiens
tccaggccactgcagaggctct

SEQ ID NO: 7790486 - DNA, 19 bp, Homo sapiens
ggaccaggtcctgggcagc

SEQ ID NO: 7790487 - DNA, 22 bp, Homo sapiens
ggaccaggactggtggtatctc

SEQ ID NO: 7790488 - DNA, 22 bp, Homo sapiens
ggaccaggcaagctgaggcggg

SEQ ID NO: 7790489 - DNA, 22 bp, Homo sapiens
ggaagcagcctgaagccaaggg

SEQ ID NO: 7790490 - DNA, 22 bp, Homo sapiens
gctttattttgtgagggattac

SEQ ID NO: 7790491 - DNA, 22 bp, Homo sapiens
gctttccctgccctcagaagga

SEQ ID NO: 7790492 - DNA, 22 bp, Homo sapiens
gctgtggctgtacagagaccat

SEQ ID NO: 7790493 - DNA, 22 bp, Homo sapiens
gctgtggctgaagatgcaggga

SEQ ID NO: 7790494 - DNA, 22 bp, Homo sapiens
gctgtggctgaccaccaggggg

SEQ ID NO: 7790495 - DNA, 18 bp, Homo sapiens
gctttatttcttggggaa

SEQ ID NO: 7790496 - DNA, 20 bp, Homo sapiens
gcctgagctccgcctcctgt

SEQ ID NO: 7790497 - DNA, 19 bp, Homo sapiens
gcctgagccagccatgcaa

SEQ ID NO: 7790498 - DNA, 22 bp, Homo sapiens
gcctgagcagctatacacacag

SEQ ID NO: 7790499 - DNA, 22 bp, Homo sapiens
gcctctggtccctcatgctgtg

SEQ ID NO: 7790500 - DNA, 22 bp, Homo sapiens
gcctctggggtggagcccagca

SEQ ID NO: 7790501 - DNA, 17 bp, Homo sapiens
gctccctgaggacagct

SEQ ID NO: 7790502 - DNA, 21 bp, Homo sapiens
gctccctgctcagctcctggg

SEQ ID NO: 7790503 - DNA, 23 bp, Homo sapiens
gctccctgtccctgcacttaggc

SEQ ID NO: 7790504 - DNA, 22 bp, Homo sapiens
gctccctgctccttcaccgacc

SEQ ID NO: 7790505 - DNA, 22 bp, Homo sapiens
gctccctggcttttacagtgta

SEQ ID NO: 7790506 - DNA, 22 bp, Homo sapiens
gctccctgttctcagccatgat

SEQ ID NO: 7790507 - DNA, 23 bp, Homo sapiens
gctccctgtgctccaggagatgc

SEQ ID NO: 7790508 - DNA, 22 bp, Homo sapiens
gctgccctaatatcacatgtta

SEQ ID NO: 7790509 - DNA, 22 bp, Homo sapiens
gcctcctgaagtgctgggatta

SEQ ID NO: 7790510 - DNA, 22 bp, Homo sapiens
gcctcctgacttacactgagct

SEQ ID NO: 7790511 - DNA, 22 bp, Homo sapiens
gcctctgggctctgcccctggc

SEQ ID NO: 7790512 - DNA, 22 bp, Homo sapiens
gcctcctgagtagctgggattg

SEQ ID NO: 7790513 - DNA, 22 bp, Homo sapiens
gtgaaggactgaatgaaaatgt

SEQ ID NO: 7790514 - DNA, 22 bp, Homo sapiens
gtgaaggaccaatatgactcat

SEQ ID NO: 7790515 - DNA, 22 bp, Homo sapiens
ggtagggtgggccgaagctcaa

SEQ ID NO: 7790516 - DNA, 22 bp, Homo sapiens
ggtgtggggaggttctgcttct

SEQ ID NO: 7790517 - DNA, 22 bp, Homo sapiens
ggcatgggccgaggtgcctcct

SEQ ID NO: 7790518 - DNA, 20 bp, Homo sapiens
ggcatgggtggggctcccag

SEQ ID NO: 7790519 - DNA, 22 bp, Homo sapiens
ggccaggtgcggtggctcacac

SEQ ID NO: 7790520 - DNA, 22 bp, Homo sapiens
ggccaggtggctgtcctggcgt

SEQ ID NO: 7790521 - DNA, 22 bp, Homo sapiens
ggccaggtccagtggaaggccc

SEQ ID NO: 7790522 - DNA, 22 bp, Homo sapiens
ggccaggtaagagtgcagccgc

SEQ ID NO: 7790523 - DNA, 20 bp, Homo sapiens
ggcctgcagctcccagcaag

SEQ ID NO: 7790524 - DNA, 23 bp, Homo sapiens
ggagtgcaatggcgccatctcgg

SEQ ID NO: 7790525 - DNA, 22 bp, Homo sapiens
gggaccagaagaaggatggtga

SEQ ID NO: 7790526 - DNA, 22 bp, Homo sapiens
gggaccagaggctgtgcacaat

SEQ ID NO: 7790527 - DNA, 23 bp, Homo sapiens
gggaccagctagggctgtgacct

SEQ ID NO: 7790528 - DNA, 22 bp, Homo sapiens
ggcttgggagcaggcatgtgac

SEQ ID NO: 7790529 - DNA, 22 bp, Homo sapiens
ggctccagatgtcccctggcaa

SEQ ID NO: 7790530 - DNA, 22 bp, Homo sapiens
gaagccagattatcacaagcca

SEQ ID NO: 7790531 - DNA, 22 bp, Homo sapiens
gaagccaggggcctgacaggca

SEQ ID NO: 7790532 - DNA, 22 bp, Homo sapiens
gacccttggctgcagcatcaca

SEQ ID NO: 7790533 - DNA, 22 bp, Homo sapiens
gaccctgtttctacaaataatt

SEQ ID NO: 7790534 - DNA, 22 bp, Homo sapiens
gagatggaatctgtgtggaggg

SEQ ID NO: 7790535 - DNA, 22 bp, Homo sapiens
gagcagcttatgtcaagccaga

SEQ ID NO: 7790536 - DNA, 22 bp, Homo sapiens
gagcagctgcagtgcagaccct

SEQ ID NO: 7790537 - DNA, 22 bp, Homo sapiens
gagccaggtcgggccgcggcga

SEQ ID NO: 7790538 - DNA, 22 bp, Homo sapiens
gacctctgggtgatgcccaggc

SEQ ID NO: 7790539 - DNA, 22 bp, Homo sapiens
gagcttggacaagctctgaagg

SEQ ID NO: 7790540 - DNA, 22 bp, Homo sapiens
gagcttggcagtgtcactaggg

SEQ ID NO: 7790541 - DNA, 22 bp, Homo sapiens
cttccctttttatgtcttcagc

SEQ ID NO: 7790542 - DNA, 22 bp, Homo sapiens
ctggcaggcggcagagcccagg

SEQ ID NO: 7790543 - DNA, 22 bp, Homo sapiens
ctggcaggatctaaccagggaa

SEQ ID NO: 7790544 - DNA, 22 bp, Homo sapiens
tttgccctggtcccccgcaggc

SEQ ID NO: 7790545 - DNA, 20 bp, Homo sapiens
tttgcccttcctctgccttt

SEQ ID NO: 7790546 - DNA, 22 bp, Homo sapiens
tttgccctttctgagcctcatc

SEQ ID NO: 7790547 - DNA, 22 bp, Homo sapiens
ctctctgctgtatccttaggct

SEQ ID NO: 7790548 - DNA, 22 bp, Homo sapiens
tttccagagcatgtctgctcag

SEQ ID NO: 7790549 - DNA, 22 bp, Homo sapiens
cctttccccgcgggaggtgcca

SEQ ID NO: 7790550 - DNA, 22 bp, Homo sapiens
cctgtctgaatcatgatttcct

SEQ ID NO: 7790551 - DNA, 22 bp, Homo sapiens
tcctacactcaaggcatggagg

SEQ ID NO: 7790552 - DNA, 18 bp, Homo sapiens
tccctcctgcctgcttcc

SEQ ID NO: 7790553 - DNA, 20 bp, Homo sapiens
caggcctctgggggccctgg

SEQ ID NO: 7790554 - DNA, 22 bp, Homo sapiens
caggcctcgaggagacagctac

SEQ ID NO: 7790555 - DNA, 22 bp, Homo sapiens
caggcccagggagggagaccaa

SEQ ID NO: 7790556 - DNA, 22 bp, Homo sapiens
caggcctgagacatctgagata

SEQ ID NO: 7790557 - DNA, 22 bp, Homo sapiens
caggctgccctagcttggacat

SEQ ID NO: 7790558 - DNA, 22 bp, Homo sapiens
caggcttggttggggcgaggga

SEQ ID NO: 7790559 - DNA, 22 bp, Homo sapiens
tagattcctctacaataaatga

SEQ ID NO: 7790560 - DNA, 22 bp, Homo sapiens
caggcccacgaggcacacagag

SEQ ID NO: 7790561 - DNA, 22 bp, Homo sapiens
tggcttccagaactgagcaaca

SEQ ID NO: 7790562 - DNA, 22 bp, Homo sapiens
cccttcctcaaggagctgtgtt

SEQ ID NO: 7790563 - DNA, 22 bp, Homo sapiens
cccttcctcctcgcctgtcaga

SEQ ID NO: 7790564 - DNA, 22 bp, Homo sapiens
tgccacagaggtgaagcccact

SEQ ID NO: 7790565 - DNA, 21 bp, Homo sapiens
ccagggtccagctgccatggt

SEQ ID NO: 7790566 - DNA, 22 bp, Homo sapiens
ccaggtgtggccacatggctgg

SEQ ID NO: 7790567 - DNA, 22 bp, Homo sapiens
ccaggtgtggggaggactcaca

SEQ ID NO: 7790568 - DNA, 22 bp, Homo sapiens
ccaggtgtgatttggcagtgtc

SEQ ID NO: 7790569 - DNA, 22 bp, Homo sapiens
ccaggtgtgccagcagggactg

SEQ ID NO: 7790570 - DNA, 22 bp, Homo sapiens
ccaggtgtgctctgcagtggat

SEQ ID NO: 7790571 - DNA, 22 bp, Homo sapiens
ccaggtgtctgtggccagccct

SEQ ID NO: 7790572 - DNA, 22 bp, Homo sapiens
ccaggtgtaggacaccaaggga

SEQ ID NO: 7790573 - DNA, 22 bp, Homo sapiens
ccaggctggagtgcagtggcac

SEQ ID NO: 7790574 - DNA, 19 bp, Homo sapiens
tcttccctggctgtcagtc

SEQ ID NO: 7790575 - DNA, 22 bp, Homo sapiens
ccaggccagcgctggctggagg

SEQ ID NO: 7790576 - DNA, 22 bp, Homo sapiens
ccaggagtttgaggctgcagtg

SEQ ID NO: 7790577 - DNA, 22 bp, Homo sapiens
ccaggagttggaggctgcagtg

SEQ ID NO: 7790578 - DNA, 22 bp, Homo sapiens
ccaggagttggaagctgccatg

SEQ ID NO: 7790579 - DNA, 22 bp, Homo sapiens
ccaggctgaatatgttccaggg

SEQ ID NO: 7790580 - DNA, 22 bp, Homo sapiens
ccaggcctggccaggggatgcc

SEQ ID NO: 7790581 - DNA, 22 bp, Homo sapiens
ccaggccaggagagcgaggttt

SEQ ID NO: 7790582 - DNA, 22 bp, Homo sapiens
ccaggccccagggctggctttc

SEQ ID NO: 7790583 - DNA, 22 bp, Homo sapiens
tctggtcccttttcctgcagtc

SEQ ID NO: 7790584 - DNA, 22 bp, Homo sapiens
tctggcctactggagtccatga

SEQ ID NO: 7790585 - DNA, 22 bp, Homo sapiens
tctggcctcttgggatgctccc

SEQ ID NO: 7790586 - DNA, 22 bp, Homo sapiens
ccagctctctgcagaaaggact

SEQ ID NO: 7790587 - DNA, 22 bp, Homo sapiens
tttctagaatgactcatctgag

SEQ ID NO: 7790588 - DNA, 22 bp, Homo sapiens
tttctgacagagtgctcagagt

SEQ ID NO: 7790589 - DNA, 22 bp, Homo sapiens
tttctgtaaagaccaagccagc

SEQ ID NO: 7790590 - DNA, 22 bp, Homo sapiens
tgtggcagtataagagctagaa

SEQ ID NO: 7790591 - DNA, 22 bp, Homo sapiens
tgtggcagagagagcttccttg

SEQ ID NO: 7790592 - DNA, 22 bp, Homo sapiens
tgtggcagaactgggactcaaa

SEQ ID NO: 7790593 - DNA, 22 bp, Homo sapiens
tgtggcagaggaggcagcgtcc

SEQ ID NO: 7790594 - DNA, 22 bp, Homo sapiens
tgtggcagctgctgcaggagct

SEQ ID NO: 7790595 - DNA, 23 bp, Homo sapiens
tgttctcttgtccaggccttaac

SEQ ID NO: 7790596 - DNA, 17 bp, Homo sapiens
tgttctcttcagaaatc

SEQ ID NO: 7790597 - DNA, 22 bp, Homo sapiens
tgttctctaagccacccatttt

SEQ ID NO: 7790598 - DNA, 22 bp, Homo sapiens
ttccagactatcagcagcagga

SEQ ID NO: 7790599 - DNA, 22 bp, Homo sapiens
ttccagaccattccacgggaga

SEQ ID NO: 7790600 - DNA, 22 bp, Homo sapiens
ttcaggactaggggcttcaagg

SEQ ID NO: 7790601 - DNA, 22 bp, Homo sapiens
cagactgtggcttcttggaggg

SEQ ID NO: 7790602 - DNA, 22 bp, Homo sapiens
gggttcagactaaagctatgca

SEQ ID NO: 7790603 - DNA, 22 bp, Homo sapiens
cagagccagagacctgctgtgc

SEQ ID NO: 7790604 - DNA, 22 bp, Homo sapiens
cactatcttgtagggcatggca

SEQ ID NO: 7790605 - DNA, 22 bp, Homo sapiens
cactggtgtattagagctagaa

SEQ ID NO: 7790606 - DNA, 22 bp, Homo sapiens
cactgcactccagcctgggtca

SEQ ID NO: 7790607 - DNA, 22 bp, Homo sapiens
cactgcactccagcttgggtga

SEQ ID NO: 7790608 - DNA, 22 bp, Homo sapiens
cactgcactccagcctgggtga

SEQ ID NO: 7790609 - DNA, 22 bp, Homo sapiens
gctggggagcaagagtagtgag

SEQ ID NO: 7790610 - DNA, 20 bp, Homo sapiens
caagccctctttagcctgcc

SEQ ID NO: 7790611 - DNA, 22 bp, Homo sapiens
gctctggatccggctgggtctg

SEQ ID NO: 7790612 - DNA, 23 bp, Homo sapiens
gctctggagctgggcctggcagg

SEQ ID NO: 7790613 - DNA, 22 bp, Homo sapiens
gctctggactggggcctgagaa

SEQ ID NO: 7790614 - DNA, 22 bp, Homo sapiens
gctctggaccctggagtggctg

SEQ ID NO: 7790615 - DNA, 22 bp, Homo sapiens
gctctggaacctgccaggatgc

SEQ ID NO: 7790616 - DNA, 22 bp, Homo sapiens
gctctggaagcatctgagagga

SEQ ID NO: 7790617 - DNA, 22 bp, Homo sapiens
caattcccagctgccgggctgc

SEQ ID NO: 7790618 - DNA, 22 bp, Homo sapiens
cttctccctggcttctgcacac

SEQ ID NO: 7790619 - DNA, 22 bp, Homo sapiens
atctggagaaaccgccaaggga

SEQ ID NO: 7790620 - DNA, 22 bp, Homo sapiens
atgtggctgatcgcagagctct

SEQ ID NO: 7790621 - DNA, 22 bp, Homo sapiens
gaggtgtgatgcagagtggtgg

SEQ ID NO: 7790622 - DNA, 22 bp, Homo sapiens
atgggagggtggaaaggctctg

SEQ ID NO: 7790623 - DNA, 22 bp, Homo sapiens
attgcactccggcctgggtgac

SEQ ID NO: 7790624 - DNA, 22 bp, Homo sapiens
attgcactccagcctgggtgac

SEQ ID NO: 7790625 - DNA, 22 bp, Homo sapiens
gatgtggcataagagtgaacac

SEQ ID NO: 7790626 - DNA, 20 bp, Homo sapiens
caaagacatgctaggggtgg

SEQ ID NO: 7790627 - DNA, 22 bp, Homo sapiens
caaagacacgggaaacaacgtt

SEQ ID NO: 7790628 - DNA, 22 bp, Homo sapiens
ctgccctctagaggaggactga

SEQ ID NO: 7790629 - DNA, 20 bp, Homo sapiens
cctttattatttgtatgatg

SEQ ID NO: 7790630 - DNA, 22 bp, Homo sapiens
aggtgtggctggggcagaggcc

SEQ ID NO: 7790631 - DNA, 22 bp, Homo sapiens
aggtgtgctctgtgatggacta

SEQ ID NO: 7790632 - DNA, 22 bp, Homo sapiens
aggccagagttaaggagaacag

SEQ ID NO: 7790633 - DNA, 22 bp, Homo sapiens
aggccagagaggggaccagcct

SEQ ID NO: 7790634 - DNA, 21 bp, Homo sapiens
aggcttggatctagacaggcc

SEQ ID NO: 7790635 - DNA, 22 bp, Homo sapiens
cctgaggacatcagcatcacct

SEQ ID NO: 7790636 - DNA, 22 bp, Homo sapiens
aggaccagtgagtctggcaagt

SEQ ID NO: 7790637 - DNA, 22 bp, Homo sapiens
aggactaaagggagcctagact

SEQ ID NO: 7790638 - DNA, 22 bp, Homo sapiens
aggactaaggaacagctgattc

SEQ ID NO: 7790639 - DNA, 22 bp, Homo sapiens
caggctgcgtttgtgaaaggta

SEQ ID NO: 7790640 - DNA, 22 bp, Homo sapiens
cagctgagagacaatgagtcat

SEQ ID NO: 7790641 - DNA, 22 bp, Homo sapiens
cagctgagaaggtctgatcagg

SEQ ID NO: 7790642 - DNA, 19 bp, Homo sapiens
aggatggagcaggcggtga

SEQ ID NO: 7790643 - DNA, 22 bp, Homo sapiens
acatcagtaattaagtctcaag

SEQ ID NO: 7790644 - DNA, 22 bp, Homo sapiens
acatttctatcatcctgtaatg

SEQ ID NO: 7790645 - DNA, 20 bp, Homo sapiens
aggcttggcttggcaggaac

SEQ ID NO: 7790646 - DNA, 22 bp, Homo sapiens
accaggctggagtgcagtggcg

SEQ ID NO: 7790647 - DNA, 22 bp, Homo sapiens
actgcacttcagcctgggtgtc

SEQ ID NO: 7790648 - DNA, 22 bp, Homo sapiens
agagacagggttttgtcgtgtt

SEQ ID NO: 7790649 - DNA, 22 bp, Homo sapiens
agcctgagccccatccagctga

SEQ ID NO: 7790650 - DNA, 22 bp, Homo sapiens
agcctctggtcctccctcagct

SEQ ID NO: 7790651 - DNA, 22 bp, Homo sapiens
agcctctgggggagctgggagc

SEQ ID NO: 7790652 - DNA, 22 bp, Homo sapiens
agcctctgctggccctggcact

SEQ ID NO: 7790653 - DNA, 22 bp, Homo sapiens
agccagagagtgttggagatgt

SEQ ID NO: 7790654 - DNA, 22 bp, Homo sapiens
cagacatctgtacccagcctgt

SEQ ID NO: 7790655 - DNA, 22 bp, Homo sapiens
aagagaggggttgcatggaaat

SEQ ID NO: 7790656 - DNA, 22 bp, Homo sapiens
aagccaggaagagagccttcac

SEQ ID NO: 7790657 - DNA, 22 bp, Homo sapiens
aagccaggaccaaactcatcct

SEQ ID NO: 7790658 - DNA, 22 bp, Homo sapiens
aagccaggaatggagtcttcgc

SEQ ID NO: 7790659 - DNA, 22 bp, Homo sapiens
aagccaggcatgcttggacagt

SEQ ID NO: 7790660 - DNA, 22 bp, Homo sapiens
aagccaggagcgaggcctcggc

SEQ ID NO: 7790661 - DNA, 22 bp, Homo sapiens
aagcacaggatcttgaggagcg

SEQ ID NO: 7790662 - DNA, 22 bp, Homo sapiens
aaaagacaggtgtctgcggccc

SEQ ID NO: 7790663 - DNA, 22 bp, Homo sapiens
aaaagacatatgtgggcattct

SEQ ID NO: 7790664 - DNA, 22 bp, Homo sapiens
aaaagacatctatttcaggcag

SEQ ID NO: 7790665 - DNA, 22 bp, Homo sapiens
aaagccatcagtaaaatgattt

SEQ ID NO: 7790666 - DNA, 22 bp, Homo sapiens
aagcacagagatgggcacgcct

SEQ ID NO: 7790667 - DNA, 22 bp, Homo sapiens
aatccaggtggcggaggttgtg

SEQ ID NO: 7790668 - DNA, 22 bp, Homo sapiens
actgcgctccagcctgggtgac

SEQ ID NO: 7790669 - DNA, 22 bp, Homo sapiens
aagccagggtcaggggcctcct

SEQ ID NO: 7790670 - DNA, 22 bp, Homo sapiens
aagccagggatggaatgatagg

SEQ ID NO: 7790671 - DNA, 22 bp, Homo sapiens
aagccaggtgtttaggccagcg

SEQ ID NO: 7790672 - DNA, 22 bp, Homo sapiens
aagccaggtgtgcccaggatcc

SEQ ID NO: 7790673 - DNA, 22 bp, Homo sapiens
aagccaggtgttgtggtaagag

SEQ ID NO: 7790674 - DNA, 18 bp, Homo sapiens
aagccaggtcaagataag

SEQ ID NO: 7790675 - DNA, 22 bp, Homo sapiens
aattatctgtaaatggcaattt

SEQ ID NO: 7790676 - DNA, 18 bp, Homo sapiens
tatgaaagtccactctca

SEQ ID NO: 7790677 - DNA, 22 bp, Homo sapiens
tatggaaataattagacaagtg

SEQ ID NO: 7790678 - DNA, 22 bp, Homo sapiens
taaggaatagtgctatgaaaaa

SEQ ID NO: 7790679 - DNA, 22 bp, Homo sapiens
taaagacatggtgtaggtgaac

SEQ ID NO: 7790680 - DNA, 22 bp, Homo sapiens
taaagacatgcaaagtctaatt

SEQ ID NO: 7790681 - DNA, 22 bp, Homo sapiens
taaagacataggatcagggaga

SEQ ID NO: 7790682 - DNA, 20 bp, Homo sapiens
taaagacataagctactatc

SEQ ID NO: 7790683 - DNA, 23 bp, Homo sapiens
taaagacagccttcaggattctg

SEQ ID NO: 7790684 - DNA, 22 bp, Homo sapiens
taaagacagatggaccagccat

SEQ ID NO: 7790685 - DNA, 22 bp, Homo sapiens
taaaagacatataactgtagga

SEQ ID NO: 7790686 - DNA, 22 bp, Homo sapiens
taagagcagaggttgaataaat

SEQ ID NO: 7790687 - DNA, 23 bp, Homo sapiens
tccaggctgggacttcaactggc

SEQ ID NO: 7790688 - DNA, 22 bp, Homo sapiens
tcctcagagcatagcgctgtct

SEQ ID NO: 7790689 - DNA, 22 bp, Homo sapiens
tcctcagacttccctttgtgta

SEQ ID NO: 7790690 - DNA, 22 bp, Homo sapiens
gtagggctcagtaaatactttg

SEQ ID NO: 7790691 - DNA, 22 bp, Homo sapiens
gtcactgtatccaggttccagc

SEQ ID NO: 7790692 - DNA, 22 bp, Homo sapiens
gtcctggaatcctagaacagtg

SEQ ID NO: 7790693 - DNA, 22 bp, Homo sapiens
ggggccagagaggacccaggtg

SEQ ID NO: 7790694 - DNA, 22 bp, Homo sapiens
ggtggcagagacataggacata

SEQ ID NO: 7790695 - DNA, 22 bp, Homo sapiens
ggtccccagcagtggctgcttc

SEQ ID NO: 7790696 - DNA, 21 bp, Homo sapiens
ggcctctgccttgccccactc

SEQ ID NO: 7790697 - DNA, 22 bp, Homo sapiens
ggcctctgcctcatctgggcac

SEQ ID NO: 7790698 - DNA, 22 bp, Homo sapiens
ggcctctggcaggcaggccctc

SEQ ID NO: 7790699 - DNA, 22 bp, Homo sapiens
ggccagcagacctcagggactc

SEQ ID NO: 7790700 - DNA, 22 bp, Homo sapiens
ggccaccagtcctctggcaggg

SEQ ID NO: 7790701 - DNA, 21 bp, Homo sapiens
ggccacagttagggctcagga

SEQ ID NO: 7790702 - DNA, 22 bp, Homo sapiens
ggcccaggctggagtgcagtgg

SEQ ID NO: 7790703 - DNA, 22 bp, Homo sapiens
ggctggcagtgtgagagaggga

SEQ ID NO: 7790704 - DNA, 22 bp, Homo sapiens
gggctccaaggaggccagcctg

SEQ ID NO: 7790705 - DNA, 22 bp, Homo sapiens
gccagacactcccctgggcagg

SEQ ID NO: 7790706 - DNA, 22 bp, Homo sapiens
gcaggccagctgtgcagatggg

SEQ ID NO: 7790707 - DNA, 22 bp, Homo sapiens
gcaggccattcaggagatgtgc

SEQ ID NO: 7790708 - DNA, 19 bp, Homo sapiens
gcaggcccagtcgggctgg

SEQ ID NO: 7790709 - DNA, 18 bp, Homo sapiens
gcaggccctgtttctggg

SEQ ID NO: 7790710 - DNA, 20 bp, Homo sapiens
gcaggccctctctctagtct

SEQ ID NO: 7790711 - DNA, 22 bp, Homo sapiens
gcagctggggccacacttaggc

SEQ ID NO: 7790712 - DNA, 22 bp, Homo sapiens
gctctctgccatatgaggatac

SEQ ID NO: 7790713 - DNA, 22 bp, Homo sapiens
gctctctgggcgggagctaaga

SEQ ID NO: 7790714 - DNA, 22 bp, Homo sapiens
gctccctgaaaagaacaaagtc

SEQ ID NO: 7790715 - DNA, 22 bp, Homo sapiens
cttctgtagccagtaacatata

SEQ ID NO: 7790716 - DNA, 19 bp, Homo sapiens
cttcccctgttacctcact

SEQ ID NO: 7790717 - DNA, 22 bp, Homo sapiens
gaaagacatagttgcaagatgg

SEQ ID NO: 7790718 - DNA, 22 bp, Homo sapiens
ctgggtgttcaggagctgggct

SEQ ID NO: 7790719 - DNA, 23 bp, Homo sapiens
ctggtaaatcactaaaattacaa

SEQ ID NO: 7790720 - DNA, 21 bp, Homo sapiens
ctggtgtagcactcaggtgct

SEQ ID NO: 7790721 - DNA, 23 bp, Homo sapiens
ctgtggcaagtcctgcacctgcc

SEQ ID NO: 7790722 - DNA, 23 bp, Homo sapiens
gaggtgtgaattctgggtgctgc

SEQ ID NO: 7790723 - DNA, 22 bp, Homo sapiens
gaggtggctggctcagagccag

SEQ ID NO: 7790724 - DNA, 22 bp, Homo sapiens
gagcaggccagcaatggaaggg

SEQ ID NO: 7790725 - DNA, 22 bp, Homo sapiens
gaggccagaagtctgagatcag

SEQ ID NO: 7790726 - DNA, 22 bp, Homo sapiens
gaccttggagtgctgcatcaca

SEQ ID NO: 7790727 - DNA, 19 bp, Homo sapiens
gactatctctggagaccat

SEQ ID NO: 7790728 - DNA, 22 bp, Homo sapiens
ctcaggagacagtgtccacatg

SEQ ID NO: 7790729 - DNA, 22 bp, Homo sapiens
cgtgtggtcccggcaaggcaag

SEQ ID NO: 7790730 - DNA, 22 bp, Homo sapiens
ctcagaaaggtgccatttatgt

SEQ ID NO: 7790731 - DNA, 22 bp, Homo sapiens
ctcactcagtttttagttcatc

SEQ ID NO: 7790732 - DNA, 22 bp, Homo sapiens
tttccaagtactgagctgtcaa

SEQ ID NO: 7790733 - DNA, 22 bp, Homo sapiens
ctctgaaagttagagaaaatag

SEQ ID NO: 7790734 - DNA, 22 bp, Homo sapiens
ctctgcaccttgtaggaggcaa

SEQ ID NO: 7790735 - DNA, 22 bp, Homo sapiens
tgagaaaactcaaagacagatc

SEQ ID NO: 7790736 - DNA, 22 bp, Homo sapiens
ccagccctttgtggttcactga

SEQ ID NO: 7790737 - DNA, 22 bp, Homo sapiens
tctttatttaagtctgttgtaa

SEQ ID NO: 7790738 - DNA, 22 bp, Homo sapiens
tgaaagcagtgccatgattatg

SEQ ID NO: 7790739 - DNA, 22 bp, Homo sapiens
ccaggctcctcatgatcttgtt

SEQ ID NO: 7790740 - DNA, 22 bp, Homo sapiens
tgaaggaatgagggagtgggtc

SEQ ID NO: 7790741 - DNA, 17 bp, Homo sapiens
tgaaggaaggatgatgt

SEQ ID NO: 7790742 - DNA, 22 bp, Homo sapiens
tgaaggaaatgacggcagaaga

SEQ ID NO: 7790743 - DNA, 22 bp, Homo sapiens
tgaaggaagaataggcagtgtt

SEQ ID NO: 7790744 - DNA, 22 bp, Homo sapiens
tgtaaagacagataaaacagca

SEQ ID NO: 7790745 - DNA, 22 bp, Homo sapiens
cctgctgttttcttcacttcag

SEQ ID NO: 7790746 - DNA, 22 bp, Homo sapiens
tgtaaagacgcttatagcttgc

SEQ ID NO: 7790747 - DNA, 22 bp, Homo sapiens
cctggaggagcgctgaccagct

SEQ ID NO: 7790748 - DNA, 22 bp, Homo sapiens
cctccctgcgctcctgcggcgg

SEQ ID NO: 7790749 - DNA, 22 bp, Homo sapiens
ccctgtccttggctgtgaggct

SEQ ID NO: 7790750 - DNA, 22 bp, Homo sapiens
cctcagcccctgaatggagaga

SEQ ID NO: 7790751 - DNA, 22 bp, Homo sapiens
tctccagaggtcccttgtctct

SEQ ID NO: 7790752 - DNA, 22 bp, Homo sapiens
tcctttccagcctcacctcagc

SEQ ID NO: 7790753 - DNA, 22 bp, Homo sapiens
tctgaaggtttgattggagcta

SEQ ID NO: 7790754 - DNA, 22 bp, Homo sapiens
tctctgcccatcctcagtccac

SEQ ID NO: 7790755 - DNA, 22 bp, Homo sapiens
tccctagtcgcatctgtggaga

SEQ ID NO: 7790756 - DNA, 19 bp, Homo sapiens
tccagactgtccaggctat

SEQ ID NO: 7790757 - DNA, 22 bp, Homo sapiens
tccagactgttcacattggcat

SEQ ID NO: 7790758 - DNA, 22 bp, Homo sapiens
tccagactggggccatgtctgc

SEQ ID NO: 7790759 - DNA, 22 bp, Homo sapiens
tccagactgccctgcacatgtg

SEQ ID NO: 7790760 - DNA, 22 bp, Homo sapiens
tccagactctgtcacttcctag

SEQ ID NO: 7790761 - DNA, 23 bp, Homo sapiens
tccagactctaaagccctccaca

SEQ ID NO: 7790762 - DNA, 22 bp, Homo sapiens
tccagactcactcatgtgacta

SEQ ID NO: 7790763 - DNA, 22 bp, Homo sapiens
tccaggcccgagatgggctgga

SEQ ID NO: 7790764 - DNA, 20 bp, Homo sapiens
tccaggcagctcagagtgtc

SEQ ID NO: 7790765 - DNA, 22 bp, Homo sapiens
tagggtacatgtgcacaacatg

SEQ ID NO: 7790766 - DNA, 22 bp, Homo sapiens
taggtacatggaattggacatt

SEQ ID NO: 7790767 - DNA, 22 bp, Homo sapiens
tagagctggccgggacagctgg

SEQ ID NO: 7790768 - DNA, 22 bp, Homo sapiens
tcagactgcttagctcccagta

SEQ ID NO: 7790769 - DNA, 22 bp, Homo sapiens
tcagactgctgtccctgcctgg

SEQ ID NO: 7790770 - DNA, 22 bp, Homo sapiens
ttctgtgtgtctcagcaagctg

SEQ ID NO: 7790771 - DNA, 22 bp, Homo sapiens
ttcagacttcttgactggcttt

SEQ ID NO: 7790772 - DNA, 22 bp, Homo sapiens
ttagcttttctctatgttggct

SEQ ID NO: 7790773 - DNA, 22 bp, Homo sapiens
ttagcttttttgcagatgtcct

SEQ ID NO: 7790774 - DNA, 22 bp, Homo sapiens
ttattaatcttatctttggaaa

SEQ ID NO: 7790775 - DNA, 22 bp, Homo sapiens
ttattaatgagtacaagttatt

SEQ ID NO: 7790776 - DNA, 22 bp, Homo sapiens
tttccctacttgtaactggaaa

SEQ ID NO: 7790777 - DNA, 20 bp, Homo sapiens
ttttctgtgccaagaaaact

SEQ ID NO: 7790778 - DNA, 22 bp, Homo sapiens
ggtggcagtagcactgggcctg

SEQ ID NO: 7790779 - DNA, 22 bp, Homo sapiens
ggtggcagtcttaagagatctt

SEQ ID NO: 7790780 - DNA, 22 bp, Homo sapiens
ggcccagagctccctggcacct

SEQ ID NO: 7790781 - DNA, 22 bp, Homo sapiens
ggcaggactctcaggaccaagc

SEQ ID NO: 7790782 - DNA, 22 bp, Homo sapiens
ggatcaggcgccatgggaagtg

SEQ ID NO: 7790783 - DNA, 22 bp, Homo sapiens
ggagctggccgcctatgtgcag

SEQ ID NO: 7790784 - DNA, 22 bp, Homo sapiens
ggagagctgacatcatgatgtt

SEQ ID NO: 7790785 - DNA, 22 bp, Homo sapiens
gaaaatgtgcctttgggtattg

SEQ ID NO: 7790786 - DNA, 22 bp, Homo sapiens
gagcttgggtgccatgctgagc

SEQ ID NO: 7790787 - DNA, 22 bp, Homo sapiens
gcagggagggcctttcatgaca

SEQ ID NO: 7790788 - DNA, 22 bp, Homo sapiens
aggcaggccgtgtccctcctca

SEQ ID NO: 7790789 - DNA, 22 bp, Homo sapiens
aggcaggctagtcgcttgagcc

SEQ ID NO: 7790790 - DNA, 22 bp, Homo sapiens
caggctgtgggagtcaggaccc

SEQ ID NO: 7790791 - DNA, 22 bp, Homo sapiens
caggcttgctagaggagccaaa

SEQ ID NO: 7790792 - DNA, 22 bp, Homo sapiens
aggccagaaaaagacagctcca

SEQ ID NO: 7790793 - DNA, 22 bp, Homo sapiens
aggccaggcaacattctgaagt

SEQ ID NO: 7790794 - DNA, 22 bp, Homo sapiens
ccagactattgtgtgtcttggg

SEQ ID NO: 7790795 - DNA, 20 bp, Homo sapiens
ccagggctggctcctgggat

SEQ ID NO: 7790796 - DNA, 22 bp, Homo sapiens
ccaggctctgcgctggacatgg

SEQ ID NO: 7790797 - DNA, 22 bp, Homo sapiens
ccctcacttcacgctctgcaga

SEQ ID NO: 7790798 - DNA, 22 bp, Homo sapiens
agggtaggtgtaagatagccct

SEQ ID NO: 7790799 - DNA, 22 bp, Homo sapiens
agggtagggcccggagacagac

SEQ ID NO: 7790800 - DNA, 22 bp, Homo sapiens
ctggagtggccggtgctgtggc

SEQ ID NO: 7790801 - DNA, 22 bp, Homo sapiens
ctggcaggttatagagctgccc

SEQ ID NO: 7790802 - DNA, 22 bp, Homo sapiens
agttctctatgaagtctattgt

SEQ ID NO: 7790803 - DNA, 22 bp, Homo sapiens
agttctctttagctcatatggt

SEQ ID NO: 7790804 - DNA, 22 bp, Homo sapiens
agttctcttggaagttatgtga

SEQ ID NO: 7790805 - DNA, 22 bp, Homo sapiens
ataaagcatttcccctgtgtgg

SEQ ID NO: 7790806 - DNA, 22 bp, Homo sapiens
ctgtctccagggcaggtgcagg

SEQ ID NO: 7790807 - DNA, 22 bp, Homo sapiens
ctgtaacagatatcatttagca

SEQ ID NO: 7790808 - DNA, 22 bp, Homo sapiens
ctgtaaagacactaactatgga

SEQ ID NO: 7790809 - DNA, 22 bp, Homo sapiens
ctggtccctggacctccctgga

SEQ ID NO: 7790810 - DNA, 22 bp, Homo sapiens
ctggtcccagcagagctctgag

SEQ ID NO: 7790811 - DNA, 22 bp, Homo sapiens
cttctgcccctgtagcctgagt

SEQ ID NO: 7790812 - DNA, 22 bp, Homo sapiens
ccttccagccccatctcatcgt

SEQ ID NO: 7790813 - DNA, 22 bp, Homo sapiens
agtgtggccaatgaggatgggc

SEQ ID NO: 7790814 - DNA, 22 bp, Homo sapiens
actgcacttcagcctgggtgac

SEQ ID NO: 7790815 - DNA, 22 bp, Homo sapiens
actgcacttcaccctgggtgac

SEQ ID NO: 7790816 - DNA, 22 bp, Homo sapiens
actgcactccagcctgggtgat

SEQ ID NO: 7790817 - DNA, 22 bp, Homo sapiens
actgcactcctgcctgggtaac

SEQ ID NO: 7790818 - DNA, 22 bp, Homo sapiens
actagaaagcactaagctaggc

SEQ ID NO: 7790819 - DNA, 21 bp, Homo sapiens
agctggctctctctggagaga

SEQ ID NO: 7790820 - DNA, 22 bp, Homo sapiens
agctggctatgccctgtgaacc

SEQ ID NO: 7790821 - DNA, 22 bp, Homo sapiens
agctgggagcagagccacagcc

SEQ ID NO: 7790822 - DNA, 22 bp, Homo sapiens
accagctgaactgcagcccagg

SEQ ID NO: 7790823 - DNA, 22 bp, Homo sapiens
accaggaggcctggagcacaaa

SEQ ID NO: 7790824 - DNA, 22 bp, Homo sapiens
aggccacagcctgggaggtgac

SEQ ID NO: 7790825 - DNA, 19 bp, Homo sapiens
agctcctgattgtgcctcg

SEQ ID NO: 7790826 - DNA, 22 bp, Homo sapiens
cagagctctctttgctactaca

SEQ ID NO: 7790827 - DNA, 22 bp, Homo sapiens
agccagatgctattgctggaaa

SEQ ID NO: 7790828 - DNA, 20 bp, Homo sapiens
cagagacccaggcttcagct

SEQ ID NO: 7790829 - DNA, 22 bp, Homo sapiens
cactgtgtctggagtgagctgg

SEQ ID NO: 7790830 - DNA, 22 bp, Homo sapiens
agcagcccagataaagctcagg

SEQ ID NO: 7790831 - DNA, 22 bp, Homo sapiens
agacttctataaatttgggaat

SEQ ID NO: 7790832 - DNA, 22 bp, Homo sapiens
agacttctctaacttgaggacc

SEQ ID NO: 7790833 - DNA, 22 bp, Homo sapiens
agagagcatggcacagaggggt

SEQ ID NO: 7790834 - DNA, 22 bp, Homo sapiens
agagccctgtggactgtcaagt

SEQ ID NO: 7790835 - DNA, 22 bp, Homo sapiens
agagccctgtggttctggtaag

SEQ ID NO: 7790836 - DNA, 22 bp, Homo sapiens
agagcccttgccctcagtcacc

SEQ ID NO: 7790837 - DNA, 22 bp, Homo sapiens
agagccctgcagttcttcagga

SEQ ID NO: 7790838 - DNA, 22 bp, Homo sapiens
agacctggtttatcaccagcat

SEQ ID NO: 7790839 - DNA, 22 bp, Homo sapiens
agatgtgggcaaaaggcttagc

SEQ ID NO: 7790840 - DNA, 22 bp, Homo sapiens
attggtagttttgtatttctct

SEQ ID NO: 7790841 - DNA, 22 bp, Homo sapiens
aagatacatcattcaggagtga

SEQ ID NO: 7790842 - DNA, 22 bp, Homo sapiens
aaagcacagggtgctagagagt

SEQ ID NO: 7790843 - DNA, 22 bp, Homo sapiens
aagcactgagcacagtggctga

SEQ ID NO: 7790844 - DNA, 22 bp, Homo sapiens
agattaagaactcctggactgg

SEQ ID NO: 7790845 - DNA, 22 bp, Homo sapiens
agagcagctggctgcatctaga

SEQ ID NO: 7790846 - DNA, 22 bp, Homo sapiens
agccttaaatgctagattcata

SEQ ID NO: 7790847 - DNA, 21 bp, Homo sapiens
agaaaatggcgttttagattt

SEQ ID NO: 7790848 - DNA, 20 bp, Homo sapiens
agaaaatgttttcagctgga

SEQ ID NO: 7790849 - DNA, 22 bp, Homo sapiens
agaaaatgtgaacttgtgaatt

SEQ ID NO: 7790850 - DNA, 22 bp, Homo sapiens
acttccaggaggtgtcactgaa

SEQ ID NO: 7790851 - DNA, 22 bp, Homo sapiens
acttagctgtgtgatttccatt

SEQ ID NO: 7790852 - DNA, 22 bp, Homo sapiens
accagctgtgtgacctgaggca

SEQ ID NO: 7790853 - DNA, 22 bp, Homo sapiens
tcagaagataaagctttttgtt

SEQ ID NO: 7790854 - DNA, 22 bp, Homo sapiens
tcatctaagagtcttacattta

SEQ ID NO: 7790855 - DNA, 22 bp, Homo sapiens
tcaggctctgagctgatgctaa

SEQ ID NO: 7790856 - DNA, 22 bp, Homo sapiens
tcagggtaaaccttcactgtga

SEQ ID NO: 7790857 - DNA, 22 bp, Homo sapiens
tcagggtatgttctagatctga

SEQ ID NO: 7790858 - DNA, 22 bp, Homo sapiens
tcaggagcctgaaagaggtcta

SEQ ID NO: 7790859 - DNA, 22 bp, Homo sapiens
tcccagctactctagaggctga

SEQ ID NO: 7790860 - DNA, 22 bp, Homo sapiens
tccctgagcttctctgaaatgg

SEQ ID NO: 7790861 - DNA, 22 bp, Homo sapiens
tccctgatgccttgatccgtgg

SEQ ID NO: 7790862 - DNA, 22 bp, Homo sapiens
tccctgatgccaaagaagcatg

SEQ ID NO: 7790863 - DNA, 22 bp, Homo sapiens
tcctccctgtaccattcctctg

SEQ ID NO: 7790864 - DNA, 22 bp, Homo sapiens
tcctccctaaatcctagactgt

SEQ ID NO: 7790865 - DNA, 22 bp, Homo sapiens
tcctccagtgtctggggccttg

SEQ ID NO: 7790866 - DNA, 19 bp, Homo sapiens
tcctccctttggtgtcctg

SEQ ID NO: 7790867 - DNA, 22 bp, Homo sapiens
tcctccagcttctcttttgggg

SEQ ID NO: 7790868 - DNA, 22 bp, Homo sapiens
tcctccagaccacttctgtgcg

SEQ ID NO: 7790869 - DNA, 23 bp, Homo sapiens
tcctccagaggccctccttggcc

SEQ ID NO: 7790870 - DNA, 22 bp, Homo sapiens
tcctccagccctctaggaaaat

SEQ ID NO: 7790871 - DNA, 22 bp, Homo sapiens
tcctccagctactaggcaaata

SEQ ID NO: 7790872 - DNA, 20 bp, Homo sapiens
tcctccagaagggcagggtg

SEQ ID NO: 7790873 - DNA, 22 bp, Homo sapiens
taggacagagttccctgatggc

SEQ ID NO: 7790874 - DNA, 22 bp, Homo sapiens
tatcttctcagtatatgggatg

SEQ ID NO: 7790875 - DNA, 22 bp, Homo sapiens
tatcttcttgccaggctggtgt

SEQ ID NO: 7790876 - DNA, 22 bp, Homo sapiens
taaagacaatttcgagctgtag

SEQ ID NO: 7790877 - DNA, 22 bp, Homo sapiens
taaagacacccagggagggact

SEQ ID NO: 7790878 - DNA, 22 bp, Homo sapiens
taaagacactggttttaatcat

SEQ ID NO: 7790879 - DNA, 22 bp, Homo sapiens
taaagacaataggaaagttgtt

SEQ ID NO: 7790880 - DNA, 22 bp, Homo sapiens
taaagacaaatgacattacggc

SEQ ID NO: 7790881 - DNA, 22 bp, Homo sapiens
taaagacaaacccactagggtt

SEQ ID NO: 7790882 - DNA, 22 bp, Homo sapiens
gctgcaggagctggagctgtgg

SEQ ID NO: 7790883 - DNA, 22 bp, Homo sapiens
gcctcagggataggatgagcat

SEQ ID NO: 7790884 - DNA, 22 bp, Homo sapiens
gctggctctacatttgaggtca

SEQ ID NO: 7790885 - DNA, 22 bp, Homo sapiens
ggaccctgtaaagtcgtgtcca

SEQ ID NO: 7790886 - DNA, 22 bp, Homo sapiens
ggaccctgcgtgtatccacact

SEQ ID NO: 7790887 - DNA, 23 bp, Homo sapiens
ggactaggcaacagatgggacag

SEQ ID NO: 7790888 - DNA, 22 bp, Homo sapiens
gccctgaggggtggtgtctgta

SEQ ID NO: 7790889 - DNA, 22 bp, Homo sapiens
gccctgagactgaagaactgtc

SEQ ID NO: 7790890 - DNA, 22 bp, Homo sapiens
gccctgagaatgtgtgtgtcta

SEQ ID NO: 7790891 - DNA, 22 bp, Homo sapiens
gccctgagcctatgagcctctc

SEQ ID NO: 7790892 - DNA, 22 bp, Homo sapiens
gccctgagccaccaatgccatt

SEQ ID NO: 7790893 - DNA, 22 bp, Homo sapiens
gccctgagctagtgtgggcagg

SEQ ID NO: 7790894 - DNA, 22 bp, Homo sapiens
gccctgaggatttgcatttcct

SEQ ID NO: 7790895 - DNA, 22 bp, Homo sapiens
gccctctggggcacacagagga

SEQ ID NO: 7790896 - DNA, 22 bp, Homo sapiens
gcacttgaagaattgaactgga

SEQ ID NO: 7790897 - DNA, 22 bp, Homo sapiens
gcacttgacccccagagctggt

SEQ ID NO: 7790898 - DNA, 22 bp, Homo sapiens
gcacttgaggacgactcagctg

SEQ ID NO: 7790899 - DNA, 22 bp, Homo sapiens
gcacttgaaaagatcaggtgca

SEQ ID NO: 7790900 - DNA, 22 bp, Homo sapiens
gcacttgatcattgttacagat

SEQ ID NO: 7790901 - DNA, 22 bp, Homo sapiens
gcaagacctatctagttgctgt

SEQ ID NO: 7790902 - DNA, 22 bp, Homo sapiens
ggtcaggatccaagtctgtgct

SEQ ID NO: 7790903 - DNA, 22 bp, Homo sapiens
ggagatggtggaagctggtgca

SEQ ID NO: 7790904 - DNA, 22 bp, Homo sapiens
ggcatgagtggcagtgggcagt

SEQ ID NO: 7790905 - DNA, 22 bp, Homo sapiens
gggaggttgaggctgcagtgag

SEQ ID NO: 7790906 - DNA, 22 bp, Homo sapiens
gggaagtgccctcttcaggaga

SEQ ID NO: 7790907 - DNA, 22 bp, Homo sapiens
gaaaatgtttgtccggagctga

SEQ ID NO: 7790908 - DNA, 22 bp, Homo sapiens
ctgtagctgacaggatcactta

SEQ ID NO: 7790909 - DNA, 22 bp, Homo sapiens
ctggggactcattcagagcata

SEQ ID NO: 7790910 - DNA, 23 bp, Homo sapiens
gagaccagggccagctgtgtcat

SEQ ID NO: 7790911 - DNA, 22 bp, Homo sapiens
gagcatggatagaaggtgggat

SEQ ID NO: 7790912 - DNA, 22 bp, Homo sapiens
gagcatggcagctgagggcagg

SEQ ID NO: 7790913 - DNA, 18 bp, Homo sapiens
gagcatgggcagtgggga

SEQ ID NO: 7790914 - DNA, 23 bp, Homo sapiens
ctccctgaacatgacacaccaga

SEQ ID NO: 7790915 - DNA, 22 bp, Homo sapiens
ctccctgacctggattccaggc

SEQ ID NO: 7790916 - DNA, 22 bp, Homo sapiens
ctccctgaaattcagatgcctc

SEQ ID NO: 7790917 - DNA, 22 bp, Homo sapiens
ctcctgcttcacgggcaccgcc

SEQ ID NO: 7790918 - DNA, 22 bp, Homo sapiens
ctgaaagcaaagtaattcttaa

SEQ ID NO: 7790919 - DNA, 22 bp, Homo sapiens
ttctctttttgcatctcaacct

SEQ ID NO: 7790920 - DNA, 22 bp, Homo sapiens
ctcagaaaacctctttcttgat

SEQ ID NO: 7790921 - DNA, 22 bp, Homo sapiens
ttgcactccagcccgagcaaca

SEQ ID NO: 7790922 - DNA, 22 bp, Homo sapiens
ctcaggagttggaggctacagt

SEQ ID NO: 7790923 - DNA, 23 bp, Homo sapiens
cgtcttgtcctcgggcgcctggg

SEQ ID NO: 7790924 - DNA, 22 bp, Homo sapiens
cctgtaaatagtttcttctgac

SEQ ID NO: 7790925 - DNA, 22 bp, Homo sapiens
tggaggacaggactggacagcc

SEQ ID NO: 7790926 - DNA, 18 bp, Homo sapiens
tgcttggagcatttacca

SEQ ID NO: 7790927 - DNA, 22 bp, Homo sapiens
tgctcaggccagccggacagag

SEQ ID NO: 7790928 - DNA, 19 bp, Homo sapiens
tgctcaggccaaggagccc

SEQ ID NO: 7790929 - DNA, 20 bp, Homo sapiens
tgctcaggatggagaggtgt

SEQ ID NO: 7790930 - DNA, 19 bp, Homo sapiens
cccagtctaggtcctagga

SEQ ID NO: 7790931 - DNA, 22 bp, Homo sapiens
cctgagtgaattccctcactgt

SEQ ID NO: 7790932 - DNA, 22 bp, Homo sapiens
tggcagtggtgtctgcacaggc

SEQ ID NO: 7790933 - DNA, 22 bp, Homo sapiens
ccaggcctcctgtgagtggacc

SEQ ID NO: 7790934 - DNA, 19 bp, Homo sapiens
ccaggcctctggggcctgt

SEQ ID NO: 7790935 - DNA, 22 bp, Homo sapiens
tgcactccaggctgggtgacag

SEQ ID NO: 7790936 - DNA, 22 bp, Homo sapiens
ccagggctgctgtgggactcca

SEQ ID NO: 7790937 - DNA, 22 bp, Homo sapiens
cattttcagcacccatctgaaa

SEQ ID NO: 7790938 - DNA, 17 bp, Homo sapiens
ccagatgtgtaggtcgt

SEQ ID NO: 7790939 - DNA, 22 bp, Homo sapiens
tagacatttggcatggttttca

SEQ ID NO: 7790940 - DNA, 22 bp, Homo sapiens
tagacattggccattcctgtgg

SEQ ID NO: 7790941 - DNA, 22 bp, Homo sapiens
cagggcataagatgaggctgta

SEQ ID NO: 7790942 - DNA, 22 bp, Homo sapiens
caggccctcgtggtgagctggg

SEQ ID NO: 7790943 - DNA, 22 bp, Homo sapiens
caggccctcgtggtgagctggg

SEQ ID NO: 7790944 - DNA, 22 bp, Homo sapiens
tttccagagggtgctcagggcg

SEQ ID NO: 7790945 - DNA, 22 bp, Homo sapiens
tttccagagctgagaaggcttg

SEQ ID NO: 7790946 - DNA, 22 bp, Homo sapiens
ttgccacagtagcaaaaggttc

SEQ ID NO: 7790947 - DNA, 22 bp, Homo sapiens
ttgtgctcctgtgagaatctag

SEQ ID NO: 7790948 - DNA, 22 bp, Homo sapiens
ttgtgctcctatgagaatctaa

SEQ ID NO: 7790949 - DNA, 22 bp, Homo sapiens
ttgtgctctgtgttatttaagg

SEQ ID NO: 7790950 - DNA, 22 bp, Homo sapiens
ttctccctggtatttacttagt

SEQ ID NO: 7790951 - DNA, 22 bp, Homo sapiens
ttcttctgagagaaaaagctca

SEQ ID NO: 7790952 - DNA, 22 bp, Homo sapiens
ttcttctgaaacataatcaata

SEQ ID NO: 7790953 - DNA, 23 bp, Homo sapiens
ttttccagaatcgactctgtaga

SEQ ID NO: 7790954 - DNA, 22 bp, Homo sapiens
tttctagagtgggcatgtctta

SEQ ID NO: 7790955 - DNA, 22 bp, Homo sapiens
cttggcctgtggctcaagaatt

SEQ ID NO: 7790956 - DNA, 22 bp, Homo sapiens
gagccaggaggcagagactgca

SEQ ID NO: 7790957 - DNA, 19 bp, Homo sapiens
gccaggcctggacctgcag

SEQ ID NO: 7790958 - DNA, 22 bp, Homo sapiens
gatgaggcgagcacgttgtttg

SEQ ID NO: 7790959 - DNA, 22 bp, Homo sapiens
gatgaggcaggagtttgcttgt

SEQ ID NO: 7790960 - DNA, 22 bp, Homo sapiens
attattcttatgtcatcatggc

SEQ ID NO: 7790961 - DNA, 22 bp, Homo sapiens
attattctctggaggaaagatt

SEQ ID NO: 7790962 - DNA, 22 bp, Homo sapiens
attgcacttcagcctgggtgac

SEQ ID NO: 7790963 - DNA, 22 bp, Homo sapiens
ggaaaatgggaacctgaagcca

SEQ ID NO: 7790964 - DNA, 22 bp, Homo sapiens
gcttgggaaactggggaaacca

SEQ ID NO: 7790965 - DNA, 19 bp, Homo sapiens
gcttgggagagggagctaa

SEQ ID NO: 7790966 - DNA, 22 bp, Homo sapiens
ctcagacttgctttttatggaa

SEQ ID NO: 7790967 - DNA, 18 bp, Homo sapiens
ctcagacatgcttctttt

SEQ ID NO: 7790968 - DNA, 22 bp, Homo sapiens
ctcagaagctctgctcctttgc

SEQ ID NO: 7790969 - DNA, 22 bp, Homo sapiens
ctctggacagcaggtgctgtgg

SEQ ID NO: 7790970 - DNA, 22 bp, Homo sapiens
cctgccctatgaccagcttcac

SEQ ID NO: 7790971 - DNA, 22 bp, Homo sapiens
cctgccctagagatgacacaat

SEQ ID NO: 7790972 - DNA, 22 bp, Homo sapiens
cctgccctaatccagagactag

SEQ ID NO: 7790973 - DNA, 22 bp, Homo sapiens
cggaggttgaggctgcagtgag

SEQ ID NO: 7790974 - DNA, 22 bp, Homo sapiens
cctttattcaattagtcctaat

SEQ ID NO: 7790975 - DNA, 22 bp, Homo sapiens
aggtggcagttgtggaaccatc

SEQ ID NO: 7790976 - DNA, 22 bp, Homo sapiens
ccttggaggactgctgcttctt

SEQ ID NO: 7790977 - DNA, 22 bp, Homo sapiens
ctggagtgcaatgaacaaggtc

SEQ ID NO: 7790978 - DNA, 22 bp, Homo sapiens
ctggagtgcagtggcatgatca

SEQ ID NO: 7790979 - DNA, 22 bp, Homo sapiens
ctggagtgcaacctctgcctcc

SEQ ID NO: 7790980 - DNA, 22 bp, Homo sapiens
ctggagtgatactcagaatgtg

SEQ ID NO: 7790981 - DNA, 22 bp, Homo sapiens
caggcctcccggtgcacactga

SEQ ID NO: 7790982 - DNA, 22 bp, Homo sapiens
agctctgactgaagagatgcaa

SEQ ID NO: 7790983 - DNA, 22 bp, Homo sapiens
caggagtccatctggcctggtg

SEQ ID NO: 7790984 - DNA, 22 bp, Homo sapiens
caggagtccctctggccagcat

SEQ ID NO: 7790985 - DNA, 22 bp, Homo sapiens
agctgctcttgggtgacttcaa

SEQ ID NO: 7790986 - DNA, 22 bp, Homo sapiens
caggacagagcccagactgtgt

SEQ ID NO: 7790987 - DNA, 22 bp, Homo sapiens
caggacagaccaagatcgtgct

SEQ ID NO: 7790988 - DNA, 22 bp, Homo sapiens
aggcacaggcctcagcacccag

SEQ ID NO: 7790989 - DNA, 22 bp, Homo sapiens
ccaggccctgcctgtggttcct

SEQ ID NO: 7790990 - DNA, 22 bp, Homo sapiens
ccaggcctagcccctgagggta

SEQ ID NO: 7790991 - DNA, 21 bp, Homo sapiens
ccaggcatgactgcagagagc

SEQ ID NO: 7790992 - DNA, 22 bp, Homo sapiens
ccaggcatggggagagccagat

SEQ ID NO: 7790993 - DNA, 22 bp, Homo sapiens
ccaggcattgtgagtgggcagg

SEQ ID NO: 7790994 - DNA, 22 bp, Homo sapiens
aggccagctgttactagagcca

SEQ ID NO: 7790995 - DNA, 22 bp, Homo sapiens
cccttagccaggaaatcgacct

SEQ ID NO: 7790996 - DNA, 22 bp, Homo sapiens
agccaggtctaaggacatcagg

SEQ ID NO: 7790997 - DNA, 22 bp, Homo sapiens
agccaggtactcttgtgaccat

SEQ ID NO: 7790998 - DNA, 22 bp, Homo sapiens
agccaggtgcagtggcacacac

SEQ ID NO: 7790999 - DNA, 22 bp, Homo sapiens
agcacagattctgaagagtcct

SEQ ID NO: 7791000 - DNA, 22 bp, Homo sapiens
agcacagatgtgagtggaggct

SEQ ID NO: 7791001 - DNA, 22 bp, Homo sapiens
atgggaggcagcagagcccagc

SEQ ID NO: 7791002 - DNA, 22 bp, Homo sapiens
atggaaagccagtgttccatca

SEQ ID NO: 7791003 - DNA, 22 bp, Homo sapiens
agatgtgcctccaaggggtgca

SEQ ID NO: 7791004 - DNA, 22 bp, Homo sapiens
aggccttaccatagctgtagca

SEQ ID NO: 7791005 - DNA, 22 bp, Homo sapiens
aggcaggctggtctgaagagtg

SEQ ID NO: 7791006 - DNA, 22 bp, Homo sapiens
accaggagttttgaccaggggc

SEQ ID NO: 7791007 - DNA, 22 bp, Homo sapiens
accaggcctagcaagtacatta

SEQ ID NO: 7791008 - DNA, 22 bp, Homo sapiens
agggcctggttctgtgtaggga

SEQ ID NO: 7791009 - DNA, 22 bp, Homo sapiens
aggcaggcaagttcatatgagg

SEQ ID NO: 7791010 - DNA, 22 bp, Homo sapiens
aggtacataatgatggtgatga

SEQ ID NO: 7791011 - DNA, 22 bp, Homo sapiens
aggtacatggggtgtgtgcacg

SEQ ID NO: 7791012 - DNA, 22 bp, Homo sapiens
actgaaagataaatcagttagc

SEQ ID NO: 7791013 - DNA, 22 bp, Homo sapiens
actgatgtgacagctgagcaga

SEQ ID NO: 7791014 - DNA, 22 bp, Homo sapiens
agtttccaaagcatgttcacac

SEQ ID NO: 7791015 - DNA, 22 bp, Homo sapiens
actgtgaaagctaacatcttag

SEQ ID NO: 7791016 - DNA, 22 bp, Homo sapiens
actgtctttgagctggaggagg

SEQ ID NO: 7791017 - DNA, 22 bp, Homo sapiens
actgtcttccaggtctggaggt

SEQ ID NO: 7791018 - DNA, 22 bp, Homo sapiens
actgtcttgctatgagctccca

SEQ ID NO: 7791019 - DNA, 22 bp, Homo sapiens
actgtaaagttacgatcaagtt

SEQ ID NO: 7791020 - DNA, 22 bp, Homo sapiens
actgtaaagcttttctcatgcg

SEQ ID NO: 7791021 - DNA, 22 bp, Homo sapiens
actgtaaaatacataagtattg

SEQ ID NO: 7791022 - DNA, 22 bp, Homo sapiens
actgtaaaatgagatatgtata

SEQ ID NO: 7791023 - DNA, 18 bp, Homo sapiens
actgtgtgaattagctcc

SEQ ID NO: 7791024 - DNA, 22 bp, Homo sapiens
atatcttctttattttgtgagg

SEQ ID NO: 7791025 - DNA, 22 bp, Homo sapiens
aaagccattgaactgtacttta

SEQ ID NO: 7791026 - DNA, 22 bp, Homo sapiens
aactgtaagacaaatgacttct

SEQ ID NO: 7791027 - DNA, 22 bp, Homo sapiens
aagagcaggctgctgtggagta

SEQ ID NO: 7791028 - DNA, 22 bp, Homo sapiens
aagaaaacaatgacttgccagc

SEQ ID NO: 7791029 - DNA, 22 bp, Homo sapiens
acgtggagagaatagggcacca

SEQ ID NO: 7791030 - DNA, 22 bp, Homo sapiens
actctccacccactcactctgt

SEQ ID NO: 7791031 - DNA, 22 bp, Homo sapiens
actgcgtggggagctgtgacta

SEQ ID NO: 7791032 - DNA, 22 bp, Homo sapiens
actgcactccagcctgggtgac

SEQ ID NO: 7791033 - DNA, 22 bp, Homo sapiens
actctggagatggatgtcagga

SEQ ID NO: 7791034 - DNA, 22 bp, Homo sapiens
actgcactccaacctgggtgac

SEQ ID NO: 7791035 - DNA, 22 bp, Homo sapiens
actgcactccagcctcggggtc

SEQ ID NO: 7791036 - DNA, 22 bp, Homo sapiens
actgcactccagcctgggtaac

SEQ ID NO: 7791037 - DNA, 21 bp, Homo sapiens
accaggcttgtgggagggagc

SEQ ID NO: 7791038 - DNA, 22 bp, Homo sapiens
agagccagttacaactgtggag

SEQ ID NO: 7791039 - DNA, 22 bp, Homo sapiens
agagccaggctctacctgggtt

SEQ ID NO: 7791040 - DNA, 22 bp, Homo sapiens
agagccaggtgtagtctcggag

SEQ ID NO: 7791041 - DNA, 22 bp, Homo sapiens
agagccaggctcccatggggca

SEQ ID NO: 7791042 - DNA, 22 bp, Homo sapiens
agagccaggcggctgggcacct

SEQ ID NO: 7791043 - DNA, 22 bp, Homo sapiens
agaccctggggaaagtcacttc

SEQ ID NO: 7791044 - DNA, 22 bp, Homo sapiens
agaccctgaagttttctatgat

SEQ ID NO: 7791045 - DNA, 22 bp, Homo sapiens
agaccctgcacctctcgtgggc

SEQ ID NO: 7791046 - DNA, 22 bp, Homo sapiens
agaccctgttagttccagtctt

SEQ ID NO: 7791047 - DNA, 22 bp, Homo sapiens
agaccctgtcagtgttaggaaa

SEQ ID NO: 7791048 - DNA, 22 bp, Homo sapiens
agcctctgatggctcccaagga

SEQ ID NO: 7791049 - DNA, 22 bp, Homo sapiens
acactgagtgtagaaatagcca

SEQ ID NO: 7791050 - DNA, 22 bp, Homo sapiens
agcagagccaggtctctctgta

SEQ ID NO: 7791051 - DNA, 22 bp, Homo sapiens
gtgtcaggagccttccatgggc

SEQ ID NO: 7791052 - DNA, 22 bp, Homo sapiens
gtgtcaggcagtcagcatggag

SEQ ID NO: 7791053 - DNA, 22 bp, Homo sapiens
gttcaagaccagcctggccaac

SEQ ID NO: 7791054 - DNA, 22 bp, Homo sapiens
gtcaggagagatcaggacagca

SEQ ID NO: 7791055 - DNA, 22 bp, Homo sapiens
gtcaggactctgacccgtcccg

SEQ ID NO: 7791056 - DNA, 20 bp, Homo sapiens
gtaaagcattcttggcatac

SEQ ID NO: 7791057 - DNA, 22 bp, Homo sapiens
ggtggcagaggtgcatcagccc

SEQ ID NO: 7791058 - DNA, 22 bp, Homo sapiens
ggtggcaggccctgagcatccc

SEQ ID NO: 7791059 - DNA, 22 bp, Homo sapiens
gtggcaggatcacggctcactg

SEQ ID NO: 7791060 - DNA, 22 bp, Homo sapiens
gtggcaggagagacacagccat

SEQ ID NO: 7791061 - DNA, 22 bp, Homo sapiens
gggtggctgagaacaggacccc

SEQ ID NO: 7791062 - DNA, 22 bp, Homo sapiens
gggacgagatcttggcagtgtg

SEQ ID NO: 7791063 - DNA, 22 bp, Homo sapiens
gggacctgggccagaggacagt

SEQ ID NO: 7791064 - DNA, 22 bp, Homo sapiens
gggacctgggccagaggacagt

SEQ ID NO: 7791065 - DNA, 22 bp, Homo sapiens
gggaccagtgtctgtgagaaaa

SEQ ID NO: 7791066 - DNA, 22 bp, Homo sapiens
gcctgtaatcccagcactttgg

SEQ ID NO: 7791067 - DNA, 22 bp, Homo sapiens
gcctgtaatcccagcactttgt

SEQ ID NO: 7791068 - DNA, 20 bp, Homo sapiens
gccctcagtcttgtctttat

SEQ ID NO: 7791069 - DNA, 22 bp, Homo sapiens
gccctctgatgctcaccgagga

SEQ ID NO: 7791070 - DNA, 22 bp, Homo sapiens
gattgtggaagtcagtggttct

SEQ ID NO: 7791071 - DNA, 22 bp, Homo sapiens
gcaccgagaaggaagcatgcct

SEQ ID NO: 7791072 - DNA, 22 bp, Homo sapiens
gcagagccctgggggtatggtg

SEQ ID NO: 7791073 - DNA, 22 bp, Homo sapiens
gcagagcccctcaagccagcct

SEQ ID NO: 7791074 - DNA, 20 bp, Homo sapiens
gcagagcctcactgcaaggg

SEQ ID NO: 7791075 - DNA, 21 bp, Homo sapiens
gcagagccggggcgagaaggc

SEQ ID NO: 7791076 - DNA, 22 bp, Homo sapiens
gcagagcctgtgtctgagcaaa

SEQ ID NO: 7791077 - DNA, 22 bp, Homo sapiens
gcagagcctgggggtctgcgga

SEQ ID NO: 7791078 - DNA, 22 bp, Homo sapiens
gagtgtggatcccagaagcaga

SEQ ID NO: 7791079 - DNA, 22 bp, Homo sapiens
gaggcctcctctgagacatctg

SEQ ID NO: 7791080 - DNA, 22 bp, Homo sapiens
gaacccagtccaggtgcagcct

SEQ ID NO: 7791081 - DNA, 22 bp, Homo sapiens
cttctctggctcctcagcgccc

SEQ ID NO: 7791082 - DNA, 22 bp, Homo sapiens
cttgggaccctcacatttgatg

SEQ ID NO: 7791083 - DNA, 23 bp, Homo sapiens
ttgaccttatcaagggcatttgc

SEQ ID NO: 7791084 - DNA, 22 bp, Homo sapiens
ttctgtatctttcttcaagatt

SEQ ID NO: 7791085 - DNA, 22 bp, Homo sapiens
ttctgtatattgtaaagactca

SEQ ID NO: 7791086 - DNA, 22 bp, Homo sapiens
ttcccttaaattatggcatcta

SEQ ID NO: 7791087 - DNA, 18 bp, Homo sapiens
ctctgggagaggcataca

SEQ ID NO: 7791088 - DNA, 22 bp, Homo sapiens
ctgaaagcaaatacatgaatct

SEQ ID NO: 7791089 - DNA, 22 bp, Homo sapiens
ctgactgtgagagcaggaatgg

SEQ ID NO: 7791090 - DNA, 22 bp, Homo sapiens
ctggagtgtaaagagcatagaa

SEQ ID NO: 7791091 - DNA, 20 bp, Homo sapiens
ctggagtgtagcagtggctg

SEQ ID NO: 7791092 - DNA, 22 bp, Homo sapiens
ctggaggggccatccacagtct

SEQ ID NO: 7791093 - DNA, 22 bp, Homo sapiens
ctggaaagtagacaatctaaaa

SEQ ID NO: 7791094 - DNA, 22 bp, Homo sapiens
cctccctggccagagcagcagc

SEQ ID NO: 7791095 - DNA, 22 bp, Homo sapiens
cctctgtaatgattcactgaat

SEQ ID NO: 7791096 - DNA, 22 bp, Homo sapiens
tgccacagacaggacagaacag

SEQ ID NO: 7791097 - DNA, 22 bp, Homo sapiens
tgtctgtaatagtcactatgtg

SEQ ID NO: 7791098 - DNA, 19 bp, Homo sapiens
tgtctgtataggtaaagaa

SEQ ID NO: 7791099 - DNA, 22 bp, Homo sapiens
tgtctgtattagtcagcattct

SEQ ID NO: 7791100 - DNA, 20 bp, Homo sapiens
tgtctgtatgcagtcatata

SEQ ID NO: 7791101 - DNA, 20 bp, Homo sapiens
tgtggcaggatgagggcgga

SEQ ID NO: 7791102 - DNA, 22 bp, Homo sapiens
tgtggcaggaagagcttctgag

SEQ ID NO: 7791103 - DNA, 22 bp, Homo sapiens
cctgggtgaaatagtcctcaag

SEQ ID NO: 7791104 - DNA, 22 bp, Homo sapiens
tgtaggacatgtacttgtaaca

SEQ ID NO: 7791105 - DNA, 22 bp, Homo sapiens
tgtaaagaaatagcatttgtag

SEQ ID NO: 7791106 - DNA, 22 bp, Homo sapiens
cagctttcttccttctgtctgt

SEQ ID NO: 7791107 - DNA, 22 bp, Homo sapiens
cagctttctgtctcatgactga

SEQ ID NO: 7791108 - DNA, 22 bp, Homo sapiens
gtgtggccgtgtatccatggct

SEQ ID NO: 7791109 - DNA, 22 bp, Homo sapiens
gtgggcaggagtgagcaacagg

SEQ ID NO: 7791110 - DNA, 22 bp, Homo sapiens
gtggctaggcccaacggcagga

SEQ ID NO: 7791111 - DNA, 22 bp, Homo sapiens
gtggctagttggcagagaacag

SEQ ID NO: 7791112 - DNA, 22 bp, Homo sapiens
gtggcaggttataagcatctca

SEQ ID NO: 7791113 - DNA, 22 bp, Homo sapiens
caggatgttcaagggacctatg

SEQ ID NO: 7791114 - DNA, 22 bp, Homo sapiens
caggcacagctgggcaattgcg

SEQ ID NO: 7791115 - DNA, 22 bp, Homo sapiens
caggagctcttaaggatgtgat

SEQ ID NO: 7791116 - DNA, 22 bp, Homo sapiens
caggagtgttgattgctcagga

SEQ ID NO: 7791117 - DNA, 22 bp, Homo sapiens
caggacagtgcaggtccatcct

SEQ ID NO: 7791118 - DNA, 22 bp, Homo sapiens
caggaagctggtcagatcctgt

SEQ ID NO: 7791119 - DNA, 22 bp, Homo sapiens
caggaagctgccggtgagcgag

SEQ ID NO: 7791120 - DNA, 22 bp, Homo sapiens
caggacactacagatgggaggg

SEQ ID NO: 7791121 - DNA, 22 bp, Homo sapiens
caggacaggagtggggtcaaag

SEQ ID NO: 7791122 - DNA, 22 bp, Homo sapiens
caggacacagggtgtggctgat

SEQ ID NO: 7791123 - DNA, 22 bp, Homo sapiens
ccagatgtatgtatgagtgcat

SEQ ID NO: 7791124 - DNA, 22 bp, Homo sapiens
tctgccaccttcatcctccact

SEQ ID NO: 7791125 - DNA, 20 bp, Homo sapiens
tctgccactaattaggtgat

SEQ ID NO: 7791126 - DNA, 19 bp, Homo sapiens
tctctctgtacattagata

SEQ ID NO: 7791127 - DNA, 22 bp, Homo sapiens
ccagccctacagtatcacctgt

SEQ ID NO: 7791128 - DNA, 22 bp, Homo sapiens
tctgccttttactagctggatg

SEQ ID NO: 7791129 - DNA, 22 bp, Homo sapiens
ccagctgtgccggggacctggg

SEQ ID NO: 7791130 - DNA, 18 bp, Homo sapiens
ccagctgtgcagcatctg

SEQ ID NO: 7791131 - DNA, 22 bp, Homo sapiens
ccagctgtttctgatgctaggc

SEQ ID NO: 7791132 - DNA, 22 bp, Homo sapiens
ccagctgtgcctaggagcaggg

SEQ ID NO: 7791133 - DNA, 23 bp, Homo sapiens
ccagctgtgcctggcccaggagc

SEQ ID NO: 7791134 - DNA, 22 bp, Homo sapiens
ccagctgtctggttccagagcc

SEQ ID NO: 7791135 - DNA, 22 bp, Homo sapiens
ccagctgtcactcagaaaggcc

SEQ ID NO: 7791136 - DNA, 22 bp, Homo sapiens
tccaggcaagggaggagcatgg

SEQ ID NO: 7791137 - DNA, 22 bp, Homo sapiens
tcagccctagcctcagtccagg

SEQ ID NO: 7791138 - DNA, 20 bp, Homo sapiens
tcagccctgagtccaggctg

SEQ ID NO: 7791139 - DNA, 22 bp, Homo sapiens
tcagccctggcactgtctccca

SEQ ID NO: 7791140 - DNA, 22 bp, Homo sapiens
tcagccctacattaggtaagcc

SEQ ID NO: 7791141 - DNA, 22 bp, Homo sapiens
caggtctgtttccatcagtgct

SEQ ID NO: 7791142 - DNA, 22 bp, Homo sapiens
tgttaaagttatatgccgtcct

SEQ ID NO: 7791143 - DNA, 22 bp, Homo sapiens
tgtgaaagcaagtctagttctc

SEQ ID NO: 7791144 - DNA, 23 bp, Homo sapiens
tgtctccatctcattacttgggg

SEQ ID NO: 7791145 - DNA, 22 bp, Homo sapiens
tgggaggcccaggcctggcagg

SEQ ID NO: 7791146 - DNA, 22 bp, Homo sapiens
tgggaggcttccagaccttgct

SEQ ID NO: 7791147 - DNA, 22 bp, Homo sapiens
tgggcagggagctggaaccaca

SEQ ID NO: 7791148 - DNA, 22 bp, Homo sapiens
tggggactgacagccaggcctc

SEQ ID NO: 7791149 - DNA, 22 bp, Homo sapiens
tggggtggaacccttctgctgg

SEQ ID NO: 7791150 - DNA, 22 bp, Homo sapiens
tggggtggggttactcattctg

SEQ ID NO: 7791151 - DNA, 21 bp, Homo sapiens
tgggtgggcagagtctcttca

SEQ ID NO: 7791152 - DNA, 22 bp, Homo sapiens
tgggtggttgctgaggctcctt

SEQ ID NO: 7791153 - DNA, 22 bp, Homo sapiens
tgggtggtcttgcttcccagga

SEQ ID NO: 7791154 - DNA, 22 bp, Homo sapiens
tgggtggtccaggctcagcaga

SEQ ID NO: 7791155 - DNA, 22 bp, Homo sapiens
tgtccttgatgaatatgaaatt

SEQ ID NO: 7791156 - DNA, 22 bp, Homo sapiens
tgtcaaagcctgaatcacatag

SEQ ID NO: 7791157 - DNA, 19 bp, Homo sapiens
tgtcaaaggaatttattct

SEQ ID NO: 7791158 - DNA, 22 bp, Homo sapiens
tgtaaagatccttagcaacatc

SEQ ID NO: 7791159 - DNA, 23 bp, Homo sapiens
tgtaaagatgatgctctagacac

SEQ ID NO: 7791160 - DNA, 22 bp, Homo sapiens
tgtaaagattagattacatgaa

SEQ ID NO: 7791161 - DNA, 22 bp, Homo sapiens
tgtaaggaggaaaattagtggt

SEQ ID NO: 7791162 - DNA, 22 bp, Homo sapiens
tgctctcctgctcctcagccca

SEQ ID NO: 7791163 - DNA, 22 bp, Homo sapiens
tggaaagcagttcttagaatcg

SEQ ID NO: 7791164 - DNA, 22 bp, Homo sapiens
tggagagcccgagacatcctgt

SEQ ID NO: 7791165 - DNA, 22 bp, Homo sapiens
tggaggctggtttctgctgagg

SEQ ID NO: 7791166 - DNA, 22 bp, Homo sapiens
tggaggctgtgtgcatgagacc

SEQ ID NO: 7791167 - DNA, 23 bp, Homo sapiens
tggcatttctatactggcaagtg

SEQ ID NO: 7791168 - DNA, 22 bp, Homo sapiens
tggcagtgccccttgaccagtg

SEQ ID NO: 7791169 - DNA, 21 bp, Homo sapiens
tggcaggcagctggaagcttg

SEQ ID NO: 7791170 - DNA, 22 bp, Homo sapiens
tggcaggatttgcccggaagga

SEQ ID NO: 7791171 - DNA, 22 bp, Homo sapiens
tggcaggaaggagactcagccc

SEQ ID NO: 7791172 - DNA, 22 bp, Homo sapiens
tggcaggagagcgtcagatcag

SEQ ID NO: 7791173 - DNA, 20 bp, Homo sapiens
tggcaggaggcagcagtgga

SEQ ID NO: 7791174 - DNA, 22 bp, Homo sapiens
tggcaggaggatgaggcggcta

SEQ ID NO: 7791175 - DNA, 22 bp, Homo sapiens
tggcaggaaagtaacagagcac

SEQ ID NO: 7791176 - DNA, 18 bp, Homo sapiens
tggcaggaaatgcacttt

SEQ ID NO: 7791177 - DNA, 22 bp, Homo sapiens
tggcaggaaccttaaccacaaa

SEQ ID NO: 7791178 - DNA, 22 bp, Homo sapiens
tgggaggagccctctgggaagg

SEQ ID NO: 7791179 - DNA, 20 bp, Homo sapiens
tggccttggggagctcacac

SEQ ID NO: 7791180 - DNA, 22 bp, Homo sapiens
tggccttgagagatcaaaaggt

SEQ ID NO: 7791181 - DNA, 22 bp, Homo sapiens
tggctcacaatctcccatgaag

SEQ ID NO: 7791182 - DNA, 22 bp, Homo sapiens
tgaaagcacaagttctaacagg

SEQ ID NO: 7791183 - DNA, 21 bp, Homo sapiens
tgaacccagagctcatgacca

SEQ ID NO: 7791184 - DNA, 22 bp, Homo sapiens
tgaaaatgccctctatgtctca

SEQ ID NO: 7791185 - DNA, 22 bp, Homo sapiens
tgaaaatgcacgctggaaagca

SEQ ID NO: 7791186 - DNA, 22 bp, Homo sapiens
tgaaaatggcctgaagaagcaa

SEQ ID NO: 7791187 - DNA, 21 bp, Homo sapiens
tgacccttgccgagctacatt

SEQ ID NO: 7791188 - DNA, 22 bp, Homo sapiens
tgactctgctgtgaaagcattt

SEQ ID NO: 7791189 - DNA, 21 bp, Homo sapiens
tgactgaggcttcttcacaca

SEQ ID NO: 7791190 - DNA, 22 bp, Homo sapiens
tgagaggatattttgggaggat

SEQ ID NO: 7791191 - DNA, 19 bp, Homo sapiens
tgagccagggaggccatgc

SEQ ID NO: 7791192 - DNA, 22 bp, Homo sapiens
tgagccagagtggagtgtgcct

SEQ ID NO: 7791193 - DNA, 22 bp, Homo sapiens
tgagccttcctcagaagctcct

SEQ ID NO: 7791194 - DNA, 20 bp, Homo sapiens
tgagccagtcaagctacatt

SEQ ID NO: 7791195 - DNA, 22 bp, Homo sapiens
tgagcttgctacatagatcaga

SEQ ID NO: 7791196 - DNA, 22 bp, Homo sapiens
tgagctggtcttgagtgtagct

SEQ ID NO: 7791197 - DNA, 22 bp, Homo sapiens
tgagctggaggacaggagggta

SEQ ID NO: 7791198 - DNA, 22 bp, Homo sapiens
tgaggccagcttcagcagtgga

SEQ ID NO: 7791199 - DNA, 22 bp, Homo sapiens
tgagtctgtatgtccagattta

SEQ ID NO: 7791200 - DNA, 18 bp, Homo sapiens
tgagtggaatgagggggc

SEQ ID NO: 7791201 - DNA, 22 bp, Homo sapiens
tgcacgtgggctctctgctctt

SEQ ID NO: 7791202 - DNA, 22 bp, Homo sapiens
tgccacaggcaatccctgcacg

SEQ ID NO: 7791203 - DNA, 22 bp, Homo sapiens
tgccaggtacacaagtagccag

SEQ ID NO: 7791204 - DNA, 22 bp, Homo sapiens
tgcccttgaggacagctcccag

SEQ ID NO: 7791205 - DNA, 22 bp, Homo sapiens
tgcccttgggtaacttgctgat

SEQ ID NO: 7791206 - DNA, 22 bp, Homo sapiens
tgcccttggtgggcccaatagg

SEQ ID NO: 7791207 - DNA, 22 bp, Homo sapiens
tgcccttgaaatacgcttgggg

SEQ ID NO: 7791208 - DNA, 22 bp, Homo sapiens
tccttgagaggacagagccata

SEQ ID NO: 7791209 - DNA, 22 bp, Homo sapiens
tccttgaggaggtgacactgga

SEQ ID NO: 7791210 - DNA, 22 bp, Homo sapiens
tctctctgagttgagcaggagt

SEQ ID NO: 7791211 - DNA, 18 bp, Homo sapiens
tctctctgaagagttccc

SEQ ID NO: 7791212 - DNA, 17 bp, Homo sapiens
tctctttccctttctgc

SEQ ID NO: 7791213 - DNA, 22 bp, Homo sapiens
tctgaaagcattacagtttatt

SEQ ID NO: 7791214 - DNA, 22 bp, Homo sapiens
tctgaaagctagaaaatgctct

SEQ ID NO: 7791215 - DNA, 22 bp, Homo sapiens
tctgaaagggctaaataatttg

SEQ ID NO: 7791216 - DNA, 22 bp, Homo sapiens
tctgaaagagagtacatacagt

SEQ ID NO: 7791217 - DNA, 22 bp, Homo sapiens
tctgaaggttgagaagggctga

SEQ ID NO: 7791218 - DNA, 22 bp, Homo sapiens
tctgaaggtctgagctagaggt

SEQ ID NO: 7791219 - DNA, 21 bp, Homo sapiens
tctgaaggcttgactggggct

SEQ ID NO: 7791220 - DNA, 22 bp, Homo sapiens
tctgaagggctgagtggaggag

SEQ ID NO: 7791221 - DNA, 22 bp, Homo sapiens
tctgaaggcctggagggtccca

SEQ ID NO: 7791222 - DNA, 22 bp, Homo sapiens
tctgaaggaaaagggtagatat

SEQ ID NO: 7791223 - DNA, 22 bp, Homo sapiens
tctcagaacacccttctatggt

SEQ ID NO: 7791224 - DNA, 22 bp, Homo sapiens
tctcagaactttatatgtatca

SEQ ID NO: 7791225 - DNA, 22 bp, Homo sapiens
tctttccatggccacacagtct

SEQ ID NO: 7791226 - DNA, 22 bp, Homo sapiens
tcttctgtggctctcaccaccc

SEQ ID NO: 7791227 - DNA, 22 bp, Homo sapiens
tcttctgttaccacagcgatga

SEQ ID NO: 7791228 - DNA, 22 bp, Homo sapiens
tctgtcctgtttcctcctgaca

SEQ ID NO: 7791229 - DNA, 22 bp, Homo sapiens
tctgtctcaagttcttgcactc

SEQ ID NO: 7791230 - DNA, 20 bp, Homo sapiens
tctgtctctgagctagactt

SEQ ID NO: 7791231 - DNA, 18 bp, Homo sapiens
tctgtctctgtccttgct

SEQ ID NO: 7791232 - DNA, 22 bp, Homo sapiens
tctgtctctttgttctgtgagt

SEQ ID NO: 7791233 - DNA, 22 bp, Homo sapiens
tctgtccctgagagctcaggag

SEQ ID NO: 7791234 - DNA, 23 bp, Homo sapiens
tctgtacaattgagaagagaaca

SEQ ID NO: 7791235 - DNA, 22 bp, Homo sapiens
tctgtaaatctactaagagctc

SEQ ID NO: 7791236 - DNA, 22 bp, Homo sapiens
tctgtaaatcctgctcagcaac

SEQ ID NO: 7791237 - DNA, 22 bp, Homo sapiens
tctgtaaacacccgtaagcttt

SEQ ID NO: 7791238 - DNA, 20 bp, Homo sapiens
tctgtaaagactccagaagc

SEQ ID NO: 7791239 - DNA, 22 bp, Homo sapiens
tctgtgctaatgcttcacaata

SEQ ID NO: 7791240 - DNA, 22 bp, Homo sapiens
tctgtgccttctcccagactta

SEQ ID NO: 7791241 - DNA, 22 bp, Homo sapiens
tctgacattagattaattggaa

SEQ ID NO: 7791242 - DNA, 22 bp, Homo sapiens
tctgacattttgagaatgacat

SEQ ID NO: 7791243 - DNA, 22 bp, Homo sapiens
tctgcaagcgtcacatgattct

SEQ ID NO: 7791244 - DNA, 22 bp, Homo sapiens
tctgccctcgaggagcttgtgt

SEQ ID NO: 7791245 - DNA, 21 bp, Homo sapiens
tctgccctccaggagctcata

SEQ ID NO: 7791246 - DNA, 22 bp, Homo sapiens
tctgccttgaggtcctcagctc

SEQ ID NO: 7791247 - DNA, 22 bp, Homo sapiens
tctgccttcttttagtcatctt

SEQ ID NO: 7791248 - DNA, 22 bp, Homo sapiens
tctggagtttgaggacaagctt

SEQ ID NO: 7791249 - DNA, 22 bp, Homo sapiens
tctggagtggacccagagcact

SEQ ID NO: 7791250 - DNA, 22 bp, Homo sapiens
agcagctgggtccggcggagca

SEQ ID NO: 7791251 - DNA, 22 bp, Homo sapiens
agagcctgcatctagcctcaga

SEQ ID NO: 7791252 - DNA, 22 bp, Homo sapiens
agagcctggacctgagctacaa

SEQ ID NO: 7791253 - DNA, 22 bp, Homo sapiens
agaggccctctctgctcagtct

SEQ ID NO: 7791254 - DNA, 22 bp, Homo sapiens
aaggcctgggagtactgggaca

SEQ ID NO: 7791255 - DNA, 22 bp, Homo sapiens
acgtgaactgtttttggagatt

SEQ ID NO: 7791256 - DNA, 22 bp, Homo sapiens
agaagcagaaactgggcttgtg

SEQ ID NO: 7791257 - DNA, 22 bp, Homo sapiens
aactggtcctcaaattttgatg

SEQ ID NO: 7791258 - DNA, 22 bp, Homo sapiens
aattttatctctaagcaggctt

SEQ ID NO: 7791259 - DNA, 22 bp, Homo sapiens
aagagagaacacagcttgggca

SEQ ID NO: 7791260 - DNA, 22 bp, Homo sapiens
aagagcagattcctagtggagc

SEQ ID NO: 7791261 - DNA, 22 bp, Homo sapiens
acacatgaaagacattaaggtg

SEQ ID NO: 7791262 - DNA, 22 bp, Homo sapiens
aagatggcaggaatcataagct

SEQ ID NO: 7791263 - DNA, 22 bp, Homo sapiens
aagcagagcctgagacagggat

SEQ ID NO: 7791264 - DNA, 22 bp, Homo sapiens
aatggctctgatgttgttgtga

SEQ ID NO: 7791265 - DNA, 22 bp, Homo sapiens
aacatatctacggatacgatta

SEQ ID NO: 7791266 - DNA, 22 bp, Homo sapiens
aatagagtcagttctacattct

SEQ ID NO: 7791267 - DNA, 22 bp, Homo sapiens
aacacaatcttccagtttgctg

SEQ ID NO: 7791268 - DNA, 22 bp, Homo sapiens
aaagcctgtctggtcatagcta

SEQ ID NO: 7791269 - DNA, 22 bp, Homo sapiens
aaagccattgaactgtacttta

SEQ ID NO: 7791270 - DNA, 22 bp, Homo sapiens
aaagccattgcagagcaggatt

SEQ ID NO: 7791271 - DNA, 22 bp, Homo sapiens
aaagccattacaaaatttcata

SEQ ID NO: 7791272 - DNA, 22 bp, Homo sapiens
aagagggctgcaatcttattgc

SEQ ID NO: 7791273 - DNA, 22 bp, Homo sapiens
aagaggaggattgatgtgggag

SEQ ID NO: 7791274 - DNA, 22 bp, Homo sapiens
aagacctattttaggatatgaa

SEQ ID NO: 7791275 - DNA, 22 bp, Homo sapiens
aagcaggagatgcaggaatgta

SEQ ID NO: 7791276 - DNA, 22 bp, Homo sapiens
aagcctggactatcgcgtgtgc

SEQ ID NO: 7791277 - DNA, 22 bp, Homo sapiens
aaaacttagctaggcaagtttt

SEQ ID NO: 7791278 - DNA, 22 bp, Homo sapiens
atatccagcagcaggtgagtat

SEQ ID NO: 7791279 - DNA, 22 bp, Homo sapiens
acttgggagttctggaagcctg

SEQ ID NO: 7791280 - DNA, 22 bp, Homo sapiens
acttgggatggtggccagagcg

SEQ ID NO: 7791281 - DNA, 22 bp, Homo sapiens
acttgggagggtgtgggcagct

SEQ ID NO: 7791282 - DNA, 22 bp, Homo sapiens
acttgggatttcagatgctgtg

SEQ ID NO: 7791283 - DNA, 22 bp, Homo sapiens
acttgggtcaagtagctcacag

SEQ ID NO: 7791284 - DNA, 22 bp, Homo sapiens
atcattttatggctgagaggac

SEQ ID NO: 7791285 - DNA, 22 bp, Homo sapiens
atccagagacccaaggacagaa

SEQ ID NO: 7791286 - DNA, 22 bp, Homo sapiens
atccagacacctactgctactt

SEQ ID NO: 7791287 - DNA, 23 bp, Homo sapiens
atccagcctgggggtttaaccac

SEQ ID NO: 7791288 - DNA, 20 bp, Homo sapiens
actggcagcctgcctgctgt

SEQ ID NO: 7791289 - DNA, 19 bp, Homo sapiens
actggcagctgtagtctgt

SEQ ID NO: 7791290 - DNA, 20 bp, Homo sapiens
actgcttctttctctgacct

SEQ ID NO: 7791291 - DNA, 22 bp, Homo sapiens
actgcttcctggatggccagca

SEQ ID NO: 7791292 - DNA, 22 bp, Homo sapiens
actggcagaggatagcactaat

SEQ ID NO: 7791293 - DNA, 22 bp, Homo sapiens
actggcagagaccctgatggcc

SEQ ID NO: 7791294 - DNA, 22 bp, Homo sapiens
actcttcattcaagtatgcaaa

SEQ ID NO: 7791295 - DNA, 22 bp, Homo sapiens
actcatttgcatgatgtgctat

SEQ ID NO: 7791296 - DNA, 20 bp, Homo sapiens
actcatttccagcatctgat

SEQ ID NO: 7791297 - DNA, 22 bp, Homo sapiens
actcattttataacactgtagt

SEQ ID NO: 7791298 - DNA, 22 bp, Homo sapiens
actccagggctgaacgaggccc

SEQ ID NO: 7791299 - DNA, 22 bp, Homo sapiens
agggctttaatgattattttct

SEQ ID NO: 7791300 - DNA, 22 bp, Homo sapiens
agggctttcggcactctgaggg

SEQ ID NO: 7791301 - DNA, 22 bp, Homo sapiens
actcatttaaacatttactgaa

SEQ ID NO: 7791302 - DNA, 22 bp, Homo sapiens
agggcctggtgacctgggtcct

SEQ ID NO: 7791303 - DNA, 22 bp, Homo sapiens
acccaggctggagtgcagtagc

SEQ ID NO: 7791304 - DNA, 18 bp, Homo sapiens
acccaggctcatggtcct

SEQ ID NO: 7791305 - DNA, 22 bp, Homo sapiens
acatgaggaaacaagggtatat

SEQ ID NO: 7791306 - DNA, 22 bp, Homo sapiens
aggccctgtaaggtgtggagat

SEQ ID NO: 7791307 - DNA, 22 bp, Homo sapiens
aggccctgcccagagctcctcg

SEQ ID NO: 7791308 - DNA, 22 bp, Homo sapiens
aggccctgttatgagccactgt

SEQ ID NO: 7791309 - DNA, 22 bp, Homo sapiens
aggccctgtccatggtgctgaa

SEQ ID NO: 7791310 - DNA, 20 bp, Homo sapiens
aggccctgccagggacggag

SEQ ID NO: 7791311 - DNA, 22 bp, Homo sapiens
acatggagaccagatggaagta

SEQ ID NO: 7791312 - DNA, 22 bp, Homo sapiens
aggcctgttccttcctgggcac

SEQ ID NO: 7791313 - DNA, 22 bp, Homo sapiens
aggcctgtctggggctcagcca

SEQ ID NO: 7791314 - DNA, 22 bp, Homo sapiens
aggcctttgtggagctcatggc

SEQ ID NO: 7791315 - DNA, 22 bp, Homo sapiens
attcagctgactttgattcatt

SEQ ID NO: 7791316 - DNA, 22 bp, Homo sapiens
attcagatcatatttatagctt

SEQ ID NO: 7791317 - DNA, 22 bp, Homo sapiens
attagcatgccaagcttttaga

SEQ ID NO: 7791318 - DNA, 22 bp, Homo sapiens
atggctgggatggggtagagaa

SEQ ID NO: 7791319 - DNA, 22 bp, Homo sapiens
agcacagagttgcagagagcgt

SEQ ID NO: 7791320 - DNA, 22 bp, Homo sapiens
attttctatgttgtaattgtta

SEQ ID NO: 7791321 - DNA, 22 bp, Homo sapiens
agcagctgggctcagagctggg

SEQ ID NO: 7791322 - DNA, 22 bp, Homo sapiens
cagagcaacaccctttacatcg

SEQ ID NO: 7791323 - DNA, 22 bp, Homo sapiens
agcccaggagtttgaggctgtg

SEQ ID NO: 7791324 - DNA, 22 bp, Homo sapiens
agcccaggaatctgcatcttga

SEQ ID NO: 7791325 - DNA, 19 bp, Homo sapiens
agccacagaacttgcagga

SEQ ID NO: 7791326 - DNA, 22 bp, Homo sapiens
cagcaggataggtttctttgga

SEQ ID NO: 7791327 - DNA, 22 bp, Homo sapiens
agggagcatgggtgaagcaggc

SEQ ID NO: 7791328 - DNA, 22 bp, Homo sapiens
agggagcattgtgacatatcac

SEQ ID NO: 7791329 - DNA, 22 bp, Homo sapiens
agggagcagcagccacaggatg

SEQ ID NO: 7791330 - DNA, 22 bp, Homo sapiens
ccatgcaatttctgtaaaacca

SEQ ID NO: 7791331 - DNA, 22 bp, Homo sapiens
aggccctggtcaggtctggctg

SEQ ID NO: 7791332 - DNA, 22 bp, Homo sapiens
aggccctgaagtcggcccctca

SEQ ID NO: 7791333 - DNA, 20 bp, Homo sapiens
aggctctgccattgtccctg

SEQ ID NO: 7791334 - DNA, 22 bp, Homo sapiens
aggctctgttattctagagggc

SEQ ID NO: 7791335 - DNA, 22 bp, Homo sapiens
aggctctgcagtgctggaggac

SEQ ID NO: 7791336 - DNA, 22 bp, Homo sapiens
aggctctgatgcaagcccaggg

SEQ ID NO: 7791337 - DNA, 19 bp, Homo sapiens
aggctctgagctcctggag

SEQ ID NO: 7791338 - DNA, 23 bp, Homo sapiens
ccagtgattgcctggaaggaggt

SEQ ID NO: 7791339 - DNA, 22 bp, Homo sapiens
aggaagctggggtgttcttcat

SEQ ID NO: 7791340 - DNA, 22 bp, Homo sapiens
agctggcatactttgctaggaa

SEQ ID NO: 7791341 - DNA, 22 bp, Homo sapiens
agctggcagtcatcctagtgag

SEQ ID NO: 7791342 - DNA, 22 bp, Homo sapiens
agctggcagtatgactggtgac

SEQ ID NO: 7791343 - DNA, 22 bp, Homo sapiens
ctggagccatgtcttgactgct

SEQ ID NO: 7791344 - DNA, 22 bp, Homo sapiens
ctgcttctccctgagatagtgt

SEQ ID NO: 7791345 - DNA, 22 bp, Homo sapiens
ctgcttctgggatgatggagta

SEQ ID NO: 7791346 - DNA, 18 bp, Homo sapiens
ctgcttctgtctgccagt

SEQ ID NO: 7791347 - DNA, 22 bp, Homo sapiens
agtttggaaaatgagacaagga

SEQ ID NO: 7791348 - DNA, 22 bp, Homo sapiens
atatatctgcagtactgaagaa

SEQ ID NO: 7791349 - DNA, 22 bp, Homo sapiens
atatgtatagccagtctttagg

SEQ ID NO: 7791350 - DNA, 19 bp, Homo sapiens
ctgggacaatgaaagcatc

SEQ ID NO: 7791351 - DNA, 22 bp, Homo sapiens
ctgggaaggggaaggtcctctc

SEQ ID NO: 7791352 - DNA, 22 bp, Homo sapiens
ctgggagacaagagagggctga

SEQ ID NO: 7791353 - DNA, 22 bp, Homo sapiens
ctgggagaggaacctcgagggt

SEQ ID NO: 7791354 - DNA, 22 bp, Homo sapiens
ctgtggagtgcttggctcagtg

SEQ ID NO: 7791355 - DNA, 22 bp, Homo sapiens
ctgtggagcttgtggcagtggg

SEQ ID NO: 7791356 - DNA, 22 bp, Homo sapiens
aggtgctggcgccccaggagac

SEQ ID NO: 7791357 - DNA, 22 bp, Homo sapiens
cctgggagaactgctgggttgg

SEQ ID NO: 7791358 - DNA, 22 bp, Homo sapiens
cctggctggatggagcccctgg

SEQ ID NO: 7791359 - DNA, 22 bp, Homo sapiens
cctggcagcccagagcgccgct

SEQ ID NO: 7791360 - DNA, 22 bp, Homo sapiens
ctctggtttctgacctgaattt

SEQ ID NO: 7791361 - DNA, 21 bp, Homo sapiens
ctctggtttgcattggattat

SEQ ID NO: 7791362 - DNA, 22 bp, Homo sapiens
ctcttgggatttgcaggctcag

SEQ ID NO: 7791363 - DNA, 22 bp, Homo sapiens
ctctgtctatcccattctgtgc

SEQ ID NO: 7791364 - DNA, 22 bp, Homo sapiens
gcttgggagagggtccccagga

SEQ ID NO: 7791365 - DNA, 22 bp, Homo sapiens
gcttgggactggagaatagggt

SEQ ID NO: 7791366 - DNA, 22 bp, Homo sapiens
gcttggctttgtcttgttcact

SEQ ID NO: 7791367 - DNA, 22 bp, Homo sapiens
gctgtgctgtttccacctctct

SEQ ID NO: 7791368 - DNA, 22 bp, Homo sapiens
caagaggagcaggcaggtgtgc

SEQ ID NO: 7791369 - DNA, 22 bp, Homo sapiens
caagaggattattaataaataa

SEQ ID NO: 7791370 - DNA, 22 bp, Homo sapiens
caaggacagcgtcaggtgcaac

SEQ ID NO: 7791371 - DNA, 21 bp, Homo sapiens
caaggacaggttgcagggcaa

SEQ ID NO: 7791372 - DNA, 22 bp, Homo sapiens
gctgctggcatctagggggtgg

SEQ ID NO: 7791373 - DNA, 22 bp, Homo sapiens
cactgaagatgcgactagtgct

SEQ ID NO: 7791374 - DNA, 17 bp, Homo sapiens
caccctggctagtctga

SEQ ID NO: 7791375 - DNA, 22 bp, Homo sapiens
caccctggctggaggtgcagtg

SEQ ID NO: 7791376 - DNA, 22 bp, Homo sapiens
caccctggaaagaaggtctggg

SEQ ID NO: 7791377 - DNA, 22 bp, Homo sapiens
ggcactgggcaccggctgaggg

SEQ ID NO: 7791378 - DNA, 23 bp, Homo sapiens
cacagggagggaaactctttcag

SEQ ID NO: 7791379 - DNA, 22 bp, Homo sapiens
cagaggcctggcttggacacct

SEQ ID NO: 7791380 - DNA, 22 bp, Homo sapiens
cagaggcctatccagtgtccat

SEQ ID NO: 7791381 - DNA, 22 bp, Homo sapiens
cagaggcctcacttccagccag

SEQ ID NO: 7791382 - DNA, 22 bp, Homo sapiens
cagaggcccagtgagagggctg

SEQ ID NO: 7791383 - DNA, 22 bp, Homo sapiens
cagaggccacctgtggccactg

SEQ ID NO: 7791384 - DNA, 22 bp, Homo sapiens
gggctttttacattgaacattt

SEQ ID NO: 7791385 - DNA, 22 bp, Homo sapiens
gggagcaggacataatagcaat

SEQ ID NO: 7791386 - DNA, 22 bp, Homo sapiens
cagaagcagtgagagatgtgca

SEQ ID NO: 7791387 - DNA, 22 bp, Homo sapiens
attctattaatatttctaggaa

SEQ ID NO: 7791388 - DNA, 22 bp, Homo sapiens
attcagttagtagatttggtca

SEQ ID NO: 7791389 - DNA, 22 bp, Homo sapiens
attcagttccttgtgattgtag

SEQ ID NO: 7791390 - DNA, 22 bp, Homo sapiens
attatttatcctcttggtctat

SEQ ID NO: 7791391 - DNA, 22 bp, Homo sapiens
attattcaatgttatttcagtg

SEQ ID NO: 7791392 - DNA, 22 bp, Homo sapiens
atttctagatatggagagtggt

SEQ ID NO: 7791393 - DNA, 22 bp, Homo sapiens
atttctagcctctgaagtagga

SEQ ID NO: 7791394 - DNA, 22 bp, Homo sapiens
gcctgctggaggagcctcaggg

SEQ ID NO: 7791395 - DNA, 22 bp, Homo sapiens
gcctgctgaacctcatgcagtc

SEQ ID NO: 7791396 - DNA, 22 bp, Homo sapiens
atggcagttgtatgggctgtat

SEQ ID NO: 7791397 - DNA, 20 bp, Homo sapiens
atggaggaagggcaagagaa

SEQ ID NO: 7791398 - DNA, 22 bp, Homo sapiens
atggagcacacgccatcacata

SEQ ID NO: 7791399 - DNA, 22 bp, Homo sapiens
gaggcctgggcaagggggtctg

SEQ ID NO: 7791400 - DNA, 22 bp, Homo sapiens
gaggagctgcccgtgtgtctgc

SEQ ID NO: 7791401 - DNA, 22 bp, Homo sapiens
tatggcattttgtaagggcttg

SEQ ID NO: 7791402 - DNA, 22 bp, Homo sapiens
tatctgtaaaccaaggaggctt

SEQ ID NO: 7791403 - DNA, 23 bp, Homo sapiens
tatggcatggtacttccagcaga

SEQ ID NO: 7791404 - DNA, 22 bp, Homo sapiens
tatggcattgttggtgatgata

SEQ ID NO: 7791405 - DNA, 22 bp, Homo sapiens
tatggcatatctgggagactct

SEQ ID NO: 7791406 - DNA, 22 bp, Homo sapiens
tatggcatatagtccagcataa

SEQ ID NO: 7791407 - DNA, 21 bp, Homo sapiens
tcagaacaattccatgcctcc

SEQ ID NO: 7791408 - DNA, 22 bp, Homo sapiens
cagtgctgggcagaggagagcg

SEQ ID NO: 7791409 - DNA, 22 bp, Homo sapiens
catacttactgtgtaccaggtg

SEQ ID NO: 7791410 - DNA, 22 bp, Homo sapiens
cagtttggtacatagttcaaaa

SEQ ID NO: 7791411 - DNA, 22 bp, Homo sapiens
cagtttggggtcggagtcaggg

SEQ ID NO: 7791412 - DNA, 22 bp, Homo sapiens
catatcttctgacatgatcagg

SEQ ID NO: 7791413 - DNA, 22 bp, Homo sapiens
catccaggctgaagtgcagtgg

SEQ ID NO: 7791414 - DNA, 22 bp, Homo sapiens
catccaggcaccacaaccagct

SEQ ID NO: 7791415 - DNA, 23 bp, Homo sapiens
catccaggagctgagtctgactg

SEQ ID NO: 7791416 - DNA, 22 bp, Homo sapiens
catccaggctggagtacagtgg

SEQ ID NO: 7791417 - DNA, 22 bp, Homo sapiens
catccagggcagccatggcctg

SEQ ID NO: 7791418 - DNA, 19 bp, Homo sapiens
ccaggaacccctagctacc

SEQ ID NO: 7791419 - DNA, 22 bp, Homo sapiens
tctctcttgtcaccccatctgc

SEQ ID NO: 7791420 - DNA, 22 bp, Homo sapiens
ccagcctcatcatattcctgct

SEQ ID NO: 7791421 - DNA, 22 bp, Homo sapiens
ccacagaggacaactgcctggc

SEQ ID NO: 7791422 - DNA, 22 bp, Homo sapiens
tcctccccaaagcccagcctgg

SEQ ID NO: 7791423 - DNA, 22 bp, Homo sapiens
caggagctgggtctggaagcag

SEQ ID NO: 7791424 - DNA, 22 bp, Homo sapiens
taaagccaacactttactgctc

SEQ ID NO: 7791425 - DNA, 22 bp, Homo sapiens
taaagccaatatacctagcata

SEQ ID NO: 7791426 - DNA, 22 bp, Homo sapiens
caggcactcagtctggatccct

SEQ ID NO: 7791427 - DNA, 22 bp, Homo sapiens
tacaaattaatgggcatgttta

SEQ ID NO: 7791428 - DNA, 22 bp, Homo sapiens
tacatcataataatacttagaa

SEQ ID NO: 7791429 - DNA, 22 bp, Homo sapiens
cagcccagccgagggcctggct

SEQ ID NO: 7791430 - DNA, 22 bp, Homo sapiens
gtgggacagctggagggtccct

SEQ ID NO: 7791431 - DNA, 17 bp, Homo sapiens
cagctgtgagagcctta

SEQ ID NO: 7791432 - DNA, 22 bp, Homo sapiens
cagctgctgagaagcctccctt

SEQ ID NO: 7791433 - DNA, 22 bp, Homo sapiens
cagctgctgttcagttttgttt

SEQ ID NO: 7791434 - DNA, 22 bp, Homo sapiens
cctggcagttttgcccaggatt

SEQ ID NO: 7791435 - DNA, 22 bp, Homo sapiens
cctggcagtcaggggagtcctt

SEQ ID NO: 7791436 - DNA, 22 bp, Homo sapiens
cctggcaggtggcgccctcggc

SEQ ID NO: 7791437 - DNA, 19 bp, Homo sapiens
cctgggaggcggaggttgc

SEQ ID NO: 7791438 - DNA, 17 bp, Homo sapiens
cctgggaggagttatga

SEQ ID NO: 7791439 - DNA, 22 bp, Homo sapiens
cctgggaggcagaggttgcagt

SEQ ID NO: 7791440 - DNA, 22 bp, Homo sapiens
cctgggagctgtggaaaggctg

SEQ ID NO: 7791441 - DNA, 22 bp, Homo sapiens
cctgggaggcggaggttgcagt

SEQ ID NO: 7791442 - DNA, 22 bp, Homo sapiens
cctgggaggcggaggttgcagg

SEQ ID NO: 7791443 - DNA, 22 bp, Homo sapiens
cctgggagagtctgtggtctcc

SEQ ID NO: 7791444 - DNA, 22 bp, Homo sapiens
cctgggagagccatctgtggcc

SEQ ID NO: 7791445 - DNA, 22 bp, Homo sapiens
cccaggatgtcgaggctgcagt

SEQ ID NO: 7791446 - DNA, 19 bp, Homo sapiens
ccctcaggtctgagcagtc

SEQ ID NO: 7791447 - DNA, 20 bp, Homo sapiens
tggcccagtggggcagggtg

SEQ ID NO: 7791448 - DNA, 22 bp, Homo sapiens
tggatctcggcaatgcgggact

SEQ ID NO: 7791449 - DNA, 22 bp, Homo sapiens
tggcagctgtgtccaggtagaa

SEQ ID NO: 7791450 - DNA, 22 bp, Homo sapiens
tggccaggcaggtagaacggcc

SEQ ID NO: 7791451 - DNA, 22 bp, Homo sapiens
tggcagctggctctgcgcaggc

SEQ ID NO: 7791452 - DNA, 22 bp, Homo sapiens
tggcagcactaggtactgagct

SEQ ID NO: 7791453 - DNA, 22 bp, Homo sapiens
ctgctttttctaggaggacaat

SEQ ID NO: 7791454 - DNA, 22 bp, Homo sapiens
ctgcttctaagaacctgcagct

SEQ ID NO: 7791455 - DNA, 22 bp, Homo sapiens
ctggactcagggtgctccagcg

SEQ ID NO: 7791456 - DNA, 22 bp, Homo sapiens
ctggccaggctctcacgtggtc

SEQ ID NO: 7791457 - DNA, 22 bp, Homo sapiens
ctggcagtggggcctcagtgtt

SEQ ID NO: 7791458 - DNA, 22 bp, Homo sapiens
ctggcagtgtccagctcgtgat

SEQ ID NO: 7791459 - DNA, 22 bp, Homo sapiens
ctggcagttggcagggctgcca

SEQ ID NO: 7791460 - DNA, 22 bp, Homo sapiens
ctggcagtgacattgcaggtgc

SEQ ID NO: 7791461 - DNA, 22 bp, Homo sapiens
ctggcagtcacggccatgtgct

SEQ ID NO: 7791462 - DNA, 22 bp, Homo sapiens
ctggcagattggggtcagcagt

SEQ ID NO: 7791463 - DNA, 22 bp, Homo sapiens
ctgaagagcactgtggccagtt

SEQ ID NO: 7791464 - DNA, 22 bp, Homo sapiens
ctctggttcgtggtagatttta

SEQ ID NO: 7791465 - DNA, 22 bp, Homo sapiens
ttttattcaaatagttcacact

SEQ ID NO: 7791466 - DNA, 22 bp, Homo sapiens
ttttattcatagggatggagag

SEQ ID NO: 7791467 - DNA, 22 bp, Homo sapiens
ttccgctgtttagttgaagttt

SEQ ID NO: 7791468 - DNA, 22 bp, Homo sapiens
cggcatccccacttcctcctgc

SEQ ID NO: 7791469 - DNA, 22 bp, Homo sapiens
ttgcttttaatctttgtacatc

SEQ ID NO: 7791470 - DNA, 22 bp, Homo sapiens
ttgcttttccctgtctctgatt

SEQ ID NO: 7791471 - DNA, 22 bp, Homo sapiens
ttgcttttgtgtgctctctgga

SEQ ID NO: 7791472 - DNA, 22 bp, Homo sapiens
ctcctctttagccccagctgga

SEQ ID NO: 7791473 - DNA, 22 bp, Homo sapiens
ctcctctttggggatttacaca

SEQ ID NO: 7791474 - DNA, 22 bp, Homo sapiens
ctcctcttctgagtaccaggga

SEQ ID NO: 7791475 - DNA, 22 bp, Homo sapiens
cttggggcagtgcttggcacat

SEQ ID NO: 7791476 - DNA, 22 bp, Homo sapiens
cttttaagggataataagatgt

SEQ ID NO: 7791477 - DNA, 22 bp, Homo sapiens
gaagtgaagagattagaaatca

SEQ ID NO: 7791478 - DNA, 18 bp, Homo sapiens
gacacaggagagagtccc

SEQ ID NO: 7791479 - DNA, 22 bp, Homo sapiens
gacccaggggcagggagaaagt

SEQ ID NO: 7791480 - DNA, 18 bp, Homo sapiens
gaggcctgagaaccaggt

SEQ ID NO: 7791481 - DNA, 22 bp, Homo sapiens
gaggccctggtaggtcagagtg

SEQ ID NO: 7791482 - DNA, 22 bp, Homo sapiens
gaggccctgaagacagctgggg

SEQ ID NO: 7791483 - DNA, 22 bp, Homo sapiens
gaggccctccagctgtcagctg

SEQ ID NO: 7791484 - DNA, 22 bp, Homo sapiens
gaggccctcttgccacaatgaa

SEQ ID NO: 7791485 - DNA, 22 bp, Homo sapiens
gagagtgcgattcattcattta

SEQ ID NO: 7791486 - DNA, 20 bp, Homo sapiens
gagagtgcttttcattgctc

SEQ ID NO: 7791487 - DNA, 22 bp, Homo sapiens
gaggctggacgtgcatttctac

SEQ ID NO: 7791488 - DNA, 22 bp, Homo sapiens
gaggggcagaatgtgatcaggg

SEQ ID NO: 7791489 - DNA, 22 bp, Homo sapiens
gaggggcagaggtagagaacaa

SEQ ID NO: 7791490 - DNA, 20 bp, Homo sapiens
gagtcacagaagaagctgaa

SEQ ID NO: 7791491 - DNA, 22 bp, Homo sapiens
gatcagtttaatcttcaggggt

SEQ ID NO: 7791492 - DNA, 22 bp, Homo sapiens
gcagctcccatcagggcacaga

SEQ ID NO: 7791493 - DNA, 22 bp, Homo sapiens
gcagctcctggcacagtttttt

SEQ ID NO: 7791494 - DNA, 22 bp, Homo sapiens
gcagctccttcaatctcaccat

SEQ ID NO: 7791495 - DNA, 22 bp, Homo sapiens
gcagtggggaatgctggggaga

SEQ ID NO: 7791496 - DNA, 19 bp, Homo sapiens
gcaccctgaggtcatggcc

SEQ ID NO: 7791497 - DNA, 22 bp, Homo sapiens
gcacttggtaggacttcagtga

SEQ ID NO: 7791498 - DNA, 22 bp, Homo sapiens
gcacttgggcagagacgcacag

SEQ ID NO: 7791499 - DNA, 22 bp, Homo sapiens
gcacctggctgcccaggtggag

SEQ ID NO: 7791500 - DNA, 22 bp, Homo sapiens
gcagaacaacgtaggagtggag

SEQ ID NO: 7791501 - DNA, 22 bp, Homo sapiens
gcagaagcagcagatgggcgca

SEQ ID NO: 7791502 - DNA, 22 bp, Homo sapiens
gcaatataaccagttgtcatgc

SEQ ID NO: 7791503 - DNA, 22 bp, Homo sapiens
gatggcctgtatttgggccaga

SEQ ID NO: 7791504 - DNA, 22 bp, Homo sapiens
gatggcctcatggctgcaggcc

SEQ ID NO: 7791505 - DNA, 22 bp, Homo sapiens
gccagtgtgcaagaggccacca

SEQ ID NO: 7791506 - DNA, 22 bp, Homo sapiens
gccagtggtagaggggaggccg

SEQ ID NO: 7791507 - DNA, 22 bp, Homo sapiens
gccagtggtcactgaggaagaa

SEQ ID NO: 7791508 - DNA, 22 bp, Homo sapiens
gcccaggaggtcaagtagctat

SEQ ID NO: 7791509 - DNA, 21 bp, Homo sapiens
gcctgggatagtggcctccgg

SEQ ID NO: 7791510 - DNA, 22 bp, Homo sapiens
gcctgggaaatggtggggtcag

SEQ ID NO: 7791511 - DNA, 22 bp, Homo sapiens
gcctggcaggcctgggccagca

SEQ ID NO: 7791512 - DNA, 22 bp, Homo sapiens
gcctgctgttaactgcaggaat

SEQ ID NO: 7791513 - DNA, 22 bp, Homo sapiens
gcctgccttcggtgcgcagcgg

SEQ ID NO: 7791514 - DNA, 22 bp, Homo sapiens
gctgggcaagtgccttgggttt

SEQ ID NO: 7791515 - DNA, 22 bp, Homo sapiens
gctgggcacctctcccagattg

SEQ ID NO: 7791516 - DNA, 22 bp, Homo sapiens
gctgggcactgtcccataggct

SEQ ID NO: 7791517 - DNA, 22 bp, Homo sapiens
gctgggagttactgtctccttt

SEQ ID NO: 7791518 - DNA, 22 bp, Homo sapiens
gctggccagtgtcccagggatc

SEQ ID NO: 7791519 - DNA, 18 bp, Homo sapiens
gctcatttggatgggctt

SEQ ID NO: 7791520 - DNA, 22 bp, Homo sapiens
gctcatttcttctttccacaat

SEQ ID NO: 7791521 - DNA, 22 bp, Homo sapiens
gggcctgtctcactccctggtt

SEQ ID NO: 7791522 - DNA, 22 bp, Homo sapiens
gggaagagaccgtaccctggcc

SEQ ID NO: 7791523 - DNA, 22 bp, Homo sapiens
gggaaaggatcagtgggaggct

SEQ ID NO: 7791524 - DNA, 22 bp, Homo sapiens
ggccagagaagtcagacccttg

SEQ ID NO: 7791525 - DNA, 22 bp, Homo sapiens
ggccatggtggtttgagcacct

SEQ ID NO: 7791526 - DNA, 22 bp, Homo sapiens
gctgggctgagctagacttggc

SEQ ID NO: 7791527 - DNA, 22 bp, Homo sapiens
gcttaattctggctcagtttcc

SEQ ID NO: 7791528 - DNA, 22 bp, Homo sapiens
gctgggctggaaggccaaggca

SEQ ID NO: 7791529 - DNA, 22 bp, Homo sapiens
ggaactgattaagtcatgagaa

SEQ ID NO: 7791530 - DNA, 22 bp, Homo sapiens
ggagggctgccaggtggagcgg

SEQ ID NO: 7791531 - DNA, 22 bp, Homo sapiens
ggagggctgtagaggagacctg

SEQ ID NO: 7791532 - DNA, 18 bp, Homo sapiens
ggagggctttggggactg

SEQ ID NO: 7791533 - DNA, 22 bp, Homo sapiens
ggaggtgggctaaggactctct

SEQ ID NO: 7791534 - DNA, 22 bp, Homo sapiens
ggcaaggcctgcagctcagtgt

SEQ ID NO: 7791535 - DNA, 22 bp, Homo sapiens
ggcaaggccaggcctccaagac

SEQ ID NO: 7791536 - DNA, 22 bp, Homo sapiens
gtggcctgccgcaccccaatat

SEQ ID NO: 7791537 - DNA, 22 bp, Homo sapiens
gtgggagctgcggaggcctggg

SEQ ID NO: 7791538 - DNA, 22 bp, Homo sapiens
gtgggagctgctacctccttcc

SEQ ID NO: 7791539 - DNA, 22 bp, Homo sapiens
gtgggagcttcatcaagcagtt

SEQ ID NO: 7791540 - DNA, 22 bp, Homo sapiens
gtgggagctttggcatcaggct

SEQ ID NO: 7791541 - DNA, 22 bp, Homo sapiens
gtgggagccatttccagtatgc

SEQ ID NO: 7791542 - DNA, 22 bp, Homo sapiens
gtgggagccctcagggaggtgc

SEQ ID NO: 7791543 - DNA, 22 bp, Homo sapiens
gtgggagcatggtcccagtgcc

SEQ ID NO: 7791544 - DNA, 22 bp, Homo sapiens
gtggcactaaatacagcatttc

SEQ ID NO: 7791545 - DNA, 22 bp, Homo sapiens
ggtgtcctacagggccgcaggc

SEQ ID NO: 7791546 - DNA, 23 bp, Homo sapiens
gtcagcttgaccagtggagagtc

SEQ ID NO: 7791547 - DNA, 21 bp, Homo sapiens
gtccagtggaggaggacagga

SEQ ID NO: 7791548 - DNA, 22 bp, Homo sapiens
gtgtgtccctcctctcctgagt

SEQ ID NO: 7791549 - DNA, 22 bp, Homo sapiens
gtggggctggaagatgggtact

SEQ ID NO: 7791550 - DNA, 22 bp, Homo sapiens
gtggtcagcagcagtgggagtg

SEQ ID NO: 7791551 - DNA, 22 bp, Homo sapiens
gtggtcatcattagtattatta

SEQ ID NO: 7791552 - DNA, 22 bp, Homo sapiens
gtggtcaggcagtgggagagaa

SEQ ID NO: 7791553 - DNA, 22 bp, Homo sapiens
gtgggggtggaaaggcaagttg

SEQ ID NO: 7791554 - DNA, 18 bp, Homo sapiens
gtggggtgttgtgaggat

SEQ ID NO: 7791555 - DNA, 22 bp, Homo sapiens
gtggtcatgttaattatgatcc

SEQ ID NO: 7791556 - DNA, 22 bp, Homo sapiens
gtggtcatttgtctgagctcca

SEQ ID NO: 7791557 - DNA, 22 bp, Homo sapiens
gtggtcatctaactaaattttc

SEQ ID NO: 7791558 - DNA, 22 bp, Homo sapiens
gtggtcatctgggtttgtggca

SEQ ID NO: 7791559 - DNA, 22 bp, Homo sapiens
gtggtcatggaaggtcctacct

SEQ ID NO: 7791560 - DNA, 22 bp, Homo sapiens
taaaggctttattttccagtca

SEQ ID NO: 7791561 - DNA, 22 bp, Homo sapiens
taagaacaagatgttcctgttt

SEQ ID NO: 7791562 - DNA, 22 bp, Homo sapiens
tctggattgtggctattgttct

SEQ ID NO: 7791563 - DNA, 22 bp, Homo sapiens
tctggactataggctgccaagt

SEQ ID NO: 7791564 - DNA, 22 bp, Homo sapiens
tctgctctgtggcttcagctaa

SEQ ID NO: 7791565 - DNA, 22 bp, Homo sapiens
tctgggagtgggtccaaggaat

SEQ ID NO: 7791566 - DNA, 22 bp, Homo sapiens
tctgggagttgtagtccggtgg

SEQ ID NO: 7791567 - DNA, 22 bp, Homo sapiens
tctgggaggtggcagggtgcat

SEQ ID NO: 7791568 - DNA, 22 bp, Homo sapiens
tctgggaggtactgggaggtgt

SEQ ID NO: 7791569 - DNA, 22 bp, Homo sapiens
tctgggagagcacgtggctgac

SEQ ID NO: 7791570 - DNA, 22 bp, Homo sapiens
tctgggagacgtgtgttgtcag

SEQ ID NO: 7791571 - DNA, 22 bp, Homo sapiens
tctgggagaagctgatgtgaag

SEQ ID NO: 7791572 - DNA, 22 bp, Homo sapiens
tctgggagtttctgtgggagct

SEQ ID NO: 7791573 - DNA, 22 bp, Homo sapiens
tctggcttttctcttggatggt

SEQ ID NO: 7791574 - DNA, 22 bp, Homo sapiens
tctgcctgttcccgattccatg

SEQ ID NO: 7791575 - DNA, 22 bp, Homo sapiens
tctgcatggagaggagatgcta

SEQ ID NO: 7791576 - DNA, 22 bp, Homo sapiens
tctgatttatatatgcagatac

SEQ ID NO: 7791577 - DNA, 22 bp, Homo sapiens
tctgattacttgagttatttag

SEQ ID NO: 7791578 - DNA, 23 bp, Homo sapiens
tctgggttctaatcatgtgtgat

SEQ ID NO: 7791579 - DNA, 22 bp, Homo sapiens
tctgggttgggttcctggaatt

SEQ ID NO: 7791580 - DNA, 22 bp, Homo sapiens
tcttctccagttcatcctacca

SEQ ID NO: 7791581 - DNA, 22 bp, Homo sapiens
tcttctccagttcatcctacca

SEQ ID NO: 7791582 - DNA, 22 bp, Homo sapiens
tcttcctctctaattgatcaga

SEQ ID NO: 7791583 - DNA, 22 bp, Homo sapiens
tctttatttaagtctgttgtaa

SEQ ID NO: 7791584 - DNA, 22 bp, Homo sapiens
tctttccttagaataattcttt

SEQ ID NO: 7791585 - DNA, 22 bp, Homo sapiens
tctttcctaggtgatatgcaat

SEQ ID NO: 7791586 - DNA, 22 bp, Homo sapiens
tcttgggatagtgtctcatggc

SEQ ID NO: 7791587 - DNA, 22 bp, Homo sapiens
tcttgggaagcccatttccacc

SEQ ID NO: 7791588 - DNA, 22 bp, Homo sapiens
tcttgggaccatttacacatac

SEQ ID NO: 7791589 - DNA, 22 bp, Homo sapiens
tcttgggaaataaacagattga

SEQ ID NO: 7791590 - DNA, 22 bp, Homo sapiens
tcttgggaaatgtttgcgagct

SEQ ID NO: 7791591 - DNA, 22 bp, Homo sapiens
tcttgggatcacctcctggctt

SEQ ID NO: 7791592 - DNA, 22 bp, Homo sapiens
tcttgggatctcttcaccacct

SEQ ID NO: 7791593 - DNA, 22 bp, Homo sapiens
tctcattttgagtcagacacta

SEQ ID NO: 7791594 - DNA, 22 bp, Homo sapiens
tctcctgtgcaccctccctgtg

SEQ ID NO: 7791595 - DNA, 22 bp, Homo sapiens
tctcctgtcttctcagcacccc

SEQ ID NO: 7791596 - DNA, 20 bp, Homo sapiens
tctcccaggctcagggaaga

SEQ ID NO: 7791597 - DNA, 17 bp, Homo sapiens
tctctttccctttctgc

SEQ ID NO: 7791598 - DNA, 17 bp, Homo sapiens
tctctttccctttctgc

SEQ ID NO: 7791599 - DNA, 18 bp, Homo sapiens
tctctttcctcagtggag

SEQ ID NO: 7791600 - DNA, 22 bp, Homo sapiens
tctctttctttgtatgtctatt

SEQ ID NO: 7791601 - DNA, 22 bp, Homo sapiens
tctctttctttgtatgtctatt

SEQ ID NO: 7791602 - DNA, 21 bp, Homo sapiens
tctctttctggaagcttccct

SEQ ID NO: 7791603 - DNA, 19 bp, Homo sapiens
tctcttctccctggtttta

SEQ ID NO: 7791604 - DNA, 22 bp, Homo sapiens
tctcttccttgacctattgtaa

SEQ ID NO: 7791605 - DNA, 22 bp, Homo sapiens
tctcttccagtggctttgattt

SEQ ID NO: 7791606 - DNA, 21 bp, Homo sapiens
tctctcctcaagctcgacccc

SEQ ID NO: 7791607 - DNA, 22 bp, Homo sapiens
tctctcctgtgttctgatgttt

SEQ ID NO: 7791608 - DNA, 22 bp, Homo sapiens
tctctcctgcactgaattatgt

SEQ ID NO: 7791609 - DNA, 22 bp, Homo sapiens
tccttgggaaatcactagcact

SEQ ID NO: 7791610 - DNA, 19 bp, Homo sapiens
tctaggagatctgaacctt

SEQ ID NO: 7791611 - DNA, 22 bp, Homo sapiens
tctagggttgaggccacaggga

SEQ ID NO: 7791612 - DNA, 22 bp, Homo sapiens
taagaacataaattcatacggg

SEQ ID NO: 7791613 - DNA, 21 bp, Homo sapiens
taagaacattatcttcttcct

SEQ ID NO: 7791614 - DNA, 22 bp, Homo sapiens
taagaacagtgtctgtctcaca

SEQ ID NO: 7791615 - DNA, 23 bp, Homo sapiens
taagaacagacaagcatttacat

SEQ ID NO: 7791616 - DNA, 22 bp, Homo sapiens
taagaacagataaagtttcccc

SEQ ID NO: 7791617 - DNA, 22 bp, Homo sapiens
taagacaaatactatttcaaga

SEQ ID NO: 7791618 - DNA, 22 bp, Homo sapiens
tcctgcttgaaactctgccttc

SEQ ID NO: 7791619 - DNA, 19 bp, Homo sapiens
tgcctggagcataacaggc

SEQ ID NO: 7791620 - DNA, 22 bp, Homo sapiens
tgcccagggataagcctagaga

SEQ ID NO: 7791621 - DNA, 19 bp, Homo sapiens
tgcccaggccaggttgggc

SEQ ID NO: 7791622 - DNA, 19 bp, Homo sapiens
tgcatccaaagccccacca

SEQ ID NO: 7791623 - DNA, 22 bp, Homo sapiens
tgcatgaaatattttctgtagg

SEQ ID NO: 7791624 - DNA, 22 bp, Homo sapiens
tgcagagggacagccacagctc

SEQ ID NO: 7791625 - DNA, 21 bp, Homo sapiens
tgcagaggcacaaacaagccc

SEQ ID NO: 7791626 - DNA, 23 bp, Homo sapiens
tgattcagaaggttgttattgct

SEQ ID NO: 7791627 - DNA, 22 bp, Homo sapiens
tgattctgtctccttcactccg

SEQ ID NO: 7791628 - DNA, 22 bp, Homo sapiens
tgattctgttctccttgagaat

SEQ ID NO: 7791629 - DNA, 21 bp, Homo sapiens
tgattctgttttatcatcagc

SEQ ID NO: 7791630 - DNA, 22 bp, Homo sapiens
tgcaacagactttattaactct

SEQ ID NO: 7791631 - DNA, 22 bp, Homo sapiens
tgaggcacaggcagtgcccccg

SEQ ID NO: 7791632 - DNA, 22 bp, Homo sapiens
tgaggcactccaggatgctgtt

SEQ ID NO: 7791633 - DNA, 22 bp, Homo sapiens
tgaggagcttctggaaagtgca

SEQ ID NO: 7791634 - DNA, 19 bp, Homo sapiens
tgaggagcagctggttgat

SEQ ID NO: 7791635 - DNA, 23 bp, Homo sapiens
tgaggagcatagctgactgacag

SEQ ID NO: 7791636 - DNA, 22 bp, Homo sapiens
tgaggatggcagtgtgctcagc

SEQ ID NO: 7791637 - DNA, 22 bp, Homo sapiens
tgagccaggttaagacaggagc

SEQ ID NO: 7791638 - DNA, 22 bp, Homo sapiens
tgagcctggggcctgggcagcg

SEQ ID NO: 7791639 - DNA, 22 bp, Homo sapiens
tgagccagagtggagtgtgcct

SEQ ID NO: 7791640 - DNA, 22 bp, Homo sapiens
tgagccagaggaggctgtgtgg

SEQ ID NO: 7791641 - DNA, 22 bp, Homo sapiens
tgagccagataagggctcacgc

SEQ ID NO: 7791642 - DNA, 22 bp, Homo sapiens
tgagcagggagctgggctgagc

SEQ ID NO: 7791643 - DNA, 22 bp, Homo sapiens
tgagccaggctccatgccacct

SEQ ID NO: 7791644 - DNA, 22 bp, Homo sapiens
tgagccaggctcaagtgatcct

SEQ ID NO: 7791645 - DNA, 22 bp, Homo sapiens
tgagccagcaggcctccagtgg

SEQ ID NO: 7791646 - DNA, 22 bp, Homo sapiens
tgagccagcctcagaagtcacg

SEQ ID NO: 7791647 - DNA, 22 bp, Homo sapiens
tgagccagccttgcagctgtgc

SEQ ID NO: 7791648 - DNA, 22 bp, Homo sapiens
tgagccaggcactgctcctgga

SEQ ID NO: 7791649 - DNA, 22 bp, Homo sapiens
tgagcacaagtttgcatgtgtg

SEQ ID NO: 7791650 - DNA, 22 bp, Homo sapiens
tgagagaggatgccctcatatt

SEQ ID NO: 7791651 - DNA, 22 bp, Homo sapiens
tgagatgtaaggtatgcttact

SEQ ID NO: 7791652 - DNA, 20 bp, Homo sapiens
tgagatttgtattataagtc

SEQ ID NO: 7791653 - DNA, 22 bp, Homo sapiens
tgactctggcttcaagtttctt

SEQ ID NO: 7791654 - DNA, 22 bp, Homo sapiens
tgactctgaatttatgaaatgg

SEQ ID NO: 7791655 - DNA, 22 bp, Homo sapiens
tgactctgaattgggaaatggg

SEQ ID NO: 7791656 - DNA, 19 bp, Homo sapiens
tgactctgtggaacagaag

SEQ ID NO: 7791657 - DNA, 21 bp, Homo sapiens
tgaactctggtcatcttcatt

SEQ ID NO: 7791658 - DNA, 22 bp, Homo sapiens
tgaactatacgataacatgatt

SEQ ID NO: 7791659 - DNA, 22 bp, Homo sapiens
tgaagcaggaaccagcagcatt

SEQ ID NO: 7791660 - DNA, 22 bp, Homo sapiens
tggccttgagagatcaaaaggt

SEQ ID NO: 7791661 - DNA, 22 bp, Homo sapiens
tggccttggacagagcgctcct

SEQ ID NO: 7791662 - DNA, 20 bp, Homo sapiens
tggccttggggagctcacac

SEQ ID NO: 7791663 - DNA, 22 bp, Homo sapiens
tggccttggcagtgagaagagt

SEQ ID NO: 7791664 - DNA, 22 bp, Homo sapiens
tggcgagccccgactgagtgtt

SEQ ID NO: 7791665 - DNA, 22 bp, Homo sapiens
tggctctgtgtctcccagcagc

SEQ ID NO: 7791666 - DNA, 19 bp, Homo sapiens
tggctctgtttctctggag

SEQ ID NO: 7791667 - DNA, 21 bp, Homo sapiens
tggctgagccaggtgtgtgga

SEQ ID NO: 7791668 - DNA, 20 bp, Homo sapiens
tgggagctggtgaggtctca

SEQ ID NO: 7791669 - DNA, 22 bp, Homo sapiens
tgggagcaccttgagggcagaa

SEQ ID NO: 7791670 - DNA, 22 bp, Homo sapiens
tgggagcaagctggtgctggag

SEQ ID NO: 7791671 - DNA, 22 bp, Homo sapiens
tgggagcaccctgaggagcttc

SEQ ID NO: 7791672 - DNA, 22 bp, Homo sapiens
tgggagcagccaacatggcctt

SEQ ID NO: 7791673 - DNA, 22 bp, Homo sapiens
tgggagcagcagggagatgcgg

SEQ ID NO: 7791674 - DNA, 22 bp, Homo sapiens
tgggagcagctttgcgagggag

SEQ ID NO: 7791675 - DNA, 22 bp, Homo sapiens
tgggagcagcctcagcttcggg

SEQ ID NO: 7791676 - DNA, 22 bp, Homo sapiens
tgggagcaggaagcaggaagta

SEQ ID NO: 7791677 - DNA, 22 bp, Homo sapiens
tgggagcaagctacttagggaa

SEQ ID NO: 7791678 - DNA, 22 bp, Homo sapiens
tgggagcaaatgactgggagat

SEQ ID NO: 7791679 - DNA, 21 bp, Homo sapiens
tgggagagggctcagctaccc

SEQ ID NO: 7791680 - DNA, 22 bp, Homo sapiens
tgggaaggtacacgggaaagag

SEQ ID NO: 7791681 - DNA, 22 bp, Homo sapiens
tgggaatgctgatttcaggaac

SEQ ID NO: 7791682 - DNA, 23 bp, Homo sapiens
tgggaatgacatctagagcagag

SEQ ID NO: 7791683 - DNA, 22 bp, Homo sapiens
tgggacagttgtcctccactct

SEQ ID NO: 7791684 - DNA, 21 bp, Homo sapiens
tgggacagtgatggctcctcc

SEQ ID NO: 7791685 - DNA, 22 bp, Homo sapiens
tgggaactctctgggaggcatc

SEQ ID NO: 7791686 - DNA, 22 bp, Homo sapiens
tggctgggccgggccttgtgcc

SEQ ID NO: 7791687 - DNA, 22 bp, Homo sapiens
tggctgtgggatgagagcctca

SEQ ID NO: 7791688 - DNA, 22 bp, Homo sapiens
tggctgtgtcatcatagctgtg

SEQ ID NO: 7791689 - DNA, 22 bp, Homo sapiens
tggctgtggactcagatggctc

SEQ ID NO: 7791690 - DNA, 22 bp, Homo sapiens
tggctgtgaacaaagagaataa

SEQ ID NO: 7791691 - DNA, 22 bp, Homo sapiens
tggctgtgttaccacttcatgt

SEQ ID NO: 7791692 - DNA, 22 bp, Homo sapiens
tggcagctgaatggctggatgg

SEQ ID NO: 7791693 - DNA, 22 bp, Homo sapiens
tggcagggcctgaatcttatac

SEQ ID NO: 7791694 - DNA, 22 bp, Homo sapiens
tggcagctccgggtaggggctg

SEQ ID NO: 7791695 - DNA, 22 bp, Homo sapiens
tggcagccatctgagggtgggg

SEQ ID NO: 7791696 - DNA, 22 bp, Homo sapiens
tggcagcagggcccctggagga

SEQ ID NO: 7791697 - DNA, 22 bp, Homo sapiens
tggcagcagacatctgaggtct

SEQ ID NO: 7791698 - DNA, 22 bp, Homo sapiens
tggcaaccaggtggtctagggt

SEQ ID NO: 7791699 - DNA, 22 bp, Homo sapiens
tggcacatagaaaaggatcaat

SEQ ID NO: 7791700 - DNA, 22 bp, Homo sapiens
tggcacatggtaagactcagta

SEQ ID NO: 7791701 - DNA, 22 bp, Homo sapiens
tggcaccctgaagttggtcact

SEQ ID NO: 7791702 - DNA, 22 bp, Homo sapiens
tggcactgaaaaaggagaggtt

SEQ ID NO: 7791703 - DNA, 22 bp, Homo sapiens
tggcactgaagctggaaagcct

SEQ ID NO: 7791704 - DNA, 22 bp, Homo sapiens
tggcactgggacagatgctctc

SEQ ID NO: 7791705 - DNA, 22 bp, Homo sapiens
tggcactgggatgctactgtta

SEQ ID NO: 7791706 - DNA, 22 bp, Homo sapiens
tggcactggcgcaggatggcgg

SEQ ID NO: 7791707 - DNA, 21 bp, Homo sapiens
tggcactgcttagcaggttcc

SEQ ID NO: 7791708 - DNA, 22 bp, Homo sapiens
tggcactgaccccaggcctgtg

SEQ ID NO: 7791709 - DNA, 22 bp, Homo sapiens
tggcactgccaacctgctaggt

SEQ ID NO: 7791710 - DNA, 22 bp, Homo sapiens
tggcactgcactttaagattta

SEQ ID NO: 7791711 - DNA, 22 bp, Homo sapiens
tggcagtcccctgtgcctggaa

SEQ ID NO: 7791712 - DNA, 22 bp, Homo sapiens
tggcagtctgggttggcagtta

SEQ ID NO: 7791713 - DNA, 22 bp, Homo sapiens
tggcagtcattatcgctgagtc

SEQ ID NO: 7791714 - DNA, 22 bp, Homo sapiens
tggccacatgcgtctgtgaggc

SEQ ID NO: 7791715 - DNA, 22 bp, Homo sapiens
tggccagtagataggcaggcaa

SEQ ID NO: 7791716 - DNA, 22 bp, Homo sapiens
tggccctgaatcaaggccagca

SEQ ID NO: 7791717 - DNA, 23 bp, Homo sapiens
tggccctgaatctgtcctggagg

SEQ ID NO: 7791718 - DNA, 22 bp, Homo sapiens
tggccctgcacccagagcagtt

SEQ ID NO: 7791719 - DNA, 22 bp, Homo sapiens
tggccctgaggacccagtgtgg

SEQ ID NO: 7791720 - DNA, 22 bp, Homo sapiens
tggccctgactgatgtggaggg

SEQ ID NO: 7791721 - DNA, 22 bp, Homo sapiens
tggccggggctgatggacagtg

SEQ ID NO: 7791722 - DNA, 22 bp, Homo sapiens
tggcctctggctgaggactaac

SEQ ID NO: 7791723 - DNA, 22 bp, Homo sapiens
tggagaagtcaaagtgaacagg

SEQ ID NO: 7791724 - DNA, 22 bp, Homo sapiens
tggagccagcaggactcagagg

SEQ ID NO: 7791725 - DNA, 22 bp, Homo sapiens
tggaagggagtgacagtcagag

SEQ ID NO: 7791726 - DNA, 22 bp, Homo sapiens
tggaagggggaagacagctctg

SEQ ID NO: 7791727 - DNA, 22 bp, Homo sapiens
tgcgcggctcagtcatctccag

SEQ ID NO: 7791728 - DNA, 22 bp, Homo sapiens
tgcctgtgggcagagggccaga

SEQ ID NO: 7791729 - DNA, 22 bp, Homo sapiens
tgcctgggtgctggctggtcac

SEQ ID NO: 7791730 - DNA, 22 bp, Homo sapiens
tgctgcttttagttggatagaa

SEQ ID NO: 7791731 - DNA, 22 bp, Homo sapiens
tgcttctgattcatggttattg

SEQ ID NO: 7791732 - DNA, 22 bp, Homo sapiens
tgtaactataaaattaattgct

SEQ ID NO: 7791733 - DNA, 22 bp, Homo sapiens
tgtaactaagcacattatctaa

SEQ ID NO: 7791734 - DNA, 22 bp, Homo sapiens
tggttttaaaagatgtttgaga

SEQ ID NO: 7791735 - DNA, 22 bp, Homo sapiens
tggtgagctctttagactggga

SEQ ID NO: 7791736 - DNA, 22 bp, Homo sapiens
tggtgagctctggcagtctgtg

SEQ ID NO: 7791737 - DNA, 22 bp, Homo sapiens
tggtgagcgatgctgcatgttc

SEQ ID NO: 7791738 - DNA, 22 bp, Homo sapiens
tggtcataacatgattagtagg

SEQ ID NO: 7791739 - DNA, 17 bp, Homo sapiens
tggtcattttaatttta

SEQ ID NO: 7791740 - DNA, 22 bp, Homo sapiens
tggtcattgctattgtttctca

SEQ ID NO: 7791741 - DNA, 22 bp, Homo sapiens
tgggtgcatgtgagcacgtgca

SEQ ID NO: 7791742 - DNA, 22 bp, Homo sapiens
tgggggtgaaagtctggacagt

SEQ ID NO: 7791743 - DNA, 22 bp, Homo sapiens
tgggggtgactatctcgggaat

SEQ ID NO: 7791744 - DNA, 21 bp, Homo sapiens
tgggggtgaggcctaggaatc

SEQ ID NO: 7791745 - DNA, 23 bp, Homo sapiens
tggggttgaattgtagctgtgcc

SEQ ID NO: 7791746 - DNA, 22 bp, Homo sapiens
tggggttgaagaaaggatctag

SEQ ID NO: 7791747 - DNA, 22 bp, Homo sapiens
tggggatgtcatataagaggaa

SEQ ID NO: 7791748 - DNA, 22 bp, Homo sapiens
tggggagtgatgcctcggataa

SEQ ID NO: 7791749 - DNA, 22 bp, Homo sapiens
tggggcacttatgatgtgccac

SEQ ID NO: 7791750 - DNA, 22 bp, Homo sapiens
tggggcgcgaggtcctggctcc

SEQ ID NO: 7791751 - DNA, 22 bp, Homo sapiens
tgggggcatggaccagcctggc

SEQ ID NO: 7791752 - DNA, 22 bp, Homo sapiens
tgggcagggagctggaaccaca

SEQ ID NO: 7791753 - DNA, 19 bp, Homo sapiens
tgggcagctccctctgtcc

SEQ ID NO: 7791754 - DNA, 22 bp, Homo sapiens
tgggcagcttccacttagttag

SEQ ID NO: 7791755 - DNA, 22 bp, Homo sapiens
tgggcaggggccctgcttccgt

SEQ ID NO: 7791756 - DNA, 22 bp, Homo sapiens
tgggcagggatctcttttgcaa

SEQ ID NO: 7791757 - DNA, 22 bp, Homo sapiens
tgggagtcagacagcctgagat

SEQ ID NO: 7791758 - DNA, 18 bp, Homo sapiens
tgggcacaatgaacagca

SEQ ID NO: 7791759 - DNA, 22 bp, Homo sapiens
tgggcacactgaatctgctatt

SEQ ID NO: 7791760 - DNA, 22 bp, Homo sapiens
tgtctaggttgcggttttatgt

SEQ ID NO: 7791761 - DNA, 22 bp, Homo sapiens
tgtctaggggcaggggtttgaa

SEQ ID NO: 7791762 - DNA, 20 bp, Homo sapiens
tgtctgctgagctgctgccc

SEQ ID NO: 7791763 - DNA, 22 bp, Homo sapiens
tgtgctcatggtccagcatggt

SEQ ID NO: 7791764 - DNA, 22 bp, Homo sapiens
tgtgcagagcccacaggcagct

SEQ ID NO: 7791765 - DNA, 22 bp, Homo sapiens
tgtgcacatatactcatattcc

SEQ ID NO: 7791766 - DNA, 22 bp, Homo sapiens
tgttgtactcaacagatgaatt

SEQ ID NO: 7791767 - DNA, 18 bp, Homo sapiens
tgtttatttttctcttac

SEQ ID NO: 7791768 - DNA, 20 bp, Homo sapiens
tgtgggcccttggctggcaa

SEQ ID NO: 7791769 - DNA, 22 bp, Homo sapiens
ttcagctcagcactgacaagat

SEQ ID NO: 7791770 - DNA, 21 bp, Homo sapiens
ttcagctctgcttcagggaat

SEQ ID NO: 7791771 - DNA, 22 bp, Homo sapiens
ttatttgaatgatggcacaatt

SEQ ID NO: 7791772 - DNA, 19 bp, Homo sapiens
ttattctgtcagagcacac

SEQ ID NO: 7791773 - DNA, 22 bp, Homo sapiens
ttattcatcagtgcattaattt

SEQ ID NO: 7791774 - DNA, 21 bp, Homo sapiens
ttattctgagatgagattctt

SEQ ID NO: 7791775 - DNA, 22 bp, Homo sapiens
actgtggggggctttgctcagt

SEQ ID NO: 7791776 - DNA, 22 bp, Homo sapiens
actgtgggagcgcagtggcagc

SEQ ID NO: 7791777 - DNA, 22 bp, Homo sapiens
actcatcagtggttttaatcaa

SEQ ID NO: 7791778 - DNA, 22 bp, Homo sapiens
accttggggtgatgctgaaaga

SEQ ID NO: 7791779 - DNA, 19 bp, Homo sapiens
accttgggcaagtgccttc

SEQ ID NO: 7791780 - DNA, 22 bp, Homo sapiens
accttgggcaagttggaaactg

SEQ ID NO: 7791781 - DNA, 22 bp, Homo sapiens
acagaacagagggttttagaat

SEQ ID NO: 7791782 - DNA, 22 bp, Homo sapiens
acagaacatggatttttgaagt

SEQ ID NO: 7791783 - DNA, 22 bp, Homo sapiens
acagaacatattgcttctctca

SEQ ID NO: 7791784 - DNA, 22 bp, Homo sapiens
agcccaggtctggcccagcctg

SEQ ID NO: 7791785 - DNA, 22 bp, Homo sapiens
agcagctgagccccagctgtga

SEQ ID NO: 7791786 - DNA, 22 bp, Homo sapiens
agcaggaacgagttcatgggga

SEQ ID NO: 7791787 - DNA, 22 bp, Homo sapiens
aattcagttgacagctaatgcc

SEQ ID NO: 7791788 - DNA, 22 bp, Homo sapiens
aattttgttcttggaaatcagg

SEQ ID NO: 7791789 - DNA, 22 bp, Homo sapiens
agagggctgctgcacagtgctc

SEQ ID NO: 7791790 - DNA, 22 bp, Homo sapiens
aagcatggtggatgatacagtg

SEQ ID NO: 7791791 - DNA, 22 bp, Homo sapiens
aagccaatggattggttgcttt

SEQ ID NO: 7791792 - DNA, 22 bp, Homo sapiens
aagaggagaaaggctggctttg

SEQ ID NO: 7791793 - DNA, 22 bp, Homo sapiens
aactgacttagccagtggagct

SEQ ID NO: 7791794 - DNA, 22 bp, Homo sapiens
aactgacagcaggaaccattcc

SEQ ID NO: 7791795 - DNA, 22 bp, Homo sapiens
aaaggccttgagctgggtgcca

SEQ ID NO: 7791796 - DNA, 22 bp, Homo sapiens
acagaagaaagggaggttttgc

SEQ ID NO: 7791797 - DNA, 22 bp, Homo sapiens
acagaagagctggctctgtgct

SEQ ID NO: 7791798 - DNA, 19 bp, Homo sapiens
aagagggaaagtgctatgc

SEQ ID NO: 7791799 - DNA, 22 bp, Homo sapiens
aagccatgcaagccacaaggtg

SEQ ID NO: 7791800 - DNA, 22 bp, Homo sapiens
aagccatggcatgccaggatca

SEQ ID NO: 7791801 - DNA, 22 bp, Homo sapiens
aagccatggctgcatcagcctg

SEQ ID NO: 7791802 - DNA, 22 bp, Homo sapiens
aagccatggtagaaaactcagt

SEQ ID NO: 7791803 - DNA, 22 bp, Homo sapiens
aaggaaacagaggatgaccttg

SEQ ID NO: 7791804 - DNA, 22 bp, Homo sapiens
agatcacataatttcctgtgac

SEQ ID NO: 7791805 - DNA, 22 bp, Homo sapiens
agatggcaggccctgtgggggt

SEQ ID NO: 7791806 - DNA, 22 bp, Homo sapiens
agcaacaggaaatagctgatta

SEQ ID NO: 7791807 - DNA, 22 bp, Homo sapiens
agcaacagccctgaggttcatg

SEQ ID NO: 7791808 - DNA, 22 bp, Homo sapiens
attttatctgcttactttcagg

SEQ ID NO: 7791809 - DNA, 22 bp, Homo sapiens
attttagtacctcaagtatcca

SEQ ID NO: 7791810 - DNA, 22 bp, Homo sapiens
agaggcacagaggcagtcccct

SEQ ID NO: 7791811 - DNA, 22 bp, Homo sapiens
attacagattataaatttgagc

SEQ ID NO: 7791812 - DNA, 22 bp, Homo sapiens
attacagatagactttgaagct

SEQ ID NO: 7791813 - DNA, 22 bp, Homo sapiens
attacagaaagcaatattgagt

SEQ ID NO: 7791814 - DNA, 23 bp, Homo sapiens
agaggccagcctttggagacacc

SEQ ID NO: 7791815 - DNA, 22 bp, Homo sapiens
agagggcttccctaggagtgag

SEQ ID NO: 7791816 - DNA, 22 bp, Homo sapiens
agagggctgggatgtgctgtgt

SEQ ID NO: 7791817 - DNA, 22 bp, Homo sapiens
agagggctggacgcaggttgga

SEQ ID NO: 7791818 - DNA, 22 bp, Homo sapiens
agagtcaccaaagtaaaacagt

SEQ ID NO: 7791819 - DNA, 22 bp, Homo sapiens
atgaagggaatataagtgctgc

SEQ ID NO: 7791820 - DNA, 21 bp, Homo sapiens
atctgcttaggtttgttcaga

SEQ ID NO: 7791821 - DNA, 22 bp, Homo sapiens
atctgcttcctccttagggaaa

SEQ ID NO: 7791822 - DNA, 22 bp, Homo sapiens
atgaggcttaaactgctgcaac

SEQ ID NO: 7791823 - DNA, 22 bp, Homo sapiens
agagcctgaggccctgagaggg

SEQ ID NO: 7791824 - DNA, 22 bp, Homo sapiens
agagctggctgctgcggtgctt

SEQ ID NO: 7791825 - DNA, 22 bp, Homo sapiens
agagagcctgagtggcagctat

SEQ ID NO: 7791826 - DNA, 22 bp, Homo sapiens
agcagctatttcttccagagag

SEQ ID NO: 7791827 - DNA, 19 bp, Homo sapiens
agcagctggaggtggagtg

SEQ ID NO: 7791828 - DNA, 21 bp, Homo sapiens
agcagctgggcaacatggagg

SEQ ID NO: 7791829 - DNA, 22 bp, Homo sapiens
agcacctgcttgtgactaggga

SEQ ID NO: 7791830 - DNA, 22 bp, Homo sapiens
cactgtggggtttggctggaac

SEQ ID NO: 7791831 - DNA, 22 bp, Homo sapiens
agcagtagtgatggcccctgag

SEQ ID NO: 7791832 - DNA, 20 bp, Homo sapiens
agcagtaggacctctgggcc

SEQ ID NO: 7791833 - DNA, 22 bp, Homo sapiens
agcaggaactgacaccaagcca

SEQ ID NO: 7791834 - DNA, 22 bp, Homo sapiens
agcaggaaggggcctagcctgg

SEQ ID NO: 7791835 - DNA, 22 bp, Homo sapiens
agcaggaaggggatgatgggca

SEQ ID NO: 7791836 - DNA, 22 bp, Homo sapiens
caccagagtgggtgagggtgat

SEQ ID NO: 7791837 - DNA, 22 bp, Homo sapiens
cagagacccctggcatggtggt

SEQ ID NO: 7791838 - DNA, 22 bp, Homo sapiens
cagagaccctaggcaggtgaca

SEQ ID NO: 7791839 - DNA, 20 bp, Homo sapiens
cagagaccaggccaggtgtc

SEQ ID NO: 7791840 - DNA, 22 bp, Homo sapiens
cagagacattaagtgccatgat

SEQ ID NO: 7791841 - DNA, 22 bp, Homo sapiens
agcccaggttgaggctgcagtg

SEQ ID NO: 7791842 - DNA, 22 bp, Homo sapiens
cagatggctgccaagatgggct

SEQ ID NO: 7791843 - DNA, 22 bp, Homo sapiens
cagatggcagggcagctctgca

SEQ ID NO: 7791844 - DNA, 22 bp, Homo sapiens
cagatggccagaggcagctgca

SEQ ID NO: 7791845 - DNA, 22 bp, Homo sapiens
cagatggcatttcctttctggc

SEQ ID NO: 7791846 - DNA, 23 bp, Homo sapiens
agctccagaacatagcacaggaa

SEQ ID NO: 7791847 - DNA, 22 bp, Homo sapiens
agctctttagagtctcccttct

SEQ ID NO: 7791848 - DNA, 22 bp, Homo sapiens
aggcatggctttaggcaggcgt

SEQ ID NO: 7791849 - DNA, 22 bp, Homo sapiens
aggccctgagcatccgagggca

SEQ ID NO: 7791850 - DNA, 22 bp, Homo sapiens
aggccctgagaaaatccctgca

SEQ ID NO: 7791851 - DNA, 22 bp, Homo sapiens
aggccctgcaggagtggggaca

SEQ ID NO: 7791852 - DNA, 22 bp, Homo sapiens
aggccctgcaggaagcaggatg

SEQ ID NO: 7791853 - DNA, 22 bp, Homo sapiens
aggccctgcattgtactgaggg

SEQ ID NO: 7791854 - DNA, 22 bp, Homo sapiens
accacaggaattgctctgtggt

SEQ ID NO: 7791855 - DNA, 19 bp, Homo sapiens
agggcctgagcagatgttg

SEQ ID NO: 7791856 - DNA, 22 bp, Homo sapiens
accctgggtcatatacagtgtg

SEQ ID NO: 7791857 - DNA, 22 bp, Homo sapiens
accctgggttcccgcagcacca

SEQ ID NO: 7791858 - DNA, 22 bp, Homo sapiens
agcttccaatttctccaagaga

SEQ ID NO: 7791859 - DNA, 22 bp, Homo sapiens
agctccaggtgcaagtcatggt

SEQ ID NO: 7791860 - DNA, 22 bp, Homo sapiens
actgggaggcaaagagcaagga

SEQ ID NO: 7791861 - DNA, 22 bp, Homo sapiens
atacatcaatttcttagttatc

SEQ ID NO: 7791862 - DNA, 22 bp, Homo sapiens
agtttttctcccctggcttcat

SEQ ID NO: 7791863 - DNA, 22 bp, Homo sapiens
atcagtttaaatgggctgttgg

SEQ ID NO: 7791864 - DNA, 22 bp, Homo sapiens
agtgtgctattgcaccatcata

SEQ ID NO: 7791865 - DNA, 22 bp, Homo sapiens
agtggtcaaagactagatttca

SEQ ID NO: 7791866 - DNA, 22 bp, Homo sapiens
agtctaggcagccctgcagggt

SEQ ID NO: 7791867 - DNA, 22 bp, Homo sapiens
agtctagggtggggtccacagg

SEQ ID NO: 7791868 - DNA, 22 bp, Homo sapiens
cctgtgggaggggcctggcgcg

SEQ ID NO: 7791869 - DNA, 22 bp, Homo sapiens
cctgtgggagggagcggctgga

SEQ ID NO: 7791870 - DNA, 22 bp, Homo sapiens
cctgtggggccatctcagtcac

SEQ ID NO: 7791871 - DNA, 20 bp, Homo sapiens
aggtcctgggactggcagag

SEQ ID NO: 7791872 - DNA, 22 bp, Homo sapiens
cctgggaggctgtttccagcct

SEQ ID NO: 7791873 - DNA, 22 bp, Homo sapiens
cctgggaggtggaggttgcagt

SEQ ID NO: 7791874 - DNA, 22 bp, Homo sapiens
cctgggaggtggaggttgcagc

SEQ ID NO: 7791875 - DNA, 21 bp, Homo sapiens
cctgggagaattgggtgtggc

SEQ ID NO: 7791876 - DNA, 22 bp, Homo sapiens
cctgggaggctgtgggtctgct

SEQ ID NO: 7791877 - DNA, 22 bp, Homo sapiens
aggtcacatggataatgatcag

SEQ ID NO: 7791878 - DNA, 21 bp, Homo sapiens
agggttttatagatctcttcc

SEQ ID NO: 7791879 - DNA, 22 bp, Homo sapiens
agtagaatgttctatgtcaatg

SEQ ID NO: 7791880 - DNA, 22 bp, Homo sapiens
cttctgagatgttgttttacag

SEQ ID NO: 7791881 - DNA, 22 bp, Homo sapiens
atctggttttggctgtgtccct

SEQ ID NO: 7791882 - DNA, 22 bp, Homo sapiens
atctggttcttcttaggcatca

SEQ ID NO: 7791883 - DNA, 22 bp, Homo sapiens
cttatggctgtagtctggaagt

SEQ ID NO: 7791884 - DNA, 22 bp, Homo sapiens
ctggtcatgccaggtttgctgc

SEQ ID NO: 7791885 - DNA, 22 bp, Homo sapiens
ctgggagcttgttaggaatgca

SEQ ID NO: 7791886 - DNA, 22 bp, Homo sapiens
ctgggagcttttagaaatgcag

SEQ ID NO: 7791887 - DNA, 19 bp, Homo sapiens
atcagctgaagccttcaga

SEQ ID NO: 7791888 - DNA, 22 bp, Homo sapiens
atcagcatctttaacaattacc

SEQ ID NO: 7791889 - DNA, 22 bp, Homo sapiens
atcagtttgagtgctgtgtcaa

SEQ ID NO: 7791890 - DNA, 22 bp, Homo sapiens
ctggcctcagagggtcatggtg

SEQ ID NO: 7791891 - DNA, 22 bp, Homo sapiens
ctggcctcacctcagacttact

SEQ ID NO: 7791892 - DNA, 22 bp, Homo sapiens
ctggcctctctgagcagggagc

SEQ ID NO: 7791893 - DNA, 22 bp, Homo sapiens
ctggctgagttactccactgag

SEQ ID NO: 7791894 - DNA, 22 bp, Homo sapiens
ctggctgaggtcaccagtagct

SEQ ID NO: 7791895 - DNA, 22 bp, Homo sapiens
atatacttgatttaactgagca

SEQ ID NO: 7791896 - DNA, 22 bp, Homo sapiens
ctgggagctggaatgggagaag

SEQ ID NO: 7791897 - DNA, 22 bp, Homo sapiens
ctgggagctggatgccctgccc

SEQ ID NO: 7791898 - DNA, 22 bp, Homo sapiens
ctgggagctgtcaggagcgtgt

SEQ ID NO: 7791899 - DNA, 22 bp, Homo sapiens
ctgggagcttggagcctttggt

SEQ ID NO: 7791900 - DNA, 22 bp, Homo sapiens
aggggcacgagtagagctctag

SEQ ID NO: 7791901 - DNA, 22 bp, Homo sapiens
agggcctggaactgtgggcagg

SEQ ID NO: 7791902 - DNA, 20 bp, Homo sapiens
agggcctgctctgtggtgtc

SEQ ID NO: 7791903 - DNA, 22 bp, Homo sapiens
agggcctggaactggagaccac

SEQ ID NO: 7791904 - DNA, 23 bp, Homo sapiens
agggcctgatggctcccgctggc

SEQ ID NO: 7791905 - DNA, 22 bp, Homo sapiens
agggctaggaatggaactggag

SEQ ID NO: 7791906 - DNA, 22 bp, Homo sapiens
ccctagggtttggccagagccc

SEQ ID NO: 7791907 - DNA, 22 bp, Homo sapiens
ccccagcacttggagtggggag

SEQ ID NO: 7791908 - DNA, 22 bp, Homo sapiens
cccatggggacaccatgaagga

SEQ ID NO: 7791909 - DNA, 22 bp, Homo sapiens
aggctggcgtcaggggctgtac

SEQ ID NO: 7791910 - DNA, 22 bp, Homo sapiens
ccagaacagacctgcctgacct

SEQ ID NO: 7791911 - DNA, 22 bp, Homo sapiens
ccactgggggctgcaggcactc

SEQ ID NO: 7791912 - DNA, 22 bp, Homo sapiens
aggcgctgcgctggggccagaa

SEQ ID NO: 7791913 - DNA, 22 bp, Homo sapiens
aggcctggcatgagacctgaga

SEQ ID NO: 7791914 - DNA, 22 bp, Homo sapiens
aggcctgggacgggagccgtga

SEQ ID NO: 7791915 - DNA, 22 bp, Homo sapiens
agctcttttgctctccaagttt

SEQ ID NO: 7791916 - DNA, 22 bp, Homo sapiens
aggcactgacctgcttccttga

SEQ ID NO: 7791917 - DNA, 22 bp, Homo sapiens
aggcactgactcaagggagcca

SEQ ID NO: 7791918 - DNA, 23 bp, Homo sapiens
aggcactgaatgtgtcagtgagt

SEQ ID NO: 7791919 - DNA, 22 bp, Homo sapiens
aggcactgattctcagagttac

SEQ ID NO: 7791920 - DNA, 22 bp, Homo sapiens
aggcactgaaaggtggccagag

SEQ ID NO: 7791921 - DNA, 22 bp, Homo sapiens
aggcactgaagaactctttttg

SEQ ID NO: 7791922 - DNA, 22 bp, Homo sapiens
aggcactgaaggaagcttgcgc

SEQ ID NO: 7791923 - DNA, 22 bp, Homo sapiens
cagttcagctagaagaaacaaa

SEQ ID NO: 7791924 - DNA, 22 bp, Homo sapiens
catcatttgtttgcatgcagga

SEQ ID NO: 7791925 - DNA, 14 bp, Homo sapiens
gcaggcggatcact

SEQ ID NO: 7791926 - DNA, 22 bp, Homo sapiens
gcagaggcctgaaggtggcggg

SEQ ID NO: 7791927 - DNA, 22 bp, Homo sapiens
gcagaggctccattttacagat

SEQ ID NO: 7791928 - DNA, 22 bp, Homo sapiens
gcagaggctgggtgtcccagtc

SEQ ID NO: 7791929 - DNA, 22 bp, Homo sapiens
gcagaggcctaggtggaaggcc

SEQ ID NO: 7791930 - DNA, 22 bp, Homo sapiens
gcactgtgatcaaggctaagca

SEQ ID NO: 7791931 - DNA, 22 bp, Homo sapiens
gcactgtgacccagagcaggtg

SEQ ID NO: 7791932 - DNA, 22 bp, Homo sapiens
gcactgggtgtgaggcagcgtc

SEQ ID NO: 7791933 - DNA, 22 bp, Homo sapiens
gcactgggggcagcagtgaggg

SEQ ID NO: 7791934 - DNA, 21 bp, Homo sapiens
gcaaccagaccacagggcagt

SEQ ID NO: 7791935 - DNA, 22 bp, Homo sapiens
atttgagaaaggagggaacttt

SEQ ID NO: 7791936 - DNA, 22 bp, Homo sapiens
gcctggctcacagagcagcctt

SEQ ID NO: 7791937 - DNA, 22 bp, Homo sapiens
gcctggctcctaagagcacaac

SEQ ID NO: 7791938 - DNA, 22 bp, Homo sapiens
attttactaagtggatatctgt

SEQ ID NO: 7791939 - DNA, 22 bp, Homo sapiens
attttactactccaattaatga

SEQ ID NO: 7791940 - DNA, 22 bp, Homo sapiens
gcccaggaggttgggctgtgca

SEQ ID NO: 7791941 - DNA, 22 bp, Homo sapiens
gcccaggagttcaagtctagtg

SEQ ID NO: 7791942 - DNA, 22 bp, Homo sapiens
gcctggctctgagggagctcct

SEQ ID NO: 7791943 - DNA, 22 bp, Homo sapiens
gctctaggttcctagccaagtc

SEQ ID NO: 7791944 - DNA, 22 bp, Homo sapiens
gagctctgggtggcaggtgtct

SEQ ID NO: 7791945 - DNA, 22 bp, Homo sapiens
atgtaaggttcagagtatgtga

SEQ ID NO: 7791946 - DNA, 22 bp, Homo sapiens
atgtaaggctgcctatgacact

SEQ ID NO: 7791947 - DNA, 22 bp, Homo sapiens
gagcagtagagtacatggctcc

SEQ ID NO: 7791948 - DNA, 22 bp, Homo sapiens
gagcagctccagccgcatgact

SEQ ID NO: 7791949 - DNA, 22 bp, Homo sapiens
gaggccacagtcctgaggcatc

SEQ ID NO: 7791950 - DNA, 22 bp, Homo sapiens
gaggctgtgtgtccctctggac

SEQ ID NO: 7791951 - DNA, 22 bp, Homo sapiens
gaggctgttagggcctgaggta

SEQ ID NO: 7791952 - DNA, 22 bp, Homo sapiens
atcttcccaggctggggagagg

SEQ ID NO: 7791953 - DNA, 22 bp, Homo sapiens
gaccctggaactttcagcagag

SEQ ID NO: 7791954 - DNA, 22 bp, Homo sapiens
atgccctgcatcaagtgacact

SEQ ID NO: 7791955 - DNA, 22 bp, Homo sapiens
atgccctgctgctggggcagtg

SEQ ID NO: 7791956 - DNA, 22 bp, Homo sapiens
gacagggacgaggcttcaggca

SEQ ID NO: 7791957 - DNA, 22 bp, Homo sapiens
atgccctgtggttcatgtgaga

SEQ ID NO: 7791958 - DNA, 22 bp, Homo sapiens
ggacagcatatcagcagggcag

SEQ ID NO: 7791959 - DNA, 22 bp, Homo sapiens
ggagcagcttgcatgctcaggg

SEQ ID NO: 7791960 - DNA, 22 bp, Homo sapiens
ggagcagcctgtgtagacgggg

SEQ ID NO: 7791961 - DNA, 19 bp, Homo sapiens
gctgggagcagaccctccc

SEQ ID NO: 7791962 - DNA, 22 bp, Homo sapiens
gctgggagccccgagccagcgc

SEQ ID NO: 7791963 - DNA, 22 bp, Homo sapiens
gctgggagccctggtctgctcc

SEQ ID NO: 7791964 - DNA, 22 bp, Homo sapiens
gctgggaggaatttggggaata

SEQ ID NO: 7791965 - DNA, 22 bp, Homo sapiens
gctggcagccaagtgaagaggg

SEQ ID NO: 7791966 - DNA, 22 bp, Homo sapiens
ggctgctgtgacctcaggtgat

SEQ ID NO: 7791967 - DNA, 22 bp, Homo sapiens
ggctgggagctggacaggccgg

SEQ ID NO: 7791968 - DNA, 22 bp, Homo sapiens
cagaacagtcgcctgcatggat

SEQ ID NO: 7791969 - DNA, 22 bp, Homo sapiens
cagaacaggtcatgcttgctgt

SEQ ID NO: 7791970 - DNA, 22 bp, Homo sapiens
cagatggcaacagctctgtgac

SEQ ID NO: 7791971 - DNA, 22 bp, Homo sapiens
cagaggcctttctacagtgata

SEQ ID NO: 7791972 - DNA, 18 bp, Homo sapiens
cagaagcaggcagtgcag

SEQ ID NO: 7791973 - DNA, 22 bp, Homo sapiens
cagaagcaagagccggagctag

SEQ ID NO: 7791974 - DNA, 22 bp, Homo sapiens
cagaagcaagtagtgattcttt

SEQ ID NO: 7791975 - DNA, 22 bp, Homo sapiens
cagagagcttagtgtgctgcat

SEQ ID NO: 7791976 - DNA, 22 bp, Homo sapiens
gggctcagtcctggttctaccc

SEQ ID NO: 7791977 - DNA, 22 bp, Homo sapiens
cagaggcagaggtcatctctgg

SEQ ID NO: 7791978 - DNA, 22 bp, Homo sapiens
cagaggcagaccctccagggcg

SEQ ID NO: 7791979 - DNA, 22 bp, Homo sapiens
cagaggcagccgggggagaacg

SEQ ID NO: 7791980 - DNA, 22 bp, Homo sapiens
cagaggcaggaagatgggcagt

SEQ ID NO: 7791981 - DNA, 21 bp, Homo sapiens
cagctccactaaagcagctgt

SEQ ID NO: 7791982 - DNA, 22 bp, Homo sapiens
cagctccacttgagtggggcct

SEQ ID NO: 7791983 - DNA, 22 bp, Homo sapiens
cagctccagcccaggcagctcc

SEQ ID NO: 7791984 - DNA, 22 bp, Homo sapiens
caggctcccaccctcctgcagc

SEQ ID NO: 7791985 - DNA, 17 bp, Homo sapiens
caggctccttccagatt

SEQ ID NO: 7791986 - DNA, 22 bp, Homo sapiens
caggctccctgggcagtggcag

SEQ ID NO: 7791987 - DNA, 17 bp, Homo sapiens
tatctgtatgatggata

SEQ ID NO: 7791988 - DNA, 22 bp, Homo sapiens
tcaaagcctgtggatagtttgg

SEQ ID NO: 7791989 - DNA, 22 bp, Homo sapiens
ccagaggctggcagccagctga

SEQ ID NO: 7791990 - DNA, 22 bp, Homo sapiens
ccagaggctggggaaggataca

SEQ ID NO: 7791991 - DNA, 22 bp, Homo sapiens
cattttcatgagtttctgttca

SEQ ID NO: 7791992 - DNA, 20 bp, Homo sapiens
catttcattgtgtcttcact

SEQ ID NO: 7791993 - DNA, 22 bp, Homo sapiens
ccacaggctgctgcaggtcccg

SEQ ID NO: 7791994 - DNA, 20 bp, Homo sapiens
ccaagagcatgcatgaggaa

SEQ ID NO: 7791995 - DNA, 22 bp, Homo sapiens
tcataattgtatacatttatgg

SEQ ID NO: 7791996 - DNA, 22 bp, Homo sapiens
catcagctcttcattcttgatt

SEQ ID NO: 7791997 - DNA, 22 bp, Homo sapiens
catcagcaggcaacactcttgg

SEQ ID NO: 7791998 - DNA, 20 bp, Homo sapiens
tccagggtagatgaattctg

SEQ ID NO: 7791999 - DNA, 17 bp, Homo sapiens
tccagggtttatgaaat

SEQ ID NO: 7792000 - DNA, 22 bp, Homo sapiens
tgagccagtggaagatggcagt

SEQ ID NO: 7792001 - DNA, 22 bp, Homo sapiens
tgaggctgagatatcagggagg

SEQ ID NO: 7792002 - DNA, 19 bp, Homo sapiens
ccaggagcagtggtgagct

SEQ ID NO: 7792003 - DNA, 22 bp, Homo sapiens
tctgttctaagcattctatgtg

SEQ ID NO: 7792004 - DNA, 22 bp, Homo sapiens
tgggacaggatgaccagaaggt

SEQ ID NO: 7792005 - DNA, 22 bp, Homo sapiens
tgggagagcactgcagccccgg

SEQ ID NO: 7792006 - DNA, 22 bp, Homo sapiens
tgggcctggagccctggagagt

SEQ ID NO: 7792007 - DNA, 22 bp, Homo sapiens
cctgcctgattccaggatggct

SEQ ID NO: 7792008 - DNA, 22 bp, Homo sapiens
cctgcctgaaggtcagccaccc

SEQ ID NO: 7792009 - DNA, 22 bp, Homo sapiens
tggaaacctactgatacaggag

SEQ ID NO: 7792010 - DNA, 22 bp, Homo sapiens
ccctgggacccgctgcagaggc

SEQ ID NO: 7792011 - DNA, 22 bp, Homo sapiens
cccttgggtgccagccacaagt

SEQ ID NO: 7792012 - DNA, 22 bp, Homo sapiens
cccttggggtggaggttgcagt

SEQ ID NO: 7792013 - DNA, 22 bp, Homo sapiens
cccttgggccccagctcagggc

SEQ ID NO: 7792014 - DNA, 22 bp, Homo sapiens
cccttggggctctttgccaggc

SEQ ID NO: 7792015 - DNA, 22 bp, Homo sapiens
cccttggggatgctgtgtctgg

SEQ ID NO: 7792016 - DNA, 22 bp, Homo sapiens
ttattcacatgggctcattcta

SEQ ID NO: 7792017 - DNA, 22 bp, Homo sapiens
ttattattttgtgtacagcaaa

SEQ ID NO: 7792018 - DNA, 22 bp, Homo sapiens
ttatttcattgatttctaagac

SEQ ID NO: 7792019 - DNA, 22 bp, Homo sapiens
ttattcagattggctacaggat

SEQ ID NO: 7792020 - DNA, 22 bp, Homo sapiens
ccttgggacagccagcttcaga

SEQ ID NO: 7792021 - DNA, 22 bp, Homo sapiens
ccttgggatttctcatgccaat

SEQ ID NO: 7792022 - DNA, 22 bp, Homo sapiens
ccttgggagaaattgcagagtc

SEQ ID NO: 7792023 - DNA, 22 bp, Homo sapiens
ttcctctggaggctctaggaga

SEQ ID NO: 7792024 - DNA, 22 bp, Homo sapiens
cggctgggttcggctgcaggcc

SEQ ID NO: 7792025 - DNA, 22 bp, Homo sapiens
ttctccttgttcccttcaattg

SEQ ID NO: 7792026 - DNA, 22 bp, Homo sapiens
ttctcctggggccgtgatgtga

SEQ ID NO: 7792027 - DNA, 22 bp, Homo sapiens
ttctccttgaaaagctgcatct

SEQ ID NO: 7792028 - DNA, 22 bp, Homo sapiens
ttctcctgcccttggacttcca

SEQ ID NO: 7792029 - DNA, 22 bp, Homo sapiens
ttctatttttgtggaactgtag

SEQ ID NO: 7792030 - DNA, 22 bp, Homo sapiens
ttcttcagtgcccctctagtag

SEQ ID NO: 7792031 - DNA, 22 bp, Homo sapiens
ttcttcaggatacgtcatccag

SEQ ID NO: 7792032 - DNA, 22 bp, Homo sapiens
ttcttcagtctaggcctttctt

SEQ ID NO: 7792033 - DNA, 22 bp, Homo sapiens
ttcttcagggaagcttgttaat

SEQ ID NO: 7792034 - DNA, 22 bp, Homo sapiens
ctgctgctgagaatgcctcagg

SEQ ID NO: 7792035 - DNA, 22 bp, Homo sapiens
ctcctcagttgtcccatggaga

SEQ ID NO: 7792036 - DNA, 22 bp, Homo sapiens
tttatatggttgactatgagtt

SEQ ID NO: 7792037 - DNA, 19 bp, Homo sapiens
ctcctcagtcccagaggtc

SEQ ID NO: 7792038 - DNA, 20 bp, Homo sapiens
ctcctcagttccatgggagg

SEQ ID NO: 7792039 - DNA, 22 bp, Homo sapiens
ctcctcagtcaggtctagggtc

SEQ ID NO: 7792040 - DNA, 20 bp, Homo sapiens
ctctgctttaggagagtcag

SEQ ID NO: 7792041 - DNA, 22 bp, Homo sapiens
tttgaagggcacgacaatagtt

SEQ ID NO: 7792042 - DNA, 22 bp, Homo sapiens
ctctgcttgtatcacatttgct

SEQ ID NO: 7792043 - DNA, 22 bp, Homo sapiens
ctctgcttggaacaggggtttg

SEQ ID NO: 7792044 - DNA, 22 bp, Homo sapiens
ctctgcttggaactggacagaa

SEQ ID NO: 7792045 - DNA, 22 bp, Homo sapiens
ctctgcttctgagatggaagct

SEQ ID NO: 7792046 - DNA, 22 bp, Homo sapiens
ctctgcttcatccaccactggc

SEQ ID NO: 7792047 - DNA, 22 bp, Homo sapiens
ctctattctaatggattctggg

SEQ ID NO: 7792048 - DNA, 22 bp, Homo sapiens
ctctctggaattaaagcccaat

SEQ ID NO: 7792049 - DNA, 22 bp, Homo sapiens
gagccatgagatagttggttcg

SEQ ID NO: 7792050 - DNA, 22 bp, Homo sapiens
gagccctgtagcaagtcatgtc

SEQ ID NO: 7792051 - DNA, 22 bp, Homo sapiens
gagccctgatttgcagcatttg

SEQ ID NO: 7792052 - DNA, 22 bp, Homo sapiens
gagggctgccacgttgggcgag

SEQ ID NO: 7792053 - DNA, 22 bp, Homo sapiens
gagaccaggaagtacagcagcc

SEQ ID NO: 7792054 - DNA, 20 bp, Homo sapiens
gagacagcaaaagcctctcc

SEQ ID NO: 7792055 - DNA, 22 bp, Homo sapiens
gaccaggagatttgagctaggc

SEQ ID NO: 7792056 - DNA, 22 bp, Homo sapiens
gaccaggacacagtggcaaggt

SEQ ID NO: 7792057 - DNA, 21 bp, Homo sapiens
gactctggggtcagctcaacc

SEQ ID NO: 7792058 - DNA, 22 bp, Homo sapiens
gaaggcaccctccatcactcac

SEQ ID NO: 7792059 - DNA, 22 bp, Homo sapiens
ctgggagcaccatacttgtttc

SEQ ID NO: 7792060 - DNA, 22 bp, Homo sapiens
ctgggagcaagtcaggaaaggt

SEQ ID NO: 7792061 - DNA, 22 bp, Homo sapiens
ctgggagcaagaggctgcaaat

SEQ ID NO: 7792062 - DNA, 22 bp, Homo sapiens
ctgggagccctgactagcctgg

SEQ ID NO: 7792063 - DNA, 22 bp, Homo sapiens
ctgggagcccgcgtcctggtgg

SEQ ID NO: 7792064 - DNA, 22 bp, Homo sapiens
ctgggagcctggcagttgctga

SEQ ID NO: 7792065 - DNA, 22 bp, Homo sapiens
ctgggagcgcagcaggcacaac

SEQ ID NO: 7792066 - DNA, 22 bp, Homo sapiens
ctgggagcggctgtcactggtt

SEQ ID NO: 7792067 - DNA, 22 bp, Homo sapiens
ctgggcactgcagggtgttgag

SEQ ID NO: 7792068 - DNA, 22 bp, Homo sapiens
ctgggaccctgccctgtggcct

SEQ ID NO: 7792069 - DNA, 22 bp, Homo sapiens
ctgggacagctgagacaggaga

SEQ ID NO: 7792070 - DNA, 22 bp, Homo sapiens
ctgggacatgatagaaacagat

SEQ ID NO: 7792071 - DNA, 22 bp, Homo sapiens
ctgggagattgaggccatggtg

SEQ ID NO: 7792072 - DNA, 22 bp, Homo sapiens
ctgggagatctcctgagggcag

SEQ ID NO: 7792073 - DNA, 22 bp, Homo sapiens
ctgggacacccagagctgcaga

SEQ ID NO: 7792074 - DNA, 22 bp, Homo sapiens
ctgggacacccaaggaaagagc

SEQ ID NO: 7792075 - DNA, 22 bp, Homo sapiens
ctgggacagagcagcagtgggg

SEQ ID NO: 7792076 - DNA, 22 bp, Homo sapiens
cttctgaatggctgtgtatgct

SEQ ID NO: 7792077 - DNA, 22 bp, Homo sapiens
cttctgctgctgttcatggttg

SEQ ID NO: 7792078 - DNA, 22 bp, Homo sapiens
cttctgaaacccccagtgtggg

SEQ ID NO: 7792079 - DNA, 22 bp, Homo sapiens
ctgtgcttccaggatggcagct

SEQ ID NO: 7792080 - DNA, 22 bp, Homo sapiens
cttccaagtggggcacgtgcca

SEQ ID NO: 7792081 - DNA, 22 bp, Homo sapiens
cttccaagttgctctgctgacc

SEQ ID NO: 7792082 - DNA, 22 bp, Homo sapiens
cttcagttagtttcatgtgagc

SEQ ID NO: 7792083 - DNA, 22 bp, Homo sapiens
gggagctgagctggaagagaat

SEQ ID NO: 7792084 - DNA, 22 bp, Homo sapiens
gggaggttgaggctgcagtgag

SEQ ID NO: 7792085 - DNA, 22 bp, Homo sapiens
gggcacatgcttagggaggaaa

SEQ ID NO: 7792086 - DNA, 23 bp, Homo sapiens
ggctagagtggaggggaactgca

SEQ ID NO: 7792087 - DNA, 22 bp, Homo sapiens
ggctggagacaacgtcctgccc

SEQ ID NO: 7792088 - DNA, 22 bp, Homo sapiens
ggctgtgattggtggatgtgaa

SEQ ID NO: 7792089 - DNA, 20 bp, Homo sapiens
ggctgctgtgggcagagagg

SEQ ID NO: 7792090 - DNA, 22 bp, Homo sapiens
ggctgctgtttcagagactgtt

SEQ ID NO: 7792091 - DNA, 19 bp, Homo sapiens
ggcatccagaactaccagt

SEQ ID NO: 7792092 - DNA, 22 bp, Homo sapiens
ggcctgctggctccagcgcccg

SEQ ID NO: 7792093 - DNA, 22 bp, Homo sapiens
ggcctgctgggccccacagtcc

SEQ ID NO: 7792094 - DNA, 22 bp, Homo sapiens
ggcctgcttctcagtgagcttg

SEQ ID NO: 7792095 - DNA, 22 bp, Homo sapiens
ggcctgctttccgagcctgcag

SEQ ID NO: 7792096 - DNA, 22 bp, Homo sapiens
ggcctgctctgcagcctctaca

SEQ ID NO: 7792097 - DNA, 22 bp, Homo sapiens
ggcctgctctggctgtggtcag

SEQ ID NO: 7792098 - DNA, 22 bp, Homo sapiens
ggcctgctattggtgggcagac

SEQ ID NO: 7792099 - DNA, 22 bp, Homo sapiens
ggcctgctccgggggctgagct

SEQ ID NO: 7792100 - DNA, 22 bp, Homo sapiens
ggcctgctcagtcctctttctt

SEQ ID NO: 7792101 - DNA, 23 bp, Homo sapiens
ggcctggcccagggccctgatga

SEQ ID NO: 7792102 - DNA, 22 bp, Homo sapiens
ggcctggagaaggcccagggag

SEQ ID NO: 7792103 - DNA, 22 bp, Homo sapiens
ggcactgggtgagggtcactgg

SEQ ID NO: 7792104 - DNA, 22 bp, Homo sapiens
ggcactgtgtacacacagagac

SEQ ID NO: 7792105 - DNA, 22 bp, Homo sapiens
ggtcagggggatctgtgaggta

SEQ ID NO: 7792106 - DNA, 18 bp, Homo sapiens
ggtcaggggcggagagaa

SEQ ID NO: 7792107 - DNA, 22 bp, Homo sapiens
ggtacagacagggctgcctggg

SEQ ID NO: 7792108 - DNA, 17 bp, Homo sapiens
ggtctggggccattggc

SEQ ID NO: 7792109 - DNA, 22 bp, Homo sapiens
ggggcacttccaggctgaggct

SEQ ID NO: 7792110 - DNA, 22 bp, Homo sapiens
ggggcagctcccgagggcagga

SEQ ID NO: 7792111 - DNA, 22 bp, Homo sapiens
gtctcctgaggcatccattgaa

SEQ ID NO: 7792112 - DNA, 22 bp, Homo sapiens
gtgctgggattacaggtgtgag

SEQ ID NO: 7792113 - DNA, 22 bp, Homo sapiens
gtgctgggctccaccccagagg

SEQ ID NO: 7792114 - DNA, 22 bp, Homo sapiens
gtagcttacatcagagttggtt

SEQ ID NO: 7792115 - DNA, 22 bp, Homo sapiens
gtagcttatgaaatgtgagggg

SEQ ID NO: 7792116 - DNA, 22 bp, Homo sapiens
gcacttggatatacaaatgaag

SEQ ID NO: 7792117 - DNA, 23 bp, Homo sapiens
gcagaggagcaagctggacacca

SEQ ID NO: 7792118 - DNA, 22 bp, Homo sapiens
gcactgtgctagaagccagggg

SEQ ID NO: 7792119 - DNA, 22 bp, Homo sapiens
gcactgggctccaggaaggagg

SEQ ID NO: 7792120 - DNA, 22 bp, Homo sapiens
gcactgggaatgtgagcagctg

SEQ ID NO: 7792121 - DNA, 22 bp, Homo sapiens
gcactgggaatgagggcagctt

SEQ ID NO: 7792122 - DNA, 22 bp, Homo sapiens
gcactgggaagaatgagcctgt

SEQ ID NO: 7792123 - DNA, 22 bp, Homo sapiens
gcacctgggcaaggattcagag

SEQ ID NO: 7792124 - DNA, 22 bp, Homo sapiens
gcccagtggtaaaagcaggcct

SEQ ID NO: 7792125 - DNA, 22 bp, Homo sapiens
gcatccagaggtagccactgtg

SEQ ID NO: 7792126 - DNA, 20 bp, Homo sapiens
gcatccagacacccagctgc

SEQ ID NO: 7792127 - DNA, 22 bp, Homo sapiens
ggactctggtatttcactcttg

SEQ ID NO: 7792128 - DNA, 22 bp, Homo sapiens
ggactctgttttcctgatcact

SEQ ID NO: 7792129 - DNA, 22 bp, Homo sapiens
ggagaggcgatgagtcacagcc

SEQ ID NO: 7792130 - DNA, 22 bp, Homo sapiens
gctgggaggatctctccctgtc

SEQ ID NO: 7792131 - DNA, 22 bp, Homo sapiens
gctgggagaggccctgaagtga

SEQ ID NO: 7792132 - DNA, 22 bp, Homo sapiens
gctgggagacagacttggaacc

SEQ ID NO: 7792133 - DNA, 22 bp, Homo sapiens
gctggcagaagagctggttcaa

SEQ ID NO: 7792134 - DNA, 22 bp, Homo sapiens
gctggcagggacagctgcgtgt

SEQ ID NO: 7792135 - DNA, 22 bp, Homo sapiens
gctggcagctggaagttgggct

SEQ ID NO: 7792136 - DNA, 22 bp, Homo sapiens
gctgtgagggcttctgaggcat

SEQ ID NO: 7792137 - DNA, 22 bp, Homo sapiens
gctgtgagggtctagtgaggtg

SEQ ID NO: 7792138 - DNA, 22 bp, Homo sapiens
gctgtgagtggaggaggctgag

SEQ ID NO: 7792139 - DNA, 22 bp, Homo sapiens
gctgtgagccgctgctgagcat

SEQ ID NO: 7792140 - DNA, 22 bp, Homo sapiens
gctgggagtcgcgtctgtggcc

SEQ ID NO: 7792141 - DNA, 22 bp, Homo sapiens
gctggtaggaagtgctcctgcc

SEQ ID NO: 7792142 - DNA, 22 bp, Homo sapiens
gcctggctgctagccagaggca

SEQ ID NO: 7792143 - DNA, 18 bp, Homo sapiens
gcctggcttcggagccgc

SEQ ID NO: 7792144 - DNA, 22 bp, Homo sapiens
gcctggctgggcaccaggggag

SEQ ID NO: 7792145 - DNA, 22 bp, Homo sapiens
gctctgctgcttactagatggt

SEQ ID NO: 7792146 - DNA, 22 bp, Homo sapiens
gctctgctgagatatctgggag

SEQ ID NO: 7792147 - DNA, 22 bp, Homo sapiens
gctctgctgaagccccttgcat

SEQ ID NO: 7792148 - DNA, 22 bp, Homo sapiens
gctctgctgacagctgggacag

SEQ ID NO: 7792149 - DNA, 22 bp, Homo sapiens
gtttaggaaattgggtattaga

SEQ ID NO: 7792150 - DNA, 22 bp, Homo sapiens
gtttctaattggaactttgagg

SEQ ID NO: 7792151 - DNA, 22 bp, Homo sapiens
gtgtgtccttgggcctctgcag

SEQ ID NO: 7792152 - DNA, 22 bp, Homo sapiens
gttaggaaggtatagttgtatt

SEQ ID NO: 7792153 - DNA, 19 bp, Homo sapiens
tacttattagaaatatggg

SEQ ID NO: 7792154 - DNA, 18 bp, Homo sapiens
tactggtccttttatgat

SEQ ID NO: 7792155 - DNA, 22 bp, Homo sapiens
tacactatgggctttgtgtaat

SEQ ID NO: 7792156 - DNA, 22 bp, Homo sapiens
taatgaggaaatagagggaatg

SEQ ID NO: 7792157 - DNA, 22 bp, Homo sapiens
taatgaggcatttgagtcacct

SEQ ID NO: 7792158 - DNA, 22 bp, Homo sapiens
taatgaggggaaccatctgtag

SEQ ID NO: 7792159 - DNA, 22 bp, Homo sapiens
tacacatttctcttagagacac

SEQ ID NO: 7792160 - DNA, 22 bp, Homo sapiens
tatacttatgctaaaaaatgtt

SEQ ID NO: 7792161 - DNA, 22 bp, Homo sapiens
tatatgtaaataagtctaatgt

SEQ ID NO: 7792162 - DNA, 22 bp, Homo sapiens
tatttggagtgatggaaatgtt

SEQ ID NO: 7792163 - DNA, 22 bp, Homo sapiens
tatttggatagacagggagatg

SEQ ID NO: 7792164 - DNA, 22 bp, Homo sapiens
tatgtttaaatgtatgtgtatg

SEQ ID NO: 7792165 - DNA, 22 bp, Homo sapiens
tattcacatgtacatatgctca

SEQ ID NO: 7792166 - DNA, 22 bp, Homo sapiens
tattcacaaaatgaggtcctca

SEQ ID NO: 7792167 - DNA, 22 bp, Homo sapiens
tatgtttatactttgatgtact

SEQ ID NO: 7792168 - DNA, 22 bp, Homo sapiens
tattgaggattgaggaaagcac

SEQ ID NO: 7792169 - DNA, 22 bp, Homo sapiens
taggctgggagcctgaggctag

SEQ ID NO: 7792170 - DNA, 22 bp, Homo sapiens
tagccatgagcagatcactata

SEQ ID NO: 7792171 - DNA, 22 bp, Homo sapiens
tagccatgtgtggaacacagcc

SEQ ID NO: 7792172 - DNA, 22 bp, Homo sapiens
tcccaggaaaacactcgaggac

SEQ ID NO: 7792173 - DNA, 22 bp, Homo sapiens
tcccaggatgttggcggcaggt

SEQ ID NO: 7792174 - DNA, 22 bp, Homo sapiens
tcccaggaagatcccagggacc

SEQ ID NO: 7792175 - DNA, 17 bp, Homo sapiens
tcccaggaacagggaat

SEQ ID NO: 7792176 - DNA, 22 bp, Homo sapiens
tcccagcagcatagctcagaat

SEQ ID NO: 7792177 - DNA, 22 bp, Homo sapiens
tccagtgctggaccagagcacc

SEQ ID NO: 7792178 - DNA, 22 bp, Homo sapiens
tccaggcctaggccaagtgatt

SEQ ID NO: 7792179 - DNA, 22 bp, Homo sapiens
tccagccttgccacttttctgt

SEQ ID NO: 7792180 - DNA, 22 bp, Homo sapiens
tccaggacctcccaggctagag

SEQ ID NO: 7792181 - DNA, 22 bp, Homo sapiens
tcagcttctcaaaatggcttag

SEQ ID NO: 7792182 - DNA, 23 bp, Homo sapiens
tcagcttcattgtcttctatggc

SEQ ID NO: 7792183 - DNA, 20 bp, Homo sapiens
tcatccagttggtttatggt

SEQ ID NO: 7792184 - DNA, 22 bp, Homo sapiens
tcatccagttcacatggtgagt

SEQ ID NO: 7792185 - DNA, 22 bp, Homo sapiens
tcatccagtatgactggtgtct

SEQ ID NO: 7792186 - DNA, 22 bp, Homo sapiens
tcatccaggaaaagatttggaa

SEQ ID NO: 7792187 - DNA, 20 bp, Homo sapiens
tcatccaggacaggagtggc

SEQ ID NO: 7792188 - DNA, 22 bp, Homo sapiens
tcatccagagcttcataagtaa

SEQ ID NO: 7792189 - DNA, 22 bp, Homo sapiens
tcatccagaaaaatgtcttagc

SEQ ID NO: 7792190 - DNA, 21 bp, Homo sapiens
tcatccaggtcctgcttcttc

SEQ ID NO: 7792191 - DNA, 22 bp, Homo sapiens
tcagaacatttgggactttggg

SEQ ID NO: 7792192 - DNA, 22 bp, Homo sapiens
tcagaacatttaaaaagtggtt

SEQ ID NO: 7792193 - DNA, 22 bp, Homo sapiens
tcagaacattgacattcttatt

SEQ ID NO: 7792194 - DNA, 22 bp, Homo sapiens
tcagaacattctcattgactgc

SEQ ID NO: 7792195 - DNA, 22 bp, Homo sapiens
tcagaacatgaaggttaatttg

SEQ ID NO: 7792196 - DNA, 22 bp, Homo sapiens
tcagaacattaaggatttgaag

SEQ ID NO: 7792197 - DNA, 22 bp, Homo sapiens
tcagaacatgtttgagtaagac

SEQ ID NO: 7792198 - DNA, 22 bp, Homo sapiens
tcagaacagtgcctggcactaa

SEQ ID NO: 7792199 - DNA, 23 bp, Homo sapiens
tcagaacagttcttggtgcatag

SEQ ID NO: 7792200 - DNA, 22 bp, Homo sapiens
tcagaacatatattttgtgatg

SEQ ID NO: 7792201 - DNA, 22 bp, Homo sapiens
tcagaacatcctggtttaaaat

SEQ ID NO: 7792202 - DNA, 18 bp, Homo sapiens
tcacagacagctgtcttt

SEQ ID NO: 7792203 - DNA, 22 bp, Homo sapiens
tttctataactggactggattg

SEQ ID NO: 7792204 - DNA, 22 bp, Homo sapiens
tttctagttgttcatgaaagga

SEQ ID NO: 7792205 - DNA, 22 bp, Homo sapiens
tttggccacttgggagtccagg

SEQ ID NO: 7792206 - DNA, 22 bp, Homo sapiens
tttggccacagatccttggggg

SEQ ID NO: 7792207 - DNA, 22 bp, Homo sapiens
ttttcctcaggaatgctaagct

SEQ ID NO: 7792208 - DNA, 22 bp, Homo sapiens
ttttcctcacctaactcaaggt

SEQ ID NO: 7792209 - DNA, 22 bp, Homo sapiens
tttgtccttgaatcaattcaca

SEQ ID NO: 7792210 - DNA, 22 bp, Homo sapiens
ttttattgtcaatgaagacaga

SEQ ID NO: 7792211 - DNA, 22 bp, Homo sapiens
ttcttcagcccatatcttccag

SEQ ID NO: 7792212 - DNA, 22 bp, Homo sapiens
ttcttcagcctaccttgacctc

SEQ ID NO: 7792213 - DNA, 22 bp, Homo sapiens
ttcttcagactccctctttaag

SEQ ID NO: 7792214 - DNA, 22 bp, Homo sapiens
ttctcttcatctcagtaaatgt

SEQ ID NO: 7792215 - DNA, 22 bp, Homo sapiens
ttctgattgctgatgaggccca

SEQ ID NO: 7792216 - DNA, 22 bp, Homo sapiens
ttatgtttgagtatatgactca

SEQ ID NO: 7792217 - DNA, 22 bp, Homo sapiens
ttatttgttttctgagaagtat

SEQ ID NO: 7792218 - DNA, 22 bp, Homo sapiens
tcctctccaggtgagccgaaat

SEQ ID NO: 7792219 - DNA, 22 bp, Homo sapiens
ttatgtgtgtacatgcatatgt

SEQ ID NO: 7792220 - DNA, 22 bp, Homo sapiens
ttcatattcaaatactctgctt

SEQ ID NO: 7792221 - DNA, 22 bp, Homo sapiens
ttcaatatctctaagaatgagg

SEQ ID NO: 7792222 - DNA, 22 bp, Homo sapiens
ttccaagaaacaagtgatgcag

SEQ ID NO: 7792223 - DNA, 22 bp, Homo sapiens
ttggcactgtgcctggcacatt

SEQ ID NO: 7792224 - DNA, 22 bp, Homo sapiens
tttcataatatccagagatttt

SEQ ID NO: 7792225 - DNA, 23 bp, Homo sapiens
tttatttatttaggctgagggat

SEQ ID NO: 7792226 - DNA, 21 bp, Homo sapiens
tttatttatataggacacatg

SEQ ID NO: 7792227 - DNA, 22 bp, Homo sapiens
tttatgagcaatgctgagggga

SEQ ID NO: 7792228 - DNA, 22 bp, Homo sapiens
tttacagatgaggaaactgaga

SEQ ID NO: 7792229 - DNA, 22 bp, Homo sapiens
tttacagagaatgtacataaag

SEQ ID NO: 7792230 - DNA, 19 bp, Homo sapiens
aatgtttaagagaaaaagg

SEQ ID NO: 7792231 - DNA, 22 bp, Homo sapiens
agcaagcagaaatgccatggca

SEQ ID NO: 7792232 - DNA, 22 bp, Homo sapiens
aattttctgatgatgaagcacg

SEQ ID NO: 7792233 - DNA, 22 bp, Homo sapiens
acaaaccagcttaagcaagatg

SEQ ID NO: 7792234 - DNA, 22 bp, Homo sapiens
acagagcatataaagtgctttg

SEQ ID NO: 7792235 - DNA, 22 bp, Homo sapiens
agccatggcgccactagaggga

SEQ ID NO: 7792236 - DNA, 22 bp, Homo sapiens
agccatgggagactgtgggaga

SEQ ID NO: 7792237 - DNA, 22 bp, Homo sapiens
agccatgtcacatatggtcatc

SEQ ID NO: 7792238 - DNA, 22 bp, Homo sapiens
agccatgtatgagggtttccag

SEQ ID NO: 7792239 - DNA, 22 bp, Homo sapiens
agccatgttggggaaggtgggc

SEQ ID NO: 7792240 - DNA, 22 bp, Homo sapiens
agccatgtgtctttattctgtt

SEQ ID NO: 7792241 - DNA, 22 bp, Homo sapiens
agccatgttaaatggacttgat

SEQ ID NO: 7792242 - DNA, 22 bp, Homo sapiens
agccacaggtgttggccagtgt

SEQ ID NO: 7792243 - DNA, 22 bp, Homo sapiens
agccacagggggtgagggacaa

SEQ ID NO: 7792244 - DNA, 22 bp, Homo sapiens
acagaacaagacctgcttattg

SEQ ID NO: 7792245 - DNA, 22 bp, Homo sapiens
aaggcacttaacgtgggaggat

SEQ ID NO: 7792246 - DNA, 22 bp, Homo sapiens
aatccaggtggcggaggttgtg

SEQ ID NO: 7792247 - DNA, 22 bp, Homo sapiens
aatccagggtgtggcctttcca

SEQ ID NO: 7792248 - DNA, 19 bp, Homo sapiens
aatccaggataagcccctt

SEQ ID NO: 7792249 - DNA, 22 bp, Homo sapiens
aaagtgtggcacaagtcacatc

SEQ ID NO: 7792250 - DNA, 22 bp, Homo sapiens
aaagccatcagtaaaatgattt

SEQ ID NO: 7792251 - DNA, 22 bp, Homo sapiens
aaagccatatctattctattct

SEQ ID NO: 7792252 - DNA, 22 bp, Homo sapiens
aaagccataagcctaatactaa

SEQ ID NO: 7792253 - DNA, 22 bp, Homo sapiens
aaagccatgaatgttatagagg

SEQ ID NO: 7792254 - DNA, 22 bp, Homo sapiens
aaagccatctgctggttcgcat

SEQ ID NO: 7792255 - DNA, 22 bp, Homo sapiens
aaagccatctgtattaagtgaa

SEQ ID NO: 7792256 - DNA, 22 bp, Homo sapiens
aaagccatgggtctttggcata

SEQ ID NO: 7792257 - DNA, 22 bp, Homo sapiens
aaacaagcaagcacataatttt

SEQ ID NO: 7792258 - DNA, 22 bp, Homo sapiens
aaacctattggcaagaataata

SEQ ID NO: 7792259 - DNA, 22 bp, Homo sapiens
aaagaggaaccaagagcacgtg

SEQ ID NO: 7792260 - DNA, 22 bp, Homo sapiens
aaagaggatggagtagtcagct

SEQ ID NO: 7792261 - DNA, 18 bp, Homo sapiens
aagaggctgttctgtggg

SEQ ID NO: 7792262 - DNA, 22 bp, Homo sapiens
aagcatggtttctgacgtcatg

SEQ ID NO: 7792263 - DNA, 22 bp, Homo sapiens
aagaagcagagctgtgggtgtt

SEQ ID NO: 7792264 - DNA, 22 bp, Homo sapiens
aagaagcactttcctacatgtt

SEQ ID NO: 7792265 - DNA, 22 bp, Homo sapiens
aaattttagaccaggcaaaact

SEQ ID NO: 7792266 - DNA, 22 bp, Homo sapiens
aactgcataatatatcatgcag

SEQ ID NO: 7792267 - DNA, 22 bp, Homo sapiens
cagaatggcttttatggctcag

SEQ ID NO: 7792268 - DNA, 21 bp, Homo sapiens
cagaggcaggctctgtgtgtg

SEQ ID NO: 7792269 - DNA, 21 bp, Homo sapiens
cagaggcaggtcctgggacgg

SEQ ID NO: 7792270 - DNA, 22 bp, Homo sapiens
cagaggcagtggggttgctcct

SEQ ID NO: 7792271 - DNA, 22 bp, Homo sapiens
agcccaggcagagggatgcttg

SEQ ID NO: 7792272 - DNA, 22 bp, Homo sapiens
cagaggcatataattgctgggg

SEQ ID NO: 7792273 - DNA, 22 bp, Homo sapiens
cagaggcatactcccagtcttg

SEQ ID NO: 7792274 - DNA, 23 bp, Homo sapiens
cagaggcatcggattcaacatca

SEQ ID NO: 7792275 - DNA, 22 bp, Homo sapiens
agcccaggctggagtgcagtgg

SEQ ID NO: 7792276 - DNA, 22 bp, Homo sapiens
cactgcttccattgttcacctg

SEQ ID NO: 7792277 - DNA, 22 bp, Homo sapiens
agcagctgatcaaagcacttat

SEQ ID NO: 7792278 - DNA, 22 bp, Homo sapiens
atggcctccgacccatgacgtg

SEQ ID NO: 7792279 - DNA, 22 bp, Homo sapiens
atggcctggggagcatgggaag

SEQ ID NO: 7792280 - DNA, 22 bp, Homo sapiens
agaccacagtcaggctcctggt

SEQ ID NO: 7792281 - DNA, 22 bp, Homo sapiens
agagcctggggattggcaaggg

SEQ ID NO: 7792282 - DNA, 22 bp, Homo sapiens
atgtggggacaaaatgatggcc

SEQ ID NO: 7792283 - DNA, 22 bp, Homo sapiens
agaggactgttggtcttagaaa

SEQ ID NO: 7792284 - DNA, 22 bp, Homo sapiens
attattattgttgatgttaggg

SEQ ID NO: 7792285 - DNA, 22 bp, Homo sapiens
agaggcactccagccactggtc

SEQ ID NO: 7792286 - DNA, 22 bp, Homo sapiens
attcagtagaagttagctatta

SEQ ID NO: 7792287 - DNA, 22 bp, Homo sapiens
agaggcctgtgtgctccagtgg

SEQ ID NO: 7792288 - DNA, 22 bp, Homo sapiens
attcatttagagggattaagca

SEQ ID NO: 7792289 - DNA, 22 bp, Homo sapiens
agagggagaaaagaatcagttg

SEQ ID NO: 7792290 - DNA, 22 bp, Homo sapiens
attccaggcagaccagagagat

SEQ ID NO: 7792291 - DNA, 22 bp, Homo sapiens
attgctacttcctcaggaaaac

SEQ ID NO: 7792292 - DNA, 22 bp, Homo sapiens
agaggtcttaagatctagactg

SEQ ID NO: 7792293 - DNA, 22 bp, Homo sapiens
agtggcagtagatgagctggtt

SEQ ID NO: 7792294 - DNA, 22 bp, Homo sapiens
actctgtgttttggtggcagca

SEQ ID NO: 7792295 - DNA, 22 bp, Homo sapiens
actaggggctcaggcccaggga

SEQ ID NO: 7792296 - DNA, 22 bp, Homo sapiens
actgggagagcgaccagattct

SEQ ID NO: 7792297 - DNA, 21 bp, Homo sapiens
actgggagaacgagcctttcc

SEQ ID NO: 7792298 - DNA, 22 bp, Homo sapiens
acttaatcattctctctgcttt

SEQ ID NO: 7792299 - DNA, 22 bp, Homo sapiens
aggctctgtttgctgtggtacc

SEQ ID NO: 7792300 - DNA, 22 bp, Homo sapiens
acatttctttctattcagtagc

SEQ ID NO: 7792301 - DNA, 22 bp, Homo sapiens
acatccagatctcagcatggct

SEQ ID NO: 7792302 - DNA, 21 bp, Homo sapiens
acatccagggtcctcactgcc

SEQ ID NO: 7792303 - DNA, 22 bp, Homo sapiens
aggcactgggggatgagcaagg

SEQ ID NO: 7792304 - DNA, 20 bp, Homo sapiens
aggcactggatttcttatat

SEQ ID NO: 7792305 - DNA, 22 bp, Homo sapiens
aggacacagctcttcagtaaga

SEQ ID NO: 7792306 - DNA, 22 bp, Homo sapiens
aggagcagaatttaatgtgcag

SEQ ID NO: 7792307 - DNA, 22 bp, Homo sapiens
aggagcactgagccagcatggg

SEQ ID NO: 7792308 - DNA, 22 bp, Homo sapiens
acagtgtgtgctttcccttacg

SEQ ID NO: 7792309 - DNA, 22 bp, Homo sapiens
agctggcacagaccaggagatc

SEQ ID NO: 7792310 - DNA, 22 bp, Homo sapiens
agctggcagctctcaggggtac

SEQ ID NO: 7792311 - DNA, 21 bp, Homo sapiens
agctggcagatatggtgtctg

SEQ ID NO: 7792312 - DNA, 22 bp, Homo sapiens
aggacacactgttctcacgtaa

SEQ ID NO: 7792313 - DNA, 22 bp, Homo sapiens
agctgctgcgcctcaccctggc

SEQ ID NO: 7792314 - DNA, 22 bp, Homo sapiens
caggcactgtgcctcgctccct

SEQ ID NO: 7792315 - DNA, 22 bp, Homo sapiens
caggcactgtgctagatccttg

SEQ ID NO: 7792316 - DNA, 22 bp, Homo sapiens
caggcactggccagtcagcaca

SEQ ID NO: 7792317 - DNA, 22 bp, Homo sapiens
caggctggagttacctttaggg

SEQ ID NO: 7792318 - DNA, 22 bp, Homo sapiens
aggcactgtgctgatgtcttat

SEQ ID NO: 7792319 - DNA, 22 bp, Homo sapiens
aggcactggtctaccccttagt

SEQ ID NO: 7792320 - DNA, 22 bp, Homo sapiens
aggcactgtactaggtacaggg

SEQ ID NO: 7792321 - DNA, 15 bp, Homo sapiens
aggcactgtgggacc

SEQ ID NO: 7792322 - DNA, 22 bp, Homo sapiens
aggcactgtggaagacatggtt

SEQ ID NO: 7792323 - DNA, 23 bp, Homo sapiens
catggggagcagtgctcctgacc

SEQ ID NO: 7792324 - DNA, 22 bp, Homo sapiens
catggggatgaggctgagactt

SEQ ID NO: 7792325 - DNA, 22 bp, Homo sapiens
cccaggatgatcgagagtggga

SEQ ID NO: 7792326 - DNA, 22 bp, Homo sapiens
cccaggatcacctggtcaaggg

SEQ ID NO: 7792327 - DNA, 18 bp, Homo sapiens
aggccctggcctcgaaca

SEQ ID NO: 7792328 - DNA, 22 bp, Homo sapiens
aggccctgggagcagagatgca

SEQ ID NO: 7792329 - DNA, 22 bp, Homo sapiens
aggccctgggcagttctgtagc

SEQ ID NO: 7792330 - DNA, 22 bp, Homo sapiens
aggccctgggttagggcccact

SEQ ID NO: 7792331 - DNA, 22 bp, Homo sapiens
aggccctggcccccagagattc

SEQ ID NO: 7792332 - DNA, 22 bp, Homo sapiens
aggccctggcactgcctgggag

SEQ ID NO: 7792333 - DNA, 22 bp, Homo sapiens
aggctgaggtgtgctgtgatcg

SEQ ID NO: 7792334 - DNA, 22 bp, Homo sapiens
aggctctgtgatccacaatgag

SEQ ID NO: 7792335 - DNA, 22 bp, Homo sapiens
ccaggagctggcatgtggagag

SEQ ID NO: 7792336 - DNA, 21 bp, Homo sapiens
ctcaggcatttgaggagagtc

SEQ ID NO: 7792337 - DNA, 22 bp, Homo sapiens
ctcaggcacgggtcagtgagcg

SEQ ID NO: 7792338 - DNA, 22 bp, Homo sapiens
ctctgtttttcaatagttcttg

SEQ ID NO: 7792339 - DNA, 22 bp, Homo sapiens
ctgccctctagggatgcactgg

SEQ ID NO: 7792340 - DNA, 22 bp, Homo sapiens
agtttctagcctcactgtttag

SEQ ID NO: 7792341 - DNA, 22 bp, Homo sapiens
atctgcatttgaacaagctcct

SEQ ID NO: 7792342 - DNA, 22 bp, Homo sapiens
ctgtttctccacactcttccca

SEQ ID NO: 7792343 - DNA, 21 bp, Homo sapiens
atcagggatgggttggacacc

SEQ ID NO: 7792344 - DNA, 22 bp, Homo sapiens
atcaggaagtctgccacaaggc

SEQ ID NO: 7792345 - DNA, 22 bp, Homo sapiens
ctgtccagctgaccagagcagc

SEQ ID NO: 7792346 - DNA, 22 bp, Homo sapiens
ctgtatggtccacgtgggtgcc

SEQ ID NO: 7792347 - DNA, 22 bp, Homo sapiens
ctggtggggagtcctggtctcc

SEQ ID NO: 7792348 - DNA, 22 bp, Homo sapiens
gctctgctgtggaatcctctcc

SEQ ID NO: 7792349 - DNA, 22 bp, Homo sapiens
gctctgctgtcttcttgcaggc

SEQ ID NO: 7792350 - DNA, 22 bp, Homo sapiens
atttatgcatcccagcatgtga

SEQ ID NO: 7792351 - DNA, 20 bp, Homo sapiens
gcatggcatgtagtgaagtg

SEQ ID NO: 7792352 - DNA, 22 bp, Homo sapiens
gcatggcattaacaagatggaa

SEQ ID NO: 7792353 - DNA, 22 bp, Homo sapiens
gccagctgcatctcctgggctg

SEQ ID NO: 7792354 - DNA, 22 bp, Homo sapiens
gcccaggagttgaatgcagcag

SEQ ID NO: 7792355 - DNA, 22 bp, Homo sapiens
gatggcagtcaaccaggtgagg

SEQ ID NO: 7792356 - DNA, 22 bp, Homo sapiens
gatggcagcagcagccagggat

SEQ ID NO: 7792357 - DNA, 22 bp, Homo sapiens
gcatggcagccagtacatggtg

SEQ ID NO: 7792358 - DNA, 21 bp, Homo sapiens
gcatggcaggtcactggggca

SEQ ID NO: 7792359 - DNA, 22 bp, Homo sapiens
gcatggcagtgaggatggtgct

SEQ ID NO: 7792360 - DNA, 22 bp, Homo sapiens
gcatggagaagtgggaacaggt

SEQ ID NO: 7792361 - DNA, 22 bp, Homo sapiens
attctgaagttgcaggagaagc

SEQ ID NO: 7792362 - DNA, 22 bp, Homo sapiens
attcacaactgatccttgctca

SEQ ID NO: 7792363 - DNA, 19 bp, Homo sapiens
attcatttttgccttctaa

SEQ ID NO: 7792364 - DNA, 22 bp, Homo sapiens
atgggagccatcgcatttgctg

SEQ ID NO: 7792365 - DNA, 22 bp, Homo sapiens
atggcactgacctcccttgtaa

SEQ ID NO: 7792366 - DNA, 22 bp, Homo sapiens
atggcactaagagggagctgga

SEQ ID NO: 7792367 - DNA, 22 bp, Homo sapiens
atgtgcttggaaaagcagtggt

SEQ ID NO: 7792368 - DNA, 22 bp, Homo sapiens
gaggcctgggttggaggtgcat

SEQ ID NO: 7792369 - DNA, 22 bp, Homo sapiens
atctttcctgttttcagacagc

SEQ ID NO: 7792370 - DNA, 16 bp, Homo sapiens
atgctgctattagagg

SEQ ID NO: 7792371 - DNA, 22 bp, Homo sapiens
ggagaagggacagactcagctt

SEQ ID NO: 7792372 - DNA, 22 bp, Homo sapiens
gctctggaacctgccaggatgc

SEQ ID NO: 7792373 - DNA, 23 bp, Homo sapiens
gctctggagctgggcctggcagg

SEQ ID NO: 7792374 - DNA, 22 bp, Homo sapiens
gctgcctgcacagagctgcttt

SEQ ID NO: 7792375 - DNA, 22 bp, Homo sapiens
caagccattctcctgcctcagc

SEQ ID NO: 7792376 - DNA, 20 bp, Homo sapiens
ggctctggaatctggtgggc

SEQ ID NO: 7792377 - DNA, 22 bp, Homo sapiens
ggctggcaagtcagtgctgatg

SEQ ID NO: 7792378 - DNA, 17 bp, Homo sapiens
ggctgctgtgctggtgc

SEQ ID NO: 7792379 - DNA, 22 bp, Homo sapiens
cacttgggagcattgcacatgt

SEQ ID NO: 7792380 - DNA, 22 bp, Homo sapiens
cacttgggacaaagcttctgct

SEQ ID NO: 7792381 - DNA, 22 bp, Homo sapiens
cactccagcctcagtgacagag

SEQ ID NO: 7792382 - DNA, 22 bp, Homo sapiens
caccaggctggagtgcagaggt

SEQ ID NO: 7792383 - DNA, 22 bp, Homo sapiens
ggccaggctgccctgggagcag

SEQ ID NO: 7792384 - DNA, 22 bp, Homo sapiens
ggggcagctaccggaagtaggg

SEQ ID NO: 7792385 - DNA, 22 bp, Homo sapiens
gggtagcatgtgtcagagtttg

SEQ ID NO: 7792386 - DNA, 20 bp, Homo sapiens
cagatggcacgtcagggcat

SEQ ID NO: 7792387 - DNA, 22 bp, Homo sapiens
cagagacagaaaatggatctag

SEQ ID NO: 7792388 - DNA, 22 bp, Homo sapiens
cagagacacttaacaggaatgg

SEQ ID NO: 7792389 - DNA, 22 bp, Homo sapiens
ggctggcacagagggctggtgt

SEQ ID NO: 7792390 - DNA, 22 bp, Homo sapiens
ggctggcactctgtccagtgtc

SEQ ID NO: 7792391 - DNA, 22 bp, Homo sapiens
ggctggcactgaggagagctct

SEQ ID NO: 7792392 - DNA, 22 bp, Homo sapiens
cagaattatagttgctttttaa

SEQ ID NO: 7792393 - DNA, 22 bp, Homo sapiens
tcagctttggtcacattgagtt

SEQ ID NO: 7792394 - DNA, 22 bp, Homo sapiens
tcacagacgcatcctcaggtag

SEQ ID NO: 7792395 - DNA, 22 bp, Homo sapiens
tcacagactgtgttgctactca

SEQ ID NO: 7792396 - DNA, 22 bp, Homo sapiens
tccaggcccatggagcagagct

SEQ ID NO: 7792397 - DNA, 20 bp, Homo sapiens
tccaggcagctcagagtgtc

SEQ ID NO: 7792398 - DNA, 21 bp, Homo sapiens
tccagacctccctctcctagc

SEQ ID NO: 7792399 - DNA, 22 bp, Homo sapiens
tccagactctgtcacttcctag

SEQ ID NO: 7792400 - DNA, 22 bp, Homo sapiens
tccagcctaatgttcttcccac

SEQ ID NO: 7792401 - DNA, 22 bp, Homo sapiens
tccagcctcatttctcctgctt

SEQ ID NO: 7792402 - DNA, 17 bp, Homo sapiens
tccagcctcctctgctg

SEQ ID NO: 7792403 - DNA, 22 bp, Homo sapiens
tccagcctcctatttaccctaa

SEQ ID NO: 7792404 - DNA, 22 bp, Homo sapiens
tcatttatgcaggaatggcata

SEQ ID NO: 7792405 - DNA, 22 bp, Homo sapiens
tccctcagaaattctctctgaa

SEQ ID NO: 7792406 - DNA, 22 bp, Homo sapiens
tcccaggatctgagggcagaga

SEQ ID NO: 7792407 - DNA, 22 bp, Homo sapiens
tcccaggacatgggctctgctc

SEQ ID NO: 7792408 - DNA, 22 bp, Homo sapiens
tcccaggacttccagttggagg

SEQ ID NO: 7792409 - DNA, 22 bp, Homo sapiens
tcccaggaattgaagccagtgt

SEQ ID NO: 7792410 - DNA, 22 bp, Homo sapiens
tcccaggacaggccacatggaa

SEQ ID NO: 7792411 - DNA, 22 bp, Homo sapiens
tcctttccagcctcacctcagc

SEQ ID NO: 7792412 - DNA, 22 bp, Homo sapiens
ccctgtggaggaggagagcagt

SEQ ID NO: 7792413 - DNA, 20 bp, Homo sapiens
ccctaggaacgcagcaggag

SEQ ID NO: 7792414 - DNA, 22 bp, Homo sapiens
tggaagggaacaggtgggtgtt

SEQ ID NO: 7792415 - DNA, 22 bp, Homo sapiens
tggaagggaaagtttggggtcc

SEQ ID NO: 7792416 - DNA, 21 bp, Homo sapiens
tgctttctaaaaatactattg

SEQ ID NO: 7792417 - DNA, 22 bp, Homo sapiens
tgcctcataacactcctggagt

SEQ ID NO: 7792418 - DNA, 22 bp, Homo sapiens
tgcctcagtttctccatatgaa

SEQ ID NO: 7792419 - DNA, 22 bp, Homo sapiens
tgggagcaggtgtgctagggaa

SEQ ID NO: 7792420 - DNA, 22 bp, Homo sapiens
tgggagcagttcaggtgtggct

SEQ ID NO: 7792421 - DNA, 22 bp, Homo sapiens
tgggagcagttgtgaagctcag

SEQ ID NO: 7792422 - DNA, 22 bp, Homo sapiens
tgggagccattttagaggctgc

SEQ ID NO: 7792423 - DNA, 22 bp, Homo sapiens
cctcttctgcttcaggagcact

SEQ ID NO: 7792424 - DNA, 22 bp, Homo sapiens
tgggggtgtcctggtgcacaca

SEQ ID NO: 7792425 - DNA, 22 bp, Homo sapiens
tgggggtggttcttgcctccag

SEQ ID NO: 7792426 - DNA, 22 bp, Homo sapiens
tgggggtgtgccagggacctcc

SEQ ID NO: 7792427 - DNA, 22 bp, Homo sapiens
tgtaagtagtaatggaaggaca

SEQ ID NO: 7792428 - DNA, 20 bp, Homo sapiens
tggtctggagccagtgagga

SEQ ID NO: 7792429 - DNA, 22 bp, Homo sapiens
tgaacaggtcttagtaggttct

SEQ ID NO: 7792430 - DNA, 22 bp, Homo sapiens
tgaacaggagaaaggtttcttt

SEQ ID NO: 7792431 - DNA, 22 bp, Homo sapiens
tctttcaaagctgtagtagatt

SEQ ID NO: 7792432 - DNA, 21 bp, Homo sapiens
tcttgtccttgctctcccact

SEQ ID NO: 7792433 - DNA, 22 bp, Homo sapiens
tgaggaatgctgagcagaggaa

SEQ ID NO: 7792434 - DNA, 19 bp, Homo sapiens
ccatggagagagatgcatt

SEQ ID NO: 7792435 - DNA, 22 bp, Homo sapiens
ccagtgtgggcccggcctcctc

SEQ ID NO: 7792436 - DNA, 22 bp, Homo sapiens
tgcagaggtttccaggcaagtt

SEQ ID NO: 7792437 - DNA, 22 bp, Homo sapiens
tgcagaggtgaaagactagcaa

SEQ ID NO: 7792438 - DNA, 22 bp, Homo sapiens
ctctgaaggtttctgttactgt

SEQ ID NO: 7792439 - DNA, 22 bp, Homo sapiens
ctctggtttatttcttggaaag

SEQ ID NO: 7792440 - DNA, 22 bp, Homo sapiens
ctctggttgagtgagaaccaag

SEQ ID NO: 7792441 - DNA, 22 bp, Homo sapiens
tttctcaaggtgtcatgtattt

SEQ ID NO: 7792442 - DNA, 22 bp, Homo sapiens
tttctcaagttcagatatttga

SEQ ID NO: 7792443 - DNA, 22 bp, Homo sapiens
tttctacacttcgtggtgtttt

SEQ ID NO: 7792444 - DNA, 22 bp, Homo sapiens
tttcagaaattatattagatgc

SEQ ID NO: 7792445 - DNA, 22 bp, Homo sapiens
tttattcatcatctgttcatat

SEQ ID NO: 7792446 - DNA, 22 bp, Homo sapiens
tttcagaatatcgattcagtga

SEQ ID NO: 7792447 - DNA, 22 bp, Homo sapiens
tttattcacttcagtgccaaag

SEQ ID NO: 7792448 - DNA, 22 bp, Homo sapiens
tttattcactggggtctgcccg

SEQ ID NO: 7792449 - DNA, 18 bp, Homo sapiens
tttatgagctgtgggacc

SEQ ID NO: 7792450 - DNA, 22 bp, Homo sapiens
ctcttcctagtgtgcagcgtgg

SEQ ID NO: 7792451 - DNA, 22 bp, Homo sapiens
ctcttcctacagtctgctatgc

SEQ ID NO: 7792452 - DNA, 22 bp, Homo sapiens
ctgagccaaaaagcagagcttg

SEQ ID NO: 7792453 - DNA, 22 bp, Homo sapiens
ctgaggcctgtgttggggcagt

SEQ ID NO: 7792454 - DNA, 22 bp, Homo sapiens
ctggagccccaggctgtgcaga

SEQ ID NO: 7792455 - DNA, 22 bp, Homo sapiens
ctggagccctgaatgggcagga

SEQ ID NO: 7792456 - DNA, 22 bp, Homo sapiens
ctggaaggagcccgggcggatc

SEQ ID NO: 7792457 - DNA, 22 bp, Homo sapiens
ctgctgtcaaaaatcactccat

SEQ ID NO: 7792458 - DNA, 19 bp, Homo sapiens
ctgctgggtgctgagggag

SEQ ID NO: 7792459 - DNA, 22 bp, Homo sapiens
ctgctctgtttcttagctgggt

SEQ ID NO: 7792460 - DNA, 22 bp, Homo sapiens
ttctggaagccccagagtcaga

SEQ ID NO: 7792461 - DNA, 22 bp, Homo sapiens
ttctggaagctgggcagcaccc

SEQ ID NO: 7792462 - DNA, 22 bp, Homo sapiens
ttctatttccagtccttcagag

SEQ ID NO: 7792463 - DNA, 22 bp, Homo sapiens
ttctatttcttaatcttggctg

SEQ ID NO: 7792464 - DNA, 22 bp, Homo sapiens
ctcagggtaatgaaagacgaat

SEQ ID NO: 7792465 - DNA, 22 bp, Homo sapiens
ctcagggtgagaaattgatcca

SEQ ID NO: 7792466 - DNA, 22 bp, Homo sapiens
ttaagcataattaaagtgaaat

SEQ ID NO: 7792467 - DNA, 22 bp, Homo sapiens
ttaagaggagatcatactggag

SEQ ID NO: 7792468 - DNA, 22 bp, Homo sapiens
ttatttcatataatgttatcaa

SEQ ID NO: 7792469 - DNA, 22 bp, Homo sapiens
ttatttattgtgtacctactgt

SEQ ID NO: 7792470 - DNA, 22 bp, Homo sapiens
ccttttcttgccactgactcgg

SEQ ID NO: 7792471 - DNA, 22 bp, Homo sapiens
cgggcaaggcgagactaggccc

SEQ ID NO: 7792472 - DNA, 22 bp, Homo sapiens
gacctggggtggaaggaaggca

SEQ ID NO: 7792473 - DNA, 22 bp, Homo sapiens
gacatgcatattcactcttctt

SEQ ID NO: 7792474 - DNA, 22 bp, Homo sapiens
gacagcagccacagggagaggg

SEQ ID NO: 7792475 - DNA, 22 bp, Homo sapiens
gacagcaggatgtgaggggatg

SEQ ID NO: 7792476 - DNA, 22 bp, Homo sapiens
gagcaccgcctccacgatgccc

SEQ ID NO: 7792477 - DNA, 22 bp, Homo sapiens
gagcactgaggaaagctggtta

SEQ ID NO: 7792478 - DNA, 18 bp, Homo sapiens
gagcactggtgttgaggt

SEQ ID NO: 7792479 - DNA, 22 bp, Homo sapiens
gagaagcaggtttagcagacaa

SEQ ID NO: 7792480 - DNA, 22 bp, Homo sapiens
gagaagcaatcagcagccaccc

SEQ ID NO: 7792481 - DNA, 22 bp, Homo sapiens
gaggcctggaccagccacagag

SEQ ID NO: 7792482 - DNA, 21 bp, Homo sapiens
gaggccactaataggggcaga

SEQ ID NO: 7792483 - DNA, 22 bp, Homo sapiens
gaggactgcagatgggtgcatc

SEQ ID NO: 7792484 - DNA, 21 bp, Homo sapiens
gaggactgcacactctgattg

SEQ ID NO: 7792485 - DNA, 22 bp, Homo sapiens
gagctgtgaaaagtgcctgggg

SEQ ID NO: 7792486 - DNA, 22 bp, Homo sapiens
gaggtgctgctgtacttcttgc

SEQ ID NO: 7792487 - DNA, 21 bp, Homo sapiens
gaggctgtctgctgctggcct

SEQ ID NO: 7792488 - DNA, 22 bp, Homo sapiens
gaggctgtctgttagcctggga

SEQ ID NO: 7792489 - DNA, 22 bp, Homo sapiens
gaggccttagagcttttctaga

SEQ ID NO: 7792490 - DNA, 22 bp, Homo sapiens
ctgtggagtttgtggcgctgac

SEQ ID NO: 7792491 - DNA, 22 bp, Homo sapiens
ctggttttccaatgttttgact

SEQ ID NO: 7792492 - DNA, 22 bp, Homo sapiens
ctgggggtcttgaaagggagag

SEQ ID NO: 7792493 - DNA, 22 bp, Homo sapiens
ctgggagtcaccaggagcaagg

SEQ ID NO: 7792494 - DNA, 22 bp, Homo sapiens
ctttggcaacacatgtgggaca

SEQ ID NO: 7792495 - DNA, 20 bp, Homo sapiens
cttcttcagcctatgcttca

SEQ ID NO: 7792496 - DNA, 22 bp, Homo sapiens
cttcttctctacatcctttgat

SEQ ID NO: 7792497 - DNA, 22 bp, Homo sapiens
ctttctctgtgtttcacatgct

SEQ ID NO: 7792498 - DNA, 22 bp, Homo sapiens
gctcatattcaactatcttcac

SEQ ID NO: 7792499 - DNA, 22 bp, Homo sapiens
gcctggcaggaatctcagtgct

SEQ ID NO: 7792500 - DNA, 22 bp, Homo sapiens
gctggaggtagggaggtcctgt

SEQ ID NO: 7792501 - DNA, 22 bp, Homo sapiens
gctggcagggtggttgagagag

SEQ ID NO: 7792502 - DNA, 22 bp, Homo sapiens
gctggcagtaaagggtttggca

SEQ ID NO: 7792503 - DNA, 22 bp, Homo sapiens
gcttttattgtctttacgacga

SEQ ID NO: 7792504 - DNA, 22 bp, Homo sapiens
gcaggcctcccctgctggagct

SEQ ID NO: 7792505 - DNA, 22 bp, Homo sapiens
gcagcaaacttccacaagtaga

SEQ ID NO: 7792506 - DNA, 22 bp, Homo sapiens
gcagacagggctacagaggtac

SEQ ID NO: 7792507 - DNA, 22 bp, Homo sapiens
gcacagactttgattgcagtca

SEQ ID NO: 7792508 - DNA, 22 bp, Homo sapiens
gccagagacacttggaggtaga

SEQ ID NO: 7792509 - DNA, 22 bp, Homo sapiens
gccagctggtaggcacctagcc

SEQ ID NO: 7792510 - DNA, 22 bp, Homo sapiens
gccctgctgctggcagaggcgc

SEQ ID NO: 7792511 - DNA, 22 bp, Homo sapiens
gcccgcagagatctttaacaaa

SEQ ID NO: 7792512 - DNA, 22 bp, Homo sapiens
ggctggcaggcacagtatgcaa

SEQ ID NO: 7792513 - DNA, 22 bp, Homo sapiens
ggctggcagaggggagtctgtg

SEQ ID NO: 7792514 - DNA, 22 bp, Homo sapiens
ggctggcagaagtgtgctggct

SEQ ID NO: 7792515 - DNA, 22 bp, Homo sapiens
ggctgtggtctgggtgctcccc

SEQ ID NO: 7792516 - DNA, 22 bp, Homo sapiens
ggctgtgggccagctagaccct

SEQ ID NO: 7792517 - DNA, 22 bp, Homo sapiens
ggctgtggggccgggtacagtg

SEQ ID NO: 7792518 - DNA, 22 bp, Homo sapiens
ggctgtggggccgggtacagtg

SEQ ID NO: 7792519 - DNA, 22 bp, Homo sapiens
ggctgtggggggagcctgcccg

SEQ ID NO: 7792520 - DNA, 22 bp, Homo sapiens
ggctgtggcagctggaagtggt

SEQ ID NO: 7792521 - DNA, 22 bp, Homo sapiens
gggaagagtaactagcccatgt

SEQ ID NO: 7792522 - DNA, 22 bp, Homo sapiens
ggcacgtgcctaaggagcaggc

SEQ ID NO: 7792523 - DNA, 22 bp, Homo sapiens
gtaatttttagttcattctatc

SEQ ID NO: 7792524 - DNA, 22 bp, Homo sapiens
ggggatctaggcttatgagggc

SEQ ID NO: 7792525 - DNA, 22 bp, Homo sapiens
gtccaggaatcaaaagatggaa

SEQ ID NO: 7792526 - DNA, 20 bp, Homo sapiens
gtccaggacccagcaggagg

SEQ ID NO: 7792527 - DNA, 22 bp, Homo sapiens
gtacaaattaggaagctttgtg

SEQ ID NO: 7792528 - DNA, 22 bp, Homo sapiens
gtctatgatattttgttatagc

SEQ ID NO: 7792529 - DNA, 22 bp, Homo sapiens
gtgaggagctctttgactcacg

SEQ ID NO: 7792530 - DNA, 22 bp, Homo sapiens
tcctcagaatcacctggcagct

SEQ ID NO: 7792531 - DNA, 22 bp, Homo sapiens
tcctcagaaacccctgtgaggt

SEQ ID NO: 7792532 - DNA, 22 bp, Homo sapiens
tcctcagaagaacccctagatt

SEQ ID NO: 7792533 - DNA, 22 bp, Homo sapiens
tcctcagaatggatggcagggg

SEQ ID NO: 7792534 - DNA, 22 bp, Homo sapiens
tccctgggagatgatgatgagg

SEQ ID NO: 7792535 - DNA, 22 bp, Homo sapiens
tccctgggaacaaaggatgaga

SEQ ID NO: 7792536 - DNA, 22 bp, Homo sapiens
tccctcagggtgcagttgcttt

SEQ ID NO: 7792537 - DNA, 20 bp, Homo sapiens
tccctcaggtcattgggctg

SEQ ID NO: 7792538 - DNA, 22 bp, Homo sapiens
tccaggtctggcctgctaggca

SEQ ID NO: 7792539 - DNA, 22 bp, Homo sapiens
tccaggctacttggattcctgg

SEQ ID NO: 7792540 - DNA, 22 bp, Homo sapiens
tcctcttcagagggacctcggg

SEQ ID NO: 7792541 - DNA, 22 bp, Homo sapiens
tcctcttcaaaatagctctgaa

SEQ ID NO: 7792542 - DNA, 22 bp, Homo sapiens
tcctcttcaaaaggatttcctt

SEQ ID NO: 7792543 - DNA, 22 bp, Homo sapiens
tcctcttctgcccatcagaggc

SEQ ID NO: 7792544 - DNA, 22 bp, Homo sapiens
tcctcttctgcctatatctgcc

SEQ ID NO: 7792545 - DNA, 22 bp, Homo sapiens
tcctcttctgtggattccctga

SEQ ID NO: 7792546 - DNA, 22 bp, Homo sapiens
tcctctttaaatgcttttatct

SEQ ID NO: 7792547 - DNA, 22 bp, Homo sapiens
tcctgaaattctggttgtcact

SEQ ID NO: 7792548 - DNA, 22 bp, Homo sapiens
tcatctttaccccttgcttcaa

SEQ ID NO: 7792549 - DNA, 22 bp, Homo sapiens
tcatcttctattaatagggaga

SEQ ID NO: 7792550 - DNA, 22 bp, Homo sapiens
tcatttctgagccttccatgat

SEQ ID NO: 7792551 - DNA, 22 bp, Homo sapiens
tcatttctattgctactgtctg

SEQ ID NO: 7792552 - DNA, 22 bp, Homo sapiens
tcatttcagttgttccctggtt

SEQ ID NO: 7792553 - DNA, 22 bp, Homo sapiens
tcatttcagttcagaggccttt

SEQ ID NO: 7792554 - DNA, 22 bp, Homo sapiens
tcatttcagtggcacagaagat

SEQ ID NO: 7792555 - DNA, 22 bp, Homo sapiens
tcatttcagatgcatttagaat

SEQ ID NO: 7792556 - DNA, 22 bp, Homo sapiens
tcatttgttcatctgctcttct

SEQ ID NO: 7792557 - DNA, 19 bp, Homo sapiens
tccaaagaagttcacattt

SEQ ID NO: 7792558 - DNA, 22 bp, Homo sapiens
tccaaggcatagacacagtgcc

SEQ ID NO: 7792559 - DNA, 20 bp, Homo sapiens
tccaatgtaggataaatgtg

SEQ ID NO: 7792560 - DNA, 22 bp, Homo sapiens
tcacatttctttatgtagtctt

SEQ ID NO: 7792561 - DNA, 20 bp, Homo sapiens
tcagaacagtagaggagcta

SEQ ID NO: 7792562 - DNA, 22 bp, Homo sapiens
tcagaacagctctcagatatcc

SEQ ID NO: 7792563 - DNA, 22 bp, Homo sapiens
tcagaacagcagggtgtggctg

SEQ ID NO: 7792564 - DNA, 22 bp, Homo sapiens
tcagaacaggactggctgccat

SEQ ID NO: 7792565 - DNA, 22 bp, Homo sapiens
tcagaacagaagaaggaacacg

SEQ ID NO: 7792566 - DNA, 22 bp, Homo sapiens
tcagaacagcacagggtgattt

SEQ ID NO: 7792567 - DNA, 22 bp, Homo sapiens
tcagaacagaagctggctataa

SEQ ID NO: 7792568 - DNA, 22 bp, Homo sapiens
tcacatttgtgttttattagag

SEQ ID NO: 7792569 - DNA, 22 bp, Homo sapiens
tcacatttgtgttttattagag

SEQ ID NO: 7792570 - DNA, 22 bp, Homo sapiens
tcacattttatctattttaagt

SEQ ID NO: 7792571 - DNA, 20 bp, Homo sapiens
tcagcatgctcctcagacat

SEQ ID NO: 7792572 - DNA, 18 bp, Homo sapiens
tcagatttaactgtatcc

SEQ ID NO: 7792573 - DNA, 22 bp, Homo sapiens
tcagaattagagctcttcttga

SEQ ID NO: 7792574 - DNA, 22 bp, Homo sapiens
tcagaattaagctcttggtcag

SEQ ID NO: 7792575 - DNA, 19 bp, Homo sapiens
tcagaattctgtctcttga

SEQ ID NO: 7792576 - DNA, 23 bp, Homo sapiens
tcagaattccagtttctttgaag

SEQ ID NO: 7792577 - DNA, 22 bp, Homo sapiens
taagaggatatttggccagaag

SEQ ID NO: 7792578 - DNA, 22 bp, Homo sapiens
gttatgatggccctttcctggt

SEQ ID NO: 7792579 - DNA, 22 bp, Homo sapiens
taagccatcatcatggctttgg

SEQ ID NO: 7792580 - DNA, 22 bp, Homo sapiens
taattattgtctgaagagttat

SEQ ID NO: 7792581 - DNA, 22 bp, Homo sapiens
taattattctagtcacatagca

SEQ ID NO: 7792582 - DNA, 22 bp, Homo sapiens
taccaggcagctgcacagaggc

SEQ ID NO: 7792583 - DNA, 22 bp, Homo sapiens
tacttacagagcttataagtta

SEQ ID NO: 7792584 - DNA, 22 bp, Homo sapiens
tactctgccactaggagttctg

SEQ ID NO: 7792585 - DNA, 22 bp, Homo sapiens
tatgtttgttatcacaactagg

SEQ ID NO: 7792586 - DNA, 22 bp, Homo sapiens
tatgtatagagtcttttaaatt

SEQ ID NO: 7792587 - DNA, 18 bp, Homo sapiens
tatgtataacatagttca

SEQ ID NO: 7792588 - DNA, 22 bp, Homo sapiens
tatgtagtcaagtggatatatg

SEQ ID NO: 7792589 - DNA, 22 bp, Homo sapiens
tattgtatcttctgtttagaag

SEQ ID NO: 7792590 - DNA, 22 bp, Homo sapiens
tatttgatgaaggtaaagtctt

SEQ ID NO: 7792591 - DNA, 22 bp, Homo sapiens
tatttggacaccaagtagaagt

SEQ ID NO: 7792592 - DNA, 21 bp, Homo sapiens
tagaagcacataggttcaaag

SEQ ID NO: 7792593 - DNA, 22 bp, Homo sapiens
tagttattgcctaggagcagct

SEQ ID NO: 7792594 - DNA, 22 bp, Homo sapiens
tagggctttgctcatcctaggt

SEQ ID NO: 7792595 - DNA, 22 bp, Homo sapiens
ttttctgtttgcttcaagacat

SEQ ID NO: 7792596 - DNA, 22 bp, Homo sapiens
tttcctctccaccaggaggtct

SEQ ID NO: 7792597 - DNA, 22 bp, Homo sapiens
tttcctctccggggcctccagg

SEQ ID NO: 7792598 - DNA, 22 bp, Homo sapiens
tttcctctccggggcctccagg

SEQ ID NO: 7792599 - DNA, 22 bp, Homo sapiens
tttcctctgactgctcccctgc

SEQ ID NO: 7792600 - DNA, 22 bp, Homo sapiens
tttcctctgatgctgacttgga

SEQ ID NO: 7792601 - DNA, 22 bp, Homo sapiens
tttcctctgagtgagctgggag

SEQ ID NO: 7792602 - DNA, 22 bp, Homo sapiens
tttcctctaaacgcatttgctt

SEQ ID NO: 7792603 - DNA, 22 bp, Homo sapiens
tttcctctccaccaggaggtct

SEQ ID NO: 7792604 - DNA, 22 bp, Homo sapiens
tttcctcctagcctccagccgc

SEQ ID NO: 7792605 - DNA, 22 bp, Homo sapiens
tttgaagataaatatggagaaa

SEQ ID NO: 7792606 - DNA, 22 bp, Homo sapiens
tttgatttactggatattctca

SEQ ID NO: 7792607 - DNA, 22 bp, Homo sapiens
ttatagttagtaggtcattaaa

SEQ ID NO: 7792608 - DNA, 22 bp, Homo sapiens
ttcaaagagttgggtgtctggg

SEQ ID NO: 7792609 - DNA, 22 bp, Homo sapiens
ttcatttgtggtgaatgaagtg

SEQ ID NO: 7792610 - DNA, 22 bp, Homo sapiens
ttcatttgggatgagtcagaag

SEQ ID NO: 7792611 - DNA, 22 bp, Homo sapiens
ttcatttaatttgtgtattaac

SEQ ID NO: 7792612 - DNA, 22 bp, Homo sapiens
ttcagttttctttagaatgtag

SEQ ID NO: 7792613 - DNA, 22 bp, Homo sapiens
ttcagtttcaaatcctggatgc

SEQ ID NO: 7792614 - DNA, 22 bp, Homo sapiens
ttcagtttcaaatcctgtgaag

SEQ ID NO: 7792615 - DNA, 22 bp, Homo sapiens
ttcttttaatgtctggctttca

SEQ ID NO: 7792616 - DNA, 22 bp, Homo sapiens
ttctctcccatgaagcttctat

SEQ ID NO: 7792617 - DNA, 22 bp, Homo sapiens
ttctctctggacctgggatgcg

SEQ ID NO: 7792618 - DNA, 22 bp, Homo sapiens
ttgggagcttggccgagatgta

SEQ ID NO: 7792619 - DNA, 22 bp, Homo sapiens
ttgggagcaaataggaaagagg

SEQ ID NO: 7792620 - DNA, 22 bp, Homo sapiens
ttgggagctggaagcaaggcct

SEQ ID NO: 7792621 - DNA, 22 bp, Homo sapiens
ttgggagcatttagaaaagacg

SEQ ID NO: 7792622 - DNA, 22 bp, Homo sapiens
ttgggagcttggacttagtgtg

SEQ ID NO: 7792623 - DNA, 22 bp, Homo sapiens
ttggcagtagtggtagtacatt

SEQ ID NO: 7792624 - DNA, 22 bp, Homo sapiens
ttggcagtctcagtcagatggc

SEQ ID NO: 7792625 - DNA, 22 bp, Homo sapiens
ttggcagtgtcactagggagcc

SEQ ID NO: 7792626 - DNA, 22 bp, Homo sapiens
ttggcagtagtctcggctaccc

SEQ ID NO: 7792627 - DNA, 22 bp, Homo sapiens
ttgcacaaaaaattgttgaata

SEQ ID NO: 7792628 - DNA, 22 bp, Homo sapiens
tttatcatcttgtttttaaagc

SEQ ID NO: 7792629 - DNA, 21 bp, Homo sapiens
tttatcatcacgagcttgagc

SEQ ID NO: 7792630 - DNA, 22 bp, Homo sapiens
tttattcaagatgaggttcatg

SEQ ID NO: 7792631 - DNA, 22 bp, Homo sapiens
tttaaggaggggctcacgtggg

SEQ ID NO: 7792632 - DNA, 22 bp, Homo sapiens
tttcagaaagcatcatcaaagt

SEQ ID NO: 7792633 - DNA, 22 bp, Homo sapiens
tttcagaaaacttatcatcagt

SEQ ID NO: 7792634 - DNA, 21 bp, Homo sapiens
tttattctcagatacagggag

SEQ ID NO: 7792635 - DNA, 19 bp, Homo sapiens
tttattcacctttaccttg

SEQ ID NO: 7792636 - DNA, 22 bp, Homo sapiens
tttcaagagggaactgaacaca

SEQ ID NO: 7792637 - DNA, 22 bp, Homo sapiens
tttcaagacgttaagtcagctt

SEQ ID NO: 7792638 - DNA, 18 bp, Homo sapiens
actctttctgcccacagg

SEQ ID NO: 7792639 - DNA, 22 bp, Homo sapiens
actcttggtcagaacaattcag

SEQ ID NO: 7792640 - DNA, 22 bp, Homo sapiens
actgggagttctccatgtccct

SEQ ID NO: 7792641 - DNA, 22 bp, Homo sapiens
actgggagggtcttgaagaggg

SEQ ID NO: 7792642 - DNA, 22 bp, Homo sapiens
actgggagtcatgaggaaggag

SEQ ID NO: 7792643 - DNA, 22 bp, Homo sapiens
actgggaggcatctggagctga

SEQ ID NO: 7792644 - DNA, 22 bp, Homo sapiens
aagggcacagggaaagagtgca

SEQ ID NO: 7792645 - DNA, 22 bp, Homo sapiens
agaggaggtggtgatgctttaa

SEQ ID NO: 7792646 - DNA, 22 bp, Homo sapiens
agcacaggctttggtgtgaggg

SEQ ID NO: 7792647 - DNA, 22 bp, Homo sapiens
agccagctgtactgcctgctca

SEQ ID NO: 7792648 - DNA, 22 bp, Homo sapiens
agccaggaagaaggtcacacca

SEQ ID NO: 7792649 - DNA, 22 bp, Homo sapiens
agccacagtctgtagccagctt

SEQ ID NO: 7792650 - DNA, 22 bp, Homo sapiens
acagaggctgcgcttgggaacg

SEQ ID NO: 7792651 - DNA, 23 bp, Homo sapiens
acagaggcttaaatgagtggcag

SEQ ID NO: 7792652 - DNA, 22 bp, Homo sapiens
acagaggcctcggcctgcccag

SEQ ID NO: 7792653 - DNA, 22 bp, Homo sapiens
acagaggccccgtgggagagcc

SEQ ID NO: 7792654 - DNA, 17 bp, Homo sapiens
acagaggcaggagtgga

SEQ ID NO: 7792655 - DNA, 22 bp, Homo sapiens
acagaggccatgagctgccacc

SEQ ID NO: 7792656 - DNA, 21 bp, Homo sapiens
acagaggcatacagcttaagg

SEQ ID NO: 7792657 - DNA, 22 bp, Homo sapiens
aagcagggagaaatttttcttc

SEQ ID NO: 7792658 - DNA, 23 bp, Homo sapiens
aaggtgtcattgatgggattcta

SEQ ID NO: 7792659 - DNA, 22 bp, Homo sapiens
aaagcagggtccaaggagatgt

SEQ ID NO: 7792660 - DNA, 22 bp, Homo sapiens
aaagtcatacatggtgcttact

SEQ ID NO: 7792661 - DNA, 22 bp, Homo sapiens
aagagagagcattcttctgtta

SEQ ID NO: 7792662 - DNA, 22 bp, Homo sapiens
aagaagcaggtcacagacaggg

SEQ ID NO: 7792663 - DNA, 22 bp, Homo sapiens
aagaagcattctttcattggtt

SEQ ID NO: 7792664 - DNA, 22 bp, Homo sapiens
aagagagaagtctctctggttc

SEQ ID NO: 7792665 - DNA, 22 bp, Homo sapiens
aaaggcatgcatggtctgctcc

SEQ ID NO: 7792666 - DNA, 22 bp, Homo sapiens
aaattccattttgtgactattc

SEQ ID NO: 7792667 - DNA, 22 bp, Homo sapiens
atgtatatgaagctagtatttt

SEQ ID NO: 7792668 - DNA, 22 bp, Homo sapiens
agagcctgttttgtgggagatg

SEQ ID NO: 7792669 - DNA, 22 bp, Homo sapiens
atgaggaggccagtaagagcct

SEQ ID NO: 7792670 - DNA, 22 bp, Homo sapiens
atgaggagctgttttaactgct

SEQ ID NO: 7792671 - DNA, 22 bp, Homo sapiens
atgccagggtcacagtcatatt

SEQ ID NO: 7792672 - DNA, 19 bp, Homo sapiens
agaggcctcagcagctggc

SEQ ID NO: 7792673 - DNA, 22 bp, Homo sapiens
agaggcctccgaaaggtgggct

SEQ ID NO: 7792674 - DNA, 22 bp, Homo sapiens
agaggccctgggctggtgtgct

SEQ ID NO: 7792675 - DNA, 22 bp, Homo sapiens
cagcactggggccactggagtt

SEQ ID NO: 7792676 - DNA, 22 bp, Homo sapiens
cagcatggacccatcgctgagt

SEQ ID NO: 7792677 - DNA, 22 bp, Homo sapiens
cagcatggggatcactgtaggc

SEQ ID NO: 7792678 - DNA, 22 bp, Homo sapiens
cagcatggttgggttctgggga

SEQ ID NO: 7792679 - DNA, 18 bp, Homo sapiens
cagctgccagctcatgga

SEQ ID NO: 7792680 - DNA, 22 bp, Homo sapiens
cagagccatccaggtgcctgtt

SEQ ID NO: 7792681 - DNA, 22 bp, Homo sapiens
cagagccatcccagcctgtggt

SEQ ID NO: 7792682 - DNA, 22 bp, Homo sapiens
cagagccaggtggtgttggggc

SEQ ID NO: 7792683 - DNA, 22 bp, Homo sapiens
agcctattccaggatgagctca

SEQ ID NO: 7792684 - DNA, 22 bp, Homo sapiens
cagatccatctctcagaaagag

SEQ ID NO: 7792685 - DNA, 22 bp, Homo sapiens
cacagaacatccttagctcatg

SEQ ID NO: 7792686 - DNA, 22 bp, Homo sapiens
caagggagttgctgcatgcagg

SEQ ID NO: 7792687 - DNA, 22 bp, Homo sapiens
cacatggcctgtgtggccagac

SEQ ID NO: 7792688 - DNA, 22 bp, Homo sapiens
cacgggagacgtgatcttggac

SEQ ID NO: 7792689 - DNA, 22 bp, Homo sapiens
agccaaagagaccccatatcca

SEQ ID NO: 7792690 - DNA, 23 bp, Homo sapiens
cactgggcccagggtgtggaggc

SEQ ID NO: 7792691 - DNA, 22 bp, Homo sapiens
acaggacaggtaggattcgcag

SEQ ID NO: 7792692 - DNA, 22 bp, Homo sapiens
agggctttgagaatagtggaac

SEQ ID NO: 7792693 - DNA, 22 bp, Homo sapiens
agggctttgatggcattctcat

SEQ ID NO: 7792694 - DNA, 22 bp, Homo sapiens
aggctctggagtgtggtgctgg

SEQ ID NO: 7792695 - DNA, 22 bp, Homo sapiens
aggctctggacagtgaggagtt

SEQ ID NO: 7792696 - DNA, 22 bp, Homo sapiens
aggctctgacgtcacacgtggc

SEQ ID NO: 7792697 - DNA, 22 bp, Homo sapiens
aggctctgacccatgggaccca

SEQ ID NO: 7792698 - DNA, 22 bp, Homo sapiens
aggctctgaaggagaacctgtt

SEQ ID NO: 7792699 - DNA, 19 bp, Homo sapiens
aggctgtgagggaggactc

SEQ ID NO: 7792700 - DNA, 22 bp, Homo sapiens
aggctgtgagttttgtctcaga

SEQ ID NO: 7792701 - DNA, 22 bp, Homo sapiens
accacaggacccatgagtcagt

SEQ ID NO: 7792702 - DNA, 22 bp, Homo sapiens
acatttctcaggtaagtcattt

SEQ ID NO: 7792703 - DNA, 22 bp, Homo sapiens
aggctctggctactacagagct

SEQ ID NO: 7792704 - DNA, 22 bp, Homo sapiens
agtccagaccccggcagctggt

SEQ ID NO: 7792705 - DNA, 22 bp, Homo sapiens
agtggggtctcctccagccccc

SEQ ID NO: 7792706 - DNA, 22 bp, Homo sapiens
agtgggggccaacgagggcagc

SEQ ID NO: 7792707 - DNA, 22 bp, Homo sapiens
agtggggcggacaggaccagga

SEQ ID NO: 7792708 - DNA, 22 bp, Homo sapiens
agtgtgtcgagggagggtccag

SEQ ID NO: 7792709 - DNA, 22 bp, Homo sapiens
atagtgtgtaaagtgcagtgat

SEQ ID NO: 7792710 - DNA, 22 bp, Homo sapiens
atctgcttgttgcatgtctgtt

SEQ ID NO: 7792711 - DNA, 22 bp, Homo sapiens
aggctctgggaagcagtgagtt

SEQ ID NO: 7792712 - DNA, 22 bp, Homo sapiens
aggctctgtcaggcggagcagc

SEQ ID NO: 7792713 - DNA, 22 bp, Homo sapiens
aggctgtggtgctgaaggaggg

SEQ ID NO: 7792714 - DNA, 22 bp, Homo sapiens
aggctgtgggaatggctgcttg

SEQ ID NO: 7792715 - DNA, 19 bp, Homo sapiens
aggcctggggttttgcact

SEQ ID NO: 7792716 - DNA, 22 bp, Homo sapiens
aggcctgggcaagaaggggcgt

SEQ ID NO: 7792717 - DNA, 22 bp, Homo sapiens
aggcctggtgtgccggatgcag

SEQ ID NO: 7792718 - DNA, 22 bp, Homo sapiens
ccagaggctggcaagggctcct

SEQ ID NO: 7792719 - DNA, 21 bp, Homo sapiens
ccagaggcctctcttggccac

SEQ ID NO: 7792720 - DNA, 16 bp, Homo sapiens
ccagaggcctggcctc

SEQ ID NO: 7792721 - DNA, 18 bp, Homo sapiens
ccagaggcccgggcaggc

SEQ ID NO: 7792722 - DNA, 22 bp, Homo sapiens
aggccctgcccagtgccacaag

SEQ ID NO: 7792723 - DNA, 23 bp, Homo sapiens
aggccctgcctgtccctcttttt

SEQ ID NO: 7792724 - DNA, 22 bp, Homo sapiens
aggccctgacctgggagatcta

SEQ ID NO: 7792725 - DNA, 22 bp, Homo sapiens
ccctgaggcaaaggctagagtt

SEQ ID NO: 7792726 - DNA, 22 bp, Homo sapiens
cccctgggtccaggcttctctg

SEQ ID NO: 7792727 - DNA, 21 bp, Homo sapiens
cccctgggagccctgtcagta

SEQ ID NO: 7792728 - DNA, 22 bp, Homo sapiens
cctcttcaggcactcgaaggcc

SEQ ID NO: 7792729 - DNA, 22 bp, Homo sapiens
agggcctgtgcttcctgagata

SEQ ID NO: 7792730 - DNA, 21 bp, Homo sapiens
agggcctgtgctctccaggtc

SEQ ID NO: 7792731 - DNA, 22 bp, Homo sapiens
agggctttgcaatgcacagtgg

SEQ ID NO: 7792732 - DNA, 22 bp, Homo sapiens
agggctttgatgtccatgagga

SEQ ID NO: 7792733 - DNA, 22 bp, Homo sapiens
agggcttttgcaatccaagtct

SEQ ID NO: 7792734 - DNA, 22 bp, Homo sapiens
agggctttggccccctgctgca

SEQ ID NO: 7792735 - DNA, 19 bp, Homo sapiens
agggctttgtgtgctgctc

SEQ ID NO: 7792736 - DNA, 22 bp, Homo sapiens
agggctttgtggcagtcactat

SEQ ID NO: 7792737 - DNA, 22 bp, Homo sapiens
agggctttgtttaggtgaccac

SEQ ID NO: 7792738 - DNA, 22 bp, Homo sapiens
aggacacttaggttattcaact

SEQ ID NO: 7792739 - DNA, 23 bp, Homo sapiens
ccacagagctgccaattcctgtg

SEQ ID NO: 7792740 - DNA, 22 bp, Homo sapiens
ccacagagacagagcccagggt

SEQ ID NO: 7792741 - DNA, 22 bp, Homo sapiens
ccacagagacagggtccttgct

SEQ ID NO: 7792742 - DNA, 22 bp, Homo sapiens
ccacagtggttctcaaccaggg

SEQ ID NO: 7792743 - DNA, 22 bp, Homo sapiens
aggcacttctcaaattcatgcc

SEQ ID NO: 7792744 - DNA, 22 bp, Homo sapiens
aggcacttgaattgatgatgtt

SEQ ID NO: 7792745 - DNA, 22 bp, Homo sapiens
aggcactgttcccagttatcct

SEQ ID NO: 7792746 - DNA, 20 bp, Homo sapiens
aggcactgttgtctgtatcc

SEQ ID NO: 7792747 - DNA, 22 bp, Homo sapiens
cagtgtggagggagagagcctg

SEQ ID NO: 7792748 - DNA, 22 bp, Homo sapiens
cagtccagctcatcagtggcac

SEQ ID NO: 7792749 - DNA, 22 bp, Homo sapiens
agtccaggtctctgagtcacaa

SEQ ID NO: 7792750 - DNA, 22 bp, Homo sapiens
agtatggggctgtgtgtgcaca

SEQ ID NO: 7792751 - DNA, 22 bp, Homo sapiens
ctaagaggaagtactctgttat

SEQ ID NO: 7792752 - DNA, 20 bp, Homo sapiens
ctaagaggaggactaggttt

SEQ ID NO: 7792753 - DNA, 20 bp, Homo sapiens
cctgggctccaggagccccg

SEQ ID NO: 7792754 - DNA, 22 bp, Homo sapiens
ctctgggaccatggcaagtgcg

SEQ ID NO: 7792755 - DNA, 22 bp, Homo sapiens
ctctgcctgtgtcgccaccaca

SEQ ID NO: 7792756 - DNA, 22 bp, Homo sapiens
ctctgcctgtctcatcctgcaa

SEQ ID NO: 7792757 - DNA, 22 bp, Homo sapiens
ctctgcctgccactgttcaggc

SEQ ID NO: 7792758 - DNA, 22 bp, Homo sapiens
ctctgcatcaggcattatggat

SEQ ID NO: 7792759 - DNA, 22 bp, Homo sapiens
ctccaggcttcaagggccggcc

SEQ ID NO: 7792760 - DNA, 22 bp, Homo sapiens
ctcctcagactttccttgtccg

SEQ ID NO: 7792761 - DNA, 22 bp, Homo sapiens
atagcaaaaggcaccagagtga

SEQ ID NO: 7792762 - DNA, 22 bp, Homo sapiens
atccaggctgcgggtctcaagt

SEQ ID NO: 7792763 - DNA, 22 bp, Homo sapiens
atccaggctgggtgtggctact

SEQ ID NO: 7792764 - DNA, 22 bp, Homo sapiens
atccaggccttgaagtaccagt

SEQ ID NO: 7792765 - DNA, 22 bp, Homo sapiens
atccaggcgaatgcagaaggcc

SEQ ID NO: 7792766 - DNA, 22 bp, Homo sapiens
atccagtctgtctaccttctca

SEQ ID NO: 7792767 - DNA, 22 bp, Homo sapiens
atccagtcccacacatgctctg

SEQ ID NO: 7792768 - DNA, 22 bp, Homo sapiens
cttcctctatgttcaggtagaa

SEQ ID NO: 7792769 - DNA, 22 bp, Homo sapiens
atattactctgatttagtaaat

SEQ ID NO: 7792770 - DNA, 22 bp, Homo sapiens
ctttccccagtatatcattgcc

SEQ ID NO: 7792771 - DNA, 22 bp, Homo sapiens
gaaggctgtggctggtctcagt

SEQ ID NO: 7792772 - DNA, 22 bp, Homo sapiens
atggtctgttaggagctacttt

SEQ ID NO: 7792773 - DNA, 22 bp, Homo sapiens
atggctggcatccaggtgggct

SEQ ID NO: 7792774 - DNA, 22 bp, Homo sapiens
atggcttttgatgctaagccaa

SEQ ID NO: 7792775 - DNA, 22 bp, Homo sapiens
gagagagctctgtgcctgggat

SEQ ID NO: 7792776 - DNA, 22 bp, Homo sapiens
atgtcccttgtctgtgatgtct

SEQ ID NO: 7792777 - DNA, 22 bp, Homo sapiens
atgtcccttctttggtgctcag

SEQ ID NO: 7792778 - DNA, 22 bp, Homo sapiens
gcctggcacattgcagtggatt

SEQ ID NO: 7792779 - DNA, 22 bp, Homo sapiens
caaagccaggctttctaatgta

SEQ ID NO: 7792780 - DNA, 22 bp, Homo sapiens
caaagccatagagtagataaga

SEQ ID NO: 7792781 - DNA, 21 bp, Homo sapiens
caaagccaggcaactctctcc

SEQ ID NO: 7792782 - DNA, 22 bp, Homo sapiens
gctctttctgtccgcagggcct

SEQ ID NO: 7792783 - DNA, 22 bp, Homo sapiens
attcagttctgctggttctgct

SEQ ID NO: 7792784 - DNA, 22 bp, Homo sapiens
attcagttgtaatctttgttag

SEQ ID NO: 7792785 - DNA, 20 bp, Homo sapiens
gcagcagacagacaggggac

SEQ ID NO: 7792786 - DNA, 22 bp, Homo sapiens
gcagctggacccacacggctta

SEQ ID NO: 7792787 - DNA, 22 bp, Homo sapiens
gcagctgcgaagaagtctatct

SEQ ID NO: 7792788 - DNA, 22 bp, Homo sapiens
gccacagggcagatgcgcagag

SEQ ID NO: 7792789 - DNA, 22 bp, Homo sapiens
gccaagagtttccagctgcaag

SEQ ID NO: 7792790 - DNA, 22 bp, Homo sapiens
ggaagggcaataaaatctcagg

SEQ ID NO: 7792791 - DNA, 22 bp, Homo sapiens
cacacagatggtaagggaggga

SEQ ID NO: 7792792 - DNA, 22 bp, Homo sapiens
caaggcctcctgggcccagaga

SEQ ID NO: 7792793 - DNA, 22 bp, Homo sapiens
ggctgtaggttggtgctggaca

SEQ ID NO: 7792794 - DNA, 22 bp, Homo sapiens
ggcctgagctctggggaggcaa

SEQ ID NO: 7792795 - DNA, 22 bp, Homo sapiens
ggcctgtgcacatgtgcaggaa

SEQ ID NO: 7792796 - DNA, 17 bp, Homo sapiens
ggcctgtgtggctgcag

SEQ ID NO: 7792797 - DNA, 22 bp, Homo sapiens
gtcatcttcgcagagtgatttt

SEQ ID NO: 7792798 - DNA, 20 bp, Homo sapiens
cagcaggctatggggcaccc

SEQ ID NO: 7792799 - DNA, 22 bp, Homo sapiens
cagcagctggtgagacacagcc

SEQ ID NO: 7792800 - DNA, 22 bp, Homo sapiens
cagaccagaaggaagccgacaa

SEQ ID NO: 7792801 - DNA, 22 bp, Homo sapiens
cagagacagcctgggagggaca

SEQ ID NO: 7792802 - DNA, 22 bp, Homo sapiens
gggcagcatcaggaggggcttt

SEQ ID NO: 7792803 - DNA, 22 bp, Homo sapiens
cagaggcacaagaaagcaaggc

SEQ ID NO: 7792804 - DNA, 22 bp, Homo sapiens
cagaggcaaaagaggtggaggt

SEQ ID NO: 7792805 - DNA, 22 bp, Homo sapiens
ggtcatctgtaattctgttcct

SEQ ID NO: 7792806 - DNA, 22 bp, Homo sapiens
cagagtcctgcaccagctccag

SEQ ID NO: 7792807 - DNA, 19 bp, Homo sapiens
cagagtccttgaccagtcc

SEQ ID NO: 7792808 - DNA, 22 bp, Homo sapiens
cagcaccaggcagacctggagc

SEQ ID NO: 7792809 - DNA, 22 bp, Homo sapiens
ccagctgctgtgaggaccacag

SEQ ID NO: 7792810 - DNA, 22 bp, Homo sapiens
ccagctgctatcatgccatttc

SEQ ID NO: 7792811 - DNA, 23 bp, Homo sapiens
tctgcttctgtattttttcccat

SEQ ID NO: 7792812 - DNA, 22 bp, Homo sapiens
tctgcttctgtgaaggcagtct

SEQ ID NO: 7792813 - DNA, 22 bp, Homo sapiens
tctgcttctcctacttcatggg

SEQ ID NO: 7792814 - DNA, 22 bp, Homo sapiens
tctgggagccatgccttggagt

SEQ ID NO: 7792815 - DNA, 22 bp, Homo sapiens
tctgggagcacacgcagtgatc

SEQ ID NO: 7792816 - DNA, 22 bp, Homo sapiens
tctgggagcagatgatggtata

SEQ ID NO: 7792817 - DNA, 22 bp, Homo sapiens
tctttcaaatgcttgaattgga

SEQ ID NO: 7792818 - DNA, 19 bp, Homo sapiens
tctttggctaaattgggtg

SEQ ID NO: 7792819 - DNA, 22 bp, Homo sapiens
ccaggccagagtgcagtggcac

SEQ ID NO: 7792820 - DNA, 22 bp, Homo sapiens
tgaatgcaagtcacacatttct

SEQ ID NO: 7792821 - DNA, 20 bp, Homo sapiens
tgagggctaaccagactctg

SEQ ID NO: 7792822 - DNA, 22 bp, Homo sapiens
tgagggctgcttccagagctag

SEQ ID NO: 7792823 - DNA, 22 bp, Homo sapiens
tgagggctccccgctgctgtgt

SEQ ID NO: 7792824 - DNA, 22 bp, Homo sapiens
ccagtctcttccctcctgccag

SEQ ID NO: 7792825 - DNA, 22 bp, Homo sapiens
tgatttctcatattgttcaaaa

SEQ ID NO: 7792826 - DNA, 22 bp, Homo sapiens
tggagcaggactgctgccctca

SEQ ID NO: 7792827 - DNA, 22 bp, Homo sapiens
tggcagggttggccaccttacc

SEQ ID NO: 7792828 - DNA, 21 bp, Homo sapiens
cctcatcaaactttcacttgc

SEQ ID NO: 7792829 - DNA, 21 bp, Homo sapiens
cctctgctcgggcatgcgttt

SEQ ID NO: 7792830 - DNA, 22 bp, Homo sapiens
cctcttcctcaccatctacaac

SEQ ID NO: 7792831 - DNA, 22 bp, Homo sapiens
tggctgggagctggaactgggc

SEQ ID NO: 7792832 - DNA, 22 bp, Homo sapiens
cctcttcctgcactgacatttt

SEQ ID NO: 7792833 - DNA, 19 bp, Homo sapiens
cctcttcctctgacactat

SEQ ID NO: 7792834 - DNA, 22 bp, Homo sapiens
taagtcgtggatgattcttcgg

SEQ ID NO: 7792835 - DNA, 22 bp, Homo sapiens
caggctgggactgacccctgct

SEQ ID NO: 7792836 - DNA, 22 bp, Homo sapiens
cagggctgaaatcaaggtgtag

SEQ ID NO: 7792837 - DNA, 22 bp, Homo sapiens
cagggagcactgcgagcggcag

SEQ ID NO: 7792838 - DNA, 21 bp, Homo sapiens
tccctcagaagctcttggtca

SEQ ID NO: 7792839 - DNA, 22 bp, Homo sapiens
tccctggggtaacattagaggg

SEQ ID NO: 7792840 - DNA, 22 bp, Homo sapiens
tccctgggttcccgtggaagtg

SEQ ID NO: 7792841 - DNA, 22 bp, Homo sapiens
tccttggggacgctgacatcgt

SEQ ID NO: 7792842 - DNA, 22 bp, Homo sapiens
catctgatgggaatataagagc

SEQ ID NO: 7792843 - DNA, 22 bp, Homo sapiens
catgaaggctgccagcaggcat

SEQ ID NO: 7792844 - DNA, 22 bp, Homo sapiens
catggcagagcctgcaggtggg

SEQ ID NO: 7792845 - DNA, 23 bp, Homo sapiens
catggcagcaagagctcatggcc

SEQ ID NO: 7792846 - DNA, 22 bp, Homo sapiens
catggcagctcctccagtgtga

SEQ ID NO: 7792847 - DNA, 22 bp, Homo sapiens
catggcagcaattttcctgact

SEQ ID NO: 7792848 - DNA, 22 bp, Homo sapiens
catggcaggaaggacatgcact

SEQ ID NO: 7792849 - DNA, 22 bp, Homo sapiens
catggcagagaaggggaactgg

SEQ ID NO: 7792850 - DNA, 22 bp, Homo sapiens
catggcattgcataacggggct

SEQ ID NO: 7792851 - DNA, 22 bp, Homo sapiens
catggcagggctgtgggcaggt

SEQ ID NO: 7792852 - DNA, 22 bp, Homo sapiens
catggcaggtgtggggttttat

SEQ ID NO: 7792853 - DNA, 22 bp, Homo sapiens
cctgtctggccttccacggggg

SEQ ID NO: 7792854 - DNA, 22 bp, Homo sapiens
cctggtggacagcagccagcag

SEQ ID NO: 7792855 - DNA, 22 bp, Homo sapiens
cctggtggccttcagcccacaa

SEQ ID NO: 7792856 - DNA, 22 bp, Homo sapiens
cctgggaggtggatgttgcggt

SEQ ID NO: 7792857 - DNA, 19 bp, Homo sapiens
cctgggagtcagctgaagg

SEQ ID NO: 7792858 - DNA, 22 bp, Homo sapiens
cctgggagtgcacaggtttcgt

SEQ ID NO: 7792859 - DNA, 22 bp, Homo sapiens
tttattgttgttagtcataagt

SEQ ID NO: 7792860 - DNA, 22 bp, Homo sapiens
tttatttaccttatgtcctcca

SEQ ID NO: 7792861 - DNA, 22 bp, Homo sapiens
ctccagcctcatctcctggctg

SEQ ID NO: 7792862 - DNA, 22 bp, Homo sapiens
ttcttttaatttctgtctgcag

SEQ ID NO: 7792863 - DNA, 22 bp, Homo sapiens
ttcttttacattaagatttcag

SEQ ID NO: 7792864 - DNA, 22 bp, Homo sapiens
ctctgctttttaaaaggagtcc

SEQ ID NO: 7792865 - DNA, 22 bp, Homo sapiens
ttttcagtgggcaatgatgtga

SEQ ID NO: 7792866 - DNA, 22 bp, Homo sapiens
ctctttcctcagccacagtcta

SEQ ID NO: 7792867 - DNA, 22 bp, Homo sapiens
ctgagccaaggggacagtgaca

SEQ ID NO: 7792868 - DNA, 22 bp, Homo sapiens
ctgaggcccctcttgtgagcat

SEQ ID NO: 7792869 - DNA, 19 bp, Homo sapiens
ctggccaggccaggggccc

SEQ ID NO: 7792870 - DNA, 22 bp, Homo sapiens
ctgggagctagctctgagctga

SEQ ID NO: 7792871 - DNA, 22 bp, Homo sapiens
ctgggagctcagccctggggtg

SEQ ID NO: 7792872 - DNA, 22 bp, Homo sapiens
ctgggagctgaggctgacgctg

SEQ ID NO: 7792873 - DNA, 22 bp, Homo sapiens
ctggggcattgggagaggcctg

SEQ ID NO: 7792874 - DNA, 22 bp, Homo sapiens
cttcctctgaggcttctgagtc

SEQ ID NO: 7792875 - DNA, 22 bp, Homo sapiens
cttcctctgtgtcctgggcttg

SEQ ID NO: 7792876 - DNA, 22 bp, Homo sapiens
cttcctctgtggccagagtgta

SEQ ID NO: 7792877 - DNA, 22 bp, Homo sapiens
cttcctctgtgtcctgggcttc

SEQ ID NO: 7792878 - DNA, 22 bp, Homo sapiens
cttcagctacctctgatgcaag

SEQ ID NO: 7792879 - DNA, 22 bp, Homo sapiens
cttcagctgcagttatgtttag

SEQ ID NO: 7792880 - DNA, 22 bp, Homo sapiens
gaggcactgctgggcccctgta

SEQ ID NO: 7792881 - DNA, 22 bp, Homo sapiens
gaggcactgagagtgggggatg

SEQ ID NO: 7792882 - DNA, 22 bp, Homo sapiens
gaggcactgaatacttgagggt

SEQ ID NO: 7792883 - DNA, 23 bp, Homo sapiens
gaggcactcaggaaatgtgagtg

SEQ ID NO: 7792884 - DNA, 22 bp, Homo sapiens
gaggcactctcgacaagggtgg

SEQ ID NO: 7792885 - DNA, 22 bp, Homo sapiens
gaggagcttcagaggaatctta

SEQ ID NO: 7792886 - DNA, 22 bp, Homo sapiens
gaggagcttgtgagaagatgtc

SEQ ID NO: 7792887 - DNA, 22 bp, Homo sapiens
gaggagctgtctttgtgatctt

SEQ ID NO: 7792888 - DNA, 19 bp, Homo sapiens
gaggagctatcggagacag

SEQ ID NO: 7792889 - DNA, 22 bp, Homo sapiens
gagccagcagccggcaccacca

SEQ ID NO: 7792890 - DNA, 22 bp, Homo sapiens
gagcagctgcagtgcagaccct

SEQ ID NO: 7792891 - DNA, 20 bp, Homo sapiens
gagcagctgtttgcattgca

SEQ ID NO: 7792892 - DNA, 22 bp, Homo sapiens
gagccaagggcgtgctggagag

SEQ ID NO: 7792893 - DNA, 18 bp, Homo sapiens
gagcagcaggatcaagaa

SEQ ID NO: 7792894 - DNA, 22 bp, Homo sapiens
gaagccatctttgttccccacc

SEQ ID NO: 7792895 - DNA, 22 bp, Homo sapiens
gaagaggactgtggcatcctag

SEQ ID NO: 7792896 - DNA, 21 bp, Homo sapiens
ggctgctgggagagctgcgtg

SEQ ID NO: 7792897 - DNA, 21 bp, Homo sapiens
ggctgctgggagagctgcgtg

SEQ ID NO: 7792898 - DNA, 22 bp, Homo sapiens
gggacatctttctagtcagggt

SEQ ID NO: 7792899 - DNA, 22 bp, Homo sapiens
gggacaggctgagacttgagct

SEQ ID NO: 7792900 - DNA, 22 bp, Homo sapiens
gggattgaattgggggatcaca

SEQ ID NO: 7792901 - DNA, 20 bp, Homo sapiens
ggcagagggcctgggagaag

SEQ ID NO: 7792902 - DNA, 22 bp, Homo sapiens
ggcagaggtagctggaaccagg

SEQ ID NO: 7792903 - DNA, 22 bp, Homo sapiens
ggcctgagtcacatcaggagag

SEQ ID NO: 7792904 - DNA, 22 bp, Homo sapiens
ggcctgagaaccatggggccaa

SEQ ID NO: 7792905 - DNA, 22 bp, Homo sapiens
ggccttggtgccatggccagtt

SEQ ID NO: 7792906 - DNA, 22 bp, Homo sapiens
ggccttggtaaagggatgcatg

SEQ ID NO: 7792907 - DNA, 22 bp, Homo sapiens
ggccagtgtgcaggtcagagat

SEQ ID NO: 7792908 - DNA, 21 bp, Homo sapiens
ggcatggcacctctgggcagg

SEQ ID NO: 7792909 - DNA, 22 bp, Homo sapiens
gggctgagagctggaatctgag

SEQ ID NO: 7792910 - DNA, 22 bp, Homo sapiens
gggctgaggctaccactggtct

SEQ ID NO: 7792911 - DNA, 22 bp, Homo sapiens
ggggttgatcacagaggggtct

SEQ ID NO: 7792912 - DNA, 20 bp, Homo sapiens
ggggttgaccctcttggact

SEQ ID NO: 7792913 - DNA, 22 bp, Homo sapiens
ggggaaggattgagttgaccca

SEQ ID NO: 7792914 - DNA, 22 bp, Homo sapiens
gtgcacagagcccagggccgcg

SEQ ID NO: 7792915 - DNA, 21 bp, Homo sapiens
gtgcacagtcctgcacacagg

SEQ ID NO: 7792916 - DNA, 23 bp, Homo sapiens
gtgcacagtcaagcccagcttag

SEQ ID NO: 7792917 - DNA, 22 bp, Homo sapiens
gtgactctcaaaagtgcagtct

SEQ ID NO: 7792918 - DNA, 22 bp, Homo sapiens
gtcattttgctgcatatttaga

SEQ ID NO: 7792919 - DNA, 22 bp, Homo sapiens
gtcattttctagaattatttga

SEQ ID NO: 7792920 - DNA, 22 bp, Homo sapiens
gccagggtggcagaaggcccca

SEQ ID NO: 7792921 - DNA, 22 bp, Homo sapiens
gcccaggaggagaggctgcagt

SEQ ID NO: 7792922 - DNA, 22 bp, Homo sapiens
gcccaggagaggccagggctga

SEQ ID NO: 7792923 - DNA, 22 bp, Homo sapiens
gccagctgaagccctggtggaa

SEQ ID NO: 7792924 - DNA, 22 bp, Homo sapiens
gcagaggccaggccaccagcaa

SEQ ID NO: 7792925 - DNA, 22 bp, Homo sapiens
gcagaggcacagccccagatga

SEQ ID NO: 7792926 - DNA, 21 bp, Homo sapiens
gcagaggcacggcaccaaggg

SEQ ID NO: 7792927 - DNA, 22 bp, Homo sapiens
gcagaggcagggccctcctcca

SEQ ID NO: 7792928 - DNA, 22 bp, Homo sapiens
gcacatgagctgctgggatggg

SEQ ID NO: 7792929 - DNA, 22 bp, Homo sapiens
gctgcctgtcctgaggagtccg

SEQ ID NO: 7792930 - DNA, 22 bp, Homo sapiens
gctgcttcagggacgtgccagc

SEQ ID NO: 7792931 - DNA, 22 bp, Homo sapiens
gctgcttcctttcctgctgacc

SEQ ID NO: 7792932 - DNA, 22 bp, Homo sapiens
gctgcctgtggcccttctgggt

SEQ ID NO: 7792933 - DNA, 19 bp, Homo sapiens
gctcagcagacccagtgct

SEQ ID NO: 7792934 - DNA, 22 bp, Homo sapiens
gccttgggcacaggcagggccc

SEQ ID NO: 7792935 - DNA, 22 bp, Homo sapiens
gccttgggccagctgctctgga

SEQ ID NO: 7792936 - DNA, 22 bp, Homo sapiens
gccttgggggtgaaagaggcta

SEQ ID NO: 7792937 - DNA, 22 bp, Homo sapiens
gccttgggattcttggatgctc

SEQ ID NO: 7792938 - DNA, 22 bp, Homo sapiens
gccttgggaaagtgggaggaga

SEQ ID NO: 7792939 - DNA, 22 bp, Homo sapiens
gccttgtttcattacacgtggt

SEQ ID NO: 7792940 - DNA, 22 bp, Homo sapiens
gctgtgtatcagatgccacggg

SEQ ID NO: 7792941 - DNA, 22 bp, Homo sapiens
gctgtgggtgctggctccaccc

SEQ ID NO: 7792942 - DNA, 22 bp, Homo sapiens
gctgtgggtccggaccccacgg

SEQ ID NO: 7792943 - DNA, 22 bp, Homo sapiens
gctttcaaatcctaattccaac

SEQ ID NO: 7792944 - DNA, 22 bp, Homo sapiens
ggaagagggaaccacgactgta

SEQ ID NO: 7792945 - DNA, 22 bp, Homo sapiens
ggagcagcactgattagcggtt

SEQ ID NO: 7792946 - DNA, 22 bp, Homo sapiens
ggagagagagctcattagctgc

SEQ ID NO: 7792947 - DNA, 22 bp, Homo sapiens
tccaggccactgcagaggctct

SEQ ID NO: 7792948 - DNA, 22 bp, Homo sapiens
tccaggctctaggctgctctcc

SEQ ID NO: 7792949 - DNA, 22 bp, Homo sapiens
tccaggccaatgtagcaggccc

SEQ ID NO: 7792950 - DNA, 22 bp, Homo sapiens
tccaggcagggttaagggtcct

SEQ ID NO: 7792951 - DNA, 22 bp, Homo sapiens
tccaggcataatgcccagtggt

SEQ ID NO: 7792952 - DNA, 22 bp, Homo sapiens
tccaggagtcagacagatggtg

SEQ ID NO: 7792953 - DNA, 22 bp, Homo sapiens
tccaggctgcagtcttgccctc

SEQ ID NO: 7792954 - DNA, 20 bp, Homo sapiens
tccagaggccacatccagtg

SEQ ID NO: 7792955 - DNA, 22 bp, Homo sapiens
tccagctcctgagttcactgct

SEQ ID NO: 7792956 - DNA, 21 bp, Homo sapiens
tccagctcctgccactcctta

SEQ ID NO: 7792957 - DNA, 22 bp, Homo sapiens
tccagcctttctactcactgag

SEQ ID NO: 7792958 - DNA, 22 bp, Homo sapiens
tccagctccacagcctccctgt

SEQ ID NO: 7792959 - DNA, 22 bp, Homo sapiens
tccagctcatctgtctccatta

SEQ ID NO: 7792960 - DNA, 22 bp, Homo sapiens
tcagctccagagttgcacagtg

SEQ ID NO: 7792961 - DNA, 22 bp, Homo sapiens
tcagctccacagctcctctgcc

SEQ ID NO: 7792962 - DNA, 22 bp, Homo sapiens
tcagctcctcagagcctcagtt

SEQ ID NO: 7792963 - DNA, 21 bp, Homo sapiens
tcatatttctcttgctattgt

SEQ ID NO: 7792964 - DNA, 22 bp, Homo sapiens
tcagtgatttctggggtgaggg

SEQ ID NO: 7792965 - DNA, 19 bp, Homo sapiens
tcacttgaagttcagaaat

SEQ ID NO: 7792966 - DNA, 22 bp, Homo sapiens
tcactttaatgatttgtagaat

SEQ ID NO: 7792967 - DNA, 22 bp, Homo sapiens
tcactctttatcttttatgtct

SEQ ID NO: 7792968 - DNA, 22 bp, Homo sapiens
gttgggaagtgtagctccacct

SEQ ID NO: 7792969 - DNA, 22 bp, Homo sapiens
gttgctcaggcaggagtacagt

SEQ ID NO: 7792970 - DNA, 22 bp, Homo sapiens
gtgctcagcccggatgagatca

SEQ ID NO: 7792971 - DNA, 22 bp, Homo sapiens
gttaatttagtagagtccagat

SEQ ID NO: 7792972 - DNA, 22 bp, Homo sapiens
gtgtgccctggctccagcacca

SEQ ID NO: 7792973 - DNA, 22 bp, Homo sapiens
gtgtgcccttgttcagcagagt

SEQ ID NO: 7792974 - DNA, 22 bp, Homo sapiens
tacatagctcctagtgatgcat

SEQ ID NO: 7792975 - DNA, 22 bp, Homo sapiens
taagggctgacttggaactgtc

SEQ ID NO: 7792976 - DNA, 22 bp, Homo sapiens
tatttattggacagtgttgctg

SEQ ID NO: 7792977 - DNA, 22 bp, Homo sapiens
tattctgatttcaagtgagagt

SEQ ID NO: 7792978 - DNA, 22 bp, Homo sapiens
tatatcatggagattaacattc

SEQ ID NO: 7792979 - DNA, 22 bp, Homo sapiens
tatccaggaggaactcattttg

SEQ ID NO: 7792980 - DNA, 22 bp, Homo sapiens
tatccagggagttttagggctt

SEQ ID NO: 7792981 - DNA, 22 bp, Homo sapiens
tatccaggaggaactcattttg

SEQ ID NO: 7792982 - DNA, 22 bp, Homo sapiens
taggggtgtttcgagagaggtt

SEQ ID NO: 7792983 - DNA, 22 bp, Homo sapiens
tagggagctctggcagaaggaa

SEQ ID NO: 7792984 - DNA, 22 bp, Homo sapiens
taggcacttggcgtgttggaga

SEQ ID NO: 7792985 - DNA, 22 bp, Homo sapiens
taggcactgtgtttgtaggagt

SEQ ID NO: 7792986 - DNA, 22 bp, Homo sapiens
taggcactggttgtggatagtt

SEQ ID NO: 7792987 - DNA, 22 bp, Homo sapiens
taggcactagacatggttacca

SEQ ID NO: 7792988 - DNA, 22 bp, Homo sapiens
taggcactggggaggcagcatg

SEQ ID NO: 7792989 - DNA, 22 bp, Homo sapiens
taggcactgagtacatattggt

SEQ ID NO: 7792990 - DNA, 22 bp, Homo sapiens
taggcactgggctaggacaggt

SEQ ID NO: 7792991 - DNA, 22 bp, Homo sapiens
taggcactgaggggagcaaggt

SEQ ID NO: 7792992 - DNA, 22 bp, Homo sapiens
ttcatcatcagaactgttcact

SEQ ID NO: 7792993 - DNA, 22 bp, Homo sapiens
ttagagttgagtttctatgaga

SEQ ID NO: 7792994 - DNA, 22 bp, Homo sapiens
ttcacaataatgtccatcctct

SEQ ID NO: 7792995 - DNA, 20 bp, Homo sapiens
ttccagagatctgcatttta

SEQ ID NO: 7792996 - DNA, 22 bp, Homo sapiens
ttcctgaatataaagacactag

SEQ ID NO: 7792997 - DNA, 22 bp, Homo sapiens
ttcctctttagggctggccagg

SEQ ID NO: 7792998 - DNA, 22 bp, Homo sapiens
ttcctcttccatcttcccaggg

SEQ ID NO: 7792999 - DNA, 22 bp, Homo sapiens
ttctaagttactgttatggtct

SEQ ID NO: 7793000 - DNA, 21 bp, Homo sapiens
ttctgggttgttaatctgaac

SEQ ID NO: 7793001 - DNA, 18 bp, Homo sapiens
ttctgggtgttatgttta

SEQ ID NO: 7793002 - DNA, 22 bp, Homo sapiens
ttctgggtggccagtatttaga

SEQ ID NO: 7793003 - DNA, 22 bp, Homo sapiens
ttctgagaaggctgtggacaca

SEQ ID NO: 7793004 - DNA, 22 bp, Homo sapiens
ttctgaatttctgtgtatctta

SEQ ID NO: 7793005 - DNA, 20 bp, Homo sapiens
ttctgcttgcaaatatcaag

SEQ ID NO: 7793006 - DNA, 22 bp, Homo sapiens
ttctgcttttctctgtctgagt

SEQ ID NO: 7793007 - DNA, 22 bp, Homo sapiens
ttctgctttcagttcttctggg

SEQ ID NO: 7793008 - DNA, 22 bp, Homo sapiens
ttctgctttggttccatggatg

SEQ ID NO: 7793009 - DNA, 22 bp, Homo sapiens
ttgaagagcaccagcattttga

SEQ ID NO: 7793010 - DNA, 22 bp, Homo sapiens
ttgaagagacgatttttccacc

SEQ ID NO: 7793011 - DNA, 22 bp, Homo sapiens
ttgagcacaactcttggagagc

SEQ ID NO: 7793012 - DNA, 22 bp, Homo sapiens
tgtggagcactgttcctggcat

SEQ ID NO: 7793013 - DNA, 22 bp, Homo sapiens
ttacagtagatacaatgagtaa

SEQ ID NO: 7793014 - DNA, 22 bp, Homo sapiens
ttaatttttatgtatagtgtgt

SEQ ID NO: 7793015 - DNA, 22 bp, Homo sapiens
ttaagttttaaagctagagtct

SEQ ID NO: 7793016 - DNA, 22 bp, Homo sapiens
ttaaggcaactgggtccaagat

SEQ ID NO: 7793017 - DNA, 22 bp, Homo sapiens
tttctccttgtgtctcctttga

SEQ ID NO: 7793018 - DNA, 22 bp, Homo sapiens
tttcttcctggattcctacttc

SEQ ID NO: 7793019 - DNA, 22 bp, Homo sapiens
tttcttccccaagtgaatttta

SEQ ID NO: 7793020 - DNA, 22 bp, Homo sapiens
tttcctctttgtaccttgacta

SEQ ID NO: 7793021 - DNA, 22 bp, Homo sapiens
tttctacatgttttctattgaa

SEQ ID NO: 7793022 - DNA, 22 bp, Homo sapiens
tttctactcatcctttggagaa

SEQ ID NO: 7793023 - DNA, 22 bp, Homo sapiens
tttccaaaatgaatctaatgca

SEQ ID NO: 7793024 - DNA, 22 bp, Homo sapiens
tttcctctgggccctgccaccc

SEQ ID NO: 7793025 - DNA, 22 bp, Homo sapiens
tttcctctgggccctgccaccc

SEQ ID NO: 7793026 - DNA, 22 bp, Homo sapiens
tttcctctgtcatgacagctga

SEQ ID NO: 7793027 - DNA, 22 bp, Homo sapiens
tttcctcttatacagtgtttat

SEQ ID NO: 7793028 - DNA, 22 bp, Homo sapiens
tttcctcttcttcccatgtcat

SEQ ID NO: 7793029 - DNA, 22 bp, Homo sapiens
tttcctcttccgagggggaggc

SEQ ID NO: 7793030 - DNA, 22 bp, Homo sapiens
tttcctcttcgattaagtttgg

SEQ ID NO: 7793031 - DNA, 22 bp, Homo sapiens
tttcaaagaccattaactatca

SEQ ID NO: 7793032 - DNA, 22 bp, Homo sapiens
tttatttgtcttgccatttagt

SEQ ID NO: 7793033 - DNA, 22 bp, Homo sapiens
tttattattctgttctctctac

SEQ ID NO: 7793034 - DNA, 22 bp, Homo sapiens
tttagtttgatgttctactcct

SEQ ID NO: 7793035 - DNA, 22 bp, Homo sapiens
tttaatttgtatttctagaggg

SEQ ID NO: 7793036 - DNA, 21 bp, Homo sapiens
tttaatttgcatgtatgacgc

SEQ ID NO: 7793037 - DNA, 22 bp, Homo sapiens
tttaattttcctggtaggcctg

SEQ ID NO: 7793038 - DNA, 22 bp, Homo sapiens
tttaatttgaaatgagtaaccc

SEQ ID NO: 7793039 - DNA, 22 bp, Homo sapiens
ttgtcgggcttacgcagggcca

SEQ ID NO: 7793040 - DNA, 22 bp, Homo sapiens
ttgttttagtaggtacactgag

SEQ ID NO: 7793041 - DNA, 22 bp, Homo sapiens
tttgcagaagaaaacatgaaca

SEQ ID NO: 7793042 - DNA, 20 bp, Homo sapiens
tttggagagaaagaagtagt

SEQ ID NO: 7793043 - DNA, 22 bp, Homo sapiens
cagcacagtttgcttggcagag

SEQ ID NO: 7793044 - DNA, 22 bp, Homo sapiens
ggtctgctttccttgccactgt

SEQ ID NO: 7793045 - DNA, 22 bp, Homo sapiens
ggtctggaagcgcagtaggctg

SEQ ID NO: 7793046 - DNA, 22 bp, Homo sapiens
ggtgacggggcccaggtttcct

SEQ ID NO: 7793047 - DNA, 23 bp, Homo sapiens
ggtccacccgagcctgcagcttc

SEQ ID NO: 7793048 - DNA, 22 bp, Homo sapiens
cagagggctcggcggccgctcc

SEQ ID NO: 7793049 - DNA, 16 bp, Homo sapiens
cagaggcacctggctc

SEQ ID NO: 7793050 - DNA, 22 bp, Homo sapiens
cagaggcaaaagaggtggaggt

SEQ ID NO: 7793051 - DNA, 22 bp, Homo sapiens
cagagctgcttcccagtttgtg

SEQ ID NO: 7793052 - DNA, 22 bp, Homo sapiens
cagagctgcttcccagtttgtg

SEQ ID NO: 7793053 - DNA, 22 bp, Homo sapiens
gggccagcagtatcggaggcat

SEQ ID NO: 7793054 - DNA, 22 bp, Homo sapiens
gggccagctctgtgatgtaggg

SEQ ID NO: 7793055 - DNA, 22 bp, Homo sapiens
gggctgacgaaggccatgtgtg

SEQ ID NO: 7793056 - DNA, 22 bp, Homo sapiens
gggctgactctgcactgagcca

SEQ ID NO: 7793057 - DNA, 22 bp, Homo sapiens
cagagcctcagaatcctgtgga

SEQ ID NO: 7793058 - DNA, 22 bp, Homo sapiens
gggctgacaccacccaggcgca

SEQ ID NO: 7793059 - DNA, 17 bp, Homo sapiens
gggctgacagtggcctc

SEQ ID NO: 7793060 - DNA, 22 bp, Homo sapiens
gggctgacagtttcccctgaaa

SEQ ID NO: 7793061 - DNA, 22 bp, Homo sapiens
gggctgaccccacccctcactc

SEQ ID NO: 7793062 - DNA, 22 bp, Homo sapiens
gggctgaccaatgccttgcttt

SEQ ID NO: 7793063 - DNA, 21 bp, Homo sapiens
cagaccattgcatgagcaggt

SEQ ID NO: 7793064 - DNA, 22 bp, Homo sapiens
cagaccctgggccacagaggag

SEQ ID NO: 7793065 - DNA, 21 bp, Homo sapiens
cagaccctctagaggccacct

SEQ ID NO: 7793066 - DNA, 22 bp, Homo sapiens
cagcaggacatggaggagtaaa

SEQ ID NO: 7793067 - DNA, 22 bp, Homo sapiens
gtcataaagcttgttgcattta

SEQ ID NO: 7793068 - DNA, 22 bp, Homo sapiens
cagccaggttagtgctaattgt

SEQ ID NO: 7793069 - DNA, 22 bp, Homo sapiens
cagccagggtcaggcagcttct

SEQ ID NO: 7793070 - DNA, 22 bp, Homo sapiens
gtctgtctgttgttgagaagca

SEQ ID NO: 7793071 - DNA, 22 bp, Homo sapiens
gtctgtctccctgtgactgaga

SEQ ID NO: 7793072 - DNA, 22 bp, Homo sapiens
gtctggaaggaggagatggagc

SEQ ID NO: 7793073 - DNA, 22 bp, Homo sapiens
cagccaggcctggtgaccaaag

SEQ ID NO: 7793074 - DNA, 22 bp, Homo sapiens
gtgctgtgcgctttttctgtat

SEQ ID NO: 7793075 - DNA, 22 bp, Homo sapiens
cagctattaatgtttttgctga

SEQ ID NO: 7793076 - DNA, 22 bp, Homo sapiens
cagccttcaaggcttagctcag

SEQ ID NO: 7793077 - DNA, 22 bp, Homo sapiens
cagccctgcttccccgctagtt

SEQ ID NO: 7793078 - DNA, 22 bp, Homo sapiens
ggcctgaggcgtcccagctgtg

SEQ ID NO: 7793079 - DNA, 22 bp, Homo sapiens
ggcctgaggccaccagcagccc

SEQ ID NO: 7793080 - DNA, 19 bp, Homo sapiens
ggcctgaggccacagatcc

SEQ ID NO: 7793081 - DNA, 22 bp, Homo sapiens
ggctgtctctgtgactgccacc

SEQ ID NO: 7793082 - DNA, 22 bp, Homo sapiens
cagaaagctctttcaatcttgc

SEQ ID NO: 7793083 - DNA, 22 bp, Homo sapiens
cagaaaggacagagtgagggtg

SEQ ID NO: 7793084 - DNA, 22 bp, Homo sapiens
cacttttaaatgggtccgtgtt

SEQ ID NO: 7793085 - DNA, 23 bp, Homo sapiens
cagaaagccctttccccacagta

SEQ ID NO: 7793086 - DNA, 22 bp, Homo sapiens
cagaaagcgggatgcagcatgt

SEQ ID NO: 7793087 - DNA, 20 bp, Homo sapiens
cagaaagcatgttccagggc

SEQ ID NO: 7793088 - DNA, 22 bp, Homo sapiens
cagaaagacctgggctcaagag

SEQ ID NO: 7793089 - DNA, 22 bp, Homo sapiens
cacctgttagctctaattttct

SEQ ID NO: 7793090 - DNA, 22 bp, Homo sapiens
ggcagggagtggagactcccta

SEQ ID NO: 7793091 - DNA, 22 bp, Homo sapiens
ggcaggcaggtcttcatggccc

SEQ ID NO: 7793092 - DNA, 22 bp, Homo sapiens
cacatttccttggcctttaatt

SEQ ID NO: 7793093 - DNA, 22 bp, Homo sapiens
cacatatacctcttcttgagtt

SEQ ID NO: 7793094 - DNA, 22 bp, Homo sapiens
ggaggtgatcagagttttgagg

SEQ ID NO: 7793095 - DNA, 22 bp, Homo sapiens
ggaggtgcagagtagggttggt

SEQ ID NO: 7793096 - DNA, 22 bp, Homo sapiens
cacagtgtgggcatggtgcctg

SEQ ID NO: 7793097 - DNA, 22 bp, Homo sapiens
cacagtttggttttgctgtaat

SEQ ID NO: 7793098 - DNA, 22 bp, Homo sapiens
cacagttttatcttatactgat

SEQ ID NO: 7793099 - DNA, 22 bp, Homo sapiens
cacagttttgcccagggcttct

SEQ ID NO: 7793100 - DNA, 22 bp, Homo sapiens
cacagttttgtcttggtttcca

SEQ ID NO: 7793101 - DNA, 22 bp, Homo sapiens
cacataaatggtgccatgtttt

SEQ ID NO: 7793102 - DNA, 22 bp, Homo sapiens
caaggccttcgtctcctagctt

SEQ ID NO: 7793103 - DNA, 21 bp, Homo sapiens
caagccagaccaatagcagcc

SEQ ID NO: 7793104 - DNA, 22 bp, Homo sapiens
caagcaggtttgctattttctt

SEQ ID NO: 7793105 - DNA, 22 bp, Homo sapiens
caaatggtcatttctcttttgt

SEQ ID NO: 7793106 - DNA, 22 bp, Homo sapiens
caaggtgccatgctgggcgggg

SEQ ID NO: 7793107 - DNA, 22 bp, Homo sapiens
gctgttcagatgcgattcagga

SEQ ID NO: 7793108 - DNA, 22 bp, Homo sapiens
gctgttcattagaaatagaatg

SEQ ID NO: 7793109 - DNA, 22 bp, Homo sapiens
caatgtttcttgtaaccagtga

SEQ ID NO: 7793110 - DNA, 22 bp, Homo sapiens
gctttcttggttctgcaggggc

SEQ ID NO: 7793111 - DNA, 22 bp, Homo sapiens
caataaagaagatttttgcaat

SEQ ID NO: 7793112 - DNA, 22 bp, Homo sapiens
caagttttgattttgcagtaaa

SEQ ID NO: 7793113 - DNA, 22 bp, Homo sapiens
caagttttagcaagtggaaagg

SEQ ID NO: 7793114 - DNA, 22 bp, Homo sapiens
gctttctggttctcaaagcact

SEQ ID NO: 7793115 - DNA, 18 bp, Homo sapiens
gctttctgtagaaaaggg

SEQ ID NO: 7793116 - DNA, 18 bp, Homo sapiens
gctttctgtgcagcggag

SEQ ID NO: 7793117 - DNA, 22 bp, Homo sapiens
ggaaggggagctggaaagggta

SEQ ID NO: 7793118 - DNA, 20 bp, Homo sapiens
ggaaggggcaaagtgtgtga

SEQ ID NO: 7793119 - DNA, 22 bp, Homo sapiens
ggaaggggagctggaaagggta

SEQ ID NO: 7793120 - DNA, 22 bp, Homo sapiens
ggagccctgctgacatgggtgt

SEQ ID NO: 7793121 - DNA, 22 bp, Homo sapiens
ggagcccttctattccatggag

SEQ ID NO: 7793122 - DNA, 22 bp, Homo sapiens
ggagccctgccctaggcagctc

SEQ ID NO: 7793123 - DNA, 22 bp, Homo sapiens
ggagcctgaaaagtctgcattt

SEQ ID NO: 7793124 - DNA, 22 bp, Homo sapiens
ggaggccaaggcaggtggatca

SEQ ID NO: 7793125 - DNA, 22 bp, Homo sapiens
attgtctttaaaaatatacaac

SEQ ID NO: 7793126 - DNA, 20 bp, Homo sapiens
gcagtgctggtgcctctgct

SEQ ID NO: 7793127 - DNA, 22 bp, Homo sapiens
gcagtgcttgaagaggtggcca

SEQ ID NO: 7793128 - DNA, 22 bp, Homo sapiens
gcatacaaaggtttacaactga

SEQ ID NO: 7793129 - DNA, 22 bp, Homo sapiens
gcatacagagaggatgtggcat

SEQ ID NO: 7793130 - DNA, 22 bp, Homo sapiens
gcagtgtgtgtccccacactgg

SEQ ID NO: 7793131 - DNA, 22 bp, Homo sapiens
gcagtgtgtttctgagatatgg

SEQ ID NO: 7793132 - DNA, 22 bp, Homo sapiens
attgtatttgtacaagacatgt

SEQ ID NO: 7793133 - DNA, 22 bp, Homo sapiens
attgtcatcgatgttagccagt

SEQ ID NO: 7793134 - DNA, 22 bp, Homo sapiens
attgtcagtgggatttgtcaac

SEQ ID NO: 7793135 - DNA, 22 bp, Homo sapiens
attgtcattggcttctatgtct

SEQ ID NO: 7793136 - DNA, 22 bp, Homo sapiens
attgtcattccagtcattgtta

SEQ ID NO: 7793137 - DNA, 22 bp, Homo sapiens
attgtcattccagtcattgtta

SEQ ID NO: 7793138 - DNA, 22 bp, Homo sapiens
gcatagtaggctgtcaaaaatg

SEQ ID NO: 7793139 - DNA, 22 bp, Homo sapiens
attctttacattggcttcttcc

SEQ ID NO: 7793140 - DNA, 22 bp, Homo sapiens
attctttaattcaattgaagga

SEQ ID NO: 7793141 - DNA, 22 bp, Homo sapiens
attctttaattcaattgaagga

SEQ ID NO: 7793142 - DNA, 22 bp, Homo sapiens
attcttgtttaatttgcatccc

SEQ ID NO: 7793143 - DNA, 19 bp, Homo sapiens
attcttgttaagtgtcatc

SEQ ID NO: 7793144 - DNA, 19 bp, Homo sapiens
attcttgttaagtgtcatc

SEQ ID NO: 7793145 - DNA, 22 bp, Homo sapiens
attcttgtttaatttgcatccc

SEQ ID NO: 7793146 - DNA, 22 bp, Homo sapiens
attctttcaaggaatagttatt

SEQ ID NO: 7793147 - DNA, 22 bp, Homo sapiens
attctttcatataaaggctcag

SEQ ID NO: 7793148 - DNA, 22 bp, Homo sapiens
attctttattgctgatggttat

SEQ ID NO: 7793149 - DNA, 22 bp, Homo sapiens
attctttattgctgatggttat

SEQ ID NO: 7793150 - DNA, 22 bp, Homo sapiens
attctttagttggcttcttgcc

SEQ ID NO: 7793151 - DNA, 22 bp, Homo sapiens
attctttagccagcaggtatat

SEQ ID NO: 7793152 - DNA, 19 bp, Homo sapiens
attcttcagcagtgagacc

SEQ ID NO: 7793153 - DNA, 19 bp, Homo sapiens
attcttcagcagtgagacc

SEQ ID NO: 7793154 - DNA, 20 bp, Homo sapiens
attcagaataggcatgtaaa

SEQ ID NO: 7793155 - DNA, 22 bp, Homo sapiens
attcagtttttattggaccagc

SEQ ID NO: 7793156 - DNA, 22 bp, Homo sapiens
attcagtttcatggcacagcta

SEQ ID NO: 7793157 - DNA, 22 bp, Homo sapiens
attcagtttcaatcattgtagt

SEQ ID NO: 7793158 - DNA, 21 bp, Homo sapiens
attcagtttgacatctagcag

SEQ ID NO: 7793159 - DNA, 22 bp, Homo sapiens
gcagcctttggaattagagact

SEQ ID NO: 7793160 - DNA, 22 bp, Homo sapiens
gcacctttctatattcagtggc

SEQ ID NO: 7793161 - DNA, 22 bp, Homo sapiens
attacagttctacacatccttt

SEQ ID NO: 7793162 - DNA, 17 bp, Homo sapiens
gatttcctgaagttctt

SEQ ID NO: 7793163 - DNA, 22 bp, Homo sapiens
attagaggtacaaaccttcact

SEQ ID NO: 7793164 - DNA, 22 bp, Homo sapiens
gatttcacctgatcttgtcatc

SEQ ID NO: 7793165 - DNA, 23 bp, Homo sapiens
attagaaaggctttctggtgaaa

SEQ ID NO: 7793166 - DNA, 22 bp, Homo sapiens
attaggtcatggggaggcccta

SEQ ID NO: 7793167 - DNA, 22 bp, Homo sapiens
attagggaaggatttggcctga

SEQ ID NO: 7793168 - DNA, 22 bp, Homo sapiens
attagggaaactgacttgtctc

SEQ ID NO: 7793169 - DNA, 22 bp, Homo sapiens
attagggctggatgcaaggaaa

SEQ ID NO: 7793170 - DNA, 22 bp, Homo sapiens
attagctttatttgaaatagga

SEQ ID NO: 7793171 - DNA, 22 bp, Homo sapiens
attagcttatcacacaagctgc

SEQ ID NO: 7793172 - DNA, 20 bp, Homo sapiens
attagcttggagacagtggc

SEQ ID NO: 7793173 - DNA, 22 bp, Homo sapiens
attcaactgtaaacttgttcac

SEQ ID NO: 7793174 - DNA, 22 bp, Homo sapiens
gctgaaaaatagtgtcgtgttt

SEQ ID NO: 7793175 - DNA, 22 bp, Homo sapiens
gctgaaaggggtgacattcttt

SEQ ID NO: 7793176 - DNA, 22 bp, Homo sapiens
gctgaaatcccagcattcccca

SEQ ID NO: 7793177 - DNA, 22 bp, Homo sapiens
gctgaaatgaaaacacaggtcg

SEQ ID NO: 7793178 - DNA, 22 bp, Homo sapiens
gctgaaatgccttgtaaatatt

SEQ ID NO: 7793179 - DNA, 22 bp, Homo sapiens
caaatggctggcatccttctac

SEQ ID NO: 7793180 - DNA, 22 bp, Homo sapiens
caaagctggactgctcagttca

SEQ ID NO: 7793181 - DNA, 22 bp, Homo sapiens
caaagctggaaaaggaggctgg

SEQ ID NO: 7793182 - DNA, 22 bp, Homo sapiens
caaatagaactcacagacaaga

SEQ ID NO: 7793183 - DNA, 22 bp, Homo sapiens
caaagcagttttaatcaagtag

SEQ ID NO: 7793184 - DNA, 22 bp, Homo sapiens
caaagcaggaagaatattgaaa

SEQ ID NO: 7793185 - DNA, 22 bp, Homo sapiens
caaaattagaaatgcagctgtt

SEQ ID NO: 7793186 - DNA, 22 bp, Homo sapiens
caaaattagggagtgagctgga

SEQ ID NO: 7793187 - DNA, 22 bp, Homo sapiens
caaaattctgcatttctaataa

SEQ ID NO: 7793188 - DNA, 22 bp, Homo sapiens
atttttcagcttcattgaggca

SEQ ID NO: 7793189 - DNA, 22 bp, Homo sapiens
attttacttcatttgaaatgcc

SEQ ID NO: 7793190 - DNA, 22 bp, Homo sapiens
attttagagctccaagtacagc

SEQ ID NO: 7793191 - DNA, 22 bp, Homo sapiens
atttttctctttccactgagat

SEQ ID NO: 7793192 - DNA, 19 bp, Homo sapiens
atttttcttcctctgtgca

SEQ ID NO: 7793193 - DNA, 22 bp, Homo sapiens
caaaagcagttctatctgagtt

SEQ ID NO: 7793194 - DNA, 22 bp, Homo sapiens
caaaataccacgacttgtttta

SEQ ID NO: 7793195 - DNA, 22 bp, Homo sapiens
atttttctctccactccattaa

SEQ ID NO: 7793196 - DNA, 22 bp, Homo sapiens
atttttctctcacacttaccag

SEQ ID NO: 7793197 - DNA, 22 bp, Homo sapiens
gcctggcacagtagggacccaa

SEQ ID NO: 7793198 - DNA, 22 bp, Homo sapiens
gcctggcacattgcagtggatt

SEQ ID NO: 7793199 - DNA, 22 bp, Homo sapiens
gcctggcaaggccctgttgact

SEQ ID NO: 7793200 - DNA, 22 bp, Homo sapiens
gcctggcacaggaattaggagg

SEQ ID NO: 7793201 - DNA, 22 bp, Homo sapiens
gcctggcaatggcctcaggaag

SEQ ID NO: 7793202 - DNA, 22 bp, Homo sapiens
gcctggcaatggcctcaggaag

SEQ ID NO: 7793203 - DNA, 22 bp, Homo sapiens
gcctggattccttgtttctcag

SEQ ID NO: 7793204 - DNA, 22 bp, Homo sapiens
gcctggattccttgtttctcag

SEQ ID NO: 7793205 - DNA, 22 bp, Homo sapiens
gcctgagattcccggagccgtg

SEQ ID NO: 7793206 - DNA, 22 bp, Homo sapiens
gcctgagatcaggagaaagcca

SEQ ID NO: 7793207 - DNA, 22 bp, Homo sapiens
gcctgagatcagccaagcccct

SEQ ID NO: 7793208 - DNA, 22 bp, Homo sapiens
gcctgagaaggataggaagcga

SEQ ID NO: 7793209 - DNA, 22 bp, Homo sapiens
gcctgaagtttcatgcctctat

SEQ ID NO: 7793210 - DNA, 22 bp, Homo sapiens
gcctgaaggagtcagagagggc

SEQ ID NO: 7793211 - DNA, 22 bp, Homo sapiens
gcctgaagaacagctgtgagga

SEQ ID NO: 7793212 - DNA, 22 bp, Homo sapiens
gcctgaagaacagctgtgagga

SEQ ID NO: 7793213 - DNA, 19 bp, Homo sapiens
gcctctgagggcaggacac

SEQ ID NO: 7793214 - DNA, 22 bp, Homo sapiens
gcccccagctctcaagctcaaa

SEQ ID NO: 7793215 - DNA, 22 bp, Homo sapiens
gccacaggtactatgggagaga

SEQ ID NO: 7793216 - DNA, 22 bp, Homo sapiens
atttctgttgcttataaattac

SEQ ID NO: 7793217 - DNA, 22 bp, Homo sapiens
atttctgtgcagtaaatggtga

SEQ ID NO: 7793218 - DNA, 22 bp, Homo sapiens
atttctgtatcctgctgtcaga

SEQ ID NO: 7793219 - DNA, 22 bp, Homo sapiens
atttctgtggcttcattctcct

SEQ ID NO: 7793220 - DNA, 22 bp, Homo sapiens
atttctgtagtccacattcttt

SEQ ID NO: 7793221 - DNA, 22 bp, Homo sapiens
atttctgtagtccacattcttt

SEQ ID NO: 7793222 - DNA, 17 bp, Homo sapiens
gcccacccttaggagct

SEQ ID NO: 7793223 - DNA, 22 bp, Homo sapiens
gcccacagtgtagcaggtactc

SEQ ID NO: 7793224 - DNA, 23 bp, Homo sapiens
gcccaccctcagcgtcctcacgg

SEQ ID NO: 7793225 - DNA, 23 bp, Homo sapiens
gcccaccctcagcgtcctcacgg

SEQ ID NO: 7793226 - DNA, 22 bp, Homo sapiens
atgtagagctccttgatcctcc

SEQ ID NO: 7793227 - DNA, 22 bp, Homo sapiens
atgtagagtagaatagtacaac

SEQ ID NO: 7793228 - DNA, 22 bp, Homo sapiens
gaggcagcgggtcaggaccgtg

SEQ ID NO: 7793229 - DNA, 21 bp, Homo sapiens
atgtgaaatatcatcagagca

SEQ ID NO: 7793230 - DNA, 22 bp, Homo sapiens
atgtgaaatagctggatatgaa

SEQ ID NO: 7793231 - DNA, 20 bp, Homo sapiens
atgtgaggggttgaagtggg

SEQ ID NO: 7793232 - DNA, 22 bp, Homo sapiens
atgtctgcggcccaggccaggg

SEQ ID NO: 7793233 - DNA, 22 bp, Homo sapiens
gagggctcaactactactaggc

SEQ ID NO: 7793234 - DNA, 22 bp, Homo sapiens
gagggctctgtctggaagggaa

SEQ ID NO: 7793235 - DNA, 22 bp, Homo sapiens
gagggctctactcaccaccctg

SEQ ID NO: 7793236 - DNA, 22 bp, Homo sapiens
gagggctctgaaaggaggtcac

SEQ ID NO: 7793237 - DNA, 23 bp, Homo sapiens
gagggctctgagtgcttgggcca

SEQ ID NO: 7793238 - DNA, 20 bp, Homo sapiens
gagggctcgtggatggataa

SEQ ID NO: 7793239 - DNA, 22 bp, Homo sapiens
gagggctctaccaagtaactct

SEQ ID NO: 7793240 - DNA, 22 bp, Homo sapiens
gagggctcctcacattctctat

SEQ ID NO: 7793241 - DNA, 22 bp, Homo sapiens
gagggctccattccccgtgccc

SEQ ID NO: 7793242 - DNA, 19 bp, Homo sapiens
gagggctcatttgaacaat

SEQ ID NO: 7793243 - DNA, 22 bp, Homo sapiens
gagggctccacacgggcccagc

SEQ ID NO: 7793244 - DNA, 22 bp, Homo sapiens
gagggctcactgagaaagcagt

SEQ ID NO: 7793245 - DNA, 22 bp, Homo sapiens
atgtgtctctaccaatgcaatt

SEQ ID NO: 7793246 - DNA, 22 bp, Homo sapiens
atgtttaaaggagtcagagact

SEQ ID NO: 7793247 - DNA, 22 bp, Homo sapiens
gataatattagaagatacaaat

SEQ ID NO: 7793248 - DNA, 22 bp, Homo sapiens
atgtttaaagggttgagaaata

SEQ ID NO: 7793249 - DNA, 22 bp, Homo sapiens
atgtttaagaaagtcttccata

SEQ ID NO: 7793250 - DNA, 22 bp, Homo sapiens
gataattttagtctgaaaattg

SEQ ID NO: 7793251 - DNA, 22 bp, Homo sapiens
gataatttgatacctcaatcag

SEQ ID NO: 7793252 - DNA, 22 bp, Homo sapiens
gagacagtgtccatccaggggc

SEQ ID NO: 7793253 - DNA, 22 bp, Homo sapiens
gactggggctctagccaggcct

SEQ ID NO: 7793254 - DNA, 22 bp, Homo sapiens
gagatggccagtgccaggacaa

SEQ ID NO: 7793255 - DNA, 22 bp, Homo sapiens
atgggaaagaagccactgccca

SEQ ID NO: 7793256 - DNA, 22 bp, Homo sapiens
atggcttggcaccatctccttg

SEQ ID NO: 7793257 - DNA, 22 bp, Homo sapiens
gaggagaagctaagaaacacag

SEQ ID NO: 7793258 - DNA, 22 bp, Homo sapiens
gaggcacatatatacagagccc

SEQ ID NO: 7793259 - DNA, 22 bp, Homo sapiens
atggtgtttataggcaaagatc

SEQ ID NO: 7793260 - DNA, 22 bp, Homo sapiens
atgggagaaacatcatgaggca

SEQ ID NO: 7793261 - DNA, 22 bp, Homo sapiens
atgggcttgaccctacagaaag

SEQ ID NO: 7793262 - DNA, 23 bp, Homo sapiens
atgggcttagaaagcaagtggga

SEQ ID NO: 7793263 - DNA, 22 bp, Homo sapiens
gaacaaattggagaaatcagga

SEQ ID NO: 7793264 - DNA, 22 bp, Homo sapiens
gaacaactccaagggacatcat

SEQ ID NO: 7793265 - DNA, 22 bp, Homo sapiens
gaacaaatcccttcctgtctcc

SEQ ID NO: 7793266 - DNA, 22 bp, Homo sapiens
gaacaaattctcatcaacttgt

SEQ ID NO: 7793267 - DNA, 22 bp, Homo sapiens
gaataatagcagaaattagcag

SEQ ID NO: 7793268 - DNA, 22 bp, Homo sapiens
gaataatattgactttgcaggc

SEQ ID NO: 7793269 - DNA, 22 bp, Homo sapiens
gaagtcttcatctgatgctctg

SEQ ID NO: 7793270 - DNA, 22 bp, Homo sapiens
gaagtcttgaaacacaaactag

SEQ ID NO: 7793271 - DNA, 22 bp, Homo sapiens
gaagtcttcattctctctgaga

SEQ ID NO: 7793272 - DNA, 22 bp, Homo sapiens
gaagtcttttcttccacccaaa

SEQ ID NO: 7793273 - DNA, 22 bp, Homo sapiens
gaagtcttttagcaaaacgaac

SEQ ID NO: 7793274 - DNA, 22 bp, Homo sapiens
gaagtcttggctgaaaaccctc

SEQ ID NO: 7793275 - DNA, 22 bp, Homo sapiens
gaagtcttgaagagcactgtaa

SEQ ID NO: 7793276 - DNA, 22 bp, Homo sapiens
gaataattttgatcagaaggga

SEQ ID NO: 7793277 - DNA, 22 bp, Homo sapiens
gaataattgtgatgcttgaagt

SEQ ID NO: 7793278 - DNA, 22 bp, Homo sapiens
gaatcaatggtagattaagtaa

SEQ ID NO: 7793279 - DNA, 22 bp, Homo sapiens
gaatatttttaaagggactaat

SEQ ID NO: 7793280 - DNA, 22 bp, Homo sapiens
gaatcagcctgagtttgcagct

SEQ ID NO: 7793281 - DNA, 22 bp, Homo sapiens
gaatcagatactgatttcagtc

SEQ ID NO: 7793282 - DNA, 22 bp, Homo sapiens
atgctatttaccacacatcatt

SEQ ID NO: 7793283 - DNA, 22 bp, Homo sapiens
atgctcagggcacactctggac

SEQ ID NO: 7793284 - DNA, 22 bp, Homo sapiens
gacatttctagcccataaaact

SEQ ID NO: 7793285 - DNA, 22 bp, Homo sapiens
atgaaaagttcgatctagaagg

SEQ ID NO: 7793286 - DNA, 22 bp, Homo sapiens
ctttccagtaccaggaagcgga

SEQ ID NO: 7793287 - DNA, 22 bp, Homo sapiens
cttctttaccaagagatagagt

SEQ ID NO: 7793288 - DNA, 22 bp, Homo sapiens
cttctttaccaagagatagagt

SEQ ID NO: 7793289 - DNA, 22 bp, Homo sapiens
cttctttactttctagaaataa

SEQ ID NO: 7793290 - DNA, 22 bp, Homo sapiens
cttctttaatgtatacaaaaga

SEQ ID NO: 7793291 - DNA, 22 bp, Homo sapiens
cttctttaatgtatacaaaaga

SEQ ID NO: 7793292 - DNA, 22 bp, Homo sapiens
atgaaaattgacagcggaagta

SEQ ID NO: 7793293 - DNA, 22 bp, Homo sapiens
atgaaaagttcgatctagaagg

SEQ ID NO: 7793294 - DNA, 22 bp, Homo sapiens
atgaaaatgtacatgtgtataa

SEQ ID NO: 7793295 - DNA, 22 bp, Homo sapiens
atgaacagaggaatagaattct

SEQ ID NO: 7793296 - DNA, 23 bp, Homo sapiens
atgaacattagtttcagatattg

SEQ ID NO: 7793297 - DNA, 22 bp, Homo sapiens
ctttcttatacctgtcagggcc

SEQ ID NO: 7793298 - DNA, 22 bp, Homo sapiens
ctttctggagtggaaaggtatt

SEQ ID NO: 7793299 - DNA, 22 bp, Homo sapiens
ctttctttcgaagacgtgatta

SEQ ID NO: 7793300 - DNA, 22 bp, Homo sapiens
gaaacatattaatccagtgaaa

SEQ ID NO: 7793301 - DNA, 22 bp, Homo sapiens
atgacataaagctatgctaggt

SEQ ID NO: 7793302 - DNA, 22 bp, Homo sapiens
atgacagatgctgtggggaggt

SEQ ID NO: 7793303 - DNA, 22 bp, Homo sapiens
atgatattttagtaaagtgata

SEQ ID NO: 7793304 - DNA, 22 bp, Homo sapiens
gaaatagtacagcatagttctt

SEQ ID NO: 7793305 - DNA, 22 bp, Homo sapiens
atgatgaaactaggaactagag

SEQ ID NO: 7793306 - DNA, 22 bp, Homo sapiens
atattaggagttaaatgtatta

SEQ ID NO: 7793307 - DNA, 22 bp, Homo sapiens
atattacataaacatgagtgaa

SEQ ID NO: 7793308 - DNA, 22 bp, Homo sapiens
atattataagttatttcaagtt

SEQ ID NO: 7793309 - DNA, 22 bp, Homo sapiens
atattaggttggtgcaaaagta

SEQ ID NO: 7793310 - DNA, 23 bp, Homo sapiens
atattagggagattagccctcta

SEQ ID NO: 7793311 - DNA, 22 bp, Homo sapiens
atattaggcaaggagattattt

SEQ ID NO: 7793312 - DNA, 22 bp, Homo sapiens
atattaggtgctcaatacatgc

SEQ ID NO: 7793313 - DNA, 22 bp, Homo sapiens
atattagggtctctaaattcta

SEQ ID NO: 7793314 - DNA, 22 bp, Homo sapiens
atatgtttttggaaagaacaca

SEQ ID NO: 7793315 - DNA, 22 bp, Homo sapiens
ctggctgggagcgagctgctca

SEQ ID NO: 7793316 - DNA, 22 bp, Homo sapiens
atatgcagagagcatgaatagg

SEQ ID NO: 7793317 - DNA, 22 bp, Homo sapiens
atatttaaacagggtaccaata

SEQ ID NO: 7793318 - DNA, 22 bp, Homo sapiens
atcaaagtatctcaatatggta

SEQ ID NO: 7793319 - DNA, 22 bp, Homo sapiens
atcaaagtaattaacactgaga

SEQ ID NO: 7793320 - DNA, 22 bp, Homo sapiens
atatttaactggtcccaatata

SEQ ID NO: 7793321 - DNA, 22 bp, Homo sapiens
atattttggggtgatgtgcatc

SEQ ID NO: 7793322 - DNA, 22 bp, Homo sapiens
atcaaaatggaagaatttggct

SEQ ID NO: 7793323 - DNA, 22 bp, Homo sapiens
atcagaaatagtcatgttactt

SEQ ID NO: 7793324 - DNA, 22 bp, Homo sapiens
atcaaagttcgtaactgataac

SEQ ID NO: 7793325 - DNA, 22 bp, Homo sapiens
atctgaaatagtcttatctgag

SEQ ID NO: 7793326 - DNA, 22 bp, Homo sapiens
atctgagactgagtttggattt

SEQ ID NO: 7793327 - DNA, 22 bp, Homo sapiens
atctgacaaggccacatattct

SEQ ID NO: 7793328 - DNA, 22 bp, Homo sapiens
atctgagtctctgacagcatgt

SEQ ID NO: 7793329 - DNA, 21 bp, Homo sapiens
cttcttggggagcagctagac

SEQ ID NO: 7793330 - DNA, 22 bp, Homo sapiens
cttcattaaccaaaatgcaata

SEQ ID NO: 7793331 - DNA, 22 bp, Homo sapiens
cttcattaatgtctataagttt

SEQ ID NO: 7793332 - DNA, 22 bp, Homo sapiens
atccaggcgaatgcagaaggcc

SEQ ID NO: 7793333 - DNA, 22 bp, Homo sapiens
atccaggccccaagaccccgac

SEQ ID NO: 7793334 - DNA, 22 bp, Homo sapiens
atccaccctgtggtggctttct

SEQ ID NO: 7793335 - DNA, 22 bp, Homo sapiens
atccaggctgctatgaggatga

SEQ ID NO: 7793336 - DNA, 22 bp, Homo sapiens
atccaggcttaatgggagccac

SEQ ID NO: 7793337 - DNA, 22 bp, Homo sapiens
atccaggctgtctaatgggaga

SEQ ID NO: 7793338 - DNA, 22 bp, Homo sapiens
atccaggcttaatgggagccac

SEQ ID NO: 7793339 - DNA, 22 bp, Homo sapiens
atcctgggcaagtcaatgtccc

SEQ ID NO: 7793340 - DNA, 22 bp, Homo sapiens
ctgtgggaacactgaggacttc

SEQ ID NO: 7793341 - DNA, 22 bp, Homo sapiens
atcagagaagtttcactggcat

SEQ ID NO: 7793342 - DNA, 22 bp, Homo sapiens
atcagagaaatggagggcgctt

SEQ ID NO: 7793343 - DNA, 22 bp, Homo sapiens
atcagagacaaaaccagcactt

SEQ ID NO: 7793344 - DNA, 22 bp, Homo sapiens
atcagagaccggtcaagtcatg

SEQ ID NO: 7793345 - DNA, 22 bp, Homo sapiens
atcagagattgtagtatgtgca

SEQ ID NO: 7793346 - DNA, 22 bp, Homo sapiens
atcagagatggctccagtgctc

SEQ ID NO: 7793347 - DNA, 22 bp, Homo sapiens
atcagacaattgttgagtactg

SEQ ID NO: 7793348 - DNA, 22 bp, Homo sapiens
ctggccccaggcagcctgctgg

SEQ ID NO: 7793349 - DNA, 22 bp, Homo sapiens
atagcaaatattttaatgagca

SEQ ID NO: 7793350 - DNA, 22 bp, Homo sapiens
ctggaagtggggttggcttgaa

SEQ ID NO: 7793351 - DNA, 17 bp, Homo sapiens
atacagtttattttaca

SEQ ID NO: 7793352 - DNA, 22 bp, Homo sapiens
atacagtggctgtgagctgggc

SEQ ID NO: 7793353 - DNA, 22 bp, Homo sapiens
atacagtgccccttttcacatg

SEQ ID NO: 7793354 - DNA, 22 bp, Homo sapiens
atacagtggctgtgagctgggc

SEQ ID NO: 7793355 - DNA, 22 bp, Homo sapiens
atacagtgcacaacctgtgcag

SEQ ID NO: 7793356 - DNA, 22 bp, Homo sapiens
atacctgtgtatccacaagcgt

SEQ ID NO: 7793357 - DNA, 22 bp, Homo sapiens
ctgaggagccccctctcagcat

SEQ ID NO: 7793358 - DNA, 22 bp, Homo sapiens
ctgaggagcgttggtcacgtgt

SEQ ID NO: 7793359 - DNA, 22 bp, Homo sapiens
ctgaggagctgaaggccctcca

SEQ ID NO: 7793360 - DNA, 22 bp, Homo sapiens
ctgaggagcaaccccgtgccct

SEQ ID NO: 7793361 - DNA, 22 bp, Homo sapiens
ctgaggagcagctggcccgcta

SEQ ID NO: 7793362 - DNA, 22 bp, Homo sapiens
ctgaggagatgataatgtcatt

SEQ ID NO: 7793363 - DNA, 22 bp, Homo sapiens
ctgaggagatgggctttttagg

SEQ ID NO: 7793364 - DNA, 22 bp, Homo sapiens
ctgaggagatccccccagaagt

SEQ ID NO: 7793365 - DNA, 22 bp, Homo sapiens
agttattactctttaacatatt

SEQ ID NO: 7793366 - DNA, 22 bp, Homo sapiens
agttatttaaaatgattgtcct

SEQ ID NO: 7793367 - DNA, 22 bp, Homo sapiens
agttatttactcctttgtctct

SEQ ID NO: 7793368 - DNA, 22 bp, Homo sapiens
ctgcagggtttttcaaggacaa

SEQ ID NO: 7793369 - DNA, 22 bp, Homo sapiens
ctgcatcttagtcaaaatctgt

SEQ ID NO: 7793370 - DNA, 22 bp, Homo sapiens
ctgcatctgcataatcaacttc

SEQ ID NO: 7793371 - DNA, 21 bp, Homo sapiens
ctgcatctgagtcattatgcc

SEQ ID NO: 7793372 - DNA, 22 bp, Homo sapiens
ctgcatctgttagattatcacc

SEQ ID NO: 7793373 - DNA, 22 bp, Homo sapiens
ctgcagggtgacgttgcccacc

SEQ ID NO: 7793374 - DNA, 20 bp, Homo sapiens
ctgcagggttagaggctcca

SEQ ID NO: 7793375 - DNA, 20 bp, Homo sapiens
ctgcagggtgagtgggcgat

SEQ ID NO: 7793376 - DNA, 22 bp, Homo sapiens
atacaaatttatagatgcattt

SEQ ID NO: 7793377 - DNA, 22 bp, Homo sapiens
ctgctgaggtatactatgtgac

SEQ ID NO: 7793378 - DNA, 22 bp, Homo sapiens
ataaatgtttgttgaatgaata

SEQ ID NO: 7793379 - DNA, 23 bp, Homo sapiens
ataaattactatctccctagagc

SEQ ID NO: 7793380 - DNA, 22 bp, Homo sapiens
ataaatgtgaattagagctttg

SEQ ID NO: 7793381 - DNA, 22 bp, Homo sapiens
ataaattatgaatggccctttt

SEQ ID NO: 7793382 - DNA, 22 bp, Homo sapiens
ataacagatactctctgtgagg

SEQ ID NO: 7793383 - DNA, 22 bp, Homo sapiens
ataaattaggatctggggttcc

SEQ ID NO: 7793384 - DNA, 22 bp, Homo sapiens
ataaattaggatctggggttcc

SEQ ID NO: 7793385 - DNA, 22 bp, Homo sapiens
ataacatggagtttgtcattta

SEQ ID NO: 7793386 - DNA, 22 bp, Homo sapiens
ataacattttgacaactggtga

SEQ ID NO: 7793387 - DNA, 22 bp, Homo sapiens
ataacagatgtgaagtgctaat

SEQ ID NO: 7793388 - DNA, 22 bp, Homo sapiens
ataaatgaacattcacagagct

SEQ ID NO: 7793389 - DNA, 22 bp, Homo sapiens
ataaatgattcagcaggaaata

SEQ ID NO: 7793390 - DNA, 18 bp, Homo sapiens
ctcctggctgatggtgag

SEQ ID NO: 7793391 - DNA, 19 bp, Homo sapiens
ctcctggctctgtcatttt

SEQ ID NO: 7793392 - DNA, 22 bp, Homo sapiens
ctcctggctctgccacttacta

SEQ ID NO: 7793393 - DNA, 22 bp, Homo sapiens
ctcctggctcgcccccagctga

SEQ ID NO: 7793394 - DNA, 22 bp, Homo sapiens
ctcctggctctctgtttagtgt

SEQ ID NO: 7793395 - DNA, 22 bp, Homo sapiens
ctcctacattccaccttggact

SEQ ID NO: 7793396 - DNA, 22 bp, Homo sapiens
ctcctacagtgtttgagtccag

SEQ ID NO: 7793397 - DNA, 22 bp, Homo sapiens
ctcctacacatagatgctttca

SEQ ID NO: 7793398 - DNA, 22 bp, Homo sapiens
ctcctaggacgccgctgctcct

SEQ ID NO: 7793399 - DNA, 22 bp, Homo sapiens
ctcctacataacccagcgaact

SEQ ID NO: 7793400 - DNA, 22 bp, Homo sapiens
ctccctcagaggagcacctgtt

SEQ ID NO: 7793401 - DNA, 22 bp, Homo sapiens
ctccctcaccatgacccgctgt

SEQ ID NO: 7793402 - DNA, 22 bp, Homo sapiens
ctcccaggttgattctttccct

SEQ ID NO: 7793403 - DNA, 22 bp, Homo sapiens
ctccctcaggccttagccctgc

SEQ ID NO: 7793404 - DNA, 22 bp, Homo sapiens
ctcctggtgactcccagataaa

SEQ ID NO: 7793405 - DNA, 22 bp, Homo sapiens
agtggcagaagccaagtctgca

SEQ ID NO: 7793406 - DNA, 22 bp, Homo sapiens
ctcctggctttcccagaccagg

SEQ ID NO: 7793407 - DNA, 22 bp, Homo sapiens
ctcctggctttcccagaccagg

SEQ ID NO: 7793408 - DNA, 22 bp, Homo sapiens
ctcctggcttctgaaatcgtgg

SEQ ID NO: 7793409 - DNA, 18 bp, Homo sapiens
ctcctggctgatggtgag

SEQ ID NO: 7793410 - DNA, 22 bp, Homo sapiens
ctccaggctcgtccaagatcga

SEQ ID NO: 7793411 - DNA, 22 bp, Homo sapiens
ctccaggctggatccaagtcaa

SEQ ID NO: 7793412 - DNA, 22 bp, Homo sapiens
ctccaggctcgtccaagatcga

SEQ ID NO: 7793413 - DNA, 22 bp, Homo sapiens
agtcttcagcagggttaaaccc

SEQ ID NO: 7793414 - DNA, 22 bp, Homo sapiens
agtccggggtctggacacctgg

SEQ ID NO: 7793415 - DNA, 22 bp, Homo sapiens
agtccggggtctggacacctgg

SEQ ID NO: 7793416 - DNA, 22 bp, Homo sapiens
agtccggggtctggacacctgg

SEQ ID NO: 7793417 - DNA, 22 bp, Homo sapiens
agtcctctgctgtgcgtctttg

SEQ ID NO: 7793418 - DNA, 22 bp, Homo sapiens
agtcctggcatataggtcctca

SEQ ID NO: 7793419 - DNA, 18 bp, Homo sapiens
ctcagtgtttgctgaaaa

SEQ ID NO: 7793420 - DNA, 22 bp, Homo sapiens
ctcattgcccagatccccacag

SEQ ID NO: 7793421 - DNA, 22 bp, Homo sapiens
ctcattgcaacctccgcctccc

SEQ ID NO: 7793422 - DNA, 22 bp, Homo sapiens
ctcatggcagagtcacctgtcc

SEQ ID NO: 7793423 - DNA, 22 bp, Homo sapiens
ctctgctagggctgaggtgttc

SEQ ID NO: 7793424 - DNA, 22 bp, Homo sapiens
ctctcagtgcctgccctaggct

SEQ ID NO: 7793425 - DNA, 22 bp, Homo sapiens
ctctgagcagaggccgtggcta

SEQ ID NO: 7793426 - DNA, 22 bp, Homo sapiens
ctgaaataaagttgctaaaatt

SEQ ID NO: 7793427 - DNA, 20 bp, Homo sapiens
agtgtctggattttgtaacc

SEQ ID NO: 7793428 - DNA, 22 bp, Homo sapiens
agtgtctgcgggcagaggagcg

SEQ ID NO: 7793429 - DNA, 22 bp, Homo sapiens
agtgtctgcctgggaggagcat

SEQ ID NO: 7793430 - DNA, 22 bp, Homo sapiens
ctgaaattattgtttaatcaaa

SEQ ID NO: 7793431 - DNA, 22 bp, Homo sapiens
ctgaaattctgcctctgcacaa

SEQ ID NO: 7793432 - DNA, 22 bp, Homo sapiens
ctgacaaggttgaattgtccca

SEQ ID NO: 7793433 - DNA, 22 bp, Homo sapiens
ctgaggagaacaatgagatcaa

SEQ ID NO: 7793434 - DNA, 17 bp, Homo sapiens
ctgaggagaacagaaag

SEQ ID NO: 7793435 - DNA, 22 bp, Homo sapiens
ctgaggagacagaagccaaata

SEQ ID NO: 7793436 - DNA, 22 bp, Homo sapiens
ctgaggagagatcacgtggtgt

SEQ ID NO: 7793437 - DNA, 22 bp, Homo sapiens
ctgaggagaccatcaactaatt

SEQ ID NO: 7793438 - DNA, 22 bp, Homo sapiens
ctgaggagaggtggcctgtgtt

SEQ ID NO: 7793439 - DNA, 22 bp, Homo sapiens
agttagcagcttattagaaaca

SEQ ID NO: 7793440 - DNA, 22 bp, Homo sapiens
agttaggacacttgagggctaa

SEQ ID NO: 7793441 - DNA, 23 bp, Homo sapiens
agttaggtcaagttaggtcaatt

SEQ ID NO: 7793442 - DNA, 22 bp, Homo sapiens
agttaggagtataggaatgcct

SEQ ID NO: 7793443 - DNA, 22 bp, Homo sapiens
agttactcactgagggtttatt

SEQ ID NO: 7793444 - DNA, 22 bp, Homo sapiens
cctggctctgtcctcgcgcaaa

SEQ ID NO: 7793445 - DNA, 22 bp, Homo sapiens
cctggctctggttccctcagct

SEQ ID NO: 7793446 - DNA, 22 bp, Homo sapiens
cctggctctgcgtgcagctccg

SEQ ID NO: 7793447 - DNA, 22 bp, Homo sapiens
cctggctctgggatcttcgctt

SEQ ID NO: 7793448 - DNA, 22 bp, Homo sapiens
cctggctctggggcggacagct

SEQ ID NO: 7793449 - DNA, 22 bp, Homo sapiens
cctggctctgcagccactccag

SEQ ID NO: 7793450 - DNA, 22 bp, Homo sapiens
cctggcacaagagcagcattgg

SEQ ID NO: 7793451 - DNA, 22 bp, Homo sapiens
cctggcaagtgggctcccagat

SEQ ID NO: 7793452 - DNA, 22 bp, Homo sapiens
cctggcacacggtggcattcaa

SEQ ID NO: 7793453 - DNA, 22 bp, Homo sapiens
cctgccagcgcttatctctcgg

SEQ ID NO: 7793454 - DNA, 21 bp, Homo sapiens
aggtacaggtcttgtgagtct

SEQ ID NO: 7793455 - DNA, 22 bp, Homo sapiens
aggtagggaagaaggcatgaaa

SEQ ID NO: 7793456 - DNA, 17 bp, Homo sapiens
cgggcatggagggcagg

SEQ ID NO: 7793457 - DNA, 17 bp, Homo sapiens
cgggcatggagggcagg

SEQ ID NO: 7793458 - DNA, 22 bp, Homo sapiens
cgggcaaggcgagactaggccc

SEQ ID NO: 7793459 - DNA, 22 bp, Homo sapiens
cgggctccgggtctttgcagtc

SEQ ID NO: 7793460 - DNA, 22 bp, Homo sapiens
aggtttctgcactgtcactggt

SEQ ID NO: 7793461 - DNA, 19 bp, Homo sapiens
cgcaggagccgaggtgacc

SEQ ID NO: 7793462 - DNA, 22 bp, Homo sapiens
agtatttagagacacaagatgg

SEQ ID NO: 7793463 - DNA, 22 bp, Homo sapiens
ctacccagcacctaggctgcct

SEQ ID NO: 7793464 - DNA, 22 bp, Homo sapiens
agtccagggagcccaggctttg

SEQ ID NO: 7793465 - DNA, 22 bp, Homo sapiens
agtccagtgtcaaggtgccatt

SEQ ID NO: 7793466 - DNA, 22 bp, Homo sapiens
agtccagtgtgttctggcagca

SEQ ID NO: 7793467 - DNA, 22 bp, Homo sapiens
agtccagtctcactcttggcag

SEQ ID NO: 7793468 - DNA, 21 bp, Homo sapiens
cagtattttaagcagtgagtt

SEQ ID NO: 7793469 - DNA, 22 bp, Homo sapiens
cagtccagagcccaccagagga

SEQ ID NO: 7793470 - DNA, 22 bp, Homo sapiens
cagtccagagcccaccagagga

SEQ ID NO: 7793471 - DNA, 22 bp, Homo sapiens
cagtgtggagggagagagcctg

SEQ ID NO: 7793472 - DNA, 22 bp, Homo sapiens
cagtgtggctgagacagaggct

SEQ ID NO: 7793473 - DNA, 22 bp, Homo sapiens
cagtgtgctgcagagaacattt

SEQ ID NO: 7793474 - DNA, 22 bp, Homo sapiens
cagtgttccctgaacatatgtt

SEQ ID NO: 7793475 - DNA, 22 bp, Homo sapiens
cagtgtgtctcttgtcctggct

SEQ ID NO: 7793476 - DNA, 22 bp, Homo sapiens
cagtgtggtgtgcacagcttag

SEQ ID NO: 7793477 - DNA, 22 bp, Homo sapiens
cagtgtggtgagattccaggtg

SEQ ID NO: 7793478 - DNA, 21 bp, Homo sapiens
cagtgtggtgaccagggtctc

SEQ ID NO: 7793479 - DNA, 22 bp, Homo sapiens
cataacattaagcctctatttc

SEQ ID NO: 7793480 - DNA, 22 bp, Homo sapiens
cagttttattggttgaaatctg

SEQ ID NO: 7793481 - DNA, 22 bp, Homo sapiens
catgagataatttttctccagt

SEQ ID NO: 7793482 - DNA, 22 bp, Homo sapiens
catgagagatccttcatgagag

SEQ ID NO: 7793483 - DNA, 23 bp, Homo sapiens
aggatgtaggatgtatggcagag

SEQ ID NO: 7793484 - DNA, 22 bp, Homo sapiens
catacagttttccctagatgtg

SEQ ID NO: 7793485 - DNA, 22 bp, Homo sapiens
catacagtcactgtggtaccac

SEQ ID NO: 7793486 - DNA, 22 bp, Homo sapiens
aggaggctgaactagggtctgg

SEQ ID NO: 7793487 - DNA, 22 bp, Homo sapiens
catttctccgccgagatcactg

SEQ ID NO: 7793488 - DNA, 22 bp, Homo sapiens
catttcaatgccttcaacatag

SEQ ID NO: 7793489 - DNA, 22 bp, Homo sapiens
catttattggttaggccagcag

SEQ ID NO: 7793490 - DNA, 22 bp, Homo sapiens
aggcaagattaggaccagaaga

SEQ ID NO: 7793491 - DNA, 22 bp, Homo sapiens
cattcggaggtagttgaggtta

SEQ ID NO: 7793492 - DNA, 22 bp, Homo sapiens
aggcaatcccctgaggatactt

SEQ ID NO: 7793493 - DNA, 22 bp, Homo sapiens
ccacccagccagatgcaggaag

SEQ ID NO: 7793494 - DNA, 22 bp, Homo sapiens
ccacccagcagaggaggcaaga

SEQ ID NO: 7793495 - DNA, 22 bp, Homo sapiens
ccacccagaccagggatctggg

SEQ ID NO: 7793496 - DNA, 22 bp, Homo sapiens
ccacgacgagtcatcagggcga

SEQ ID NO: 7793497 - DNA, 22 bp, Homo sapiens
aggcaggaaaatcgcttgaacc

SEQ ID NO: 7793498 - DNA, 17 bp, Homo sapiens
aggcaggagattggaga

SEQ ID NO: 7793499 - DNA, 22 bp, Homo sapiens
aggacaagctaaaggacttcct

SEQ ID NO: 7793500 - DNA, 22 bp, Homo sapiens
cagtaaacactagcattcttgg

SEQ ID NO: 7793501 - DNA, 22 bp, Homo sapiens
cagtaacatttcaaggtagagg

SEQ ID NO: 7793502 - DNA, 22 bp, Homo sapiens
cagtatgttcttccaggacaga

SEQ ID NO: 7793503 - DNA, 22 bp, Homo sapiens
agctttggccctggaggttact

SEQ ID NO: 7793504 - DNA, 22 bp, Homo sapiens
agctttgggattcaggcaggaa

SEQ ID NO: 7793505 - DNA, 22 bp, Homo sapiens
cagggatgtgatgagctgagcc

SEQ ID NO: 7793506 - DNA, 22 bp, Homo sapiens
cagggatgtgatgagctgagcc

SEQ ID NO: 7793507 - DNA, 22 bp, Homo sapiens
cagggctggcttccaagttgtt

SEQ ID NO: 7793508 - DNA, 22 bp, Homo sapiens
caggcccattctaggcttgcta

SEQ ID NO: 7793509 - DNA, 22 bp, Homo sapiens
agcttccttgaattctgtagaa

SEQ ID NO: 7793510 - DNA, 22 bp, Homo sapiens
agcttcctgtcttctgcacaaa

SEQ ID NO: 7793511 - DNA, 22 bp, Homo sapiens
caggcaggtgcagattcctctt

SEQ ID NO: 7793512 - DNA, 22 bp, Homo sapiens
agctgtcaggcagaactgagct

SEQ ID NO: 7793513 - DNA, 22 bp, Homo sapiens
caggcacaattatttccctttc

SEQ ID NO: 7793514 - DNA, 22 bp, Homo sapiens
caggcacacatccgtgagagat

SEQ ID NO: 7793515 - DNA, 20 bp, Homo sapiens
caggcacactcattcctgct

SEQ ID NO: 7793516 - DNA, 22 bp, Homo sapiens
caggactgatgttcctccagcc

SEQ ID NO: 7793517 - DNA, 22 bp, Homo sapiens
cagctgtcacttctaagttttg

SEQ ID NO: 7793518 - DNA, 22 bp, Homo sapiens
cagctgggtttagtggggtgtg

SEQ ID NO: 7793519 - DNA, 22 bp, Homo sapiens
cagctgtcagccggtgcaggct

SEQ ID NO: 7793520 - DNA, 22 bp, Homo sapiens
cctacagttatattcttgattg

SEQ ID NO: 7793521 - DNA, 22 bp, Homo sapiens
cctacattctctgagttttcct

SEQ ID NO: 7793522 - DNA, 22 bp, Homo sapiens
agggctgacagtggcgtggcgt

SEQ ID NO: 7793523 - DNA, 22 bp, Homo sapiens
agggctgaggcgagggagatgc

SEQ ID NO: 7793524 - DNA, 22 bp, Homo sapiens
agggctgagcccaggcatgtag

SEQ ID NO: 7793525 - DNA, 20 bp, Homo sapiens
agggctgagaagggactagc

SEQ ID NO: 7793526 - DNA, 22 bp, Homo sapiens
agggctgacctaagctccactt

SEQ ID NO: 7793527 - DNA, 22 bp, Homo sapiens
agggctgagactaaggccagat

SEQ ID NO: 7793528 - DNA, 20 bp, Homo sapiens
agggctgagaagggactagc

SEQ ID NO: 7793529 - DNA, 22 bp, Homo sapiens
agggctgagaatgacagggccg

SEQ ID NO: 7793530 - DNA, 22 bp, Homo sapiens
ccctggcagagggggcaggtgc

SEQ ID NO: 7793531 - DNA, 20 bp, Homo sapiens
cctctgtgtcctgtgtcata

SEQ ID NO: 7793532 - DNA, 22 bp, Homo sapiens
agggggtgcatttgtgaatgaa

SEQ ID NO: 7793533 - DNA, 22 bp, Homo sapiens
agggggtgtctctgattgggtt

SEQ ID NO: 7793534 - DNA, 22 bp, Homo sapiens
cctcctggtgggcgcttctggc

SEQ ID NO: 7793535 - DNA, 22 bp, Homo sapiens
cctcctggttgcaatgaaatgg

SEQ ID NO: 7793536 - DNA, 22 bp, Homo sapiens
cctcctggtgacaaggcaaagc

SEQ ID NO: 7793537 - DNA, 22 bp, Homo sapiens
agggatggtggaggaatttcaa

SEQ ID NO: 7793538 - DNA, 22 bp, Homo sapiens
agggcatgtgggagaggagcct

SEQ ID NO: 7793539 - DNA, 22 bp, Homo sapiens
agggaaaggctgatgctgtggg

SEQ ID NO: 7793540 - DNA, 21 bp, Homo sapiens
agggaaagaaaatgagctaat

SEQ ID NO: 7793541 - DNA, 22 bp, Homo sapiens
aggctttcgatgaacgcttgct

SEQ ID NO: 7793542 - DNA, 22 bp, Homo sapiens
cccagatgcaggttcaagagta

SEQ ID NO: 7793543 - DNA, 23 bp, Homo sapiens
agggaaagtagtaatggcctttg

SEQ ID NO: 7793544 - DNA, 22 bp, Homo sapiens
agggaaagtaagcatttcatta

SEQ ID NO: 7793545 - DNA, 22 bp, Homo sapiens
cccaggcctggtctgggccagt

SEQ ID NO: 7793546 - DNA, 17 bp, Homo sapiens
cccaggccgccgggagc

SEQ ID NO: 7793547 - DNA, 22 bp, Homo sapiens
agggaccaatcaccgacaggct

SEQ ID NO: 7793548 - DNA, 22 bp, Homo sapiens
agggacagtctactgttcactg

SEQ ID NO: 7793549 - DNA, 22 bp, Homo sapiens
agggaatggatgatggcaggtt

SEQ ID NO: 7793550 - DNA, 22 bp, Homo sapiens
agggaccctgatgactgaggag

SEQ ID NO: 7793551 - DNA, 22 bp, Homo sapiens
agggacccatagagagaccagt

SEQ ID NO: 7793552 - DNA, 22 bp, Homo sapiens
agggaccttgatgggtttggga

SEQ ID NO: 7793553 - DNA, 22 bp, Homo sapiens
agggacctgtcaatgacagtta

SEQ ID NO: 7793554 - DNA, 22 bp, Homo sapiens
agggacctgctcactgcctggc

SEQ ID NO: 7793555 - DNA, 22 bp, Homo sapiens
agggacctcttcttgcagctga

SEQ ID NO: 7793556 - DNA, 22 bp, Homo sapiens
agggacctcatgtaagtggatt

SEQ ID NO: 7793557 - DNA, 22 bp, Homo sapiens
cccaggcattttcaactttagt

SEQ ID NO: 7793558 - DNA, 22 bp, Homo sapiens
agggactccctgggccgacacg

SEQ ID NO: 7793559 - DNA, 22 bp, Homo sapiens
cccaggccagaacttggttgct

SEQ ID NO: 7793560 - DNA, 22 bp, Homo sapiens
aggccctgcccagagctcctcg

SEQ ID NO: 7793561 - DNA, 23 bp, Homo sapiens
aggccctgcctgtccctcttttt

SEQ ID NO: 7793562 - DNA, 22 bp, Homo sapiens
aggccctgcccagtgccacaag

SEQ ID NO: 7793563 - DNA, 22 bp, Homo sapiens
ccagaggcagacttacactcca

SEQ ID NO: 7793564 - DNA, 22 bp, Homo sapiens
ccagaggttactttgccttgga

SEQ ID NO: 7793565 - DNA, 22 bp, Homo sapiens
aggcctgggcaagaaggggcgt

SEQ ID NO: 7793566 - DNA, 22 bp, Homo sapiens
ccaggaggtctgagtgtggaca

SEQ ID NO: 7793567 - DNA, 22 bp, Homo sapiens
ccaggaggtggcaggacttgcc

SEQ ID NO: 7793568 - DNA, 22 bp, Homo sapiens
cccagaggtgcttcagaggtgc

SEQ ID NO: 7793569 - DNA, 22 bp, Homo sapiens
cccagaggttccttagggacca

SEQ ID NO: 7793570 - DNA, 22 bp, Homo sapiens
cccactccctacgacacgctcc

SEQ ID NO: 7793571 - DNA, 22 bp, Homo sapiens
cccaccctgggaagctaggcag

SEQ ID NO: 7793572 - DNA, 22 bp, Homo sapiens
cccaccctgggctacacatcca

SEQ ID NO: 7793573 - DNA, 22 bp, Homo sapiens
ccagtgtattatttgagaaatt

SEQ ID NO: 7793574 - DNA, 22 bp, Homo sapiens
ccagtgtcagaaagattatcct

SEQ ID NO: 7793575 - DNA, 22 bp, Homo sapiens
ccagtgtctagcagatgacagg

SEQ ID NO: 7793576 - DNA, 22 bp, Homo sapiens
ccagtgtctactgtggcatatc

SEQ ID NO: 7793577 - DNA, 22 bp, Homo sapiens
ccagtgtccttcctttccatgg

SEQ ID NO: 7793578 - DNA, 22 bp, Homo sapiens
ccagtgtcttcagagtaaatct

SEQ ID NO: 7793579 - DNA, 22 bp, Homo sapiens
ccagtgtgaacctcaccaccct

SEQ ID NO: 7793580 - DNA, 19 bp, Homo sapiens
ccagtgtctagcgcacagc

SEQ ID NO: 7793581 - DNA, 22 bp, Homo sapiens
ccagtgtctgtggtatagaaag

SEQ ID NO: 7793582 - DNA, 22 bp, Homo sapiens
ccagtgtctagtcacaggtact

SEQ ID NO: 7793583 - DNA, 22 bp, Homo sapiens
ccaggcctgtgcaaggagggag

SEQ ID NO: 7793584 - DNA, 22 bp, Homo sapiens
ccaggcctgtgcaaggagggag

SEQ ID NO: 7793585 - DNA, 22 bp, Homo sapiens
ccaggccttccagtacgcagaa

SEQ ID NO: 7793586 - DNA, 22 bp, Homo sapiens
ccaggcctcccttttccagcca

SEQ ID NO: 7793587 - DNA, 20 bp, Homo sapiens
ccaggcctgggcctgctcta

SEQ ID NO: 7793588 - DNA, 22 bp, Homo sapiens
ccaggccttctgaggacactct

SEQ ID NO: 7793589 - DNA, 22 bp, Homo sapiens
agaagctaattcatgtcttatg

SEQ ID NO: 7793590 - DNA, 18 bp, Homo sapiens
agaagcctgcctcaatgc

SEQ ID NO: 7793591 - DNA, 22 bp, Homo sapiens
agaagcctcatcctctctagtg

SEQ ID NO: 7793592 - DNA, 22 bp, Homo sapiens
atcctggcccaggtgtggaggg

SEQ ID NO: 7793593 - DNA, 22 bp, Homo sapiens
atcctggcccaggtgtggaggg

SEQ ID NO: 7793594 - DNA, 22 bp, Homo sapiens
atcctggccctcatgacccctt

SEQ ID NO: 7793595 - DNA, 22 bp, Homo sapiens
atcctggcgggggaactgccca

SEQ ID NO: 7793596 - DNA, 22 bp, Homo sapiens
atcctggcgccacacggctcta

SEQ ID NO: 7793597 - DNA, 22 bp, Homo sapiens
atcctggctttaggtcagaggc

SEQ ID NO: 7793598 - DNA, 22 bp, Homo sapiens
atcctggacagtttcccctatt

SEQ ID NO: 7793599 - DNA, 22 bp, Homo sapiens
atcctggcaagcagaggagaac

SEQ ID NO: 7793600 - DNA, 22 bp, Homo sapiens
atcctgaggaaggtgcagagat

SEQ ID NO: 7793601 - DNA, 22 bp, Homo sapiens
atcctgaggtactgcagggccg

SEQ ID NO: 7793602 - DNA, 22 bp, Homo sapiens
atcaattcttaggaaaatagct

SEQ ID NO: 7793603 - DNA, 22 bp, Homo sapiens
atcaatatcagatcagacagga

SEQ ID NO: 7793604 - DNA, 22 bp, Homo sapiens
agaaatatgctgattagatgaa

SEQ ID NO: 7793605 - DNA, 22 bp, Homo sapiens
atattaattatttacacatgag

SEQ ID NO: 7793606 - DNA, 22 bp, Homo sapiens
atattacacacggtatcacggg

SEQ ID NO: 7793607 - DNA, 20 bp, Homo sapiens
agaaacatttcttgagaact

SEQ ID NO: 7793608 - DNA, 22 bp, Homo sapiens
atattaatgagcaagtaagtga

SEQ ID NO: 7793609 - DNA, 22 bp, Homo sapiens
atattaatgggatttagtcagg

SEQ ID NO: 7793610 - DNA, 22 bp, Homo sapiens
atattaaatggattttgggagc

SEQ ID NO: 7793611 - DNA, 22 bp, Homo sapiens
atattaaaactatggttttcag

SEQ ID NO: 7793612 - DNA, 22 bp, Homo sapiens
agaaagaacgttggttatctta

SEQ ID NO: 7793613 - DNA, 22 bp, Homo sapiens
agaaagacaaaatgcagtggct

SEQ ID NO: 7793614 - DNA, 22 bp, Homo sapiens
atagtgttagagccagtatgtt

SEQ ID NO: 7793615 - DNA, 22 bp, Homo sapiens
atagctttttgtcatagagtct

SEQ ID NO: 7793616 - DNA, 22 bp, Homo sapiens
atagctgtagaatgtatacaca

SEQ ID NO: 7793617 - DNA, 22 bp, Homo sapiens
agaaaacttgtcacagctctca

SEQ ID NO: 7793618 - DNA, 20 bp, Homo sapiens
agaaaaagtgtggaaatttc

SEQ ID NO: 7793619 - DNA, 22 bp, Homo sapiens
actttacaggcacttcaagtat

SEQ ID NO: 7793620 - DNA, 22 bp, Homo sapiens
actttagaaaagcatccataga

SEQ ID NO: 7793621 - DNA, 22 bp, Homo sapiens
agttgaatgttacagttctaaa

SEQ ID NO: 7793622 - DNA, 22 bp, Homo sapiens
ataaattctctgatgtatagta

SEQ ID NO: 7793623 - DNA, 22 bp, Homo sapiens
ataaattatgaatggccctttt

SEQ ID NO: 7793624 - DNA, 22 bp, Homo sapiens
agttgcagacgcagagatgttg

SEQ ID NO: 7793625 - DNA, 22 bp, Homo sapiens
ataacaatagtggtagtgctgg

SEQ ID NO: 7793626 - DNA, 22 bp, Homo sapiens
ataaggcacacatagatagggt

SEQ ID NO: 7793627 - DNA, 22 bp, Homo sapiens
ataaggtaagggtattgtcaga

SEQ ID NO: 7793628 - DNA, 22 bp, Homo sapiens
atacacgtgccatgttggtgtg

SEQ ID NO: 7793629 - DNA, 22 bp, Homo sapiens
atacacagctacattgaacaat

SEQ ID NO: 7793630 - DNA, 22 bp, Homo sapiens
agtgtctgttgttcagaactct

SEQ ID NO: 7793631 - DNA, 22 bp, Homo sapiens
agtgtctgttgagtttcaaaag

SEQ ID NO: 7793632 - DNA, 22 bp, Homo sapiens
agtgtctgttacgcttgcagaa

SEQ ID NO: 7793633 - DNA, 22 bp, Homo sapiens
agtgtctgtgctttgcagcaaa

SEQ ID NO: 7793634 - DNA, 19 bp, Homo sapiens
agttatttctaaatttacc

SEQ ID NO: 7793635 - DNA, 22 bp, Homo sapiens
agttcaaactctataagaactt

SEQ ID NO: 7793636 - DNA, 22 bp, Homo sapiens
agttacaactgtttgaatgtca

SEQ ID NO: 7793637 - DNA, 22 bp, Homo sapiens
agtgctttatgttgttgtgcaa

SEQ ID NO: 7793638 - DNA, 22 bp, Homo sapiens
agtgctttccttcttgtgacat

SEQ ID NO: 7793639 - DNA, 20 bp, Homo sapiens
agtgatttgttagtacattg

SEQ ID NO: 7793640 - DNA, 17 bp, Homo sapiens
agtgagaatgtcatgta

SEQ ID NO: 7793641 - DNA, 21 bp, Homo sapiens
agtccaggaggaggccaggtt

SEQ ID NO: 7793642 - DNA, 22 bp, Homo sapiens
agtccaggcattccagccattc

SEQ ID NO: 7793643 - DNA, 22 bp, Homo sapiens
agtcctggtgacactcctcttc

SEQ ID NO: 7793644 - DNA, 22 bp, Homo sapiens
agtcctgggtgtgcaaggcaga

SEQ ID NO: 7793645 - DNA, 20 bp, Homo sapiens
agtaacttagcaactctagg

SEQ ID NO: 7793646 - DNA, 22 bp, Homo sapiens
agtaaggcatttttcatgttta

SEQ ID NO: 7793647 - DNA, 22 bp, Homo sapiens
agtaataatagctgtaaagtgc

SEQ ID NO: 7793648 - DNA, 22 bp, Homo sapiens
agtcacttctattctattaagt

SEQ ID NO: 7793649 - DNA, 22 bp, Homo sapiens
agtcacttctattctattaagt

SEQ ID NO: 7793650 - DNA, 21 bp, Homo sapiens
aggtgccaaggagaagcaggc

SEQ ID NO: 7793651 - DNA, 22 bp, Homo sapiens
aggtgccaagatgtcacagaca

SEQ ID NO: 7793652 - DNA, 22 bp, Homo sapiens
aggtgcatgatgcagagtgcag

SEQ ID NO: 7793653 - DNA, 22 bp, Homo sapiens
aggttcttggtgagcatttggt

SEQ ID NO: 7793654 - DNA, 22 bp, Homo sapiens
aggttctcacacgtctacaccc

SEQ ID NO: 7793655 - DNA, 22 bp, Homo sapiens
aggttctccttatcaatgaaga

SEQ ID NO: 7793656 - DNA, 21 bp, Homo sapiens
aggctgctggctcagggtcct

SEQ ID NO: 7793657 - DNA, 22 bp, Homo sapiens
accactgcccatggtgaaaact

SEQ ID NO: 7793658 - DNA, 22 bp, Homo sapiens
accactgtctacacattgactc

SEQ ID NO: 7793659 - DNA, 22 bp, Homo sapiens
accactgtactatttgagtggc

SEQ ID NO: 7793660 - DNA, 22 bp, Homo sapiens
accactgtacagcagatatagt

SEQ ID NO: 7793661 - DNA, 22 bp, Homo sapiens
aggctctggagttagccaggca

SEQ ID NO: 7793662 - DNA, 22 bp, Homo sapiens
aggctcaggtctcaggtctggc

SEQ ID NO: 7793663 - DNA, 22 bp, Homo sapiens
acattaaaaaatgttgcatgaa

SEQ ID NO: 7793664 - DNA, 22 bp, Homo sapiens
acattaaaattgggtggggtaa

SEQ ID NO: 7793665 - DNA, 22 bp, Homo sapiens
acattaaacttgcttggctgta

SEQ ID NO: 7793666 - DNA, 22 bp, Homo sapiens
acattaaaatggagaattttga

SEQ ID NO: 7793667 - DNA, 22 bp, Homo sapiens
acattaaatttcatagtgatta

SEQ ID NO: 7793668 - DNA, 22 bp, Homo sapiens
acattaaagagtaaggttagtt

SEQ ID NO: 7793669 - DNA, 22 bp, Homo sapiens
acatgtgtaaaagtggataaaa

SEQ ID NO: 7793670 - DNA, 21 bp, Homo sapiens
acatgtctctaatctcagtga

SEQ ID NO: 7793671 - DNA, 21 bp, Homo sapiens
acatgtctggtcatttttagc

SEQ ID NO: 7793672 - DNA, 21 bp, Homo sapiens
acatgtctctaatctcagtga

SEQ ID NO: 7793673 - DNA, 22 bp, Homo sapiens
acatgtctcatggcagaatttt

SEQ ID NO: 7793674 - DNA, 22 bp, Homo sapiens
acatgtcaatttagtactctta

SEQ ID NO: 7793675 - DNA, 22 bp, Homo sapiens
acatgtctaagtactcaacaaa

SEQ ID NO: 7793676 - DNA, 22 bp, Homo sapiens
acatgtaaacatttacagtatt

SEQ ID NO: 7793677 - DNA, 22 bp, Homo sapiens
aggcagtgtgtagctggaagag

SEQ ID NO: 7793678 - DNA, 22 bp, Homo sapiens
acatggctaaattagctttact

SEQ ID NO: 7793679 - DNA, 22 bp, Homo sapiens
acatggctcagtctcatgacag

SEQ ID NO: 7793680 - DNA, 22 bp, Homo sapiens
agggctttctttgtaaaagaag

SEQ ID NO: 7793681 - DNA, 22 bp, Homo sapiens
aggggaggagcttttcttgcct

SEQ ID NO: 7793682 - DNA, 22 bp, Homo sapiens
agggctgaagggaggtgctcat

SEQ ID NO: 7793683 - DNA, 22 bp, Homo sapiens
agggctgaagggaggtgctcat

SEQ ID NO: 7793684 - DNA, 22 bp, Homo sapiens
agggctgaaacataatccttct

SEQ ID NO: 7793685 - DNA, 22 bp, Homo sapiens
agggctcagttgcctggagccc

SEQ ID NO: 7793686 - DNA, 22 bp, Homo sapiens
agggctgacaaatggcagtgac

SEQ ID NO: 7793687 - DNA, 22 bp, Homo sapiens
agggctgacaaatggcagtgac

SEQ ID NO: 7793688 - DNA, 22 bp, Homo sapiens
agggctgacacaccttatcctc

SEQ ID NO: 7793689 - DNA, 22 bp, Homo sapiens
agggctgacagtaaaagtatga

SEQ ID NO: 7793690 - DNA, 22 bp, Homo sapiens
agggctgaagttatggctgagc

SEQ ID NO: 7793691 - DNA, 23 bp, Homo sapiens
agggctgaatgcagagaagcaga

SEQ ID NO: 7793692 - DNA, 22 bp, Homo sapiens
aggggtgtgcatcctggaggat

SEQ ID NO: 7793693 - DNA, 22 bp, Homo sapiens
aggggtgtgcatcctggaggat

SEQ ID NO: 7793694 - DNA, 22 bp, Homo sapiens
agggccagtaaatgtttcctca

SEQ ID NO: 7793695 - DNA, 22 bp, Homo sapiens
agggccagtattaaggtaatta

SEQ ID NO: 7793696 - DNA, 22 bp, Homo sapiens
agggccagtcgtgtattactgt

SEQ ID NO: 7793697 - DNA, 22 bp, Homo sapiens
agggccagttctacctctgaat

SEQ ID NO: 7793698 - DNA, 22 bp, Homo sapiens
agggccagcactcctggcagga

SEQ ID NO: 7793699 - DNA, 22 bp, Homo sapiens
agggcatgctggaggagagaca

SEQ ID NO: 7793700 - DNA, 21 bp, Homo sapiens
agggccagatcaccaaggagc

SEQ ID NO: 7793701 - DNA, 19 bp, Homo sapiens
agggaggtagcattggaaa

SEQ ID NO: 7793702 - DNA, 22 bp, Homo sapiens
agggcaccctctctgcagtacc

SEQ ID NO: 7793703 - DNA, 22 bp, Homo sapiens
agggatgttagttgtgagctca

SEQ ID NO: 7793704 - DNA, 22 bp, Homo sapiens
agggatgttgtcaaggatgtgg

SEQ ID NO: 7793705 - DNA, 22 bp, Homo sapiens
agggatgttcattttgtggctg

SEQ ID NO: 7793706 - DNA, 22 bp, Homo sapiens
agggaggatagtagtcagttta

SEQ ID NO: 7793707 - DNA, 22 bp, Homo sapiens
agggaggatctgctccttgtct

SEQ ID NO: 7793708 - DNA, 20 bp, Homo sapiens
accagagctctcagtatgtg

SEQ ID NO: 7793709 - DNA, 22 bp, Homo sapiens
aggacagtccggggtcctccac

SEQ ID NO: 7793710 - DNA, 22 bp, Homo sapiens
aggacagtggacactagtccct

SEQ ID NO: 7793711 - DNA, 22 bp, Homo sapiens
aggacagtggtgttctggagtg

SEQ ID NO: 7793712 - DNA, 22 bp, Homo sapiens
aggacagtgtggaagagggtgc

SEQ ID NO: 7793713 - DNA, 22 bp, Homo sapiens
acagtgctgtctatctcactaa

SEQ ID NO: 7793714 - DNA, 22 bp, Homo sapiens
acagtgcttggcacacagtaat

SEQ ID NO: 7793715 - DNA, 22 bp, Homo sapiens
acagtgcttttgttcctctcct

SEQ ID NO: 7793716 - DNA, 22 bp, Homo sapiens
acagtgcttctgatatgatgcc

SEQ ID NO: 7793717 - DNA, 19 bp, Homo sapiens
acagtgcttctgagtgagg

SEQ ID NO: 7793718 - DNA, 22 bp, Homo sapiens
acagtgcttagcacagagtaga

SEQ ID NO: 7793719 - DNA, 22 bp, Homo sapiens
acagtgctgtgcagtctgccct

SEQ ID NO: 7793720 - DNA, 22 bp, Homo sapiens
acagtgctgtctatctcactaa

SEQ ID NO: 7793721 - DNA, 22 bp, Homo sapiens
acagtgagcccactccaggaga

SEQ ID NO: 7793722 - DNA, 22 bp, Homo sapiens
acagtggctcatgcctgtcatc

SEQ ID NO: 7793723 - DNA, 22 bp, Homo sapiens
acagtggcagtattagggcaga

SEQ ID NO: 7793724 - DNA, 22 bp, Homo sapiens
acagtgttcacttaacaatgga

SEQ ID NO: 7793725 - DNA, 22 bp, Homo sapiens
aggcaccttgagagcaggagct

SEQ ID NO: 7793726 - DNA, 22 bp, Homo sapiens
aggcaggggagctggaagggta

SEQ ID NO: 7793727 - DNA, 23 bp, Homo sapiens
aggcagtgtctcttatcctgtcc

SEQ ID NO: 7793728 - DNA, 22 bp, Homo sapiens
acatataagggatcagtgacag

SEQ ID NO: 7793729 - DNA, 22 bp, Homo sapiens
acatatatgtgcacatgtgcag

SEQ ID NO: 7793730 - DNA, 22 bp, Homo sapiens
acatatattactagtaaagaca

SEQ ID NO: 7793731 - DNA, 22 bp, Homo sapiens
acatctggaaagttacttgaga

SEQ ID NO: 7793732 - DNA, 20 bp, Homo sapiens
agccaaaggagaacagtgct

SEQ ID NO: 7793733 - DNA, 22 bp, Homo sapiens
cactgcacttcagcctgggtga

SEQ ID NO: 7793734 - DNA, 22 bp, Homo sapiens
agcattcaagtaattcacttgg

SEQ ID NO: 7793735 - DNA, 22 bp, Homo sapiens
agcatttaggagaatttgagaa

SEQ ID NO: 7793736 - DNA, 22 bp, Homo sapiens
cactgcacaatgtagcaaagaa

SEQ ID NO: 7793737 - DNA, 22 bp, Homo sapiens
cactgcactccagcactccagc

SEQ ID NO: 7793738 - DNA, 22 bp, Homo sapiens
cactgcactccagcccgggcaa

SEQ ID NO: 7793739 - DNA, 22 bp, Homo sapiens
cactgcactccatcctgggaaa

SEQ ID NO: 7793740 - DNA, 22 bp, Homo sapiens
cacctgcaaggagctttcattt

SEQ ID NO: 7793741 - DNA, 22 bp, Homo sapiens
cacctgcagggggagtcaagag

SEQ ID NO: 7793742 - DNA, 22 bp, Homo sapiens
cacatttaagtgcttgttcaga

SEQ ID NO: 7793743 - DNA, 22 bp, Homo sapiens
caagggccatctgagggcactg

SEQ ID NO: 7793744 - DNA, 22 bp, Homo sapiens
caattatatttagaatgataca

SEQ ID NO: 7793745 - DNA, 22 bp, Homo sapiens
caatgtttttccttccttaata

SEQ ID NO: 7793746 - DNA, 22 bp, Homo sapiens
caagctttccattacacacatt

SEQ ID NO: 7793747 - DNA, 22 bp, Homo sapiens
caagctttatccgccatgtagg

SEQ ID NO: 7793748 - DNA, 22 bp, Homo sapiens
caaggaaaagaagtatttcaga

SEQ ID NO: 7793749 - DNA, 22 bp, Homo sapiens
agcagacatggcttggatgtgg

SEQ ID NO: 7793750 - DNA, 22 bp, Homo sapiens
agcagagacatgaaatatgctt

SEQ ID NO: 7793751 - DNA, 22 bp, Homo sapiens
caaggcatttcgcttagagaga

SEQ ID NO: 7793752 - DNA, 22 bp, Homo sapiens
caaggaaacatgaaatgcattg

SEQ ID NO: 7793753 - DNA, 22 bp, Homo sapiens
agcagacatatctcatgtcaca

SEQ ID NO: 7793754 - DNA, 22 bp, Homo sapiens
agcagacatatctcatgtcaca

SEQ ID NO: 7793755 - DNA, 22 bp, Homo sapiens
cacagctgaccaccctgctccc

SEQ ID NO: 7793756 - DNA, 22 bp, Homo sapiens
cacagctgccatgcagtcagtg

SEQ ID NO: 7793757 - DNA, 22 bp, Homo sapiens
cacagctgccccctctctaact

SEQ ID NO: 7793758 - DNA, 22 bp, Homo sapiens
cacagctgccccctctctaact

SEQ ID NO: 7793759 - DNA, 22 bp, Homo sapiens
cacagctgccctactccatgtg

SEQ ID NO: 7793760 - DNA, 22 bp, Homo sapiens
cacagctggggaagctgaggcc

SEQ ID NO: 7793761 - DNA, 22 bp, Homo sapiens
cacactttgtgctaatctattt

SEQ ID NO: 7793762 - DNA, 22 bp, Homo sapiens
caattttattggtccaaataca

SEQ ID NO: 7793763 - DNA, 22 bp, Homo sapiens
cagatcctgccaggctgagttg

SEQ ID NO: 7793764 - DNA, 22 bp, Homo sapiens
cagatcatgggactgtctcagc

SEQ ID NO: 7793765 - DNA, 22 bp, Homo sapiens
agcccttgcagactgtcagcat

SEQ ID NO: 7793766 - DNA, 22 bp, Homo sapiens
agcccttggtattttccgatcc

SEQ ID NO: 7793767 - DNA, 22 bp, Homo sapiens
agcccttagtacatttctcaag

SEQ ID NO: 7793768 - DNA, 22 bp, Homo sapiens
cagatctatctgttgatggtgc

SEQ ID NO: 7793769 - DNA, 22 bp, Homo sapiens
cagagtggcgaccccctcagct

SEQ ID NO: 7793770 - DNA, 20 bp, Homo sapiens
cagagccagggttttgtttt

SEQ ID NO: 7793771 - DNA, 22 bp, Homo sapiens
cagagctgtgataaatagatat

SEQ ID NO: 7793772 - DNA, 22 bp, Homo sapiens
cagagctgtgataaatagatat

SEQ ID NO: 7793773 - DNA, 22 bp, Homo sapiens
agctctggagccggaggatttc

SEQ ID NO: 7793774 - DNA, 17 bp, Homo sapiens
agctgagctggccaggg

SEQ ID NO: 7793775 - DNA, 22 bp, Homo sapiens
agctgaggacgtgaagggcggc

SEQ ID NO: 7793776 - DNA, 22 bp, Homo sapiens
agctgaggaataataacaaggt

SEQ ID NO: 7793777 - DNA, 22 bp, Homo sapiens
agctgaggaggaatgatgggta

SEQ ID NO: 7793778 - DNA, 23 bp, Homo sapiens
agctgaggcagaggggcattctc

SEQ ID NO: 7793779 - DNA, 20 bp, Homo sapiens
agctgaggcacctgaggtta

SEQ ID NO: 7793780 - DNA, 22 bp, Homo sapiens
agcgccactgcactccagcctg

SEQ ID NO: 7793781 - DNA, 22 bp, Homo sapiens
cagcatcatactacctaaatga

SEQ ID NO: 7793782 - DNA, 22 bp, Homo sapiens
cagcacttcagcattcagattt

SEQ ID NO: 7793783 - DNA, 22 bp, Homo sapiens
cagcactttgagggctcttaat

SEQ ID NO: 7793784 - DNA, 22 bp, Homo sapiens
cagcacttgagctttcatgtaa

SEQ ID NO: 7793785 - DNA, 22 bp, Homo sapiens
agaggccggccgagcccatggg

SEQ ID NO: 7793786 - DNA, 22 bp, Homo sapiens
agaggcctccctcccagctggt

SEQ ID NO: 7793787 - DNA, 19 bp, Homo sapiens
agaggcctcagcagctggc

SEQ ID NO: 7793788 - DNA, 22 bp, Homo sapiens
agaggcctaaccaagatgtcct

SEQ ID NO: 7793789 - DNA, 22 bp, Homo sapiens
agaggcctaattgctacccttt

SEQ ID NO: 7793790 - DNA, 22 bp, Homo sapiens
attattttatgtgcggcctgat

SEQ ID NO: 7793791 - DNA, 22 bp, Homo sapiens
attattttatgtgcggcctgat

SEQ ID NO: 7793792 - DNA, 22 bp, Homo sapiens
agaggcctccgaaaggtgggct

SEQ ID NO: 7793793 - DNA, 22 bp, Homo sapiens
agaggcctctgttgttcagacg

SEQ ID NO: 7793794 - DNA, 22 bp, Homo sapiens
agaggcctctagggcccctcag

SEQ ID NO: 7793795 - DNA, 22 bp, Homo sapiens
attctctgtgcagatttaagac

SEQ ID NO: 7793796 - DNA, 22 bp, Homo sapiens
attgaaaaatgactattgctta

SEQ ID NO: 7793797 - DNA, 22 bp, Homo sapiens
attctctgaagtctttcagggc

SEQ ID NO: 7793798 - DNA, 22 bp, Homo sapiens
attcgcacattaacactcatat

SEQ ID NO: 7793799 - DNA, 22 bp, Homo sapiens
attcaaaagaccatgcagactc

SEQ ID NO: 7793800 - DNA, 22 bp, Homo sapiens
attctaagtcttgttcacattc

SEQ ID NO: 7793801 - DNA, 22 bp, Homo sapiens
attgaaagatatactgttctca

SEQ ID NO: 7793802 - DNA, 22 bp, Homo sapiens
attgaaaaattcacaattctgg

SEQ ID NO: 7793803 - DNA, 22 bp, Homo sapiens
attgaaaatgacatttgtgccc

SEQ ID NO: 7793804 - DNA, 22 bp, Homo sapiens
attgaaaatataattctaggag

SEQ ID NO: 7793805 - DNA, 22 bp, Homo sapiens
attgtataagtctatttacaat

SEQ ID NO: 7793806 - DNA, 22 bp, Homo sapiens
attgtggtgtcagttataggca

SEQ ID NO: 7793807 - DNA, 22 bp, Homo sapiens
agataaattcctaagatttcag

SEQ ID NO: 7793808 - DNA, 22 bp, Homo sapiens
agataattatttacttcaaagt

SEQ ID NO: 7793809 - DNA, 22 bp, Homo sapiens
agatacacagccctgccatcac

SEQ ID NO: 7793810 - DNA, 22 bp, Homo sapiens
attttgttgaggtaattgtcaa

SEQ ID NO: 7793811 - DNA, 21 bp, Homo sapiens
attttgtacatagaatttgtc

SEQ ID NO: 7793812 - DNA, 22 bp, Homo sapiens
attttgttataggagctgaaat

SEQ ID NO: 7793813 - DNA, 23 bp, Homo sapiens
attttttgtctttgtaactagat

SEQ ID NO: 7793814 - DNA, 23 bp, Homo sapiens
agcaataagaagggatacatgtg

SEQ ID NO: 7793815 - DNA, 22 bp, Homo sapiens
caaacatttgacttctctcagg

SEQ ID NO: 7793816 - DNA, 22 bp, Homo sapiens
caaataattactatcctcactt

SEQ ID NO: 7793817 - DNA, 22 bp, Homo sapiens
caaagttttagtaaacatatat

SEQ ID NO: 7793818 - DNA, 22 bp, Homo sapiens
caaagtttaaagtagatttcag

SEQ ID NO: 7793819 - DNA, 22 bp, Homo sapiens
atttctttctggccacggtttt

SEQ ID NO: 7793820 - DNA, 22 bp, Homo sapiens
atttcttttcaagagggtgctt

SEQ ID NO: 7793821 - DNA, 22 bp, Homo sapiens
atttacagccttgaaaacagca

SEQ ID NO: 7793822 - DNA, 22 bp, Homo sapiens
atttacagatgatgctatttga

SEQ ID NO: 7793823 - DNA, 22 bp, Homo sapiens
atttacaggacagcttggcatt

SEQ ID NO: 7793824 - DNA, 22 bp, Homo sapiens
agatttacaaaggatttgcttt

SEQ ID NO: 7793825 - DNA, 23 bp, Homo sapiens
agattgttattcccagttcatgt

SEQ ID NO: 7793826 - DNA, 21 bp, Homo sapiens
agattcataatctgtaaaatg

SEQ ID NO: 7793827 - DNA, 22 bp, Homo sapiens
agatgtttgtgttatctccatt

SEQ ID NO: 7793828 - DNA, 22 bp, Homo sapiens
agatgagtaggtagcattagta

SEQ ID NO: 7793829 - DNA, 22 bp, Homo sapiens
atgccagtaagtctcagctagg

SEQ ID NO: 7793830 - DNA, 22 bp, Homo sapiens
agacagtgctatcccatctgtg

SEQ ID NO: 7793831 - DNA, 19 bp, Homo sapiens
atgcaacaaaagtgtaaga

SEQ ID NO: 7793832 - DNA, 23 bp, Homo sapiens
atgccaggctgcctggccagcct

SEQ ID NO: 7793833 - DNA, 22 bp, Homo sapiens
atgccaggccccacgctgggca

SEQ ID NO: 7793834 - DNA, 22 bp, Homo sapiens
atgcttaggttaaatttgtaat

SEQ ID NO: 7793835 - DNA, 22 bp, Homo sapiens
atgcttcagatttggggtatta

SEQ ID NO: 7793836 - DNA, 22 bp, Homo sapiens
agagaaacaggtcagctgggag

SEQ ID NO: 7793837 - DNA, 22 bp, Homo sapiens
agagaacaaattaaaggtggtt

SEQ ID NO: 7793838 - DNA, 22 bp, Homo sapiens
atgaggagctccttgaaatgag

SEQ ID NO: 7793839 - DNA, 22 bp, Homo sapiens
atgaggagctgttttaactgct

SEQ ID NO: 7793840 - DNA, 22 bp, Homo sapiens
atgaggaggccagtaagagcct

SEQ ID NO: 7793841 - DNA, 22 bp, Homo sapiens
atgaggaggtcaggccttacaa

SEQ ID NO: 7793842 - DNA, 22 bp, Homo sapiens
atgaggagtcaaggagtcggag

SEQ ID NO: 7793843 - DNA, 22 bp, Homo sapiens
atgaggagaccaaggcctgatg

SEQ ID NO: 7793844 - DNA, 22 bp, Homo sapiens
atgaggagccctcatttaggtt

SEQ ID NO: 7793845 - DNA, 22 bp, Homo sapiens
atgacttctgctttacagagtt

SEQ ID NO: 7793846 - DNA, 22 bp, Homo sapiens
atgattctcattttataaactt

SEQ ID NO: 7793847 - DNA, 22 bp, Homo sapiens
atgattctcattttataaactt

SEQ ID NO: 7793848 - DNA, 21 bp, Homo sapiens
atgattctgcaaatgagtagt

SEQ ID NO: 7793849 - DNA, 22 bp, Homo sapiens
atgattcttttggatagatgat

SEQ ID NO: 7793850 - DNA, 22 bp, Homo sapiens
atgattctggcaaatttattat

SEQ ID NO: 7793851 - DNA, 22 bp, Homo sapiens
atgattctggggcaaaagctgg

SEQ ID NO: 7793852 - DNA, 22 bp, Homo sapiens
atcttagaagtttgataaaatc

SEQ ID NO: 7793853 - DNA, 22 bp, Homo sapiens
atcttagagagtcgtgttttgt

SEQ ID NO: 7793854 - DNA, 22 bp, Homo sapiens
atcttacaattacaagacactc

SEQ ID NO: 7793855 - DNA, 22 bp, Homo sapiens
atgactgctctgggctcccatg

SEQ ID NO: 7793856 - DNA, 22 bp, Homo sapiens
atctggcttacctagggtgcct

SEQ ID NO: 7793857 - DNA, 22 bp, Homo sapiens
atctggctgagcgaggcccaca

SEQ ID NO: 7793858 - DNA, 22 bp, Homo sapiens
agagcctgttttgtgggagatg

SEQ ID NO: 7793859 - DNA, 19 bp, Homo sapiens
atgttctatcctccaagtt

SEQ ID NO: 7793860 - DNA, 22 bp, Homo sapiens
atgttctatatcattattgtga

SEQ ID NO: 7793861 - DNA, 22 bp, Homo sapiens
atgttctacagatggaaagggg

SEQ ID NO: 7793862 - DNA, 22 bp, Homo sapiens
agagctagaaggaagcatttct

SEQ ID NO: 7793863 - DNA, 22 bp, Homo sapiens
agagccttgaagatctggaaaa

SEQ ID NO: 7793864 - DNA, 22 bp, Homo sapiens
attaagggccaatcctccagcc

SEQ ID NO: 7793865 - DNA, 22 bp, Homo sapiens
atgtcttgggtttcagtttact

SEQ ID NO: 7793866 - DNA, 22 bp, Homo sapiens
atgtgcaacttttctgtctttt

SEQ ID NO: 7793867 - DNA, 22 bp, Homo sapiens
agagccagcatttgacactggc

SEQ ID NO: 7793868 - DNA, 22 bp, Homo sapiens
agagccagccttctcagcttac

SEQ ID NO: 7793869 - DNA, 22 bp, Homo sapiens
agagccagcatttgggccctgc

SEQ ID NO: 7793870 - DNA, 22 bp, Homo sapiens
atgttacactgtttcacgttcc

SEQ ID NO: 7793871 - DNA, 22 bp, Homo sapiens
agagccaggatgtcttctgggg

SEQ ID NO: 7793872 - DNA, 22 bp, Homo sapiens
agagccaggaagtggcgtgggg

SEQ ID NO: 7793873 - DNA, 22 bp, Homo sapiens
agagccaggactgtgtctcact

SEQ ID NO: 7793874 - DNA, 22 bp, Homo sapiens
agagccaggatctgttttgggg

SEQ ID NO: 7793875 - DNA, 22 bp, Homo sapiens
atgtatacgtgcaggtcacagg

SEQ ID NO: 7793876 - DNA, 22 bp, Homo sapiens
atgtagttgaagtgctataaag

SEQ ID NO: 7793877 - DNA, 22 bp, Homo sapiens
atgtacatagcatcatctagga

SEQ ID NO: 7793878 - DNA, 18 bp, Homo sapiens
atgggaggggccaagaga

SEQ ID NO: 7793879 - DNA, 22 bp, Homo sapiens
aaattgctgacacttgaccatt

SEQ ID NO: 7793880 - DNA, 22 bp, Homo sapiens
aaattgctgaccaagtatattc

SEQ ID NO: 7793881 - DNA, 22 bp, Homo sapiens
aaattccagaaactcagtatat

SEQ ID NO: 7793882 - DNA, 22 bp, Homo sapiens
aaattccattaggaaacttcca

SEQ ID NO: 7793883 - DNA, 22 bp, Homo sapiens
aaattcatttttcttagtgtgc

SEQ ID NO: 7793884 - DNA, 22 bp, Homo sapiens
aaattagaccagttcaggtcca

SEQ ID NO: 7793885 - DNA, 22 bp, Homo sapiens
aaattagatatgtgtgagactc

SEQ ID NO: 7793886 - DNA, 22 bp, Homo sapiens
aaattagatcagtggattttct

SEQ ID NO: 7793887 - DNA, 19 bp, Homo sapiens
aaagcagtgcatcctcttt

SEQ ID NO: 7793888 - DNA, 22 bp, Homo sapiens
aaagcagtccttcccttaaggt

SEQ ID NO: 7793889 - DNA, 22 bp, Homo sapiens
aacatgaagttttctatagtga

SEQ ID NO: 7793890 - DNA, 22 bp, Homo sapiens
aacatgaaagttgctaagtgca

SEQ ID NO: 7793891 - DNA, 20 bp, Homo sapiens
aaagcatttacttgtgattg

SEQ ID NO: 7793892 - DNA, 22 bp, Homo sapiens
aaagcatagttcatctgtccat

SEQ ID NO: 7793893 - DNA, 21 bp, Homo sapiens
aacatgatatgtgtatggatt

SEQ ID NO: 7793894 - DNA, 22 bp, Homo sapiens
aacttgaaactgttccagaaaa

SEQ ID NO: 7793895 - DNA, 22 bp, Homo sapiens
aacttctttgagctccagtttt

SEQ ID NO: 7793896 - DNA, 22 bp, Homo sapiens
aacttctttgagctccagtttt

SEQ ID NO: 7793897 - DNA, 22 bp, Homo sapiens
aacttctgccaaacagctgtta

SEQ ID NO: 7793898 - DNA, 22 bp, Homo sapiens
aaagttctggagaaaataatga

SEQ ID NO: 7793899 - DNA, 22 bp, Homo sapiens
aaagttctctatggtgtaaaaa

SEQ ID NO: 7793900 - DNA, 22 bp, Homo sapiens
aaagtcttaatgtaagtttagt

SEQ ID NO: 7793901 - DNA, 22 bp, Homo sapiens
aaagtcttcacggcactagtgt

SEQ ID NO: 7793902 - DNA, 22 bp, Homo sapiens
aaagtcttgcattgatcttgaa

SEQ ID NO: 7793903 - DNA, 20 bp, Homo sapiens
aaagtcttatggttaatttt

SEQ ID NO: 7793904 - DNA, 22 bp, Homo sapiens
aaagtcttgttacgttccattg

SEQ ID NO: 7793905 - DNA, 22 bp, Homo sapiens
aaagtctttattttgtatcttt

SEQ ID NO: 7793906 - DNA, 22 bp, Homo sapiens
aaagtctttctcatagtcacgc

SEQ ID NO: 7793907 - DNA, 22 bp, Homo sapiens
aaagtctttctcattggccatg

SEQ ID NO: 7793908 - DNA, 22 bp, Homo sapiens
aaagtcctgttaactgttaaca

SEQ ID NO: 7793909 - DNA, 22 bp, Homo sapiens
aaatacaaaaattagccaggca

SEQ ID NO: 7793910 - DNA, 22 bp, Homo sapiens
aaagttctttttctataaatcc

SEQ ID NO: 7793911 - DNA, 22 bp, Homo sapiens
aaagttctttttctataaatcc

SEQ ID NO: 7793912 - DNA, 22 bp, Homo sapiens
aaagttgttcagtaagaaactc

SEQ ID NO: 7793913 - DNA, 22 bp, Homo sapiens
aaatatacggtccctaacagtc

SEQ ID NO: 7793914 - DNA, 20 bp, Homo sapiens
aaatgctgtaatgtttggga

SEQ ID NO: 7793915 - DNA, 22 bp, Homo sapiens
aaatgccaaggagagactgtta

SEQ ID NO: 7793916 - DNA, 22 bp, Homo sapiens
aaatcactgattaaagttagaa

SEQ ID NO: 7793917 - DNA, 22 bp, Homo sapiens
aaatcactgttattgatcttaa

SEQ ID NO: 7793918 - DNA, 22 bp, Homo sapiens
aaatcaaaagacatgtgtttta

SEQ ID NO: 7793919 - DNA, 23 bp, Homo sapiens
aaatattcttttttagtaagtgc

SEQ ID NO: 7793920 - DNA, 22 bp, Homo sapiens
aaatattgttttggtaagcttc

SEQ ID NO: 7793921 - DNA, 22 bp, Homo sapiens
aaatgaacatcaagaatagcct

SEQ ID NO: 7793922 - DNA, 22 bp, Homo sapiens
aaatgatcatgtaatttcagaa

SEQ ID NO: 7793923 - DNA, 22 bp, Homo sapiens
aaatgagtagcgatgcacatta

SEQ ID NO: 7793924 - DNA, 22 bp, Homo sapiens
aaatgagtttcctcaatgtcct

SEQ ID NO: 7793925 - DNA, 22 bp, Homo sapiens
aaatgagtttgcctctagatag

SEQ ID NO: 7793926 - DNA, 23 bp, Homo sapiens
aaatgacatatggtttctgaagg

SEQ ID NO: 7793927 - DNA, 22 bp, Homo sapiens
aaagttttctgccttcattaga

SEQ ID NO: 7793928 - DNA, 22 bp, Homo sapiens
aaagttttgttgattgtggaat

SEQ ID NO: 7793929 - DNA, 22 bp, Homo sapiens
aaagtttttaagcaagaccctt

SEQ ID NO: 7793930 - DNA, 22 bp, Homo sapiens
aaagttctaaaactctttgtga

SEQ ID NO: 7793931 - DNA, 22 bp, Homo sapiens
aaagttttattcaagcattagt

SEQ ID NO: 7793932 - DNA, 19 bp, Homo sapiens
aaagttttattctcatttg

SEQ ID NO: 7793933 - DNA, 22 bp, Homo sapiens
aaaggagacagtcttacctgga

SEQ ID NO: 7793934 - DNA, 22 bp, Homo sapiens
aaagctatttattacagagaat

SEQ ID NO: 7793935 - DNA, 22 bp, Homo sapiens
aaaattgtcgaacagtagtaac

SEQ ID NO: 7793936 - DNA, 22 bp, Homo sapiens
aaaatttccaccatctttgtgt

SEQ ID NO: 7793937 - DNA, 23 bp, Homo sapiens
aaacttcagtagtgtcatcagcc

SEQ ID NO: 7793938 - DNA, 22 bp, Homo sapiens
aaatacagattccagggtctta

SEQ ID NO: 7793939 - DNA, 22 bp, Homo sapiens
aaataacagtcagggacaacat

SEQ ID NO: 7793940 - DNA, 22 bp, Homo sapiens
aaatgacactcattcagtgtca

SEQ ID NO: 7793941 - DNA, 21 bp, Homo sapiens
aaatgaatgtggtagtgcaag

SEQ ID NO: 7793942 - DNA, 22 bp, Homo sapiens
aaatgaacatcaagaatagcct

SEQ ID NO: 7793943 - DNA, 22 bp, Homo sapiens
aaaatgatgctgtaatttggca

SEQ ID NO: 7793944 - DNA, 22 bp, Homo sapiens
aaaatgatatcctgacttttat

SEQ ID NO: 7793945 - DNA, 22 bp, Homo sapiens
aaaatgaggaacggatcatggc

SEQ ID NO: 7793946 - DNA, 22 bp, Homo sapiens
aaaatgaggtcaatatcctttt

SEQ ID NO: 7793947 - DNA, 22 bp, Homo sapiens
aaaatgaggtcaatatcctttt

SEQ ID NO: 7793948 - DNA, 22 bp, Homo sapiens
aaaatactactgtcttcttccc

SEQ ID NO: 7793949 - DNA, 22 bp, Homo sapiens
aaaatgagacacatgtgactcc

SEQ ID NO: 7793950 - DNA, 22 bp, Homo sapiens
aaaatgagacacatgtgactcc

SEQ ID NO: 7793951 - DNA, 22 bp, Homo sapiens
aaaatgagcatattgatccttt

SEQ ID NO: 7793952 - DNA, 22 bp, Homo sapiens
aaaatgagacacatgtgactcc

SEQ ID NO: 7793953 - DNA, 22 bp, Homo sapiens
aaaagtttgtgcaaacactcag

SEQ ID NO: 7793954 - DNA, 18 bp, Homo sapiens
aaaataacaaagttggct

SEQ ID NO: 7793955 - DNA, 22 bp, Homo sapiens
aaaataacttctactatttgca

SEQ ID NO: 7793956 - DNA, 22 bp, Homo sapiens
aaaagttagctattagtaggtg

SEQ ID NO: 7793957 - DNA, 21 bp, Homo sapiens
aaaagtttgacaggaaaggga

SEQ ID NO: 7793958 - DNA, 22 bp, Homo sapiens
aaaagtttaagactcattctag

SEQ ID NO: 7793959 - DNA, 22 bp, Homo sapiens
aaaagtgttcaggaagaataat

SEQ ID NO: 7793960 - DNA, 22 bp, Homo sapiens
aaaacattctgtgaactctcaa

SEQ ID NO: 7793961 - DNA, 22 bp, Homo sapiens
aaaagagtcttaggcagtcata

SEQ ID NO: 7793962 - DNA, 22 bp, Homo sapiens
aaaagagtcttaggcagtcata

SEQ ID NO: 7793963 - DNA, 22 bp, Homo sapiens
aaaagagtgactgataagtata

SEQ ID NO: 7793964 - DNA, 22 bp, Homo sapiens
aaaagagtgactgataagtata

SEQ ID NO: 7793965 - DNA, 22 bp, Homo sapiens
aaaagagtgactgataagtata

SEQ ID NO: 7793966 - DNA, 22 bp, Homo sapiens
aaaaccaggcttgctgtgctcg

SEQ ID NO: 7793967 - DNA, 22 bp, Homo sapiens
aaaaatgaaacggctggttggc

SEQ ID NO: 7793968 - DNA, 22 bp, Homo sapiens
aaaagcaagaggctggattaaa

SEQ ID NO: 7793969 - DNA, 22 bp, Homo sapiens
aaaagcaaggcagtctgtctga

SEQ ID NO: 7793970 - DNA, 22 bp, Homo sapiens
aaaagcaagttgcctaggttga

SEQ ID NO: 7793971 - DNA, 22 bp, Homo sapiens
aaaagcaaggcagtctgtctga

SEQ ID NO: 7793972 - DNA, 20 bp, Homo sapiens
aaaagagtgcttcaactgct

SEQ ID NO: 7793973 - DNA, 22 bp, Homo sapiens
aaaagcaagaggctggattaaa

SEQ ID NO: 7793974 - DNA, 22 bp, Homo sapiens
aaaacacaagaagcagggtaca

SEQ ID NO: 7793975 - DNA, 22 bp, Homo sapiens
aaaagcagaccacgctttgtgg

SEQ ID NO: 7793976 - DNA, 22 bp, Homo sapiens
aaaagcactacaatttcgcttc

SEQ ID NO: 7793977 - DNA, 22 bp, Homo sapiens
aaaagcaagttgcctaggttga

SEQ ID NO: 7793978 - DNA, 22 bp, Homo sapiens
aaaagcaattgcagttcttgcc

SEQ ID NO: 7793979 - DNA, 22 bp, Homo sapiens
aaaagcaattgcgggttttgcc

SEQ ID NO: 7793980 - DNA, 22 bp, Homo sapiens
aagtaacatgggaacatctgaa

SEQ ID NO: 7793981 - DNA, 22 bp, Homo sapiens
aagtaacatctgaacatgatgt

SEQ ID NO: 7793982 - DNA, 22 bp, Homo sapiens
aagtctttttgaatctataact

SEQ ID NO: 7793983 - DNA, 22 bp, Homo sapiens
aagtgccatcatagcatggctg

SEQ ID NO: 7793984 - DNA, 22 bp, Homo sapiens
aagtcttaggaaatagcaaaga

SEQ ID NO: 7793985 - DNA, 22 bp, Homo sapiens
aagtcttaggcattttatttct

SEQ ID NO: 7793986 - DNA, 22 bp, Homo sapiens
aagtcttaaccaaataaatgtt

SEQ ID NO: 7793987 - DNA, 22 bp, Homo sapiens
aagtcttaaccaaataaatgtt

SEQ ID NO: 7793988 - DNA, 22 bp, Homo sapiens
aagtgcttaaaagggtggtcta

SEQ ID NO: 7793989 - DNA, 22 bp, Homo sapiens
aagtgctcccatatcctgccct

SEQ ID NO: 7793990 - DNA, 23 bp, Homo sapiens
aagtgctcagtggacagcattgc

SEQ ID NO: 7793991 - DNA, 22 bp, Homo sapiens
aacagtgttctagggtgtggct

SEQ ID NO: 7793992 - DNA, 22 bp, Homo sapiens
aaatggatgttgagttaaatgt

SEQ ID NO: 7793993 - DNA, 22 bp, Homo sapiens
aaggagggttcccaggtcctgg

SEQ ID NO: 7793994 - DNA, 22 bp, Homo sapiens
aatataattttattcctagagt

SEQ ID NO: 7793995 - DNA, 22 bp, Homo sapiens
aatatcagtatattgtatcagt

SEQ ID NO: 7793996 - DNA, 22 bp, Homo sapiens
aatatctcaccatgacaaagca

SEQ ID NO: 7793997 - DNA, 22 bp, Homo sapiens
aacagtttatcaagtttttaca

SEQ ID NO: 7793998 - DNA, 22 bp, Homo sapiens
aacagtttatgagatatgctat

SEQ ID NO: 7793999 - DNA, 22 bp, Homo sapiens
aataatgtacatacatatttcg

SEQ ID NO: 7794000 - DNA, 22 bp, Homo sapiens
aataatcttgactactgaatca

SEQ ID NO: 7794001 - DNA, 22 bp, Homo sapiens
aataatgagcttgtctaattgt

SEQ ID NO: 7794002 - DNA, 22 bp, Homo sapiens
aataatgataatggttatagct

SEQ ID NO: 7794003 - DNA, 21 bp, Homo sapiens
aacttgtatttctccttattc

SEQ ID NO: 7794004 - DNA, 22 bp, Homo sapiens
aacttgtatatgttattcagag

SEQ ID NO: 7794005 - DNA, 22 bp, Homo sapiens
aatgtacaaaccttctttgtag

SEQ ID NO: 7794006 - DNA, 22 bp, Homo sapiens
aatgtacaaaagtcagccaact

SEQ ID NO: 7794007 - DNA, 22 bp, Homo sapiens
aatgtaaacagcaagagaaggg

SEQ ID NO: 7794008 - DNA, 22 bp, Homo sapiens
aatgtaaagctcaggtcaggag

SEQ ID NO: 7794009 - DNA, 22 bp, Homo sapiens
aatgcttccaaaataccaagcc

SEQ ID NO: 7794010 - DNA, 22 bp, Homo sapiens
aacttcattcctttttatgact

SEQ ID NO: 7794011 - DNA, 22 bp, Homo sapiens
aacttgtaatgaaaggcaatag

SEQ ID NO: 7794012 - DNA, 18 bp, Homo sapiens
aatgaaatgtacaccttt

SEQ ID NO: 7794013 - DNA, 22 bp, Homo sapiens
aatctggaatatttgcattgta

SEQ ID NO: 7794014 - DNA, 22 bp, Homo sapiens
aatctcttcccagtaaaaatgg

SEQ ID NO: 7794015 - DNA, 22 bp, Homo sapiens
aatctgcacaattcagtttcag

SEQ ID NO: 7794016 - DNA, 21 bp, Homo sapiens
aatctgcttccctgtgacttg

SEQ ID NO: 7794017 - DNA, 22 bp, Homo sapiens
aagcaggttatgaaatatagaa

SEQ ID NO: 7794018 - DNA, 19 bp, Homo sapiens
acagcaggtgtggggataa

SEQ ID NO: 7794019 - DNA, 22 bp, Homo sapiens
acagcagggggagctgttggac

SEQ ID NO: 7794020 - DNA, 22 bp, Homo sapiens
acagctggacaggggagagttt

SEQ ID NO: 7794021 - DNA, 22 bp, Homo sapiens
acagacctgattcaagtcttga

SEQ ID NO: 7794022 - DNA, 23 bp, Homo sapiens
acagactgtattcaaagtaggac

SEQ ID NO: 7794023 - DNA, 23 bp, Homo sapiens
acagacattccataatgtacacc

SEQ ID NO: 7794024 - DNA, 22 bp, Homo sapiens
acagacattttaagacacttta

SEQ ID NO: 7794025 - DNA, 22 bp, Homo sapiens
acacttctcatttgatactaac

SEQ ID NO: 7794026 - DNA, 22 bp, Homo sapiens
acacataagcctaatcatctcc

SEQ ID NO: 7794027 - DNA, 22 bp, Homo sapiens
acacatataccactgtaaatga

SEQ ID NO: 7794028 - DNA, 22 bp, Homo sapiens
acacatataccactgtaaatga

SEQ ID NO: 7794029 - DNA, 22 bp, Homo sapiens
aagaacattgatattgtctatg

SEQ ID NO: 7794030 - DNA, 22 bp, Homo sapiens
aagaacattcgaactattttct

SEQ ID NO: 7794031 - DNA, 22 bp, Homo sapiens
aatgtacaagggttccagtttt

SEQ ID NO: 7794032 - DNA, 22 bp, Homo sapiens
aagaagaagtgttatttttaga

SEQ ID NO: 7794033 - DNA, 22 bp, Homo sapiens
aagaagaagtgttatttttaga

SEQ ID NO: 7794034 - DNA, 22 bp, Homo sapiens
acaaaagtgtaggaattcctta

SEQ ID NO: 7794035 - DNA, 22 bp, Homo sapiens
acaaaatagagttctcccctgg

SEQ ID NO: 7794036 - DNA, 22 bp, Homo sapiens
aagaatcatcctgcaagagtct

SEQ ID NO: 7794037 - DNA, 22 bp, Homo sapiens
aagaatctccatctgattcact

SEQ ID NO: 7794038 - DNA, 23 bp, Homo sapiens
aagaatctcagaattagaaatac

SEQ ID NO: 7794039 - DNA, 22 bp, Homo sapiens
aagaatcattgtaaagttctgt

SEQ ID NO: 7794040 - DNA, 22 bp, Homo sapiens
acaaatatttactgaatccact

SEQ ID NO: 7794041 - DNA, 22 bp, Homo sapiens
acaaatgaacatataagcttga

SEQ ID NO: 7794042 - DNA, 22 bp, Homo sapiens
acaaatgactatttggtacagg

SEQ ID NO: 7794043 - DNA, 22 bp, Homo sapiens
acaaatgaatcatacataatgt

SEQ ID NO: 7794044 - DNA, 22 bp, Homo sapiens
acacagcttcaaagtctaattc

SEQ ID NO: 7794045 - DNA, 22 bp, Homo sapiens
aagataatattcattaactaga

SEQ ID NO: 7794046 - DNA, 22 bp, Homo sapiens
acaatgttctacatatacataa

SEQ ID NO: 7794047 - DNA, 23 bp, Homo sapiens
acaatgtctgttcataaaatacc

SEQ ID NO: 7794048 - DNA, 22 bp, Homo sapiens
acaatatgggatatacatttta

SEQ ID NO: 7794049 - DNA, 22 bp, Homo sapiens
acaatattgtacccagaagttt

SEQ ID NO: 7794050 - DNA, 22 bp, Homo sapiens
acagagctgtacatgtgccatg

SEQ ID NO: 7794051 - DNA, 22 bp, Homo sapiens
acagaggccgcctctctcacgg

SEQ ID NO: 7794052 - DNA, 22 bp, Homo sapiens
agcgtgaattagttggtacaca

SEQ ID NO: 7794053 - DNA, 22 bp, Homo sapiens
agccttcaacctagctagagca

SEQ ID NO: 7794054 - DNA, 22 bp, Homo sapiens
agccttcactgggaccttggat

SEQ ID NO: 7794055 - DNA, 22 bp, Homo sapiens
agccttcagcagttcaggtgcc

SEQ ID NO: 7794056 - DNA, 22 bp, Homo sapiens
acagatactataatgtaaagtg

SEQ ID NO: 7794057 - DNA, 22 bp, Homo sapiens
acagcaggttttaactttgaag

SEQ ID NO: 7794058 - DNA, 22 bp, Homo sapiens
acagcaggcccatactggaagg

SEQ ID NO: 7794059 - DNA, 22 bp, Homo sapiens
agctgaggttgaagagtgaacg

SEQ ID NO: 7794060 - DNA, 22 bp, Homo sapiens
agctgataggtgtaggatacac

SEQ ID NO: 7794061 - DNA, 21 bp, Homo sapiens
agctgaggtaaggcaagagag

SEQ ID NO: 7794062 - DNA, 22 bp, Homo sapiens
agctgaggttagtataaatgtg

SEQ ID NO: 7794063 - DNA, 22 bp, Homo sapiens
agctgaggttagtataaatgtg

SEQ ID NO: 7794064 - DNA, 23 bp, Homo sapiens
agctgaggtgcagatccaaagaa

SEQ ID NO: 7794065 - DNA, 22 bp, Homo sapiens
agctgagggttcggtgtccaca

SEQ ID NO: 7794066 - DNA, 18 bp, Homo sapiens
agctgaggggactgaaga

SEQ ID NO: 7794067 - DNA, 20 bp, Homo sapiens
acactgttcttcacacattt

SEQ ID NO: 7794068 - DNA, 22 bp, Homo sapiens
acactgttccacactaagaagg

SEQ ID NO: 7794069 - DNA, 22 bp, Homo sapiens
acacttatacaaagaatgtctg

SEQ ID NO: 7794070 - DNA, 22 bp, Homo sapiens
acacttatttttgtccacttcc

SEQ ID NO: 7794071 - DNA, 22 bp, Homo sapiens
acacttatttcttgtctaacca

SEQ ID NO: 7794072 - DNA, 22 bp, Homo sapiens
acacataagaaactacaaagag

SEQ ID NO: 7794073 - DNA, 22 bp, Homo sapiens
acacagttcttagcaggtgtct

SEQ ID NO: 7794074 - DNA, 22 bp, Homo sapiens
acacagttcaggatcaaatagc

SEQ ID NO: 7794075 - DNA, 22 bp, Homo sapiens
acacagttgattgtcactcagg

SEQ ID NO: 7794076 - DNA, 22 bp, Homo sapiens
acacagttctttcactgttggt

SEQ ID NO: 7794077 - DNA, 22 bp, Homo sapiens
acacagttggtggctcagtctg

SEQ ID NO: 7794078 - DNA, 22 bp, Homo sapiens
acacatattcatatgtacttac

SEQ ID NO: 7794079 - DNA, 22 bp, Homo sapiens
acacatatgtggcaactgtaga

SEQ ID NO: 7794080 - DNA, 19 bp, Homo sapiens
acacaatgacacatatata

SEQ ID NO: 7794081 - DNA, 22 bp, Homo sapiens
acacaagattgtgtattgaatt

SEQ ID NO: 7794082 - DNA, 22 bp, Homo sapiens
agcacaggaccaaggaagctgt

SEQ ID NO: 7794083 - DNA, 22 bp, Homo sapiens
agcacaggctttggtgtgaggg

SEQ ID NO: 7794084 - DNA, 22 bp, Homo sapiens
agcacagggacaatgccaggtg

SEQ ID NO: 7794085 - DNA, 22 bp, Homo sapiens
agcacacatcacttctgctcat

SEQ ID NO: 7794086 - DNA, 22 bp, Homo sapiens
agcacaggaacatggagatggg

SEQ ID NO: 7794087 - DNA, 22 bp, Homo sapiens
agcaaggccgagaggatgctat

SEQ ID NO: 7794088 - DNA, 22 bp, Homo sapiens
acaacattatacatagaaagct

SEQ ID NO: 7794089 - DNA, 22 bp, Homo sapiens
acaacattatacatagaaagct

SEQ ID NO: 7794090 - DNA, 22 bp, Homo sapiens
aatttcttcagctctaaaatgg

SEQ ID NO: 7794091 - DNA, 22 bp, Homo sapiens
aatttgcatgatgagaacaata

SEQ ID NO: 7794092 - DNA, 22 bp, Homo sapiens
agagtgaagttcatcgtgcagc

SEQ ID NO: 7794093 - DNA, 22 bp, Homo sapiens
agagtgtaccaaatatcctaca

SEQ ID NO: 7794094 - DNA, 22 bp, Homo sapiens
agagttaaggccactgtcagta

SEQ ID NO: 7794095 - DNA, 20 bp, Homo sapiens
acaaagtattgaggacaagt

SEQ ID NO: 7794096 - DNA, 22 bp, Homo sapiens
acaaagtatttttaggtttgta

SEQ ID NO: 7794097 - DNA, 19 bp, Homo sapiens
acaaagtgcgtgctctttt

SEQ ID NO: 7794098 - DNA, 23 bp, Homo sapiens
acaacaggaaatcagacctgaac

SEQ ID NO: 7794099 - DNA, 22 bp, Homo sapiens
acaacagggtaaggcaggccat

SEQ ID NO: 7794100 - DNA, 21 bp, Homo sapiens
agatgctgatgctgcaggtcc

SEQ ID NO: 7794101 - DNA, 22 bp, Homo sapiens
agatgctgattgaatagatttc

SEQ ID NO: 7794102 - DNA, 22 bp, Homo sapiens
agaggaggtggtgatgctttaa

SEQ ID NO: 7794103 - DNA, 22 bp, Homo sapiens
agaggaggtggtgatgctttaa

SEQ ID NO: 7794104 - DNA, 22 bp, Homo sapiens
agaggaggtccttttctgatgt

SEQ ID NO: 7794105 - DNA, 22 bp, Homo sapiens
agaggagtattttctaagggaa

SEQ ID NO: 7794106 - DNA, 22 bp, Homo sapiens
aatttcacagtgaactttgagg

SEQ ID NO: 7794107 - DNA, 18 bp, Homo sapiens
aattccaagccataggag

SEQ ID NO: 7794108 - DNA, 22 bp, Homo sapiens
aattcattgccagaatctatga

SEQ ID NO: 7794109 - DNA, 22 bp, Homo sapiens
agagcacagaagaataggtgct

SEQ ID NO: 7794110 - DNA, 22 bp, Homo sapiens
agagcacagccaccatttacaa

SEQ ID NO: 7794111 - DNA, 22 bp, Homo sapiens
aattaactaatttggtacaaga

SEQ ID NO: 7794112 - DNA, 22 bp, Homo sapiens
agacatttattcacacatttat

SEQ ID NO: 7794113 - DNA, 22 bp, Homo sapiens
agacatcatgttacagattaag

SEQ ID NO: 7794114 - DNA, 22 bp, Homo sapiens
agacatcagcttgtgtgcaggg

SEQ ID NO: 7794115 - DNA, 22 bp, Homo sapiens
agacatgacagatagttgctag

SEQ ID NO: 7794116 - DNA, 22 bp, Homo sapiens
aatgccttggagagcctagagg

SEQ ID NO: 7794117 - DNA, 22 bp, Homo sapiens
agagcaatggcatccagctgat

SEQ ID NO: 7794118 - DNA, 22 bp, Homo sapiens
aatgtgttactgtgtaagagca

SEQ ID NO: 7794119 - DNA, 22 bp, Homo sapiens
agagaagggggaaagatctcac

SEQ ID NO: 7794120 - DNA, 22 bp, Homo sapiens
agagaaggggtaaagagtcctg

SEQ ID NO: 7794121 - DNA, 22 bp, Homo sapiens
aagggatgtaaacatgaataag

SEQ ID NO: 7794122 - DNA, 22 bp, Homo sapiens
aagggatgcaggaaagaaggtt

SEQ ID NO: 7794123 - DNA, 22 bp, Homo sapiens
acatttcagatgtaatgtgatg

SEQ ID NO: 7794124 - DNA, 22 bp, Homo sapiens
acatttcagatgtaatgtgatg

SEQ ID NO: 7794125 - DNA, 22 bp, Homo sapiens
acatttcagcgtgcatgacatg

SEQ ID NO: 7794126 - DNA, 22 bp, Homo sapiens
acatttcagtaagtgttaattt

SEQ ID NO: 7794127 - DNA, 22 bp, Homo sapiens
acatttcagtgagctattgaag

SEQ ID NO: 7794128 - DNA, 22 bp, Homo sapiens
aagggggcggcagccagtggaa

SEQ ID NO: 7794129 - DNA, 22 bp, Homo sapiens
accagcaagattttgctttgca

SEQ ID NO: 7794130 - DNA, 22 bp, Homo sapiens
accagaggcagtttcggctggt

SEQ ID NO: 7794131 - DNA, 22 bp, Homo sapiens
aagggttggggaagagcaaatt

SEQ ID NO: 7794132 - DNA, 22 bp, Homo sapiens
aagggttgcaaggtcagaggaa

SEQ ID NO: 7794133 - DNA, 22 bp, Homo sapiens
aagtcctgccacctataagcct

SEQ ID NO: 7794134 - DNA, 20 bp, Homo sapiens
aagtccctaagtctctggcc

SEQ ID NO: 7794135 - DNA, 22 bp, Homo sapiens
aagtccttcccaagcatgtacc

SEQ ID NO: 7794136 - DNA, 22 bp, Homo sapiens
aagtcctgtgtgcttacacttg

SEQ ID NO: 7794137 - DNA, 22 bp, Homo sapiens
aagtccttggagaatagaaagg

SEQ ID NO: 7794138 - DNA, 22 bp, Homo sapiens
acctgcctatcagctgcctgct

SEQ ID NO: 7794139 - DNA, 22 bp, Homo sapiens
aagtatctcaaaaacagtaatc

SEQ ID NO: 7794140 - DNA, 22 bp, Homo sapiens
aagtccagtgatactggcagga

SEQ ID NO: 7794141 - DNA, 22 bp, Homo sapiens
aagtagcattttcaaaatgtat

SEQ ID NO: 7794142 - DNA, 22 bp, Homo sapiens
acctcctggctgctcatggaac

SEQ ID NO: 7794143 - DNA, 22 bp, Homo sapiens
acctcctggtgcccaagtgttt

SEQ ID NO: 7794144 - DNA, 22 bp, Homo sapiens
acctcctggcttatcatggaca

SEQ ID NO: 7794145 - DNA, 20 bp, Homo sapiens
acctcctggaagcaggtgcc

SEQ ID NO: 7794146 - DNA, 22 bp, Homo sapiens
acccaggggcagccttgctgtg

SEQ ID NO: 7794147 - DNA, 21 bp, Homo sapiens
acccaggggaagcagaaactg

SEQ ID NO: 7794148 - DNA, 22 bp, Homo sapiens
acccagggcttaaggcggtgca

SEQ ID NO: 7794149 - DNA, 22 bp, Homo sapiens
acccagggctcaagcgtaggca

SEQ ID NO: 7794150 - DNA, 22 bp, Homo sapiens
acccagggagtgctcctgttct

SEQ ID NO: 7794151 - DNA, 22 bp, Homo sapiens
acccagggccacagcccgcagt

SEQ ID NO: 7794152 - DNA, 22 bp, Homo sapiens
acccagggcagccagcggggag

SEQ ID NO: 7794153 - DNA, 19 bp, Homo sapiens
acccaggggtttatgtgtg

SEQ ID NO: 7794154 - DNA, 22 bp, Homo sapiens
acccagggtagaacctcagagc

SEQ ID NO: 7794155 - DNA, 22 bp, Homo sapiens
acccaggggcgaagctggccac

SEQ ID NO: 7794156 - DNA, 22 bp, Homo sapiens
acccagggtagaacctcagagc

SEQ ID NO: 7794157 - DNA, 22 bp, Homo sapiens
aaggagggaaagcagtgcttct

SEQ ID NO: 7794158 - DNA, 22 bp, Homo sapiens
acagctggagtgttggtgaggt

SEQ ID NO: 7794159 - DNA, 22 bp, Homo sapiens
acagctggagtgaggatggagt

SEQ ID NO: 7794160 - DNA, 22 bp, Homo sapiens
aagctgtgtattacagaatatt

SEQ ID NO: 7794161 - DNA, 22 bp, Homo sapiens
aagctgtgaagagcaagtgagg

SEQ ID NO: 7794162 - DNA, 22 bp, Homo sapiens
aagctgtgaaatctctagtgca

SEQ ID NO: 7794163 - DNA, 22 bp, Homo sapiens
aagctgtgcaggaactgcttgc

SEQ ID NO: 7794164 - DNA, 22 bp, Homo sapiens
aagctgtggcttggaggaaaca

SEQ ID NO: 7794165 - DNA, 21 bp, Homo sapiens
aagcttccaaactgctggact

SEQ ID NO: 7794166 - DNA, 22 bp, Homo sapiens
acatcctcccgatctactggct

SEQ ID NO: 7794167 - DNA, 22 bp, Homo sapiens
aaggcacagccacttgatcatc

SEQ ID NO: 7794168 - DNA, 22 bp, Homo sapiens
aaggcattgctgatcctcaggt

SEQ ID NO: 7794169 - DNA, 22 bp, Homo sapiens
aaggcattgctgatcctcaggt

SEQ ID NO: 7794170 - DNA, 22 bp, Homo sapiens
aaggcattacctaagtttggga

SEQ ID NO: 7794171 - DNA, 22 bp, Homo sapiens
aaggccagccctaatgatgctc

SEQ ID NO: 7794172 - DNA, 22 bp, Homo sapiens
actgggagtcatgaggaaggag

SEQ ID NO: 7794173 - DNA, 22 bp, Homo sapiens
actgggagggtcttgaagaggg

SEQ ID NO: 7794174 - DNA, 22 bp, Homo sapiens
aagtttttgattctaagagaga

SEQ ID NO: 7794175 - DNA, 22 bp, Homo sapiens
aagtttttggtagagaaaagta

SEQ ID NO: 7794176 - DNA, 22 bp, Homo sapiens
aataatagcagagtttacaatc

SEQ ID NO: 7794177 - DNA, 22 bp, Homo sapiens
aataatagcagagtttacaatc

SEQ ID NO: 7794178 - DNA, 22 bp, Homo sapiens
aatagcatcctgtatctcttcc

SEQ ID NO: 7794179 - DNA, 22 bp, Homo sapiens
actgtccattcactcatattca

SEQ ID NO: 7794180 - DNA, 22 bp, Homo sapiens
actgtccaagcatgcctggctt

SEQ ID NO: 7794181 - DNA, 22 bp, Homo sapiens
actgtccagaagatagaaatat

SEQ ID NO: 7794182 - DNA, 22 bp, Homo sapiens
actgtccattcactcatattca

SEQ ID NO: 7794183 - DNA, 22 bp, Homo sapiens
actgtcatgtgctaactgtcca

SEQ ID NO: 7794184 - DNA, 22 bp, Homo sapiens
actgtacatgcatcttgtctat

SEQ ID NO: 7794185 - DNA, 22 bp, Homo sapiens
actgtacatatggattctaaga

SEQ ID NO: 7794186 - DNA, 22 bp, Homo sapiens
aagtgtttaacggtgattgagc

SEQ ID NO: 7794187 - DNA, 22 bp, Homo sapiens
aagtgtttaaattatttgcagg

SEQ ID NO: 7794188 - DNA, 22 bp, Homo sapiens
aagtgtgttttcagtgtactta

SEQ ID NO: 7794189 - DNA, 22 bp, Homo sapiens
aagtgtctgcaaaatgacagag

SEQ ID NO: 7794190 - DNA, 22 bp, Homo sapiens
acctgcctatggagccacatgg

SEQ ID NO: 7794191 - DNA, 22 bp, Homo sapiens
acctgcctcagtgcagctggat

SEQ ID NO: 7794192 - DNA, 22 bp, Homo sapiens
actctttattgtttgtggctag

SEQ ID NO: 7794193 - DNA, 22 bp, Homo sapiens
aagttcctgggccaagtccagg

SEQ ID NO: 7794194 - DNA, 20 bp, Homo sapiens
aagttttctccaaatacagt

SEQ ID NO: 7794195 - DNA, 22 bp, Homo sapiens
agaaagcttatgaatgggcaag

SEQ ID NO: 7794196 - DNA, 22 bp, Homo sapiens
agaaagctggagtcaagcagag

SEQ ID NO: 7794197 - DNA, 22 bp, Homo sapiens
aatagctttggtcaccatctgg

SEQ ID NO: 7794198 - DNA, 22 bp, Homo sapiens
acttttaaggggccttgattta

SEQ ID NO: 7794199 - DNA, 22 bp, Homo sapiens
acttttaaggggccttgattta

SEQ ID NO: 7794200 - DNA, 22 bp, Homo sapiens
acttttaaatgagtttcagttg

SEQ ID NO: 7794201 - DNA, 22 bp, Homo sapiens
agaaggaaaacctgtcttatgt

SEQ ID NO: 7794202 - DNA, 22 bp, Homo sapiens
agaagaaatgaggccgttctgc

SEQ ID NO: 7794203 - DNA, 22 bp, Homo sapiens
taggatttggctttagtcaggt

SEQ ID NO: 7794204 - DNA, 22 bp, Homo sapiens
taggattttttggattctggat

SEQ ID NO: 7794205 - DNA, 22 bp, Homo sapiens
tagggaccctccctgctctaac

SEQ ID NO: 7794206 - DNA, 22 bp, Homo sapiens
tagggacactgctcatgagttc

SEQ ID NO: 7794207 - DNA, 22 bp, Homo sapiens
tagggaccttagaattgtatgt

SEQ ID NO: 7794208 - DNA, 22 bp, Homo sapiens
tagggacactgctcatgagttc

SEQ ID NO: 7794209 - DNA, 22 bp, Homo sapiens
tagggatgaagttgctatttac

SEQ ID NO: 7794210 - DNA, 22 bp, Homo sapiens
tagggatgaagatggtatttct

SEQ ID NO: 7794211 - DNA, 22 bp, Homo sapiens
tagggatgactatgattcccac

SEQ ID NO: 7794212 - DNA, 22 bp, Homo sapiens
tagggatgacgaaaggacagag

SEQ ID NO: 7794213 - DNA, 22 bp, Homo sapiens
tagggatgagcaactggtagtg

SEQ ID NO: 7794214 - DNA, 22 bp, Homo sapiens
tagggatgaggatagatttttc

SEQ ID NO: 7794215 - DNA, 22 bp, Homo sapiens
tagggatgagccagtgggtagt

SEQ ID NO: 7794216 - DNA, 22 bp, Homo sapiens
tagggatgtggtgagaactgag

SEQ ID NO: 7794217 - DNA, 22 bp, Homo sapiens
tagggatgtaaacatagtaatt

SEQ ID NO: 7794218 - DNA, 22 bp, Homo sapiens
tagggatgtcctgagacttggc

SEQ ID NO: 7794219 - DNA, 22 bp, Homo sapiens
tagggatggaaacccgttttct

SEQ ID NO: 7794220 - DNA, 22 bp, Homo sapiens
tagggatgcttagtaggaccca

SEQ ID NO: 7794221 - DNA, 20 bp, Homo sapiens
tagggatgccagtacttctc

SEQ ID NO: 7794222 - DNA, 22 bp, Homo sapiens
tagggatgatgtctaaaatcat

SEQ ID NO: 7794223 - DNA, 22 bp, Homo sapiens
tagggatgatggagcctatgta

SEQ ID NO: 7794224 - DNA, 22 bp, Homo sapiens
tagggatggatgatgcctggca

SEQ ID NO: 7794225 - DNA, 22 bp, Homo sapiens
tagggatggaaactaggaatct

SEQ ID NO: 7794226 - DNA, 22 bp, Homo sapiens
tagggatggcagcatgtagctt

SEQ ID NO: 7794227 - DNA, 22 bp, Homo sapiens
tagggatgggagattctcaaac

SEQ ID NO: 7794228 - DNA, 22 bp, Homo sapiens
taggaaaagtctagattgatga

SEQ ID NO: 7794229 - DNA, 22 bp, Homo sapiens
tagctttagaaatattctcaga

SEQ ID NO: 7794230 - DNA, 22 bp, Homo sapiens
tagctttaccatagaagagtat

SEQ ID NO: 7794231 - DNA, 22 bp, Homo sapiens
tagctttacaaagtgctgcacc

SEQ ID NO: 7794232 - DNA, 22 bp, Homo sapiens
tagctttagtgaaaaatatcag

SEQ ID NO: 7794233 - DNA, 22 bp, Homo sapiens
tagctttaggcacgtttgaatt

SEQ ID NO: 7794234 - DNA, 22 bp, Homo sapiens
tagctttaggatggttctcttg

SEQ ID NO: 7794235 - DNA, 18 bp, Homo sapiens
tagaggggaagaccttta

SEQ ID NO: 7794236 - DNA, 22 bp, Homo sapiens
tagcgaggtgtttctaggactg

SEQ ID NO: 7794237 - DNA, 21 bp, Homo sapiens
tagctttaatattcccacatt

SEQ ID NO: 7794238 - DNA, 22 bp, Homo sapiens
tagctttaatgagttggtaaga

SEQ ID NO: 7794239 - DNA, 22 bp, Homo sapiens
tagaaaagaattttatttgata

SEQ ID NO: 7794240 - DNA, 22 bp, Homo sapiens
tagaaaagataacattctgtgc

SEQ ID NO: 7794241 - DNA, 22 bp, Homo sapiens
tagaaaactaatacatgcttga

SEQ ID NO: 7794242 - DNA, 22 bp, Homo sapiens
tactttttatgataagaactga

SEQ ID NO: 7794243 - DNA, 22 bp, Homo sapiens
tacatttccttgactcctcaac

SEQ ID NO: 7794244 - DNA, 19 bp, Homo sapiens
tacatttgtgtacacttgt

SEQ ID NO: 7794245 - DNA, 22 bp, Homo sapiens
tacttttaaaattcacaggtat

SEQ ID NO: 7794246 - DNA, 22 bp, Homo sapiens
tacttttagcctatttgattct

SEQ ID NO: 7794247 - DNA, 22 bp, Homo sapiens
tacttttagcctatttgattct

SEQ ID NO: 7794248 - DNA, 22 bp, Homo sapiens
tagaaacagatgtttttgaaga

SEQ ID NO: 7794249 - DNA, 22 bp, Homo sapiens
tagaaacagaatatgagtgaga

SEQ ID NO: 7794250 - DNA, 22 bp, Homo sapiens
tagaaacagcatatattagccc

SEQ ID NO: 7794251 - DNA, 22 bp, Homo sapiens
tagaaacagcatatattagccc

SEQ ID NO: 7794252 - DNA, 22 bp, Homo sapiens
tagaaacatcagctaaccaaaa

SEQ ID NO: 7794253 - DNA, 22 bp, Homo sapiens
tagaaagaacttcatgtaaaac

SEQ ID NO: 7794254 - DNA, 22 bp, Homo sapiens
tagaaagccctgtgttcactgc

SEQ ID NO: 7794255 - DNA, 19 bp, Homo sapiens
tagaaagccagaaaacaga

SEQ ID NO: 7794256 - DNA, 22 bp, Homo sapiens
tagaaagctgagtaatacattt

SEQ ID NO: 7794257 - DNA, 22 bp, Homo sapiens
tagaaagcgttaaatctacaga

SEQ ID NO: 7794258 - DNA, 22 bp, Homo sapiens
tagaaagctgagtaatacattt

SEQ ID NO: 7794259 - DNA, 22 bp, Homo sapiens
tagaattcaagattcaacaggc

SEQ ID NO: 7794260 - DNA, 22 bp, Homo sapiens
tagacagatgttttctggctgt

SEQ ID NO: 7794261 - DNA, 22 bp, Homo sapiens
tataaatgcacttttgaaatat

SEQ ID NO: 7794262 - DNA, 22 bp, Homo sapiens
tataaatctttgttcctagaat

SEQ ID NO: 7794263 - DNA, 22 bp, Homo sapiens
tataaattaatgtgcccatgag

SEQ ID NO: 7794264 - DNA, 22 bp, Homo sapiens
tataaattattaggctgctaaa

SEQ ID NO: 7794265 - DNA, 20 bp, Homo sapiens
tataaattcagagctttggt

SEQ ID NO: 7794266 - DNA, 20 bp, Homo sapiens
tataaattcagagctttggt

SEQ ID NO: 7794267 - DNA, 20 bp, Homo sapiens
tataaattcagagctttggt

SEQ ID NO: 7794268 - DNA, 22 bp, Homo sapiens
tataatttatcatgtcacagtt

SEQ ID NO: 7794269 - DNA, 22 bp, Homo sapiens
tataattttaagtggtaaatta

SEQ ID NO: 7794270 - DNA, 22 bp, Homo sapiens
tataatttggggaaagtggtgt

SEQ ID NO: 7794271 - DNA, 22 bp, Homo sapiens
tatccaattcaccattgatggg

SEQ ID NO: 7794272 - DNA, 22 bp, Homo sapiens
tatatcagcaaagcatttaaaa

SEQ ID NO: 7794273 - DNA, 22 bp, Homo sapiens
tatagtttcatgagctttttaa

SEQ ID NO: 7794274 - DNA, 22 bp, Homo sapiens
tatgagaaaggagaatgacttt

SEQ ID NO: 7794275 - DNA, 22 bp, Homo sapiens
tatgagaaaggagaatgacttt

SEQ ID NO: 7794276 - DNA, 21 bp, Homo sapiens
tatctactggtgtctttcaga

SEQ ID NO: 7794277 - DNA, 22 bp, Homo sapiens
tatctacagttaatatgtcatc

SEQ ID NO: 7794278 - DNA, 22 bp, Homo sapiens
tatctaaaggatttaatttagt

SEQ ID NO: 7794279 - DNA, 20 bp, Homo sapiens
tatctaaatgcttacattac

SEQ ID NO: 7794280 - DNA, 22 bp, Homo sapiens
tattctgtgtgatatgtaaatg

SEQ ID NO: 7794281 - DNA, 19 bp, Homo sapiens
tattctgttaacctttgtc

SEQ ID NO: 7794282 - DNA, 22 bp, Homo sapiens
tattcttgtaccttaaatgatt

SEQ ID NO: 7794283 - DNA, 22 bp, Homo sapiens
tattcttgtaccttaaatgatt

SEQ ID NO: 7794284 - DNA, 22 bp, Homo sapiens
tattcttgtatactacaatctt

SEQ ID NO: 7794285 - DNA, 22 bp, Homo sapiens
tattattatgcatagcatgaaa

SEQ ID NO: 7794286 - DNA, 22 bp, Homo sapiens
tattagggtaaatttgacatgc

SEQ ID NO: 7794287 - DNA, 22 bp, Homo sapiens
tattagggttttgaaggtttgt

SEQ ID NO: 7794288 - DNA, 22 bp, Homo sapiens
tattaggtaaaggacttgcagg

SEQ ID NO: 7794289 - DNA, 22 bp, Homo sapiens
tattagggaactgcaagactaa

SEQ ID NO: 7794290 - DNA, 23 bp, Homo sapiens
tattagggccaggactggcaaat

SEQ ID NO: 7794291 - DNA, 22 bp, Homo sapiens
tatttctgaatccaaaaggtca

SEQ ID NO: 7794292 - DNA, 22 bp, Homo sapiens
tatttctgagaaccaacttacc

SEQ ID NO: 7794293 - DNA, 22 bp, Homo sapiens
tatgagcaagagtttgtgaagg

SEQ ID NO: 7794294 - DNA, 22 bp, Homo sapiens
tatgtacaatcagcagttcata

SEQ ID NO: 7794295 - DNA, 22 bp, Homo sapiens
tatgtacaagcacacatgtgac

SEQ ID NO: 7794296 - DNA, 22 bp, Homo sapiens
tatgtacaatcagcagttcata

SEQ ID NO: 7794297 - DNA, 22 bp, Homo sapiens
tatgtacacacacatgcatgta

SEQ ID NO: 7794298 - DNA, 22 bp, Homo sapiens
tatgtacaccaaggattgaaaa

SEQ ID NO: 7794299 - DNA, 22 bp, Homo sapiens
tatgtacagggatagaacttga

SEQ ID NO: 7794300 - DNA, 22 bp, Homo sapiens
tatgtacataacatgaaatgca

SEQ ID NO: 7794301 - DNA, 22 bp, Homo sapiens
tatgtacagtccttaacttaaa

SEQ ID NO: 7794302 - DNA, 22 bp, Homo sapiens
tatgtacatacatgtgcatacg

SEQ ID NO: 7794303 - DNA, 22 bp, Homo sapiens
tatgtgaagagattaaaaaata

SEQ ID NO: 7794304 - DNA, 22 bp, Homo sapiens
tatgtcttttgcttgcaaatag

SEQ ID NO: 7794305 - DNA, 22 bp, Homo sapiens
tattagaaagcttaatatcgtg

SEQ ID NO: 7794306 - DNA, 22 bp, Homo sapiens
tattacagaatcaggcataact

SEQ ID NO: 7794307 - DNA, 22 bp, Homo sapiens
tattacagctttgattatctgg

SEQ ID NO: 7794308 - DNA, 22 bp, Homo sapiens
taaggtttctagtttctaaact

SEQ ID NO: 7794309 - DNA, 19 bp, Homo sapiens
taaggctgaaggaggaggg

SEQ ID NO: 7794310 - DNA, 22 bp, Homo sapiens
taactggaagtataattatcaa

SEQ ID NO: 7794311 - DNA, 22 bp, Homo sapiens
taaggcaaagtgatttcttaaa

SEQ ID NO: 7794312 - DNA, 22 bp, Homo sapiens
taataattaacagtgatgggtc

SEQ ID NO: 7794313 - DNA, 22 bp, Homo sapiens
taataatagcagtagctgccac

SEQ ID NO: 7794314 - DNA, 21 bp, Homo sapiens
taagtgcaaagagacagatac

SEQ ID NO: 7794315 - DNA, 22 bp, Homo sapiens
taaggtttgtggggagcaaaag

SEQ ID NO: 7794316 - DNA, 22 bp, Homo sapiens
taatagaatagtggaaacattg

SEQ ID NO: 7794317 - DNA, 22 bp, Homo sapiens
taattagagtcacaagtaacca

SEQ ID NO: 7794318 - DNA, 23 bp, Homo sapiens
taattagatgttgattcctgaga

SEQ ID NO: 7794319 - DNA, 22 bp, Homo sapiens
taattagagtttggtaaacaat

SEQ ID NO: 7794320 - DNA, 22 bp, Homo sapiens
tacaaaaaattgatactgacga

SEQ ID NO: 7794321 - DNA, 22 bp, Homo sapiens
tacaaaaaattgatactgacga

SEQ ID NO: 7794322 - DNA, 22 bp, Homo sapiens
tacaaagaggcagctccatttt

SEQ ID NO: 7794323 - DNA, 22 bp, Homo sapiens
tacaaagaggtaattgcatata

SEQ ID NO: 7794324 - DNA, 22 bp, Homo sapiens
tacaaagagtttggtctctaga

SEQ ID NO: 7794325 - DNA, 22 bp, Homo sapiens
tacattctactttttcactccc

SEQ ID NO: 7794326 - DNA, 22 bp, Homo sapiens
tacattctcttcccattgtctc

SEQ ID NO: 7794327 - DNA, 22 bp, Homo sapiens
tacaggagctgctctgtgatac

SEQ ID NO: 7794328 - DNA, 22 bp, Homo sapiens
tacagatatagagatttataga

SEQ ID NO: 7794329 - DNA, 22 bp, Homo sapiens
tacagataggaggaatctgaaa

SEQ ID NO: 7794330 - DNA, 21 bp, Homo sapiens
tacagatgaggagaccaaggc

SEQ ID NO: 7794331 - DNA, 22 bp, Homo sapiens
tacaaagtcagaataacaggtg

SEQ ID NO: 7794332 - DNA, 20 bp, Homo sapiens
tacagaaacaggacttttgg

SEQ ID NO: 7794333 - DNA, 22 bp, Homo sapiens
tacacttttctggttactcttg

SEQ ID NO: 7794334 - DNA, 22 bp, Homo sapiens
gtgtgggaaggctaggatgctg

SEQ ID NO: 7794335 - DNA, 22 bp, Homo sapiens
gttaatttagtagagtccagat

SEQ ID NO: 7794336 - DNA, 22 bp, Homo sapiens
gttaatttagtagagtccagat

SEQ ID NO: 7794337 - DNA, 22 bp, Homo sapiens
gttaataaaggtatagaatcag

SEQ ID NO: 7794338 - DNA, 22 bp, Homo sapiens
gttacaaagcacttcaagtgaa

SEQ ID NO: 7794339 - DNA, 22 bp, Homo sapiens
gttacaaaggaagcttcactgc

SEQ ID NO: 7794340 - DNA, 22 bp, Homo sapiens
gttacaaactcaggtgccaaaa

SEQ ID NO: 7794341 - DNA, 22 bp, Homo sapiens
gttaatttgcagctttcgagct

SEQ ID NO: 7794342 - DNA, 18 bp, Homo sapiens
gttaattttgaagttcat

SEQ ID NO: 7794343 - DNA, 22 bp, Homo sapiens
gtgctccctccttcctcaagga

SEQ ID NO: 7794344 - DNA, 22 bp, Homo sapiens
gtgctctgatctgtctgacatc

SEQ ID NO: 7794345 - DNA, 22 bp, Homo sapiens
gtgctctgagtttgcatgtcag

SEQ ID NO: 7794346 - DNA, 22 bp, Homo sapiens
gtgctctcctggctgccctgac

SEQ ID NO: 7794347 - DNA, 21 bp, Homo sapiens
gtgctctgggcagcagagggc

SEQ ID NO: 7794348 - DNA, 22 bp, Homo sapiens
gttgctcaggcaggagtacagt

SEQ ID NO: 7794349 - DNA, 22 bp, Homo sapiens
gttgggaaggcaagaagtagaa

SEQ ID NO: 7794350 - DNA, 22 bp, Homo sapiens
gttgggaaggtgaacatgatgc

SEQ ID NO: 7794351 - DNA, 22 bp, Homo sapiens
gtttcatatatagtaactgaaa

SEQ ID NO: 7794352 - DNA, 22 bp, Homo sapiens
gttgtaaatacagcagataatt

SEQ ID NO: 7794353 - DNA, 22 bp, Homo sapiens
gttgtaagtttaatgtcaattg

SEQ ID NO: 7794354 - DNA, 22 bp, Homo sapiens
gttcagcagcagtgattttgtg

SEQ ID NO: 7794355 - DNA, 22 bp, Homo sapiens
gttacaaaggactgggggccac

SEQ ID NO: 7794356 - DNA, 22 bp, Homo sapiens
gttacaaaggtcataaaagtgt

SEQ ID NO: 7794357 - DNA, 22 bp, Homo sapiens
gttcacatcccagaaagagcat

SEQ ID NO: 7794358 - DNA, 22 bp, Homo sapiens
gttcaatttcagcatccattga

SEQ ID NO: 7794359 - DNA, 22 bp, Homo sapiens
gttcaattaagttacaaattta

SEQ ID NO: 7794360 - DNA, 22 bp, Homo sapiens
gttcatattctaagtaactggc

SEQ ID NO: 7794361 - DNA, 22 bp, Homo sapiens
gttgaggtgatgccagccctgc

SEQ ID NO: 7794362 - DNA, 22 bp, Homo sapiens
gttcatttatgatgtaacatgt

SEQ ID NO: 7794363 - DNA, 22 bp, Homo sapiens
gttcatgtggaaatttaaaaca

SEQ ID NO: 7794364 - DNA, 22 bp, Homo sapiens
gtttccaggcccctccctagac

SEQ ID NO: 7794365 - DNA, 22 bp, Homo sapiens
gtttccagggctctcttcatga

SEQ ID NO: 7794366 - DNA, 22 bp, Homo sapiens
gtttccagctttctgatgcttg

SEQ ID NO: 7794367 - DNA, 22 bp, Homo sapiens
gttttcttcctgcaattggcat

SEQ ID NO: 7794368 - DNA, 22 bp, Homo sapiens
gttttggagtcaggcttagatg

SEQ ID NO: 7794369 - DNA, 22 bp, Homo sapiens
taaaatgatctctcatgttctt

SEQ ID NO: 7794370 - DNA, 22 bp, Homo sapiens
taaaagttttagttgtacataa

SEQ ID NO: 7794371 - DNA, 22 bp, Homo sapiens
taaaatgtgtttctgtatggtt

SEQ ID NO: 7794372 - DNA, 22 bp, Homo sapiens
taaaattgcggtgaatatttcc

SEQ ID NO: 7794373 - DNA, 22 bp, Homo sapiens
taaagggtaggttttactgtaa

SEQ ID NO: 7794374 - DNA, 22 bp, Homo sapiens
taactcaaatacttatgttact

SEQ ID NO: 7794375 - DNA, 22 bp, Homo sapiens
taactcaaatatgttgtctgaa

SEQ ID NO: 7794376 - DNA, 23 bp, Homo sapiens
taaatttcttgattcttatgtga

SEQ ID NO: 7794377 - DNA, 22 bp, Homo sapiens
taaattatggctggcagagcag

SEQ ID NO: 7794378 - DNA, 22 bp, Homo sapiens
taaattatggctggcagagcag

SEQ ID NO: 7794379 - DNA, 20 bp, Homo sapiens
taaattagccttgaagatta

SEQ ID NO: 7794380 - DNA, 22 bp, Homo sapiens
taaattagggactttagttaat

SEQ ID NO: 7794381 - DNA, 22 bp, Homo sapiens
taaattagggactttagttaat

SEQ ID NO: 7794382 - DNA, 22 bp, Homo sapiens
taaattatgttccatgtccttt

SEQ ID NO: 7794383 - DNA, 22 bp, Homo sapiens
taaattcactcctggtagacct

SEQ ID NO: 7794384 - DNA, 22 bp, Homo sapiens
taaattatgtcacatgactctg

SEQ ID NO: 7794385 - DNA, 22 bp, Homo sapiens
taaattagagccaggtaagttt

SEQ ID NO: 7794386 - DNA, 22 bp, Homo sapiens
taaattagagccaggtaagttt

SEQ ID NO: 7794387 - DNA, 22 bp, Homo sapiens
taaaggtttattcaacaaaata

SEQ ID NO: 7794388 - DNA, 22 bp, Homo sapiens
taaagtagcaagtttagactga

SEQ ID NO: 7794389 - DNA, 22 bp, Homo sapiens
taaaggtagtgtgacatattgt

SEQ ID NO: 7794390 - DNA, 19 bp, Homo sapiens
tcacttctgttagcatgga

SEQ ID NO: 7794391 - DNA, 22 bp, Homo sapiens
tcacttcttcagctttccttga

SEQ ID NO: 7794392 - DNA, 22 bp, Homo sapiens
tcacattttctactactgtacg

SEQ ID NO: 7794393 - DNA, 22 bp, Homo sapiens
tcacccagcgggcgcacactcg

SEQ ID NO: 7794394 - DNA, 22 bp, Homo sapiens
tcagaaaagagaaaatcttata

SEQ ID NO: 7794395 - DNA, 22 bp, Homo sapiens
tcactttttgatatcattctgc

SEQ ID NO: 7794396 - DNA, 23 bp, Homo sapiens
tcagagaactcgggcagatgacc

SEQ ID NO: 7794397 - DNA, 22 bp, Homo sapiens
tcagagcttatctcttgctgga

SEQ ID NO: 7794398 - DNA, 22 bp, Homo sapiens
tcagagaggttggtgataagaa

SEQ ID NO: 7794399 - DNA, 22 bp, Homo sapiens
tcagagaggttaaatatcttgt

SEQ ID NO: 7794400 - DNA, 23 bp, Homo sapiens
tcagagaggccccctgcagagat

SEQ ID NO: 7794401 - DNA, 22 bp, Homo sapiens
tcagagaggcaatactgtttaa

SEQ ID NO: 7794402 - DNA, 22 bp, Homo sapiens
tcagagcattcgggtgacaaat

SEQ ID NO: 7794403 - DNA, 20 bp, Homo sapiens
tcacaatatgagctcataca

SEQ ID NO: 7794404 - DNA, 22 bp, Homo sapiens
tcacagaaaagctgagcatcag

SEQ ID NO: 7794405 - DNA, 22 bp, Homo sapiens
tatttctgaggcccaggaagtg

SEQ ID NO: 7794406 - DNA, 22 bp, Homo sapiens
tatttctgattgctcatgaggc

SEQ ID NO: 7794407 - DNA, 22 bp, Homo sapiens
tatttctgggagttcagaaatt

SEQ ID NO: 7794408 - DNA, 22 bp, Homo sapiens
tatttctgtcagccagatatgg

SEQ ID NO: 7794409 - DNA, 22 bp, Homo sapiens
tatttctgtatgcataaaagga

SEQ ID NO: 7794410 - DNA, 22 bp, Homo sapiens
tatttctgtttatttgtacatc

SEQ ID NO: 7794411 - DNA, 22 bp, Homo sapiens
tcaagaagtctgtaccatttga

SEQ ID NO: 7794412 - DNA, 22 bp, Homo sapiens
tcaagctggctgttgctatttc

SEQ ID NO: 7794413 - DNA, 22 bp, Homo sapiens
tcaagtctggagatctggaact

SEQ ID NO: 7794414 - DNA, 22 bp, Homo sapiens
tcaaggcacttcatgtctcagt

SEQ ID NO: 7794415 - DNA, 22 bp, Homo sapiens
tcaaggcacttcatgtctcagt

SEQ ID NO: 7794416 - DNA, 22 bp, Homo sapiens
tcaatttcattctattagttaa

SEQ ID NO: 7794417 - DNA, 22 bp, Homo sapiens
tcaatttcttggtttgataata

SEQ ID NO: 7794418 - DNA, 22 bp, Homo sapiens
tcaataaatagcttggctcagc

SEQ ID NO: 7794419 - DNA, 20 bp, Homo sapiens
tcaagttttgcttgacaaga

SEQ ID NO: 7794420 - DNA, 20 bp, Homo sapiens
tcaagttttgcttgacaaga

SEQ ID NO: 7794421 - DNA, 22 bp, Homo sapiens
tcagtgaaatgcatattcttcg

SEQ ID NO: 7794422 - DNA, 22 bp, Homo sapiens
tcagtgtcacaggatgctatgc

SEQ ID NO: 7794423 - DNA, 16 bp, Homo sapiens
tcagtgtcagctcctg

SEQ ID NO: 7794424 - DNA, 20 bp, Homo sapiens
tcagtgtcagtagccactac

SEQ ID NO: 7794425 - DNA, 22 bp, Homo sapiens
tcagtgtcagtcttttagatat

SEQ ID NO: 7794426 - DNA, 22 bp, Homo sapiens
tcagtgtcatatcaagaagatg

SEQ ID NO: 7794427 - DNA, 22 bp, Homo sapiens
tcagtgtcatcacttaatataa

SEQ ID NO: 7794428 - DNA, 22 bp, Homo sapiens
tcagtgtccttcgttcttgttg

SEQ ID NO: 7794429 - DNA, 22 bp, Homo sapiens
tcagtgtcctgtgcggtgcagc

SEQ ID NO: 7794430 - DNA, 22 bp, Homo sapiens
tcagtgtctagggacagtaatc

SEQ ID NO: 7794431 - DNA, 23 bp, Homo sapiens
tcagtgtctagttgtggaattga

SEQ ID NO: 7794432 - DNA, 22 bp, Homo sapiens
tcagtgtccggagcctgagtgc

SEQ ID NO: 7794433 - DNA, 19 bp, Homo sapiens
tcagtgtccctgttaatat

SEQ ID NO: 7794434 - DNA, 22 bp, Homo sapiens
tcagtgtcccgtctcttaactc

SEQ ID NO: 7794435 - DNA, 22 bp, Homo sapiens
tcagtgtccaaaaagaggcaag

SEQ ID NO: 7794436 - DNA, 22 bp, Homo sapiens
tcagtgtccataaataaagttt

SEQ ID NO: 7794437 - DNA, 22 bp, Homo sapiens
tcagtgtctcatatgaggtttc

SEQ ID NO: 7794438 - DNA, 22 bp, Homo sapiens
tcagtgtctatagataaggttt

SEQ ID NO: 7794439 - DNA, 22 bp, Homo sapiens
tcagtcttgaacagccccctgt

SEQ ID NO: 7794440 - DNA, 17 bp, Homo sapiens
tcagggaatgaggttgt

SEQ ID NO: 7794441 - DNA, 18 bp, Homo sapiens
tcagggaagagaatatga

SEQ ID NO: 7794442 - DNA, 22 bp, Homo sapiens
tcagggaagagagatctcctag

SEQ ID NO: 7794443 - DNA, 22 bp, Homo sapiens
tcagggaacctctcctgtttct

SEQ ID NO: 7794444 - DNA, 22 bp, Homo sapiens
tcagggaagaaatgggacttta

SEQ ID NO: 7794445 - DNA, 22 bp, Homo sapiens
tcagggacccctctgagtggag

SEQ ID NO: 7794446 - DNA, 22 bp, Homo sapiens
tcagggacgtgagctcagagtc

SEQ ID NO: 7794447 - DNA, 22 bp, Homo sapiens
tcagggacagggtgctgctgcg

SEQ ID NO: 7794448 - DNA, 23 bp, Homo sapiens
tcagggacatgatgtgtcatatc

SEQ ID NO: 7794449 - DNA, 22 bp, Homo sapiens
tcatattagggtaatgataaga

SEQ ID NO: 7794450 - DNA, 22 bp, Homo sapiens
tcatgccaaactgaacacagtt

SEQ ID NO: 7794451 - DNA, 22 bp, Homo sapiens
tcatgccaaaatccagtggctt

SEQ ID NO: 7794452 - DNA, 22 bp, Homo sapiens
tcatgccagctttgcttgtccc

SEQ ID NO: 7794453 - DNA, 22 bp, Homo sapiens
tcatgccagttaaaggctgtga

SEQ ID NO: 7794454 - DNA, 22 bp, Homo sapiens
tcatgccacttacaaaataatg

SEQ ID NO: 7794455 - DNA, 22 bp, Homo sapiens
tcatgctagttaagaacacaat

SEQ ID NO: 7794456 - DNA, 22 bp, Homo sapiens
tcatgcctgattatgttactca

SEQ ID NO: 7794457 - DNA, 22 bp, Homo sapiens
tcatgccatccacatctgtttc

SEQ ID NO: 7794458 - DNA, 22 bp, Homo sapiens
tcatataagtttaaaactatct

SEQ ID NO: 7794459 - DNA, 22 bp, Homo sapiens
tcatataactggatattttcaa

SEQ ID NO: 7794460 - DNA, 22 bp, Homo sapiens
tcatagctaagctccagagtgc

SEQ ID NO: 7794461 - DNA, 22 bp, Homo sapiens
tcatatattttggcagtgatca

SEQ ID NO: 7794462 - DNA, 22 bp, Homo sapiens
tcatataagtttaaaactatct

SEQ ID NO: 7794463 - DNA, 22 bp, Homo sapiens
tcatggattaaattattaagtt

SEQ ID NO: 7794464 - DNA, 22 bp, Homo sapiens
tcatggcattgttaagggtttt

SEQ ID NO: 7794465 - DNA, 22 bp, Homo sapiens
tcatggctctaaagacatagat

SEQ ID NO: 7794466 - DNA, 22 bp, Homo sapiens
tcatggctaatgcagtatattc

SEQ ID NO: 7794467 - DNA, 22 bp, Homo sapiens
tcattcataaaaattagttggc

SEQ ID NO: 7794468 - DNA, 23 bp, Homo sapiens
tcattcaaggctggtatctttca

SEQ ID NO: 7794469 - DNA, 22 bp, Homo sapiens
tcattattctctttaatgttct

SEQ ID NO: 7794470 - DNA, 22 bp, Homo sapiens
tcagctctacacacacctgtgt

SEQ ID NO: 7794471 - DNA, 17 bp, Homo sapiens
tcaggaggtgtttctag

SEQ ID NO: 7794472 - DNA, 21 bp, Homo sapiens
tcaggaagagccagttcatgc

SEQ ID NO: 7794473 - DNA, 22 bp, Homo sapiens
tcaggctttttctcaacctctt

SEQ ID NO: 7794474 - DNA, 18 bp, Homo sapiens
tcaggctgggcctccttc

SEQ ID NO: 7794475 - DNA, 22 bp, Homo sapiens
tcagggaacaatgttatggctt

SEQ ID NO: 7794476 - DNA, 22 bp, Homo sapiens
tcagggaacatcgttaaactag

SEQ ID NO: 7794477 - DNA, 22 bp, Homo sapiens
tcaggagtgataccatttgtca

SEQ ID NO: 7794478 - DNA, 20 bp, Homo sapiens
tcaggatgtgctgagtgaag

SEQ ID NO: 7794479 - DNA, 22 bp, Homo sapiens
tcaggcagtagaattgcttgaa

SEQ ID NO: 7794480 - DNA, 22 bp, Homo sapiens
tcaggatgtccaaaatccagcc

SEQ ID NO: 7794481 - DNA, 22 bp, Homo sapiens
tcaggatggagggaagcacaga

SEQ ID NO: 7794482 - DNA, 22 bp, Homo sapiens
tccagctcagggttggctcaag

SEQ ID NO: 7794483 - DNA, 22 bp, Homo sapiens
tccagctcaaagtgctcctgtc

SEQ ID NO: 7794484 - DNA, 22 bp, Homo sapiens
tccagcattttgatacttgaaa

SEQ ID NO: 7794485 - DNA, 22 bp, Homo sapiens
tccaggaaagcactgggctggg

SEQ ID NO: 7794486 - DNA, 22 bp, Homo sapiens
tccaggaaagcactgggctggg

SEQ ID NO: 7794487 - DNA, 22 bp, Homo sapiens
tccaggaaagtgggatgtgtgt

SEQ ID NO: 7794488 - DNA, 20 bp, Homo sapiens
tccagaggccacatccagtg

SEQ ID NO: 7794489 - DNA, 22 bp, Homo sapiens
tccagaggggcagccctgtgct

SEQ ID NO: 7794490 - DNA, 22 bp, Homo sapiens
tccagagggcgatggctggggg

SEQ ID NO: 7794491 - DNA, 22 bp, Homo sapiens
tccagagctgggtctgtgctca

SEQ ID NO: 7794492 - DNA, 22 bp, Homo sapiens
tccagaggcaaaaaggtatgga

SEQ ID NO: 7794493 - DNA, 21 bp, Homo sapiens
tccagaggaggacagactcag

SEQ ID NO: 7794494 - DNA, 22 bp, Homo sapiens
tccagagcctgcgcactggctg

SEQ ID NO: 7794495 - DNA, 18 bp, Homo sapiens
tccagagcagtctttggc

SEQ ID NO: 7794496 - DNA, 19 bp, Homo sapiens
tccagaagtccctgagcgg

SEQ ID NO: 7794497 - DNA, 22 bp, Homo sapiens
tcattgcagttgagttgtgtta

SEQ ID NO: 7794498 - DNA, 22 bp, Homo sapiens
tccatgagctagctttccaaag

SEQ ID NO: 7794499 - DNA, 20 bp, Homo sapiens
tcccaaggatgcctgggtgt

SEQ ID NO: 7794500 - DNA, 22 bp, Homo sapiens
tcccaaggccaggcatctagaa

SEQ ID NO: 7794501 - DNA, 20 bp, Homo sapiens
tcccaagggctgagaggatc

SEQ ID NO: 7794502 - DNA, 22 bp, Homo sapiens
tcccaaggtgctcggcaacagg

SEQ ID NO: 7794503 - DNA, 22 bp, Homo sapiens
tcccaaggtgctcggcaacagg

SEQ ID NO: 7794504 - DNA, 22 bp, Homo sapiens
tcccaattaacaggtatcaggc

SEQ ID NO: 7794505 - DNA, 22 bp, Homo sapiens
tcccaatttcgagagttttaga

SEQ ID NO: 7794506 - DNA, 22 bp, Homo sapiens
tcccacacttgaaacaaggctg

SEQ ID NO: 7794507 - DNA, 22 bp, Homo sapiens
tcccacactacacggttgttgg

SEQ ID NO: 7794508 - DNA, 22 bp, Homo sapiens
tcccacacctgtctattcctag

SEQ ID NO: 7794509 - DNA, 22 bp, Homo sapiens
tccaggagtcctgggagtgatt

SEQ ID NO: 7794510 - DNA, 22 bp, Homo sapiens
tccaggagggattgggctgtgg

SEQ ID NO: 7794511 - DNA, 22 bp, Homo sapiens
tccaggaggttgagactgcagt

SEQ ID NO: 7794512 - DNA, 20 bp, Homo sapiens
tccaggaggttagtgtggct

SEQ ID NO: 7794513 - DNA, 22 bp, Homo sapiens
tccaggcataatgcccagtggt

SEQ ID NO: 7794514 - DNA, 22 bp, Homo sapiens
tccaggcatagaaggcacgcac

SEQ ID NO: 7794515 - DNA, 22 bp, Homo sapiens
tccaggcataagccttgagtgt

SEQ ID NO: 7794516 - DNA, 22 bp, Homo sapiens
tccaggcagggttaagggtcct

SEQ ID NO: 7794517 - DNA, 22 bp, Homo sapiens
tccaggcagggttaagggtcct

SEQ ID NO: 7794518 - DNA, 22 bp, Homo sapiens
tccaggcagtcattaatctcta

SEQ ID NO: 7794519 - DNA, 22 bp, Homo sapiens
tccaggcagttttccaggttgt

SEQ ID NO: 7794520 - DNA, 22 bp, Homo sapiens
tccaggcagggcagccatcaag

SEQ ID NO: 7794521 - DNA, 22 bp, Homo sapiens
tccaggagtttgagactgcagt

SEQ ID NO: 7794522 - DNA, 22 bp, Homo sapiens
tccaggcattggagagataatg

SEQ ID NO: 7794523 - DNA, 15 bp, Homo sapiens
tccaggcattcattc

SEQ ID NO: 7794524 - DNA, 22 bp, Homo sapiens
tccaggcattccagccattcca

SEQ ID NO: 7794525 - DNA, 22 bp, Homo sapiens
tccaggcatgttgggaagatga

SEQ ID NO: 7794526 - DNA, 22 bp, Homo sapiens
tccaggcatcccccaggacaga

SEQ ID NO: 7794527 - DNA, 22 bp, Homo sapiens
tccaggcatcccccaggacaga

SEQ ID NO: 7794528 - DNA, 17 bp, Homo sapiens
tccaggcatatctccta

SEQ ID NO: 7794529 - DNA, 16 bp, Homo sapiens
tccaggcatatctgag

SEQ ID NO: 7794530 - DNA, 23 bp, Homo sapiens
tccaggcatgagctctggatgga

SEQ ID NO: 7794531 - DNA, 22 bp, Homo sapiens
tccaggcatctgtattttttaa

SEQ ID NO: 7794532 - DNA, 19 bp, Homo sapiens
tccaggcatccttcaggct

SEQ ID NO: 7794533 - DNA, 22 bp, Homo sapiens
tccaggcatgtggccagtactc

SEQ ID NO: 7794534 - DNA, 22 bp, Homo sapiens
tccaggcatgtctgagtccttc

SEQ ID NO: 7794535 - DNA, 22 bp, Homo sapiens
tccaggcatgtcccaagccgga

SEQ ID NO: 7794536 - DNA, 22 bp, Homo sapiens
tccaggcatggtgtaattttgc

SEQ ID NO: 7794537 - DNA, 22 bp, Homo sapiens
tccaggctctaggctgctctcc

SEQ ID NO: 7794538 - DNA, 22 bp, Homo sapiens
tccaggctctaggctgctctcc

SEQ ID NO: 7794539 - DNA, 22 bp, Homo sapiens
tccaggccactgcagaggctct

SEQ ID NO: 7794540 - DNA, 22 bp, Homo sapiens
tccaggctaggtttacaggaca

SEQ ID NO: 7794541 - DNA, 22 bp, Homo sapiens
tccccacctaagatacccatct

SEQ ID NO: 7794542 - DNA, 22 bp, Homo sapiens
tccccacactttcactcctggc

SEQ ID NO: 7794543 - DNA, 22 bp, Homo sapiens
tcccagggttacagccagggca

SEQ ID NO: 7794544 - DNA, 22 bp, Homo sapiens
tcccagggtgaaatgcagtagg

SEQ ID NO: 7794545 - DNA, 22 bp, Homo sapiens
tcccagggtgcgcctgccctcg

SEQ ID NO: 7794546 - DNA, 21 bp, Homo sapiens
tcccagggtcttatgggatgt

SEQ ID NO: 7794547 - DNA, 22 bp, Homo sapiens
tcccagggattaggacatggat

SEQ ID NO: 7794548 - DNA, 22 bp, Homo sapiens
tcccagggactgggctaggctt

SEQ ID NO: 7794549 - DNA, 22 bp, Homo sapiens
tcccagggatcctccgggtcgc

SEQ ID NO: 7794550 - DNA, 22 bp, Homo sapiens
ggagactcgggttctagccttg

SEQ ID NO: 7794551 - DNA, 22 bp, Homo sapiens
ggagagaattccatggacatgt

SEQ ID NO: 7794552 - DNA, 22 bp, Homo sapiens
ggaccaggcaagctgaggcggg

SEQ ID NO: 7794553 - DNA, 22 bp, Homo sapiens
ggaccaggactggtggtatctc

SEQ ID NO: 7794554 - DNA, 18 bp, Homo sapiens
ggacatcatcaggtgctt

SEQ ID NO: 7794555 - DNA, 19 bp, Homo sapiens
ggaccaggtcctgggcagc

SEQ ID NO: 7794556 - DNA, 22 bp, Homo sapiens
ggacaggtgtgaggctggcaca

SEQ ID NO: 7794557 - DNA, 22 bp, Homo sapiens
ggaatcagatgaggggcagagc

SEQ ID NO: 7794558 - DNA, 22 bp, Homo sapiens
ggaatcagaattactgaatgga

SEQ ID NO: 7794559 - DNA, 20 bp, Homo sapiens
ggaatcagggtaatgtactg

SEQ ID NO: 7794560 - DNA, 22 bp, Homo sapiens
gctttattttgtgagggattac

SEQ ID NO: 7794561 - DNA, 22 bp, Homo sapiens
gctttattttgtgagggattac

SEQ ID NO: 7794562 - DNA, 22 bp, Homo sapiens
gctttattttgtgagggattac

SEQ ID NO: 7794563 - DNA, 22 bp, Homo sapiens
gctttcagggtcactgtcaaca

SEQ ID NO: 7794564 - DNA, 22 bp, Homo sapiens
gctttctgattgcgaaaacaaa

SEQ ID NO: 7794565 - DNA, 22 bp, Homo sapiens
gctttgctggcttgaaatgctg

SEQ ID NO: 7794566 - DNA, 22 bp, Homo sapiens
gctgtgtatcagatgccacggg

SEQ ID NO: 7794567 - DNA, 22 bp, Homo sapiens
gctgtgtatcagatgccacggg

SEQ ID NO: 7794568 - DNA, 22 bp, Homo sapiens
gcttctttccttgggctggaac

SEQ ID NO: 7794569 - DNA, 18 bp, Homo sapiens
gctttatttcttggggaa

SEQ ID NO: 7794570 - DNA, 18 bp, Homo sapiens
gctttatttcttggggaa

SEQ ID NO: 7794571 - DNA, 18 bp, Homo sapiens
gctttatttcttggggaa

SEQ ID NO: 7794572 - DNA, 22 bp, Homo sapiens
gcttgcctatctggtggtcgtt

SEQ ID NO: 7794573 - DNA, 21 bp, Homo sapiens
gctggcttcctgagggctgag

SEQ ID NO: 7794574 - DNA, 22 bp, Homo sapiens
gctggcttgacagaggcctggg

SEQ ID NO: 7794575 - DNA, 22 bp, Homo sapiens
gccttgtttcattacacgtggt

SEQ ID NO: 7794576 - DNA, 23 bp, Homo sapiens
gcgtccggcctctctcgctcccg

SEQ ID NO: 7794577 - DNA, 22 bp, Homo sapiens
gcgtccagggaaggcccagctg

SEQ ID NO: 7794578 - DNA, 22 bp, Homo sapiens
gcctgagctttaattttcttgt

SEQ ID NO: 7794579 - DNA, 22 bp, Homo sapiens
gctcagagttaaatatagtgct

SEQ ID NO: 7794580 - DNA, 22 bp, Homo sapiens
gctcagaggagcatcataagga

SEQ ID NO: 7794581 - DNA, 17 bp, Homo sapiens
gctcagagtacacgtgt

SEQ ID NO: 7794582 - DNA, 22 bp, Homo sapiens
gctcccaactcaggcctcctcc

SEQ ID NO: 7794583 - DNA, 22 bp, Homo sapiens
gctccaggtgtcccaggtaaaa

SEQ ID NO: 7794584 - DNA, 20 bp, Homo sapiens
gctccaggtcagagaggacg

SEQ ID NO: 7794585 - DNA, 22 bp, Homo sapiens
gctgcgccggatcccacgttcc

SEQ ID NO: 7794586 - DNA, 22 bp, Homo sapiens
gctgaggctcctcgggaggaca

SEQ ID NO: 7794587 - DNA, 22 bp, Homo sapiens
gctgaggctgggagcagcctgt

SEQ ID NO: 7794588 - DNA, 22 bp, Homo sapiens
gctgaggcctcagaaggctgag

SEQ ID NO: 7794589 - DNA, 22 bp, Homo sapiens
gctgaggctcaagtcatgggtc

SEQ ID NO: 7794590 - DNA, 20 bp, Homo sapiens
gcacagtttgggaaccatgg

SEQ ID NO: 7794591 - DNA, 22 bp, Homo sapiens
gcacagttgtgacaaccatcgc

SEQ ID NO: 7794592 - DNA, 22 bp, Homo sapiens
gcacagttaaagggtcatgtga

SEQ ID NO: 7794593 - DNA, 22 bp, Homo sapiens
gcagagcaccctgcagtggtat

SEQ ID NO: 7794594 - DNA, 22 bp, Homo sapiens
gcagagcaccctgcagtggtat

SEQ ID NO: 7794595 - DNA, 22 bp, Homo sapiens
gcagagcagtactctcttgact

SEQ ID NO: 7794596 - DNA, 22 bp, Homo sapiens
gcagagtggtttcagagttgag

SEQ ID NO: 7794597 - DNA, 22 bp, Homo sapiens
gcaaagcaagctgtcagcctca

SEQ ID NO: 7794598 - DNA, 22 bp, Homo sapiens
gcaaagcaagattcagatgtag

SEQ ID NO: 7794599 - DNA, 22 bp, Homo sapiens
gcaaagcaatcaggagtagcat

SEQ ID NO: 7794600 - DNA, 22 bp, Homo sapiens
gcaaagcacaccctcagagttt

SEQ ID NO: 7794601 - DNA, 22 bp, Homo sapiens
gcaaagctgggtgtgaatgcac

SEQ ID NO: 7794602 - DNA, 22 bp, Homo sapiens
gcaaagcatcagtagaaatgtt

SEQ ID NO: 7794603 - DNA, 22 bp, Homo sapiens
gcaaagcacactggagatgtcg

SEQ ID NO: 7794604 - DNA, 22 bp, Homo sapiens
gcaaagcagaaccctctctatc

SEQ ID NO: 7794605 - DNA, 22 bp, Homo sapiens
gcaaagcagtcttctgtgccta

SEQ ID NO: 7794606 - DNA, 22 bp, Homo sapiens
gcaaatacatgttgagcaccta

SEQ ID NO: 7794607 - DNA, 22 bp, Homo sapiens
gcaaatacatgttgagcaccta

SEQ ID NO: 7794608 - DNA, 22 bp, Homo sapiens
gcaaagtaaaaatagattctga

SEQ ID NO: 7794609 - DNA, 17 bp, Homo sapiens
gcaaaggtgaggagaga

SEQ ID NO: 7794610 - DNA, 22 bp, Homo sapiens
gcacacttaatactcactgtgc

SEQ ID NO: 7794611 - DNA, 22 bp, Homo sapiens
gcacagtgataggcagttgtgc

SEQ ID NO: 7794612 - DNA, 22 bp, Homo sapiens
gcaggcagttgcagttttctag

SEQ ID NO: 7794613 - DNA, 22 bp, Homo sapiens
gcaggcagtcatctttcatatt

SEQ ID NO: 7794614 - DNA, 22 bp, Homo sapiens
gcagggaaggggcatgctggag

SEQ ID NO: 7794615 - DNA, 19 bp, Homo sapiens
gcaggcagctggggtatcc

SEQ ID NO: 7794616 - DNA, 16 bp, Homo sapiens
gcaggcagatcacatg

SEQ ID NO: 7794617 - DNA, 22 bp, Homo sapiens
gcagggacctcactacccccag

SEQ ID NO: 7794618 - DNA, 22 bp, Homo sapiens
gcagggaccagggccagatcca

SEQ ID NO: 7794619 - DNA, 22 bp, Homo sapiens
gcagggacaactgtgcacctga

SEQ ID NO: 7794620 - DNA, 22 bp, Homo sapiens
gcagggacagggcagggccttt

SEQ ID NO: 7794621 - DNA, 22 bp, Homo sapiens
gcagggacatcttcagatcact

SEQ ID NO: 7794622 - DNA, 22 bp, Homo sapiens
gcagccctgcagctccacaccg

SEQ ID NO: 7794623 - DNA, 22 bp, Homo sapiens
gcagctttgtggagaggcccat

SEQ ID NO: 7794624 - DNA, 18 bp, Homo sapiens
gcagcttttgattcaccc

SEQ ID NO: 7794625 - DNA, 22 bp, Homo sapiens
gcagctttttggatgtcagtta

SEQ ID NO: 7794626 - DNA, 22 bp, Homo sapiens
gcagcctcaaactccccagctc

SEQ ID NO: 7794627 - DNA, 22 bp, Homo sapiens
gcagcctcaaactccccagctc

SEQ ID NO: 7794628 - DNA, 22 bp, Homo sapiens
gcagctttctgggacagaaagg

SEQ ID NO: 7794629 - DNA, 22 bp, Homo sapiens
gcagctttctttttgcatgtct

SEQ ID NO: 7794630 - DNA, 22 bp, Homo sapiens
gcagctttcttgccctaatctt

SEQ ID NO: 7794631 - DNA, 22 bp, Homo sapiens
gcagctttgtaaagtatgaagc

SEQ ID NO: 7794632 - DNA, 22 bp, Homo sapiens
gcagctttgtcacggagtgtcg

SEQ ID NO: 7794633 - DNA, 22 bp, Homo sapiens
gcagctttgaagacttatttgc

SEQ ID NO: 7794634 - DNA, 22 bp, Homo sapiens
gcagctttggaggtggaactct

SEQ ID NO: 7794635 - DNA, 22 bp, Homo sapiens
gcagctttctacttcctacagc

SEQ ID NO: 7794636 - DNA, 22 bp, Homo sapiens
gcagctttctgcaatgtcatcc

SEQ ID NO: 7794637 - DNA, 22 bp, Homo sapiens
gccaggcactgctctaagccct

SEQ ID NO: 7794638 - DNA, 22 bp, Homo sapiens
gccagctgacaccttgattttg

SEQ ID NO: 7794639 - DNA, 20 bp, Homo sapiens
gccaggcactgttctcaata

SEQ ID NO: 7794640 - DNA, 22 bp, Homo sapiens
gccaggcagagccccgtgcagc

SEQ ID NO: 7794641 - DNA, 22 bp, Homo sapiens
gccaggcagacaggtcatcagg

SEQ ID NO: 7794642 - DNA, 22 bp, Homo sapiens
gccagctcagtttcaaagtagg

SEQ ID NO: 7794643 - DNA, 22 bp, Homo sapiens
gccagctctcattgtataggct

SEQ ID NO: 7794644 - DNA, 22 bp, Homo sapiens
gccagccttctgtggcctgcaa

SEQ ID NO: 7794645 - DNA, 22 bp, Homo sapiens
gccaccccaacctccctaagtt

SEQ ID NO: 7794646 - DNA, 22 bp, Homo sapiens
gccacccccaagtaggtggtct

SEQ ID NO: 7794647 - DNA, 22 bp, Homo sapiens
gccaggcatgtcctctgcagaa

SEQ ID NO: 7794648 - DNA, 22 bp, Homo sapiens
gccaggcatgggcttctgggcg

SEQ ID NO: 7794649 - DNA, 18 bp, Homo sapiens
gccaggcagggtggggaa

SEQ ID NO: 7794650 - DNA, 22 bp, Homo sapiens
gccaggcagttcaagtacacca

SEQ ID NO: 7794651 - DNA, 22 bp, Homo sapiens
gccaggcaggtgtcggagccct

SEQ ID NO: 7794652 - DNA, 22 bp, Homo sapiens
gccaggcagctagcaacccctg

SEQ ID NO: 7794653 - DNA, 22 bp, Homo sapiens
gccaggcagctgggagggtgcc

SEQ ID NO: 7794654 - DNA, 22 bp, Homo sapiens
gccaggcaggccacgctgtgtt

SEQ ID NO: 7794655 - DNA, 22 bp, Homo sapiens
gccaggcagatatgtgagctta

SEQ ID NO: 7794656 - DNA, 22 bp, Homo sapiens
gccaggcagccaccctctgcga

SEQ ID NO: 7794657 - DNA, 22 bp, Homo sapiens
gccaggcagcagcgaggatggt

SEQ ID NO: 7794658 - DNA, 22 bp, Homo sapiens
gccaggcagcaggaagccagtg

SEQ ID NO: 7794659 - DNA, 22 bp, Homo sapiens
gcagtggccacatggaggagga

SEQ ID NO: 7794660 - DNA, 22 bp, Homo sapiens
gcagtgctttagtctgtccttt

SEQ ID NO: 7794661 - DNA, 22 bp, Homo sapiens
gcatggctggtgtcctgaggga

SEQ ID NO: 7794662 - DNA, 22 bp, Homo sapiens
gcatggctctggcctcagtgtg

SEQ ID NO: 7794663 - DNA, 22 bp, Homo sapiens
gcatggctcctgtcttactccc

SEQ ID NO: 7794664 - DNA, 22 bp, Homo sapiens
gcatggctattatgaggcagaa

SEQ ID NO: 7794665 - DNA, 22 bp, Homo sapiens
gcatggctgttgaagtcagctc

SEQ ID NO: 7794666 - DNA, 22 bp, Homo sapiens
gccaccaggagcccagtccaaa

SEQ ID NO: 7794667 - DNA, 22 bp, Homo sapiens
gccccaccttgagagcagaaac

SEQ ID NO: 7794668 - DNA, 22 bp, Homo sapiens
gccccacctgctaccttccagc

SEQ ID NO: 7794669 - DNA, 22 bp, Homo sapiens
gcccagctggcttccagcacat

SEQ ID NO: 7794670 - DNA, 22 bp, Homo sapiens
gcccagcttttcacttccacac

SEQ ID NO: 7794671 - DNA, 22 bp, Homo sapiens
gcccagcacattgctgaggacc

SEQ ID NO: 7794672 - DNA, 22 bp, Homo sapiens
gcctcctgacttacactgagct

SEQ ID NO: 7794673 - DNA, 22 bp, Homo sapiens
gcctcctggaagtcacatgttt

SEQ ID NO: 7794674 - DNA, 22 bp, Homo sapiens
gcctcctggggtgccatcatct

SEQ ID NO: 7794675 - DNA, 22 bp, Homo sapiens
gcctcctggcctttgctcctca

SEQ ID NO: 7794676 - DNA, 22 bp, Homo sapiens
gcctcctggttgcttctccaac

SEQ ID NO: 7794677 - DNA, 22 bp, Homo sapiens
gcctcctgaaaggaagagctcc

SEQ ID NO: 7794678 - DNA, 22 bp, Homo sapiens
gcctccggagttgcagtgtctt

SEQ ID NO: 7794679 - DNA, 22 bp, Homo sapiens
gcctccggagtcacagtgtctt

SEQ ID NO: 7794680 - DNA, 22 bp, Homo sapiens
gtcatttttgactttgaagtga

SEQ ID NO: 7794681 - DNA, 22 bp, Homo sapiens
gtccagaaagggcagtgatttg

SEQ ID NO: 7794682 - DNA, 23 bp, Homo sapiens
gtccagaacccaggctggggtgg

SEQ ID NO: 7794683 - DNA, 22 bp, Homo sapiens
gtccacagagggctgggcaggc

SEQ ID NO: 7794684 - DNA, 22 bp, Homo sapiens
gtccacccatgacacctgcctg

SEQ ID NO: 7794685 - DNA, 22 bp, Homo sapiens
ggtttcaacttcaacctctcca

SEQ ID NO: 7794686 - DNA, 22 bp, Homo sapiens
ggtttcaacttttgtgaggaat

SEQ ID NO: 7794687 - DNA, 22 bp, Homo sapiens
ggtttcaaattaaagtcttaag

SEQ ID NO: 7794688 - DNA, 22 bp, Homo sapiens
ggtttcaactaaatcaagaagg

SEQ ID NO: 7794689 - DNA, 22 bp, Homo sapiens
ggtttcaactcagctagtaagg

SEQ ID NO: 7794690 - DNA, 22 bp, Homo sapiens
ggtttcaatgagaagtgcttgt

SEQ ID NO: 7794691 - DNA, 22 bp, Homo sapiens
gtacatttctcccaacactaaa

SEQ ID NO: 7794692 - DNA, 22 bp, Homo sapiens
gtacccaggcacgccttgctga

SEQ ID NO: 7794693 - DNA, 22 bp, Homo sapiens
gtacccagaggcatgatcccag

SEQ ID NO: 7794694 - DNA, 22 bp, Homo sapiens
gtacatttatttttgcagcata

SEQ ID NO: 7794695 - DNA, 22 bp, Homo sapiens
gtaaaactgtctaatggtatat

SEQ ID NO: 7794696 - DNA, 22 bp, Homo sapiens
gtattaggttggtgcaaaattg

SEQ ID NO: 7794697 - DNA, 22 bp, Homo sapiens
gtattaggttggtgcaaaagta

SEQ ID NO: 7794698 - DNA, 20 bp, Homo sapiens
gtattaggtgttcctctttc

SEQ ID NO: 7794699 - DNA, 22 bp, Homo sapiens
gtattagactgagaaatggagt

SEQ ID NO: 7794700 - DNA, 22 bp, Homo sapiens
gtattaggtggtggaattgtag

SEQ ID NO: 7794701 - DNA, 22 bp, Homo sapiens
gtattagggccaaaggcaggaa

SEQ ID NO: 7794702 - DNA, 22 bp, Homo sapiens
gtattaggaggtggagcctttg

SEQ ID NO: 7794703 - DNA, 20 bp, Homo sapiens
gtattaggaggtaaatgtaa

SEQ ID NO: 7794704 - DNA, 22 bp, Homo sapiens
gtattaggaggaacacaggcct

SEQ ID NO: 7794705 - DNA, 22 bp, Homo sapiens
gtattaggaaatatgaagaaag

SEQ ID NO: 7794706 - DNA, 22 bp, Homo sapiens
gtattcttggttatcaaaatac

SEQ ID NO: 7794707 - DNA, 22 bp, Homo sapiens
gtattcttaaggattgagcaaa

SEQ ID NO: 7794708 - DNA, 22 bp, Homo sapiens
gtattcttatactcagtgagct

SEQ ID NO: 7794709 - DNA, 22 bp, Homo sapiens
gtgagcagcctcacctgagggt

SEQ ID NO: 7794710 - DNA, 23 bp, Homo sapiens
gtgagcagcccactaggaatgcc

SEQ ID NO: 7794711 - DNA, 22 bp, Homo sapiens
gtgcagtgtgtaatccaggaac

SEQ ID NO: 7794712 - DNA, 22 bp, Homo sapiens
gtgcattccaccgtgcaggttg

SEQ ID NO: 7794713 - DNA, 22 bp, Homo sapiens
gtgcagtgaccctggagagctg

SEQ ID NO: 7794714 - DNA, 22 bp, Homo sapiens
gtgcagtggcagatcctagctc

SEQ ID NO: 7794715 - DNA, 22 bp, Homo sapiens
gtgaacaggagaaagtgatgga

SEQ ID NO: 7794716 - DNA, 22 bp, Homo sapiens
gtgaaaataaggctggttcttg

SEQ ID NO: 7794717 - DNA, 22 bp, Homo sapiens
ggggctgagtcagtgggaagag

SEQ ID NO: 7794718 - DNA, 22 bp, Homo sapiens
ggggctccagtcttcacatttt

SEQ ID NO: 7794719 - DNA, 22 bp, Homo sapiens
ggggctcagttcggacagcctg

SEQ ID NO: 7794720 - DNA, 22 bp, Homo sapiens
ggggtgggcgtgcagggacacc

SEQ ID NO: 7794721 - DNA, 22 bp, Homo sapiens
gggtaggcaaagcaatgacgtt

SEQ ID NO: 7794722 - DNA, 22 bp, Homo sapiens
gggtggagcttggacaccagta

SEQ ID NO: 7794723 - DNA, 22 bp, Homo sapiens
gggctgatgtgctcccaggtgg

SEQ ID NO: 7794724 - DNA, 22 bp, Homo sapiens
gggcttcttgccatggggacgg

SEQ ID NO: 7794725 - DNA, 22 bp, Homo sapiens
gggcttcttgcaggggcaacat

SEQ ID NO: 7794726 - DNA, 22 bp, Homo sapiens
ggtgtggggaggttctgcttct

SEQ ID NO: 7794727 - DNA, 22 bp, Homo sapiens
ggtgttgggctcactggtcctt

SEQ ID NO: 7794728 - DNA, 22 bp, Homo sapiens
ggtgttcaaatgaacacatgca

SEQ ID NO: 7794729 - DNA, 22 bp, Homo sapiens
ggtttattaatgtgaactgtat

SEQ ID NO: 7794730 - DNA, 22 bp, Homo sapiens
ggtttcaaagtggacagttagt

SEQ ID NO: 7794731 - DNA, 22 bp, Homo sapiens
ggtcacatggttgagcttgatc

SEQ ID NO: 7794732 - DNA, 22 bp, Homo sapiens
ggtcactggtctctgcttccat

SEQ ID NO: 7794733 - DNA, 22 bp, Homo sapiens
ggtcactgccctcccttttgca

SEQ ID NO: 7794734 - DNA, 22 bp, Homo sapiens
ggtcactccaccttctccacct

SEQ ID NO: 7794735 - DNA, 18 bp, Homo sapiens
ggtcactgagatgctact

SEQ ID NO: 7794736 - DNA, 22 bp, Homo sapiens
ggtcactgagctgtaattctgt

SEQ ID NO: 7794737 - DNA, 22 bp, Homo sapiens
ggtaggggaagacaagtgaaaa

SEQ ID NO: 7794738 - DNA, 22 bp, Homo sapiens
ggtctctgacttagagatggat

SEQ ID NO: 7794739 - DNA, 22 bp, Homo sapiens
ggtctcctgaggctgccacacc

SEQ ID NO: 7794740 - DNA, 22 bp, Homo sapiens
ggtctccttgggaaagcaggaa

SEQ ID NO: 7794741 - DNA, 22 bp, Homo sapiens
ggtctcagaggtttctgctcag

SEQ ID NO: 7794742 - DNA, 22 bp, Homo sapiens
ggtctagagtggggcctggaaa

SEQ ID NO: 7794743 - DNA, 22 bp, Homo sapiens
ggcatgggccgaggtgcctcct

SEQ ID NO: 7794744 - DNA, 22 bp, Homo sapiens
ggccagggggcttcagactcca

SEQ ID NO: 7794745 - DNA, 20 bp, Homo sapiens
ggcatgggtggggctcccag

SEQ ID NO: 7794746 - DNA, 22 bp, Homo sapiens
ggcctttgcgtccacgccgctt

SEQ ID NO: 7794747 - DNA, 22 bp, Homo sapiens
ggcctgacttgatcggctctct

SEQ ID NO: 7794748 - DNA, 22 bp, Homo sapiens
ggcctgacatttgcatcaacac

SEQ ID NO: 7794749 - DNA, 22 bp, Homo sapiens
ggcctgactgacctgattctaa

SEQ ID NO: 7794750 - DNA, 22 bp, Homo sapiens
ggcctgagggtgggctctcagt

SEQ ID NO: 7794751 - DNA, 22 bp, Homo sapiens
ggcctgagtcccacctggctgt

SEQ ID NO: 7794752 - DNA, 22 bp, Homo sapiens
ggcctgatctttgaccctcatc

SEQ ID NO: 7794753 - DNA, 22 bp, Homo sapiens
ggcctcagagaaggctgtgcgg

SEQ ID NO: 7794754 - DNA, 22 bp, Homo sapiens
ggccatggaccccgagctgacc

SEQ ID NO: 7794755 - DNA, 22 bp, Homo sapiens
ggcagaggtagctggaaccagg

SEQ ID NO: 7794756 - DNA, 22 bp, Homo sapiens
ggcacagctcaggtcccagctc

SEQ ID NO: 7794757 - DNA, 22 bp, Homo sapiens
ggcaaacagacttgaccatctt

SEQ ID NO: 7794758 - DNA, 22 bp, Homo sapiens
ggcaaacaccaggcgagggagc

SEQ ID NO: 7794759 - DNA, 22 bp, Homo sapiens
ggcaaacacacctcggtgagaa

SEQ ID NO: 7794760 - DNA, 22 bp, Homo sapiens
ggcaaacaggagagtaaagaga

SEQ ID NO: 7794761 - DNA, 22 bp, Homo sapiens
ggcaagaggtccaagaggtctc

SEQ ID NO: 7794762 - DNA, 22 bp, Homo sapiens
ggcaagagggcagatggagtgc

SEQ ID NO: 7794763 - DNA, 22 bp, Homo sapiens
ggagtattgtagcttccagttc

SEQ ID NO: 7794764 - DNA, 22 bp, Homo sapiens
gggattgaattgggggatcaca

SEQ ID NO: 7794765 - DNA, 22 bp, Homo sapiens
gggcaggagaaggtggatgtcc

SEQ ID NO: 7794766 - DNA, 22 bp, Homo sapiens
gggacaggctgagacttgagct

SEQ ID NO: 7794767 - DNA, 22 bp, Homo sapiens
gggacatgaagcatcggaggca

SEQ ID NO: 7794768 - DNA, 23 bp, Homo sapiens
gggaccagctagggctgtgacct

SEQ ID NO: 7794769 - DNA, 22 bp, Homo sapiens
gggaccagaggctgtgcacaat

SEQ ID NO: 7794770 - DNA, 22 bp, Homo sapiens
gggaccagaagaaggatggtga

SEQ ID NO: 7794771 - DNA, 22 bp, Homo sapiens
gggaccagaagaaggatggtga

SEQ ID NO: 7794772 - DNA, 22 bp, Homo sapiens
gggacatggaggcgcgcaggca

SEQ ID NO: 7794773 - DNA, 22 bp, Homo sapiens
ggcttgggagcaggcatgtgac

SEQ ID NO: 7794774 - DNA, 22 bp, Homo sapiens
gggacaggcaaaggtatgcttc

SEQ ID NO: 7794775 - DNA, 22 bp, Homo sapiens
gggagctgtaagggacaggtag

SEQ ID NO: 7794776 - DNA, 22 bp, Homo sapiens
ggctggcttgccaagctcaggg

SEQ ID NO: 7794777 - DNA, 22 bp, Homo sapiens
ggctccactgctgaccactcca

SEQ ID NO: 7794778 - DNA, 22 bp, Homo sapiens
ggctccaccctgcttccagaag

SEQ ID NO: 7794779 - DNA, 22 bp, Homo sapiens
gaagagaaaggcaaggagtttt

SEQ ID NO: 7794780 - DNA, 22 bp, Homo sapiens
gaagattgaaggctgggaatta

SEQ ID NO: 7794781 - DNA, 22 bp, Homo sapiens
gaacatttggatttgtaaattt

SEQ ID NO: 7794782 - DNA, 22 bp, Homo sapiens
gaaatatttctcttgagcccct

SEQ ID NO: 7794783 - DNA, 22 bp, Homo sapiens
ctttcataaaggaaatgatgag

SEQ ID NO: 7794784 - DNA, 22 bp, Homo sapiens
ctttcagtcagttaactcagaa

SEQ ID NO: 7794785 - DNA, 22 bp, Homo sapiens
ctttcagtctttacaaggttgc

SEQ ID NO: 7794786 - DNA, 22 bp, Homo sapiens
gaccctggtgtccaggtcctgc

SEQ ID NO: 7794787 - DNA, 22 bp, Homo sapiens
gacccagtgactcgtctctgtg

SEQ ID NO: 7794788 - DNA, 22 bp, Homo sapiens
gacaggttgaagtatcaaaggt

SEQ ID NO: 7794789 - DNA, 22 bp, Homo sapiens
gacagggaaacattgaagtgtc

SEQ ID NO: 7794790 - DNA, 22 bp, Homo sapiens
gacaagctcttgtttcatggtt

SEQ ID NO: 7794791 - DNA, 22 bp, Homo sapiens
gacaagattaaccatagttaag

SEQ ID NO: 7794792 - DNA, 22 bp, Homo sapiens
gacaagctcttgtttcatggtt

SEQ ID NO: 7794793 - DNA, 22 bp, Homo sapiens
gacaagctcgcctgccccggaa

SEQ ID NO: 7794794 - DNA, 22 bp, Homo sapiens
gacaagctcccggtggccctcc

SEQ ID NO: 7794795 - DNA, 18 bp, Homo sapiens
gaatatctagcacatagt

SEQ ID NO: 7794796 - DNA, 22 bp, Homo sapiens
gaagttttagtcaaaatgtaga

SEQ ID NO: 7794797 - DNA, 22 bp, Homo sapiens
gaagttttctgaggctgtagct

SEQ ID NO: 7794798 - DNA, 22 bp, Homo sapiens
gaagcctcaacatctctgcgtc

SEQ ID NO: 7794799 - DNA, 22 bp, Homo sapiens
gagatggaatctgtgtggaggg

SEQ ID NO: 7794800 - DNA, 22 bp, Homo sapiens
gagatgtttagggtggggagag

SEQ ID NO: 7794801 - DNA, 22 bp, Homo sapiens
gagatttaattggattaactta

SEQ ID NO: 7794802 - DNA, 22 bp, Homo sapiens
gagccaccttcaactcaggaat

SEQ ID NO: 7794803 - DNA, 17 bp, Homo sapiens
gagccaccctgtgcgag

SEQ ID NO: 7794804 - DNA, 22 bp, Homo sapiens
gagccagggctgtgagctgagc

SEQ ID NO: 7794805 - DNA, 22 bp, Homo sapiens
gagccagggtttgaaactagac

SEQ ID NO: 7794806 - DNA, 22 bp, Homo sapiens
gacctcagtgaatggtcatgta

SEQ ID NO: 7794807 - DNA, 18 bp, Homo sapiens
gagaaggccacttgtttt

SEQ ID NO: 7794808 - DNA, 22 bp, Homo sapiens
gagaaggcttccaaattctgtg

SEQ ID NO: 7794809 - DNA, 22 bp, Homo sapiens
gagaagggggctcgagtgtcct

SEQ ID NO: 7794810 - DNA, 22 bp, Homo sapiens
gagaatgggaatgaaagtagca

SEQ ID NO: 7794811 - DNA, 22 bp, Homo sapiens
gagaatgttaatgttgaagtat

SEQ ID NO: 7794812 - DNA, 22 bp, Homo sapiens
gagaggctgggttggagatcga

SEQ ID NO: 7794813 - DNA, 22 bp, Homo sapiens
gaggagctgttccctcacctct

SEQ ID NO: 7794814 - DNA, 22 bp, Homo sapiens
gaggaaaatattcagggaggtt

SEQ ID NO: 7794815 - DNA, 22 bp, Homo sapiens
gaggaaaataacaactaagggc

SEQ ID NO: 7794816 - DNA, 22 bp, Homo sapiens
gaggaggaagttctctgtaggc

SEQ ID NO: 7794817 - DNA, 22 bp, Homo sapiens
gaggcaaggccgcacgtctcag

SEQ ID NO: 7794818 - DNA, 22 bp, Homo sapiens
gagcttcatatgttgcagagaa

SEQ ID NO: 7794819 - DNA, 22 bp, Homo sapiens
gagcttcagctgccatgactgt

SEQ ID NO: 7794820 - DNA, 22 bp, Homo sapiens
gagctgaacatcatggaaaggc

SEQ ID NO: 7794821 - DNA, 22 bp, Homo sapiens
gagctgaagcgctacagcatcc

SEQ ID NO: 7794822 - DNA, 18 bp, Homo sapiens
gagctgagaagaggatgc

SEQ ID NO: 7794823 - DNA, 22 bp, Homo sapiens
gagctgagacacactttggcaa

SEQ ID NO: 7794824 - DNA, 19 bp, Homo sapiens
gagctgagagtagcactgg

SEQ ID NO: 7794825 - DNA, 22 bp, Homo sapiens
gagctgaattacggtgagtcat

SEQ ID NO: 7794826 - DNA, 22 bp, Homo sapiens
gagctgaatcagagatattatt

SEQ ID NO: 7794827 - DNA, 22 bp, Homo sapiens
gagctgaaggagaaagcagggg

SEQ ID NO: 7794828 - DNA, 22 bp, Homo sapiens
gagctctgatgtttagtggaga

SEQ ID NO: 7794829 - DNA, 22 bp, Homo sapiens
gagcctcctcctggtgtgccga

SEQ ID NO: 7794830 - DNA, 22 bp, Homo sapiens
gagcctcgtggcggccactgcg

SEQ ID NO: 7794831 - DNA, 22 bp, Homo sapiens
gagcctgatgaaacaggcagac

SEQ ID NO: 7794832 - DNA, 22 bp, Homo sapiens
cttcagtgaatgttgagtaagg

SEQ ID NO: 7794833 - DNA, 22 bp, Homo sapiens
ctgtttaaccagatctcatatc

SEQ ID NO: 7794834 - DNA, 22 bp, Homo sapiens
ctgttgtcttcattgtcatatc

SEQ ID NO: 7794835 - DNA, 22 bp, Homo sapiens
cttattggagagttgggccctt

SEQ ID NO: 7794836 - DNA, 22 bp, Homo sapiens
cttattggtgctttttctcata

SEQ ID NO: 7794837 - DNA, 22 bp, Homo sapiens
cttattggtggagtcaggccct

SEQ ID NO: 7794838 - DNA, 22 bp, Homo sapiens
cttattggtcccaggaggagaa

SEQ ID NO: 7794839 - DNA, 22 bp, Homo sapiens
cttattgggatgagaggatgca

SEQ ID NO: 7794840 - DNA, 22 bp, Homo sapiens
cttcaaaagccagaagcctgcg

SEQ ID NO: 7794841 - DNA, 22 bp, Homo sapiens
cttattttgctgatgacccagg

SEQ ID NO: 7794842 - DNA, 22 bp, Homo sapiens
cttattttgctgatgacccagg

SEQ ID NO: 7794843 - DNA, 22 bp, Homo sapiens
cttattttgctgatgacccagg

SEQ ID NO: 7794844 - DNA, 22 bp, Homo sapiens
cttattttgctgatgacccagg

SEQ ID NO: 7794845 - DNA, 22 bp, Homo sapiens
cttattttgctgatgacccagg

SEQ ID NO: 7794846 - DNA, 22 bp, Homo sapiens
cttattttaagtcagtttgggt

SEQ ID NO: 7794847 - DNA, 22 bp, Homo sapiens
cttattttaagtcagtttgggt

SEQ ID NO: 7794848 - DNA, 22 bp, Homo sapiens
cttattttaagtcagtttgggt

SEQ ID NO: 7794849 - DNA, 19 bp, Homo sapiens
cttcctggaggagagcctc

SEQ ID NO: 7794850 - DNA, 22 bp, Homo sapiens
cttcctggatgaacagtagaaa

SEQ ID NO: 7794851 - DNA, 22 bp, Homo sapiens
cttcctggatgagcaggctgat

SEQ ID NO: 7794852 - DNA, 22 bp, Homo sapiens
cttcctgggtcagcctggaggt

SEQ ID NO: 7794853 - DNA, 22 bp, Homo sapiens
cttcctggcatgggtctcatga

SEQ ID NO: 7794854 - DNA, 22 bp, Homo sapiens
cttcctggccattgccatggca

SEQ ID NO: 7794855 - DNA, 22 bp, Homo sapiens
cttcctggctcggtgcctcacc

SEQ ID NO: 7794856 - DNA, 22 bp, Homo sapiens
cttcctggctcggtgcctcacc

SEQ ID NO: 7794857 - DNA, 22 bp, Homo sapiens
cttcctgggcaatgttctgctt

SEQ ID NO: 7794858 - DNA, 22 bp, Homo sapiens
cttgatttattacccactatat

SEQ ID NO: 7794859 - DNA, 22 bp, Homo sapiens
cttgatttcagccttgtgatat

SEQ ID NO: 7794860 - DNA, 22 bp, Homo sapiens
cttgccagtgttgcagaagctc

SEQ ID NO: 7794861 - DNA, 22 bp, Homo sapiens
cttgccagcacttggccagctg

SEQ ID NO: 7794862 - DNA, 22 bp, Homo sapiens
cttgtattcagagtggacatga

SEQ ID NO: 7794863 - DNA, 22 bp, Homo sapiens
cttgtattgcaaactggccagg

SEQ ID NO: 7794864 - DNA, 22 bp, Homo sapiens
cttgtcctttacttgagactca

SEQ ID NO: 7794865 - DNA, 22 bp, Homo sapiens
ctgttcagaaaaaatcttcatg

SEQ ID NO: 7794866 - DNA, 18 bp, Homo sapiens
ctgttcagctgaactaca

SEQ ID NO: 7794867 - DNA, 22 bp, Homo sapiens
ctgttcagtaacctataaaaca

SEQ ID NO: 7794868 - DNA, 22 bp, Homo sapiens
ctgttctatcattaaaagctat

SEQ ID NO: 7794869 - DNA, 22 bp, Homo sapiens
ctgtgccaggcccagctgactt

SEQ ID NO: 7794870 - DNA, 22 bp, Homo sapiens
ctgtcctgcccaccctgcaggg

SEQ ID NO: 7794871 - DNA, 20 bp, Homo sapiens
ctgtcctgatcttttcagaa

SEQ ID NO: 7794872 - DNA, 21 bp, Homo sapiens
ctgtcctggtctagaggcaca

SEQ ID NO: 7794873 - DNA, 22 bp, Homo sapiens
ctgtcctggagggcataggacg

SEQ ID NO: 7794874 - DNA, 22 bp, Homo sapiens
ctgggaggcaccgcgtcgtgct

SEQ ID NO: 7794875 - DNA, 22 bp, Homo sapiens
ctggctgtgctgactgagaggg

SEQ ID NO: 7794876 - DNA, 22 bp, Homo sapiens
ctggctttctctgtggtgttca

SEQ ID NO: 7794877 - DNA, 22 bp, Homo sapiens
ctgggaggcagtctctctagaa

SEQ ID NO: 7794878 - DNA, 22 bp, Homo sapiens
ctgggaggcccacgttgggaag

SEQ ID NO: 7794879 - DNA, 22 bp, Homo sapiens
ctggccctcggagtccagctgc

SEQ ID NO: 7794880 - DNA, 22 bp, Homo sapiens
ctggctgtgcagtcttccagaa

SEQ ID NO: 7794881 - DNA, 22 bp, Homo sapiens
ctggcaggagcattcacagagg

SEQ ID NO: 7794882 - DNA, 22 bp, Homo sapiens
ctggcaggcagacttctgcaag

SEQ ID NO: 7794883 - DNA, 22 bp, Homo sapiens
ctggcaggaagaggaaaggtca

SEQ ID NO: 7794884 - DNA, 22 bp, Homo sapiens
ctgcacaggggatgagggcagt

SEQ ID NO: 7794885 - DNA, 22 bp, Homo sapiens
ctgcacagctgggcaagatata

SEQ ID NO: 7794886 - DNA, 22 bp, Homo sapiens
ctgcaggggcctcgagcacagg

SEQ ID NO: 7794887 - DNA, 19 bp, Homo sapiens
ctgcagggatgtgcagagt

SEQ ID NO: 7794888 - DNA, 22 bp, Homo sapiens
ctgcagggatgtgaggcccgtt

SEQ ID NO: 7794889 - DNA, 22 bp, Homo sapiens
ctgcagggcagaagggcataga

SEQ ID NO: 7794890 - DNA, 22 bp, Homo sapiens
ctgagccagggccacacatgga

SEQ ID NO: 7794891 - DNA, 20 bp, Homo sapiens
ctgagccaactctcttcttg

SEQ ID NO: 7794892 - DNA, 22 bp, Homo sapiens
ctgagccatgggtctaagcact

SEQ ID NO: 7794893 - DNA, 17 bp, Homo sapiens
ctgagccccgggcagct

SEQ ID NO: 7794894 - DNA, 20 bp, Homo sapiens
ctgagcccccagcctgcagg

SEQ ID NO: 7794895 - DNA, 22 bp, Homo sapiens
ctgagcccgggtgctctacccc

SEQ ID NO: 7794896 - DNA, 22 bp, Homo sapiens
ctgagcccaggcgggagctgag

SEQ ID NO: 7794897 - DNA, 20 bp, Homo sapiens
ctgagcccagatcccaggtc

SEQ ID NO: 7794898 - DNA, 22 bp, Homo sapiens
ctgagcccttgaacccaagtcc

SEQ ID NO: 7794899 - DNA, 22 bp, Homo sapiens
ctgagccctctgttttccctct

SEQ ID NO: 7794900 - DNA, 22 bp, Homo sapiens
ctgagccctggctcgcctggag

SEQ ID NO: 7794901 - DNA, 22 bp, Homo sapiens
ctgaggcagagggcagaccaga

SEQ ID NO: 7794902 - DNA, 22 bp, Homo sapiens
ctgagcctcctgcttctatttc

SEQ ID NO: 7794903 - DNA, 22 bp, Homo sapiens
ctgagcctcctgcttctatttc

SEQ ID NO: 7794904 - DNA, 21 bp, Homo sapiens
ctctttatatagtaaagatat

SEQ ID NO: 7794905 - DNA, 17 bp, Homo sapiens
ctctttataaagagtta

SEQ ID NO: 7794906 - DNA, 22 bp, Homo sapiens
ctctttctcgccgcccgcagtc

SEQ ID NO: 7794907 - DNA, 22 bp, Homo sapiens
ctgaccaacatggtgaaacctt

SEQ ID NO: 7794908 - DNA, 22 bp, Homo sapiens
ctctgtttctcagcctatttcc

SEQ ID NO: 7794909 - DNA, 22 bp, Homo sapiens
ttttagttactgcagtagcaaa

SEQ ID NO: 7794910 - DNA, 23 bp, Homo sapiens
ttttagtgactcctttatctgcc

SEQ ID NO: 7794911 - DNA, 22 bp, Homo sapiens
ttttagctgttgattgttcccc

SEQ ID NO: 7794912 - DNA, 22 bp, Homo sapiens
ttttaatactgctattgtagga

SEQ ID NO: 7794913 - DNA, 22 bp, Homo sapiens
tttgttctgaaaactcaagtcc

SEQ ID NO: 7794914 - DNA, 22 bp, Homo sapiens
tttgtacatatataaaatctgt

SEQ ID NO: 7794915 - DNA, 22 bp, Homo sapiens
tttgtacactgtctactatgaa

SEQ ID NO: 7794916 - DNA, 22 bp, Homo sapiens
ctctgcagattcatcccttcac

SEQ ID NO: 7794917 - DNA, 22 bp, Homo sapiens
ctctgccactcgaagtcaagga

SEQ ID NO: 7794918 - DNA, 22 bp, Homo sapiens
ttctttcttagcaatctatggt

SEQ ID NO: 7794919 - DNA, 22 bp, Homo sapiens
ttcttttcggcctgtgagaagg

SEQ ID NO: 7794920 - DNA, 22 bp, Homo sapiens
ttgaaatactgcattgttcagt

SEQ ID NO: 7794921 - DNA, 22 bp, Homo sapiens
ttggtcagctaataaggacagg

SEQ ID NO: 7794922 - DNA, 22 bp, Homo sapiens
ttgtacaaaggatttggaagag

SEQ ID NO: 7794923 - DNA, 22 bp, Homo sapiens
ttgtacaaataggaacctctga

SEQ ID NO: 7794924 - DNA, 22 bp, Homo sapiens
ttgtacaaagatttcacagctc

SEQ ID NO: 7794925 - DNA, 22 bp, Homo sapiens
ttgtacaagtattatgtgaaca

SEQ ID NO: 7794926 - DNA, 22 bp, Homo sapiens
ttgtacaacgttttaaatttga

SEQ ID NO: 7794927 - DNA, 22 bp, Homo sapiens
ttgtacaaatgcatattcctgg

SEQ ID NO: 7794928 - DNA, 22 bp, Homo sapiens
ttgtacaacacatattctacag

SEQ ID NO: 7794929 - DNA, 22 bp, Homo sapiens
ctccatggctttcgcatctgca

SEQ ID NO: 7794930 - DNA, 22 bp, Homo sapiens
tttaatatctcacacttccatg

SEQ ID NO: 7794931 - DNA, 22 bp, Homo sapiens
tttaatatttctttcctgaagc

SEQ ID NO: 7794932 - DNA, 22 bp, Homo sapiens
tttaagttccttttcaacaact

SEQ ID NO: 7794933 - DNA, 22 bp, Homo sapiens
ctcccaagctgtgctgaactgt

SEQ ID NO: 7794934 - DNA, 22 bp, Homo sapiens
ctcccaagataaataaggcagt

SEQ ID NO: 7794935 - DNA, 22 bp, Homo sapiens
ctcccagagaccaagctgagaa

SEQ ID NO: 7794936 - DNA, 22 bp, Homo sapiens
ctcctggcactcagtgtggaag

SEQ ID NO: 7794937 - DNA, 22 bp, Homo sapiens
ctcctggcactcagtgtggaag

SEQ ID NO: 7794938 - DNA, 22 bp, Homo sapiens
ctcctggatgcaggctgtctgc

SEQ ID NO: 7794939 - DNA, 22 bp, Homo sapiens
ctcctggcagttccccttgtca

SEQ ID NO: 7794940 - DNA, 22 bp, Homo sapiens
ctcctggcagttccccttgtca

SEQ ID NO: 7794941 - DNA, 17 bp, Homo sapiens
ctcctggccacccctct

SEQ ID NO: 7794942 - DNA, 22 bp, Homo sapiens
ctcctggccacgttcttgctgg

SEQ ID NO: 7794943 - DNA, 22 bp, Homo sapiens
ctcctggccccagatcccaatc

SEQ ID NO: 7794944 - DNA, 17 bp, Homo sapiens
ctcctggcagcctcagg

SEQ ID NO: 7794945 - DNA, 22 bp, Homo sapiens
ctcctggcaggctgagtgaaat

SEQ ID NO: 7794946 - DNA, 22 bp, Homo sapiens
ctcctggcaggctgagtgaaat

SEQ ID NO: 7794947 - DNA, 22 bp, Homo sapiens
ctcctggcactgtcttgaccca

SEQ ID NO: 7794948 - DNA, 22 bp, Homo sapiens
ctcctggcactgtcttgaccca

SEQ ID NO: 7794949 - DNA, 22 bp, Homo sapiens
ctcctggcagcaacatttatat

SEQ ID NO: 7794950 - DNA, 18 bp, Homo sapiens
ctcctccacagcccctgc

SEQ ID NO: 7794951 - DNA, 22 bp, Homo sapiens
tttaggcagtcattgaacaagt

SEQ ID NO: 7794952 - DNA, 22 bp, Homo sapiens
tttaatctattccctaaacacc

SEQ ID NO: 7794953 - DNA, 23 bp, Homo sapiens
ctccccagtgtcctcatgcatct

SEQ ID NO: 7794954 - DNA, 21 bp, Homo sapiens
tttagggaggatatttaactt

SEQ ID NO: 7794955 - DNA, 22 bp, Homo sapiens
tttagggatgtcagaacaggga

SEQ ID NO: 7794956 - DNA, 22 bp, Homo sapiens
tttaggttcttggaatcagtct

SEQ ID NO: 7794957 - DNA, 22 bp, Homo sapiens
tttagggaaattgagggttaag

SEQ ID NO: 7794958 - DNA, 22 bp, Homo sapiens
tttagggacaagggtctggggt

SEQ ID NO: 7794959 - DNA, 21 bp, Homo sapiens
tttagggaccaggtcataggc

SEQ ID NO: 7794960 - DNA, 22 bp, Homo sapiens
tttagggaagaagcccatggcc

SEQ ID NO: 7794961 - DNA, 22 bp, Homo sapiens
tttagggaatagaagatctgaa

SEQ ID NO: 7794962 - DNA, 22 bp, Homo sapiens
tttagtagaatgatacagggca

SEQ ID NO: 7794963 - DNA, 22 bp, Homo sapiens
tttagtatataaaaagagaagt

SEQ ID NO: 7794964 - DNA, 22 bp, Homo sapiens
tttccagagcatgtctgctcag

SEQ ID NO: 7794965 - DNA, 22 bp, Homo sapiens
tttcctactgccctatacacac

SEQ ID NO: 7794966 - DNA, 21 bp, Homo sapiens
tttcaatttgccttgagtcat

SEQ ID NO: 7794967 - DNA, 22 bp, Homo sapiens
ctcctggccctgagctcccagg

SEQ ID NO: 7794968 - DNA, 22 bp, Homo sapiens
tttcacaaagcatagcacttta

SEQ ID NO: 7794969 - DNA, 22 bp, Homo sapiens
tttcctcactcatgtcatcagt

SEQ ID NO: 7794970 - DNA, 22 bp, Homo sapiens
tttcctcactcatgtcatcagt

SEQ ID NO: 7794971 - DNA, 22 bp, Homo sapiens
cctgggagtgtgccatctctgt

SEQ ID NO: 7794972 - DNA, 22 bp, Homo sapiens
cctgggaggctgaggctgcagt

SEQ ID NO: 7794973 - DNA, 22 bp, Homo sapiens
tgttacagggataaatgaggta

SEQ ID NO: 7794974 - DNA, 22 bp, Homo sapiens
tgttacaagtcttgaggtactt

SEQ ID NO: 7794975 - DNA, 23 bp, Homo sapiens
cctgtctgtgctgggtggacaca

SEQ ID NO: 7794976 - DNA, 22 bp, Homo sapiens
cctgtctctttcaatctgagag

SEQ ID NO: 7794977 - DNA, 22 bp, Homo sapiens
tgtttagatgcaaagtctcaca

SEQ ID NO: 7794978 - DNA, 22 bp, Homo sapiens
tgtttagactcaaaattgaaag

SEQ ID NO: 7794979 - DNA, 22 bp, Homo sapiens
cctgtgccctggaaggagagag

SEQ ID NO: 7794980 - DNA, 22 bp, Homo sapiens
cctgtgccctctgcatagcagc

SEQ ID NO: 7794981 - DNA, 22 bp, Homo sapiens
ttaaagctgagccctcagaagc

SEQ ID NO: 7794982 - DNA, 19 bp, Homo sapiens
ttaaagtgcgagaagtctt

SEQ ID NO: 7794983 - DNA, 19 bp, Homo sapiens
ccttcctccccagggccat

SEQ ID NO: 7794984 - DNA, 22 bp, Homo sapiens
ccttcctggagcccatgcagat

SEQ ID NO: 7794985 - DNA, 22 bp, Homo sapiens
ttagaaaatttgcttctttgga

SEQ ID NO: 7794986 - DNA, 22 bp, Homo sapiens
ttagaagtcatctagtctaaaa

SEQ ID NO: 7794987 - DNA, 22 bp, Homo sapiens
ttagaagtgaaatagctgtaca

SEQ ID NO: 7794988 - DNA, 22 bp, Homo sapiens
ttagaagttcaggtctgtaatc

SEQ ID NO: 7794989 - DNA, 22 bp, Homo sapiens
ttagaaaaaacgtcttctagtg

SEQ ID NO: 7794990 - DNA, 23 bp, Homo sapiens
ttacttttgcaccaacctaatat

SEQ ID NO: 7794991 - DNA, 22 bp, Homo sapiens
ttactaagttttatgcaactta

SEQ ID NO: 7794992 - DNA, 23 bp, Homo sapiens
cgcccagcctcagtgacctgggc

SEQ ID NO: 7794993 - DNA, 23 bp, Homo sapiens
ttaggcacttagtagggccagag

SEQ ID NO: 7794994 - DNA, 22 bp, Homo sapiens
ttaggagatggtcctctaggga

SEQ ID NO: 7794995 - DNA, 22 bp, Homo sapiens
ttcaagtttactttgaagttta

SEQ ID NO: 7794996 - DNA, 22 bp, Homo sapiens
ttcaatatcattgtttagtctc

SEQ ID NO: 7794997 - DNA, 22 bp, Homo sapiens
cgccccggacgtctgaccaaac

SEQ ID NO: 7794998 - DNA, 22 bp, Homo sapiens
ttcatgaaacttaactgttggg

SEQ ID NO: 7794999 - DNA, 22 bp, Homo sapiens
ttcatgaaagacagcaactgtg

SEQ ID NO: 7795000 - DNA, 22 bp, Homo sapiens
cgtcacttcttagtctattttc

SEQ ID NO: 7795001 - DNA, 17 bp, Homo sapiens
ctaaatacttgcgtttc

SEQ ID NO: 7795002 - DNA, 22 bp, Homo sapiens
ctaaataatccctctggtctta

SEQ ID NO: 7795003 - DNA, 22 bp, Homo sapiens
ttcatgaatatattgaattagc

SEQ ID NO: 7795004 - DNA, 22 bp, Homo sapiens
ttcatgaagggtgaatatagtc

SEQ ID NO: 7795005 - DNA, 22 bp, Homo sapiens
ttcatgaatgttccatgtgagt

SEQ ID NO: 7795006 - DNA, 20 bp, Homo sapiens
ttcagagtcagcaaatgcag

SEQ ID NO: 7795007 - DNA, 22 bp, Homo sapiens
ttcagaaagtgaatcttgttat

SEQ ID NO: 7795008 - DNA, 22 bp, Homo sapiens
ttcacacttgttaggatggctt

SEQ ID NO: 7795009 - DNA, 22 bp, Homo sapiens
ttcacactgtcccgggtggaaa

SEQ ID NO: 7795010 - DNA, 22 bp, Homo sapiens
ttcacactgtttttcatagtgg

SEQ ID NO: 7795011 - DNA, 22 bp, Homo sapiens
ttcagcaaacacgatgcttgtt

SEQ ID NO: 7795012 - DNA, 22 bp, Homo sapiens
ttcaggcccagcacagcgcgtg

SEQ ID NO: 7795013 - DNA, 22 bp, Homo sapiens
ttcaggcccaacgcacagcttc

SEQ ID NO: 7795014 - DNA, 20 bp, Homo sapiens
ctactttaggcactgagaat

SEQ ID NO: 7795015 - DNA, 22 bp, Homo sapiens
ctacttctgtgatgaaactaca

SEQ ID NO: 7795016 - DNA, 17 bp, Homo sapiens
ctacttcttctattctt

SEQ ID NO: 7795017 - DNA, 22 bp, Homo sapiens
ctacttcttgatctgtcgacct

SEQ ID NO: 7795018 - DNA, 22 bp, Homo sapiens
ctacttctaagtacatggtgat

SEQ ID NO: 7795019 - DNA, 22 bp, Homo sapiens
ctactgagtccttcagctgcca

SEQ ID NO: 7795020 - DNA, 16 bp, Homo sapiens
ctacccagtgagaagg

SEQ ID NO: 7795021 - DNA, 22 bp, Homo sapiens
ctacccttgcctgccaggtgac

SEQ ID NO: 7795022 - DNA, 22 bp, Homo sapiens
ttcctggctgtcatgccctagt

SEQ ID NO: 7795023 - DNA, 22 bp, Homo sapiens
ttcctggctggcggttttggtg

SEQ ID NO: 7795024 - DNA, 22 bp, Homo sapiens
ttcctggcttttgggctaattc

SEQ ID NO: 7795025 - DNA, 22 bp, Homo sapiens
ttcctggcttcatactttgtac

SEQ ID NO: 7795026 - DNA, 22 bp, Homo sapiens
ttcctggcttgtcacatctacg

SEQ ID NO: 7795027 - DNA, 20 bp, Homo sapiens
ttcctggctctaggaccttg

SEQ ID NO: 7795028 - DNA, 19 bp, Homo sapiens
ttcctggctcttctgtttt

SEQ ID NO: 7795029 - DNA, 22 bp, Homo sapiens
ttcctggctctctgttgcacag

SEQ ID NO: 7795030 - DNA, 22 bp, Homo sapiens
ttcctggctgatctaccaaagt

SEQ ID NO: 7795031 - DNA, 22 bp, Homo sapiens
ttcctggctgaactgaactcct

SEQ ID NO: 7795032 - DNA, 22 bp, Homo sapiens
ttccaggactcgttctggctca

SEQ ID NO: 7795033 - DNA, 22 bp, Homo sapiens
ctaaatcatcatttatgtttgt

SEQ ID NO: 7795034 - DNA, 22 bp, Homo sapiens
ctcaagaggatatgtccagaaa

SEQ ID NO: 7795035 - DNA, 22 bp, Homo sapiens
ctattaggcttccatttcatgc

SEQ ID NO: 7795036 - DNA, 22 bp, Homo sapiens
ctattaggtatgtggttgctat

SEQ ID NO: 7795037 - DNA, 22 bp, Homo sapiens
ctattaggtatgcagcctattt

SEQ ID NO: 7795038 - DNA, 22 bp, Homo sapiens
ctattaggttggtgcaaaagta

SEQ ID NO: 7795039 - DNA, 22 bp, Homo sapiens
ctcaaaatccataaaatcaggt

SEQ ID NO: 7795040 - DNA, 22 bp, Homo sapiens
ctcacagcagccagtctgcctt

SEQ ID NO: 7795041 - DNA, 22 bp, Homo sapiens
ctcacagcatggaattttctgg

SEQ ID NO: 7795042 - DNA, 22 bp, Homo sapiens
ttctctggatgtttctcagtca

SEQ ID NO: 7795043 - DNA, 22 bp, Homo sapiens
ctattaaatactcttcaaattg

SEQ ID NO: 7795044 - DNA, 22 bp, Homo sapiens
ctatgtttatctgtatttctgt

SEQ ID NO: 7795045 - DNA, 22 bp, Homo sapiens
ctattaaatactcttcaaattg

SEQ ID NO: 7795046 - DNA, 22 bp, Homo sapiens
catgaaggaccatttcacggtc

SEQ ID NO: 7795047 - DNA, 22 bp, Homo sapiens
catgaaggctgccagcaggcat

SEQ ID NO: 7795048 - DNA, 23 bp, Homo sapiens
catgaaggtagcacaaagcctct

SEQ ID NO: 7795049 - DNA, 22 bp, Homo sapiens
catgaaggaattaaggtaagga

SEQ ID NO: 7795050 - DNA, 22 bp, Homo sapiens
catgaaggaataattgtttaga

SEQ ID NO: 7795051 - DNA, 22 bp, Homo sapiens
catgacatcctgaagctgcaca

SEQ ID NO: 7795052 - DNA, 22 bp, Homo sapiens
catgcaggcctatggagcagtg

SEQ ID NO: 7795053 - DNA, 22 bp, Homo sapiens
catgcagtcaataaacatgtgt

SEQ ID NO: 7795054 - DNA, 22 bp, Homo sapiens
catctgaatttgccttagtttc

SEQ ID NO: 7795055 - DNA, 22 bp, Homo sapiens
catctgaagtgaattgcttttt

SEQ ID NO: 7795056 - DNA, 22 bp, Homo sapiens
catgaaaataacattgttgtga

SEQ ID NO: 7795057 - DNA, 22 bp, Homo sapiens
catctgttgcttcctaacaagt

SEQ ID NO: 7795058 - DNA, 22 bp, Homo sapiens
tcagtgctgagtagcgtgcacc

SEQ ID NO: 7795059 - DNA, 20 bp, Homo sapiens
tcagtgctcaggcaccaggt

SEQ ID NO: 7795060 - DNA, 22 bp, Homo sapiens
tcagtgctaaaagagctggtgt

SEQ ID NO: 7795061 - DNA, 22 bp, Homo sapiens
tcagtccataggtgggcctgag

SEQ ID NO: 7795062 - DNA, 22 bp, Homo sapiens
cagttttggtcctttctaggta

SEQ ID NO: 7795063 - DNA, 22 bp, Homo sapiens
tcagatctggtgaagttatagt

SEQ ID NO: 7795064 - DNA, 22 bp, Homo sapiens
cagtttgtcttgattcagaaca

SEQ ID NO: 7795065 - DNA, 22 bp, Homo sapiens
cataaaagccacctatttaaag

SEQ ID NO: 7795066 - DNA, 22 bp, Homo sapiens
cataaaaggtagcagtttgaaa

SEQ ID NO: 7795067 - DNA, 22 bp, Homo sapiens
tcagatagtgataatagcatgt

SEQ ID NO: 7795068 - DNA, 22 bp, Homo sapiens
tcagagtttctgatttagtagg

SEQ ID NO: 7795069 - DNA, 22 bp, Homo sapiens
tcagagttggcctttctgtatt

SEQ ID NO: 7795070 - DNA, 22 bp, Homo sapiens
tcaatattcttctttagtagga

SEQ ID NO: 7795071 - DNA, 22 bp, Homo sapiens
cagttgctggatgtgcagctct

SEQ ID NO: 7795072 - DNA, 22 bp, Homo sapiens
tcagagagtgcaaaatatagct

SEQ ID NO: 7795073 - DNA, 22 bp, Homo sapiens
tcagagagtcctggtcatttgc

SEQ ID NO: 7795074 - DNA, 21 bp, Homo sapiens
tcagagagtcacagtgaactg

SEQ ID NO: 7795075 - DNA, 22 bp, Homo sapiens
tcagagagttagtgtcttagct

SEQ ID NO: 7795076 - DNA, 22 bp, Homo sapiens
tcagagagttacacaaattgtt

SEQ ID NO: 7795077 - DNA, 22 bp, Homo sapiens
tcagagagttggaaagaattaa

SEQ ID NO: 7795078 - DNA, 22 bp, Homo sapiens
tcagagagttttcactagggtg

SEQ ID NO: 7795079 - DNA, 22 bp, Homo sapiens
tcagagcaaattcctgtgagcc

SEQ ID NO: 7795080 - DNA, 22 bp, Homo sapiens
tcaggcccagagtcacggatcc

SEQ ID NO: 7795081 - DNA, 22 bp, Homo sapiens
cataacagtggcttcagcaagt

SEQ ID NO: 7795082 - DNA, 17 bp, Homo sapiens
tcaggctgtgcctggta

SEQ ID NO: 7795083 - DNA, 21 bp, Homo sapiens
tcaggctgtctgctggttcca

SEQ ID NO: 7795084 - DNA, 22 bp, Homo sapiens
catagaaatcaggtgagaatct

SEQ ID NO: 7795085 - DNA, 22 bp, Homo sapiens
tcaggccctttgctgctgcccc

SEQ ID NO: 7795086 - DNA, 22 bp, Homo sapiens
tcaggcccttctcccaggactc

SEQ ID NO: 7795087 - DNA, 22 bp, Homo sapiens
tccttcctgcaggccaagtcct

SEQ ID NO: 7795088 - DNA, 22 bp, Homo sapiens
tccttcccaggtgtcgccgcct

SEQ ID NO: 7795089 - DNA, 22 bp, Homo sapiens
ccactgtctgtgacatcagaaa

SEQ ID NO: 7795090 - DNA, 22 bp, Homo sapiens
ccagagaccagaacatggggat

SEQ ID NO: 7795091 - DNA, 19 bp, Homo sapiens
ccagagacattggcatctt

SEQ ID NO: 7795092 - DNA, 20 bp, Homo sapiens
tcctaataacctgaagaaat

SEQ ID NO: 7795093 - DNA, 22 bp, Homo sapiens
tcctacatcagctctcagtagc

SEQ ID NO: 7795094 - DNA, 22 bp, Homo sapiens
ccaaggaggccccaggtcagct

SEQ ID NO: 7795095 - DNA, 22 bp, Homo sapiens
ccaaggcaggggatcaaagttt

SEQ ID NO: 7795096 - DNA, 22 bp, Homo sapiens
tcctggaggagatccaatctga

SEQ ID NO: 7795097 - DNA, 22 bp, Homo sapiens
tcctggcactttgggggctcgc

SEQ ID NO: 7795098 - DNA, 22 bp, Homo sapiens
tcctggcacccttgggttggag

SEQ ID NO: 7795099 - DNA, 22 bp, Homo sapiens
tcctggcagaaatggggctgtg

SEQ ID NO: 7795100 - DNA, 22 bp, Homo sapiens
tcctggcagagggcggcctcga

SEQ ID NO: 7795101 - DNA, 22 bp, Homo sapiens
tcctggcagagagcatgaggcc

SEQ ID NO: 7795102 - DNA, 22 bp, Homo sapiens
tcctggctccagcagctcttcc

SEQ ID NO: 7795103 - DNA, 22 bp, Homo sapiens
tcctggctcctgatctgtcact

SEQ ID NO: 7795104 - DNA, 22 bp, Homo sapiens
tcctgggagagtgggactgtat

SEQ ID NO: 7795105 - DNA, 22 bp, Homo sapiens
tcctgggagcccttgctccacc

SEQ ID NO: 7795106 - DNA, 22 bp, Homo sapiens
tcctggcagcccgcaggtgctg

SEQ ID NO: 7795107 - DNA, 22 bp, Homo sapiens
tcctggcagcccgcaggtgctg

SEQ ID NO: 7795108 - DNA, 21 bp, Homo sapiens
tcctggcaggcccaggaccct

SEQ ID NO: 7795109 - DNA, 22 bp, Homo sapiens
tcctggcagggtctaggtctag

SEQ ID NO: 7795110 - DNA, 22 bp, Homo sapiens
tcctggcagggaacttgtcagc

SEQ ID NO: 7795111 - DNA, 22 bp, Homo sapiens
tcctggcagggtctaggtctag

SEQ ID NO: 7795112 - DNA, 22 bp, Homo sapiens
tcctggcaggtcagcaggagca

SEQ ID NO: 7795113 - DNA, 22 bp, Homo sapiens
tcctggcagtaatttgatgttg

SEQ ID NO: 7795114 - DNA, 22 bp, Homo sapiens
tcctggcaggtgtattggctgt

SEQ ID NO: 7795115 - DNA, 18 bp, Homo sapiens
tcctggcagtcagagagg

SEQ ID NO: 7795116 - DNA, 18 bp, Homo sapiens
tcctggcagtcagagagg

SEQ ID NO: 7795117 - DNA, 22 bp, Homo sapiens
catttattcatttgctagggct

SEQ ID NO: 7795118 - DNA, 22 bp, Homo sapiens
catttattcatgatctgtagct

SEQ ID NO: 7795119 - DNA, 22 bp, Homo sapiens
catttattgagtggccacagtg

SEQ ID NO: 7795120 - DNA, 22 bp, Homo sapiens
catttattctcagatccttgtc

SEQ ID NO: 7795121 - DNA, 22 bp, Homo sapiens
catttattctcagatccttgtc

SEQ ID NO: 7795122 - DNA, 22 bp, Homo sapiens
tccctcctggccgtcaccgctg

SEQ ID NO: 7795123 - DNA, 22 bp, Homo sapiens
catttaatagatgctgtttcag

SEQ ID NO: 7795124 - DNA, 22 bp, Homo sapiens
tccaggagaggtgtggggactg

SEQ ID NO: 7795125 - DNA, 22 bp, Homo sapiens
tccaggagcatccaggtgaagc

SEQ ID NO: 7795126 - DNA, 21 bp, Homo sapiens
tccaggagcacgggactagga

SEQ ID NO: 7795127 - DNA, 22 bp, Homo sapiens
tccatcaccacagaggacagag

SEQ ID NO: 7795128 - DNA, 21 bp, Homo sapiens
cattagggcagaagcaggaag

SEQ ID NO: 7795129 - DNA, 22 bp, Homo sapiens
cattagggccaccataacaaaa

SEQ ID NO: 7795130 - DNA, 22 bp, Homo sapiens
cattagggtaattgaacactta

SEQ ID NO: 7795131 - DNA, 22 bp, Homo sapiens
cattagggactgaggaataagg

SEQ ID NO: 7795132 - DNA, 22 bp, Homo sapiens
cattagggtctctcagctgaat

SEQ ID NO: 7795133 - DNA, 22 bp, Homo sapiens
tcccacccatcctgcatctctt

SEQ ID NO: 7795134 - DNA, 22 bp, Homo sapiens
tcccaccccttgactctttaag

SEQ ID NO: 7795135 - DNA, 22 bp, Homo sapiens
tcccaccccggtcaagggctga

SEQ ID NO: 7795136 - DNA, 22 bp, Homo sapiens
tcccaccccggtcaagggctga

SEQ ID NO: 7795137 - DNA, 22 bp, Homo sapiens
tcccaccccctccaaggaggaa

SEQ ID NO: 7795138 - DNA, 20 bp, Homo sapiens
tagatttcatacttctcttt

SEQ ID NO: 7795139 - DNA, 22 bp, Homo sapiens
cagggctccatgcagggactcc

SEQ ID NO: 7795140 - DNA, 22 bp, Homo sapiens
taggaggcatttgctcccaggg

SEQ ID NO: 7795141 - DNA, 22 bp, Homo sapiens
tagctttaaaaatcatcaaagc

SEQ ID NO: 7795142 - DNA, 22 bp, Homo sapiens
tagctttaagacatggtgaatg

SEQ ID NO: 7795143 - DNA, 22 bp, Homo sapiens
tagcttctcataatttatgctg

SEQ ID NO: 7795144 - DNA, 22 bp, Homo sapiens
cagggctgaaatcaaggtgtag

SEQ ID NO: 7795145 - DNA, 22 bp, Homo sapiens
cagggctcttccggagcaggga

SEQ ID NO: 7795146 - DNA, 22 bp, Homo sapiens
cagggctcttcatcacacagta

SEQ ID NO: 7795147 - DNA, 20 bp, Homo sapiens
cagggctctgggcctggcct

SEQ ID NO: 7795148 - DNA, 22 bp, Homo sapiens
tattatcattaactgttgaatt

SEQ ID NO: 7795149 - DNA, 22 bp, Homo sapiens
tattattaaatggcagaatttt

SEQ ID NO: 7795150 - DNA, 22 bp, Homo sapiens
tattatgcataggcaataatgg

SEQ ID NO: 7795151 - DNA, 22 bp, Homo sapiens
caggtcagaggtagatgagatg

SEQ ID NO: 7795152 - DNA, 22 bp, Homo sapiens
caggtacattcgtagacccatt

SEQ ID NO: 7795153 - DNA, 22 bp, Homo sapiens
caggtcagcacttggaggtgca

SEQ ID NO: 7795154 - DNA, 22 bp, Homo sapiens
tcaagcaactgaattctaaaag

SEQ ID NO: 7795155 - DNA, 22 bp, Homo sapiens
tcaagctgcatcagtgcagtga

SEQ ID NO: 7795156 - DNA, 22 bp, Homo sapiens
tattttcaccatgtatccctgt

SEQ ID NO: 7795157 - DNA, 22 bp, Homo sapiens
tcaaaaatgttttatattggta

SEQ ID NO: 7795158 - DNA, 22 bp, Homo sapiens
tattttacatgatccagagttg

SEQ ID NO: 7795159 - DNA, 22 bp, Homo sapiens
tattttaggtaatatccattgt

SEQ ID NO: 7795160 - DNA, 22 bp, Homo sapiens
tattttactttaaagcgagaga

SEQ ID NO: 7795161 - DNA, 22 bp, Homo sapiens
cagtcactggaatagctgagga

SEQ ID NO: 7795162 - DNA, 22 bp, Homo sapiens
caggtgggtgtatgaatgcaaa

SEQ ID NO: 7795163 - DNA, 22 bp, Homo sapiens
cagtattttccttgttaactta

SEQ ID NO: 7795164 - DNA, 22 bp, Homo sapiens
caggctgggactgacccctgct

SEQ ID NO: 7795165 - DNA, 22 bp, Homo sapiens
caggctggcaatgcgtcaagca

SEQ ID NO: 7795166 - DNA, 22 bp, Homo sapiens
tagaaaatggccaagcaggact

SEQ ID NO: 7795167 - DNA, 22 bp, Homo sapiens
tagaaaatagggcctgtggagc

SEQ ID NO: 7795168 - DNA, 22 bp, Homo sapiens
tagaaaatagggcctgtggagc

SEQ ID NO: 7795169 - DNA, 22 bp, Homo sapiens
caggctgccctagcttggacat

SEQ ID NO: 7795170 - DNA, 22 bp, Homo sapiens
caggctgccgtgaagcaggcct

SEQ ID NO: 7795171 - DNA, 22 bp, Homo sapiens
caggctggagttcagtggtgtg

SEQ ID NO: 7795172 - DNA, 22 bp, Homo sapiens
caggctggagtgcagtggtgcc

SEQ ID NO: 7795173 - DNA, 22 bp, Homo sapiens
cagggacaatggcagagcctga

SEQ ID NO: 7795174 - DNA, 22 bp, Homo sapiens
caggcttggttggggcgaggga

SEQ ID NO: 7795175 - DNA, 22 bp, Homo sapiens
tagaaacaaagacctgggtgct

SEQ ID NO: 7795176 - DNA, 22 bp, Homo sapiens
caggctttttctgctgtcctct

SEQ ID NO: 7795177 - DNA, 22 bp, Homo sapiens
caggcctgagtgtggaagtctt

SEQ ID NO: 7795178 - DNA, 20 bp, Homo sapiens
tacattgtagaaatattcaa

SEQ ID NO: 7795179 - DNA, 22 bp, Homo sapiens
caggcctcgaggagacagctac

SEQ ID NO: 7795180 - DNA, 20 bp, Homo sapiens
caggcctctgggggccctgg

SEQ ID NO: 7795181 - DNA, 22 bp, Homo sapiens
tactttaaaaactgataattca

SEQ ID NO: 7795182 - DNA, 22 bp, Homo sapiens
tacttgttctttcaagagatag

SEQ ID NO: 7795183 - DNA, 22 bp, Homo sapiens
caggcctttgcagggagagaga

SEQ ID NO: 7795184 - DNA, 22 bp, Homo sapiens
caggccttgtcaagaaaatgcc

SEQ ID NO: 7795185 - DNA, 22 bp, Homo sapiens
taagtcttcatagtctaatgtc

SEQ ID NO: 7795186 - DNA, 22 bp, Homo sapiens
taagtcttgaaatatttcctat

SEQ ID NO: 7795187 - DNA, 22 bp, Homo sapiens
cagctcagacgcaggtcgagca

SEQ ID NO: 7795188 - DNA, 22 bp, Homo sapiens
cagctattgataaatgttgggg

SEQ ID NO: 7795189 - DNA, 22 bp, Homo sapiens
cagctattggtccacaggtatg

SEQ ID NO: 7795190 - DNA, 22 bp, Homo sapiens
cagctattggcaagaagtggtg

SEQ ID NO: 7795191 - DNA, 22 bp, Homo sapiens
cagctattttctcattaaggat

SEQ ID NO: 7795192 - DNA, 22 bp, Homo sapiens
cagctattttctcattaaggat

SEQ ID NO: 7795193 - DNA, 22 bp, Homo sapiens
gtgcttctccgttctgcagcac

SEQ ID NO: 7795194 - DNA, 22 bp, Homo sapiens
cagctattctctgaaatgaata

SEQ ID NO: 7795195 - DNA, 22 bp, Homo sapiens
taataattggctaaccctggga

SEQ ID NO: 7795196 - DNA, 22 bp, Homo sapiens
taataattttaaagaaggctag

SEQ ID NO: 7795197 - DNA, 22 bp, Homo sapiens
taataattttaaagaaggctag

SEQ ID NO: 7795198 - DNA, 22 bp, Homo sapiens
taataattggcaatgttgagca

SEQ ID NO: 7795199 - DNA, 22 bp, Homo sapiens
taataattagttattgatcgtg

SEQ ID NO: 7795200 - DNA, 21 bp, Homo sapiens
taataattccactacagagta

SEQ ID NO: 7795201 - DNA, 21 bp, Homo sapiens
taataattccactacagagta

SEQ ID NO: 7795202 - DNA, 22 bp, Homo sapiens
caggcaccccaggtgagcactg

SEQ ID NO: 7795203 - DNA, 22 bp, Homo sapiens
caggcatggtgagaactcagcc

SEQ ID NO: 7795204 - DNA, 22 bp, Homo sapiens
tacaaaagtaattacggttttt

SEQ ID NO: 7795205 - DNA, 22 bp, Homo sapiens
tacaaaaggaagagggatctta

SEQ ID NO: 7795206 - DNA, 22 bp, Homo sapiens
caggcagggagctggaaaggat

SEQ ID NO: 7795207 - DNA, 22 bp, Homo sapiens
cctcttcctgcactgacatttt

SEQ ID NO: 7795208 - DNA, 22 bp, Homo sapiens
cctgagcctgcagccgagcaga

SEQ ID NO: 7795209 - DNA, 22 bp, Homo sapiens
cctgagagagaagcgacctggt

SEQ ID NO: 7795210 - DNA, 22 bp, Homo sapiens
cctgagattggctagtatgagt

SEQ ID NO: 7795211 - DNA, 22 bp, Homo sapiens
cctgagatttcattgtctggcc

SEQ ID NO: 7795212 - DNA, 22 bp, Homo sapiens
cctgagctagggaaggaagacc

SEQ ID NO: 7795213 - DNA, 22 bp, Homo sapiens
cctgagctcaagaaggtgacca

SEQ ID NO: 7795214 - DNA, 22 bp, Homo sapiens
cctgagctgaactaagcagttt

SEQ ID NO: 7795215 - DNA, 22 bp, Homo sapiens
tgggctccttgggagcaagtga

SEQ ID NO: 7795216 - DNA, 22 bp, Homo sapiens
tggcttcattcagcatgacagt

SEQ ID NO: 7795217 - DNA, 22 bp, Homo sapiens
tggcttcattctcctgtgaata

SEQ ID NO: 7795218 - DNA, 22 bp, Homo sapiens
cctcagttttctcatctgtaaa

SEQ ID NO: 7795219 - DNA, 22 bp, Homo sapiens
cctcagtttatcctctgtaaca

SEQ ID NO: 7795220 - DNA, 22 bp, Homo sapiens
tggcctgggcctgccggtgcaa

SEQ ID NO: 7795221 - DNA, 22 bp, Homo sapiens
cctagagctctgctttatctaa

SEQ ID NO: 7795222 - DNA, 21 bp, Homo sapiens
cctagcctcttacccagcttt

SEQ ID NO: 7795223 - DNA, 18 bp, Homo sapiens
cctagcctccaagctcat

SEQ ID NO: 7795224 - DNA, 22 bp, Homo sapiens
cctagatgggatggcggccggg

SEQ ID NO: 7795225 - DNA, 22 bp, Homo sapiens
cccttcctgggtgtcccggagt

SEQ ID NO: 7795226 - DNA, 22 bp, Homo sapiens
cccttccttgattttaactgga

SEQ ID NO: 7795227 - DNA, 22 bp, Homo sapiens
cccttcctcccaggcttctgtg

SEQ ID NO: 7795228 - DNA, 22 bp, Homo sapiens
cccttccttgtgactggtgggg

SEQ ID NO: 7795229 - DNA, 22 bp, Homo sapiens
ccctgcagccttgcatgccttc

SEQ ID NO: 7795230 - DNA, 21 bp, Homo sapiens
ccctgcaggccagggctgagc

SEQ ID NO: 7795231 - DNA, 22 bp, Homo sapiens
ccctgcaggctcagactggagt

SEQ ID NO: 7795232 - DNA, 22 bp, Homo sapiens
ccctgcagcttttgcatagtca

SEQ ID NO: 7795233 - DNA, 22 bp, Homo sapiens
ccctgcaggggacctgcagcct

SEQ ID NO: 7795234 - DNA, 22 bp, Homo sapiens
ccctgcagggaggattctgaag

SEQ ID NO: 7795235 - DNA, 23 bp, Homo sapiens
ccctgcagtcagggtgagatggt

SEQ ID NO: 7795236 - DNA, 22 bp, Homo sapiens
ccctgaggaaagggtggagggc

SEQ ID NO: 7795237 - DNA, 22 bp, Homo sapiens
ccctgagagtgagtgccacctt

SEQ ID NO: 7795238 - DNA, 22 bp, Homo sapiens
ccctgagatgcctcaccctagt

SEQ ID NO: 7795239 - DNA, 22 bp, Homo sapiens
ccctgagctcaggcccttgggg

SEQ ID NO: 7795240 - DNA, 22 bp, Homo sapiens
ccctgagcgtgaggaggaagta

SEQ ID NO: 7795241 - DNA, 20 bp, Homo sapiens
ccctgagacgactgagctcc

SEQ ID NO: 7795242 - DNA, 22 bp, Homo sapiens
ccctgaccaccagctccatttg

SEQ ID NO: 7795243 - DNA, 22 bp, Homo sapiens
ccctgagaagatcattgccacg

SEQ ID NO: 7795244 - DNA, 22 bp, Homo sapiens
ccctctcagtcagagccagata

SEQ ID NO: 7795245 - DNA, 22 bp, Homo sapiens
tgctgtgctctttaaggtgctg

SEQ ID NO: 7795246 - DNA, 22 bp, Homo sapiens
tgctggctttaaggttaaagtg

SEQ ID NO: 7795247 - DNA, 22 bp, Homo sapiens
cccgagtgtctactcactccca

SEQ ID NO: 7795248 - DNA, 22 bp, Homo sapiens
cccagttgttgccggctctgga

SEQ ID NO: 7795249 - DNA, 22 bp, Homo sapiens
ccccaccctcgctccatttcgg

SEQ ID NO: 7795250 - DNA, 22 bp, Homo sapiens
ccccaccctcgctccatttcgg

SEQ ID NO: 7795251 - DNA, 22 bp, Homo sapiens
ccccacccacctaagagaaact

SEQ ID NO: 7795252 - DNA, 22 bp, Homo sapiens
ccccaaggtgctcactgtctgg

SEQ ID NO: 7795253 - DNA, 22 bp, Homo sapiens
ccccacagcttgtggagagaat

SEQ ID NO: 7795254 - DNA, 22 bp, Homo sapiens
ccccacaggtgtctgaggcagg

SEQ ID NO: 7795255 - DNA, 22 bp, Homo sapiens
tgccagctgttcccacccaaaa

SEQ ID NO: 7795256 - DNA, 22 bp, Homo sapiens
tgccagcttgtggtcagaggct

SEQ ID NO: 7795257 - DNA, 22 bp, Homo sapiens
tgccagtgcttgtgtctgagca

SEQ ID NO: 7795258 - DNA, 22 bp, Homo sapiens
tgccctggggagcccagccagg

SEQ ID NO: 7795259 - DNA, 21 bp, Homo sapiens
tgccctggggctcttccctca

SEQ ID NO: 7795260 - DNA, 22 bp, Homo sapiens
cccaggcatcccattaaggagc

SEQ ID NO: 7795261 - DNA, 22 bp, Homo sapiens
tgccagtgtggaactaggaaga

SEQ ID NO: 7795262 - DNA, 22 bp, Homo sapiens
tgccagtgtggaactaggaaga

SEQ ID NO: 7795263 - DNA, 22 bp, Homo sapiens
tgccatagcaatggtaagctga

SEQ ID NO: 7795264 - DNA, 22 bp, Homo sapiens
cccagggtggatgcaagcagca

SEQ ID NO: 7795265 - DNA, 22 bp, Homo sapiens
tgccttcactgagcttatggga

SEQ ID NO: 7795266 - DNA, 22 bp, Homo sapiens
tgccttcctgctttgagttctg

SEQ ID NO: 7795267 - DNA, 22 bp, Homo sapiens
tgccttcatccatgttatagtg

SEQ ID NO: 7795268 - DNA, 22 bp, Homo sapiens
tgccttcaagacccatcctcca

SEQ ID NO: 7795269 - DNA, 22 bp, Homo sapiens
tgccttcaatcaggatggtctc

SEQ ID NO: 7795270 - DNA, 22 bp, Homo sapiens
tgccttcaccaggccttcagcc

SEQ ID NO: 7795271 - DNA, 23 bp, Homo sapiens
cccagggacacgatgacacctcc

SEQ ID NO: 7795272 - DNA, 22 bp, Homo sapiens
cccagggaatgactctggcctt

SEQ ID NO: 7795273 - DNA, 22 bp, Homo sapiens
cccagggaagggctacctgagg

SEQ ID NO: 7795274 - DNA, 22 bp, Homo sapiens
cccagggaagggctacctgagg

SEQ ID NO: 7795275 - DNA, 22 bp, Homo sapiens
cccaggctggagtgtaatggtg

SEQ ID NO: 7795276 - DNA, 22 bp, Homo sapiens
tgccctggtgaagtgctctcct

SEQ ID NO: 7795277 - DNA, 22 bp, Homo sapiens
cccaggctggagggcagtgtca

SEQ ID NO: 7795278 - DNA, 22 bp, Homo sapiens
tgccctggttacactggagtcc

SEQ ID NO: 7795279 - DNA, 22 bp, Homo sapiens
tgatttcttccttgtcattaga

SEQ ID NO: 7795280 - DNA, 22 bp, Homo sapiens
tgatttcttccttgtcattaga

SEQ ID NO: 7795281 - DNA, 20 bp, Homo sapiens
tgatttctcttctattcctt

SEQ ID NO: 7795282 - DNA, 22 bp, Homo sapiens
tgatttctcttggcaatatgtt

SEQ ID NO: 7795283 - DNA, 22 bp, Homo sapiens
tgatttctctccgttatttcag

SEQ ID NO: 7795284 - DNA, 22 bp, Homo sapiens
tgatttcttctaatttccatca

SEQ ID NO: 7795285 - DNA, 22 bp, Homo sapiens
tgattttacttagcatgatgtt

SEQ ID NO: 7795286 - DNA, 22 bp, Homo sapiens
ccattctttcagtgtctcatgt

SEQ ID NO: 7795287 - DNA, 21 bp, Homo sapiens
ccattcttagtcaagtgtctc

SEQ ID NO: 7795288 - DNA, 22 bp, Homo sapiens
ccattcatacaattttgttcta

SEQ ID NO: 7795289 - DNA, 22 bp, Homo sapiens
cccagacattgcagggactggt

SEQ ID NO: 7795290 - DNA, 22 bp, Homo sapiens
cccagaaggtcgaggctgcagt

SEQ ID NO: 7795291 - DNA, 22 bp, Homo sapiens
tgcaaatagcctgatgaaagaa

SEQ ID NO: 7795292 - DNA, 22 bp, Homo sapiens
cccaccctcaagggtgtctata

SEQ ID NO: 7795293 - DNA, 23 bp, Homo sapiens
ccagtctcacgtatacaggattt

SEQ ID NO: 7795294 - DNA, 22 bp, Homo sapiens
ccagtcctgtgtgaccctgcac

SEQ ID NO: 7795295 - DNA, 22 bp, Homo sapiens
tgaggtaggtgtcgagagaggt

SEQ ID NO: 7795296 - DNA, 19 bp, Homo sapiens
ccatgccatcattttaaag

SEQ ID NO: 7795297 - DNA, 19 bp, Homo sapiens
ccatgccatcattttaaag

SEQ ID NO: 7795298 - DNA, 22 bp, Homo sapiens
ccatgccagctgctaggtcaca

SEQ ID NO: 7795299 - DNA, 22 bp, Homo sapiens
ccaggctggagtgcagtggcac

SEQ ID NO: 7795300 - DNA, 22 bp, Homo sapiens
tgagaaggaaacaatggctttt

SEQ ID NO: 7795301 - DNA, 22 bp, Homo sapiens
tgacaagtacataatttcatgt

SEQ ID NO: 7795302 - DNA, 17 bp, Homo sapiens
ccaggtctccttgcttt

SEQ ID NO: 7795303 - DNA, 20 bp, Homo sapiens
tgagaaggggtcagctgtac

SEQ ID NO: 7795304 - DNA, 22 bp, Homo sapiens
ccaggcaggctagaatgtaaat

SEQ ID NO: 7795305 - DNA, 22 bp, Homo sapiens
tcttcagagcatttctgaggta

SEQ ID NO: 7795306 - DNA, 22 bp, Homo sapiens
ccaggagttggaggctgcagtg

SEQ ID NO: 7795307 - DNA, 22 bp, Homo sapiens
ccaggagtttgaggctgcagtg

SEQ ID NO: 7795308 - DNA, 22 bp, Homo sapiens
ccaggagttggaggttgcagtg

SEQ ID NO: 7795309 - DNA, 22 bp, Homo sapiens
tcttagaatgtcaactgatgtt

SEQ ID NO: 7795310 - DNA, 22 bp, Homo sapiens
ccaggagtctggatgaggtgtc

SEQ ID NO: 7795311 - DNA, 22 bp, Homo sapiens
ccaggagttggaagctgccatg

SEQ ID NO: 7795312 - DNA, 22 bp, Homo sapiens
ccaggagtggctggtgaccttc

SEQ ID NO: 7795313 - DNA, 22 bp, Homo sapiens
ccaggaggttgaggctgcagtg

SEQ ID NO: 7795314 - DNA, 22 bp, Homo sapiens
tctttggcttgtctcctcagtt

SEQ ID NO: 7795315 - DNA, 23 bp, Homo sapiens
tctttggtaaataaagtggggat

SEQ ID NO: 7795316 - DNA, 22 bp, Homo sapiens
tctttggtattcacttgtgaag

SEQ ID NO: 7795317 - DNA, 22 bp, Homo sapiens
tctttggtcatcatgggaagca

SEQ ID NO: 7795318 - DNA, 22 bp, Homo sapiens
ccaggcctggccaggggatgcc

SEQ ID NO: 7795319 - DNA, 22 bp, Homo sapiens
ccaggcctggccaggggatgcc

SEQ ID NO: 7795320 - DNA, 23 bp, Homo sapiens
ccaggctctttcacctgctattc

SEQ ID NO: 7795321 - DNA, 22 bp, Homo sapiens
ccaggctctgttccccgaggag

SEQ ID NO: 7795322 - DNA, 22 bp, Homo sapiens
tctttcttattagccattgttc

SEQ ID NO: 7795323 - DNA, 22 bp, Homo sapiens
ccaggcccagggtactgaccaa

SEQ ID NO: 7795324 - DNA, 22 bp, Homo sapiens
ccaggccattcccagagttgct

SEQ ID NO: 7795325 - DNA, 22 bp, Homo sapiens
tctttcttggtattctgagcta

SEQ ID NO: 7795326 - DNA, 22 bp, Homo sapiens
tctttgaaagctgttctagagt

SEQ ID NO: 7795327 - DNA, 22 bp, Homo sapiens
ccaggcctggaccatgccaggg

SEQ ID NO: 7795328 - DNA, 19 bp, Homo sapiens
ccaggcctgcgggcgttgg

SEQ ID NO: 7795329 - DNA, 22 bp, Homo sapiens
tctggcaggggttctgcacttg

SEQ ID NO: 7795330 - DNA, 22 bp, Homo sapiens
tctggcaggccttgtcaatctg

SEQ ID NO: 7795331 - DNA, 21 bp, Homo sapiens
tctggcaggcacgggcccagc

SEQ ID NO: 7795332 - DNA, 22 bp, Homo sapiens
tctggcaggcaatcggctctgg

SEQ ID NO: 7795333 - DNA, 22 bp, Homo sapiens
tctggcaggacatgctgaccat

SEQ ID NO: 7795334 - DNA, 22 bp, Homo sapiens
tctggcaggatatcgaagtgaa

SEQ ID NO: 7795335 - DNA, 22 bp, Homo sapiens
tctggcaggaccatgaagcgta

SEQ ID NO: 7795336 - DNA, 21 bp, Homo sapiens
tctggcagcagtttgttgagt

SEQ ID NO: 7795337 - DNA, 22 bp, Homo sapiens
tctggcagcgaagcgtgtactt

SEQ ID NO: 7795338 - DNA, 22 bp, Homo sapiens
tctggcagctatcctctggcca

SEQ ID NO: 7795339 - DNA, 21 bp, Homo sapiens
tctggcaggaagacggatggg

SEQ ID NO: 7795340 - DNA, 22 bp, Homo sapiens
tctggcagctctcctcggcgga

SEQ ID NO: 7795341 - DNA, 22 bp, Homo sapiens
tctggcagctcagttcaggtct

SEQ ID NO: 7795342 - DNA, 22 bp, Homo sapiens
tctggctagattgatgagtccc

SEQ ID NO: 7795343 - DNA, 22 bp, Homo sapiens
ccagagacgtcggtcagggcgc

SEQ ID NO: 7795344 - DNA, 22 bp, Homo sapiens
ccagagagaaaatggagggcca

SEQ ID NO: 7795345 - DNA, 22 bp, Homo sapiens
tctcagaagtgatcaggatgtt

SEQ ID NO: 7795346 - DNA, 22 bp, Homo sapiens
ccagagagagaggtcaatggca

SEQ ID NO: 7795347 - DNA, 22 bp, Homo sapiens
ccagagagaaatggatttgagt

SEQ ID NO: 7795348 - DNA, 22 bp, Homo sapiens
ccagagagaaatggatttgagt

SEQ ID NO: 7795349 - DNA, 22 bp, Homo sapiens
tctggcagcagcatcagtggct

SEQ ID NO: 7795350 - DNA, 22 bp, Homo sapiens
tctggcagcaagtctgtttctc

SEQ ID NO: 7795351 - DNA, 22 bp, Homo sapiens
tttggagtttaacaacttgaag

SEQ ID NO: 7795352 - DNA, 23 bp, Homo sapiens
tttgtacattgaggaggcagaat

SEQ ID NO: 7795353 - DNA, 22 bp, Homo sapiens
tttgtacaattagcagaggcta

SEQ ID NO: 7795354 - DNA, 22 bp, Homo sapiens
tttgcagaagaaaacatgaaca

SEQ ID NO: 7795355 - DNA, 22 bp, Homo sapiens
tttgcagagtgcagaagcatct

SEQ ID NO: 7795356 - DNA, 22 bp, Homo sapiens
tttgcagcaaggagagagcatt

SEQ ID NO: 7795357 - DNA, 22 bp, Homo sapiens
tttctttatcctcctttgcaca

SEQ ID NO: 7795358 - DNA, 22 bp, Homo sapiens
tttctttatcctcctttgcaca

SEQ ID NO: 7795359 - DNA, 22 bp, Homo sapiens
tttctttatcctcctttgcaca

SEQ ID NO: 7795360 - DNA, 22 bp, Homo sapiens
tttctttccagagtgattggca

SEQ ID NO: 7795361 - DNA, 22 bp, Homo sapiens
tttctttcaattctcctaatgc

SEQ ID NO: 7795362 - DNA, 18 bp, Homo sapiens
tttctttctgcctggggc

SEQ ID NO: 7795363 - DNA, 22 bp, Homo sapiens
tttctttctcgtaaacttagtt

SEQ ID NO: 7795364 - DNA, 22 bp, Homo sapiens
tttctttctcgtaaacttagtt

SEQ ID NO: 7795365 - DNA, 22 bp, Homo sapiens
tttctttccatgagcctatgta

SEQ ID NO: 7795366 - DNA, 22 bp, Homo sapiens
tttctttccatacatattgcta

SEQ ID NO: 7795367 - DNA, 22 bp, Homo sapiens
tttgcaaatatgtgtttctatt

SEQ ID NO: 7795368 - DNA, 22 bp, Homo sapiens
ttttataaagagagtcagttgg

SEQ ID NO: 7795369 - DNA, 22 bp, Homo sapiens
ttttagtttggatttctaaagc

SEQ ID NO: 7795370 - DNA, 22 bp, Homo sapiens
ttttagtttggatttctaaagc

SEQ ID NO: 7795371 - DNA, 22 bp, Homo sapiens
ttttataagcaagaaagggaaa

SEQ ID NO: 7795372 - DNA, 22 bp, Homo sapiens
tttgttttctgtaggcctttcc

SEQ ID NO: 7795373 - DNA, 22 bp, Homo sapiens
tttgttttcaatgtgtcattca

SEQ ID NO: 7795374 - DNA, 22 bp, Homo sapiens
tttgtttagatggtaaatcagt

SEQ ID NO: 7795375 - DNA, 22 bp, Homo sapiens
tttgttttcaatgtgtcattca

SEQ ID NO: 7795376 - DNA, 22 bp, Homo sapiens
tttgttttcaatgtgtcattca

SEQ ID NO: 7795377 - DNA, 22 bp, Homo sapiens
tttgtataagaacattctagca

SEQ ID NO: 7795378 - DNA, 22 bp, Homo sapiens
tttgtagcagcatgatttataa

SEQ ID NO: 7795379 - DNA, 22 bp, Homo sapiens
tttgtagcagcatgatttataa

SEQ ID NO: 7795380 - DNA, 22 bp, Homo sapiens
tttgtattccatatcatgccat

SEQ ID NO: 7795381 - DNA, 22 bp, Homo sapiens
tttgtcaaagatcagatgcttt

SEQ ID NO: 7795382 - DNA, 22 bp, Homo sapiens
tttgtttacaaaaataagcagt

SEQ ID NO: 7795383 - DNA, 22 bp, Homo sapiens
tttgttctgcatcacagaaaaa

SEQ ID NO: 7795384 - DNA, 22 bp, Homo sapiens
tttgttcttgcaacagttatta

SEQ ID NO: 7795385 - DNA, 22 bp, Homo sapiens
tttgttcttgcaacagttatta

SEQ ID NO: 7795386 - DNA, 22 bp, Homo sapiens
ttttctttaatctggtggggtg

SEQ ID NO: 7795387 - DNA, 22 bp, Homo sapiens
ttttcttggagtggctgtcctt

SEQ ID NO: 7795388 - DNA, 22 bp, Homo sapiens
ttttctaacatctagtaatttg

SEQ ID NO: 7795389 - DNA, 20 bp, Homo sapiens
ttttccttctgagtatgttg

SEQ ID NO: 7795390 - DNA, 22 bp, Homo sapiens
ttttggaatttatacagtaatg

SEQ ID NO: 7795391 - DNA, 22 bp, Homo sapiens
ttttggccacatccttttgagt

SEQ ID NO: 7795392 - DNA, 22 bp, Homo sapiens
ttttggctccagtggtttgtgc

SEQ ID NO: 7795393 - DNA, 22 bp, Homo sapiens
tttttggcagctcagaaacttc

SEQ ID NO: 7795394 - DNA, 22 bp, Homo sapiens
tttttgctgataagcagaattc

SEQ ID NO: 7795395 - DNA, 22 bp, Homo sapiens
tttttgctccacaactttgaag

SEQ ID NO: 7795396 - DNA, 22 bp, Homo sapiens
ttttttgtcccagagagcctgg

SEQ ID NO: 7795397 - DNA, 22 bp, Homo sapiens
ttgttttgctaaagggtcatca

SEQ ID NO: 7795398 - DNA, 22 bp, Homo sapiens
ttgttttggaagaacttactct

SEQ ID NO: 7795399 - DNA, 22 bp, Homo sapiens
ttgttttggagatgagctaaaa

SEQ ID NO: 7795400 - DNA, 22 bp, Homo sapiens
ttgtttcttcaggcttttagga

SEQ ID NO: 7795401 - DNA, 23 bp, Homo sapiens
ttgtttctttgtattgtctctat

SEQ ID NO: 7795402 - DNA, 22 bp, Homo sapiens
ttgtttctttgaagtttctaga

SEQ ID NO: 7795403 - DNA, 22 bp, Homo sapiens
ttgtttgtcataatatcattac

SEQ ID NO: 7795404 - DNA, 22 bp, Homo sapiens
ttgtttctgagttttcatgtat

SEQ ID NO: 7795405 - DNA, 22 bp, Homo sapiens
ttgtttctctggtcttgagtga

SEQ ID NO: 7795406 - DNA, 22 bp, Homo sapiens
ttgtttctgagttttcatgtat

SEQ ID NO: 7795407 - DNA, 20 bp, Homo sapiens
ttgtttctgctattttctaa

SEQ ID NO: 7795408 - DNA, 20 bp, Homo sapiens
ttgtttctgctattttctaa

SEQ ID NO: 7795409 - DNA, 22 bp, Homo sapiens
ttgtgtttctggccaagatgga

SEQ ID NO: 7795410 - DNA, 21 bp, Homo sapiens
ttgtgtttccccagtcacttt

SEQ ID NO: 7795411 - DNA, 20 bp, Homo sapiens
ttgtttaaaggtgaagaggc

SEQ ID NO: 7795412 - DNA, 22 bp, Homo sapiens
ttgtctctgccatgcttgaggg

SEQ ID NO: 7795413 - DNA, 22 bp, Homo sapiens
ttggtgaacacatacacatttt

SEQ ID NO: 7795414 - DNA, 22 bp, Homo sapiens
ttggtgaattgagaccatttgt

SEQ ID NO: 7795415 - DNA, 22 bp, Homo sapiens
ttggtcctcagtttccctatct

SEQ ID NO: 7795416 - DNA, 22 bp, Homo sapiens
ttgcaagttccttatgagaatc

SEQ ID NO: 7795417 - DNA, 22 bp, Homo sapiens
ttgcaaggtttctctctgccta

SEQ ID NO: 7795418 - DNA, 22 bp, Homo sapiens
ttgcaaggagccactctgcctg

SEQ ID NO: 7795419 - DNA, 22 bp, Homo sapiens
ttgcaacttctcccatcactct

SEQ ID NO: 7795420 - DNA, 22 bp, Homo sapiens
tttaatttgaaatgagtaaccc

SEQ ID NO: 7795421 - DNA, 22 bp, Homo sapiens
tttaatttgaaatgagtaaccc

SEQ ID NO: 7795422 - DNA, 22 bp, Homo sapiens
tttaattgttgtgggtacatag

SEQ ID NO: 7795423 - DNA, 22 bp, Homo sapiens
tttaattgcatttaaagatgga

SEQ ID NO: 7795424 - DNA, 22 bp, Homo sapiens
tttaattgattcacagtctgta

SEQ ID NO: 7795425 - DNA, 22 bp, Homo sapiens
tttaattttcctggtaggcctg

SEQ ID NO: 7795426 - DNA, 22 bp, Homo sapiens
tttaattttcctcttcctggag

SEQ ID NO: 7795427 - DNA, 22 bp, Homo sapiens
tttaattttctgggcccagcag

SEQ ID NO: 7795428 - DNA, 21 bp, Homo sapiens
tttaatttgcatgtatgacgc

SEQ ID NO: 7795429 - DNA, 22 bp, Homo sapiens
tttaatttgtatttctagaggg

SEQ ID NO: 7795430 - DNA, 22 bp, Homo sapiens
tttaatttgtatttctagaggg

SEQ ID NO: 7795431 - DNA, 22 bp, Homo sapiens
tttaatttgtatttctagaggg

SEQ ID NO: 7795432 - DNA, 22 bp, Homo sapiens
tttaaacaaataggattgccta

SEQ ID NO: 7795433 - DNA, 22 bp, Homo sapiens
tttaaaatttagacctctccac

SEQ ID NO: 7795434 - DNA, 22 bp, Homo sapiens
tttaaaatcagatgggagttgg

SEQ ID NO: 7795435 - DNA, 22 bp, Homo sapiens
tttagttattgttacagtatga

SEQ ID NO: 7795436 - DNA, 21 bp, Homo sapiens
tttactgagcacttactatgt

SEQ ID NO: 7795437 - DNA, 22 bp, Homo sapiens
tttactgaatttggtatattcc

SEQ ID NO: 7795438 - DNA, 19 bp, Homo sapiens
tttactctccaaggtgagt

SEQ ID NO: 7795439 - DNA, 22 bp, Homo sapiens
tttactcttgctacacaactgt

SEQ ID NO: 7795440 - DNA, 22 bp, Homo sapiens
tttagttgaaggcagtcctcaa

SEQ ID NO: 7795441 - DNA, 22 bp, Homo sapiens
tttataaacagtaccacggtgc

SEQ ID NO: 7795442 - DNA, 22 bp, Homo sapiens
tttataaaatagactgggtcta

SEQ ID NO: 7795443 - DNA, 22 bp, Homo sapiens
tttattaatgtagcatccatgg

SEQ ID NO: 7795444 - DNA, 22 bp, Homo sapiens
tttattatgatggacaccttcg

SEQ ID NO: 7795445 - DNA, 22 bp, Homo sapiens
tttattatccagtgttgtcatg

SEQ ID NO: 7795446 - DNA, 22 bp, Homo sapiens
tttattagtgcttgtatcactg

SEQ ID NO: 7795447 - DNA, 22 bp, Homo sapiens
tttattagattatcaaagaggt

SEQ ID NO: 7795448 - DNA, 22 bp, Homo sapiens
tttatttggcatctctgccaag

SEQ ID NO: 7795449 - DNA, 22 bp, Homo sapiens
tttatttggcatccagggagaa

SEQ ID NO: 7795450 - DNA, 22 bp, Homo sapiens
tttatttggcatctctgccaag

SEQ ID NO: 7795451 - DNA, 22 bp, Homo sapiens
tttcaaaccactgaggttctga

SEQ ID NO: 7795452 - DNA, 22 bp, Homo sapiens
tttcaaacctacttgtatgttt

SEQ ID NO: 7795453 - DNA, 22 bp, Homo sapiens
tttcaaactgtactttccccta

SEQ ID NO: 7795454 - DNA, 22 bp, Homo sapiens
tttcaaacttaaatacctttcc

SEQ ID NO: 7795455 - DNA, 22 bp, Homo sapiens
tttcaaacatatcttcattact

SEQ ID NO: 7795456 - DNA, 22 bp, Homo sapiens
tttcaaaattttgcagtggtaa

SEQ ID NO: 7795457 - DNA, 22 bp, Homo sapiens
tttcaaaagcgtacgtagtgaa

SEQ ID NO: 7795458 - DNA, 15 bp, Homo sapiens
tttcaaaatgaggcc

SEQ ID NO: 7795459 - DNA, 22 bp, Homo sapiens
tttcaaactttactcttgaatc

SEQ ID NO: 7795460 - DNA, 20 bp, Homo sapiens
tttcaaaggcacctatgaag

SEQ ID NO: 7795461 - DNA, 23 bp, Homo sapiens
tttcagcattctagttcaggttc

SEQ ID NO: 7795462 - DNA, 22 bp, Homo sapiens
tttcagattatctcaactttgg

SEQ ID NO: 7795463 - DNA, 22 bp, Homo sapiens
tttcaggaaggtgaggcacatg

SEQ ID NO: 7795464 - DNA, 22 bp, Homo sapiens
tttcaggattttatgagatagt

SEQ ID NO: 7795465 - DNA, 22 bp, Homo sapiens
tttcattttggttatgccataa

SEQ ID NO: 7795466 - DNA, 20 bp, Homo sapiens
tttcattgtcagaatcttat

SEQ ID NO: 7795467 - DNA, 22 bp, Homo sapiens
tttcctgagtcagagacaccag

SEQ ID NO: 7795468 - DNA, 22 bp, Homo sapiens
tttcctgttgccatcaagaatg

SEQ ID NO: 7795469 - DNA, 22 bp, Homo sapiens
tttctagaatgactcatctgag

SEQ ID NO: 7795470 - DNA, 22 bp, Homo sapiens
tttctactttggaatgcactga

SEQ ID NO: 7795471 - DNA, 22 bp, Homo sapiens
tttctattgtaagtctcctata

SEQ ID NO: 7795472 - DNA, 23 bp, Homo sapiens
tttctcatccagagagtcagtcc

SEQ ID NO: 7795473 - DNA, 21 bp, Homo sapiens
tttctgtcctttccatcagct

SEQ ID NO: 7795474 - DNA, 19 bp, Homo sapiens
tttctgtctgtgttttgcc

SEQ ID NO: 7795475 - DNA, 21 bp, Homo sapiens
tttctgtctctgccactagtt

SEQ ID NO: 7795476 - DNA, 22 bp, Homo sapiens
tttcttatattctgtcattgtt

SEQ ID NO: 7795477 - DNA, 23 bp, Homo sapiens
tttctgttgggtatatatccaag

SEQ ID NO: 7795478 - DNA, 23 bp, Homo sapiens
tttctgttcctctagctttgcat

SEQ ID NO: 7795479 - DNA, 22 bp, Homo sapiens
tttctttaaaggaactctgttt

SEQ ID NO: 7795480 - DNA, 22 bp, Homo sapiens
tttctttaaaggaactctgttt

SEQ ID NO: 7795481 - DNA, 22 bp, Homo sapiens
tttctttaattctcacagcaat

SEQ ID NO: 7795482 - DNA, 22 bp, Homo sapiens
tttcttgtctttagtatctggc

SEQ ID NO: 7795483 - DNA, 22 bp, Homo sapiens
tttcttgtttcatggtgtctca

SEQ ID NO: 7795484 - DNA, 22 bp, Homo sapiens
tttctttatcatagcatctttg

SEQ ID NO: 7795485 - DNA, 22 bp, Homo sapiens
tttctttatcatagcatctttg

SEQ ID NO: 7795486 - DNA, 22 bp, Homo sapiens
tttctttaggctgtgttgccaa

SEQ ID NO: 7795487 - DNA, 22 bp, Homo sapiens
tttctttaattctcacagcaat

SEQ ID NO: 7795488 - DNA, 22 bp, Homo sapiens
tttcttctctaatctcaatgat

SEQ ID NO: 7795489 - DNA, 22 bp, Homo sapiens
tttcttgtaagatgtttattaa

SEQ ID NO: 7795490 - DNA, 20 bp, Homo sapiens
tttcttgtacttggagaagg

SEQ ID NO: 7795491 - DNA, 20 bp, Homo sapiens
tttcttgtacttggagaagg

SEQ ID NO: 7795492 - DNA, 20 bp, Homo sapiens
tttcttgtcggctgttgctg

SEQ ID NO: 7795493 - DNA, 20 bp, Homo sapiens
tttcttgtcggctgttgctg

SEQ ID NO: 7795494 - DNA, 17 bp, Homo sapiens
tttctccttccatctca

SEQ ID NO: 7795495 - DNA, 22 bp, Homo sapiens
tttctcttaatgtctctgtgct

SEQ ID NO: 7795496 - DNA, 22 bp, Homo sapiens
tttctctgtgccatttccataa

SEQ ID NO: 7795497 - DNA, 22 bp, Homo sapiens
tttctcttcactgtgtgcctca

SEQ ID NO: 7795498 - DNA, 22 bp, Homo sapiens
tttctgtaaggacttaatgcaa

SEQ ID NO: 7795499 - DNA, 20 bp, Homo sapiens
tttctgtagctcagtattca

SEQ ID NO: 7795500 - DNA, 22 bp, Homo sapiens
tttctgtaagtggcaaataatg

SEQ ID NO: 7795501 - DNA, 17 bp, Homo sapiens
tttctggaatgggcaaa

SEQ ID NO: 7795502 - DNA, 22 bp, Homo sapiens
tttctgacagagtgctcagagt

SEQ ID NO: 7795503 - DNA, 22 bp, Homo sapiens
tttctgaggaattaatacagaa

SEQ ID NO: 7795504 - DNA, 22 bp, Homo sapiens
tttctgagaaattaaacacttt

SEQ ID NO: 7795505 - DNA, 18 bp, Homo sapiens
ttaaggataagcagacta

SEQ ID NO: 7795506 - DNA, 23 bp, Homo sapiens
ttaaggagcttgcactctgggtg

SEQ ID NO: 7795507 - DNA, 22 bp, Homo sapiens
ttaaggagcagaatgcttggac

SEQ ID NO: 7795508 - DNA, 22 bp, Homo sapiens
ttaaggctggtcccctctgcgt

SEQ ID NO: 7795509 - DNA, 17 bp, Homo sapiens
ttaaggtggatcagcac

SEQ ID NO: 7795510 - DNA, 17 bp, Homo sapiens
ttaaggtggatcagcac

SEQ ID NO: 7795511 - DNA, 18 bp, Homo sapiens
ttaagttttactgcttta

SEQ ID NO: 7795512 - DNA, 22 bp, Homo sapiens
ttaatttatgtccaaaccagat

SEQ ID NO: 7795513 - DNA, 22 bp, Homo sapiens
ttaatttatacataatcacagg

SEQ ID NO: 7795514 - DNA, 22 bp, Homo sapiens
ttaattctagtttaacacttag

SEQ ID NO: 7795515 - DNA, 22 bp, Homo sapiens
ttaaggaaagccaaaatgaatt

SEQ ID NO: 7795516 - DNA, 22 bp, Homo sapiens
ttaagaaggtactcaaagatct

SEQ ID NO: 7795517 - DNA, 22 bp, Homo sapiens
ttaacatacatcatgaacaatg

SEQ ID NO: 7795518 - DNA, 22 bp, Homo sapiens
ttaaatattttcagcagggtca

SEQ ID NO: 7795519 - DNA, 22 bp, Homo sapiens
ttaaatattatgttgtctgcaa

SEQ ID NO: 7795520 - DNA, 22 bp, Homo sapiens
ttaaatattatgttgtctgcaa

SEQ ID NO: 7795521 - DNA, 22 bp, Homo sapiens
ttaaatattatgttgtctgcaa

SEQ ID NO: 7795522 - DNA, 22 bp, Homo sapiens
ttaaagctaggtggaacaaatt

SEQ ID NO: 7795523 - DNA, 22 bp, Homo sapiens
tgttttctgatggttaatgagt

SEQ ID NO: 7795524 - DNA, 23 bp, Homo sapiens
tgttttcttgtcctggtataatt

SEQ ID NO: 7795525 - DNA, 22 bp, Homo sapiens
tgttttctgggtggaaggtact

SEQ ID NO: 7795526 - DNA, 22 bp, Homo sapiens
tgttttggtttaagtatatgaa

SEQ ID NO: 7795527 - DNA, 22 bp, Homo sapiens
tgttttggaacaaaagctattc

SEQ ID NO: 7795528 - DNA, 22 bp, Homo sapiens
tgttttggtagattgattatgg

SEQ ID NO: 7795529 - DNA, 22 bp, Homo sapiens
ttaaatgaggctgatgtagatt

SEQ ID NO: 7795530 - DNA, 22 bp, Homo sapiens
ttaaatgatgcatatcatttag

SEQ ID NO: 7795531 - DNA, 22 bp, Homo sapiens
ttaaattaggactctagttctg

SEQ ID NO: 7795532 - DNA, 22 bp, Homo sapiens
ttaacaatagagtttcttcagg

SEQ ID NO: 7795533 - DNA, 22 bp, Homo sapiens
ttaatttttatgtatagtgtgt

SEQ ID NO: 7795534 - DNA, 22 bp, Homo sapiens
ttacaaacaacagacatttatt

SEQ ID NO: 7795535 - DNA, 22 bp, Homo sapiens
ttaattttaacctgtttgtgtc

SEQ ID NO: 7795536 - DNA, 22 bp, Homo sapiens
ttaattttctcatctgtgaaat

SEQ ID NO: 7795537 - DNA, 22 bp, Homo sapiens
ttacacaacatctgtattatta

SEQ ID NO: 7795538 - DNA, 22 bp, Homo sapiens
ttacacaagttctttaacctat

SEQ ID NO: 7795539 - DNA, 22 bp, Homo sapiens
ttacacaacatctgtattatta

SEQ ID NO: 7795540 - DNA, 22 bp, Homo sapiens
ttacacagatggttagtagagg

SEQ ID NO: 7795541 - DNA, 22 bp, Homo sapiens
ttacacaatatatggtacttgg

SEQ ID NO: 7795542 - DNA, 22 bp, Homo sapiens
ttacacatgctcacttatttgt

SEQ ID NO: 7795543 - DNA, 22 bp, Homo sapiens
ttacacagtggttaagtctggg

SEQ ID NO: 7795544 - DNA, 22 bp, Homo sapiens
ttacacagtgcacaagcagagt

SEQ ID NO: 7795545 - DNA, 22 bp, Homo sapiens
ttacagtagctttatttggagt

SEQ ID NO: 7795546 - DNA, 22 bp, Homo sapiens
ttacagtagattttgaatgtgg

SEQ ID NO: 7795547 - DNA, 22 bp, Homo sapiens
ttacagtaatcgagtgttgtgg

SEQ ID NO: 7795548 - DNA, 22 bp, Homo sapiens
ttacacttacctgtccattgaa

SEQ ID NO: 7795549 - DNA, 22 bp, Homo sapiens
ttacacttagggtttgtcagag

SEQ ID NO: 7795550 - DNA, 22 bp, Homo sapiens
ttacacttgtaattatataacg

SEQ ID NO: 7795551 - DNA, 22 bp, Homo sapiens
ttacacttgggtgtggatttta

SEQ ID NO: 7795552 - DNA, 22 bp, Homo sapiens
ttacatattatccaaaactgct

SEQ ID NO: 7795553 - DNA, 22 bp, Homo sapiens
ttacatattgtctattgttcaa

SEQ ID NO: 7795554 - DNA, 22 bp, Homo sapiens
ttactagtggagaaactgaggc

SEQ ID NO: 7795555 - DNA, 22 bp, Homo sapiens
ttaccaaatgaaatagagattt

SEQ ID NO: 7795556 - DNA, 22 bp, Homo sapiens
ttacttcttgtctcatgcctat

SEQ ID NO: 7795557 - DNA, 22 bp, Homo sapiens
ttacttctttggccttcagcca

SEQ ID NO: 7795558 - DNA, 22 bp, Homo sapiens
ttacttcttacaaaagaaatat

SEQ ID NO: 7795559 - DNA, 22 bp, Homo sapiens
ttacttcttacaaaagaaatat

SEQ ID NO: 7795560 - DNA, 21 bp, Homo sapiens
ttacttctgcttgttattgtc

SEQ ID NO: 7795561 - DNA, 22 bp, Homo sapiens
ttacttggaggcctgttaccag

SEQ ID NO: 7795562 - DNA, 22 bp, Homo sapiens
ttacttggtgttctgcccagga

SEQ ID NO: 7795563 - DNA, 22 bp, Homo sapiens
ttagaaaatttgcttctttgga

SEQ ID NO: 7795564 - DNA, 22 bp, Homo sapiens
ttagaaagaactttagatatca

SEQ ID NO: 7795565 - DNA, 20 bp, Homo sapiens
ttagaaagagcgtgataaga

SEQ ID NO: 7795566 - DNA, 22 bp, Homo sapiens
ttactttgttctcaagatatgt

SEQ ID NO: 7795567 - DNA, 22 bp, Homo sapiens
ttactttggatggtcaagaaag

SEQ ID NO: 7795568 - DNA, 22 bp, Homo sapiens
ttagagaattccaaatgactac

SEQ ID NO: 7795569 - DNA, 22 bp, Homo sapiens
ttagagaattccaaatgactac

SEQ ID NO: 7795570 - DNA, 22 bp, Homo sapiens
ttagagaagctgtaattattca

SEQ ID NO: 7795571 - DNA, 22 bp, Homo sapiens
ttagaaagctttccatagtcaa

SEQ ID NO: 7795572 - DNA, 21 bp, Homo sapiens
ttagaaagctcactacagtta

SEQ ID NO: 7795573 - DNA, 22 bp, Homo sapiens
ttagaaagctttccatagtcaa

SEQ ID NO: 7795574 - DNA, 22 bp, Homo sapiens
ttagagaagatgaaccatcgtt

SEQ ID NO: 7795575 - DNA, 22 bp, Homo sapiens
ttagagaaccaatgaatagtct

SEQ ID NO: 7795576 - DNA, 22 bp, Homo sapiens
tgtgtccaacccagggacaagt

SEQ ID NO: 7795577 - DNA, 21 bp, Homo sapiens
tgtgtaatatgtataagaata

SEQ ID NO: 7795578 - DNA, 22 bp, Homo sapiens
tgtgtaaatttatttacataaa

SEQ ID NO: 7795579 - DNA, 22 bp, Homo sapiens
tgtgtaaaatctgattaatact

SEQ ID NO: 7795580 - DNA, 22 bp, Homo sapiens
tgttctctctccttttgaagtg

SEQ ID NO: 7795581 - DNA, 22 bp, Homo sapiens
tgttctgagtgcagcttaataa

SEQ ID NO: 7795582 - DNA, 22 bp, Homo sapiens
tgtttacagctgatcaggcatc

SEQ ID NO: 7795583 - DNA, 22 bp, Homo sapiens
tgtttacaaggagtttatattg

SEQ ID NO: 7795584 - DNA, 22 bp, Homo sapiens
tgtttaatttcacaaagttgac

SEQ ID NO: 7795585 - DNA, 22 bp, Homo sapiens
tgtttaattcaccatcatgttc

SEQ ID NO: 7795586 - DNA, 22 bp, Homo sapiens
tgtttaataattctatgatagt

SEQ ID NO: 7795587 - DNA, 22 bp, Homo sapiens
tgtttctttgtagatattcttt

SEQ ID NO: 7795588 - DNA, 20 bp, Homo sapiens
tgtttcttttaatgagcggc

SEQ ID NO: 7795589 - DNA, 22 bp, Homo sapiens
tgtttgagttctagcgcattta

SEQ ID NO: 7795590 - DNA, 22 bp, Homo sapiens
tgtttacatggaggttttcagc

SEQ ID NO: 7795591 - DNA, 22 bp, Homo sapiens
tgtttcatgaaacatgtttagg

SEQ ID NO: 7795592 - DNA, 21 bp, Homo sapiens
tgtttcatgctattttcttgt

SEQ ID NO: 7795593 - DNA, 22 bp, Homo sapiens
tgtttcatgtggacatagttgt

SEQ ID NO: 7795594 - DNA, 22 bp, Homo sapiens
tgtttccatggtgacagcagct

SEQ ID NO: 7795595 - DNA, 22 bp, Homo sapiens
tgtgtttcagaaccttctttca

SEQ ID NO: 7795596 - DNA, 22 bp, Homo sapiens
tgtgttcaagattagttctagt

SEQ ID NO: 7795597 - DNA, 22 bp, Homo sapiens
tgtgttcaatcaccaaaggtat

SEQ ID NO: 7795598 - DNA, 22 bp, Homo sapiens
tgttatttatttcacctccaga

SEQ ID NO: 7795599 - DNA, 22 bp, Homo sapiens
tgttcacttatgttctcccatt

SEQ ID NO: 7795600 - DNA, 22 bp, Homo sapiens
tgttcctgaggcatgtgtcaat

SEQ ID NO: 7795601 - DNA, 22 bp, Homo sapiens
tgttatttatttcacctccaga

SEQ ID NO: 7795602 - DNA, 22 bp, Homo sapiens
tgttatttatctgagcatttat

SEQ ID NO: 7795603 - DNA, 19 bp, Homo sapiens
ttgagcagtgcttagcacc

SEQ ID NO: 7795604 - DNA, 22 bp, Homo sapiens
ttgagcaggatggctatgcaca

SEQ ID NO: 7795605 - DNA, 22 bp, Homo sapiens
ttgaggagttgtgacagatact

SEQ ID NO: 7795606 - DNA, 18 bp, Homo sapiens
ttgaggagttcactgtct

SEQ ID NO: 7795607 - DNA, 22 bp, Homo sapiens
ttgaggagttaggatgtttata

SEQ ID NO: 7795608 - DNA, 22 bp, Homo sapiens
ttgaggagtgtttagggtgagg

SEQ ID NO: 7795609 - DNA, 22 bp, Homo sapiens
ttgaggagtgtgaggtctccca

SEQ ID NO: 7795610 - DNA, 23 bp, Homo sapiens
ttgagctcagtagctctgctggt

SEQ ID NO: 7795611 - DNA, 22 bp, Homo sapiens
ttgaattataagtgtgtctact

SEQ ID NO: 7795612 - DNA, 22 bp, Homo sapiens
ttgaatggcttctaggttctcc

SEQ ID NO: 7795613 - DNA, 22 bp, Homo sapiens
ttgaagagaatcagaaggttga

SEQ ID NO: 7795614 - DNA, 22 bp, Homo sapiens
ttgaagagtttgatagagttga

SEQ ID NO: 7795615 - DNA, 22 bp, Homo sapiens
ttctttctcaacatgaatgttt

SEQ ID NO: 7795616 - DNA, 22 bp, Homo sapiens
ttctttccccatggagttcgga

SEQ ID NO: 7795617 - DNA, 22 bp, Homo sapiens
ttctttccttgcctcagtgaag

SEQ ID NO: 7795618 - DNA, 22 bp, Homo sapiens
ttctttatgttaatgaatctat

SEQ ID NO: 7795619 - DNA, 22 bp, Homo sapiens
ttctttatgttaatgaatctat

SEQ ID NO: 7795620 - DNA, 22 bp, Homo sapiens
ttctttattgagacttcattgt

SEQ ID NO: 7795621 - DNA, 22 bp, Homo sapiens
ttctttattgagacttcattgt

SEQ ID NO: 7795622 - DNA, 22 bp, Homo sapiens
ttctttattagtttagtgagct

SEQ ID NO: 7795623 - DNA, 22 bp, Homo sapiens
ttctttattagtttagtgagct

SEQ ID NO: 7795624 - DNA, 22 bp, Homo sapiens
ttctttatggaatggtgatagt

SEQ ID NO: 7795625 - DNA, 22 bp, Homo sapiens
ttctttatcctatttgtaggtg

SEQ ID NO: 7795626 - DNA, 22 bp, Homo sapiens
ttctttatgcttctgtttaggc

SEQ ID NO: 7795627 - DNA, 22 bp, Homo sapiens
ttctttcaatagctggcatatg

SEQ ID NO: 7795628 - DNA, 22 bp, Homo sapiens
ttgatttcaaaatatatgcttg

SEQ ID NO: 7795629 - DNA, 22 bp, Homo sapiens
ttgatcttcatcgaaatattgt

SEQ ID NO: 7795630 - DNA, 22 bp, Homo sapiens
ttgatcttacagtgttcttcca

SEQ ID NO: 7795631 - DNA, 22 bp, Homo sapiens
ttgatcttcatttgttctgtat

SEQ ID NO: 7795632 - DNA, 22 bp, Homo sapiens
ttgatctttataatagttttga

SEQ ID NO: 7795633 - DNA, 22 bp, Homo sapiens
ttctgctttcagttcttctggg

SEQ ID NO: 7795634 - DNA, 22 bp, Homo sapiens
ttctgcttttagctaaactata

SEQ ID NO: 7795635 - DNA, 20 bp, Homo sapiens
ttctgcttgcaaatatcaag

SEQ ID NO: 7795636 - DNA, 22 bp, Homo sapiens
ttctgcttagagggcatttgca

SEQ ID NO: 7795637 - DNA, 22 bp, Homo sapiens
ttctgcttattcaaatgatctt

SEQ ID NO: 7795638 - DNA, 22 bp, Homo sapiens
ttctgcttattctgtagccttt

SEQ ID NO: 7795639 - DNA, 22 bp, Homo sapiens
ttctggaaagcatttgaggccc

SEQ ID NO: 7795640 - DNA, 20 bp, Homo sapiens
ttctagtttggagttattaa

SEQ ID NO: 7795641 - DNA, 22 bp, Homo sapiens
ttctagttaaagtatgtattag

SEQ ID NO: 7795642 - DNA, 22 bp, Homo sapiens
ttctgtttgtgaactggctgag

SEQ ID NO: 7795643 - DNA, 22 bp, Homo sapiens
ttctgttttagaaataagtagt

SEQ ID NO: 7795644 - DNA, 22 bp, Homo sapiens
ttctgtttgccatatatagtag

SEQ ID NO: 7795645 - DNA, 22 bp, Homo sapiens
ttctgtttctggggtctctgac

SEQ ID NO: 7795646 - DNA, 22 bp, Homo sapiens
ttctgtttgccatatatagtag

SEQ ID NO: 7795647 - DNA, 22 bp, Homo sapiens
ttctgtttataatttgcagttg

SEQ ID NO: 7795648 - DNA, 22 bp, Homo sapiens
ttctggttacattgttacagct

SEQ ID NO: 7795649 - DNA, 22 bp, Homo sapiens
ttctttaaaatagtgagaaaga

SEQ ID NO: 7795650 - DNA, 22 bp, Homo sapiens
ttcttggaaactgattccttgt

SEQ ID NO: 7795651 - DNA, 18 bp, Homo sapiens
ttctttaattcagtttga

SEQ ID NO: 7795652 - DNA, 22 bp, Homo sapiens
ttctttatcagttactcatagg

SEQ ID NO: 7795653 - DNA, 23 bp, Homo sapiens
ttctttataaatcaatgggatgt

SEQ ID NO: 7795654 - DNA, 22 bp, Homo sapiens
ttctttatagctattggatgag

SEQ ID NO: 7795655 - DNA, 22 bp, Homo sapiens
ttctttatatctgctagtgggt

SEQ ID NO: 7795656 - DNA, 22 bp, Homo sapiens
ttcttctttccaattacatggt

SEQ ID NO: 7795657 - DNA, 22 bp, Homo sapiens
ttcttacatattttcatatggt

SEQ ID NO: 7795658 - DNA, 22 bp, Homo sapiens
ttctacaaatatttactgttcc

SEQ ID NO: 7795659 - DNA, 22 bp, Homo sapiens
ttctagaatgatatgaggtact

SEQ ID NO: 7795660 - DNA, 22 bp, Homo sapiens
ttctagaaactggagcaaacag

SEQ ID NO: 7795661 - DNA, 22 bp, Homo sapiens
ttcctgaaaatacagggagacc

SEQ ID NO: 7795662 - DNA, 22 bp, Homo sapiens
ttcctgaaaatacagggagaga

SEQ ID NO: 7795663 - DNA, 22 bp, Homo sapiens
ttcctgaagtcaaagatctaaa

SEQ ID NO: 7795664 - DNA, 22 bp, Homo sapiens
ttcctgaacatttctaagttga

SEQ ID NO: 7795665 - DNA, 22 bp, Homo sapiens
ttctaagaaatggaaaacgatt

SEQ ID NO: 7795666 - DNA, 22 bp, Homo sapiens
ttctaagaggctaatgaagaat

SEQ ID NO: 7795667 - DNA, 22 bp, Homo sapiens
ttccagaccattccacgggaga

SEQ ID NO: 7795668 - DNA, 22 bp, Homo sapiens
ttccagaattgggagccttgag

SEQ ID NO: 7795669 - DNA, 22 bp, Homo sapiens
ttccagactatcagcagcagga

SEQ ID NO: 7795670 - DNA, 22 bp, Homo sapiens
ttccagaagatggcagcaaagg

SEQ ID NO: 7795671 - DNA, 22 bp, Homo sapiens
ttccagaagcctccatattact

SEQ ID NO: 7795672 - DNA, 22 bp, Homo sapiens
ttccagaactcaagaaatgccc

SEQ ID NO: 7795673 - DNA, 22 bp, Homo sapiens
ttccagaacaatgtggacgtat

SEQ ID NO: 7795674 - DNA, 22 bp, Homo sapiens
ttcctagaatggttagaaaata

SEQ ID NO: 7795675 - DNA, 22 bp, Homo sapiens
ttcctacatttgcctcactccc

SEQ ID NO: 7795676 - DNA, 22 bp, Homo sapiens
ttcctacagccctgaatctcta

SEQ ID NO: 7795677 - DNA, 22 bp, Homo sapiens
ttcctacatcaccagggggagt

SEQ ID NO: 7795678 - DNA, 22 bp, Homo sapiens
ttcctacaattagagcctcttt

SEQ ID NO: 7795679 - DNA, 22 bp, Homo sapiens
ttcctacatttgtacaataaga

SEQ ID NO: 7795680 - DNA, 22 bp, Homo sapiens
ttcacaaagctggagcatttcc

SEQ ID NO: 7795681 - DNA, 22 bp, Homo sapiens
ttcaatttagtgatgttgttgg

SEQ ID NO: 7795682 - DNA, 22 bp, Homo sapiens
ttcaatttcataatatctagct

SEQ ID NO: 7795683 - DNA, 22 bp, Homo sapiens
ttagaggttctatgtgtctgga

SEQ ID NO: 7795684 - DNA, 22 bp, Homo sapiens
ttagataaaagtgttcaataaa

SEQ ID NO: 7795685 - DNA, 22 bp, Homo sapiens
ttagataaattgcaacttgatt

SEQ ID NO: 7795686 - DNA, 21 bp, Homo sapiens
ttcaacaaagggaataagttt

SEQ ID NO: 7795687 - DNA, 22 bp, Homo sapiens
ttcaacaacttggttcaaatgg

SEQ ID NO: 7795688 - DNA, 22 bp, Homo sapiens
ttcaacaagtagtacacacagt

SEQ ID NO: 7795689 - DNA, 22 bp, Homo sapiens
ttcaacaatgaaagctaaggaa

SEQ ID NO: 7795690 - DNA, 18 bp, Homo sapiens
ttcatgttggcttaggga

SEQ ID NO: 7795691 - DNA, 22 bp, Homo sapiens
ttcatgtatttatcatgtaaat

SEQ ID NO: 7795692 - DNA, 22 bp, Homo sapiens
ttcatgtattgcattgtgtcct

SEQ ID NO: 7795693 - DNA, 22 bp, Homo sapiens
ttcacagtggctaagttctgca

SEQ ID NO: 7795694 - DNA, 22 bp, Homo sapiens
ttcagtatgattcctccagtag

SEQ ID NO: 7795695 - DNA, 22 bp, Homo sapiens
ttcaggtgtcaaggataggctg

SEQ ID NO: 7795696 - DNA, 22 bp, Homo sapiens
cagacaaggccatctttcattt

SEQ ID NO: 7795697 - DNA, 22 bp, Homo sapiens
cagacacacaagcaatctaagt

SEQ ID NO: 7795698 - DNA, 22 bp, Homo sapiens
gggaggcagtgctggaggctgg

SEQ ID NO: 7795699 - DNA, 22 bp, Homo sapiens
cagactgtggcttcttggaggg

SEQ ID NO: 7795700 - DNA, 22 bp, Homo sapiens
cagagcacccaaggagcatttg

SEQ ID NO: 7795701 - DNA, 22 bp, Homo sapiens
cagagcactgcttggaggattt

SEQ ID NO: 7795702 - DNA, 22 bp, Homo sapiens
gggatgagagctgggacagaag

SEQ ID NO: 7795703 - DNA, 22 bp, Homo sapiens
cagagcaggggtttcccaggtt

SEQ ID NO: 7795704 - DNA, 22 bp, Homo sapiens
cagagccaaatgctgtggttat

SEQ ID NO: 7795705 - DNA, 22 bp, Homo sapiens
cagagcatttggaagccacgtg

SEQ ID NO: 7795706 - DNA, 22 bp, Homo sapiens
cagagcattgagggtctgccaa

SEQ ID NO: 7795707 - DNA, 22 bp, Homo sapiens
cagagcattgagggtctgccaa

SEQ ID NO: 7795708 - DNA, 22 bp, Homo sapiens
cagagcattgagggtctgccaa

SEQ ID NO: 7795709 - DNA, 22 bp, Homo sapiens
cagagcattaaaaccagctctg

SEQ ID NO: 7795710 - DNA, 22 bp, Homo sapiens
cagagcattaaaaccagctctg

SEQ ID NO: 7795711 - DNA, 22 bp, Homo sapiens
cagagcatgtcaactagcttta

SEQ ID NO: 7795712 - DNA, 22 bp, Homo sapiens
cagagcatgtcaactagcttta

SEQ ID NO: 7795713 - DNA, 22 bp, Homo sapiens
cagagcatcgcgcagagagcct

SEQ ID NO: 7795714 - DNA, 22 bp, Homo sapiens
cagagcatgaataaaagttaca

SEQ ID NO: 7795715 - DNA, 22 bp, Homo sapiens
cagagcataattgacatgaggt

SEQ ID NO: 7795716 - DNA, 22 bp, Homo sapiens
cagagcataattgacatgaggt

SEQ ID NO: 7795717 - DNA, 22 bp, Homo sapiens
cagatatgataggattagcaca

SEQ ID NO: 7795718 - DNA, 22 bp, Homo sapiens
cagatgagagtggccagggttc

SEQ ID NO: 7795719 - DNA, 19 bp, Homo sapiens
cagatgagaaaagtgaggt

SEQ ID NO: 7795720 - DNA, 18 bp, Homo sapiens
cagatgagatgcaatctc

SEQ ID NO: 7795721 - DNA, 22 bp, Homo sapiens
cagatgaggggcatataacaat

SEQ ID NO: 7795722 - DNA, 23 bp, Homo sapiens
cagatgaggttggcagcatggtc

SEQ ID NO: 7795723 - DNA, 22 bp, Homo sapiens
cagatgaggacagatgactggg

SEQ ID NO: 7795724 - DNA, 22 bp, Homo sapiens
cagatgaggcaacctcattgct

SEQ ID NO: 7795725 - DNA, 20 bp, Homo sapiens
gggtccctccggcctgctat

SEQ ID NO: 7795726 - DNA, 22 bp, Homo sapiens
gggttcctccagttcctagagc

SEQ ID NO: 7795727 - DNA, 22 bp, Homo sapiens
ggtatacaagagcaatttaggg

SEQ ID NO: 7795728 - DNA, 19 bp, Homo sapiens
ggtatatgggcctcacttg

SEQ ID NO: 7795729 - DNA, 19 bp, Homo sapiens
cagccctcttaccactgtg

SEQ ID NO: 7795730 - DNA, 22 bp, Homo sapiens
cagccctgaaacaacctcctct

SEQ ID NO: 7795731 - DNA, 22 bp, Homo sapiens
cagattctccaggggctgcaga

SEQ ID NO: 7795732 - DNA, 22 bp, Homo sapiens
cagattctcactgtattcaggt

SEQ ID NO: 7795733 - DNA, 22 bp, Homo sapiens
cagattctgggcccagcttgtc

SEQ ID NO: 7795734 - DNA, 22 bp, Homo sapiens
cagattctgaagtctagctgct

SEQ ID NO: 7795735 - DNA, 22 bp, Homo sapiens
cagattctccaggggctgcaga

SEQ ID NO: 7795736 - DNA, 22 bp, Homo sapiens
cagattcttcattgccccattc

SEQ ID NO: 7795737 - DNA, 22 bp, Homo sapiens
cagatttactccctgctgctgc

SEQ ID NO: 7795738 - DNA, 22 bp, Homo sapiens
cagatttagagtggggcttgga

SEQ ID NO: 7795739 - DNA, 22 bp, Homo sapiens
cagatttacctaactccaagtt

SEQ ID NO: 7795740 - DNA, 22 bp, Homo sapiens
cagcagcctacaatgcacagaa

SEQ ID NO: 7795741 - DNA, 22 bp, Homo sapiens
gtacacttgactcataggaaat

SEQ ID NO: 7795742 - DNA, 22 bp, Homo sapiens
gtacacagatgcttgagaatct

SEQ ID NO: 7795743 - DNA, 22 bp, Homo sapiens
gtaggcagtggttggaagagaa

SEQ ID NO: 7795744 - DNA, 22 bp, Homo sapiens
gtacttccctgggaggcaagca

SEQ ID NO: 7795745 - DNA, 22 bp, Homo sapiens
gtacttctttagtcaatatgta

SEQ ID NO: 7795746 - DNA, 22 bp, Homo sapiens
gtccagagatggacgagcagat

SEQ ID NO: 7795747 - DNA, 22 bp, Homo sapiens
cagccaggactcccatttagga

SEQ ID NO: 7795748 - DNA, 22 bp, Homo sapiens
cagccaggcccccgagtcgttg

SEQ ID NO: 7795749 - DNA, 22 bp, Homo sapiens
cagccaggatggagaactgttg

SEQ ID NO: 7795750 - DNA, 22 bp, Homo sapiens
cagccaggatggagaactgttg

SEQ ID NO: 7795751 - DNA, 22 bp, Homo sapiens
gtcagcaaggtgcaagcggctg

SEQ ID NO: 7795752 - DNA, 22 bp, Homo sapiens
gtcacactcttccctccacatg

SEQ ID NO: 7795753 - DNA, 22 bp, Homo sapiens
gtcacaggcctggatgaggggc

SEQ ID NO: 7795754 - DNA, 22 bp, Homo sapiens
gtcacaggcagtaactaggacc

SEQ ID NO: 7795755 - DNA, 22 bp, Homo sapiens
gtagggacttgttttactagta

SEQ ID NO: 7795756 - DNA, 22 bp, Homo sapiens
gtagggacaatatgttattaga

SEQ ID NO: 7795757 - DNA, 21 bp, Homo sapiens
gtagggacagagagttggtga

SEQ ID NO: 7795758 - DNA, 19 bp, Homo sapiens
gtagggacagtggttctga

SEQ ID NO: 7795759 - DNA, 22 bp, Homo sapiens
gtagggacatgccattatctca

SEQ ID NO: 7795760 - DNA, 22 bp, Homo sapiens
gtagggacccacagtctatatt

SEQ ID NO: 7795761 - DNA, 22 bp, Homo sapiens
gtagggactgttctcacctgag

SEQ ID NO: 7795762 - DNA, 22 bp, Homo sapiens
ggccaggctgccctgggagcag

SEQ ID NO: 7795763 - DNA, 20 bp, Homo sapiens
cacctggctgactgtctcca

SEQ ID NO: 7795764 - DNA, 22 bp, Homo sapiens
cactccagcctcagtgacagag

SEQ ID NO: 7795765 - DNA, 22 bp, Homo sapiens
cactcctgttccactaaatgag

SEQ ID NO: 7795766 - DNA, 23 bp, Homo sapiens
cactcctgtttctaagccagcat

SEQ ID NO: 7795767 - DNA, 22 bp, Homo sapiens
cactgcactccagcctgggaga

SEQ ID NO: 7795768 - DNA, 22 bp, Homo sapiens
cactatcttgtagggcatggca

SEQ ID NO: 7795769 - DNA, 22 bp, Homo sapiens
cacgccagccggacactgggcc

SEQ ID NO: 7795770 - DNA, 17 bp, Homo sapiens
cactagtagtctctggc

SEQ ID NO: 7795771 - DNA, 22 bp, Homo sapiens
cacttgttggtggtgaaatcac

SEQ ID NO: 7795772 - DNA, 22 bp, Homo sapiens
cactgtggcaacctgtgcccaa

SEQ ID NO: 7795773 - DNA, 22 bp, Homo sapiens
cacttcaatctctgcctccatc

SEQ ID NO: 7795774 - DNA, 22 bp, Homo sapiens
cacttattatgggctaggaact

SEQ ID NO: 7795775 - DNA, 22 bp, Homo sapiens
cacttcaaataagctcttctca

SEQ ID NO: 7795776 - DNA, 22 bp, Homo sapiens
cacttatttatgcagaaaagtt

SEQ ID NO: 7795777 - DNA, 22 bp, Homo sapiens
cactgcactccagcctgggtga

SEQ ID NO: 7795778 - DNA, 22 bp, Homo sapiens
cactgcactccagcctgggtca

SEQ ID NO: 7795779 - DNA, 22 bp, Homo sapiens
cactgtcacgttctgaaactgt

SEQ ID NO: 7795780 - DNA, 18 bp, Homo sapiens
cacaggcaggtgataggt

SEQ ID NO: 7795781 - DNA, 22 bp, Homo sapiens
cacaggtttgacaaggataaaa

SEQ ID NO: 7795782 - DNA, 22 bp, Homo sapiens
cacaggttaggtattatactat

SEQ ID NO: 7795783 - DNA, 22 bp, Homo sapiens
cacaggttcacctcaggtaggt

SEQ ID NO: 7795784 - DNA, 22 bp, Homo sapiens
ggcaaggggtcaggctgagaca

SEQ ID NO: 7795785 - DNA, 22 bp, Homo sapiens
ggcaagtgcttccccaaccaca

SEQ ID NO: 7795786 - DNA, 16 bp, Homo sapiens
cacatatatttatatg

SEQ ID NO: 7795787 - DNA, 16 bp, Homo sapiens
cacatatatttatatg

SEQ ID NO: 7795788 - DNA, 22 bp, Homo sapiens
ggcaatagttgtgggttcttta

SEQ ID NO: 7795789 - DNA, 22 bp, Homo sapiens
cacatgtttgctacatttttct

SEQ ID NO: 7795790 - DNA, 22 bp, Homo sapiens
cacattaaaatcctaacttcca

SEQ ID NO: 7795791 - DNA, 22 bp, Homo sapiens
cacattaaatagtagggatgct

SEQ ID NO: 7795792 - DNA, 22 bp, Homo sapiens
gctggggagcaagagtagtgag

SEQ ID NO: 7795793 - DNA, 22 bp, Homo sapiens
caagccttggaaatccattctg

SEQ ID NO: 7795794 - DNA, 22 bp, Homo sapiens
caagctgaacactgtcttcaag

SEQ ID NO: 7795795 - DNA, 22 bp, Homo sapiens
caacttttctgtgaatttaagt

SEQ ID NO: 7795796 - DNA, 22 bp, Homo sapiens
caacttttgacacgtgtgctaa

SEQ ID NO: 7795797 - DNA, 23 bp, Homo sapiens
caacttttggctacatgcttagc

SEQ ID NO: 7795798 - DNA, 22 bp, Homo sapiens
caacaccttgatcttggacttc

SEQ ID NO: 7795799 - DNA, 22 bp, Homo sapiens
caaagtgcctgtaccactttgc

SEQ ID NO: 7795800 - DNA, 22 bp, Homo sapiens
ggaagctggacaggctttgagt

SEQ ID NO: 7795801 - DNA, 22 bp, Homo sapiens
cacaaataccagtttcctaaca

SEQ ID NO: 7795802 - DNA, 22 bp, Homo sapiens
cacaaataccagtttcctaaca

SEQ ID NO: 7795803 - DNA, 22 bp, Homo sapiens
cacaaataccagtttcctaaca

SEQ ID NO: 7795804 - DNA, 22 bp, Homo sapiens
ggaccacaatatttgtgaggtt

SEQ ID NO: 7795805 - DNA, 19 bp, Homo sapiens
caattctattatcattcca

SEQ ID NO: 7795806 - DNA, 22 bp, Homo sapiens
caattctttcagctgcatttgt

SEQ ID NO: 7795807 - DNA, 22 bp, Homo sapiens
caattcttggagaagaagcata

SEQ ID NO: 7795808 - DNA, 22 bp, Homo sapiens
caatttcaagattctgttcttt

SEQ ID NO: 7795809 - DNA, 22 bp, Homo sapiens
caattctttgtagaagctctcc

SEQ ID NO: 7795810 - DNA, 22 bp, Homo sapiens
caatttctaacattccatggat

SEQ ID NO: 7795811 - DNA, 22 bp, Homo sapiens
caatttcatgccatgtattgct

SEQ ID NO: 7795812 - DNA, 22 bp, Homo sapiens
caatttcatcttgtgcttcaat

SEQ ID NO: 7795813 - DNA, 20 bp, Homo sapiens
caatttcatcatttcctgtg

SEQ ID NO: 7795814 - DNA, 22 bp, Homo sapiens
caatttcaatgaggccacaggg

SEQ ID NO: 7795815 - DNA, 23 bp, Homo sapiens
caatttcatatgattctacctaa

SEQ ID NO: 7795816 - DNA, 22 bp, Homo sapiens
caatttcaggtggataggtttt

SEQ ID NO: 7795817 - DNA, 22 bp, Homo sapiens
caatttcactaatgatgtgggg

SEQ ID NO: 7795818 - DNA, 22 bp, Homo sapiens
caatttcagacctttccttgga

SEQ ID NO: 7795819 - DNA, 22 bp, Homo sapiens
caatttcactgacaccctggaa

SEQ ID NO: 7795820 - DNA, 22 bp, Homo sapiens
caaggccttgctgtctcctcct

SEQ ID NO: 7795821 - DNA, 22 bp, Homo sapiens
atgctatgtaactggcagatag

SEQ ID NO: 7795822 - DNA, 22 bp, Homo sapiens
gaatttcctctaaacccctgag

SEQ ID NO: 7795823 - DNA, 22 bp, Homo sapiens
gaatttcatttgtttcctacca

SEQ ID NO: 7795824 - DNA, 22 bp, Homo sapiens
gaatttcaggacaactggaagg

SEQ ID NO: 7795825 - DNA, 22 bp, Homo sapiens
gaatttcaagcagtgcaatgtt

SEQ ID NO: 7795826 - DNA, 22 bp, Homo sapiens
gaatttcaaagaggttaagagg

SEQ ID NO: 7795827 - DNA, 22 bp, Homo sapiens
atgagcagtttttaagtagcaa

SEQ ID NO: 7795828 - DNA, 22 bp, Homo sapiens
gaagccttgaactgcaaacccc

SEQ ID NO: 7795829 - DNA, 22 bp, Homo sapiens
gaagccttatcagtcacttata

SEQ ID NO: 7795830 - DNA, 22 bp, Homo sapiens
gaaggagggtgcggatctgagc

SEQ ID NO: 7795831 - DNA, 22 bp, Homo sapiens
gaaggagggtgcggatctgagc

SEQ ID NO: 7795832 - DNA, 22 bp, Homo sapiens
atgcaggagccctcttgagggc

SEQ ID NO: 7795833 - DNA, 22 bp, Homo sapiens
atgcagtggcagctcctggtgt

SEQ ID NO: 7795834 - DNA, 22 bp, Homo sapiens
atctttctatggtactttctcc

SEQ ID NO: 7795835 - DNA, 22 bp, Homo sapiens
atctttctctgcactatacaat

SEQ ID NO: 7795836 - DNA, 22 bp, Homo sapiens
atctttctccatatacatcttt

SEQ ID NO: 7795837 - DNA, 22 bp, Homo sapiens
atctttatttattgagcactta

SEQ ID NO: 7795838 - DNA, 21 bp, Homo sapiens
atctttattacgcagagaaga

SEQ ID NO: 7795839 - DNA, 17 bp, Homo sapiens
cttgttttccactggga

SEQ ID NO: 7795840 - DNA, 22 bp, Homo sapiens
ctttacagaaagagaactctgg

SEQ ID NO: 7795841 - DNA, 22 bp, Homo sapiens
ctttacagataggaactactca

SEQ ID NO: 7795842 - DNA, 22 bp, Homo sapiens
ctttacagaataagaatactgg

SEQ ID NO: 7795843 - DNA, 22 bp, Homo sapiens
ctttacagatggataattgttt

SEQ ID NO: 7795844 - DNA, 22 bp, Homo sapiens
ctttacagatggataattgttt

SEQ ID NO: 7795845 - DNA, 22 bp, Homo sapiens
ctttacagcttagtggtatgga

SEQ ID NO: 7795846 - DNA, 22 bp, Homo sapiens
ctttattgtccttcttaggtgg

SEQ ID NO: 7795847 - DNA, 22 bp, Homo sapiens
ctttattagatgtagactttct

SEQ ID NO: 7795848 - DNA, 22 bp, Homo sapiens
ctttacattaatttctactgat

SEQ ID NO: 7795849 - DNA, 22 bp, Homo sapiens
ctttttataccgtgccagttga

SEQ ID NO: 7795850 - DNA, 22 bp, Homo sapiens
cttttgttgcccttgtcgcagg

SEQ ID NO: 7795851 - DNA, 22 bp, Homo sapiens
ctttttcattggctttaggaca

SEQ ID NO: 7795852 - DNA, 22 bp, Homo sapiens
atgacatgattgccatttgata

SEQ ID NO: 7795853 - DNA, 22 bp, Homo sapiens
ctttttcattggctttaggaca

SEQ ID NO: 7795854 - DNA, 22 bp, Homo sapiens
atgagattttaaaacttcactt

SEQ ID NO: 7795855 - DNA, 22 bp, Homo sapiens
atgagaggtttcgtcagaggaa

SEQ ID NO: 7795856 - DNA, 22 bp, Homo sapiens
atgacacttggtgatactttgt

SEQ ID NO: 7795857 - DNA, 22 bp, Homo sapiens
atgacagacagaagggattttt

SEQ ID NO: 7795858 - DNA, 22 bp, Homo sapiens
atgaattgaggaaaacagtcgt

SEQ ID NO: 7795859 - DNA, 22 bp, Homo sapiens
gaggcctgggttggaggtgcat

SEQ ID NO: 7795860 - DNA, 22 bp, Homo sapiens
atgtatttctatgtagtgaaga

SEQ ID NO: 7795861 - DNA, 22 bp, Homo sapiens
gaggctccccatgaggccccag

SEQ ID NO: 7795862 - DNA, 22 bp, Homo sapiens
gaggagggctttgttgatgtta

SEQ ID NO: 7795863 - DNA, 22 bp, Homo sapiens
gaggcacagtcccgaggcaagg

SEQ ID NO: 7795864 - DNA, 22 bp, Homo sapiens
atgtcactccagggacacaggt

SEQ ID NO: 7795865 - DNA, 19 bp, Homo sapiens
atgtcactcatgttccctg

SEQ ID NO: 7795866 - DNA, 22 bp, Homo sapiens
atgtcactgttgttattgttat

SEQ ID NO: 7795867 - DNA, 22 bp, Homo sapiens
atgtcactgtttaccagctcca

SEQ ID NO: 7795868 - DNA, 22 bp, Homo sapiens
atgtcagtctttctgtctcaga

SEQ ID NO: 7795869 - DNA, 22 bp, Homo sapiens
gaggttcacaggctatcacagt

SEQ ID NO: 7795870 - DNA, 22 bp, Homo sapiens
gaggttctgggggtctgcctgg

SEQ ID NO: 7795871 - DNA, 22 bp, Homo sapiens
gaggttcagtaaggaatactga

SEQ ID NO: 7795872 - DNA, 22 bp, Homo sapiens
gaggttcacttcctggatcctt

SEQ ID NO: 7795873 - DNA, 22 bp, Homo sapiens
gaggttcaggaaatgggcaaag

SEQ ID NO: 7795874 - DNA, 22 bp, Homo sapiens
gaggttcagctgctgcctggta

SEQ ID NO: 7795875 - DNA, 22 bp, Homo sapiens
gaggttcacttcctgaaatagc

SEQ ID NO: 7795876 - DNA, 19 bp, Homo sapiens
gaggttcacgcgctggatg

SEQ ID NO: 7795877 - DNA, 22 bp, Homo sapiens
atgggaggaagagaagatgtct

SEQ ID NO: 7795878 - DNA, 22 bp, Homo sapiens
atgggagggtggaaaggctctg

SEQ ID NO: 7795879 - DNA, 20 bp, Homo sapiens
gagctgagtgtggtcatggg

SEQ ID NO: 7795880 - DNA, 22 bp, Homo sapiens
gagctgagtgtcctaggcatgg

SEQ ID NO: 7795881 - DNA, 22 bp, Homo sapiens
attccactccaataagtgtcaa

SEQ ID NO: 7795882 - DNA, 22 bp, Homo sapiens
gcaggcaggcttccttgaactg

SEQ ID NO: 7795883 - DNA, 22 bp, Homo sapiens
gcaggcaggagcccaactgcct

SEQ ID NO: 7795884 - DNA, 19 bp, Homo sapiens
gcatcagagcagaaggggt

SEQ ID NO: 7795885 - DNA, 22 bp, Homo sapiens
attctttggacaataagtggtg

SEQ ID NO: 7795886 - DNA, 22 bp, Homo sapiens
attctttccagacactgattgc

SEQ ID NO: 7795887 - DNA, 22 bp, Homo sapiens
attctttccagacactgattgc

SEQ ID NO: 7795888 - DNA, 22 bp, Homo sapiens
attctgcacttcctttgcttcc

SEQ ID NO: 7795889 - DNA, 22 bp, Homo sapiens
gatgtgtagagggaatttcaaa

SEQ ID NO: 7795890 - DNA, 22 bp, Homo sapiens
gattcagtgagggtgagaagaa

SEQ ID NO: 7795891 - DNA, 22 bp, Homo sapiens
gatgtgaggactcatgtggagg

SEQ ID NO: 7795892 - DNA, 22 bp, Homo sapiens
gatgtgagtggtagctgggatt

SEQ ID NO: 7795893 - DNA, 22 bp, Homo sapiens
attaaattttcactaggctccc

SEQ ID NO: 7795894 - DNA, 22 bp, Homo sapiens
gattcttgggccttctgaagtt

SEQ ID NO: 7795895 - DNA, 22 bp, Homo sapiens
gattcccatgtctgaggaggtg

SEQ ID NO: 7795896 - DNA, 22 bp, Homo sapiens
gcagagaggaatgaagccatcc

SEQ ID NO: 7795897 - DNA, 22 bp, Homo sapiens
gcagagaggatattattgtcca

SEQ ID NO: 7795898 - DNA, 22 bp, Homo sapiens
gcagagagttgggctgcgccag

SEQ ID NO: 7795899 - DNA, 22 bp, Homo sapiens
gcagagaccccgcagtgaggcc

SEQ ID NO: 7795900 - DNA, 22 bp, Homo sapiens
attatctatgtagaatgatttt

SEQ ID NO: 7795901 - DNA, 22 bp, Homo sapiens
gcagagaaggattgaaaccaga

SEQ ID NO: 7795902 - DNA, 22 bp, Homo sapiens
attatgtatttggtatagtttg

SEQ ID NO: 7795903 - DNA, 22 bp, Homo sapiens
attaagactgcccatgttttta

SEQ ID NO: 7795904 - DNA, 22 bp, Homo sapiens
attaagactattgatatttaca

SEQ ID NO: 7795905 - DNA, 22 bp, Homo sapiens
attataggcttgagccaccgtg

SEQ ID NO: 7795906 - DNA, 22 bp, Homo sapiens
gcaccaggcagctgagcaggcc

SEQ ID NO: 7795907 - DNA, 19 bp, Homo sapiens
gcccaggggcccgatgctg

SEQ ID NO: 7795908 - DNA, 22 bp, Homo sapiens
gcccaggttggagagcagtggc

SEQ ID NO: 7795909 - DNA, 22 bp, Homo sapiens
gcccaggtgccctctgccttac

SEQ ID NO: 7795910 - DNA, 22 bp, Homo sapiens
gcccagggtgcttagaacccat

SEQ ID NO: 7795911 - DNA, 22 bp, Homo sapiens
gcccagggtgaagtgcagttgt

SEQ ID NO: 7795912 - DNA, 22 bp, Homo sapiens
gcccagggtctacaaaaatatt

SEQ ID NO: 7795913 - DNA, 22 bp, Homo sapiens
gcccagtagttcaaggttgcag

SEQ ID NO: 7795914 - DNA, 19 bp, Homo sapiens
atttattgtatgattccat

SEQ ID NO: 7795915 - DNA, 22 bp, Homo sapiens
atttattggtttgcatggtgaa

SEQ ID NO: 7795916 - DNA, 22 bp, Homo sapiens
atttcttcaggttcttctagga

SEQ ID NO: 7795917 - DNA, 22 bp, Homo sapiens
gccagccagaaacgtcacactg

SEQ ID NO: 7795918 - DNA, 22 bp, Homo sapiens
attgtacatgcagtgagtcatc

SEQ ID NO: 7795919 - DNA, 19 bp, Homo sapiens
attgtacattgagtttggc

SEQ ID NO: 7795920 - DNA, 22 bp, Homo sapiens
atttatgactggtgaatagaac

SEQ ID NO: 7795921 - DNA, 22 bp, Homo sapiens
atttattaagcatctgctatgt

SEQ ID NO: 7795922 - DNA, 22 bp, Homo sapiens
atttattacctcggagtttctg

SEQ ID NO: 7795923 - DNA, 22 bp, Homo sapiens
atttattatgggatttggcaca

SEQ ID NO: 7795924 - DNA, 22 bp, Homo sapiens
gccatcatatcccctgtgacct

SEQ ID NO: 7795925 - DNA, 22 bp, Homo sapiens
atttatgacaaccaaagagtga

SEQ ID NO: 7795926 - DNA, 22 bp, Homo sapiens
atttatctctggaaactaagca

SEQ ID NO: 7795927 - DNA, 22 bp, Homo sapiens
atttatctctggaaactaagca

SEQ ID NO: 7795928 - DNA, 22 bp, Homo sapiens
atttataacgtgcagccagggt

SEQ ID NO: 7795929 - DNA, 22 bp, Homo sapiens
caaagagctgttcagtgtcgct

SEQ ID NO: 7795930 - DNA, 22 bp, Homo sapiens
caaagaagagatttacagagct

SEQ ID NO: 7795931 - DNA, 22 bp, Homo sapiens
caaaagcagcaagtttatatgt

SEQ ID NO: 7795932 - DNA, 22 bp, Homo sapiens
gccttccttttaccaccagcca

SEQ ID NO: 7795933 - DNA, 22 bp, Homo sapiens
attttgactgcattacagaaca

SEQ ID NO: 7795934 - DNA, 22 bp, Homo sapiens
attttgctgtggtacattagga

SEQ ID NO: 7795935 - DNA, 22 bp, Homo sapiens
gctcagagaaattataggaatt

SEQ ID NO: 7795936 - DNA, 22 bp, Homo sapiens
gctcagagagaggatatgttat

SEQ ID NO: 7795937 - DNA, 20 bp, Homo sapiens
caaaagcaatgaagttatga

SEQ ID NO: 7795938 - DNA, 22 bp, Homo sapiens
caaaagcaaagtccctgaatgt

SEQ ID NO: 7795939 - DNA, 22 bp, Homo sapiens
caaaagatacttgcatctaact

SEQ ID NO: 7795940 - DNA, 21 bp, Homo sapiens
attttcattaattcagtgtgg

SEQ ID NO: 7795941 - DNA, 22 bp, Homo sapiens
attttccttctaagaggaaggt

SEQ ID NO: 7795942 - DNA, 22 bp, Homo sapiens
atttcttcctctgtcagtaact

SEQ ID NO: 7795943 - DNA, 22 bp, Homo sapiens
attttagatttaagaataaggt

SEQ ID NO: 7795944 - DNA, 22 bp, Homo sapiens
atatttgttagagtctatgtgt

SEQ ID NO: 7795945 - DNA, 22 bp, Homo sapiens
atattttggcaaatgtctagat

SEQ ID NO: 7795946 - DNA, 22 bp, Homo sapiens
atattttgaagttaataatgtg

SEQ ID NO: 7795947 - DNA, 22 bp, Homo sapiens
atattttccgaacttgaggtag

SEQ ID NO: 7795948 - DNA, 22 bp, Homo sapiens
atattttctggaactatgcctg

SEQ ID NO: 7795949 - DNA, 22 bp, Homo sapiens
atattttcactgaaccaaagta

SEQ ID NO: 7795950 - DNA, 22 bp, Homo sapiens
atattttcacagaacttgcaaa

SEQ ID NO: 7795951 - DNA, 22 bp, Homo sapiens
atatttgttgagttcttatgat

SEQ ID NO: 7795952 - DNA, 22 bp, Homo sapiens
ctgtccagctgaccagagcagc

SEQ ID NO: 7795953 - DNA, 21 bp, Homo sapiens
ctgtccaaatttcataacttt

SEQ ID NO: 7795954 - DNA, 22 bp, Homo sapiens
ctgtccagaaagggggcaacaa

SEQ ID NO: 7795955 - DNA, 22 bp, Homo sapiens
ctgtattagtccatttgagctg

SEQ ID NO: 7795956 - DNA, 22 bp, Homo sapiens
ctgtatttcttggacagttgct

SEQ ID NO: 7795957 - DNA, 19 bp, Homo sapiens
atatatgtatacaatgtgg

SEQ ID NO: 7795958 - DNA, 23 bp, Homo sapiens
atagtcatgtaaaatatttgaag

SEQ ID NO: 7795959 - DNA, 22 bp, Homo sapiens
atagtcttacttttctctgcta

SEQ ID NO: 7795960 - DNA, 22 bp, Homo sapiens
atatcattctgatgtatatctt

SEQ ID NO: 7795961 - DNA, 20 bp, Homo sapiens
ctgtgctccgggttcctgga

SEQ ID NO: 7795962 - DNA, 22 bp, Homo sapiens
ctgtccagcttggctcctgggg

SEQ ID NO: 7795963 - DNA, 22 bp, Homo sapiens
ctgtccagcttggctcctgggg

SEQ ID NO: 7795964 - DNA, 21 bp, Homo sapiens
ctgtccagtaattcctggcac

SEQ ID NO: 7795965 - DNA, 18 bp, Homo sapiens
ctgtccagtagactctgc

SEQ ID NO: 7795966 - DNA, 22 bp, Homo sapiens
ctgtccagtcagaacgtcatta

SEQ ID NO: 7795967 - DNA, 22 bp, Homo sapiens
ctgttatttctgccaggtgagt

SEQ ID NO: 7795968 - DNA, 22 bp, Homo sapiens
ctgtttattgagcaatctgcca

SEQ ID NO: 7795969 - DNA, 21 bp, Homo sapiens
ctgtttatttcacctgggtgc

SEQ ID NO: 7795970 - DNA, 22 bp, Homo sapiens
atcattccacatgtaccactag

SEQ ID NO: 7795971 - DNA, 23 bp, Homo sapiens
cttcatgagagccctgaggaaaa

SEQ ID NO: 7795972 - DNA, 22 bp, Homo sapiens
atctcagtcaggttgaatttgg

SEQ ID NO: 7795973 - DNA, 22 bp, Homo sapiens
atctatttctgctaataacaat

SEQ ID NO: 7795974 - DNA, 22 bp, Homo sapiens
atctccaggattttcacactca

SEQ ID NO: 7795975 - DNA, 22 bp, Homo sapiens
atctcccagccacagcattctt

SEQ ID NO: 7795976 - DNA, 22 bp, Homo sapiens
atctcccaaattagcctcttga

SEQ ID NO: 7795977 - DNA, 22 bp, Homo sapiens
cttcagttagtttcatgtgagc

SEQ ID NO: 7795978 - DNA, 22 bp, Homo sapiens
atctcccaaactcatttcttca

SEQ ID NO: 7795979 - DNA, 21 bp, Homo sapiens
agtttcaggaagttcagctgc

SEQ ID NO: 7795980 - DNA, 22 bp, Homo sapiens
agtttcagaatttatgcagaca

SEQ ID NO: 7795981 - DNA, 22 bp, Homo sapiens
agttttattccaatgtgcagca

SEQ ID NO: 7795982 - DNA, 22 bp, Homo sapiens
ctgataatgtcctgcagtaaat

SEQ ID NO: 7795983 - DNA, 22 bp, Homo sapiens
agtttattctgcttggccctcc

SEQ ID NO: 7795984 - DNA, 22 bp, Homo sapiens
agtgttcactctgtggagccca

SEQ ID NO: 7795985 - DNA, 22 bp, Homo sapiens
agtgttcagtgattgtcaaccg

SEQ ID NO: 7795986 - DNA, 22 bp, Homo sapiens
agtgttctagcgctgtgcttgt

SEQ ID NO: 7795987 - DNA, 20 bp, Homo sapiens
agtttattccaggagaactg

SEQ ID NO: 7795988 - DNA, 21 bp, Homo sapiens
agttttgagagtgggtagtgt

SEQ ID NO: 7795989 - DNA, 17 bp, Homo sapiens
agttttgatataatggc

SEQ ID NO: 7795990 - DNA, 18 bp, Homo sapiens
ctgcccagagcatttcat

SEQ ID NO: 7795991 - DNA, 22 bp, Homo sapiens
ataagtttgtctttgtaaagat

SEQ ID NO: 7795992 - DNA, 23 bp, Homo sapiens
ataagccttttctttctgcccca

SEQ ID NO: 7795993 - DNA, 22 bp, Homo sapiens
ataagcctgattcacttgtcat

SEQ ID NO: 7795994 - DNA, 22 bp, Homo sapiens
ctgcctgctgccctccagagcc

SEQ ID NO: 7795995 - DNA, 22 bp, Homo sapiens
ctgcctgcttaccatgcatcag

SEQ ID NO: 7795996 - DNA, 22 bp, Homo sapiens
ctgcctgcttctgagccagagg

SEQ ID NO: 7795997 - DNA, 22 bp, Homo sapiens
ataataacaatgccagatgcct

SEQ ID NO: 7795998 - DNA, 22 bp, Homo sapiens
ataataacacctgaataggaaa

SEQ ID NO: 7795999 - DNA, 22 bp, Homo sapiens
ataataactcctgttgaagaac

SEQ ID NO: 7796000 - DNA, 23 bp, Homo sapiens
ataataattatggcagcaaagtg

SEQ ID NO: 7796001 - DNA, 22 bp, Homo sapiens
ctgcctgctctatccaggcctg

SEQ ID NO: 7796002 - DNA, 22 bp, Homo sapiens
ataattaatttcagtaatctcc

SEQ ID NO: 7796003 - DNA, 22 bp, Homo sapiens
atacagaaaatgatgcagagtt

SEQ ID NO: 7796004 - DNA, 22 bp, Homo sapiens
atacatgactcacacattctgc

SEQ ID NO: 7796005 - DNA, 22 bp, Homo sapiens
atagaaacagaggtcaggcatt

SEQ ID NO: 7796006 - DNA, 22 bp, Homo sapiens
atagacatagccgtaatttatt

SEQ ID NO: 7796007 - DNA, 22 bp, Homo sapiens
atagtacagagggctactggtt

SEQ ID NO: 7796008 - DNA, 22 bp, Homo sapiens
agtgtctgcctatttttcaagc

SEQ ID NO: 7796009 - DNA, 21 bp, Homo sapiens
ctctgtttgcctgctgccatc

SEQ ID NO: 7796010 - DNA, 22 bp, Homo sapiens
agtgtctgcaaaatgaaagagc

SEQ ID NO: 7796011 - DNA, 22 bp, Homo sapiens
agtgtctgcaaaatgaaagagc

SEQ ID NO: 7796012 - DNA, 22 bp, Homo sapiens
ctcttaatgttttatagattga

SEQ ID NO: 7796013 - DNA, 22 bp, Homo sapiens
agtgtctgatcagttgactaga

SEQ ID NO: 7796014 - DNA, 22 bp, Homo sapiens
agtgtctgagccagaattagaa

SEQ ID NO: 7796015 - DNA, 22 bp, Homo sapiens
ctgagaggcagccagagaaaat

SEQ ID NO: 7796016 - DNA, 22 bp, Homo sapiens
ctgagaggcagccagagaaaat

SEQ ID NO: 7796017 - DNA, 22 bp, Homo sapiens
ctctgaccattcccttgatttt

SEQ ID NO: 7796018 - DNA, 22 bp, Homo sapiens
ctctctgggcccagttggcacc

SEQ ID NO: 7796019 - DNA, 19 bp, Homo sapiens
agtgcagggagcaccctca

SEQ ID NO: 7796020 - DNA, 22 bp, Homo sapiens
ctctctccttagctgcagacca

SEQ ID NO: 7796021 - DNA, 23 bp, Homo sapiens
agtcttaatacagctcttttcta

SEQ ID NO: 7796022 - DNA, 22 bp, Homo sapiens
agtcttacatgagaaagaacct

SEQ ID NO: 7796023 - DNA, 22 bp, Homo sapiens
agtcttaatagagaaaaactgt

SEQ ID NO: 7796024 - DNA, 22 bp, Homo sapiens
ctcaggagttggaggctacagt

SEQ ID NO: 7796025 - DNA, 23 bp, Homo sapiens
agtcttactgtcccagaacaggg

SEQ ID NO: 7796026 - DNA, 22 bp, Homo sapiens
agtctgaagactcatgtctgaa

SEQ ID NO: 7796027 - DNA, 22 bp, Homo sapiens
agtcatttatcttagccattat

SEQ ID NO: 7796028 - DNA, 22 bp, Homo sapiens
ctccagtggcaagtccgggcgg

SEQ ID NO: 7796029 - DNA, 22 bp, Homo sapiens
ctcccaggttacatctgagcct

SEQ ID NO: 7796030 - DNA, 22 bp, Homo sapiens
ctcccaggttccgacgcctctt

SEQ ID NO: 7796031 - DNA, 22 bp, Homo sapiens
cctggtccttacgtcattgctt

SEQ ID NO: 7796032 - DNA, 22 bp, Homo sapiens
aggtgtctggatgggtgtcctt

SEQ ID NO: 7796033 - DNA, 22 bp, Homo sapiens
aggttcaaattgttgcagtttc

SEQ ID NO: 7796034 - DNA, 22 bp, Homo sapiens
aggttcaaatgcaagagatgct

SEQ ID NO: 7796035 - DNA, 23 bp, Homo sapiens
aggttatgattatagagcgagga

SEQ ID NO: 7796036 - DNA, 22 bp, Homo sapiens
aggttaggaaatagggctgtaa

SEQ ID NO: 7796037 - DNA, 22 bp, Homo sapiens
aggttaaaaaggattcagttaa

SEQ ID NO: 7796038 - DNA, 20 bp, Homo sapiens
cctttattatttgtatgatg

SEQ ID NO: 7796039 - DNA, 22 bp, Homo sapiens
cctttattcaattagtcctaat

SEQ ID NO: 7796040 - DNA, 20 bp, Homo sapiens
cctttattatttgtatgatg

SEQ ID NO: 7796041 - DNA, 20 bp, Homo sapiens
cctttattatttgtatgatg

SEQ ID NO: 7796042 - DNA, 22 bp, Homo sapiens
aggtttcatgggagacaactca

SEQ ID NO: 7796043 - DNA, 22 bp, Homo sapiens
aggtttatgtttggtgcaggag

SEQ ID NO: 7796044 - DNA, 22 bp, Homo sapiens
aggtttatgccttggagctggg

SEQ ID NO: 7796045 - DNA, 22 bp, Homo sapiens
agtacaaatgcagccagagtag

SEQ ID NO: 7796046 - DNA, 22 bp, Homo sapiens
agtcagagcaaactggacagac

SEQ ID NO: 7796047 - DNA, 22 bp, Homo sapiens
agtcagagaatgttttcatgga

SEQ ID NO: 7796048 - DNA, 22 bp, Homo sapiens
agtcactttgctactctgcctt

SEQ ID NO: 7796049 - DNA, 22 bp, Homo sapiens
agtcagagttttgaggtgtgac

SEQ ID NO: 7796050 - DNA, 17 bp, Homo sapiens
agtcagaggagtatctg

SEQ ID NO: 7796051 - DNA, 22 bp, Homo sapiens
agtcaggattttggattattcg

SEQ ID NO: 7796052 - DNA, 22 bp, Homo sapiens
ctacagaaacactggacatgtg

SEQ ID NO: 7796053 - DNA, 22 bp, Homo sapiens
ctaaaattatcaagataattcc

SEQ ID NO: 7796054 - DNA, 22 bp, Homo sapiens
cgtgctctggactcgtggcaca

SEQ ID NO: 7796055 - DNA, 22 bp, Homo sapiens
cgtgccactgcactctagcctg

SEQ ID NO: 7796056 - DNA, 22 bp, Homo sapiens
cgtgccactgcactccagtctg

SEQ ID NO: 7796057 - DNA, 22 bp, Homo sapiens
cctggccagcagccccttcctc

SEQ ID NO: 7796058 - DNA, 22 bp, Homo sapiens
aggtatatgaagatgaaataac

SEQ ID NO: 7796059 - DNA, 22 bp, Homo sapiens
aggtatatattctggtccttat

SEQ ID NO: 7796060 - DNA, 22 bp, Homo sapiens
cctgcctggagctgagtgtgga

SEQ ID NO: 7796061 - DNA, 18 bp, Homo sapiens
cctggacctgtctccttt

SEQ ID NO: 7796062 - DNA, 22 bp, Homo sapiens
aggggctttggtgctggtcctg

SEQ ID NO: 7796063 - DNA, 22 bp, Homo sapiens
aggggcttatgtttctccaggc

SEQ ID NO: 7796064 - DNA, 22 bp, Homo sapiens
aggggcttgtggagttgctggt

SEQ ID NO: 7796065 - DNA, 22 bp, Homo sapiens
aggtatgccaattaggtcaagt

SEQ ID NO: 7796066 - DNA, 22 bp, Homo sapiens
aggtcctgtctatcaccctcgc

SEQ ID NO: 7796067 - DNA, 22 bp, Homo sapiens
aggtctggaaacagcagggaga

SEQ ID NO: 7796068 - DNA, 20 bp, Homo sapiens
aggtgcaagcagtaaattgc

SEQ ID NO: 7796069 - DNA, 22 bp, Homo sapiens
aggtgcttggctcgtgcacaca

SEQ ID NO: 7796070 - DNA, 22 bp, Homo sapiens
ccatggcttacagatggagcat

SEQ ID NO: 7796071 - DNA, 22 bp, Homo sapiens
ccatggcttctttctctgccag

SEQ ID NO: 7796072 - DNA, 22 bp, Homo sapiens
ccatggctcttaccttgttata

SEQ ID NO: 7796073 - DNA, 22 bp, Homo sapiens
ccatggctccttgccctgtagc

SEQ ID NO: 7796074 - DNA, 22 bp, Homo sapiens
ccatggctaagtatctgtagaa

SEQ ID NO: 7796075 - DNA, 22 bp, Homo sapiens
cccagagatgtcctgagtgata

SEQ ID NO: 7796076 - DNA, 23 bp, Homo sapiens
cccagagcacagcctccagatgc

SEQ ID NO: 7796077 - DNA, 22 bp, Homo sapiens
cccagagcatgtgctgcctttg

SEQ ID NO: 7796078 - DNA, 20 bp, Homo sapiens
cccagagccatagccagaca

SEQ ID NO: 7796079 - DNA, 22 bp, Homo sapiens
ccagcttttcctctcattgctt

SEQ ID NO: 7796080 - DNA, 22 bp, Homo sapiens
ccagcttttcttatcattataa

SEQ ID NO: 7796081 - DNA, 22 bp, Homo sapiens
ccagcttttgcactggactggg

SEQ ID NO: 7796082 - DNA, 22 bp, Homo sapiens
ccagcttttggggtgacaattt

SEQ ID NO: 7796083 - DNA, 22 bp, Homo sapiens
ccagctttctcagaggcttcta

SEQ ID NO: 7796084 - DNA, 22 bp, Homo sapiens
ccagctttcctgcgagttgatt

SEQ ID NO: 7796085 - DNA, 20 bp, Homo sapiens
ccagctttccctgcagcatc

SEQ ID NO: 7796086 - DNA, 22 bp, Homo sapiens
ccagcttttagtgggcttatta

SEQ ID NO: 7796087 - DNA, 22 bp, Homo sapiens
ccagcttttcagaatctgcctg

SEQ ID NO: 7796088 - DNA, 22 bp, Homo sapiens
ccagctttggagtgttgttgct

SEQ ID NO: 7796089 - DNA, 22 bp, Homo sapiens
ccagctttctgggtggtttctg

SEQ ID NO: 7796090 - DNA, 18 bp, Homo sapiens
aggccctggcctcgaaca

SEQ ID NO: 7796091 - DNA, 22 bp, Homo sapiens
ccaggagcaaagatcactggga

SEQ ID NO: 7796092 - DNA, 22 bp, Homo sapiens
ccaggagagcattgcacagagg

SEQ ID NO: 7796093 - DNA, 22 bp, Homo sapiens
ccagccctgccagagagagctg

SEQ ID NO: 7796094 - DNA, 22 bp, Homo sapiens
aggccagatgtcgggctagaag

SEQ ID NO: 7796095 - DNA, 21 bp, Homo sapiens
ccagctttcccaagtcccttt

SEQ ID NO: 7796096 - DNA, 22 bp, Homo sapiens
ccagctttccagggttgactgg

SEQ ID NO: 7796097 - DNA, 22 bp, Homo sapiens
ccagctttatcaagtctgagct

SEQ ID NO: 7796098 - DNA, 22 bp, Homo sapiens
ccagctttatagcttcaaagga

SEQ ID NO: 7796099 - DNA, 22 bp, Homo sapiens
ccagctttcatatcatgaggta

SEQ ID NO: 7796100 - DNA, 22 bp, Homo sapiens
ccagctttaggttgcctgccag

SEQ ID NO: 7796101 - DNA, 22 bp, Homo sapiens
aggcccagctggacaaactgct

SEQ ID NO: 7796102 - DNA, 22 bp, Homo sapiens
ccagagcaattctcacagaact

SEQ ID NO: 7796103 - DNA, 22 bp, Homo sapiens
ccacaggaccagaggagatcac

SEQ ID NO: 7796104 - DNA, 20 bp, Homo sapiens
ccacaggagtccagtcgacc

SEQ ID NO: 7796105 - DNA, 22 bp, Homo sapiens
ccagagagggcgccacctggag

SEQ ID NO: 7796106 - DNA, 17 bp, Homo sapiens
ccagagagtagttagga

SEQ ID NO: 7796107 - DNA, 20 bp, Homo sapiens
ccagagagtaggttagtgat

SEQ ID NO: 7796108 - DNA, 22 bp, Homo sapiens
ccagagagtaggaggcattatt

SEQ ID NO: 7796109 - DNA, 22 bp, Homo sapiens
ccagagagtaaacattttccgg

SEQ ID NO: 7796110 - DNA, 22 bp, Homo sapiens
ccagagaggggaagggcttgcc

SEQ ID NO: 7796111 - DNA, 22 bp, Homo sapiens
ccagagaggggaagggcttgcc

SEQ ID NO: 7796112 - DNA, 22 bp, Homo sapiens
ccagagaggtagcttaccctct

SEQ ID NO: 7796113 - DNA, 22 bp, Homo sapiens
ccagagagtcgatgggggacac

SEQ ID NO: 7796114 - DNA, 22 bp, Homo sapiens
ccagagagtatcatggagagta

SEQ ID NO: 7796115 - DNA, 22 bp, Homo sapiens
aggcaggggagctggaagggta

SEQ ID NO: 7796116 - DNA, 21 bp, Homo sapiens
aggcttggatctagacaggcc

SEQ ID NO: 7796117 - DNA, 22 bp, Homo sapiens
agggcagagatctgagtgggca

SEQ ID NO: 7796118 - DNA, 22 bp, Homo sapiens
agggacttgatgtcagggagat

SEQ ID NO: 7796119 - DNA, 22 bp, Homo sapiens
agggatggaagctcgtctgcaa

SEQ ID NO: 7796120 - DNA, 22 bp, Homo sapiens
agggatggaagacttgaagacc

SEQ ID NO: 7796121 - DNA, 22 bp, Homo sapiens
agggatgatttcagtgtctgcc

SEQ ID NO: 7796122 - DNA, 22 bp, Homo sapiens
agggatgatcagggtagaggct

SEQ ID NO: 7796123 - DNA, 22 bp, Homo sapiens
cctgagctttaaaagccatgta

SEQ ID NO: 7796124 - DNA, 22 bp, Homo sapiens
cctgagagtgcgtgcctcctta

SEQ ID NO: 7796125 - DNA, 22 bp, Homo sapiens
cctgagagtgagtgcctcctta

SEQ ID NO: 7796126 - DNA, 22 bp, Homo sapiens
cctcctggaaaaattccctggc

SEQ ID NO: 7796127 - DNA, 22 bp, Homo sapiens
cctcctggaggctctaagggag

SEQ ID NO: 7796128 - DNA, 22 bp, Homo sapiens
cctcctggagcattggtgagga

SEQ ID NO: 7796129 - DNA, 22 bp, Homo sapiens
cctcctggatggatttggtgga

SEQ ID NO: 7796130 - DNA, 22 bp, Homo sapiens
cctcctggaggctctagggaaa

SEQ ID NO: 7796131 - DNA, 22 bp, Homo sapiens
agggctgagtgggagagagttg

SEQ ID NO: 7796132 - DNA, 22 bp, Homo sapiens
cctcctggccctgggcctggaa

SEQ ID NO: 7796133 - DNA, 22 bp, Homo sapiens
agggctgatgcaccatgtagcc

SEQ ID NO: 7796134 - DNA, 22 bp, Homo sapiens
agggctgagtggtgcagtcaaa

SEQ ID NO: 7796135 - DNA, 18 bp, Homo sapiens
agggctgatgagtttggg

SEQ ID NO: 7796136 - DNA, 23 bp, Homo sapiens
agggctgatgccattgcagctct

SEQ ID NO: 7796137 - DNA, 20 bp, Homo sapiens
agggctctgccttgctgatg

SEQ ID NO: 7796138 - DNA, 22 bp, Homo sapiens
agggctcctatgccccatggac

SEQ ID NO: 7796139 - DNA, 22 bp, Homo sapiens
agggctccgggcaggcgatgga

SEQ ID NO: 7796140 - DNA, 22 bp, Homo sapiens
agggctccgggccaccggcctg

SEQ ID NO: 7796141 - DNA, 22 bp, Homo sapiens
agggctcctatgatgctctgcc

SEQ ID NO: 7796142 - DNA, 22 bp, Homo sapiens
agggctcctccccggcctccac

SEQ ID NO: 7796143 - DNA, 23 bp, Homo sapiens
agggctccttgttgattagcatt

SEQ ID NO: 7796144 - DNA, 22 bp, Homo sapiens
agggctcctgaggcccttctgg

SEQ ID NO: 7796145 - DNA, 22 bp, Homo sapiens
agggctctgagctggaccacct

SEQ ID NO: 7796146 - DNA, 22 bp, Homo sapiens
agggccctctgggcactgtggc

SEQ ID NO: 7796147 - DNA, 22 bp, Homo sapiens
agggccctagggaatgagacat

SEQ ID NO: 7796148 - DNA, 22 bp, Homo sapiens
agggctccaaggaagtgtagct

SEQ ID NO: 7796149 - DNA, 22 bp, Homo sapiens
agggctccaggggaccatcagt

SEQ ID NO: 7796150 - DNA, 22 bp, Homo sapiens
agggctcccgtgaggtgactgc

SEQ ID NO: 7796151 - DNA, 22 bp, Homo sapiens
agggctcccgcggtgtccggga

SEQ ID NO: 7796152 - DNA, 22 bp, Homo sapiens
agggctccaggggctgggtgac

SEQ ID NO: 7796153 - DNA, 22 bp, Homo sapiens
agggccagaatccctcagtcta

SEQ ID NO: 7796154 - DNA, 22 bp, Homo sapiens
agggccagaggcaccttgcagc

SEQ ID NO: 7796155 - DNA, 22 bp, Homo sapiens
agggccagagtctgtgtagata

SEQ ID NO: 7796156 - DNA, 22 bp, Homo sapiens
agggccccatagtcactgcccg

SEQ ID NO: 7796157 - DNA, 22 bp, Homo sapiens
agggccctaaggaaggcacaca

SEQ ID NO: 7796158 - DNA, 22 bp, Homo sapiens
aggatttacaatgattctaggt

SEQ ID NO: 7796159 - DNA, 19 bp, Homo sapiens
catggtgaaaccccgtctc

SEQ ID NO: 7796160 - DNA, 19 bp, Homo sapiens
catggtgaaaccccgtctc

SEQ ID NO: 7796161 - DNA, 22 bp, Homo sapiens
aggattcagaatgtatgcagtg

SEQ ID NO: 7796162 - DNA, 20 bp, Homo sapiens
aggaggggatagaatcaaag

SEQ ID NO: 7796163 - DNA, 20 bp, Homo sapiens
aggaggggatagaatcaaag

SEQ ID NO: 7796164 - DNA, 22 bp, Homo sapiens
cattaaaatatctcatggtgtt

SEQ ID NO: 7796165 - DNA, 22 bp, Homo sapiens
cattttaaatgatttaagccaa

SEQ ID NO: 7796166 - DNA, 22 bp, Homo sapiens
catttgtttagaagtctttata

SEQ ID NO: 7796167 - DNA, 22 bp, Homo sapiens
catttgtttataagttccccag

SEQ ID NO: 7796168 - DNA, 22 bp, Homo sapiens
catttgttggttgctgtcttat

SEQ ID NO: 7796169 - DNA, 22 bp, Homo sapiens
catttgttggtcagattgtagt

SEQ ID NO: 7796170 - DNA, 22 bp, Homo sapiens
catttgttgggacaatgaaaag

SEQ ID NO: 7796171 - DNA, 17 bp, Homo sapiens
catttgttgatcagttg

SEQ ID NO: 7796172 - DNA, 22 bp, Homo sapiens
catttgttaaccagtgtggatt

SEQ ID NO: 7796173 - DNA, 22 bp, Homo sapiens
catttgttaatgctgcttttaa

SEQ ID NO: 7796174 - DNA, 22 bp, Homo sapiens
catttgttaagaaggaaaaagg

SEQ ID NO: 7796175 - DNA, 18 bp, Homo sapiens
catttgttattgtgtgtg

SEQ ID NO: 7796176 - DNA, 22 bp, Homo sapiens
catttgttcaaccattctcgct

SEQ ID NO: 7796177 - DNA, 22 bp, Homo sapiens
catttgttctgatttcaaaagg

SEQ ID NO: 7796178 - DNA, 22 bp, Homo sapiens
catttgttaattactattatct

SEQ ID NO: 7796179 - DNA, 20 bp, Homo sapiens
catttgttagctttctactg

SEQ ID NO: 7796180 - DNA, 22 bp, Homo sapiens
catttgttaatgctgcttttaa

SEQ ID NO: 7796181 - DNA, 22 bp, Homo sapiens
ccaaggacgtacaggagataat

SEQ ID NO: 7796182 - DNA, 22 bp, Homo sapiens
ccaaggactggacacacaggtt

SEQ ID NO: 7796183 - DNA, 22 bp, Homo sapiens
ccaatattatgaaagtgtgaca

SEQ ID NO: 7796184 - DNA, 22 bp, Homo sapiens
ccaagtacagattcctccactg

SEQ ID NO: 7796185 - DNA, 22 bp, Homo sapiens
ccaagtactctcaccaaagctt

SEQ ID NO: 7796186 - DNA, 22 bp, Homo sapiens
ccaagctacttaggagtctgag

SEQ ID NO: 7796187 - DNA, 22 bp, Homo sapiens
cagtgcccttccaggactgcag

SEQ ID NO: 7796188 - DNA, 21 bp, Homo sapiens
cagtgctcaatctgacagtgg

SEQ ID NO: 7796189 - DNA, 21 bp, Homo sapiens
cagtgctcaggaatagagaga

SEQ ID NO: 7796190 - DNA, 22 bp, Homo sapiens
cagtgctaggtcgtgtgctggg

SEQ ID NO: 7796191 - DNA, 22 bp, Homo sapiens
cagtgctcatagctgttcctcc

SEQ ID NO: 7796192 - DNA, 22 bp, Homo sapiens
cagtgctcctgatgtacccttg

SEQ ID NO: 7796193 - DNA, 22 bp, Homo sapiens
cagtgctcccgctgccgctgtg

SEQ ID NO: 7796194 - DNA, 22 bp, Homo sapiens
aggaccattatgcttgctgaaa

SEQ ID NO: 7796195 - DNA, 22 bp, Homo sapiens
aggaccaccggtccatccaccc

SEQ ID NO: 7796196 - DNA, 22 bp, Homo sapiens
aggacctgtgttttccttgaat

SEQ ID NO: 7796197 - DNA, 22 bp, Homo sapiens
aggacctgtagggcctgcatcc

SEQ ID NO: 7796198 - DNA, 22 bp, Homo sapiens
aggacctgtacctcagcatcta

SEQ ID NO: 7796199 - DNA, 22 bp, Homo sapiens
aggacctgctaatgtgccaagt

SEQ ID NO: 7796200 - DNA, 22 bp, Homo sapiens
aggacctggatcacagagatct

SEQ ID NO: 7796201 - DNA, 22 bp, Homo sapiens
aggacctgccaggtgcaaagca

SEQ ID NO: 7796202 - DNA, 22 bp, Homo sapiens
aggacctgagagttggaaatcc

SEQ ID NO: 7796203 - DNA, 22 bp, Homo sapiens
aggacctgactggctcctgctt

SEQ ID NO: 7796204 - DNA, 22 bp, Homo sapiens
aggacctgaaattcttgctttt

SEQ ID NO: 7796205 - DNA, 22 bp, Homo sapiens
aggacctgacattgtgttttct

SEQ ID NO: 7796206 - DNA, 22 bp, Homo sapiens
aggacccagaaggtgcagcaga

SEQ ID NO: 7796207 - DNA, 22 bp, Homo sapiens
caggtggcttctccctaggcca

SEQ ID NO: 7796208 - DNA, 22 bp, Homo sapiens
cagtttatttccaagatgacaa

SEQ ID NO: 7796209 - DNA, 22 bp, Homo sapiens
cagtttccctgcttgaaaacgt

SEQ ID NO: 7796210 - DNA, 22 bp, Homo sapiens
cagttttaaattgttagataat

SEQ ID NO: 7796211 - DNA, 22 bp, Homo sapiens
cagttttaaattttgaatgtct

SEQ ID NO: 7796212 - DNA, 22 bp, Homo sapiens
cagttttagggcaatgtgaaga

SEQ ID NO: 7796213 - DNA, 22 bp, Homo sapiens
cagttttaggacatgtggatgt

SEQ ID NO: 7796214 - DNA, 22 bp, Homo sapiens
cagttttagctagagcaaacca

SEQ ID NO: 7796215 - DNA, 22 bp, Homo sapiens
cagtggtccctgaggttgctgg

SEQ ID NO: 7796216 - DNA, 22 bp, Homo sapiens
cagtgggtggctaagtggctga

SEQ ID NO: 7796217 - DNA, 22 bp, Homo sapiens
cagtggtgaagagcaggggctc

SEQ ID NO: 7796218 - DNA, 22 bp, Homo sapiens
cagttctggaggatagaagtct

SEQ ID NO: 7796219 - DNA, 22 bp, Homo sapiens
catagcggtattccacgtggtt

SEQ ID NO: 7796220 - DNA, 22 bp, Homo sapiens
catacattacctaacttaatgc

SEQ ID NO: 7796221 - DNA, 22 bp, Homo sapiens
cagttttatgtcgaatgtatac

SEQ ID NO: 7796222 - DNA, 22 bp, Homo sapiens
cagttttatcatctgtgaaatg

SEQ ID NO: 7796223 - DNA, 22 bp, Homo sapiens
catattctgttggtcacataga

SEQ ID NO: 7796224 - DNA, 22 bp, Homo sapiens
catatttagtgtttggagatcg

SEQ ID NO: 7796225 - DNA, 22 bp, Homo sapiens
aggagggagcttaagccaggca

SEQ ID NO: 7796226 - DNA, 22 bp, Homo sapiens
cagggagctggtgccagccgac

SEQ ID NO: 7796227 - DNA, 22 bp, Homo sapiens
cagggagctttcccaggaccct

SEQ ID NO: 7796228 - DNA, 22 bp, Homo sapiens
cagggatgggatggagtcagtt

SEQ ID NO: 7796229 - DNA, 19 bp, Homo sapiens
cagggatgggtagggactc

SEQ ID NO: 7796230 - DNA, 19 bp, Homo sapiens
cagggatgggtagggactc

SEQ ID NO: 7796231 - DNA, 22 bp, Homo sapiens
cagggatggtaaatatgtaaag

SEQ ID NO: 7796232 - DNA, 22 bp, Homo sapiens
caggctgcgtttgtgaaaggta

SEQ ID NO: 7796233 - DNA, 22 bp, Homo sapiens
caggctcagtcagaaaatgtat

SEQ ID NO: 7796234 - DNA, 22 bp, Homo sapiens
caggctcagctctggccagtgc

SEQ ID NO: 7796235 - DNA, 22 bp, Homo sapiens
caggctcactttctcagtcaca

SEQ ID NO: 7796236 - DNA, 22 bp, Homo sapiens
caggctcactgtaaggtcagct

SEQ ID NO: 7796237 - DNA, 22 bp, Homo sapiens
cagggctcccttgcaaggaggg

SEQ ID NO: 7796238 - DNA, 22 bp, Homo sapiens
cagggctccctgcagcctctgt

SEQ ID NO: 7796239 - DNA, 22 bp, Homo sapiens
cagggctccctctggctcccag

SEQ ID NO: 7796240 - DNA, 22 bp, Homo sapiens
cagggctcccaaatatctcttc

SEQ ID NO: 7796241 - DNA, 22 bp, Homo sapiens
cagggctccccagagagcctct

SEQ ID NO: 7796242 - DNA, 22 bp, Homo sapiens
cagggctccccgcaccgcagcc

SEQ ID NO: 7796243 - DNA, 22 bp, Homo sapiens
cagggctcgctcttgcccttcg

SEQ ID NO: 7796244 - DNA, 22 bp, Homo sapiens
cagggctcgctcgctcgctcgc

SEQ ID NO: 7796245 - DNA, 22 bp, Homo sapiens
cagggctcgctgccagcttcag

SEQ ID NO: 7796246 - DNA, 22 bp, Homo sapiens
cagggctctgccttgagggatg

SEQ ID NO: 7796247 - DNA, 22 bp, Homo sapiens
cagggatgtctctggaagggag

SEQ ID NO: 7796248 - DNA, 22 bp, Homo sapiens
cagggatgtctctggaagggag

SEQ ID NO: 7796249 - DNA, 22 bp, Homo sapiens
cagggatggttgagaattggta

SEQ ID NO: 7796250 - DNA, 22 bp, Homo sapiens
caggtccttgtttgtaaagcag

SEQ ID NO: 7796251 - DNA, 22 bp, Homo sapiens
caggcacactgtctacactgag

SEQ ID NO: 7796252 - DNA, 22 bp, Homo sapiens
caggcatagaagggcaagaata

SEQ ID NO: 7796253 - DNA, 22 bp, Homo sapiens
agctgagggcaggatggggtga

SEQ ID NO: 7796254 - DNA, 20 bp, Homo sapiens
agctgcaacagactgtatgg

SEQ ID NO: 7796255 - DNA, 22 bp, Homo sapiens
agctgcaaagatctgtcagtca

SEQ ID NO: 7796256 - DNA, 22 bp, Homo sapiens
cagctgaaggtaggaaccagga

SEQ ID NO: 7796257 - DNA, 22 bp, Homo sapiens
agctgcagaggtttgtgcaaca

SEQ ID NO: 7796258 - DNA, 22 bp, Homo sapiens
agctgcagatcaataggctcac

SEQ ID NO: 7796259 - DNA, 23 bp, Homo sapiens
agctgcagatgctcagcgggcag

SEQ ID NO: 7796260 - DNA, 22 bp, Homo sapiens
agctgcagtgaactgttttgtc

SEQ ID NO: 7796261 - DNA, 22 bp, Homo sapiens
aggacacactgcaagagcctgg

SEQ ID NO: 7796262 - DNA, 22 bp, Homo sapiens
aggaagaacagataatggacgc

SEQ ID NO: 7796263 - DNA, 22 bp, Homo sapiens
aggaagaacctaagaaagtctc

SEQ ID NO: 7796264 - DNA, 22 bp, Homo sapiens
aggaagaacagataatggacgc

SEQ ID NO: 7796265 - DNA, 22 bp, Homo sapiens
acaggcaggcttcggccagagc

SEQ ID NO: 7796266 - DNA, 22 bp, Homo sapiens
acaggcaggcttcggccagagc

SEQ ID NO: 7796267 - DNA, 22 bp, Homo sapiens
acaggcagggacctcttgagtt

SEQ ID NO: 7796268 - DNA, 22 bp, Homo sapiens
acaggcagcaaaatcagcctca

SEQ ID NO: 7796269 - DNA, 22 bp, Homo sapiens
acaggcagcactaatctctggt

SEQ ID NO: 7796270 - DNA, 22 bp, Homo sapiens
acaggcagcactaatctctggt

SEQ ID NO: 7796271 - DNA, 17 bp, Homo sapiens
acaggcagatcacctga

SEQ ID NO: 7796272 - DNA, 17 bp, Homo sapiens
acaggcagatcacctga

SEQ ID NO: 7796273 - DNA, 22 bp, Homo sapiens
acaggcagcgtcattgctgctc

SEQ ID NO: 7796274 - DNA, 22 bp, Homo sapiens
acaggcaggagctccccattcc

SEQ ID NO: 7796275 - DNA, 22 bp, Homo sapiens
acaggcaggcgggacagcccga

SEQ ID NO: 7796276 - DNA, 22 bp, Homo sapiens
acaggcaggcgggacagcccga

SEQ ID NO: 7796277 - DNA, 22 bp, Homo sapiens
acaggagggacaccttcctgct

SEQ ID NO: 7796278 - DNA, 18 bp, Homo sapiens
agctggtggggagacagc

SEQ ID NO: 7796279 - DNA, 22 bp, Homo sapiens
acagctggcaggggggcatgaa

SEQ ID NO: 7796280 - DNA, 22 bp, Homo sapiens
acagctgtatccccagagctca

SEQ ID NO: 7796281 - DNA, 21 bp, Homo sapiens
acagctggtgcagggcgggga

SEQ ID NO: 7796282 - DNA, 22 bp, Homo sapiens
agctgaagcaacaacaggatgg

SEQ ID NO: 7796283 - DNA, 22 bp, Homo sapiens
acagtgtgtgctttcccttacg

SEQ ID NO: 7796284 - DNA, 22 bp, Homo sapiens
acagtgtggttgtttctggtta

SEQ ID NO: 7796285 - DNA, 23 bp, Homo sapiens
acagtgtggtggacaaggagcag

SEQ ID NO: 7796286 - DNA, 22 bp, Homo sapiens
acagtgtggtttgagcactggg

SEQ ID NO: 7796287 - DNA, 19 bp, Homo sapiens
acagtgtctgtatataaat

SEQ ID NO: 7796288 - DNA, 22 bp, Homo sapiens
acagtgtgatgggcctgcctga

SEQ ID NO: 7796289 - DNA, 21 bp, Homo sapiens
acagtgtgcttctctccctcc

SEQ ID NO: 7796290 - DNA, 22 bp, Homo sapiens
acagtgtggtgatggcacttgc

SEQ ID NO: 7796291 - DNA, 22 bp, Homo sapiens
acagtgtctcactgctgaaatc

SEQ ID NO: 7796292 - DNA, 22 bp, Homo sapiens
acagtgtctcactgctgaaatc

SEQ ID NO: 7796293 - DNA, 23 bp, Homo sapiens
acagtgtctgctgcaagatatct

SEQ ID NO: 7796294 - DNA, 23 bp, Homo sapiens
acagtgtctgctgcaagatatct

SEQ ID NO: 7796295 - DNA, 22 bp, Homo sapiens
acagtgtctgacacgtaggaag

SEQ ID NO: 7796296 - DNA, 22 bp, Homo sapiens
acagtgtctcctggtacccagt

SEQ ID NO: 7796297 - DNA, 22 bp, Homo sapiens
acagtgtctgacacattgtagc

SEQ ID NO: 7796298 - DNA, 22 bp, Homo sapiens
acagtgtctgacacgtaggaag

SEQ ID NO: 7796299 - DNA, 22 bp, Homo sapiens
acagtctgcagggtgaacatgt

SEQ ID NO: 7796300 - DNA, 22 bp, Homo sapiens
acagtctctccacactgcaggg

SEQ ID NO: 7796301 - DNA, 22 bp, Homo sapiens
acagtctaggcctaggtcaaaa

SEQ ID NO: 7796302 - DNA, 22 bp, Homo sapiens
acagtctacttgagcttgtata

SEQ ID NO: 7796303 - DNA, 22 bp, Homo sapiens
acagtctactaaacatcatcag

SEQ ID NO: 7796304 - DNA, 22 bp, Homo sapiens
acagtctacaaagtgatgtgtg

SEQ ID NO: 7796305 - DNA, 22 bp, Homo sapiens
acagtctaatcttgtgttctgt

SEQ ID NO: 7796306 - DNA, 20 bp, Homo sapiens
acagtcctgcactggtgttt

SEQ ID NO: 7796307 - DNA, 22 bp, Homo sapiens
acagtcaatcagaacagcatgt

SEQ ID NO: 7796308 - DNA, 22 bp, Homo sapiens
acagtatttgcgatactgatga

SEQ ID NO: 7796309 - DNA, 22 bp, Homo sapiens
aggagcaaatgatgagacagca

SEQ ID NO: 7796310 - DNA, 22 bp, Homo sapiens
aggagattggctgaaaaatatt

SEQ ID NO: 7796311 - DNA, 22 bp, Homo sapiens
acagtatatatagtctaaaagc

SEQ ID NO: 7796312 - DNA, 22 bp, Homo sapiens
acagtttatgtaaagctgccaa

SEQ ID NO: 7796313 - DNA, 21 bp, Homo sapiens
acagtttattagagtaagtgc

SEQ ID NO: 7796314 - DNA, 22 bp, Homo sapiens
acagtttatggtgttttatata

SEQ ID NO: 7796315 - DNA, 22 bp, Homo sapiens
acagtttatggtgttttatata

SEQ ID NO: 7796316 - DNA, 22 bp, Homo sapiens
acagtttatcgattcacctacc

SEQ ID NO: 7796317 - DNA, 22 bp, Homo sapiens
acagtttatgcctctgagcctg

SEQ ID NO: 7796318 - DNA, 22 bp, Homo sapiens
acagtttattgcacaggtaacc

SEQ ID NO: 7796319 - DNA, 20 bp, Homo sapiens
acagtttattttacttggtt

SEQ ID NO: 7796320 - DNA, 19 bp, Homo sapiens
aggatggagcaggcggtga

SEQ ID NO: 7796321 - DNA, 21 bp, Homo sapiens
acagttcatgataactccatc

SEQ ID NO: 7796322 - DNA, 22 bp, Homo sapiens
acagtttagagcatgatgacca

SEQ ID NO: 7796323 - DNA, 22 bp, Homo sapiens
acagtttagaatgccacatagt

SEQ ID NO: 7796324 - DNA, 22 bp, Homo sapiens
acagtttaggatgagagaacac

SEQ ID NO: 7796325 - DNA, 20 bp, Homo sapiens
acagtttatccagttagcag

SEQ ID NO: 7796326 - DNA, 22 bp, Homo sapiens
acagtttataaaaataatgagg

SEQ ID NO: 7796327 - DNA, 22 bp, Homo sapiens
aggatgccttcattgcatggcc

SEQ ID NO: 7796328 - DNA, 21 bp, Homo sapiens
aggatgccgcaggcggagaag

SEQ ID NO: 7796329 - DNA, 22 bp, Homo sapiens
acagtgtgttggaggagactgt

SEQ ID NO: 7796330 - DNA, 22 bp, Homo sapiens
acagtgtgttctgggacctcca

SEQ ID NO: 7796331 - DNA, 22 bp, Homo sapiens
acatatattttcacacatggtt

SEQ ID NO: 7796332 - DNA, 22 bp, Homo sapiens
aggcagctggaaaactccaggc

SEQ ID NO: 7796333 - DNA, 22 bp, Homo sapiens
acatccagatctcagcatggct

SEQ ID NO: 7796334 - DNA, 22 bp, Homo sapiens
acatcagtaattaagtctcaag

SEQ ID NO: 7796335 - DNA, 22 bp, Homo sapiens
acatattttgaaagctttctaa

SEQ ID NO: 7796336 - DNA, 22 bp, Homo sapiens
acatgcttttcccacaattata

SEQ ID NO: 7796337 - DNA, 22 bp, Homo sapiens
acatgccagcccatttaaatgg

SEQ ID NO: 7796338 - DNA, 22 bp, Homo sapiens
acatgccagcccatttaaatgg

SEQ ID NO: 7796339 - DNA, 22 bp, Homo sapiens
acatgccaatttggttagttca

SEQ ID NO: 7796340 - DNA, 22 bp, Homo sapiens
acatgccagcactgcttttcag

SEQ ID NO: 7796341 - DNA, 22 bp, Homo sapiens
acatgccagcctcagcagcagt

SEQ ID NO: 7796342 - DNA, 22 bp, Homo sapiens
acatgccatcactttcattcct

SEQ ID NO: 7796343 - DNA, 22 bp, Homo sapiens
acatgccatctttgtcaggagt

SEQ ID NO: 7796344 - DNA, 22 bp, Homo sapiens
acatgccatgaaggtatttttg

SEQ ID NO: 7796345 - DNA, 22 bp, Homo sapiens
acatgccatggttgtttgctgc

SEQ ID NO: 7796346 - DNA, 22 bp, Homo sapiens
acatgtttgcctgcaggcttag

SEQ ID NO: 7796347 - DNA, 22 bp, Homo sapiens
aggccagggtcccacactcgca

SEQ ID NO: 7796348 - DNA, 22 bp, Homo sapiens
aggccagggtagggcccattgt

SEQ ID NO: 7796349 - DNA, 22 bp, Homo sapiens
aggccagggcactgctctttag

SEQ ID NO: 7796350 - DNA, 22 bp, Homo sapiens
aggccaggcgagacacccggct

SEQ ID NO: 7796351 - DNA, 22 bp, Homo sapiens
aggccaggcctttctccattcc

SEQ ID NO: 7796352 - DNA, 22 bp, Homo sapiens
aggccaggggtgagcacttctg

SEQ ID NO: 7796353 - DNA, 22 bp, Homo sapiens
aggccagggccagattagccac

SEQ ID NO: 7796354 - DNA, 22 bp, Homo sapiens
acatttggcatcttgtaacact

SEQ ID NO: 7796355 - DNA, 22 bp, Homo sapiens
acatttgactacatttatatat

SEQ ID NO: 7796356 - DNA, 22 bp, Homo sapiens
acatttctatagtgcatctgtt

SEQ ID NO: 7796357 - DNA, 17 bp, Homo sapiens
acatttcctaactgaag

SEQ ID NO: 7796358 - DNA, 22 bp, Homo sapiens
acatttcctaacgtatacactg

SEQ ID NO: 7796359 - DNA, 22 bp, Homo sapiens
accaggctggagtgcagtggcg

SEQ ID NO: 7796360 - DNA, 22 bp, Homo sapiens
acccagcctacaaagctcacct

SEQ ID NO: 7796361 - DNA, 22 bp, Homo sapiens
acccagcatgacacctgcacat

SEQ ID NO: 7796362 - DNA, 22 bp, Homo sapiens
acccagcaaagataaacttatg

SEQ ID NO: 7796363 - DNA, 22 bp, Homo sapiens
acccagccacagcattgaggga

SEQ ID NO: 7796364 - DNA, 22 bp, Homo sapiens
acccagctgtttcccgtgtcat

SEQ ID NO: 7796365 - DNA, 22 bp, Homo sapiens
acccagctggatgcatggaggc

SEQ ID NO: 7796366 - DNA, 22 bp, Homo sapiens
acccagctaaccctaccctgga

SEQ ID NO: 7796367 - DNA, 20 bp, Homo sapiens
acccagctctgtgccctggg

SEQ ID NO: 7796368 - DNA, 22 bp, Homo sapiens
agggctgacagtgaggagtcaa

SEQ ID NO: 7796369 - DNA, 22 bp, Homo sapiens
agggctgacagtgaggagtcaa

SEQ ID NO: 7796370 - DNA, 22 bp, Homo sapiens
agggggcccttgcaggtgagcg

SEQ ID NO: 7796371 - DNA, 20 bp, Homo sapiens
aggcttggcttggcaggaac

SEQ ID NO: 7796372 - DNA, 22 bp, Homo sapiens
aggctttaagtggcctacagct

SEQ ID NO: 7796373 - DNA, 22 bp, Homo sapiens
aggctttaattatctacaggag

SEQ ID NO: 7796374 - DNA, 22 bp, Homo sapiens
agggagacacatgaggaagtca

SEQ ID NO: 7796375 - DNA, 22 bp, Homo sapiens
agggcacttgaggctgggcctg

SEQ ID NO: 7796376 - DNA, 22 bp, Homo sapiens
acttagaagatgcagtaaagca

SEQ ID NO: 7796377 - DNA, 22 bp, Homo sapiens
atacagattgctatacttacaa

SEQ ID NO: 7796378 - DNA, 22 bp, Homo sapiens
acttctctttagtactaaatgt

SEQ ID NO: 7796379 - DNA, 22 bp, Homo sapiens
actttcaaatatcatgattcta

SEQ ID NO: 7796380 - DNA, 22 bp, Homo sapiens
actttcaaatatcatgattcta

SEQ ID NO: 7796381 - DNA, 22 bp, Homo sapiens
atactgtaatacctaaatgaac

SEQ ID NO: 7796382 - DNA, 22 bp, Homo sapiens
atacatgttgagaaaatatctg

SEQ ID NO: 7796383 - DNA, 22 bp, Homo sapiens
actgtagtctaaatatagtctt

SEQ ID NO: 7796384 - DNA, 22 bp, Homo sapiens
actgtcacttgcaactgtgagg

SEQ ID NO: 7796385 - DNA, 22 bp, Homo sapiens
actgtcatcttgtaagcaatgt

SEQ ID NO: 7796386 - DNA, 22 bp, Homo sapiens
actgtcaagagattcaaattca

SEQ ID NO: 7796387 - DNA, 22 bp, Homo sapiens
actgtcactccaactgagtcgt

SEQ ID NO: 7796388 - DNA, 22 bp, Homo sapiens
actgtcaaatgcaatgaactca

SEQ ID NO: 7796389 - DNA, 22 bp, Homo sapiens
actgtgatgcagttgccatcca

SEQ ID NO: 7796390 - DNA, 22 bp, Homo sapiens
actgtgatgtttgtgatcatct

SEQ ID NO: 7796391 - DNA, 22 bp, Homo sapiens
ataaaatttgctactgttaaat

SEQ ID NO: 7796392 - DNA, 22 bp, Homo sapiens
ataaaatttgctactgttaaat

SEQ ID NO: 7796393 - DNA, 22 bp, Homo sapiens
ataatctggtctttgtatgagt

SEQ ID NO: 7796394 - DNA, 22 bp, Homo sapiens
ataatgagcttttgaatactga

SEQ ID NO: 7796395 - DNA, 22 bp, Homo sapiens
agaaaataaattgatggtggaa

SEQ ID NO: 7796396 - DNA, 22 bp, Homo sapiens
agaaaagtgctctagtgagagc

SEQ ID NO: 7796397 - DNA, 22 bp, Homo sapiens
agaaaagtgctctagtgagagc

SEQ ID NO: 7796398 - DNA, 21 bp, Homo sapiens
agaaaagtatttgaatcaaga

SEQ ID NO: 7796399 - DNA, 22 bp, Homo sapiens
atattcttccaaaacatcattt

SEQ ID NO: 7796400 - DNA, 22 bp, Homo sapiens
atattcttatccttttctctgt

SEQ ID NO: 7796401 - DNA, 22 bp, Homo sapiens
agaaagctccccatgagatgat

SEQ ID NO: 7796402 - DNA, 22 bp, Homo sapiens
actttctaattgtctccagtgt

SEQ ID NO: 7796403 - DNA, 22 bp, Homo sapiens
actttctaggtctcagtccttt

SEQ ID NO: 7796404 - DNA, 22 bp, Homo sapiens
actttcaatttgcactaaccta

SEQ ID NO: 7796405 - DNA, 22 bp, Homo sapiens
actttcaattcccttagcaact

SEQ ID NO: 7796406 - DNA, 22 bp, Homo sapiens
actttcaagcaagaacactttg

SEQ ID NO: 7796407 - DNA, 22 bp, Homo sapiens
atatgaaagtaagcatgtgtgt

SEQ ID NO: 7796408 - DNA, 22 bp, Homo sapiens
agaaaaggttgaaagtaggatt

SEQ ID NO: 7796409 - DNA, 19 bp, Homo sapiens
atcatcctgggtcatgcac

SEQ ID NO: 7796410 - DNA, 20 bp, Homo sapiens
atcggcttgcctggaaacaa

SEQ ID NO: 7796411 - DNA, 22 bp, Homo sapiens
atctaaaaggagctctttatct

SEQ ID NO: 7796412 - DNA, 22 bp, Homo sapiens
agaacagaggccttatgtttca

SEQ ID NO: 7796413 - DNA, 22 bp, Homo sapiens
agaaattatgcagtagttttat

SEQ ID NO: 7796414 - DNA, 22 bp, Homo sapiens
agaaagtgtgtcatactaagtg

SEQ ID NO: 7796415 - DNA, 22 bp, Homo sapiens
agaaagtgtgtcatactaagtg

SEQ ID NO: 7796416 - DNA, 22 bp, Homo sapiens
actaggaaggcatatgggcaga

SEQ ID NO: 7796417 - DNA, 22 bp, Homo sapiens
agtatttgatacagtcttctag

SEQ ID NO: 7796418 - DNA, 22 bp, Homo sapiens
agtcccagcttcccccatgcag

SEQ ID NO: 7796419 - DNA, 22 bp, Homo sapiens
agtaaacactaaaatgactgcg

SEQ ID NO: 7796420 - DNA, 22 bp, Homo sapiens
agtaaaatcaccatctctttgt

SEQ ID NO: 7796421 - DNA, 22 bp, Homo sapiens
acgcctgtaatcccagcacttt

SEQ ID NO: 7796422 - DNA, 22 bp, Homo sapiens
acgcctgtaatcccagcacttt

SEQ ID NO: 7796423 - DNA, 22 bp, Homo sapiens
aggtctcaattcctgctcctgt

SEQ ID NO: 7796424 - DNA, 20 bp, Homo sapiens
aggtctcagagcaagagccc

SEQ ID NO: 7796425 - DNA, 22 bp, Homo sapiens
acctgatgtatagattctagat

SEQ ID NO: 7796426 - DNA, 22 bp, Homo sapiens
acctgagacttgggatgggaat

SEQ ID NO: 7796427 - DNA, 22 bp, Homo sapiens
acctgagacctaatctgactgt

SEQ ID NO: 7796428 - DNA, 22 bp, Homo sapiens
acctgcagccacttctctcctt

SEQ ID NO: 7796429 - DNA, 22 bp, Homo sapiens
acctgcagctaaagatgtaggg

SEQ ID NO: 7796430 - DNA, 22 bp, Homo sapiens
acctgcagctgagaaaatgact

SEQ ID NO: 7796431 - DNA, 22 bp, Homo sapiens
acctgcaggggtgctctctggg

SEQ ID NO: 7796432 - DNA, 19 bp, Homo sapiens
acctgcagtaataattcct

SEQ ID NO: 7796433 - DNA, 22 bp, Homo sapiens
acctgcaggtgtttccacactt

SEQ ID NO: 7796434 - DNA, 22 bp, Homo sapiens
acctgcaggcacaggtgtgcgc

SEQ ID NO: 7796435 - DNA, 22 bp, Homo sapiens
acctgcagtggccactcctaat

SEQ ID NO: 7796436 - DNA, 22 bp, Homo sapiens
acctgagaatgggggcatgtgt

SEQ ID NO: 7796437 - DNA, 22 bp, Homo sapiens
actctgtgaagatgcaggcttg

SEQ ID NO: 7796438 - DNA, 22 bp, Homo sapiens
actcttcaccgctactgaaata

SEQ ID NO: 7796439 - DNA, 22 bp, Homo sapiens
agtgcatgccttcctgtggatg

SEQ ID NO: 7796440 - DNA, 18 bp, Homo sapiens
agtgcatgctaggggaag

SEQ ID NO: 7796441 - DNA, 19 bp, Homo sapiens
agtgcatgggcgaggtgca

SEQ ID NO: 7796442 - DNA, 20 bp, Homo sapiens
agtgcatggagggagagggc

SEQ ID NO: 7796443 - DNA, 22 bp, Homo sapiens
agtgcatgtatctacagtcaca

SEQ ID NO: 7796444 - DNA, 22 bp, Homo sapiens
actgagggagagtcttaggttg

SEQ ID NO: 7796445 - DNA, 22 bp, Homo sapiens
actgaggacagtgaggagggct

SEQ ID NO: 7796446 - DNA, 22 bp, Homo sapiens
actgaggagaaatttgagtgaa

SEQ ID NO: 7796447 - DNA, 22 bp, Homo sapiens
actgaggatggataggtcatat

SEQ ID NO: 7796448 - DNA, 22 bp, Homo sapiens
agtctgtcagtcattctaacaa

SEQ ID NO: 7796449 - DNA, 22 bp, Homo sapiens
agtctttacatgtgttatatat

SEQ ID NO: 7796450 - DNA, 22 bp, Homo sapiens
actcctgggttgcagtcctcaa

SEQ ID NO: 7796451 - DNA, 20 bp, Homo sapiens
actcctggtaacttttgtga

SEQ ID NO: 7796452 - DNA, 17 bp, Homo sapiens
actcctggtctgaaggg

SEQ ID NO: 7796453 - DNA, 22 bp, Homo sapiens
actcctgggttctaaatttgaa

SEQ ID NO: 7796454 - DNA, 22 bp, Homo sapiens
actcctgggttccggagattct

SEQ ID NO: 7796455 - DNA, 22 bp, Homo sapiens
actcctggttcccagttgagat

SEQ ID NO: 7796456 - DNA, 22 bp, Homo sapiens
actcctggtgctgatgaagaga

SEQ ID NO: 7796457 - DNA, 22 bp, Homo sapiens
actcctggtttgtgtcctggct

SEQ ID NO: 7796458 - DNA, 22 bp, Homo sapiens
agtggcagtagatgagctggtt

SEQ ID NO: 7796459 - DNA, 22 bp, Homo sapiens
agtgtacatcagaacatatcaa

SEQ ID NO: 7796460 - DNA, 22 bp, Homo sapiens
agtgtattagttgtccagcagt

SEQ ID NO: 7796461 - DNA, 22 bp, Homo sapiens
agtgtatgcaggttttcaatgt

SEQ ID NO: 7796462 - DNA, 22 bp, Homo sapiens
actggctttgagggaatagcta

SEQ ID NO: 7796463 - DNA, 22 bp, Homo sapiens
agtgtttaccccaatcagttta

SEQ ID NO: 7796464 - DNA, 23 bp, Homo sapiens
agtgttggttgggaagccaagca

SEQ ID NO: 7796465 - DNA, 22 bp, Homo sapiens
agtgttgggtctttagaattta

SEQ ID NO: 7796466 - DNA, 22 bp, Homo sapiens
agtgttcttctggggtatgctc

SEQ ID NO: 7796467 - DNA, 22 bp, Homo sapiens
agtgttcttcctatctgctgtt

SEQ ID NO: 7796468 - DNA, 22 bp, Homo sapiens
agagttgctaccaagatgctag

SEQ ID NO: 7796469 - DNA, 22 bp, Homo sapiens
agagttgctatagaaggatgga

SEQ ID NO: 7796470 - DNA, 22 bp, Homo sapiens
agagttggcccacgtgtaggcg

SEQ ID NO: 7796471 - DNA, 22 bp, Homo sapiens
agaggtcagctgcatgccacat

SEQ ID NO: 7796472 - DNA, 22 bp, Homo sapiens
atttcacaaagaacagatgcag

SEQ ID NO: 7796473 - DNA, 21 bp, Homo sapiens
atttcacaccctcctttttct

SEQ ID NO: 7796474 - DNA, 22 bp, Homo sapiens
atttcacagcgtggttgactgc

SEQ ID NO: 7796475 - DNA, 22 bp, Homo sapiens
atttcacagctgctgttcaggt

SEQ ID NO: 7796476 - DNA, 22 bp, Homo sapiens
agataaaatggttcaaaggcta

SEQ ID NO: 7796477 - DNA, 22 bp, Homo sapiens
atttcacattaatttgatgctc

SEQ ID NO: 7796478 - DNA, 17 bp, Homo sapiens
atttcacttagcatgag

SEQ ID NO: 7796479 - DNA, 22 bp, Homo sapiens
atttcacagctgtcagtgttac

SEQ ID NO: 7796480 - DNA, 22 bp, Homo sapiens
atttcacatctatctcagattt

SEQ ID NO: 7796481 - DNA, 22 bp, Homo sapiens
atttgttccatgagtaaggcta

SEQ ID NO: 7796482 - DNA, 22 bp, Homo sapiens
atttgttaattatgaggcatac

SEQ ID NO: 7796483 - DNA, 22 bp, Homo sapiens
atttgttcacaatcagggcagg

SEQ ID NO: 7796484 - DNA, 22 bp, Homo sapiens
atttgttaattatgaggcatac

SEQ ID NO: 7796485 - DNA, 22 bp, Homo sapiens
attttaaccctcttatatatac

SEQ ID NO: 7796486 - DNA, 22 bp, Homo sapiens
attccagatggcttcaagtaag

SEQ ID NO: 7796487 - DNA, 22 bp, Homo sapiens
attcatttaggtattcacttac

SEQ ID NO: 7796488 - DNA, 22 bp, Homo sapiens
agaggcctgtgtgctccagtgg

SEQ ID NO: 7796489 - DNA, 22 bp, Homo sapiens
agaggcctttctgttgagtgaa

SEQ ID NO: 7796490 - DNA, 22 bp, Homo sapiens
attcagtaggtctagaataaga

SEQ ID NO: 7796491 - DNA, 22 bp, Homo sapiens
attcatgtcatagcaggatttc

SEQ ID NO: 7796492 - DNA, 19 bp, Homo sapiens
attcattggccagggtggt

SEQ ID NO: 7796493 - DNA, 17 bp, Homo sapiens
agaggcagatacttgga

SEQ ID NO: 7796494 - DNA, 22 bp, Homo sapiens
attattagattcttaattgtaa

SEQ ID NO: 7796495 - DNA, 22 bp, Homo sapiens
attattaggactactggggttg

SEQ ID NO: 7796496 - DNA, 22 bp, Homo sapiens
attattaggtgctctctgacaa

SEQ ID NO: 7796497 - DNA, 22 bp, Homo sapiens
attattagtgatgttgttactg

SEQ ID NO: 7796498 - DNA, 22 bp, Homo sapiens
agaggaggctgggtccagataa

SEQ ID NO: 7796499 - DNA, 22 bp, Homo sapiens
attattagacttatatggtagt

SEQ ID NO: 7796500 - DNA, 20 bp, Homo sapiens
agaggaggattattttattc

SEQ ID NO: 7796501 - DNA, 22 bp, Homo sapiens
agaggaggaagagctttaaaat

SEQ ID NO: 7796502 - DNA, 22 bp, Homo sapiens
agaggaggatttgtaaaggtct

SEQ ID NO: 7796503 - DNA, 20 bp, Homo sapiens
agaggaggattattttattc

SEQ ID NO: 7796504 - DNA, 22 bp, Homo sapiens
agaggaggctctgggatcgtcc

SEQ ID NO: 7796505 - DNA, 22 bp, Homo sapiens
agaggaggctgggtccagataa

SEQ ID NO: 7796506 - DNA, 22 bp, Homo sapiens
agaggaggcagcttaactcagt

SEQ ID NO: 7796507 - DNA, 22 bp, Homo sapiens
agaggaggcagcttaactcagt

SEQ ID NO: 7796508 - DNA, 22 bp, Homo sapiens
agaggaggccaggcccacacct

SEQ ID NO: 7796509 - DNA, 22 bp, Homo sapiens
atgtttacaattcagtattaca

SEQ ID NO: 7796510 - DNA, 22 bp, Homo sapiens
atgtttactggtttatagaata

SEQ ID NO: 7796511 - DNA, 22 bp, Homo sapiens
atgtggttttggattattcatg

SEQ ID NO: 7796512 - DNA, 22 bp, Homo sapiens
atgtatttgcgtatggacatac

SEQ ID NO: 7796513 - DNA, 22 bp, Homo sapiens
atgtatttgcgtatggacatac

SEQ ID NO: 7796514 - DNA, 22 bp, Homo sapiens
agagccagcaagtgaatagtga

SEQ ID NO: 7796515 - DNA, 22 bp, Homo sapiens
agagccagcaactctagccctg

SEQ ID NO: 7796516 - DNA, 22 bp, Homo sapiens
agagccagatggagccgtgtgt

SEQ ID NO: 7796517 - DNA, 22 bp, Homo sapiens
agagcatccatcggccaggacc

SEQ ID NO: 7796518 - DNA, 23 bp, Homo sapiens
agagcatcatgatgctaagtctg

SEQ ID NO: 7796519 - DNA, 22 bp, Homo sapiens
agagcatctaacacataagcct

SEQ ID NO: 7796520 - DNA, 19 bp, Homo sapiens
agagccagacagcatagga

SEQ ID NO: 7796521 - DNA, 22 bp, Homo sapiens
agagccagaccattgccgtgca

SEQ ID NO: 7796522 - DNA, 22 bp, Homo sapiens
agagccagagacctgggttcac

SEQ ID NO: 7796523 - DNA, 22 bp, Homo sapiens
atggcctggggattcctgagca

SEQ ID NO: 7796524 - DNA, 22 bp, Homo sapiens
atggcctgatgcacctgtccca

SEQ ID NO: 7796525 - DNA, 22 bp, Homo sapiens
atggcctgcagtgctgccacag

SEQ ID NO: 7796526 - DNA, 22 bp, Homo sapiens
agagaaggaaagctgacatggg

SEQ ID NO: 7796527 - DNA, 22 bp, Homo sapiens
atgaaagatgatttaaagtact

SEQ ID NO: 7796528 - DNA, 22 bp, Homo sapiens
atgaaattgatcttgaactttt

SEQ ID NO: 7796529 - DNA, 22 bp, Homo sapiens
agaagtttggtcctataaactc

SEQ ID NO: 7796530 - DNA, 22 bp, Homo sapiens
agacatcaatgatcagaggtag

SEQ ID NO: 7796531 - DNA, 22 bp, Homo sapiens
agacatatattgcaattcactg

SEQ ID NO: 7796532 - DNA, 22 bp, Homo sapiens
atgcacctgaactccatcagct

SEQ ID NO: 7796533 - DNA, 22 bp, Homo sapiens
agcaggcaagcgtgagttctct

SEQ ID NO: 7796534 - DNA, 22 bp, Homo sapiens
agcaggagcccttatcaccagg

SEQ ID NO: 7796535 - DNA, 22 bp, Homo sapiens
cacagtttgggtctccggggca

SEQ ID NO: 7796536 - DNA, 22 bp, Homo sapiens
cacagtttggtatagaagtgat

SEQ ID NO: 7796537 - DNA, 22 bp, Homo sapiens
cacagtttgcataggaaaaaca

SEQ ID NO: 7796538 - DNA, 22 bp, Homo sapiens
cacagtttctgaacactttgca

SEQ ID NO: 7796539 - DNA, 22 bp, Homo sapiens
cacagtttatgatctcagtgaa

SEQ ID NO: 7796540 - DNA, 22 bp, Homo sapiens
cacagtttcaataattattctt

SEQ ID NO: 7796541 - DNA, 22 bp, Homo sapiens
cacagtttctataggtcagaat

SEQ ID NO: 7796542 - DNA, 20 bp, Homo sapiens
agcatacatcataagaaacc

SEQ ID NO: 7796543 - DNA, 22 bp, Homo sapiens
agcatacaggtctgaaacagct

SEQ ID NO: 7796544 - DNA, 22 bp, Homo sapiens
cacccagggctgtgcctgccca

SEQ ID NO: 7796545 - DNA, 22 bp, Homo sapiens
cacccaggctggagagcagtgg

SEQ ID NO: 7796546 - DNA, 22 bp, Homo sapiens
cacaagatggtcacataagtgc

SEQ ID NO: 7796547 - DNA, 22 bp, Homo sapiens
cacaagctgggcaagtgtatat

SEQ ID NO: 7796548 - DNA, 22 bp, Homo sapiens
cacaagctccttatgtggagaa

SEQ ID NO: 7796549 - DNA, 22 bp, Homo sapiens
cacaaggaggtcctgaggaagc

SEQ ID NO: 7796550 - DNA, 22 bp, Homo sapiens
cacaaggactggatggagtggg

SEQ ID NO: 7796551 - DNA, 22 bp, Homo sapiens
agcagccacccagctgctcatt

SEQ ID NO: 7796552 - DNA, 22 bp, Homo sapiens
agcaaagcaccatatggcagtt

SEQ ID NO: 7796553 - DNA, 22 bp, Homo sapiens
agcaaagcagtggctaagctga

SEQ ID NO: 7796554 - DNA, 21 bp, Homo sapiens
agcacagctttaagccatgtg

SEQ ID NO: 7796555 - DNA, 22 bp, Homo sapiens
agcaaagaaatggaggctcaga

SEQ ID NO: 7796556 - DNA, 22 bp, Homo sapiens
agcacagttttcattgcagggt

SEQ ID NO: 7796557 - DNA, 18 bp, Homo sapiens
caaatagcatgatgtcct

SEQ ID NO: 7796558 - DNA, 22 bp, Homo sapiens
caaatagattgttcaatcctga

SEQ ID NO: 7796559 - DNA, 22 bp, Homo sapiens
caacagaaggtgtactactgaa

SEQ ID NO: 7796560 - DNA, 22 bp, Homo sapiens
cagagggacagtgtaatgcata

SEQ ID NO: 7796561 - DNA, 22 bp, Homo sapiens
cagaggcatactcccagtcttg

SEQ ID NO: 7796562 - DNA, 21 bp, Homo sapiens
cagaggcaggtcctgggacgg

SEQ ID NO: 7796563 - DNA, 21 bp, Homo sapiens
cagaggcaggctctgtgtgtg

SEQ ID NO: 7796564 - DNA, 22 bp, Homo sapiens
cagaggagttcagtacacagcc

SEQ ID NO: 7796565 - DNA, 22 bp, Homo sapiens
agcccagataaagtacaaccat

SEQ ID NO: 7796566 - DNA, 22 bp, Homo sapiens
agcccagatggtagccctagaa

SEQ ID NO: 7796567 - DNA, 22 bp, Homo sapiens
agcccagaggctgggcgtgcat

SEQ ID NO: 7796568 - DNA, 22 bp, Homo sapiens
agcccagagccccggccatgtt

SEQ ID NO: 7796569 - DNA, 22 bp, Homo sapiens
cagagaaagggtgaattccttc

SEQ ID NO: 7796570 - DNA, 22 bp, Homo sapiens
agccatcctactacctcagcat

SEQ ID NO: 7796571 - DNA, 22 bp, Homo sapiens
cagacatctgtacccagcctgt

SEQ ID NO: 7796572 - DNA, 21 bp, Homo sapiens
cagacatgagtctcagctttg

SEQ ID NO: 7796573 - DNA, 22 bp, Homo sapiens
agccacccattcccgagcccta

SEQ ID NO: 7796574 - DNA, 22 bp, Homo sapiens
agcctctgctggccctggcact

SEQ ID NO: 7796575 - DNA, 22 bp, Homo sapiens
cagcaggggaactgtgggccag

SEQ ID NO: 7796576 - DNA, 22 bp, Homo sapiens
cagccctgagagaaccatctat

SEQ ID NO: 7796577 - DNA, 22 bp, Homo sapiens
agctcaggcaactctgggcccc

SEQ ID NO: 7796578 - DNA, 22 bp, Homo sapiens
agctcagcttcctctccatgct

SEQ ID NO: 7796579 - DNA, 22 bp, Homo sapiens
agctcagccctcctgtgcagct

SEQ ID NO: 7796580 - DNA, 22 bp, Homo sapiens
agctcagagataatcaagagac

SEQ ID NO: 7796581 - DNA, 23 bp, Homo sapiens
agctcctgaggccagcctctcct

SEQ ID NO: 7796582 - DNA, 22 bp, Homo sapiens
agctcctgatacatgcaggaat

SEQ ID NO: 7796583 - DNA, 22 bp, Homo sapiens
agctcctgattctcagagatag

SEQ ID NO: 7796584 - DNA, 22 bp, Homo sapiens
cagctcattcctcaatctagga

SEQ ID NO: 7796585 - DNA, 18 bp, Homo sapiens
agctcctgaactctgtgg

SEQ ID NO: 7796586 - DNA, 22 bp, Homo sapiens
agctcctgaaaatccagactgg

SEQ ID NO: 7796587 - DNA, 22 bp, Homo sapiens
aatcatctccgaaaaaagagta

SEQ ID NO: 7796588 - DNA, 22 bp, Homo sapiens
aatataatgctgttttatgcca

SEQ ID NO: 7796589 - DNA, 20 bp, Homo sapiens
aatataattctctgaattta

SEQ ID NO: 7796590 - DNA, 22 bp, Homo sapiens
aactacaatatgtatgtatgta

SEQ ID NO: 7796591 - DNA, 22 bp, Homo sapiens
aactgctcatttgagagtatgc

SEQ ID NO: 7796592 - DNA, 22 bp, Homo sapiens
aacttaggaaaataaggcatga

SEQ ID NO: 7796593 - DNA, 22 bp, Homo sapiens
aactgtttttcacgtgtctcat

SEQ ID NO: 7796594 - DNA, 22 bp, Homo sapiens
aactgtttggaactcttccaca

SEQ ID NO: 7796595 - DNA, 22 bp, Homo sapiens
aactgtttaccatacacagtga

SEQ ID NO: 7796596 - DNA, 20 bp, Homo sapiens
aaccaacagaatcatgtctc

SEQ ID NO: 7796597 - DNA, 22 bp, Homo sapiens
aataacttcatcttcaggatag

SEQ ID NO: 7796598 - DNA, 22 bp, Homo sapiens
aatagtttgaatttatcagatg

SEQ ID NO: 7796599 - DNA, 22 bp, Homo sapiens
aacaggcaatttaggactcttt

SEQ ID NO: 7796600 - DNA, 22 bp, Homo sapiens
aacaggcaacagttgactctga

SEQ ID NO: 7796601 - DNA, 22 bp, Homo sapiens
aacaggcaatttaggactcttt

SEQ ID NO: 7796602 - DNA, 22 bp, Homo sapiens
aacaggccttgtttttgttcat

SEQ ID NO: 7796603 - DNA, 22 bp, Homo sapiens
aacaggcagcagactgaatctg

SEQ ID NO: 7796604 - DNA, 22 bp, Homo sapiens
aacaggcaggagaattctgcct

SEQ ID NO: 7796605 - DNA, 22 bp, Homo sapiens
aacatgcatgaagaagttatat

SEQ ID NO: 7796606 - DNA, 22 bp, Homo sapiens
aacatgcccgctgtatgccatt

SEQ ID NO: 7796607 - DNA, 22 bp, Homo sapiens
aacaaaggccgttaataaccac

SEQ ID NO: 7796608 - DNA, 22 bp, Homo sapiens
aaattctatgtcaatgtttatt

SEQ ID NO: 7796609 - DNA, 22 bp, Homo sapiens
aaattctatgtcaatgtttatt

SEQ ID NO: 7796610 - DNA, 22 bp, Homo sapiens
aaattctaaggtcacaatgttg

SEQ ID NO: 7796611 - DNA, 22 bp, Homo sapiens
aaattctttggcctactttgaa

SEQ ID NO: 7796612 - DNA, 22 bp, Homo sapiens
aaattctttggcctactttgaa

SEQ ID NO: 7796613 - DNA, 22 bp, Homo sapiens
aaatgtgtgtatgtacatatat

SEQ ID NO: 7796614 - DNA, 22 bp, Homo sapiens
aaatgtgttcctttgctacaga

SEQ ID NO: 7796615 - DNA, 22 bp, Homo sapiens
aaatgtgtatatgaaacatgat

SEQ ID NO: 7796616 - DNA, 22 bp, Homo sapiens
aaattccattttgtgactattc

SEQ ID NO: 7796617 - DNA, 22 bp, Homo sapiens
aaattctaaggtcacaatgttg

SEQ ID NO: 7796618 - DNA, 22 bp, Homo sapiens
aaatgtttctacttgtgagcat

SEQ ID NO: 7796619 - DNA, 22 bp, Homo sapiens
aagtcattatctcttctaatct

SEQ ID NO: 7796620 - DNA, 22 bp, Homo sapiens
aagtcattggtagcttgatagg

SEQ ID NO: 7796621 - DNA, 22 bp, Homo sapiens
aacactatctgccttacaggga

SEQ ID NO: 7796622 - DNA, 22 bp, Homo sapiens
aaggtcaaagacagtaactttt

SEQ ID NO: 7796623 - DNA, 22 bp, Homo sapiens
aatgttttgcattagttttcta

SEQ ID NO: 7796624 - DNA, 22 bp, Homo sapiens
aatgttttcattatcctaactg

SEQ ID NO: 7796625 - DNA, 22 bp, Homo sapiens
aatgttttctctgtgaacacat

SEQ ID NO: 7796626 - DNA, 22 bp, Homo sapiens
aacttattgaacattctcgaat

SEQ ID NO: 7796627 - DNA, 22 bp, Homo sapiens
aacttcacctttttgccacact

SEQ ID NO: 7796628 - DNA, 22 bp, Homo sapiens
aacttcaagcttcgtcccttcg

SEQ ID NO: 7796629 - DNA, 22 bp, Homo sapiens
aacttattccataggctcactg

SEQ ID NO: 7796630 - DNA, 22 bp, Homo sapiens
aacttattccataggctcactg

SEQ ID NO: 7796631 - DNA, 22 bp, Homo sapiens
aacttcatgtaatttaaaacag

SEQ ID NO: 7796632 - DNA, 22 bp, Homo sapiens
aagaaatattgggccttataaa

SEQ ID NO: 7796633 - DNA, 22 bp, Homo sapiens
aagaataaattaagatacttag

SEQ ID NO: 7796634 - DNA, 22 bp, Homo sapiens
aagaataagaggatttagaaca

SEQ ID NO: 7796635 - DNA, 22 bp, Homo sapiens
aagaataagtagatgggagaag

SEQ ID NO: 7796636 - DNA, 22 bp, Homo sapiens
aattggtttgaataaataaaga

SEQ ID NO: 7796637 - DNA, 22 bp, Homo sapiens
aattgtcaaaaattgcaattgt

SEQ ID NO: 7796638 - DNA, 17 bp, Homo sapiens
aagagaggctgagctgg

SEQ ID NO: 7796639 - DNA, 22 bp, Homo sapiens
aagagatgatggcagccagagg

SEQ ID NO: 7796640 - DNA, 22 bp, Homo sapiens
acaaagattcatttgcattatt

SEQ ID NO: 7796641 - DNA, 22 bp, Homo sapiens
acaaagattcatttgcattatt

SEQ ID NO: 7796642 - DNA, 22 bp, Homo sapiens
acaaagatgtttaaagcattta

SEQ ID NO: 7796643 - DNA, 20 bp, Homo sapiens
acaaagactggaaaagcaag

SEQ ID NO: 7796644 - DNA, 22 bp, Homo sapiens
aagacatgttttaagaatattt

SEQ ID NO: 7796645 - DNA, 22 bp, Homo sapiens
acaaggccaagcattctagcaa

SEQ ID NO: 7796646 - DNA, 22 bp, Homo sapiens
acaaggctgttggtcacaaacc

SEQ ID NO: 7796647 - DNA, 22 bp, Homo sapiens
aagcatgtacaatgagtgtctc

SEQ ID NO: 7796648 - DNA, 22 bp, Homo sapiens
aagcatttatagataagaattt

SEQ ID NO: 7796649 - DNA, 22 bp, Homo sapiens
aagcatttcaggtagagatatt

SEQ ID NO: 7796650 - DNA, 22 bp, Homo sapiens
acagcagctaacccctgggcca

SEQ ID NO: 7796651 - DNA, 22 bp, Homo sapiens
acagcagctgccttcaggctct

SEQ ID NO: 7796652 - DNA, 22 bp, Homo sapiens
acagagtattggaaaggcagtg

SEQ ID NO: 7796653 - DNA, 22 bp, Homo sapiens
aagaggccttggtctgacctga

SEQ ID NO: 7796654 - DNA, 22 bp, Homo sapiens
aagcacaggatcttgaggagcg

SEQ ID NO: 7796655 - DNA, 22 bp, Homo sapiens
aagcacaggagacgcacagcca

SEQ ID NO: 7796656 - DNA, 22 bp, Homo sapiens
aagcacagggtgtctgcattca

SEQ ID NO: 7796657 - DNA, 22 bp, Homo sapiens
acactgctcacttcttcccttg

SEQ ID NO: 7796658 - DNA, 22 bp, Homo sapiens
aagatttactttctttgtaata

SEQ ID NO: 7796659 - DNA, 22 bp, Homo sapiens
aaagagcaccctcaatgtctga

SEQ ID NO: 7796660 - DNA, 22 bp, Homo sapiens
aaatgcagattgtcattcagga

SEQ ID NO: 7796661 - DNA, 22 bp, Homo sapiens
aaagagtcgtgttccaggtttg

SEQ ID NO: 7796662 - DNA, 22 bp, Homo sapiens
aaagagtcaaaggcatgtctct

SEQ ID NO: 7796663 - DNA, 22 bp, Homo sapiens
aaagagtctggcactgtaccag

SEQ ID NO: 7796664 - DNA, 22 bp, Homo sapiens
aaattagaaatactttcaaagc

SEQ ID NO: 7796665 - DNA, 22 bp, Homo sapiens
aaattagaagtgctcaggaata

SEQ ID NO: 7796666 - DNA, 22 bp, Homo sapiens
aaattagaccagggctcctgga

SEQ ID NO: 7796667 - DNA, 22 bp, Homo sapiens
aaattaagggtgagaagagttg

SEQ ID NO: 7796668 - DNA, 20 bp, Homo sapiens
aaattactgccacacatttc

SEQ ID NO: 7796669 - DNA, 22 bp, Homo sapiens
aaactgacaatctcagtcctat

SEQ ID NO: 7796670 - DNA, 22 bp, Homo sapiens
aaactgaaacatcatcatgttg

SEQ ID NO: 7796671 - DNA, 22 bp, Homo sapiens
aaagaaggtagggctggtgact

SEQ ID NO: 7796672 - DNA, 22 bp, Homo sapiens
aaagaatcagaagtctcaaaca

SEQ ID NO: 7796673 - DNA, 22 bp, Homo sapiens
aaacctttgtgtgtctgtgcct

SEQ ID NO: 7796674 - DNA, 22 bp, Homo sapiens
aaaccttttcagctgaatggag

SEQ ID NO: 7796675 - DNA, 22 bp, Homo sapiens
aaacctttctgctctcagcgta

SEQ ID NO: 7796676 - DNA, 22 bp, Homo sapiens
aaaccttttcagctgaatggag

SEQ ID NO: 7796677 - DNA, 22 bp, Homo sapiens
aaacagtggccaattctggaga

SEQ ID NO: 7796678 - DNA, 22 bp, Homo sapiens
aaacagttgttatttttatatg

SEQ ID NO: 7796679 - DNA, 22 bp, Homo sapiens
aaaatctaagtagcgagtaagg

SEQ ID NO: 7796680 - DNA, 22 bp, Homo sapiens
aaaatccttagccgagtgaggt

SEQ ID NO: 7796681 - DNA, 22 bp, Homo sapiens
aaaatctgcttccttttacaga

SEQ ID NO: 7796682 - DNA, 22 bp, Homo sapiens
aaaatcctctaattctagaata

SEQ ID NO: 7796683 - DNA, 22 bp, Homo sapiens
aaaatcctgctgactcgagatg

SEQ ID NO: 7796684 - DNA, 22 bp, Homo sapiens
aaaatcctctaattctagaata

SEQ ID NO: 7796685 - DNA, 22 bp, Homo sapiens
aaaagagaatcctgtacagaga

SEQ ID NO: 7796686 - DNA, 22 bp, Homo sapiens
aaaagacatctatttcaggcag

SEQ ID NO: 7796687 - DNA, 22 bp, Homo sapiens
aaaaatcacttttataggcagc

SEQ ID NO: 7796688 - DNA, 22 bp, Homo sapiens
aaaaatctatgactgcttctcc

SEQ ID NO: 7796689 - DNA, 22 bp, Homo sapiens
aaaaatcacttttataggcagc

SEQ ID NO: 7796690 - DNA, 22 bp, Homo sapiens
aaacacaggtactgcagaagtg

SEQ ID NO: 7796691 - DNA, 22 bp, Homo sapiens
aaaaacctcaattacttttgca

SEQ ID NO: 7796692 - DNA, 22 bp, Homo sapiens
aaaatcttgactgtttttagaa

SEQ ID NO: 7796693 - DNA, 22 bp, Homo sapiens
aaaatcttgtgacttaggaagg

SEQ ID NO: 7796694 - DNA, 22 bp, Homo sapiens
aaaatgaagcaaaggcattcag

SEQ ID NO: 7796695 - DNA, 22 bp, Homo sapiens
aaaatgaagcaaaggcattcag

SEQ ID NO: 7796696 - DNA, 22 bp, Homo sapiens
aaaaaattccattctgtgcctt

SEQ ID NO: 7796697 - DNA, 22 bp, Homo sapiens
aaaaaattatcatagttcctga

SEQ ID NO: 7796698 - DNA, 22 bp, Homo sapiens
aaaaaatcagatctttggttaa

SEQ ID NO: 7796699 - DNA, 22 bp, Homo sapiens
aacagataatttctaagttact

SEQ ID NO: 7796700 - DNA, 22 bp, Homo sapiens
aacagataagtatatctatgta

SEQ ID NO: 7796701 - DNA, 22 bp, Homo sapiens
aacagcagcaagtaagcaggtc

SEQ ID NO: 7796702 - DNA, 22 bp, Homo sapiens
aacagcaatagcactattcatt

SEQ ID NO: 7796703 - DNA, 18 bp, Homo sapiens
aaagctgttattccagaa

SEQ ID NO: 7796704 - DNA, 22 bp, Homo sapiens
aaagatcacgtcccaggactcg

SEQ ID NO: 7796705 - DNA, 22 bp, Homo sapiens
aaagatcaatagataaagctac

SEQ ID NO: 7796706 - DNA, 22 bp, Homo sapiens
aaagatcaagtaggcatggcct

SEQ ID NO: 7796707 - DNA, 22 bp, Homo sapiens
aaagataatgtttccttattct

SEQ ID NO: 7796708 - DNA, 22 bp, Homo sapiens
aacaaaagccgaagtaggtgtc

SEQ ID NO: 7796709 - DNA, 22 bp, Homo sapiens
aaattttagtaaggaagttgag

SEQ ID NO: 7796710 - DNA, 22 bp, Homo sapiens
aaattttctctctaagacttaa

SEQ ID NO: 7796711 - DNA, 20 bp, Homo sapiens
aaagtgtaagcatataatta

SEQ ID NO: 7796712 - DNA, 22 bp, Homo sapiens
aaagtgctgtgggctgtaagtg

SEQ ID NO: 7796713 - DNA, 22 bp, Homo sapiens
aaagtagcttagttgatatttc

SEQ ID NO: 7796714 - DNA, 22 bp, Homo sapiens
aaagtatttgtgatttttacca

SEQ ID NO: 7796715 - DNA, 22 bp, Homo sapiens
aaagtattcaaaaatatttggt

SEQ ID NO: 7796716 - DNA, 22 bp, Homo sapiens
aaagtattcttgactgtttttc

SEQ ID NO: 7796717 - DNA, 22 bp, Homo sapiens
aactaaatctggcatttagagc

SEQ ID NO: 7796718 - DNA, 22 bp, Homo sapiens
aacgttttatcgtgtgctcttc

SEQ ID NO: 7796719 - DNA, 22 bp, Homo sapiens
aactaaaactggtttgttctct

SEQ ID NO: 7796720 - DNA, 22 bp, Homo sapiens
aaagtgttatgcaaaactctgt

SEQ ID NO: 7796721 - DNA, 22 bp, Homo sapiens
aaataacttatgatcgtctggc

SEQ ID NO: 7796722 - DNA, 22 bp, Homo sapiens
aaagttttatatgctgcagcga

SEQ ID NO: 7796723 - DNA, 22 bp, Homo sapiens
aaataacttggtttcatcagag

SEQ ID NO: 7796724 - DNA, 22 bp, Homo sapiens
aaataactttctgtgtatagtc

SEQ ID NO: 7796725 - DNA, 22 bp, Homo sapiens
aaataagttagcagattccagt

SEQ ID NO: 7796726 - DNA, 23 bp, Homo sapiens
aaataggagtatctggatcatga

SEQ ID NO: 7796727 - DNA, 22 bp, Homo sapiens
aaatagctacatgatctctagg

SEQ ID NO: 7796728 - DNA, 22 bp, Homo sapiens
aaataattgagttggtcaatat

SEQ ID NO: 7796729 - DNA, 22 bp, Homo sapiens
aaataattatagcgagtctatc

SEQ ID NO: 7796730 - DNA, 22 bp, Homo sapiens
aagcacagactccctctgagtg

SEQ ID NO: 7796731 - DNA, 22 bp, Homo sapiens
aaatcctaagcagaggaattta

SEQ ID NO: 7796732 - DNA, 22 bp, Homo sapiens
aaatcctaaggagaatatgatt

SEQ ID NO: 7796733 - DNA, 22 bp, Homo sapiens
aaatcctaaaagtttgacttaa

SEQ ID NO: 7796734 - DNA, 22 bp, Homo sapiens
aaatcctaatgacaagtttagt

SEQ ID NO: 7796735 - DNA, 22 bp, Homo sapiens
aaatcctaccaagaaattccct

SEQ ID NO: 7796736 - DNA, 22 bp, Homo sapiens
aaatcctaataatgcactagtg

SEQ ID NO: 7796737 - DNA, 22 bp, Homo sapiens
aaatcctaatgacaagtttagt

SEQ ID NO: 7796738 - DNA, 22 bp, Homo sapiens
aaatgcacaggttttaaatcct

SEQ ID NO: 7796739 - DNA, 22 bp, Homo sapiens
aagcacagcagagccttgcttg

SEQ ID NO: 7796740 - DNA, 22 bp, Homo sapiens
aaatgcaggtagtatttatttt

SEQ ID NO: 7796741 - DNA, 22 bp, Homo sapiens
aaatgtacaacatccatatata

SEQ ID NO: 7796742 - DNA, 22 bp, Homo sapiens
aagcatcttctatcagttagac

SEQ ID NO: 7796743 - DNA, 22 bp, Homo sapiens
aaatgtagtatgttgcatgtat

SEQ ID NO: 7796744 - DNA, 22 bp, Homo sapiens
aaatgtagtatgttgcatgtat

SEQ ID NO: 7796745 - DNA, 22 bp, Homo sapiens
aaatgtattgcataggatattt

SEQ ID NO: 7796746 - DNA, 22 bp, Homo sapiens
aagctcttttcaccattaaagt

SEQ ID NO: 7796747 - DNA, 22 bp, Homo sapiens
aagctgaatctgaaatagaatt

SEQ ID NO: 7796748 - DNA, 22 bp, Homo sapiens
aagctgaattttctaaaagaat

SEQ ID NO: 7796749 - DNA, 22 bp, Homo sapiens
aagctgaagccggatcaaaaag

SEQ ID NO: 7796750 - DNA, 22 bp, Homo sapiens
aagctgaagacacagctccagt

SEQ ID NO: 7796751 - DNA, 22 bp, Homo sapiens
acttgttttatctgtcaataga

SEQ ID NO: 7796752 - DNA, 22 bp, Homo sapiens
acttgtttggtctcatgtttaa

SEQ ID NO: 7796753 - DNA, 22 bp, Homo sapiens
acttgtttgcctaaaattttga

SEQ ID NO: 7796754 - DNA, 22 bp, Homo sapiens
acttgtttgaatctctctagag

SEQ ID NO: 7796755 - DNA, 22 bp, Homo sapiens
acttgtttcaactgtactctcc

SEQ ID NO: 7796756 - DNA, 22 bp, Homo sapiens
acttgtttcaactgtactctca

SEQ ID NO: 7796757 - DNA, 22 bp, Homo sapiens
aatcctgacctgggcatgcttg

SEQ ID NO: 7796758 - DNA, 22 bp, Homo sapiens
aatcaaagaatgggctagttgg

SEQ ID NO: 7796759 - DNA, 22 bp, Homo sapiens
aatcaagaaaatgaggattctt

SEQ ID NO: 7796760 - DNA, 22 bp, Homo sapiens
aatattctaataaatgcccatc

SEQ ID NO: 7796761 - DNA, 22 bp, Homo sapiens
aatattcatttgcagaagaagt

SEQ ID NO: 7796762 - DNA, 22 bp, Homo sapiens
acttgaaacatctttaaatgta

SEQ ID NO: 7796763 - DNA, 22 bp, Homo sapiens
acttgaaaccttggcaaacaat

SEQ ID NO: 7796764 - DNA, 22 bp, Homo sapiens
acttcttttcaaatcatgcaaa

SEQ ID NO: 7796765 - DNA, 22 bp, Homo sapiens
aatgacctgggtgtcatttcat

SEQ ID NO: 7796766 - DNA, 22 bp, Homo sapiens
aatgagatggcaatgacttaaa

SEQ ID NO: 7796767 - DNA, 22 bp, Homo sapiens
aatgagatggaattcccgccta

SEQ ID NO: 7796768 - DNA, 22 bp, Homo sapiens
aatgagatcagagataactcaa

SEQ ID NO: 7796769 - DNA, 22 bp, Homo sapiens
aatgagatggaggactcttaat

SEQ ID NO: 7796770 - DNA, 22 bp, Homo sapiens
aatgagctgctgctgttccacc

SEQ ID NO: 7796771 - DNA, 22 bp, Homo sapiens
aatgagttagatgagaaaataa

SEQ ID NO: 7796772 - DNA, 22 bp, Homo sapiens
aatgagttagatgagaaaataa

SEQ ID NO: 7796773 - DNA, 22 bp, Homo sapiens
aatgagttattaggtgtaagtg

SEQ ID NO: 7796774 - DNA, 22 bp, Homo sapiens
aatgagttatttaatagaaagg

SEQ ID NO: 7796775 - DNA, 22 bp, Homo sapiens
aatgagttctgacacttcacga

SEQ ID NO: 7796776 - DNA, 22 bp, Homo sapiens
agaaaacagaaagtcattggtg

SEQ ID NO: 7796777 - DNA, 23 bp, Homo sapiens
aatgaactgagaatctgtacagt

SEQ ID NO: 7796778 - DNA, 22 bp, Homo sapiens
aataatagttgcaaagtgttta

SEQ ID NO: 7796779 - DNA, 22 bp, Homo sapiens
aataagattgacacaagtacct

SEQ ID NO: 7796780 - DNA, 22 bp, Homo sapiens
aataagattgacacaagtacct

SEQ ID NO: 7796781 - DNA, 22 bp, Homo sapiens
aataattagtgggacagagaac

SEQ ID NO: 7796782 - DNA, 22 bp, Homo sapiens
aataatgttgacgatagtctta

SEQ ID NO: 7796783 - DNA, 22 bp, Homo sapiens
aataatattcctctgtgtgcgt

SEQ ID NO: 7796784 - DNA, 22 bp, Homo sapiens
aataagatcctgaagatatgtt

SEQ ID NO: 7796785 - DNA, 22 bp, Homo sapiens
aataagaatttacttgtcaaga

SEQ ID NO: 7796786 - DNA, 22 bp, Homo sapiens
aagtttatgttggtaagatatc

SEQ ID NO: 7796787 - DNA, 22 bp, Homo sapiens
aagtttatgttggtaagatatc

SEQ ID NO: 7796788 - DNA, 22 bp, Homo sapiens
aagtttcaagaggttctttgaa

SEQ ID NO: 7796789 - DNA, 22 bp, Homo sapiens
aagtttaacttgaattctttct

SEQ ID NO: 7796790 - DNA, 22 bp, Homo sapiens
actaacttgctgagtgaccatg

SEQ ID NO: 7796791 - DNA, 22 bp, Homo sapiens
aagttacattttggtctaattg

SEQ ID NO: 7796792 - DNA, 22 bp, Homo sapiens
actccaggttttttcactgaag

SEQ ID NO: 7796793 - DNA, 22 bp, Homo sapiens
actccccagactgccatgctgg

SEQ ID NO: 7796794 - DNA, 22 bp, Homo sapiens
aagtcagagcaactgagacatt

SEQ ID NO: 7796795 - DNA, 22 bp, Homo sapiens
aagtcagataggtgagtccaaa

SEQ ID NO: 7796796 - DNA, 22 bp, Homo sapiens
aagtcactggcaaaagctgcag

SEQ ID NO: 7796797 - DNA, 22 bp, Homo sapiens
aaggcagaaagggatgtgagtg

SEQ ID NO: 7796798 - DNA, 22 bp, Homo sapiens
acagtactgagtactgagttgg

SEQ ID NO: 7796799 - DNA, 22 bp, Homo sapiens
acagtatacattgattaggacc

SEQ ID NO: 7796800 - DNA, 22 bp, Homo sapiens
acagttgagatgcaactttggg

SEQ ID NO: 7796801 - DNA, 22 bp, Homo sapiens
acagttctgcaagatatttttt

SEQ ID NO: 7796802 - DNA, 22 bp, Homo sapiens
acagttgacagggagagggtta

SEQ ID NO: 7796803 - DNA, 22 bp, Homo sapiens
aaggcaggatgcggacccatct

SEQ ID NO: 7796804 - DNA, 22 bp, Homo sapiens
aaggcaggagctgtatcttatt

SEQ ID NO: 7796805 - DNA, 22 bp, Homo sapiens
aaggcagtcagttgttttgaaa

SEQ ID NO: 7796806 - DNA, 22 bp, Homo sapiens
acaggcaggtcctgtcccagct

SEQ ID NO: 7796807 - DNA, 22 bp, Homo sapiens
acaggcaggtcctgtcccagct

SEQ ID NO: 7796808 - DNA, 22 bp, Homo sapiens
acaggcaggttgagaaacattt

SEQ ID NO: 7796809 - DNA, 22 bp, Homo sapiens
acaggcagtgatttcctctggt

SEQ ID NO: 7796810 - DNA, 22 bp, Homo sapiens
acaggcagtgatttcctctggt

SEQ ID NO: 7796811 - DNA, 22 bp, Homo sapiens
acaggcatatttctagattaca

SEQ ID NO: 7796812 - DNA, 22 bp, Homo sapiens
aagctttaagtgtcagtcagcc

SEQ ID NO: 7796813 - DNA, 22 bp, Homo sapiens
aagctttaaggaattttatgga

SEQ ID NO: 7796814 - DNA, 22 bp, Homo sapiens
aaggaaagattctctctctaga

SEQ ID NO: 7796815 - DNA, 22 bp, Homo sapiens
accccccagataatcccttgag

SEQ ID NO: 7796816 - DNA, 22 bp, Homo sapiens
aaggtgaactggtaatgacaga

SEQ ID NO: 7796817 - DNA, 22 bp, Homo sapiens
aaggtgctcgttatggccagtg

SEQ ID NO: 7796818 - DNA, 22 bp, Homo sapiens
aaggtgctcacgggctcaggga

SEQ ID NO: 7796819 - DNA, 22 bp, Homo sapiens
aagggaccctggatcaaatgga

SEQ ID NO: 7796820 - DNA, 22 bp, Homo sapiens
aagggctcacccaactcacttc

SEQ ID NO: 7796821 - DNA, 22 bp, Homo sapiens
aagggctctgtgcttgtcccat

SEQ ID NO: 7796822 - DNA, 22 bp, Homo sapiens
aagggctctgggctacgcactg

SEQ ID NO: 7796823 - DNA, 22 bp, Homo sapiens
aagggctctgtgtgcctcccca

SEQ ID NO: 7796824 - DNA, 22 bp, Homo sapiens
aagggctctgttgccatttcag

SEQ ID NO: 7796825 - DNA, 22 bp, Homo sapiens
aagggctcttctatttatggcc

SEQ ID NO: 7796826 - DNA, 22 bp, Homo sapiens
aagggctccacttgaatcacac

SEQ ID NO: 7796827 - DNA, 22 bp, Homo sapiens
aagggctccaagaggtagctgg

SEQ ID NO: 7796828 - DNA, 22 bp, Homo sapiens
aagggctccatccttataaatg

SEQ ID NO: 7796829 - DNA, 22 bp, Homo sapiens
aagggctccctgcctgaggtgg

SEQ ID NO: 7796830 - DNA, 22 bp, Homo sapiens
aagggctcccaactcatctttt

SEQ ID NO: 7796831 - DNA, 22 bp, Homo sapiens
aagggctctctgcattgaaatt

SEQ ID NO: 7796832 - DNA, 22 bp, Homo sapiens
aagggctctgctgtctctcccc

SEQ ID NO: 7796833 - DNA, 22 bp, Homo sapiens
aagggctcggtagcagtcctga

SEQ ID NO: 7796834 - DNA, 22 bp, Homo sapiens
acatgtgtggccgctgtagaca

SEQ ID NO: 7796835 - DNA, 22 bp, Homo sapiens
acatgtgtacttttaaggatgt

SEQ ID NO: 7796836 - DNA, 22 bp, Homo sapiens
acagaacaagacctgcttattg

SEQ ID NO: 7796837 - DNA, 22 bp, Homo sapiens
acagaaagataggcacaaggtc

SEQ ID NO: 7796838 - DNA, 22 bp, Homo sapiens
agcagtgttttagccatttctg

SEQ ID NO: 7796839 - DNA, 22 bp, Homo sapiens
agcagtgtgcttcgtttcatga

SEQ ID NO: 7796840 - DNA, 18 bp, Homo sapiens
agcagtgtgacctgaaga

SEQ ID NO: 7796841 - DNA, 23 bp, Homo sapiens
acactgtctcatggatagactgc

SEQ ID NO: 7796842 - DNA, 22 bp, Homo sapiens
acactgtctcatatgaggggac

SEQ ID NO: 7796843 - DNA, 22 bp, Homo sapiens
acactgtctgggactcaggagt

SEQ ID NO: 7796844 - DNA, 22 bp, Homo sapiens
acacattttcaacactgtcaag

SEQ ID NO: 7796845 - DNA, 22 bp, Homo sapiens
acacattttcaacactgtcaag

SEQ ID NO: 7796846 - DNA, 19 bp, Homo sapiens
acacatttgcacaatccac

SEQ ID NO: 7796847 - DNA, 22 bp, Homo sapiens
acacatttgcataatacctcat

SEQ ID NO: 7796848 - DNA, 22 bp, Homo sapiens
acaatttctgatcagtgaattt

SEQ ID NO: 7796849 - DNA, 22 bp, Homo sapiens
acacaggaactctgagaggtgg

SEQ ID NO: 7796850 - DNA, 22 bp, Homo sapiens
agcaccatcgggttcttgcttt

SEQ ID NO: 7796851 - DNA, 22 bp, Homo sapiens
acacatatgtatgcatcatgtg

SEQ ID NO: 7796852 - DNA, 22 bp, Homo sapiens
acacatatgccattacagcaaa

SEQ ID NO: 7796853 - DNA, 22 bp, Homo sapiens
acacatatctaagatagatgac

SEQ ID NO: 7796854 - DNA, 22 bp, Homo sapiens
acacatatctaagatagatgac

SEQ ID NO: 7796855 - DNA, 22 bp, Homo sapiens
acacatatatttgcatatacac

SEQ ID NO: 7796856 - DNA, 23 bp, Homo sapiens
acacatatattcagatacagatg

SEQ ID NO: 7796857 - DNA, 22 bp, Homo sapiens
agccatgcaccttactcttgct

SEQ ID NO: 7796858 - DNA, 22 bp, Homo sapiens
agccatgctcagttcctggagc

SEQ ID NO: 7796859 - DNA, 22 bp, Homo sapiens
agccatcctcccacctcagcct

SEQ ID NO: 7796860 - DNA, 22 bp, Homo sapiens
acagagagggagtgataaatcc

SEQ ID NO: 7796861 - DNA, 22 bp, Homo sapiens
acagagaggtaaaatatatagt

SEQ ID NO: 7796862 - DNA, 22 bp, Homo sapiens
acagagcagtaagaacacagct

SEQ ID NO: 7796863 - DNA, 22 bp, Homo sapiens
acagagcatataaagtgctttg

SEQ ID NO: 7796864 - DNA, 22 bp, Homo sapiens
acagagcatgctcagtgtgtga

SEQ ID NO: 7796865 - DNA, 21 bp, Homo sapiens
acagagcataatggtgtggca

SEQ ID NO: 7796866 - DNA, 22 bp, Homo sapiens
acagagtcctagctgcaaagaa

SEQ ID NO: 7796867 - DNA, 22 bp, Homo sapiens
agctcctgtgtgcccacctgct

SEQ ID NO: 7796868 - DNA, 22 bp, Homo sapiens
agctcctgttctgagagcagga

SEQ ID NO: 7796869 - DNA, 19 bp, Homo sapiens
agctcctgttcagcagctc

SEQ ID NO: 7796870 - DNA, 22 bp, Homo sapiens
agctaggggaccaaggtggccc

SEQ ID NO: 7796871 - DNA, 22 bp, Homo sapiens
agcctgcgatcccacctggcct

SEQ ID NO: 7796872 - DNA, 21 bp, Homo sapiens
agcctgcaatgtaggtaccgg

SEQ ID NO: 7796873 - DNA, 17 bp, Homo sapiens
agcctgccccatgctgc

SEQ ID NO: 7796874 - DNA, 22 bp, Homo sapiens
acaaacagagttgaaaaatagg

SEQ ID NO: 7796875 - DNA, 22 bp, Homo sapiens
acaaaattgtgttaaactttat

SEQ ID NO: 7796876 - DNA, 20 bp, Homo sapiens
acaaaataggtactgggtag

SEQ ID NO: 7796877 - DNA, 22 bp, Homo sapiens
aattttcacagtgctgtgagat

SEQ ID NO: 7796878 - DNA, 22 bp, Homo sapiens
aatttgttaaaagtgagtgaca

SEQ ID NO: 7796879 - DNA, 22 bp, Homo sapiens
agcaagcagaaatgccatggca

SEQ ID NO: 7796880 - DNA, 22 bp, Homo sapiens
agcaagcagaattctgtcctct

SEQ ID NO: 7796881 - DNA, 22 bp, Homo sapiens
acaatgcttggtttttctagaa

SEQ ID NO: 7796882 - DNA, 22 bp, Homo sapiens
acaattctgatggtttcccagt

SEQ ID NO: 7796883 - DNA, 22 bp, Homo sapiens
acaattctctcatatcttatta

SEQ ID NO: 7796884 - DNA, 22 bp, Homo sapiens
acaattcctgagaatacttgtt

SEQ ID NO: 7796885 - DNA, 22 bp, Homo sapiens
acaattctctcatatcttatta

SEQ ID NO: 7796886 - DNA, 22 bp, Homo sapiens
acaagctttgtgatagtagaga

SEQ ID NO: 7796887 - DNA, 22 bp, Homo sapiens
acaaattatagaaaattgagct

SEQ ID NO: 7796888 - DNA, 22 bp, Homo sapiens
acaaatgtggacatggataatg

SEQ ID NO: 7796889 - DNA, 22 bp, Homo sapiens
acaagtgtgtgcagtttgtaaa

SEQ ID NO: 7796890 - DNA, 22 bp, Homo sapiens
acaagtctttttcatgtcttct

SEQ ID NO: 7796891 - DNA, 22 bp, Homo sapiens
acaagtaccaaatgctcaagta

SEQ ID NO: 7796892 - DNA, 22 bp, Homo sapiens
acaagtttcattgtttagaacc

SEQ ID NO: 7796893 - DNA, 19 bp, Homo sapiens
aatgtttaagagaaaaagg

SEQ ID NO: 7796894 - DNA, 22 bp, Homo sapiens
aattagggaagtatttagtagt

SEQ ID NO: 7796895 - DNA, 22 bp, Homo sapiens
aattagggaaaatttacttgta

SEQ ID NO: 7796896 - DNA, 22 bp, Homo sapiens
aattagggaaaacatttgcttt

SEQ ID NO: 7796897 - DNA, 19 bp, Homo sapiens
aattagggagtcggttaag

SEQ ID NO: 7796898 - DNA, 22 bp, Homo sapiens
aattaggggaggacgtatcata

SEQ ID NO: 7796899 - DNA, 22 bp, Homo sapiens
aattagggaggacaaaggtaca

SEQ ID NO: 7796900 - DNA, 22 bp, Homo sapiens
aattagggagaggtagctaggt

SEQ ID NO: 7796901 - DNA, 22 bp, Homo sapiens
aattagggagccatcataaggt

SEQ ID NO: 7796902 - DNA, 21 bp, Homo sapiens
aattagggtgcctcttataat

SEQ ID NO: 7796903 - DNA, 22 bp, Homo sapiens
aatgttatttctgcatagtagt

SEQ ID NO: 7796904 - DNA, 22 bp, Homo sapiens
aatgttcagaggacaatataaa

SEQ ID NO: 7796905 - DNA, 22 bp, Homo sapiens
aattatctgtaaatggcaattt

SEQ ID NO: 7796906 - DNA, 22 bp, Homo sapiens
aattatcagatataaaactgca

SEQ ID NO: 7796907 - DNA, 22 bp, Homo sapiens
aatttacacttcatttggaggg

SEQ ID NO: 7796908 - DNA, 22 bp, Homo sapiens
aatgtattctctttataagata

SEQ ID NO: 7796909 - DNA, 22 bp, Homo sapiens
aatgtcagtgttactgctattg

SEQ ID NO: 7796910 - DNA, 22 bp, Homo sapiens
aatgtcctaggcatgattttgt

SEQ ID NO: 7796911 - DNA, 22 bp, Homo sapiens
aatgtgttagtattgatttgtc

SEQ ID NO: 7796912 - DNA, 22 bp, Homo sapiens
aatgtcttcagtgtatacatgg

SEQ ID NO: 7796913 - DNA, 22 bp, Homo sapiens
aatgtctcaccgtaaatgtaac

SEQ ID NO: 7796914 - DNA, 21 bp, Homo sapiens
agacagagtgcagtctacata

SEQ ID NO: 7796915 - DNA, 23 bp, Homo sapiens
agacagaggctgaggctggccgc

SEQ ID NO: 7796916 - DNA, 22 bp, Homo sapiens
agacagagatactatgttgtca

SEQ ID NO: 7796917 - DNA, 22 bp, Homo sapiens
tagggctgtttaaaagtgaggt

SEQ ID NO: 7796918 - DNA, 22 bp, Homo sapiens
tagggctgtggtcagtcctcta

SEQ ID NO: 7796919 - DNA, 22 bp, Homo sapiens
tagggctgttagtaattctcag

SEQ ID NO: 7796920 - DNA, 22 bp, Homo sapiens
tagggctgtgtctccaggacca

SEQ ID NO: 7796921 - DNA, 22 bp, Homo sapiens
tagggctggcgtgctcagggaa

SEQ ID NO: 7796922 - DNA, 16 bp, Homo sapiens
tagggctgggaaggag

SEQ ID NO: 7796923 - DNA, 22 bp, Homo sapiens
tagggctgggtacactcttgcc

SEQ ID NO: 7796924 - DNA, 22 bp, Homo sapiens
tagggctgcagaacaatggcct

SEQ ID NO: 7796925 - DNA, 22 bp, Homo sapiens
tagggctgccatttgcttttct

SEQ ID NO: 7796926 - DNA, 22 bp, Homo sapiens
tagggctgcctatggctagata

SEQ ID NO: 7796927 - DNA, 19 bp, Homo sapiens
tagggctggccgggcggtg

SEQ ID NO: 7796928 - DNA, 22 bp, Homo sapiens
tagggctgctttgtattctgct

SEQ ID NO: 7796929 - DNA, 22 bp, Homo sapiens
tagggctgctgcagatgacagg

SEQ ID NO: 7796930 - DNA, 21 bp, Homo sapiens
tagggctctatttttatttca

SEQ ID NO: 7796931 - DNA, 21 bp, Homo sapiens
tagggctctctgtgtcaggtg

SEQ ID NO: 7796932 - DNA, 22 bp, Homo sapiens
tagggctctgagagttcagcct

SEQ ID NO: 7796933 - DNA, 22 bp, Homo sapiens
tagggctctgctcatcagttgt

SEQ ID NO: 7796934 - DNA, 22 bp, Homo sapiens
tagggctctggtgggctctgtt

SEQ ID NO: 7796935 - DNA, 22 bp, Homo sapiens
tagggctgaggcaacaagggag

SEQ ID NO: 7796936 - DNA, 22 bp, Homo sapiens
taggcaggctgaatgtagattt

SEQ ID NO: 7796937 - DNA, 22 bp, Homo sapiens
tagctgtccagtgagtcccttt

SEQ ID NO: 7796938 - DNA, 22 bp, Homo sapiens
tagttatgtctgcatgcatatt

SEQ ID NO: 7796939 - DNA, 22 bp, Homo sapiens
tagttcaggaagagaaacaaca

SEQ ID NO: 7796940 - DNA, 22 bp, Homo sapiens
tagttaggaatagcagcgactc

SEQ ID NO: 7796941 - DNA, 22 bp, Homo sapiens
tagttaggaaagtccagggagc

SEQ ID NO: 7796942 - DNA, 22 bp, Homo sapiens
tagttagggttctgcagagaca

SEQ ID NO: 7796943 - DNA, 22 bp, Homo sapiens
tagtttaatggtcaactaatga

SEQ ID NO: 7796944 - DNA, 22 bp, Homo sapiens
tagtttctaaagcttcctaggt

SEQ ID NO: 7796945 - DNA, 22 bp, Homo sapiens
tagttttgattagtattgtctt

SEQ ID NO: 7796946 - DNA, 22 bp, Homo sapiens
tagtttcatatgcaaaatagta

SEQ ID NO: 7796947 - DNA, 22 bp, Homo sapiens
tagaagattcatttcctctgaa

SEQ ID NO: 7796948 - DNA, 22 bp, Homo sapiens
tagaagaaagtgaagctgggga

SEQ ID NO: 7796949 - DNA, 22 bp, Homo sapiens
tagatcaggctgcttagataga

SEQ ID NO: 7796950 - DNA, 20 bp, Homo sapiens
tagacttttcatcaacctta

SEQ ID NO: 7796951 - DNA, 22 bp, Homo sapiens
tagagaaaagcagggatcagga

SEQ ID NO: 7796952 - DNA, 22 bp, Homo sapiens
tagagaaacagaaccaacaggg

SEQ ID NO: 7796953 - DNA, 22 bp, Homo sapiens
tagagtccattaatgcaagttt

SEQ ID NO: 7796954 - DNA, 22 bp, Homo sapiens
tagagtcagagaatcattacag

SEQ ID NO: 7796955 - DNA, 22 bp, Homo sapiens
tagagtaacacaaacgaattgg

SEQ ID NO: 7796956 - DNA, 22 bp, Homo sapiens
tagatgaaggggttcagcatgg

SEQ ID NO: 7796957 - DNA, 22 bp, Homo sapiens
tagcaaagaacctgatacccca

SEQ ID NO: 7796958 - DNA, 22 bp, Homo sapiens
tagcaaactcatacatgtgggt

SEQ ID NO: 7796959 - DNA, 22 bp, Homo sapiens
tagcaaagaagatattattgca

SEQ ID NO: 7796960 - DNA, 18 bp, Homo sapiens
tagcaaagatgtggattg

SEQ ID NO: 7796961 - DNA, 22 bp, Homo sapiens
tagcaaaggccttggacacgct

SEQ ID NO: 7796962 - DNA, 22 bp, Homo sapiens
tagcaaagttttgtggtgatta

SEQ ID NO: 7796963 - DNA, 23 bp, Homo sapiens
tagcaaagttgtttgggaaattt

SEQ ID NO: 7796964 - DNA, 22 bp, Homo sapiens
tagcagggagggccagtgtcaa

SEQ ID NO: 7796965 - DNA, 22 bp, Homo sapiens
tagcagggatacaaggtcgcct

SEQ ID NO: 7796966 - DNA, 22 bp, Homo sapiens
tagcagggtccaatgtgaggca

SEQ ID NO: 7796967 - DNA, 22 bp, Homo sapiens
tatttggaaaggacatgtaagt

SEQ ID NO: 7796968 - DNA, 22 bp, Homo sapiens
tatttggacaccaagtagaagt

SEQ ID NO: 7796969 - DNA, 22 bp, Homo sapiens
tatttgcaacataaaactctga

SEQ ID NO: 7796970 - DNA, 22 bp, Homo sapiens
tatttcttgttattctcgttga

SEQ ID NO: 7796971 - DNA, 22 bp, Homo sapiens
tattgtcagtgcctgcctcata

SEQ ID NO: 7796972 - DNA, 23 bp, Homo sapiens
tattacaattggtcttattaaga

SEQ ID NO: 7796973 - DNA, 22 bp, Homo sapiens
tatttaagatgtgtcataaaga

SEQ ID NO: 7796974 - DNA, 22 bp, Homo sapiens
tatttaactggaaacacaatga

SEQ ID NO: 7796975 - DNA, 22 bp, Homo sapiens
tatttaaaaagaggccagctgg

SEQ ID NO: 7796976 - DNA, 22 bp, Homo sapiens
tattgtttctggctgtggcagc

SEQ ID NO: 7796977 - DNA, 17 bp, Homo sapiens
tcaaagaatgcatgcag

SEQ ID NO: 7796978 - DNA, 20 bp, Homo sapiens
tcaaagcaaagggagatgat

SEQ ID NO: 7796979 - DNA, 22 bp, Homo sapiens
tcaaagagctattcagttgtgg

SEQ ID NO: 7796980 - DNA, 22 bp, Homo sapiens
tattttgcgttgagtcagattt

SEQ ID NO: 7796981 - DNA, 20 bp, Homo sapiens
tattttgcaattatggttca

SEQ ID NO: 7796982 - DNA, 22 bp, Homo sapiens
tattttgtaattggtcatagct

SEQ ID NO: 7796983 - DNA, 22 bp, Homo sapiens
tattttgcaaacctgagtttga

SEQ ID NO: 7796984 - DNA, 22 bp, Homo sapiens
tatttttgcctctcagataaaa

SEQ ID NO: 7796985 - DNA, 22 bp, Homo sapiens
tcaaaaataagatattctggac

SEQ ID NO: 7796986 - DNA, 22 bp, Homo sapiens
tcaaagtaagaatttattacaa

SEQ ID NO: 7796987 - DNA, 22 bp, Homo sapiens
tcaaagtataattgcttttttg

SEQ ID NO: 7796988 - DNA, 22 bp, Homo sapiens
tcaaataatgccattcatcatc

SEQ ID NO: 7796989 - DNA, 22 bp, Homo sapiens
tcaaataatgccattcatcatc

SEQ ID NO: 7796990 - DNA, 22 bp, Homo sapiens
tatgtagcaatagcatcatact

SEQ ID NO: 7796991 - DNA, 22 bp, Homo sapiens
tatgtaggtaaacacagacata

SEQ ID NO: 7796992 - DNA, 22 bp, Homo sapiens
tatgtatccgtgtgtgtacaga

SEQ ID NO: 7796993 - DNA, 22 bp, Homo sapiens
tatgtattctcagatttactaa

SEQ ID NO: 7796994 - DNA, 22 bp, Homo sapiens
tattaacacgtataaagtgttt

SEQ ID NO: 7796995 - DNA, 22 bp, Homo sapiens
tattaacattttatgaaaataa

SEQ ID NO: 7796996 - DNA, 21 bp, Homo sapiens
tattaatatgtctaagctgat

SEQ ID NO: 7796997 - DNA, 22 bp, Homo sapiens
tattaataagtgactactagct

SEQ ID NO: 7796998 - DNA, 22 bp, Homo sapiens
tatggcttcttttgcaactact

SEQ ID NO: 7796999 - DNA, 22 bp, Homo sapiens
tatggcttctgggccaaattta

SEQ ID NO: 7797000 - DNA, 22 bp, Homo sapiens
tatgtacaagcacacatgtgac

SEQ ID NO: 7797001 - DNA, 22 bp, Homo sapiens
tatgaaatgatggggaaaatag

SEQ ID NO: 7797002 - DNA, 22 bp, Homo sapiens
tatgaaattgccatttttatgg

SEQ ID NO: 7797003 - DNA, 22 bp, Homo sapiens
tatgaaatggtagtaggaaggg

SEQ ID NO: 7797004 - DNA, 22 bp, Homo sapiens
tatgaacacactttggaagtga

SEQ ID NO: 7797005 - DNA, 22 bp, Homo sapiens
tatgaaggatacacctctgatt

SEQ ID NO: 7797006 - DNA, 22 bp, Homo sapiens
tatcttttgagttctcaagatg

SEQ ID NO: 7797007 - DNA, 22 bp, Homo sapiens
tatgaaaatttagctgaagcat

SEQ ID NO: 7797008 - DNA, 22 bp, Homo sapiens
tatccaaaggaacaatcacagc

SEQ ID NO: 7797009 - DNA, 22 bp, Homo sapiens
tataaagagtctcaaagaagtt

SEQ ID NO: 7797010 - DNA, 22 bp, Homo sapiens
tataaagaaggcacagcaagac

SEQ ID NO: 7797011 - DNA, 22 bp, Homo sapiens
tataaagaaatgatttccagaa

SEQ ID NO: 7797012 - DNA, 22 bp, Homo sapiens
tatcacaggtgtgatttacatt

SEQ ID NO: 7797013 - DNA, 22 bp, Homo sapiens
tatcagatttagaggagtcata

SEQ ID NO: 7797014 - DNA, 22 bp, Homo sapiens
tatcagcaactcagagcagtct

SEQ ID NO: 7797015 - DNA, 22 bp, Homo sapiens
tactgtgtgcccagccgagctg

SEQ ID NO: 7797016 - DNA, 22 bp, Homo sapiens
tacttacagaaggaagcaattg

SEQ ID NO: 7797017 - DNA, 22 bp, Homo sapiens
tactagaagctgtaatttttca

SEQ ID NO: 7797018 - DNA, 22 bp, Homo sapiens
tactagttctcatatgaaataa

SEQ ID NO: 7797019 - DNA, 22 bp, Homo sapiens
tactagtttttaggaaaagtga

SEQ ID NO: 7797020 - DNA, 22 bp, Homo sapiens
tacatgcatgatacaaagttgc

SEQ ID NO: 7797021 - DNA, 18 bp, Homo sapiens
tacatgcataaatgaagc

SEQ ID NO: 7797022 - DNA, 22 bp, Homo sapiens
tacatgagggcactctgcatct

SEQ ID NO: 7797023 - DNA, 22 bp, Homo sapiens
tacagtgtttcccccaggatag

SEQ ID NO: 7797024 - DNA, 22 bp, Homo sapiens
tacatgcatgtgtgtaaatata

SEQ ID NO: 7797025 - DNA, 22 bp, Homo sapiens
tacagtctctttgagtgattgt

SEQ ID NO: 7797026 - DNA, 22 bp, Homo sapiens
tacagtgctttttggtggagaa

SEQ ID NO: 7797027 - DNA, 22 bp, Homo sapiens
tacagtgcttggtatctagtaa

SEQ ID NO: 7797028 - DNA, 22 bp, Homo sapiens
tacagtgcacatttcttaggaa

SEQ ID NO: 7797029 - DNA, 22 bp, Homo sapiens
tacagtgcaatgtgatgtagat

SEQ ID NO: 7797030 - DNA, 22 bp, Homo sapiens
tacagtgcatagaggcatgata

SEQ ID NO: 7797031 - DNA, 22 bp, Homo sapiens
tacagtgcgatttttaggcctc

SEQ ID NO: 7797032 - DNA, 22 bp, Homo sapiens
tacagtgcgggtgcgggcctct

SEQ ID NO: 7797033 - DNA, 22 bp, Homo sapiens
tacagtgctagaacctgctgta

SEQ ID NO: 7797034 - DNA, 22 bp, Homo sapiens
tacagagatgtgaaaagctcta

SEQ ID NO: 7797035 - DNA, 22 bp, Homo sapiens
taattattctagtcacatagca

SEQ ID NO: 7797036 - DNA, 22 bp, Homo sapiens
taatgaacaatatatcaatagc

SEQ ID NO: 7797037 - DNA, 22 bp, Homo sapiens
taatcttagacatgtatttttc

SEQ ID NO: 7797038 - DNA, 22 bp, Homo sapiens
taatttatgatgcaaagaaaag

SEQ ID NO: 7797039 - DNA, 22 bp, Homo sapiens
taattcctagaaattattctca

SEQ ID NO: 7797040 - DNA, 22 bp, Homo sapiens
taattcttcaggccttttgtct

SEQ ID NO: 7797041 - DNA, 22 bp, Homo sapiens
taagcctgcatgaaccatgaga

SEQ ID NO: 7797042 - DNA, 22 bp, Homo sapiens
taatagttgtgactttgtaaag

SEQ ID NO: 7797043 - DNA, 22 bp, Homo sapiens
taatttcaagtttagggctcta

SEQ ID NO: 7797044 - DNA, 22 bp, Homo sapiens
tacaagctcacaaatttttaag

SEQ ID NO: 7797045 - DNA, 22 bp, Homo sapiens
tacacaatgacttaagatgtca

SEQ ID NO: 7797046 - DNA, 22 bp, Homo sapiens
tacagaatgttatgaagcatag

SEQ ID NO: 7797047 - DNA, 22 bp, Homo sapiens
tacacagtgagtcctctctgcc

SEQ ID NO: 7797048 - DNA, 22 bp, Homo sapiens
tacacagtatatgggatcacag

SEQ ID NO: 7797049 - DNA, 22 bp, Homo sapiens
tacacagtagagtataatgcgt

SEQ ID NO: 7797050 - DNA, 22 bp, Homo sapiens
tacacagtaaatggtaaataca

SEQ ID NO: 7797051 - DNA, 22 bp, Homo sapiens
gttataaatgactgcaaaagtt

SEQ ID NO: 7797052 - DNA, 21 bp, Homo sapiens
gttattggttacactgcactt

SEQ ID NO: 7797053 - DNA, 20 bp, Homo sapiens
gttattggtcatttttgcca

SEQ ID NO: 7797054 - DNA, 22 bp, Homo sapiens
gttattgggtgcctcaggccct

SEQ ID NO: 7797055 - DNA, 22 bp, Homo sapiens
gttattggcagcatttcagagt

SEQ ID NO: 7797056 - DNA, 20 bp, Homo sapiens
gttattggaaatattgtgtg

SEQ ID NO: 7797057 - DNA, 22 bp, Homo sapiens
gttattggaaagcctggagggc

SEQ ID NO: 7797058 - DNA, 22 bp, Homo sapiens
gttcttcagttcaggctgttca

SEQ ID NO: 7797059 - DNA, 22 bp, Homo sapiens
gtgttctgggatgattgtagtg

SEQ ID NO: 7797060 - DNA, 22 bp, Homo sapiens
gtgttcattgctagtgaggtgt

SEQ ID NO: 7797061 - DNA, 22 bp, Homo sapiens
gtttgttagaagagcagaatct

SEQ ID NO: 7797062 - DNA, 22 bp, Homo sapiens
gtttgtgtcaatgacttctgca

SEQ ID NO: 7797063 - DNA, 22 bp, Homo sapiens
gtttctttctattgactgaaca

SEQ ID NO: 7797064 - DNA, 22 bp, Homo sapiens
gtttcttttaaaatatgtagac

SEQ ID NO: 7797065 - DNA, 22 bp, Homo sapiens
gtttcttttgtgatcaccaacc

SEQ ID NO: 7797066 - DNA, 22 bp, Homo sapiens
gtttcaaataggtttcagcaaa

SEQ ID NO: 7797067 - DNA, 22 bp, Homo sapiens
gttctttaagtggagaaggaaa

SEQ ID NO: 7797068 - DNA, 19 bp, Homo sapiens
gttctttcatagtaagagc

SEQ ID NO: 7797069 - DNA, 22 bp, Homo sapiens
gttctttaggggcccaatttcc

SEQ ID NO: 7797070 - DNA, 22 bp, Homo sapiens
gttctttaaactgctgctctgt

SEQ ID NO: 7797071 - DNA, 22 bp, Homo sapiens
gttctttaacctagtctcattt

SEQ ID NO: 7797072 - DNA, 22 bp, Homo sapiens
gtttattagagttttctgtctg

SEQ ID NO: 7797073 - DNA, 22 bp, Homo sapiens
gtttattaactgtcaagtgatt

SEQ ID NO: 7797074 - DNA, 22 bp, Homo sapiens
gtttattaactgtcaagtgatt

SEQ ID NO: 7797075 - DNA, 22 bp, Homo sapiens
gtttattatacaacaaaagcta

SEQ ID NO: 7797076 - DNA, 21 bp, Homo sapiens
taagcatatcagatagactct

SEQ ID NO: 7797077 - DNA, 22 bp, Homo sapiens
taagagaactggatagatagga

SEQ ID NO: 7797078 - DNA, 22 bp, Homo sapiens
taagagaactggatagatagga

SEQ ID NO: 7797079 - DNA, 22 bp, Homo sapiens
taagacttccaggaaaaggtgg

SEQ ID NO: 7797080 - DNA, 20 bp, Homo sapiens
taacagtaagtgatgttaca

SEQ ID NO: 7797081 - DNA, 22 bp, Homo sapiens
taacagtatagcctaacatttc

SEQ ID NO: 7797082 - DNA, 22 bp, Homo sapiens
taacagttggtgtaatttcttg

SEQ ID NO: 7797083 - DNA, 22 bp, Homo sapiens
taacagttggtgtaatttcttg

SEQ ID NO: 7797084 - DNA, 22 bp, Homo sapiens
taacagttttgagttttgcttc

SEQ ID NO: 7797085 - DNA, 22 bp, Homo sapiens
taaatgttatgcccatcatcca

SEQ ID NO: 7797086 - DNA, 22 bp, Homo sapiens
taaatgtttagtcttatttggg

SEQ ID NO: 7797087 - DNA, 21 bp, Homo sapiens
taaaagatgacaagacagctc

SEQ ID NO: 7797088 - DNA, 22 bp, Homo sapiens
taaaagagaatggataacagag

SEQ ID NO: 7797089 - DNA, 22 bp, Homo sapiens
taaaagatatcttagggatttg

SEQ ID NO: 7797090 - DNA, 22 bp, Homo sapiens
taaaagatcactggctgcttta

SEQ ID NO: 7797091 - DNA, 22 bp, Homo sapiens
gttttacaaatgacggcattca

SEQ ID NO: 7797092 - DNA, 20 bp, Homo sapiens
taaagacataagctactatc

SEQ ID NO: 7797093 - DNA, 22 bp, Homo sapiens
taaaagattttataggaacaag

SEQ ID NO: 7797094 - DNA, 22 bp, Homo sapiens
taaagataagacatcaactgag

SEQ ID NO: 7797095 - DNA, 22 bp, Homo sapiens
taaagcacatatcttacaataa

SEQ ID NO: 7797096 - DNA, 22 bp, Homo sapiens
taaagcacgtctatttaatgat

SEQ ID NO: 7797097 - DNA, 22 bp, Homo sapiens
taaagcagccagggtctaagcc

SEQ ID NO: 7797098 - DNA, 22 bp, Homo sapiens
tcagacagagaagtacaatgag

SEQ ID NO: 7797099 - DNA, 22 bp, Homo sapiens
tcagattctggatagatcttca

SEQ ID NO: 7797100 - DNA, 22 bp, Homo sapiens
tcacattttatctattttaagt

SEQ ID NO: 7797101 - DNA, 22 bp, Homo sapiens
tcacatttgcaattgcattgtt

SEQ ID NO: 7797102 - DNA, 22 bp, Homo sapiens
tcacatttgttcttgaatctaa

SEQ ID NO: 7797103 - DNA, 22 bp, Homo sapiens
tcagaaaataactgttagtttg

SEQ ID NO: 7797104 - DNA, 22 bp, Homo sapiens
tcactgctctgaaagtacaggg

SEQ ID NO: 7797105 - DNA, 22 bp, Homo sapiens
tcagaacagcacagggtgattt

SEQ ID NO: 7797106 - DNA, 22 bp, Homo sapiens
tcagaacagaagctggctataa

SEQ ID NO: 7797107 - DNA, 22 bp, Homo sapiens
tcagaacagcgagaatattcac

SEQ ID NO: 7797108 - DNA, 22 bp, Homo sapiens
tcacatttctttatgtagtctt

SEQ ID NO: 7797109 - DNA, 22 bp, Homo sapiens
tcacatttcacatgggaggagg

SEQ ID NO: 7797110 - DNA, 22 bp, Homo sapiens
tcacatttaaacaggaggatta

SEQ ID NO: 7797111 - DNA, 22 bp, Homo sapiens
tcacatttatttcaaagttact

SEQ ID NO: 7797112 - DNA, 22 bp, Homo sapiens
tcaacgtttgttaaatgagtat

SEQ ID NO: 7797113 - DNA, 22 bp, Homo sapiens
tcaacaatgggtctgtaatgga

SEQ ID NO: 7797114 - DNA, 22 bp, Homo sapiens
tcaacaataggatatagcaggt

SEQ ID NO: 7797115 - DNA, 22 bp, Homo sapiens
tcaaatgaggctgatgaatgtg

SEQ ID NO: 7797116 - DNA, 22 bp, Homo sapiens
tcaacaataggatatagcaggt

SEQ ID NO: 7797117 - DNA, 23 bp, Homo sapiens
tccaattcaattgggtcaggaag

SEQ ID NO: 7797118 - DNA, 22 bp, Homo sapiens
tccaaggctccggccctggcgt

SEQ ID NO: 7797119 - DNA, 22 bp, Homo sapiens
tccaaggctccggccctggcgt

SEQ ID NO: 7797120 - DNA, 22 bp, Homo sapiens
tccaaattctatgttctttcca

SEQ ID NO: 7797121 - DNA, 22 bp, Homo sapiens
tccaaatgagctctgccttcca

SEQ ID NO: 7797122 - DNA, 18 bp, Homo sapiens
tccaaagccagagaagtt

SEQ ID NO: 7797123 - DNA, 18 bp, Homo sapiens
tccaaaatcatgtatttt

SEQ ID NO: 7797124 - DNA, 18 bp, Homo sapiens
tccaaagctgctggtttt

SEQ ID NO: 7797125 - DNA, 22 bp, Homo sapiens
tcatttttagcgcgcaaaagtt

SEQ ID NO: 7797126 - DNA, 22 bp, Homo sapiens
tcatttttagcgcgcaaaagtt

SEQ ID NO: 7797127 - DNA, 21 bp, Homo sapiens
tcatttttattgctaccttgc

SEQ ID NO: 7797128 - DNA, 22 bp, Homo sapiens
tcatttgtgcaatgtagatgaa

SEQ ID NO: 7797129 - DNA, 22 bp, Homo sapiens
tcatttgtctggcacagggaat

SEQ ID NO: 7797130 - DNA, 22 bp, Homo sapiens
tcatttttctcttacacgtaga

SEQ ID NO: 7797131 - DNA, 22 bp, Homo sapiens
tcatttttttccggtaggaata

SEQ ID NO: 7797132 - DNA, 22 bp, Homo sapiens
tcatttttttccggtaggaata

SEQ ID NO: 7797133 - DNA, 22 bp, Homo sapiens
tcatttcagatgcatttagaat

SEQ ID NO: 7797134 - DNA, 22 bp, Homo sapiens
tcatttcatgtctcaggcactg

SEQ ID NO: 7797135 - DNA, 23 bp, Homo sapiens
tcatttcatccagccttgagagt

SEQ ID NO: 7797136 - DNA, 22 bp, Homo sapiens
tcatttctctgagtctgataat

SEQ ID NO: 7797137 - DNA, 22 bp, Homo sapiens
tcatttctgttgtgcatcactg

SEQ ID NO: 7797138 - DNA, 22 bp, Homo sapiens
tcatttctctgagtctgataat

SEQ ID NO: 7797139 - DNA, 22 bp, Homo sapiens
tcatttctcccggccaaaaact

SEQ ID NO: 7797140 - DNA, 22 bp, Homo sapiens
tcatttctccgacctgctgtcc

SEQ ID NO: 7797141 - DNA, 22 bp, Homo sapiens
tcattgtaattatctgtggtat

SEQ ID NO: 7797142 - DNA, 21 bp, Homo sapiens
tcatgcaggcagagtttggta

SEQ ID NO: 7797143 - DNA, 20 bp, Homo sapiens
tcatgcaggtgttctaggtt

SEQ ID NO: 7797144 - DNA, 22 bp, Homo sapiens
tcatgcagtttgaagttcaggg

SEQ ID NO: 7797145 - DNA, 22 bp, Homo sapiens
tcatgcagttactgttatgcaa

SEQ ID NO: 7797146 - DNA, 22 bp, Homo sapiens
tcatgcagtttcttatctgcca

SEQ ID NO: 7797147 - DNA, 22 bp, Homo sapiens
tcatctgtggctgcttttgtgc

SEQ ID NO: 7797148 - DNA, 22 bp, Homo sapiens
tcatctgttatgggagtttttg

SEQ ID NO: 7797149 - DNA, 22 bp, Homo sapiens
tcatctgaggcaccagagcata

SEQ ID NO: 7797150 - DNA, 22 bp, Homo sapiens
tcatgaaaatagatcagaaatt

SEQ ID NO: 7797151 - DNA, 22 bp, Homo sapiens
tcatgcagagccagtcaggata

SEQ ID NO: 7797152 - DNA, 22 bp, Homo sapiens
tcatgcagataagaataagtaa

SEQ ID NO: 7797153 - DNA, 22 bp, Homo sapiens
tcatagatgtgctgtgcacaaa

SEQ ID NO: 7797154 - DNA, 22 bp, Homo sapiens
tcataaattctggtgctgtgag

SEQ ID NO: 7797155 - DNA, 22 bp, Homo sapiens
tcagtgtttgtggcaaatgtta

SEQ ID NO: 7797156 - DNA, 22 bp, Homo sapiens
tcagttaacaactatttattga

SEQ ID NO: 7797157 - DNA, 23 bp, Homo sapiens
tcataaatattagcacagtagga

SEQ ID NO: 7797158 - DNA, 22 bp, Homo sapiens
tcagtgttggcattcagaaatg

SEQ ID NO: 7797159 - DNA, 19 bp, Homo sapiens
tcagtctaggaatgagcta

SEQ ID NO: 7797160 - DNA, 20 bp, Homo sapiens
tcaggctggtgggctttccc

SEQ ID NO: 7797161 - DNA, 22 bp, Homo sapiens
tcagtaatattctttaaaatac

SEQ ID NO: 7797162 - DNA, 22 bp, Homo sapiens
tcagtaaataactcagatgctc

SEQ ID NO: 7797163 - DNA, 22 bp, Homo sapiens
tcagtaaagttctttcttgctg

SEQ ID NO: 7797164 - DNA, 22 bp, Homo sapiens
tcagtaaatgaatgaatatatg

SEQ ID NO: 7797165 - DNA, 22 bp, Homo sapiens
tcctgaaatgtgcacatgacat

SEQ ID NO: 7797166 - DNA, 19 bp, Homo sapiens
tcctgaaaacttctggaat

SEQ ID NO: 7797167 - DNA, 22 bp, Homo sapiens
tcctgaagaacgaagtcatgta

SEQ ID NO: 7797168 - DNA, 22 bp, Homo sapiens
tcctgaagatgaaaagagaggt

SEQ ID NO: 7797169 - DNA, 22 bp, Homo sapiens
tcctgaaaaattacatgttcag

SEQ ID NO: 7797170 - DNA, 22 bp, Homo sapiens
tcctcaggtgactaggtatctt

SEQ ID NO: 7797171 - DNA, 22 bp, Homo sapiens
tcctgagcctgacaatcaccat

SEQ ID NO: 7797172 - DNA, 22 bp, Homo sapiens
tcctgagccctgtaggaccctg

SEQ ID NO: 7797173 - DNA, 22 bp, Homo sapiens
tcctgagccctgtaggaccctg

SEQ ID NO: 7797174 - DNA, 22 bp, Homo sapiens
tcctgagcacctatgccatggc

SEQ ID NO: 7797175 - DNA, 22 bp, Homo sapiens
tcctgagcacctatgccatggc

SEQ ID NO: 7797176 - DNA, 22 bp, Homo sapiens
tcctgagcacagagacaaggaa

SEQ ID NO: 7797177 - DNA, 22 bp, Homo sapiens
tcctgagcaacacagctaagtg

SEQ ID NO: 7797178 - DNA, 22 bp, Homo sapiens
tcctgagctacagtagtatgat

SEQ ID NO: 7797179 - DNA, 22 bp, Homo sapiens
tcctgagctgccgcatcagcag

SEQ ID NO: 7797180 - DNA, 22 bp, Homo sapiens
tcctgagcttcagtttcttcat

SEQ ID NO: 7797181 - DNA, 22 bp, Homo sapiens
tcctgagctgccgcatcagcag

SEQ ID NO: 7797182 - DNA, 22 bp, Homo sapiens
tcctgagctttacagtaaggac

SEQ ID NO: 7797183 - DNA, 22 bp, Homo sapiens
tcctgaggcacaatcctagaat

SEQ ID NO: 7797184 - DNA, 22 bp, Homo sapiens
tcctgaggctcactttgaatgt

SEQ ID NO: 7797185 - DNA, 22 bp, Homo sapiens
tcctgagtggttgttttcttcc

SEQ ID NO: 7797186 - DNA, 22 bp, Homo sapiens
tcctgcagctgaagctcatgtg

SEQ ID NO: 7797187 - DNA, 22 bp, Homo sapiens
tcctgcagccttgggctggagc

SEQ ID NO: 7797188 - DNA, 22 bp, Homo sapiens
tcctgcagctctgagaagcatc

SEQ ID NO: 7797189 - DNA, 22 bp, Homo sapiens
tcctgcagctgcagacctgggg

SEQ ID NO: 7797190 - DNA, 22 bp, Homo sapiens
tcctgcagctgataaatacagt

SEQ ID NO: 7797191 - DNA, 22 bp, Homo sapiens
tcctgcaggcctgttcccagta

SEQ ID NO: 7797192 - DNA, 21 bp, Homo sapiens
tcctgcaggaggcctgagagg

SEQ ID NO: 7797193 - DNA, 22 bp, Homo sapiens
tcctgcaggccagaggggtgag

SEQ ID NO: 7797194 - DNA, 18 bp, Homo sapiens
tcctgcagcttctatgta

SEQ ID NO: 7797195 - DNA, 21 bp, Homo sapiens
tcctgcagggcagcagagtgg

SEQ ID NO: 7797196 - DNA, 22 bp, Homo sapiens
tcctgcaggcttgagtcctcag

SEQ ID NO: 7797197 - DNA, 22 bp, Homo sapiens
tcctgcaggggctgaggaacca

SEQ ID NO: 7797198 - DNA, 19 bp, Homo sapiens
tcctgcaggtggcttgcag

SEQ ID NO: 7797199 - DNA, 22 bp, Homo sapiens
tcctgcaggtggatgattctct

SEQ ID NO: 7797200 - DNA, 20 bp, Homo sapiens
tcctgcagtcgctagcgccc

SEQ ID NO: 7797201 - DNA, 22 bp, Homo sapiens
tcctgcagtctgcactctgcct

SEQ ID NO: 7797202 - DNA, 22 bp, Homo sapiens
tcctgcagacctcagtcaggtc

SEQ ID NO: 7797203 - DNA, 22 bp, Homo sapiens
tcctgcagagacagaggcctca

SEQ ID NO: 7797204 - DNA, 19 bp, Homo sapiens
tcctgcagaccagacctgt

SEQ ID NO: 7797205 - DNA, 22 bp, Homo sapiens
tcctgcagacatttacaccttt

SEQ ID NO: 7797206 - DNA, 21 bp, Homo sapiens
tcctgcagaatgccttcctac

SEQ ID NO: 7797207 - DNA, 22 bp, Homo sapiens
tcctgatgatattgctctttct

SEQ ID NO: 7797208 - DNA, 22 bp, Homo sapiens
tcctgcagccactgcaggcaga

SEQ ID NO: 7797209 - DNA, 22 bp, Homo sapiens
tcctgcagccattagaggtcaa

SEQ ID NO: 7797210 - DNA, 22 bp, Homo sapiens
tcctgcagccactgcaggcaga

SEQ ID NO: 7797211 - DNA, 22 bp, Homo sapiens
tcctgcagccaagggtcatcga

SEQ ID NO: 7797212 - DNA, 22 bp, Homo sapiens
tcctgcagcatccgtcgtctgt

SEQ ID NO: 7797213 - DNA, 22 bp, Homo sapiens
tcctgcagagccgccctcaggt

SEQ ID NO: 7797214 - DNA, 22 bp, Homo sapiens
tcctgcagagtcccactgattt

SEQ ID NO: 7797215 - DNA, 22 bp, Homo sapiens
tcctgcagatcaaagcctttga

SEQ ID NO: 7797216 - DNA, 23 bp, Homo sapiens
tcctgcagataagctggttgaca

SEQ ID NO: 7797217 - DNA, 22 bp, Homo sapiens
tccaggctaattttgcattgtt

SEQ ID NO: 7797218 - DNA, 20 bp, Homo sapiens
tccaggccttgttctcagat

SEQ ID NO: 7797219 - DNA, 22 bp, Homo sapiens
tccaggctggctcttcaaaatt

SEQ ID NO: 7797220 - DNA, 22 bp, Homo sapiens
tccatggagatggatgactgta

SEQ ID NO: 7797221 - DNA, 23 bp, Homo sapiens
tccaggctgggacttcaactggc

SEQ ID NO: 7797222 - DNA, 22 bp, Homo sapiens
tccaggctttttcatgctgtct

SEQ ID NO: 7797223 - DNA, 22 bp, Homo sapiens
tcccaaagtattagcatttcaa

SEQ ID NO: 7797224 - DNA, 22 bp, Homo sapiens
tcccaggccataaaactcagag

SEQ ID NO: 7797225 - DNA, 22 bp, Homo sapiens
tcccagccttccagtctggttt

SEQ ID NO: 7797226 - DNA, 22 bp, Homo sapiens
tccctccccacttctgagcttt

SEQ ID NO: 7797227 - DNA, 19 bp, Homo sapiens
tccctcagtctgccaggcc

SEQ ID NO: 7797228 - DNA, 22 bp, Homo sapiens
tccctgagagcactggggagcc

SEQ ID NO: 7797229 - DNA, 20 bp, Homo sapiens
tccctccctccagctctggg

SEQ ID NO: 7797230 - DNA, 22 bp, Homo sapiens
tcccagggactctctgccttcc

SEQ ID NO: 7797231 - DNA, 22 bp, Homo sapiens
tcccagggactggatgatgcag

SEQ ID NO: 7797232 - DNA, 22 bp, Homo sapiens
tcccagggacccagcctgatac

SEQ ID NO: 7797233 - DNA, 22 bp, Homo sapiens
tcccaggctggcaggcagcagt

SEQ ID NO: 7797234 - DNA, 22 bp, Homo sapiens
tcccaggctaggcctctgcgtt

SEQ ID NO: 7797235 - DNA, 20 bp, Homo sapiens
tcccaggctccaccctagac

SEQ ID NO: 7797236 - DNA, 20 bp, Homo sapiens
tcccaggctgggctccagct

SEQ ID NO: 7797237 - DNA, 22 bp, Homo sapiens
tcccaggctgggggcctgaagt

SEQ ID NO: 7797238 - DNA, 22 bp, Homo sapiens
tcccagggacaccaagctgttt

SEQ ID NO: 7797239 - DNA, 23 bp, Homo sapiens
tcccagggaaggtgagcgaggct

SEQ ID NO: 7797240 - DNA, 23 bp, Homo sapiens
tccctggccgcaatggccgcctt

SEQ ID NO: 7797241 - DNA, 22 bp, Homo sapiens
tccctgcctcctggcagtgcca

SEQ ID NO: 7797242 - DNA, 22 bp, Homo sapiens
tccctggcacaagaaggctgtc

SEQ ID NO: 7797243 - DNA, 22 bp, Homo sapiens
tcctagagagtaatacagtttt

SEQ ID NO: 7797244 - DNA, 22 bp, Homo sapiens
tcctagaatctttgtaagattg

SEQ ID NO: 7797245 - DNA, 22 bp, Homo sapiens
tcctagttctctgccagtcgct

SEQ ID NO: 7797246 - DNA, 22 bp, Homo sapiens
tcctcagacttccctttgtgta

SEQ ID NO: 7797247 - DNA, 22 bp, Homo sapiens
tcctcagagcatagcgctgtct

SEQ ID NO: 7797248 - DNA, 19 bp, Homo sapiens
tcctcaggggctcacagac

SEQ ID NO: 7797249 - DNA, 22 bp, Homo sapiens
gtgaggagctgacactggggtg

SEQ ID NO: 7797250 - DNA, 22 bp, Homo sapiens
gtgaggagctctttgactcacg

SEQ ID NO: 7797251 - DNA, 22 bp, Homo sapiens
gtgaggagctgacactggggtg

SEQ ID NO: 7797252 - DNA, 22 bp, Homo sapiens
gtgaggagggctggtcccaggc

SEQ ID NO: 7797253 - DNA, 22 bp, Homo sapiens
gtgaggagtctgaagcacataa

SEQ ID NO: 7797254 - DNA, 22 bp, Homo sapiens
gtctttatttgagattgtcatt

SEQ ID NO: 7797255 - DNA, 16 bp, Homo sapiens
gtctttattcacttag

SEQ ID NO: 7797256 - DNA, 22 bp, Homo sapiens
gtctttctatgatgaactgttg

SEQ ID NO: 7797257 - DNA, 22 bp, Homo sapiens
gtctatgatattttgttatagc

SEQ ID NO: 7797258 - DNA, 22 bp, Homo sapiens
gtctacttttgtcatcattgca

SEQ ID NO: 7797259 - DNA, 22 bp, Homo sapiens
gtctagaatggatgagcatttt

SEQ ID NO: 7797260 - DNA, 22 bp, Homo sapiens
gtctagaattgcttggcagatg

SEQ ID NO: 7797261 - DNA, 23 bp, Homo sapiens
gtctttatagtggggcactttgt

SEQ ID NO: 7797262 - DNA, 22 bp, Homo sapiens
gtctttatctttgaaattagtc

SEQ ID NO: 7797263 - DNA, 22 bp, Homo sapiens
gtctttatatttactaaagaat

SEQ ID NO: 7797264 - DNA, 22 bp, Homo sapiens
gtctttatggtatgaaaactga

SEQ ID NO: 7797265 - DNA, 20 bp, Homo sapiens
gtctttatgttttatgacct

SEQ ID NO: 7797266 - DNA, 22 bp, Homo sapiens
gtctttattacaaatccttttc

SEQ ID NO: 7797267 - DNA, 22 bp, Homo sapiens
gtgcagggtagcgacggcagga

SEQ ID NO: 7797268 - DNA, 22 bp, Homo sapiens
gtgcaggggcctccccttgctg

SEQ ID NO: 7797269 - DNA, 22 bp, Homo sapiens
gtgcagggctggcaccggaggc

SEQ ID NO: 7797270 - DNA, 19 bp, Homo sapiens
gtgaggagtgtttacagaa

SEQ ID NO: 7797271 - DNA, 22 bp, Homo sapiens
gtgaggcaggcattctcctttc

SEQ ID NO: 7797272 - DNA, 22 bp, Homo sapiens
gtgaggcagaagttccctttta

SEQ ID NO: 7797273 - DNA, 22 bp, Homo sapiens
gtgaggcagcaggagcctctgt

SEQ ID NO: 7797274 - DNA, 22 bp, Homo sapiens
gtacaaaagttattgcggtttt

SEQ ID NO: 7797275 - DNA, 22 bp, Homo sapiens
gtacaataactagtcttatagt

SEQ ID NO: 7797276 - DNA, 22 bp, Homo sapiens
gtacaagttctactctataaat

SEQ ID NO: 7797277 - DNA, 22 bp, Homo sapiens
gtagggttggagagcacaacca

SEQ ID NO: 7797278 - DNA, 22 bp, Homo sapiens
gtatacagatacttagacgtgc

SEQ ID NO: 7797279 - DNA, 22 bp, Homo sapiens
gtatacagatacttagacgtgc

SEQ ID NO: 7797280 - DNA, 22 bp, Homo sapiens
gtattttcaagagcagtagtat

SEQ ID NO: 7797281 - DNA, 22 bp, Homo sapiens
gtattttcatgatttcagacca

SEQ ID NO: 7797282 - DNA, 22 bp, Homo sapiens
gtcaaaaagtagtcatttctgt

SEQ ID NO: 7797283 - DNA, 22 bp, Homo sapiens
gtcaaaacaaagttaagaattc

SEQ ID NO: 7797284 - DNA, 22 bp, Homo sapiens
gtcaaaaagtagtcatttctgt

SEQ ID NO: 7797285 - DNA, 22 bp, Homo sapiens
gtcaaaatgagctttgttattg

SEQ ID NO: 7797286 - DNA, 22 bp, Homo sapiens
gtcctggctgtcttatgttgaa

SEQ ID NO: 7797287 - DNA, 22 bp, Homo sapiens
gtcctggctgtgtttggtttct

SEQ ID NO: 7797288 - DNA, 22 bp, Homo sapiens
gtcctggcttagttcgctgtaa

SEQ ID NO: 7797289 - DNA, 22 bp, Homo sapiens
gtcctggcccactggcaggctg

SEQ ID NO: 7797290 - DNA, 22 bp, Homo sapiens
gtcctggcccactggcaggctg

SEQ ID NO: 7797291 - DNA, 22 bp, Homo sapiens
gtcctggcacctcactggctac

SEQ ID NO: 7797292 - DNA, 22 bp, Homo sapiens
gtcctggcacctcactggctac

SEQ ID NO: 7797293 - DNA, 22 bp, Homo sapiens
gtcctggcccaggagtacacat

SEQ ID NO: 7797294 - DNA, 22 bp, Homo sapiens
gtcctggcccaggagtacacat

SEQ ID NO: 7797295 - DNA, 22 bp, Homo sapiens
gtcctggcctctgggggtatgg

SEQ ID NO: 7797296 - DNA, 19 bp, Homo sapiens
gtcctggcgccgccacacc

SEQ ID NO: 7797297 - DNA, 19 bp, Homo sapiens
gtcctggcgccgccacacc

SEQ ID NO: 7797298 - DNA, 22 bp, Homo sapiens
gtcctggctggttctgtggggc

SEQ ID NO: 7797299 - DNA, 22 bp, Homo sapiens
gtcctggctggttctgtggggc

SEQ ID NO: 7797300 - DNA, 22 bp, Homo sapiens
gtcctggctagtcgtccgcgac

SEQ ID NO: 7797301 - DNA, 22 bp, Homo sapiens
gtcactgtatccaggttccagc

SEQ ID NO: 7797302 - DNA, 22 bp, Homo sapiens
gtcagaagcatttgtggctgaa

SEQ ID NO: 7797303 - DNA, 21 bp, Homo sapiens
gtccagagagccggctcctga

SEQ ID NO: 7797304 - DNA, 22 bp, Homo sapiens
gtccagaagctcaagttgaact

SEQ ID NO: 7797305 - DNA, 22 bp, Homo sapiens
gtccagaaggaggtcaagttgg

SEQ ID NO: 7797306 - DNA, 21 bp, Homo sapiens
ggggatgcgaccacaggctcc

SEQ ID NO: 7797307 - DNA, 22 bp, Homo sapiens
ggggaggagccatgtaactagt

SEQ ID NO: 7797308 - DNA, 22 bp, Homo sapiens
ggggaggaagctggaacacggg

SEQ ID NO: 7797309 - DNA, 22 bp, Homo sapiens
gggcttctattctggcacaaga

SEQ ID NO: 7797310 - DNA, 22 bp, Homo sapiens
gggcttctgctcttttggtgct

SEQ ID NO: 7797311 - DNA, 22 bp, Homo sapiens
ggggtggattcctacaggtcca

SEQ ID NO: 7797312 - DNA, 22 bp, Homo sapiens
gggtgctttggctcacgcctgt

SEQ ID NO: 7797313 - DNA, 22 bp, Homo sapiens
ggtttaatggagatatttcaga

SEQ ID NO: 7797314 - DNA, 22 bp, Homo sapiens
ggtcccatgactgacacagcag

SEQ ID NO: 7797315 - DNA, 22 bp, Homo sapiens
ggtccccccatggtgagcactg

SEQ ID NO: 7797316 - DNA, 22 bp, Homo sapiens
gggtgtccagggcgtgtctgga

SEQ ID NO: 7797317 - DNA, 22 bp, Homo sapiens
gggttgaggcggatgtcggcgg

SEQ ID NO: 7797318 - DNA, 19 bp, Homo sapiens
gggttgtgtggaaggtatc

SEQ ID NO: 7797319 - DNA, 22 bp, Homo sapiens
gggtttcatggttctcacaatg

SEQ ID NO: 7797320 - DNA, 22 bp, Homo sapiens
ggtgaggaattggggactgacc

SEQ ID NO: 7797321 - DNA, 22 bp, Homo sapiens
ggtgaggaaagatggtgacagt

SEQ ID NO: 7797322 - DNA, 22 bp, Homo sapiens
ggtgaggaaagatggtgacagt

SEQ ID NO: 7797323 - DNA, 23 bp, Homo sapiens
ggcactcggccgtgaactcgtgc

SEQ ID NO: 7797324 - DNA, 22 bp, Homo sapiens
ggcagcactgcagcttgttggg

SEQ ID NO: 7797325 - DNA, 22 bp, Homo sapiens
ggaggcaaagcactttgcttgg

SEQ ID NO: 7797326 - DNA, 22 bp, Homo sapiens
ggaggaggggtttacattggaa

SEQ ID NO: 7797327 - DNA, 22 bp, Homo sapiens
ggaggaggtgggttaagttgta

SEQ ID NO: 7797328 - DNA, 22 bp, Homo sapiens
ggcaggggtcctggtgttgact

SEQ ID NO: 7797329 - DNA, 18 bp, Homo sapiens
ggcagggaaaagataggg

SEQ ID NO: 7797330 - DNA, 22 bp, Homo sapiens
ggcagggaagctggcatcacgg

SEQ ID NO: 7797331 - DNA, 17 bp, Homo sapiens
ggcagtggaggaagaga

SEQ ID NO: 7797332 - DNA, 22 bp, Homo sapiens
ggcccagtgtaccccaggcagt

SEQ ID NO: 7797333 - DNA, 22 bp, Homo sapiens
ggcccagtgtcccggtcgtggc

SEQ ID NO: 7797334 - DNA, 22 bp, Homo sapiens
ggcccagtgtgggtggatgttg

SEQ ID NO: 7797335 - DNA, 20 bp, Homo sapiens
ggcccagtgaaccaggacgg

SEQ ID NO: 7797336 - DNA, 22 bp, Homo sapiens
ggcccagtctggggccctgtga

SEQ ID NO: 7797337 - DNA, 19 bp, Homo sapiens
ggccagccacctcgcctgg

SEQ ID NO: 7797338 - DNA, 22 bp, Homo sapiens
ggcagtggctgtagtctcttgg

SEQ ID NO: 7797339 - DNA, 17 bp, Homo sapiens
ggccacagagcttgggg

SEQ ID NO: 7797340 - DNA, 22 bp, Homo sapiens
ggctcacgcaattatcccggcc

SEQ ID NO: 7797341 - DNA, 22 bp, Homo sapiens
ggcctctctgagagcagacgtt

SEQ ID NO: 7797342 - DNA, 22 bp, Homo sapiens
ggctctctggaggagctcaccc

SEQ ID NO: 7797343 - DNA, 22 bp, Homo sapiens
ggctctgaacatggggaggagt

SEQ ID NO: 7797344 - DNA, 22 bp, Homo sapiens
ggctgccacgtcgagggtccaa

SEQ ID NO: 7797345 - DNA, 18 bp, Homo sapiens
gggctcacacaggtcatc

SEQ ID NO: 7797346 - DNA, 22 bp, Homo sapiens
gggccccttgctgctctgctgg

SEQ ID NO: 7797347 - DNA, 22 bp, Homo sapiens
gggccccttgtatctctggctc

SEQ ID NO: 7797348 - DNA, 22 bp, Homo sapiens
gggaggttgaggctgcagtgag

SEQ ID NO: 7797349 - DNA, 22 bp, Homo sapiens
gggaggttgaggctgcagtgag

SEQ ID NO: 7797350 - DNA, 22 bp, Homo sapiens
gggaggttgaggctgcagtgag

SEQ ID NO: 7797351 - DNA, 22 bp, Homo sapiens
gcccggcagtcacacacccagg

SEQ ID NO: 7797352 - DNA, 18 bp, Homo sapiens
gcctgagggtcaagtgtg

SEQ ID NO: 7797353 - DNA, 22 bp, Homo sapiens
gcctcccctgcaattgtccttg

SEQ ID NO: 7797354 - DNA, 22 bp, Homo sapiens
gcctgcagaggtgctgctagct

SEQ ID NO: 7797355 - DNA, 20 bp, Homo sapiens
gcctgcagagaaggtcagag

SEQ ID NO: 7797356 - DNA, 22 bp, Homo sapiens
gcctgcagacgtgttttcctca

SEQ ID NO: 7797357 - DNA, 21 bp, Homo sapiens
gcctgcagaccccaccaggct

SEQ ID NO: 7797358 - DNA, 22 bp, Homo sapiens
gcctgatgagcttccagctgag

SEQ ID NO: 7797359 - DNA, 22 bp, Homo sapiens
gcctgcagaactgtgaggcaat

SEQ ID NO: 7797360 - DNA, 19 bp, Homo sapiens
gcctgcagaaaaggcaggg

SEQ ID NO: 7797361 - DNA, 19 bp, Homo sapiens
gcctgcagaaaaggcaggg

SEQ ID NO: 7797362 - DNA, 22 bp, Homo sapiens
gcctgcagatatataggatggt

SEQ ID NO: 7797363 - DNA, 22 bp, Homo sapiens
gcctgcagccagggagttctct

SEQ ID NO: 7797364 - DNA, 22 bp, Homo sapiens
gcctgcagcatgctaggtcttg

SEQ ID NO: 7797365 - DNA, 22 bp, Homo sapiens
gcctgcagcctcaagggctgag

SEQ ID NO: 7797366 - DNA, 22 bp, Homo sapiens
gcctgcagcccctctgcagtag

SEQ ID NO: 7797367 - DNA, 22 bp, Homo sapiens
gcctgcagggcctgggcctacc

SEQ ID NO: 7797368 - DNA, 22 bp, Homo sapiens
gcctgcagggcccttgtgggtc

SEQ ID NO: 7797369 - DNA, 17 bp, Homo sapiens
gcctgcaggcccgcaga

SEQ ID NO: 7797370 - DNA, 22 bp, Homo sapiens
gcctgcaggctgtagtttgtga

SEQ ID NO: 7797371 - DNA, 18 bp, Homo sapiens
gcctgcaggcacgggggt

SEQ ID NO: 7797372 - DNA, 22 bp, Homo sapiens
gcctgcagcctcagagaatttt

SEQ ID NO: 7797373 - DNA, 22 bp, Homo sapiens
gcctgcagctgcttccacacac

SEQ ID NO: 7797374 - DNA, 21 bp, Homo sapiens
gcctgcagttttgaagccctt

SEQ ID NO: 7797375 - DNA, 22 bp, Homo sapiens
gcctgcagttctgtgctaggca

SEQ ID NO: 7797376 - DNA, 22 bp, Homo sapiens
gcctgcagggtgatgggctgcc

SEQ ID NO: 7797377 - DNA, 20 bp, Homo sapiens
gcctgcaggttggatgggat

SEQ ID NO: 7797378 - DNA, 22 bp, Homo sapiens
gcctgcagtgagtgcagaaggt

SEQ ID NO: 7797379 - DNA, 22 bp, Homo sapiens
gccagctgcaaagtatgttgaa

SEQ ID NO: 7797380 - DNA, 22 bp, Homo sapiens
gcccaagctccgcctcctgtcg

SEQ ID NO: 7797381 - DNA, 22 bp, Homo sapiens
gccaggctccaggccctcctga

SEQ ID NO: 7797382 - DNA, 22 bp, Homo sapiens
gccaggcattattccgatccct

SEQ ID NO: 7797383 - DNA, 22 bp, Homo sapiens
gccaggctaagaaaggtgtgat

SEQ ID NO: 7797384 - DNA, 22 bp, Homo sapiens
gcagtgtttgtgttctcacatg

SEQ ID NO: 7797385 - DNA, 22 bp, Homo sapiens
gcattcttggtggagtgctaaa

SEQ ID NO: 7797386 - DNA, 22 bp, Homo sapiens
gcattcttggtatgaaggacag

SEQ ID NO: 7797387 - DNA, 22 bp, Homo sapiens
gcattcttgaggtgtggactca

SEQ ID NO: 7797388 - DNA, 22 bp, Homo sapiens
gcattcttgtttttcctaccct

SEQ ID NO: 7797389 - DNA, 22 bp, Homo sapiens
gcattctttagactgagagata

SEQ ID NO: 7797390 - DNA, 22 bp, Homo sapiens
gcattctttccacgaggaggta

SEQ ID NO: 7797391 - DNA, 22 bp, Homo sapiens
gcattcttcacagtattcctcc

SEQ ID NO: 7797392 - DNA, 22 bp, Homo sapiens
gcattcttagggcctggggtgt

SEQ ID NO: 7797393 - DNA, 22 bp, Homo sapiens
gcattcttcactaggtgagagc

SEQ ID NO: 7797394 - DNA, 21 bp, Homo sapiens
gcattcttcatgtgattcaga

SEQ ID NO: 7797395 - DNA, 22 bp, Homo sapiens
gcattcttcctgggctgggggc

SEQ ID NO: 7797396 - DNA, 22 bp, Homo sapiens
gcattcttcgaagtaagtagtg

SEQ ID NO: 7797397 - DNA, 22 bp, Homo sapiens
gcattctttgaatgcttctaat

SEQ ID NO: 7797398 - DNA, 22 bp, Homo sapiens
gcattctttttaggaggttcct

SEQ ID NO: 7797399 - DNA, 22 bp, Homo sapiens
gcattctttttgactcctggtt

SEQ ID NO: 7797400 - DNA, 21 bp, Homo sapiens
gcagtttatgtaatatgcact

SEQ ID NO: 7797401 - DNA, 19 bp, Homo sapiens
gcataaaatgtcaatgtgt

SEQ ID NO: 7797402 - DNA, 19 bp, Homo sapiens
gcataaaatgtcaatgtgt

SEQ ID NO: 7797403 - DNA, 22 bp, Homo sapiens
gccacctctttgtctctgccgc

SEQ ID NO: 7797404 - DNA, 22 bp, Homo sapiens
gcatttaaatttgaacttcaga

SEQ ID NO: 7797405 - DNA, 22 bp, Homo sapiens
gcacagagacagtcctgagatc

SEQ ID NO: 7797406 - DNA, 20 bp, Homo sapiens
gcacagagatgagcaaagta

SEQ ID NO: 7797407 - DNA, 22 bp, Homo sapiens
gcacagagtcactagctaagca

SEQ ID NO: 7797408 - DNA, 22 bp, Homo sapiens
gagtagaactggttatctaata

SEQ ID NO: 7797409 - DNA, 22 bp, Homo sapiens
gagtagaaggaagttatctacc

SEQ ID NO: 7797410 - DNA, 22 bp, Homo sapiens
gcaaggactccctgggtcattc

SEQ ID NO: 7797411 - DNA, 22 bp, Homo sapiens
gcaaggacctttgagcgtgcca

SEQ ID NO: 7797412 - DNA, 22 bp, Homo sapiens
gcacccagaggtcagcagtgct

SEQ ID NO: 7797413 - DNA, 22 bp, Homo sapiens
gcacccagagggcagggtctcc

SEQ ID NO: 7797414 - DNA, 22 bp, Homo sapiens
gcacccagcccagggcgtgatg

SEQ ID NO: 7797415 - DNA, 22 bp, Homo sapiens
gcacccagccagcatctcagag

SEQ ID NO: 7797416 - DNA, 22 bp, Homo sapiens
gcagacaatttattagcagatt

SEQ ID NO: 7797417 - DNA, 22 bp, Homo sapiens
gcaggtaagagaggctggcttc

SEQ ID NO: 7797418 - DNA, 22 bp, Homo sapiens
gcttttacaagagccagagagg

SEQ ID NO: 7797419 - DNA, 22 bp, Homo sapiens
gctttgtgtgaagtccatggcg

SEQ ID NO: 7797420 - DNA, 22 bp, Homo sapiens
gcttttcctgactttccattag

SEQ ID NO: 7797421 - DNA, 22 bp, Homo sapiens
gcttttctccttagtgtccctg

SEQ ID NO: 7797422 - DNA, 22 bp, Homo sapiens
gcttttggacctctgatgtttc

SEQ ID NO: 7797423 - DNA, 22 bp, Homo sapiens
gctttttcaaatgaaagctggt

SEQ ID NO: 7797424 - DNA, 21 bp, Homo sapiens
gctttttgtatggcccaggaa

SEQ ID NO: 7797425 - DNA, 22 bp, Homo sapiens
gctttatccgcttgacccttac

SEQ ID NO: 7797426 - DNA, 22 bp, Homo sapiens
gctttgtgaattattactcaca

SEQ ID NO: 7797427 - DNA, 22 bp, Homo sapiens
gctttacattttggaaaggtga

SEQ ID NO: 7797428 - DNA, 22 bp, Homo sapiens
gcttgtttgtgatttctccaga

SEQ ID NO: 7797429 - DNA, 22 bp, Homo sapiens
gctttaatgaagtcacgcaaag

SEQ ID NO: 7797430 - DNA, 22 bp, Homo sapiens
gctttacaagtggtgcagatta

SEQ ID NO: 7797431 - DNA, 22 bp, Homo sapiens
gctttacaagtggtgcagatta

SEQ ID NO: 7797432 - DNA, 22 bp, Homo sapiens
gctttaatgcaatttcacctca

SEQ ID NO: 7797433 - DNA, 22 bp, Homo sapiens
gctttaatgcttcgtggggcca

SEQ ID NO: 7797434 - DNA, 22 bp, Homo sapiens
gctttacataaacatttattat

SEQ ID NO: 7797435 - DNA, 22 bp, Homo sapiens
gctgtcaccaaagcaggcactg

SEQ ID NO: 7797436 - DNA, 22 bp, Homo sapiens
gctgtacattctgcacaggccc

SEQ ID NO: 7797437 - DNA, 21 bp, Homo sapiens
ggaggaaaaaggaatgacttg

SEQ ID NO: 7797438 - DNA, 21 bp, Homo sapiens
ggaggaaaaaggaatgacttg

SEQ ID NO: 7797439 - DNA, 22 bp, Homo sapiens
ggaggaggggcgctttgtctat

SEQ ID NO: 7797440 - DNA, 22 bp, Homo sapiens
ggaggaggggtgactgaatgct

SEQ ID NO: 7797441 - DNA, 22 bp, Homo sapiens
ggagccctcaccggcgagtgcc

SEQ ID NO: 7797442 - DNA, 22 bp, Homo sapiens
ggagcccaagtctgcactcggc

SEQ ID NO: 7797443 - DNA, 22 bp, Homo sapiens
ggagaacatatctcccacattg

SEQ ID NO: 7797444 - DNA, 22 bp, Homo sapiens
ggagaagaggagctggaagcct

SEQ ID NO: 7797445 - DNA, 22 bp, Homo sapiens
gctggcagtaaagggtttggca

SEQ ID NO: 7797446 - DNA, 22 bp, Homo sapiens
gctggcagtcccatcagctggg

SEQ ID NO: 7797447 - DNA, 22 bp, Homo sapiens
gctggcagtgtattgttagctg

SEQ ID NO: 7797448 - DNA, 22 bp, Homo sapiens
gctggcagtttcctcaccgagg

SEQ ID NO: 7797449 - DNA, 22 bp, Homo sapiens
gctggcagtgtgaatgacaagc

SEQ ID NO: 7797450 - DNA, 22 bp, Homo sapiens
gctggcagggtggttgagagag

SEQ ID NO: 7797451 - DNA, 22 bp, Homo sapiens
gctggcagggttctcactgaaa

SEQ ID NO: 7797452 - DNA, 22 bp, Homo sapiens
gctggcaggtaaagccccgggg

SEQ ID NO: 7797453 - DNA, 22 bp, Homo sapiens
gctggcaggtccaagatagagc

SEQ ID NO: 7797454 - DNA, 22 bp, Homo sapiens
gctgaggtggctgccttagtaa

SEQ ID NO: 7797455 - DNA, 22 bp, Homo sapiens
gctgaggttttctgcctgctca

SEQ ID NO: 7797456 - DNA, 22 bp, Homo sapiens
gctgcaggcattttcctgggca

SEQ ID NO: 7797457 - DNA, 22 bp, Homo sapiens
gctgataaatagttgatgtacc

SEQ ID NO: 7797458 - DNA, 22 bp, Homo sapiens
gctgataagaagacccatcctg

SEQ ID NO: 7797459 - DNA, 22 bp, Homo sapiens
gctgataaattacccagcatct

SEQ ID NO: 7797460 - DNA, 22 bp, Homo sapiens
gctgataagagggcaatgagtg

SEQ ID NO: 7797461 - DNA, 23 bp, Homo sapiens
gctgataatgcattctgtttaat

SEQ ID NO: 7797462 - DNA, 18 bp, Homo sapiens
gctgcaggcgcctgcggt

SEQ ID NO: 7797463 - DNA, 22 bp, Homo sapiens
gctgagtgattgatattttagt

SEQ ID NO: 7797464 - DNA, 22 bp, Homo sapiens
gctgcagggagctggaaggctc

SEQ ID NO: 7797465 - DNA, 22 bp, Homo sapiens
gctgcaggctgtggcaggggag

SEQ ID NO: 7797466 - DNA, 22 bp, Homo sapiens
gctgcagggaatgtatggattt

SEQ ID NO: 7797467 - DNA, 22 bp, Homo sapiens
gctgcaggcggccgtggtggcg

SEQ ID NO: 7797468 - DNA, 22 bp, Homo sapiens
gctgcaggggggtctggacttg

SEQ ID NO: 7797469 - DNA, 22 bp, Homo sapiens
gctgcagggctctcacaggggg

SEQ ID NO: 7797470 - DNA, 21 bp, Homo sapiens
gctgcagggcccagggcaccc

SEQ ID NO: 7797471 - DNA, 22 bp, Homo sapiens
gcctggcaggcctcatgagggg

SEQ ID NO: 7797472 - DNA, 22 bp, Homo sapiens
gctagaaaatgaaagataattt

SEQ ID NO: 7797473 - DNA, 22 bp, Homo sapiens
gctagaaaatgaaagataattt

SEQ ID NO: 7797474 - DNA, 22 bp, Homo sapiens
gctagaaactgtttaatctctt

SEQ ID NO: 7797475 - DNA, 22 bp, Homo sapiens
gcctggcactcaatcatctgct

SEQ ID NO: 7797476 - DNA, 22 bp, Homo sapiens
gctagaaatcgacttcagaatt

SEQ ID NO: 7797477 - DNA, 20 bp, Homo sapiens
gctcagtggagaaatgcacc

SEQ ID NO: 7797478 - DNA, 22 bp, Homo sapiens
cttcttctggacaggcagctcc

SEQ ID NO: 7797479 - DNA, 22 bp, Homo sapiens
cttcttcctgctgcagcctcca

SEQ ID NO: 7797480 - DNA, 22 bp, Homo sapiens
cttcttcatgtattgatagtct

SEQ ID NO: 7797481 - DNA, 22 bp, Homo sapiens
cttgcctccctcagctcacagc

SEQ ID NO: 7797482 - DNA, 22 bp, Homo sapiens
cttgcctgaggaacagagggta

SEQ ID NO: 7797483 - DNA, 22 bp, Homo sapiens
cttgcttttgctgatgattaag

SEQ ID NO: 7797484 - DNA, 22 bp, Homo sapiens
cttggaatggggcagaaaatgg

SEQ ID NO: 7797485 - DNA, 20 bp, Homo sapiens
ctgttaaaaggtatgaattc

SEQ ID NO: 7797486 - DNA, 22 bp, Homo sapiens
ctgttaaaatgtggtcttaaaa

SEQ ID NO: 7797487 - DNA, 22 bp, Homo sapiens
ctttggaggaaaattgaggtca

SEQ ID NO: 7797488 - DNA, 20 bp, Homo sapiens
ctttttctccagctctgagc

SEQ ID NO: 7797489 - DNA, 22 bp, Homo sapiens
ctttttctgatgttccatgatt

SEQ ID NO: 7797490 - DNA, 22 bp, Homo sapiens
cttttgttaggagaaaacatca

SEQ ID NO: 7797491 - DNA, 22 bp, Homo sapiens
cttttgttaggagaaaacatca

SEQ ID NO: 7797492 - DNA, 22 bp, Homo sapiens
gaaaaatgagctgatgtcaggg

SEQ ID NO: 7797493 - DNA, 22 bp, Homo sapiens
ctttttgttgtataagcccttt

SEQ ID NO: 7797494 - DNA, 22 bp, Homo sapiens
ctttttgtctctgtcctgatga

SEQ ID NO: 7797495 - DNA, 22 bp, Homo sapiens
ctttttgtgtatgctacagttg

SEQ ID NO: 7797496 - DNA, 22 bp, Homo sapiens
ctttttgttgtccacactagga

SEQ ID NO: 7797497 - DNA, 22 bp, Homo sapiens
gaaactgaatataagaaaggta

SEQ ID NO: 7797498 - DNA, 22 bp, Homo sapiens
gaaactgagtaggctagagcac

SEQ ID NO: 7797499 - DNA, 22 bp, Homo sapiens
gaaactttggctaaaagccaga

SEQ ID NO: 7797500 - DNA, 22 bp, Homo sapiens
gaaagaagctttagatggctat

SEQ ID NO: 7797501 - DNA, 22 bp, Homo sapiens
gaaagacttcctttgagagtac

SEQ ID NO: 7797502 - DNA, 22 bp, Homo sapiens
gaaatgttttacaaggcatact

SEQ ID NO: 7797503 - DNA, 22 bp, Homo sapiens
gaaatgtttgggaggagtcaac

SEQ ID NO: 7797504 - DNA, 22 bp, Homo sapiens
ctgggctcagtgtctcactcct

SEQ ID NO: 7797505 - DNA, 22 bp, Homo sapiens
ctgggctcaaatcctggccctg

SEQ ID NO: 7797506 - DNA, 22 bp, Homo sapiens
ctggggggctactgacagagga

SEQ ID NO: 7797507 - DNA, 22 bp, Homo sapiens
ctggtagtttgcaaaatggtgt

SEQ ID NO: 7797508 - DNA, 22 bp, Homo sapiens
ctggtcacctccttcccagcta

SEQ ID NO: 7797509 - DNA, 22 bp, Homo sapiens
ctgggttttattacagtgagct

SEQ ID NO: 7797510 - DNA, 22 bp, Homo sapiens
ctggtacagggaaataaaggaa

SEQ ID NO: 7797511 - DNA, 22 bp, Homo sapiens
ctggtacatagtaagaacacaa

SEQ ID NO: 7797512 - DNA, 22 bp, Homo sapiens
ctgggtttagggtctccccttg

SEQ ID NO: 7797513 - DNA, 22 bp, Homo sapiens
ctgtccagtgcagagaacagag

SEQ ID NO: 7797514 - DNA, 22 bp, Homo sapiens
ctgtccagtgcagagaacagag

SEQ ID NO: 7797515 - DNA, 22 bp, Homo sapiens
ctgtccccattgtttgagggtt

SEQ ID NO: 7797516 - DNA, 22 bp, Homo sapiens
ctgtgaaactggacagcacttg

SEQ ID NO: 7797517 - DNA, 22 bp, Homo sapiens
ctgtctgttcagattcattact

SEQ ID NO: 7797518 - DNA, 22 bp, Homo sapiens
ctgtctgttatctcaccagtcc

SEQ ID NO: 7797519 - DNA, 22 bp, Homo sapiens
ctgtgtgtgtctgcagcatact

SEQ ID NO: 7797520 - DNA, 22 bp, Homo sapiens
ctgtgtgtgctacaggcttcca

SEQ ID NO: 7797521 - DNA, 22 bp, Homo sapiens
gaggcctgtcgctaggcctctg

SEQ ID NO: 7797522 - DNA, 22 bp, Homo sapiens
gaggcctgtagtcatggatgta

SEQ ID NO: 7797523 - DNA, 22 bp, Homo sapiens
gaggcctggtgctgtgtccaca

SEQ ID NO: 7797524 - DNA, 22 bp, Homo sapiens
gaggcctggtctatgagatgtt

SEQ ID NO: 7797525 - DNA, 22 bp, Homo sapiens
gaggcctggtttgcatgagaat

SEQ ID NO: 7797526 - DNA, 22 bp, Homo sapiens
gaggcctggtgtgtctcccgct

SEQ ID NO: 7797527 - DNA, 22 bp, Homo sapiens
gaggcctggtttccagcatcct

SEQ ID NO: 7797528 - DNA, 22 bp, Homo sapiens
gagggacctttacacagacatt

SEQ ID NO: 7797529 - DNA, 22 bp, Homo sapiens
gagggaccccaggctggccctt

SEQ ID NO: 7797530 - DNA, 22 bp, Homo sapiens
gaggtgagaagggggtcagatg

SEQ ID NO: 7797531 - DNA, 22 bp, Homo sapiens
gaggtcttgtctgatagggaaa

SEQ ID NO: 7797532 - DNA, 22 bp, Homo sapiens
gagtaaaagttggattacaaag

SEQ ID NO: 7797533 - DNA, 22 bp, Homo sapiens
gagctcctggattgctcctagg

SEQ ID NO: 7797534 - DNA, 22 bp, Homo sapiens
gagcaggccagcaatggaaggg

SEQ ID NO: 7797535 - DNA, 22 bp, Homo sapiens
gagctcagaggcgtctttgtcc

SEQ ID NO: 7797536 - DNA, 18 bp, Homo sapiens
gagctcagcgtgtttcta

SEQ ID NO: 7797537 - DNA, 22 bp, Homo sapiens
gagctcagcactaaaatcatgt

SEQ ID NO: 7797538 - DNA, 22 bp, Homo sapiens
gagctcagattctggtgtcaga

SEQ ID NO: 7797539 - DNA, 22 bp, Homo sapiens
gagctccacttagcaaggccac

SEQ ID NO: 7797540 - DNA, 22 bp, Homo sapiens
gagctccagagttagacacccg

SEQ ID NO: 7797541 - DNA, 22 bp, Homo sapiens
gagctcaggtggtcaaaacaat

SEQ ID NO: 7797542 - DNA, 22 bp, Homo sapiens
gaggacagtgtgatctgccagc

SEQ ID NO: 7797543 - DNA, 22 bp, Homo sapiens
gaggactctgggcgtgtatggg

SEQ ID NO: 7797544 - DNA, 22 bp, Homo sapiens
gaggaggtggagtcatgcagag

SEQ ID NO: 7797545 - DNA, 22 bp, Homo sapiens
gaggaggttgacggcactgtga

SEQ ID NO: 7797546 - DNA, 22 bp, Homo sapiens
gaggcctggaattccagcctgg

SEQ ID NO: 7797547 - DNA, 22 bp, Homo sapiens
gagaacattaatagttaatttt

SEQ ID NO: 7797548 - DNA, 22 bp, Homo sapiens
gactcagtgatttgacatgcct

SEQ ID NO: 7797549 - DNA, 22 bp, Homo sapiens
gagaagcaatcagtggccaccc

SEQ ID NO: 7797550 - DNA, 23 bp, Homo sapiens
gagagcccattggcaggggtacc

SEQ ID NO: 7797551 - DNA, 22 bp, Homo sapiens
gagagccctacaaggcgttttg

SEQ ID NO: 7797552 - DNA, 22 bp, Homo sapiens
gagagccctgcatggctgatga

SEQ ID NO: 7797553 - DNA, 22 bp, Homo sapiens
gagaggaggtggctatgacagc

SEQ ID NO: 7797554 - DNA, 22 bp, Homo sapiens
gagcactgatttatttttgtct

SEQ ID NO: 7797555 - DNA, 22 bp, Homo sapiens
gagcactgaggaaagctggtta

SEQ ID NO: 7797556 - DNA, 22 bp, Homo sapiens
gagcaccgcctccacgatgccc

SEQ ID NO: 7797557 - DNA, 22 bp, Homo sapiens
gagcaccctttgcacatcagtc

SEQ ID NO: 7797558 - DNA, 22 bp, Homo sapiens
gagcaaagcttttagggccttt

SEQ ID NO: 7797559 - DNA, 22 bp, Homo sapiens
gagcaaacatcagtgatgtctg

SEQ ID NO: 7797560 - DNA, 22 bp, Homo sapiens
gagcaaaataaattctgacaaa

SEQ ID NO: 7797561 - DNA, 22 bp, Homo sapiens
gagatttattgacttaacagta

SEQ ID NO: 7797562 - DNA, 18 bp, Homo sapiens
gacaaaagtacagacaga

SEQ ID NO: 7797563 - DNA, 22 bp, Homo sapiens
gacaaaagtgttttgaacaagg

SEQ ID NO: 7797564 - DNA, 22 bp, Homo sapiens
gaatggctgaatgtcttaaatt

SEQ ID NO: 7797565 - DNA, 22 bp, Homo sapiens
gacatggatacttgataagggg

SEQ ID NO: 7797566 - DNA, 22 bp, Homo sapiens
gacattaatggcaaattaatta

SEQ ID NO: 7797567 - DNA, 22 bp, Homo sapiens
gacctgcctgagctgcctctgc

SEQ ID NO: 7797568 - DNA, 19 bp, Homo sapiens
gactatctctggagaccat

SEQ ID NO: 7797569 - DNA, 22 bp, Homo sapiens
gacagtgcatttcctggcatgg

SEQ ID NO: 7797570 - DNA, 22 bp, Homo sapiens
cggggccctggggctgaaggtc

SEQ ID NO: 7797571 - DNA, 22 bp, Homo sapiens
cgtgagcaaaatggacactccc

SEQ ID NO: 7797572 - DNA, 22 bp, Homo sapiens
cggcaggacctcatttccttct

SEQ ID NO: 7797573 - DNA, 22 bp, Homo sapiens
ttcaaagtgcatgttcctcaga

SEQ ID NO: 7797574 - DNA, 22 bp, Homo sapiens
ttcaaagtgcttttaaccttta

SEQ ID NO: 7797575 - DNA, 22 bp, Homo sapiens
ttcaaagtcctgtcaggtagcc

SEQ ID NO: 7797576 - DNA, 22 bp, Homo sapiens
ttcaaagttgcatgacagctta

SEQ ID NO: 7797577 - DNA, 22 bp, Homo sapiens
cggacccactcggatcccagcc

SEQ ID NO: 7797578 - DNA, 22 bp, Homo sapiens
cggaggttgaggctgcagtgag

SEQ ID NO: 7797579 - DNA, 22 bp, Homo sapiens
cctttggtaattctgtgtagag

SEQ ID NO: 7797580 - DNA, 22 bp, Homo sapiens
ttatccaacatgacttatgtcc

SEQ ID NO: 7797581 - DNA, 22 bp, Homo sapiens
ttattcagattggctacaggat

SEQ ID NO: 7797582 - DNA, 22 bp, Homo sapiens
ttattcagcatttagaggaagg

SEQ ID NO: 7797583 - DNA, 22 bp, Homo sapiens
cgaccctacagacagtgctgag

SEQ ID NO: 7797584 - DNA, 22 bp, Homo sapiens
ttcaaagtaccgtacttaatgg

SEQ ID NO: 7797585 - DNA, 22 bp, Homo sapiens
ttatttcatataatgttatcaa

SEQ ID NO: 7797586 - DNA, 22 bp, Homo sapiens
ttatttcatgtaaaatttatgt

SEQ ID NO: 7797587 - DNA, 22 bp, Homo sapiens
ttaaattttagaaacagactct

SEQ ID NO: 7797588 - DNA, 22 bp, Homo sapiens
ttaaattatttctagtgaggtg

SEQ ID NO: 7797589 - DNA, 22 bp, Homo sapiens
ttaaattcattccaacttttga

SEQ ID NO: 7797590 - DNA, 22 bp, Homo sapiens
ttaaattagtcaagcttctctg

SEQ ID NO: 7797591 - DNA, 22 bp, Homo sapiens
ttaaattattgagggattgtca

SEQ ID NO: 7797592 - DNA, 22 bp, Homo sapiens
ttaaattagtcaagcttctctg

SEQ ID NO: 7797593 - DNA, 22 bp, Homo sapiens
tgtcagcatcatttgttgaagg

SEQ ID NO: 7797594 - DNA, 22 bp, Homo sapiens
tgtcagagcaatgaggttcagc

SEQ ID NO: 7797595 - DNA, 21 bp, Homo sapiens
tgtcagagcttgtaggacatt

SEQ ID NO: 7797596 - DNA, 22 bp, Homo sapiens
tgtcagagcaaggccaggccag

SEQ ID NO: 7797597 - DNA, 22 bp, Homo sapiens
tgtcagagagcaggcagtagaa

SEQ ID NO: 7797598 - DNA, 22 bp, Homo sapiens
tgtcagaggctcagggtctcag

SEQ ID NO: 7797599 - DNA, 22 bp, Homo sapiens
ttacaaagcgttgagacaagta

SEQ ID NO: 7797600 - DNA, 22 bp, Homo sapiens
ttacagtttacataagaattgt

SEQ ID NO: 7797601 - DNA, 23 bp, Homo sapiens
ttataaatattttcaggtgtgtt

SEQ ID NO: 7797602 - DNA, 22 bp, Homo sapiens
ttatatttctggtagccttcag

SEQ ID NO: 7797603 - DNA, 22 bp, Homo sapiens
ttatcagttgtgtgtatacacg

SEQ ID NO: 7797604 - DNA, 22 bp, Homo sapiens
ttagttttctcatctatctcac

SEQ ID NO: 7797605 - DNA, 22 bp, Homo sapiens
ttagttttcccatctttatggt

SEQ ID NO: 7797606 - DNA, 22 bp, Homo sapiens
ttagcaaatatcttgaaacagg

SEQ ID NO: 7797607 - DNA, 22 bp, Homo sapiens
ttagcaaatatcttgaaacagg

SEQ ID NO: 7797608 - DNA, 22 bp, Homo sapiens
ctcagggtgcagcacagttcct

SEQ ID NO: 7797609 - DNA, 22 bp, Homo sapiens
ctcaggagacagtgtccacatg

SEQ ID NO: 7797610 - DNA, 22 bp, Homo sapiens
ctcaggagatgacagaaggtat

SEQ ID NO: 7797611 - DNA, 22 bp, Homo sapiens
ctcaggaggtttcctgtctagg

SEQ ID NO: 7797612 - DNA, 22 bp, Homo sapiens
ctcaggaggtttcctgtctagg

SEQ ID NO: 7797613 - DNA, 22 bp, Homo sapiens
ctcaggaggtggtagaggccct

SEQ ID NO: 7797614 - DNA, 22 bp, Homo sapiens
ctcaggaggccattctcaaggt

SEQ ID NO: 7797615 - DNA, 22 bp, Homo sapiens
ctcaggaggaggaagttcattg

SEQ ID NO: 7797616 - DNA, 22 bp, Homo sapiens
ctcaggagcttcctcagcccat

SEQ ID NO: 7797617 - DNA, 22 bp, Homo sapiens
ctcaggagtagttcagcagctg

SEQ ID NO: 7797618 - DNA, 22 bp, Homo sapiens
ttggctctgaaacccaagctct

SEQ ID NO: 7797619 - DNA, 22 bp, Homo sapiens
ctccaggactgaggacagagct

SEQ ID NO: 7797620 - DNA, 22 bp, Homo sapiens
ttggatcactctgaagccttac

SEQ ID NO: 7797621 - DNA, 22 bp, Homo sapiens
ttggatccatctcaggcatagg

SEQ ID NO: 7797622 - DNA, 20 bp, Homo sapiens
ttggaggtgcagtgcatgca

SEQ ID NO: 7797623 - DNA, 22 bp, Homo sapiens
ttggaagcagtgtacactgtac

SEQ ID NO: 7797624 - DNA, 22 bp, Homo sapiens
ctcagtctcttgggctgtgaag

SEQ ID NO: 7797625 - DNA, 22 bp, Homo sapiens
ctcagtctgtcttgtctgtgtt

SEQ ID NO: 7797626 - DNA, 19 bp, Homo sapiens
ctcagtctggctctgcctg

SEQ ID NO: 7797627 - DNA, 22 bp, Homo sapiens
ttggaaaagtgaaactagatgc

SEQ ID NO: 7797628 - DNA, 22 bp, Homo sapiens
ttggaaaagtgaaactagatgc

SEQ ID NO: 7797629 - DNA, 22 bp, Homo sapiens
ttctatttccagtccttcagag

SEQ ID NO: 7797630 - DNA, 22 bp, Homo sapiens
ttctattaatatgttaattctg

SEQ ID NO: 7797631 - DNA, 22 bp, Homo sapiens
ttctggaagggtggagtagctt

SEQ ID NO: 7797632 - DNA, 22 bp, Homo sapiens
ttctggaagctgcaggtggccg

SEQ ID NO: 7797633 - DNA, 22 bp, Homo sapiens
ttctggaagctgcaggtggccg

SEQ ID NO: 7797634 - DNA, 22 bp, Homo sapiens
ctagagaaaccccatgagcttt

SEQ ID NO: 7797635 - DNA, 22 bp, Homo sapiens
ctagaaagatacttaaatcaag

SEQ ID NO: 7797636 - DNA, 22 bp, Homo sapiens
ctagagaatggcaaagattaga

SEQ ID NO: 7797637 - DNA, 22 bp, Homo sapiens
ctagagaatcttttaagaagtg

SEQ ID NO: 7797638 - DNA, 22 bp, Homo sapiens
ctagagaaacgccgtgggagga

SEQ ID NO: 7797639 - DNA, 22 bp, Homo sapiens
ctagagaagaggttaagcatga

SEQ ID NO: 7797640 - DNA, 22 bp, Homo sapiens
ctagagaacaacattcatatgg

SEQ ID NO: 7797641 - DNA, 22 bp, Homo sapiens
ctcaccccactaccccttggtg

SEQ ID NO: 7797642 - DNA, 22 bp, Homo sapiens
ctatacagcagcttactagtta

SEQ ID NO: 7797643 - DNA, 20 bp, Homo sapiens
ttctggcaaacagagttctt

SEQ ID NO: 7797644 - DNA, 18 bp, Homo sapiens
ttctggctcactcatgct

SEQ ID NO: 7797645 - DNA, 22 bp, Homo sapiens
ttctggctaccctcctaatgtt

SEQ ID NO: 7797646 - DNA, 22 bp, Homo sapiens
ttctggctcgattctctgaccg

SEQ ID NO: 7797647 - DNA, 22 bp, Homo sapiens
ttctggcttcatctgacaagcc

SEQ ID NO: 7797648 - DNA, 22 bp, Homo sapiens
ctcagaaaggtgccatttatgt

SEQ ID NO: 7797649 - DNA, 22 bp, Homo sapiens
ttctttctgtccataatgagac

SEQ ID NO: 7797650 - DNA, 22 bp, Homo sapiens
ttctttctggggtccttcggct

SEQ ID NO: 7797651 - DNA, 22 bp, Homo sapiens
ttctttctgtcatggtgtactg

SEQ ID NO: 7797652 - DNA, 22 bp, Homo sapiens
ctcagagaaaaggagcaagggt

SEQ ID NO: 7797653 - DNA, 22 bp, Homo sapiens
ctcagagaaatgtcacaacaat

SEQ ID NO: 7797654 - DNA, 22 bp, Homo sapiens
ctcagagaacctaagcggagga

SEQ ID NO: 7797655 - DNA, 22 bp, Homo sapiens
ctcagagaacctaagcggagga

SEQ ID NO: 7797656 - DNA, 22 bp, Homo sapiens
ttctttctctccacaaggcttg

SEQ ID NO: 7797657 - DNA, 22 bp, Homo sapiens
ttctttctgaatacagttgagt

SEQ ID NO: 7797658 - DNA, 22 bp, Homo sapiens
ttctttctgggaagagttcaga

SEQ ID NO: 7797659 - DNA, 22 bp, Homo sapiens
ttctttctgggaagagttcaga

SEQ ID NO: 7797660 - DNA, 21 bp, Homo sapiens
ttctttctgaatctgaagtat

SEQ ID NO: 7797661 - DNA, 22 bp, Homo sapiens
ctcagagagggcaccagggcca

SEQ ID NO: 7797662 - DNA, 19 bp, Homo sapiens
ctcagagaggggcagtgcc

SEQ ID NO: 7797663 - DNA, 18 bp, Homo sapiens
ctcagagatgcccttatt

SEQ ID NO: 7797664 - DNA, 22 bp, Homo sapiens
ctcagagatatagtccctgctt

SEQ ID NO: 7797665 - DNA, 22 bp, Homo sapiens
ctgctcttcacactacacccgt

SEQ ID NO: 7797666 - DNA, 22 bp, Homo sapiens
ctgctctgaccctttcaccttc

SEQ ID NO: 7797667 - DNA, 22 bp, Homo sapiens
ctgctgagaaatgcatccagtt

SEQ ID NO: 7797668 - DNA, 22 bp, Homo sapiens
ctgctcttgagggactgcggtc

SEQ ID NO: 7797669 - DNA, 22 bp, Homo sapiens
ctgctcttcccactcactccca

SEQ ID NO: 7797670 - DNA, 22 bp, Homo sapiens
ctgctgtctttatttcactgct

SEQ ID NO: 7797671 - DNA, 22 bp, Homo sapiens
ctgaggctcaagggcaggtggg

SEQ ID NO: 7797672 - DNA, 22 bp, Homo sapiens
ctgaggctgcccagggccaggt

SEQ ID NO: 7797673 - DNA, 22 bp, Homo sapiens
ctgaggctgaagagggcctacg

SEQ ID NO: 7797674 - DNA, 22 bp, Homo sapiens
ctgaggctccctcgggtctgct

SEQ ID NO: 7797675 - DNA, 22 bp, Homo sapiens
ctcttcccagctccacgagagg

SEQ ID NO: 7797676 - DNA, 22 bp, Homo sapiens
ttttggaacacagacattagaa

SEQ ID NO: 7797677 - DNA, 22 bp, Homo sapiens
ttttgcttgagtgcacaaaatg

SEQ ID NO: 7797678 - DNA, 22 bp, Homo sapiens
ctgagcaggatattcacagcag

SEQ ID NO: 7797679 - DNA, 22 bp, Homo sapiens
ctgagcagtggttcttgagcgc

SEQ ID NO: 7797680 - DNA, 22 bp, Homo sapiens
ctgaggtgagaggaggccatgt

SEQ ID NO: 7797681 - DNA, 19 bp, Homo sapiens
ctgaggtgcagtaagaggc

SEQ ID NO: 7797682 - DNA, 22 bp, Homo sapiens
ctgaggtgtggtctgggagtat

SEQ ID NO: 7797683 - DNA, 22 bp, Homo sapiens
ctgaggtgttgatgacctatgc

SEQ ID NO: 7797684 - DNA, 22 bp, Homo sapiens
ctgcaggacgaccgcctcatct

SEQ ID NO: 7797685 - DNA, 22 bp, Homo sapiens
ctgccccaggacctcttctgga

SEQ ID NO: 7797686 - DNA, 22 bp, Homo sapiens
ctgcccaggggagtgctgtcgg

SEQ ID NO: 7797687 - DNA, 22 bp, Homo sapiens
ctgcaggatttcatgggctgac

SEQ ID NO: 7797688 - DNA, 22 bp, Homo sapiens
ctgcaggagtgaaagcaggcct

SEQ ID NO: 7797689 - DNA, 22 bp, Homo sapiens
ctgcaggagggctggggaagcc

SEQ ID NO: 7797690 - DNA, 22 bp, Homo sapiens
ctgcaggagcaaagcctctgct

SEQ ID NO: 7797691 - DNA, 22 bp, Homo sapiens
ctgcaggagcaagcctgggaga

SEQ ID NO: 7797692 - DNA, 22 bp, Homo sapiens
ctgcaggaggatcctgagagtg

SEQ ID NO: 7797693 - DNA, 22 bp, Homo sapiens
ctgccatgtgtgaaaggggagg

SEQ ID NO: 7797694 - DNA, 20 bp, Homo sapiens
ctgcccagccactgagggat

SEQ ID NO: 7797695 - DNA, 22 bp, Homo sapiens
ctccaggcccctggccttctgc

SEQ ID NO: 7797696 - DNA, 22 bp, Homo sapiens
ctccaggccatggctgcggagg

SEQ ID NO: 7797697 - DNA, 22 bp, Homo sapiens
tttcagaaattatattagatgc

SEQ ID NO: 7797698 - DNA, 22 bp, Homo sapiens
tttccaagtactgagctgtcaa

SEQ ID NO: 7797699 - DNA, 22 bp, Homo sapiens
tttcattacgtgtttgacttgt

SEQ ID NO: 7797700 - DNA, 22 bp, Homo sapiens
ctctgaaagcaaaactagagaa

SEQ ID NO: 7797701 - DNA, 22 bp, Homo sapiens
ctctgaaagcaaaactagagaa

SEQ ID NO: 7797702 - DNA, 22 bp, Homo sapiens
ctctgaaagttagagaaaatag

SEQ ID NO: 7797703 - DNA, 18 bp, Homo sapiens
ctctctttccactctttg

SEQ ID NO: 7797704 - DNA, 22 bp, Homo sapiens
tttgttctaacttctgcagaca

SEQ ID NO: 7797705 - DNA, 22 bp, Homo sapiens
tttgttcattttgagctcatca

SEQ ID NO: 7797706 - DNA, 22 bp, Homo sapiens
ctctgtgtggtcctctgtattg

SEQ ID NO: 7797707 - DNA, 22 bp, Homo sapiens
ctctgtgttcagcctagcagaa

SEQ ID NO: 7797708 - DNA, 23 bp, Homo sapiens
ctctgggtccgatgtcctgacag

SEQ ID NO: 7797709 - DNA, 23 bp, Homo sapiens
tttgttcatcattagagtctagc

SEQ ID NO: 7797710 - DNA, 21 bp, Homo sapiens
tttgttcatagctcactcttt

SEQ ID NO: 7797711 - DNA, 22 bp, Homo sapiens
tttgttcagctctcattgatta

SEQ ID NO: 7797712 - DNA, 21 bp, Homo sapiens
tttgttcaggcaagttacagt

SEQ ID NO: 7797713 - DNA, 21 bp, Homo sapiens
tttgttcaggcaagttacagt

SEQ ID NO: 7797714 - DNA, 22 bp, Homo sapiens
tttgttcagctctcattgatta

SEQ ID NO: 7797715 - DNA, 18 bp, Homo sapiens
ctctgaacatctttctgg

SEQ ID NO: 7797716 - DNA, 22 bp, Homo sapiens
tttcttgggttccagttcccag

SEQ ID NO: 7797717 - DNA, 22 bp, Homo sapiens
tttgagaagatgtaatgttaag

SEQ ID NO: 7797718 - DNA, 22 bp, Homo sapiens
tttgagaaaaccagaaagatct

SEQ ID NO: 7797719 - DNA, 22 bp, Homo sapiens
cccacccactctgaccagaagc

SEQ ID NO: 7797720 - DNA, 21 bp, Homo sapiens
cccaccccataaggcagaacc

SEQ ID NO: 7797721 - DNA, 22 bp, Homo sapiens
cccacaggcaggggcagagaca

SEQ ID NO: 7797722 - DNA, 22 bp, Homo sapiens
cccacaggcaggtgcatgggct

SEQ ID NO: 7797723 - DNA, 22 bp, Homo sapiens
cccagcagccagaatgaggagc

SEQ ID NO: 7797724 - DNA, 22 bp, Homo sapiens
ccagtgtgggcccggcctcctc

SEQ ID NO: 7797725 - DNA, 18 bp, Homo sapiens
tgaggcagtcagtgatgg

SEQ ID NO: 7797726 - DNA, 22 bp, Homo sapiens
cccaagaggtggaggttgcagt

SEQ ID NO: 7797727 - DNA, 22 bp, Homo sapiens
tgattatattctaacttcataa

SEQ ID NO: 7797728 - DNA, 22 bp, Homo sapiens
ccatggcagcctggcctggctt

SEQ ID NO: 7797729 - DNA, 22 bp, Homo sapiens
cccaggaggcctgcctggccgg

SEQ ID NO: 7797730 - DNA, 22 bp, Homo sapiens
tgccctcctcctgagcccatgt

SEQ ID NO: 7797731 - DNA, 22 bp, Homo sapiens
tgcagtggaaagactcagactt

SEQ ID NO: 7797732 - DNA, 22 bp, Homo sapiens
tgcagtgcctcggcagtgcagc

SEQ ID NO: 7797733 - DNA, 22 bp, Homo sapiens
cccaggactctgacacccccaa

SEQ ID NO: 7797734 - DNA, 22 bp, Homo sapiens
cccaggactcttcactgcagcc

SEQ ID NO: 7797735 - DNA, 22 bp, Homo sapiens
cccagcccatctcaaaggtcta

SEQ ID NO: 7797736 - DNA, 20 bp, Homo sapiens
cccagcccctacctgttgcc

SEQ ID NO: 7797737 - DNA, 22 bp, Homo sapiens
cccagcccacggtcctgggtgg

SEQ ID NO: 7797738 - DNA, 22 bp, Homo sapiens
tgaggacattaggaagtgaagg

SEQ ID NO: 7797739 - DNA, 22 bp, Homo sapiens
tgagcagaacacgggatccatg

SEQ ID NO: 7797740 - DNA, 22 bp, Homo sapiens
ccaggtcctgttttcaccacag

SEQ ID NO: 7797741 - DNA, 22 bp, Homo sapiens
ccaggtcaagctcccctgtggt

SEQ ID NO: 7797742 - DNA, 22 bp, Homo sapiens
tgagaaaacagtttgtaataat

SEQ ID NO: 7797743 - DNA, 22 bp, Homo sapiens
tgagaaaaggttgagatgataa

SEQ ID NO: 7797744 - DNA, 22 bp, Homo sapiens
tgaccaggatactgcagggatg

SEQ ID NO: 7797745 - DNA, 22 bp, Homo sapiens
tgaccagtgatctactgggatt

SEQ ID NO: 7797746 - DNA, 21 bp, Homo sapiens
tgaccagtgccccatcctgtc

SEQ ID NO: 7797747 - DNA, 22 bp, Homo sapiens
tgaccagttaagtcatcctgtc

SEQ ID NO: 7797748 - DNA, 22 bp, Homo sapiens
tgacagaggagctggaatgatt

SEQ ID NO: 7797749 - DNA, 22 bp, Homo sapiens
tgacagagcatgtagtgacagc

SEQ ID NO: 7797750 - DNA, 22 bp, Homo sapiens
tctttaaagttggagcttgcaa

SEQ ID NO: 7797751 - DNA, 22 bp, Homo sapiens
tcttgtttctgtatataatgac

SEQ ID NO: 7797752 - DNA, 22 bp, Homo sapiens
ccagcctcactggcatcaccta

SEQ ID NO: 7797753 - DNA, 22 bp, Homo sapiens
ccagcccttgctgaagggtggc

SEQ ID NO: 7797754 - DNA, 19 bp, Homo sapiens
ccaggcctggcgtctccgc

SEQ ID NO: 7797755 - DNA, 22 bp, Homo sapiens
tctttattttatgcttgtgcaa

SEQ ID NO: 7797756 - DNA, 22 bp, Homo sapiens
tctttattttatgcttgtgcaa

SEQ ID NO: 7797757 - DNA, 22 bp, Homo sapiens
tctttatttaagtctgttgtaa

SEQ ID NO: 7797758 - DNA, 22 bp, Homo sapiens
tctttatttaagtctgttgtaa

SEQ ID NO: 7797759 - DNA, 22 bp, Homo sapiens
tctttatttaagtctgttgtaa

SEQ ID NO: 7797760 - DNA, 22 bp, Homo sapiens
tctttatttaagtctgttgtaa

SEQ ID NO: 7797761 - DNA, 22 bp, Homo sapiens
tctttatttctgaatcccccat

SEQ ID NO: 7797762 - DNA, 22 bp, Homo sapiens
tctttatttctgaatcccccat

SEQ ID NO: 7797763 - DNA, 22 bp, Homo sapiens
tctttatttctgaatcccccat

SEQ ID NO: 7797764 - DNA, 22 bp, Homo sapiens
ccaggctcacagcatcccagga

SEQ ID NO: 7797765 - DNA, 22 bp, Homo sapiens
ccaggctccccaggaggccctt

SEQ ID NO: 7797766 - DNA, 17 bp, Homo sapiens
ccaggctccatcactgt

SEQ ID NO: 7797767 - DNA, 18 bp, Homo sapiens
tgaacagatgagttgaag

SEQ ID NO: 7797768 - DNA, 22 bp, Homo sapiens
tgaagctttaggatgggttcat

SEQ ID NO: 7797769 - DNA, 22 bp, Homo sapiens
tgaagctttaggatgggttcat

SEQ ID NO: 7797770 - DNA, 22 bp, Homo sapiens
tgaaagcagcaccaataccatt

SEQ ID NO: 7797771 - DNA, 22 bp, Homo sapiens
tgaaagcagatagctctgttgt

SEQ ID NO: 7797772 - DNA, 22 bp, Homo sapiens
tgaaagcagtgatttctccttc

SEQ ID NO: 7797773 - DNA, 22 bp, Homo sapiens
tgaaagcaggcgggctacttta

SEQ ID NO: 7797774 - DNA, 22 bp, Homo sapiens
tgaaagcagtgccatgattatg

SEQ ID NO: 7797775 - DNA, 22 bp, Homo sapiens
tgaaagcatatgctaaagacca

SEQ ID NO: 7797776 - DNA, 22 bp, Homo sapiens
tgaaagcatgcttgccaagctt

SEQ ID NO: 7797777 - DNA, 20 bp, Homo sapiens
tgaaagcatgtggtatttgg

SEQ ID NO: 7797778 - DNA, 22 bp, Homo sapiens
tgaaatgattatatggtgtttg

SEQ ID NO: 7797779 - DNA, 22 bp, Homo sapiens
cctgccttcagccctgaagtct

SEQ ID NO: 7797780 - DNA, 22 bp, Homo sapiens
cctgctgtaatgtgtctttatt

SEQ ID NO: 7797781 - DNA, 22 bp, Homo sapiens
cctgccagtcactatgtcacct

SEQ ID NO: 7797782 - DNA, 22 bp, Homo sapiens
cctgccagggccagaggccagc

SEQ ID NO: 7797783 - DNA, 22 bp, Homo sapiens
cctgccaggcgagtctaggcca

SEQ ID NO: 7797784 - DNA, 22 bp, Homo sapiens
tgggtatatatgttgctacaga

SEQ ID NO: 7797785 - DNA, 22 bp, Homo sapiens
tgggtatacaaataatctcttt

SEQ ID NO: 7797786 - DNA, 22 bp, Homo sapiens
cctgcctgtactagagacccag

SEQ ID NO: 7797787 - DNA, 22 bp, Homo sapiens
tgtaatttcctgatgttagaac

SEQ ID NO: 7797788 - DNA, 22 bp, Homo sapiens
tgtaattatttctgtgcagtca

SEQ ID NO: 7797789 - DNA, 22 bp, Homo sapiens
tgtacatacatagatatacaca

SEQ ID NO: 7797790 - DNA, 19 bp, Homo sapiens
tgtacatatagagctcagt

SEQ ID NO: 7797791 - DNA, 22 bp, Homo sapiens
tgtcaactgtgatgtcaacact

SEQ ID NO: 7797792 - DNA, 22 bp, Homo sapiens
tgtcaagttgtggcatgtctaa

SEQ ID NO: 7797793 - DNA, 22 bp, Homo sapiens
tgtcaagtctctgaatgaaatg

SEQ ID NO: 7797794 - DNA, 22 bp, Homo sapiens
tggggtccagtgccaccccaag

SEQ ID NO: 7797795 - DNA, 22 bp, Homo sapiens
tggggtccagtgcctggcaagg

SEQ ID NO: 7797796 - DNA, 22 bp, Homo sapiens
tggggtcccactcagctcccct

SEQ ID NO: 7797797 - DNA, 22 bp, Homo sapiens
tggggtcccaactctgattgat

SEQ ID NO: 7797798 - DNA, 22 bp, Homo sapiens
cctgaggtcagccattcttgcc

SEQ ID NO: 7797799 - DNA, 22 bp, Homo sapiens
cctgcaagacctgagacacacc

SEQ ID NO: 7797800 - DNA, 23 bp, Homo sapiens
cctgcaaagaaacaagccacctg

SEQ ID NO: 7797801 - DNA, 22 bp, Homo sapiens
cctgcaagactatttagttcca

SEQ ID NO: 7797802 - DNA, 20 bp, Homo sapiens
tggggtcctggaggggatcc

SEQ ID NO: 7797803 - DNA, 22 bp, Homo sapiens
tggggtcctctcacttggaggg

SEQ ID NO: 7797804 - DNA, 17 bp, Homo sapiens
tggggtccccgatggtg

SEQ ID NO: 7797805 - DNA, 22 bp, Homo sapiens
cctgattagggtctttcaaatg

SEQ ID NO: 7797806 - DNA, 22 bp, Homo sapiens
cctgcagaaagggtccccagga

SEQ ID NO: 7797807 - DNA, 22 bp, Homo sapiens
cctgcaccaggcccagcatggt

SEQ ID NO: 7797808 - DNA, 23 bp, Homo sapiens
cctgaccctgtctccctcacatg

SEQ ID NO: 7797809 - DNA, 22 bp, Homo sapiens
cctgacaggcggaggctgcagt

SEQ ID NO: 7797810 - DNA, 22 bp, Homo sapiens
cctgagaatgtttaacagagaa

SEQ ID NO: 7797811 - DNA, 22 bp, Homo sapiens
cctgacctatttttctcagctg

SEQ ID NO: 7797812 - DNA, 22 bp, Homo sapiens
cctcttggagtctatcattctg

SEQ ID NO: 7797813 - DNA, 18 bp, Homo sapiens
cctgaagcctgtgtcttt

SEQ ID NO: 7797814 - DNA, 23 bp, Homo sapiens
tgggagctcaagggaggctgccc

SEQ ID NO: 7797815 - DNA, 22 bp, Homo sapiens
tgcctgcctctggcagccctgc

SEQ ID NO: 7797816 - DNA, 22 bp, Homo sapiens
tgctttcatattgcctatgact

SEQ ID NO: 7797817 - DNA, 22 bp, Homo sapiens
tgctttcagatatctgtttcaa

SEQ ID NO: 7797818 - DNA, 22 bp, Homo sapiens
tgctttatttataaaatagcaa

SEQ ID NO: 7797819 - DNA, 22 bp, Homo sapiens
tgctttattttaaatatgccat

SEQ ID NO: 7797820 - DNA, 22 bp, Homo sapiens
tgctttattgcatcagtgtggg

SEQ ID NO: 7797821 - DNA, 22 bp, Homo sapiens
tgctttattggaacctcatcct

SEQ ID NO: 7797822 - DNA, 22 bp, Homo sapiens
tggaagggaaagtttggggtcc

SEQ ID NO: 7797823 - DNA, 22 bp, Homo sapiens
tggaagggaacaggtgggtgtt

SEQ ID NO: 7797824 - DNA, 22 bp, Homo sapiens
tggaaagacatgtccttcatta

SEQ ID NO: 7797825 - DNA, 22 bp, Homo sapiens
tggaagaataggatagaagaac

SEQ ID NO: 7797826 - DNA, 22 bp, Homo sapiens
ccctgcagccggccagctcatt

SEQ ID NO: 7797827 - DNA, 20 bp, Homo sapiens
ccctgcagccatgggagtgg

SEQ ID NO: 7797828 - DNA, 22 bp, Homo sapiens
ccctgcagatcagtgagaactt

SEQ ID NO: 7797829 - DNA, 22 bp, Homo sapiens
ccctgcagagggatgggggcag

SEQ ID NO: 7797830 - DNA, 22 bp, Homo sapiens
ccctgcagatctagggtccttc

SEQ ID NO: 7797831 - DNA, 22 bp, Homo sapiens
ccctgcagcattctctaactgg

SEQ ID NO: 7797832 - DNA, 22 bp, Homo sapiens
ccctgcagaaccacagacaaac

SEQ ID NO: 7797833 - DNA, 22 bp, Homo sapiens
ccctgcagaccaatgccataga

SEQ ID NO: 7797834 - DNA, 22 bp, Homo sapiens
ccctgcagacgtcttgatgcct

SEQ ID NO: 7797835 - DNA, 22 bp, Homo sapiens
ccctgcagagaccactgacctt

SEQ ID NO: 7797836 - DNA, 22 bp, Homo sapiens
ccctgcagagccagccctgacc

SEQ ID NO: 7797837 - DNA, 22 bp, Homo sapiens
ccctgcagagagtgcttttgtg

SEQ ID NO: 7797838 - DNA, 22 bp, Homo sapiens
ccctgcacagcctggctctctt

SEQ ID NO: 7797839 - DNA, 22 bp, Homo sapiens
ccctgcagtgtgacctcaccta

SEQ ID NO: 7797840 - DNA, 22 bp, Homo sapiens
ccctgcagtcctttcttggctc

SEQ ID NO: 7797841 - DNA, 22 bp, Homo sapiens
ccctgcctctgaagctgctcag

SEQ ID NO: 7797842 - DNA, 22 bp, Homo sapiens
tggaggtgacggggcctcgttg

SEQ ID NO: 7797843 - DNA, 22 bp, Homo sapiens
tggaggtgagtgtggtacagca

SEQ ID NO: 7797844 - DNA, 22 bp, Homo sapiens
tggaggtgaaatgagattttgt

SEQ ID NO: 7797845 - DNA, 22 bp, Homo sapiens
ccctgccttgttggagcctatg

SEQ ID NO: 7797846 - DNA, 22 bp, Homo sapiens
ccctgccttggggtccacaccg

SEQ ID NO: 7797847 - DNA, 22 bp, Homo sapiens
ccggctactcgggaggctgacg

SEQ ID NO: 7797848 - DNA, 21 bp, Homo sapiens
ccgtgctcggctatggaccac

SEQ ID NO: 7797849 - DNA, 22 bp, Homo sapiens
cctcacccactacactcaaggg

SEQ ID NO: 7797850 - DNA, 22 bp, Homo sapiens
cctcacccagtcacctaggtgg

SEQ ID NO: 7797851 - DNA, 22 bp, Homo sapiens
tggcctcggcatccagcaagag

SEQ ID NO: 7797852 - DNA, 22 bp, Homo sapiens
cctcagctgctgcacagctttt

SEQ ID NO: 7797853 - DNA, 22 bp, Homo sapiens
cctcagctgcttccctggagcc

SEQ ID NO: 7797854 - DNA, 22 bp, Homo sapiens
tggctaacaaggtgaaaccccg

SEQ ID NO: 7797855 - DNA, 22 bp, Homo sapiens
tggctaacaaggtgaaaccccg

SEQ ID NO: 7797856 - DNA, 22 bp, Homo sapiens
tggcctcccctaacagcctctt

SEQ ID NO: 7797857 - DNA, 22 bp, Homo sapiens
tggctacatttatactctcatt

SEQ ID NO: 7797858 - DNA, 22 bp, Homo sapiens
cctccccatgacccggtgctgg

SEQ ID NO: 7797859 - DNA, 22 bp, Homo sapiens
ccacattttgctttgcctaggt

SEQ ID NO: 7797860 - DNA, 22 bp, Homo sapiens
tcgcttgaacccaggaagtgga

SEQ ID NO: 7797861 - DNA, 22 bp, Homo sapiens
tcgggctcgctctcctagcgga

SEQ ID NO: 7797862 - DNA, 22 bp, Homo sapiens
tcctgacccaccaagtctgtaa

SEQ ID NO: 7797863 - DNA, 22 bp, Homo sapiens
tcctgacctcttgctctgacct

SEQ ID NO: 7797864 - DNA, 22 bp, Homo sapiens
tcctgaccacactgccttctgc

SEQ ID NO: 7797865 - DNA, 22 bp, Homo sapiens
ccacatgctcttgttacagtgt

SEQ ID NO: 7797866 - DNA, 22 bp, Homo sapiens
tcctgaagtcacaggctctgag

SEQ ID NO: 7797867 - DNA, 22 bp, Homo sapiens
tcctctccatgtctcacgccac

SEQ ID NO: 7797868 - DNA, 22 bp, Homo sapiens
tctccagaggtcccttgtctct

SEQ ID NO: 7797869 - DNA, 22 bp, Homo sapiens
ccagagagagtactgggctctg

SEQ ID NO: 7797870 - DNA, 22 bp, Homo sapiens
ccagagagattgcttctaaaga

SEQ ID NO: 7797871 - DNA, 22 bp, Homo sapiens
ccagagagagtactgggctctg

SEQ ID NO: 7797872 - DNA, 21 bp, Homo sapiens
ccagagagagggaagtgggtt

SEQ ID NO: 7797873 - DNA, 19 bp, Homo sapiens
ccagagagctaggtacaga

SEQ ID NO: 7797874 - DNA, 22 bp, Homo sapiens
ccagagaggcaaaactccttcc

SEQ ID NO: 7797875 - DNA, 19 bp, Homo sapiens
ccagagagctaggtacaga

SEQ ID NO: 7797876 - DNA, 22 bp, Homo sapiens
ccagagagctacaaggcataaa

SEQ ID NO: 7797877 - DNA, 22 bp, Homo sapiens
ccagagaggccaaggtcgtggt

SEQ ID NO: 7797878 - DNA, 22 bp, Homo sapiens
ccagagaggccttggcaagaca

SEQ ID NO: 7797879 - DNA, 22 bp, Homo sapiens
tctcccacagtctcccatggct

SEQ ID NO: 7797880 - DNA, 22 bp, Homo sapiens
tctccctggagccctgaagcat

SEQ ID NO: 7797881 - DNA, 22 bp, Homo sapiens
tctcaactttgagaaacattgt

SEQ ID NO: 7797882 - DNA, 21 bp, Homo sapiens
tctcaacttttctctttgggc

SEQ ID NO: 7797883 - DNA, 20 bp, Homo sapiens
tctcagtttctagagtcagg

SEQ ID NO: 7797884 - DNA, 22 bp, Homo sapiens
tctctgcagctaagaaattaat

SEQ ID NO: 7797885 - DNA, 22 bp, Homo sapiens
tctcctggccgggctgtcccct

SEQ ID NO: 7797886 - DNA, 22 bp, Homo sapiens
tctcctggcctttaggttaagg

SEQ ID NO: 7797887 - DNA, 22 bp, Homo sapiens
tctcctggctcaccaggctgga

SEQ ID NO: 7797888 - DNA, 17 bp, Homo sapiens
tctcctggctctatcag

SEQ ID NO: 7797889 - DNA, 22 bp, Homo sapiens
tctcctggctctaaaaggctgt

SEQ ID NO: 7797890 - DNA, 23 bp, Homo sapiens
tctcctggctgcactgtggccac

SEQ ID NO: 7797891 - DNA, 22 bp, Homo sapiens
ccagcagggcagtgccctggac

SEQ ID NO: 7797892 - DNA, 22 bp, Homo sapiens
tctgaattaatcatgcctcttt

SEQ ID NO: 7797893 - DNA, 22 bp, Homo sapiens
tctgaattcagtatggtctttc

SEQ ID NO: 7797894 - DNA, 22 bp, Homo sapiens
ccagcatgagacgatgatgaag

SEQ ID NO: 7797895 - DNA, 22 bp, Homo sapiens
ccagcatctatgtgctgttgat

SEQ ID NO: 7797896 - DNA, 22 bp, Homo sapiens
tctgaaatgacctttccccact

SEQ ID NO: 7797897 - DNA, 22 bp, Homo sapiens
tctgaaatgaactcttgaactt

SEQ ID NO: 7797898 - DNA, 20 bp, Homo sapiens
ccagcatgtacacatgtgga

SEQ ID NO: 7797899 - DNA, 22 bp, Homo sapiens
ccagccacagcttccagctcct

SEQ ID NO: 7797900 - DNA, 22 bp, Homo sapiens
ccagcccttagataaacctggc

SEQ ID NO: 7797901 - DNA, 22 bp, Homo sapiens
ccagccctgtcaccaactggag

SEQ ID NO: 7797902 - DNA, 22 bp, Homo sapiens
tcccagccaggctctaccactt

SEQ ID NO: 7797903 - DNA, 22 bp, Homo sapiens
tcccagccacagtttccacctg

SEQ ID NO: 7797904 - DNA, 22 bp, Homo sapiens
cattcattcacattttgtctat

SEQ ID NO: 7797905 - DNA, 22 bp, Homo sapiens
cattcatttactttcaacagct

SEQ ID NO: 7797906 - DNA, 22 bp, Homo sapiens
catgttgaatggccttgatttt

SEQ ID NO: 7797907 - DNA, 22 bp, Homo sapiens
catgtttaattgcgatgtttga

SEQ ID NO: 7797908 - DNA, 22 bp, Homo sapiens
catgtttctgagaaaagtagga

SEQ ID NO: 7797909 - DNA, 22 bp, Homo sapiens
cattatctcagttgaacttatg

SEQ ID NO: 7797910 - DNA, 22 bp, Homo sapiens
cattcataagactttgctcttg

SEQ ID NO: 7797911 - DNA, 22 bp, Homo sapiens
cattgcaacttcaaactcctgg

SEQ ID NO: 7797912 - DNA, 22 bp, Homo sapiens
tcccagggtcctcttctggaat

SEQ ID NO: 7797913 - DNA, 22 bp, Homo sapiens
tccccagcattgagggtctctc

SEQ ID NO: 7797914 - DNA, 22 bp, Homo sapiens
tcctcaggatctaggagtgctt

SEQ ID NO: 7797915 - DNA, 22 bp, Homo sapiens
catttgtagtatctgtttatat

SEQ ID NO: 7797916 - DNA, 22 bp, Homo sapiens
tcattcttgatcactagttagt

SEQ ID NO: 7797917 - DNA, 22 bp, Homo sapiens
tcattcttgcgtatgccatggt

SEQ ID NO: 7797918 - DNA, 22 bp, Homo sapiens
tcattctttaccaagttgtcac

SEQ ID NO: 7797919 - DNA, 22 bp, Homo sapiens
tcattccctcattgttcactgg

SEQ ID NO: 7797920 - DNA, 22 bp, Homo sapiens
tccagaccatggatggctgcaa

SEQ ID NO: 7797921 - DNA, 22 bp, Homo sapiens
tccagaccatgtgagaggcgca

SEQ ID NO: 7797922 - DNA, 22 bp, Homo sapiens
tccagacccatgaccctgggga

SEQ ID NO: 7797923 - DNA, 20 bp, Homo sapiens
tcattccaaatagttcagca

SEQ ID NO: 7797924 - DNA, 23 bp, Homo sapiens
tcattccacaaatacttatctag

SEQ ID NO: 7797925 - DNA, 22 bp, Homo sapiens
tcattcatcagttggtagagat

SEQ ID NO: 7797926 - DNA, 22 bp, Homo sapiens
tcattcatgaggtgctagtgct

SEQ ID NO: 7797927 - DNA, 22 bp, Homo sapiens
catgaaaaatttactgttaaca

SEQ ID NO: 7797928 - DNA, 22 bp, Homo sapiens
catcttttggcctattctgagg

SEQ ID NO: 7797929 - DNA, 22 bp, Homo sapiens
tcatgattcttctaccacagca

SEQ ID NO: 7797930 - DNA, 22 bp, Homo sapiens
tcatgatttttctttacagttg

SEQ ID NO: 7797931 - DNA, 22 bp, Homo sapiens
tccagactctgtcacttcctag

SEQ ID NO: 7797932 - DNA, 22 bp, Homo sapiens
tccagacctagggcaccccagt

SEQ ID NO: 7797933 - DNA, 22 bp, Homo sapiens
tccagactcactcatgtgacta

SEQ ID NO: 7797934 - DNA, 21 bp, Homo sapiens
tccagacctccctctcctagc

SEQ ID NO: 7797935 - DNA, 23 bp, Homo sapiens
tccagactctaaagccctccaca

SEQ ID NO: 7797936 - DNA, 22 bp, Homo sapiens
tccagactgccctgcacatgtg

SEQ ID NO: 7797937 - DNA, 22 bp, Homo sapiens
tccagactggggccatgtctgc

SEQ ID NO: 7797938 - DNA, 22 bp, Homo sapiens
tccagactgttcacattggcat

SEQ ID NO: 7797939 - DNA, 19 bp, Homo sapiens
tccagactgtccaggctat

SEQ ID NO: 7797940 - DNA, 22 bp, Homo sapiens
tccagagagaaaaacaagcttt

SEQ ID NO: 7797941 - DNA, 20 bp, Homo sapiens
tccaggcagctcagagtgtc

SEQ ID NO: 7797942 - DNA, 22 bp, Homo sapiens
tccaggcagcccttcctgactc

SEQ ID NO: 7797943 - DNA, 20 bp, Homo sapiens
tccaggcagctcagagtgtc

SEQ ID NO: 7797944 - DNA, 22 bp, Homo sapiens
tccaggcccgagatgggctgga

SEQ ID NO: 7797945 - DNA, 22 bp, Homo sapiens
catgtgtttcgagactgttgag

SEQ ID NO: 7797946 - DNA, 22 bp, Homo sapiens
tccaggctccctcaggatgcac

SEQ ID NO: 7797947 - DNA, 22 bp, Homo sapiens
tccaggctcccctgcgtgctcc

SEQ ID NO: 7797948 - DNA, 22 bp, Homo sapiens
tcacagctttcagattgttccc

SEQ ID NO: 7797949 - DNA, 22 bp, Homo sapiens
cagtgaggaagctgtctggacc

SEQ ID NO: 7797950 - DNA, 22 bp, Homo sapiens
tatttcttttcgtgacttattg

SEQ ID NO: 7797951 - DNA, 22 bp, Homo sapiens
tcacaaatattttaacagtagg

SEQ ID NO: 7797952 - DNA, 22 bp, Homo sapiens
tcacaagaatttgtagatgaaa

SEQ ID NO: 7797953 - DNA, 22 bp, Homo sapiens
tcacaactctttccatttaata

SEQ ID NO: 7797954 - DNA, 22 bp, Homo sapiens
tatttcatctggaacaaggtaa

SEQ ID NO: 7797955 - DNA, 22 bp, Homo sapiens
tatttcattctttatcaggagc

SEQ ID NO: 7797956 - DNA, 22 bp, Homo sapiens
tatttcagggggtacaagaaga

SEQ ID NO: 7797957 - DNA, 22 bp, Homo sapiens
caggttctgaggatggtgcctg

SEQ ID NO: 7797958 - DNA, 22 bp, Homo sapiens
caggttctcagaaggcagtcac

SEQ ID NO: 7797959 - DNA, 22 bp, Homo sapiens
caggttctatactgaataattt

SEQ ID NO: 7797960 - DNA, 22 bp, Homo sapiens
caggttcttaacttgttcttcc

SEQ ID NO: 7797961 - DNA, 22 bp, Homo sapiens
caggttctggggctccactgtg

SEQ ID NO: 7797962 - DNA, 22 bp, Homo sapiens
caggttctgggtcctgggtcct

SEQ ID NO: 7797963 - DNA, 22 bp, Homo sapiens
caggtttacaaagtaaagtgtg

SEQ ID NO: 7797964 - DNA, 22 bp, Homo sapiens
caggttggtattcatctccaca

SEQ ID NO: 7797965 - DNA, 22 bp, Homo sapiens
caggttggggacttaggatgac

SEQ ID NO: 7797966 - DNA, 22 bp, Homo sapiens
caggttggtcggcaagtacaca

SEQ ID NO: 7797967 - DNA, 22 bp, Homo sapiens
caggtggtcaggcagatgggct

SEQ ID NO: 7797968 - DNA, 22 bp, Homo sapiens
tatttctttcaggtatgtgttg

SEQ ID NO: 7797969 - DNA, 22 bp, Homo sapiens
tcagctttgggggtctcaggag

SEQ ID NO: 7797970 - DNA, 22 bp, Homo sapiens
tcagctttgggggtctcaggag

SEQ ID NO: 7797971 - DNA, 22 bp, Homo sapiens
tcagctttgcaagttagaaaat

SEQ ID NO: 7797972 - DNA, 22 bp, Homo sapiens
tcagctttgccaccagctgtaa

SEQ ID NO: 7797973 - DNA, 22 bp, Homo sapiens
tcagcttttaaaaacaagaagt

SEQ ID NO: 7797974 - DNA, 22 bp, Homo sapiens
tcagctttggtcacattgagtt

SEQ ID NO: 7797975 - DNA, 18 bp, Homo sapiens
tcagcttttgaaaaccaa

SEQ ID NO: 7797976 - DNA, 18 bp, Homo sapiens
tcagcttttgaaaaccaa

SEQ ID NO: 7797977 - DNA, 22 bp, Homo sapiens
tcagcttttaaaaacaagaagt

SEQ ID NO: 7797978 - DNA, 22 bp, Homo sapiens
tcagctttgatctcaggcaatc

SEQ ID NO: 7797979 - DNA, 21 bp, Homo sapiens
tcagctttgcaactgcacatc

SEQ ID NO: 7797980 - DNA, 22 bp, Homo sapiens
tcagctttgcaagttagaaaat

SEQ ID NO: 7797981 - DNA, 22 bp, Homo sapiens
tcagctttctcttctatcgata

SEQ ID NO: 7797982 - DNA, 22 bp, Homo sapiens
tcagctttgatctcaggcaatc

SEQ ID NO: 7797983 - DNA, 22 bp, Homo sapiens
cagtttatagctctagcagctt

SEQ ID NO: 7797984 - DNA, 22 bp, Homo sapiens
cataaattcagttctgcctctt

SEQ ID NO: 7797985 - DNA, 22 bp, Homo sapiens
cataaattgtacccattccaac

SEQ ID NO: 7797986 - DNA, 22 bp, Homo sapiens
tcagcttttgtcagaaattgta

SEQ ID NO: 7797987 - DNA, 22 bp, Homo sapiens
tcagctttttacatgtgaaata

SEQ ID NO: 7797988 - DNA, 22 bp, Homo sapiens
tcagctttttggattgcccaag

SEQ ID NO: 7797989 - DNA, 22 bp, Homo sapiens
tcagctttttacatgtgaaata

SEQ ID NO: 7797990 - DNA, 22 bp, Homo sapiens
cagttaccatcttcagtgatga

SEQ ID NO: 7797991 - DNA, 22 bp, Homo sapiens
cagttaaacgggccatgtgagt

SEQ ID NO: 7797992 - DNA, 22 bp, Homo sapiens
cagttaaagctgcatgtgtcag

SEQ ID NO: 7797993 - DNA, 22 bp, Homo sapiens
cagttaaagtgcttatcacaga

SEQ ID NO: 7797994 - DNA, 22 bp, Homo sapiens
cagttaaatttggctgttttct

SEQ ID NO: 7797995 - DNA, 22 bp, Homo sapiens
tcagactgctgtccctgcctgg

SEQ ID NO: 7797996 - DNA, 22 bp, Homo sapiens
tcagactgcttagctcccagta

SEQ ID NO: 7797997 - DNA, 22 bp, Homo sapiens
tcagagaaatgaagtagggatt

SEQ ID NO: 7797998 - DNA, 22 bp, Homo sapiens
cagtgtctccagatgctccaat

SEQ ID NO: 7797999 - DNA, 22 bp, Homo sapiens
cagtgtctgggacagaaagtca

SEQ ID NO: 7798000 - DNA, 22 bp, Homo sapiens
cagtgtctttcagactcagaaa

SEQ ID NO: 7798001 - DNA, 22 bp, Homo sapiens
cagtgtttgcttaagttatatg

SEQ ID NO: 7798002 - DNA, 22 bp, Homo sapiens
cagttaaaagaagtctatctta

SEQ ID NO: 7798003 - DNA, 22 bp, Homo sapiens
cagttaaaatgtgctataagaa

SEQ ID NO: 7798004 - DNA, 22 bp, Homo sapiens
cagtggctggttagggacagga

SEQ ID NO: 7798005 - DNA, 22 bp, Homo sapiens
cagtggcttctcatgtcattca

SEQ ID NO: 7798006 - DNA, 22 bp, Homo sapiens
cagtgccacttaatgaggctgc

SEQ ID NO: 7798007 - DNA, 22 bp, Homo sapiens
cagtgggattgggattggaacc

SEQ ID NO: 7798008 - DNA, 22 bp, Homo sapiens
cagtgggggggccatgctgcag

SEQ ID NO: 7798009 - DNA, 22 bp, Homo sapiens
cagtgggtaaataagtgggtaa

SEQ ID NO: 7798010 - DNA, 22 bp, Homo sapiens
tagagctggaaaactgcaggta

SEQ ID NO: 7798011 - DNA, 22 bp, Homo sapiens
tagataaaagggcaaagggcat

SEQ ID NO: 7798012 - DNA, 22 bp, Homo sapiens
tagataaaagggcaaagggcat

SEQ ID NO: 7798013 - DNA, 22 bp, Homo sapiens
tagataaattagaaagtttact

SEQ ID NO: 7798014 - DNA, 22 bp, Homo sapiens
caggctgggcagcctccccggc

SEQ ID NO: 7798015 - DNA, 22 bp, Homo sapiens
caggctgggctccggagataaa

SEQ ID NO: 7798016 - DNA, 22 bp, Homo sapiens
cagggcacggagaagtcacccc

SEQ ID NO: 7798017 - DNA, 22 bp, Homo sapiens
cagggatggcgctggctgcccg

SEQ ID NO: 7798018 - DNA, 22 bp, Homo sapiens
tagataaattagaaagtttact

SEQ ID NO: 7798019 - DNA, 22 bp, Homo sapiens
tagcaagtagatactcatttag

SEQ ID NO: 7798020 - DNA, 22 bp, Homo sapiens
tagaacataagtcattcatttg

SEQ ID NO: 7798021 - DNA, 22 bp, Homo sapiens
caggctggagtgcagtggggcg

SEQ ID NO: 7798022 - DNA, 22 bp, Homo sapiens
caggctggagtgcagtggcgct

SEQ ID NO: 7798023 - DNA, 22 bp, Homo sapiens
caggctggagtgcagtggcgcc

SEQ ID NO: 7798024 - DNA, 22 bp, Homo sapiens
caggctggagtgcaatggcaca

SEQ ID NO: 7798025 - DNA, 22 bp, Homo sapiens
caggctggagtgcaatgacgcc

SEQ ID NO: 7798026 - DNA, 22 bp, Homo sapiens
tactgtatttgataagtgaagt

SEQ ID NO: 7798027 - DNA, 22 bp, Homo sapiens
tactcagtttatgatttcaagt

SEQ ID NO: 7798028 - DNA, 22 bp, Homo sapiens
taggtacagctaaaaattatct

SEQ ID NO: 7798029 - DNA, 22 bp, Homo sapiens
taggtagatacatgtgttggct

SEQ ID NO: 7798030 - DNA, 22 bp, Homo sapiens
cagggctttcctgagaagtgat

SEQ ID NO: 7798031 - DNA, 22 bp, Homo sapiens
tagggacaaagagctgaggcct

SEQ ID NO: 7798032 - DNA, 22 bp, Homo sapiens
cagggctcatctgtgtgaccag

SEQ ID NO: 7798033 - DNA, 22 bp, Homo sapiens
tagggctcagagaagtggggcc

SEQ ID NO: 7798034 - DNA, 22 bp, Homo sapiens
tagggctcactgagatgaatat

SEQ ID NO: 7798035 - DNA, 22 bp, Homo sapiens
tagggtacatgtgcacaacatg

SEQ ID NO: 7798036 - DNA, 22 bp, Homo sapiens
tagggctccactcccagagatt

SEQ ID NO: 7798037 - DNA, 20 bp, Homo sapiens
tagggctcattatgatctcc

SEQ ID NO: 7798038 - DNA, 22 bp, Homo sapiens
tagggctcagctctagctcctg

SEQ ID NO: 7798039 - DNA, 22 bp, Homo sapiens
tagggctcagagtccagtttct

SEQ ID NO: 7798040 - DNA, 18 bp, Homo sapiens
tagggctctagggagtga

SEQ ID NO: 7798041 - DNA, 22 bp, Homo sapiens
tagggctcgggcacaggacagg

SEQ ID NO: 7798042 - DNA, 22 bp, Homo sapiens
tatcatgtccctaaagagagga

SEQ ID NO: 7798043 - DNA, 22 bp, Homo sapiens
tagtgaaagtcaaagacagcta

SEQ ID NO: 7798044 - DNA, 22 bp, Homo sapiens
tagtgaaatgataacagagcag

SEQ ID NO: 7798045 - DNA, 22 bp, Homo sapiens
tagtcttaagtaattcatggaa

SEQ ID NO: 7798046 - DNA, 22 bp, Homo sapiens
tagctattttgcttggaaatac

SEQ ID NO: 7798047 - DNA, 22 bp, Homo sapiens
tagctcaaaggttaagtgtgga

SEQ ID NO: 7798048 - DNA, 22 bp, Homo sapiens
tagctatttggaaaattccaat

SEQ ID NO: 7798049 - DNA, 22 bp, Homo sapiens
tagctatttagcccagataagt

SEQ ID NO: 7798050 - DNA, 22 bp, Homo sapiens
tagctattgttggtagttaccc

SEQ ID NO: 7798051 - DNA, 22 bp, Homo sapiens
taggaaattctcttgctaagtt

SEQ ID NO: 7798052 - DNA, 22 bp, Homo sapiens
taggaaattgccaatatatgac

SEQ ID NO: 7798053 - DNA, 22 bp, Homo sapiens
taggaaattgccaatatatgac

SEQ ID NO: 7798054 - DNA, 22 bp, Homo sapiens
tagctttaataagctgctgaat

SEQ ID NO: 7798055 - DNA, 22 bp, Homo sapiens
tagctttaagatgagatgtgga

SEQ ID NO: 7798056 - DNA, 22 bp, Homo sapiens
taggaaatttgaaatatgtggg

SEQ ID NO: 7798057 - DNA, 22 bp, Homo sapiens
cagggctcaggctctgggattc

SEQ ID NO: 7798058 - DNA, 22 bp, Homo sapiens
cagggctcaggaaatcagacgt

SEQ ID NO: 7798059 - DNA, 22 bp, Homo sapiens
cagggctcagggactgcagaaa

SEQ ID NO: 7798060 - DNA, 22 bp, Homo sapiens
cagggctagtgacaccccagtc

SEQ ID NO: 7798061 - DNA, 22 bp, Homo sapiens
cagggctcactcggctggcgtc

SEQ ID NO: 7798062 - DNA, 22 bp, Homo sapiens
cagggctcaccactgggatcct

SEQ ID NO: 7798063 - DNA, 22 bp, Homo sapiens
cagggctcagaagacagacctc

SEQ ID NO: 7798064 - DNA, 22 bp, Homo sapiens
tttcaagactcattgagtattg

SEQ ID NO: 7798065 - DNA, 22 bp, Homo sapiens
tttcaagaacagcagcattcca

SEQ ID NO: 7798066 - DNA, 22 bp, Homo sapiens
tttcaagaattgaagaggattt

SEQ ID NO: 7798067 - DNA, 22 bp, Homo sapiens
tttcaacaggatgataataggc

SEQ ID NO: 7798068 - DNA, 22 bp, Homo sapiens
tttcacaatgcaatcctacttc

SEQ ID NO: 7798069 - DNA, 22 bp, Homo sapiens
tttcacagaaaggataacatta

SEQ ID NO: 7798070 - DNA, 22 bp, Homo sapiens
tttattctgtgctacatgaaga

SEQ ID NO: 7798071 - DNA, 23 bp, Homo sapiens
tttcaacaatgcttagagaaaac

SEQ ID NO: 7798072 - DNA, 22 bp, Homo sapiens
tttcaacaccagagaccatgcg

SEQ ID NO: 7798073 - DNA, 22 bp, Homo sapiens
tttattgacccaaagcgagagt

SEQ ID NO: 7798074 - DNA, 22 bp, Homo sapiens
tttcacagcttccacttaagga

SEQ ID NO: 7798075 - DNA, 23 bp, Homo sapiens
tttcacagcttttattctgcatc

SEQ ID NO: 7798076 - DNA, 22 bp, Homo sapiens
tttcacagctgggtggcagagt

SEQ ID NO: 7798077 - DNA, 22 bp, Homo sapiens
tttcagactccaaattcataag

SEQ ID NO: 7798078 - DNA, 19 bp, Homo sapiens
tttcagacatttcaaattt

SEQ ID NO: 7798079 - DNA, 22 bp, Homo sapiens
tttcagacctgctgtgctatct

SEQ ID NO: 7798080 - DNA, 22 bp, Homo sapiens
tttcatgagattcctccacatc

SEQ ID NO: 7798081 - DNA, 22 bp, Homo sapiens
tttcatgtatttcccaaagctt

SEQ ID NO: 7798082 - DNA, 22 bp, Homo sapiens
tttcatgtggcgatgtctctgg

SEQ ID NO: 7798083 - DNA, 22 bp, Homo sapiens
tttcattatacagcttcataaa

SEQ ID NO: 7798084 - DNA, 21 bp, Homo sapiens
tttcattgaatgagataaggt

SEQ ID NO: 7798085 - DNA, 22 bp, Homo sapiens
tttaagctaatgtcataattag

SEQ ID NO: 7798086 - DNA, 22 bp, Homo sapiens
tttaagctgtggcattaattct

SEQ ID NO: 7798087 - DNA, 22 bp, Homo sapiens
tttaatcttcaaaatagtctta

SEQ ID NO: 7798088 - DNA, 22 bp, Homo sapiens
tttaagtcatggagaattgtgg

SEQ ID NO: 7798089 - DNA, 22 bp, Homo sapiens
tttaatgtgacatcttttagag

SEQ ID NO: 7798090 - DNA, 22 bp, Homo sapiens
tttaatgtattctttggaacca

SEQ ID NO: 7798091 - DNA, 19 bp, Homo sapiens
tttacagggaatggagacc

SEQ ID NO: 7798092 - DNA, 22 bp, Homo sapiens
tttacagtaaggtggatggtac

SEQ ID NO: 7798093 - DNA, 22 bp, Homo sapiens
tttacagggttcaagaatgaaa

SEQ ID NO: 7798094 - DNA, 22 bp, Homo sapiens
tttaaagtttttgcacattctg

SEQ ID NO: 7798095 - DNA, 19 bp, Homo sapiens
tttaaagtgactggtattt

SEQ ID NO: 7798096 - DNA, 22 bp, Homo sapiens
tttaaagtgctgctcctatcct

SEQ ID NO: 7798097 - DNA, 22 bp, Homo sapiens
tttaaatgttcatgatactgaa

SEQ ID NO: 7798098 - DNA, 22 bp, Homo sapiens
ttgtgtgtagactcagccattg

SEQ ID NO: 7798099 - DNA, 22 bp, Homo sapiens
tttaaagagaatgtgaaggagt

SEQ ID NO: 7798100 - DNA, 17 bp, Homo sapiens
tttaaactactacaagg

SEQ ID NO: 7798101 - DNA, 22 bp, Homo sapiens
tttatctgaatatgctccccac

SEQ ID NO: 7798102 - DNA, 22 bp, Homo sapiens
tttatcagaagttagagaaaga

SEQ ID NO: 7798103 - DNA, 22 bp, Homo sapiens
tttagcatcgaagtaaatttag

SEQ ID NO: 7798104 - DNA, 22 bp, Homo sapiens
tttagcagtgaagtgaagtgaa

SEQ ID NO: 7798105 - DNA, 22 bp, Homo sapiens
tttagcacggtaacacataaag

SEQ ID NO: 7798106 - DNA, 22 bp, Homo sapiens
tttatattgggagtcgttttga

SEQ ID NO: 7798107 - DNA, 20 bp, Homo sapiens
tttacattttgaaacagtga

SEQ ID NO: 7798108 - DNA, 20 bp, Homo sapiens
tttacattttgaaacagtga

SEQ ID NO: 7798109 - DNA, 22 bp, Homo sapiens
tttaccaaatagattatgtcag

SEQ ID NO: 7798110 - DNA, 22 bp, Homo sapiens
tttacagtctgtctagcaatgt

SEQ ID NO: 7798111 - DNA, 19 bp, Homo sapiens
ttgctcccaccccagtttt

SEQ ID NO: 7798112 - DNA, 22 bp, Homo sapiens
ttgcattccatggttttccttc

SEQ ID NO: 7798113 - DNA, 22 bp, Homo sapiens
ttgcattgtaggatgttagaag

SEQ ID NO: 7798114 - DNA, 22 bp, Homo sapiens
ttggaaacgtcaccttttcctt

SEQ ID NO: 7798115 - DNA, 22 bp, Homo sapiens
ttggaaaatgaggcacagagag

SEQ ID NO: 7798116 - DNA, 22 bp, Homo sapiens
ttggaaaatgtatttctagaag

SEQ ID NO: 7798117 - DNA, 22 bp, Homo sapiens
ttggaacacagcagctgatttt

SEQ ID NO: 7798118 - DNA, 22 bp, Homo sapiens
ttggaattgaggatttacatag

SEQ ID NO: 7798119 - DNA, 22 bp, Homo sapiens
ttggaattttccaggtacagtg

SEQ ID NO: 7798120 - DNA, 22 bp, Homo sapiens
ttggaatttgcttcagctaata

SEQ ID NO: 7798121 - DNA, 22 bp, Homo sapiens
ttggaatttgagaccaagaaaa

SEQ ID NO: 7798122 - DNA, 22 bp, Homo sapiens
ttggaaagtttttactgaagac

SEQ ID NO: 7798123 - DNA, 21 bp, Homo sapiens
ttggaacaagcagcagtttgc

SEQ ID NO: 7798124 - DNA, 22 bp, Homo sapiens
ttggagagatttaggtctcagt

SEQ ID NO: 7798125 - DNA, 23 bp, Homo sapiens
ttggagagggtgagtagtgtcag

SEQ ID NO: 7798126 - DNA, 17 bp, Homo sapiens
ttgggagagaaaggtat

SEQ ID NO: 7798127 - DNA, 22 bp, Homo sapiens
ttgggaagaatggaggtggtta

SEQ ID NO: 7798128 - DNA, 22 bp, Homo sapiens
ttgggaagtttaatgacagact

SEQ ID NO: 7798129 - DNA, 22 bp, Homo sapiens
ttgtatttcgatgcacgtgtag

SEQ ID NO: 7798130 - DNA, 22 bp, Homo sapiens
ttgtacaagttttgagcttaag

SEQ ID NO: 7798131 - DNA, 22 bp, Homo sapiens
ttgtaagtcacaccagggcagg

SEQ ID NO: 7798132 - DNA, 22 bp, Homo sapiens
ttgtcattggggttatttgtta

SEQ ID NO: 7798133 - DNA, 22 bp, Homo sapiens
ttgtcctgcaacctcacatggc

SEQ ID NO: 7798134 - DNA, 22 bp, Homo sapiens
ttgtcctggaggttaatagagt

SEQ ID NO: 7798135 - DNA, 23 bp, Homo sapiens
ttgtccagctggtttgggccaca

SEQ ID NO: 7798136 - DNA, 22 bp, Homo sapiens
ttgtccagagccaggctgtcgg

SEQ ID NO: 7798137 - DNA, 21 bp, Homo sapiens
ttgtgtccttctaaagggcca

SEQ ID NO: 7798138 - DNA, 22 bp, Homo sapiens
ttctctaggttttagatgaaga

SEQ ID NO: 7798139 - DNA, 22 bp, Homo sapiens
ttctctgaaggccatgctcact

SEQ ID NO: 7798140 - DNA, 22 bp, Homo sapiens
ttctctgatcttgctagactga

SEQ ID NO: 7798141 - DNA, 22 bp, Homo sapiens
ttctctgacccccttaaatatt

SEQ ID NO: 7798142 - DNA, 22 bp, Homo sapiens
ttctctgagatagactaagtgg

SEQ ID NO: 7798143 - DNA, 22 bp, Homo sapiens
ttctccaaggttcatatttatc

SEQ ID NO: 7798144 - DNA, 22 bp, Homo sapiens
ttccttgtaagacctatttttg

SEQ ID NO: 7798145 - DNA, 21 bp, Homo sapiens
ttctcagatcgagtagtgaga

SEQ ID NO: 7798146 - DNA, 22 bp, Homo sapiens
ttcctggtttatacctgtatca

SEQ ID NO: 7798147 - DNA, 22 bp, Homo sapiens
ttcctggttggattctgattaa

SEQ ID NO: 7798148 - DNA, 22 bp, Homo sapiens
ttcctggtttatggaaagcatg

SEQ ID NO: 7798149 - DNA, 22 bp, Homo sapiens
ttcctggtttgcctggaatcca

SEQ ID NO: 7798150 - DNA, 22 bp, Homo sapiens
ttcctggtggtggtgacagcac

SEQ ID NO: 7798151 - DNA, 22 bp, Homo sapiens
ttcctggtggctttgccaactg

SEQ ID NO: 7798152 - DNA, 22 bp, Homo sapiens
ttcctggtgacctcactggtag

SEQ ID NO: 7798153 - DNA, 22 bp, Homo sapiens
ttcctggtctatttagaattgc

SEQ ID NO: 7798154 - DNA, 22 bp, Homo sapiens
ttcctggtagtaagacatctgg

SEQ ID NO: 7798155 - DNA, 22 bp, Homo sapiens
ttcctggtaaattatgtccagg

SEQ ID NO: 7798156 - DNA, 23 bp, Homo sapiens
ttcctgagtgctggagagagtgc

SEQ ID NO: 7798157 - DNA, 22 bp, Homo sapiens
ttcctgagtcgccgagtctatg

SEQ ID NO: 7798158 - DNA, 22 bp, Homo sapiens
ttcctgaggaggaccaggacca

SEQ ID NO: 7798159 - DNA, 22 bp, Homo sapiens
ttcctgaggctcatcggagtcg

SEQ ID NO: 7798160 - DNA, 22 bp, Homo sapiens
ttcctgagggccccagaggagg

SEQ ID NO: 7798161 - DNA, 22 bp, Homo sapiens
ttcctgagggacttttgagatt

SEQ ID NO: 7798162 - DNA, 22 bp, Homo sapiens
ttcctgaattgagctttagaaa

SEQ ID NO: 7798163 - DNA, 22 bp, Homo sapiens
ttcctgaatgctgttgtgctgt

SEQ ID NO: 7798164 - DNA, 22 bp, Homo sapiens
ttcctgaatcccaaggagagct

SEQ ID NO: 7798165 - DNA, 22 bp, Homo sapiens
ttcctgagaacatggcagctta

SEQ ID NO: 7798166 - DNA, 22 bp, Homo sapiens
ttcctggctcacagcagtgggg

SEQ ID NO: 7798167 - DNA, 22 bp, Homo sapiens
ttcctggctcacagcagtgggg

SEQ ID NO: 7798168 - DNA, 22 bp, Homo sapiens
ttcctggcctaaggtaggtgac

SEQ ID NO: 7798169 - DNA, 22 bp, Homo sapiens
ttcctggcctaaggtaggtgac

SEQ ID NO: 7798170 - DNA, 22 bp, Homo sapiens
ttcctggcctctctctgagcag

SEQ ID NO: 7798171 - DNA, 22 bp, Homo sapiens
ttcctggcgccacggagccggt

SEQ ID NO: 7798172 - DNA, 22 bp, Homo sapiens
ttcctggcgccacggagccggt

SEQ ID NO: 7798173 - DNA, 21 bp, Homo sapiens
ttcctggcggcagaaacgtga

SEQ ID NO: 7798174 - DNA, 22 bp, Homo sapiens
ttcctggcctcttccaccacca

SEQ ID NO: 7798175 - DNA, 22 bp, Homo sapiens
ttcctggcatagagagggcaca

SEQ ID NO: 7798176 - DNA, 22 bp, Homo sapiens
ttcctggcatagagagggcaca

SEQ ID NO: 7798177 - DNA, 22 bp, Homo sapiens
ttcctggcatgaaaaatatcac

SEQ ID NO: 7798178 - DNA, 22 bp, Homo sapiens
ttcctggcattatgggaggctg

SEQ ID NO: 7798179 - DNA, 22 bp, Homo sapiens
ttcctggcagaggccccgacag

SEQ ID NO: 7798180 - DNA, 22 bp, Homo sapiens
ttcctggcagaggccccgacag

SEQ ID NO: 7798181 - DNA, 23 bp, Homo sapiens
ttcctggcaggtacaacttttac

SEQ ID NO: 7798182 - DNA, 22 bp, Homo sapiens
ttcctggcacccttgttagcct

SEQ ID NO: 7798183 - DNA, 22 bp, Homo sapiens
ttcctggcactgcagtggttga

SEQ ID NO: 7798184 - DNA, 22 bp, Homo sapiens
ttcctggccaagcagagtggaa

SEQ ID NO: 7798185 - DNA, 22 bp, Homo sapiens
ttcctggccaagcagagtggaa

SEQ ID NO: 7798186 - DNA, 22 bp, Homo sapiens
ttcctggccccacccctggaga

SEQ ID NO: 7798187 - DNA, 22 bp, Homo sapiens
ttcctggccccacccctggaga

SEQ ID NO: 7798188 - DNA, 22 bp, Homo sapiens
ttcctggccccatccatcttca

SEQ ID NO: 7798189 - DNA, 22 bp, Homo sapiens
ttcctggccagctgtggtgagt

SEQ ID NO: 7798190 - DNA, 22 bp, Homo sapiens
ttcctggcaaagtgagcatcac

SEQ ID NO: 7798191 - DNA, 22 bp, Homo sapiens
ttcctggcacactcctgaatgt

SEQ ID NO: 7798192 - DNA, 22 bp, Homo sapiens
ttcctggcaccctggacccggc

SEQ ID NO: 7798193 - DNA, 22 bp, Homo sapiens
ttcctggcaccaccacttctag

SEQ ID NO: 7798194 - DNA, 22 bp, Homo sapiens
ttcctggcacatagttagtgct

SEQ ID NO: 7798195 - DNA, 22 bp, Homo sapiens
ttcctggaaattatgctcacct

SEQ ID NO: 7798196 - DNA, 22 bp, Homo sapiens
ttcctgcccctgagagctccca

SEQ ID NO: 7798197 - DNA, 22 bp, Homo sapiens
ttcttttaatgtctggctttca

SEQ ID NO: 7798198 - DNA, 22 bp, Homo sapiens
ttcttttaaaagagagcagaaa

SEQ ID NO: 7798199 - DNA, 22 bp, Homo sapiens
ttcttttcttggcaggagtaga

SEQ ID NO: 7798200 - DNA, 17 bp, Homo sapiens
ttcttttctgagccttg

SEQ ID NO: 7798201 - DNA, 22 bp, Homo sapiens
ttcttttaatgttctgaagttt

SEQ ID NO: 7798202 - DNA, 22 bp, Homo sapiens
ttctttgttgtactttcctaca

SEQ ID NO: 7798203 - DNA, 22 bp, Homo sapiens
ttctttgttgtactttcctaca

SEQ ID NO: 7798204 - DNA, 20 bp, Homo sapiens
ttctttgttccttacatttg

SEQ ID NO: 7798205 - DNA, 20 bp, Homo sapiens
ttctttgttccttacatttg

SEQ ID NO: 7798206 - DNA, 22 bp, Homo sapiens
ttcttcaaccatctacataaac

SEQ ID NO: 7798207 - DNA, 22 bp, Homo sapiens
ttcttcagactactgatgattg

SEQ ID NO: 7798208 - DNA, 22 bp, Homo sapiens
ttcttattatgtgctctgtgaa

SEQ ID NO: 7798209 - DNA, 19 bp, Homo sapiens
ttgaaattgtttgatatgg

SEQ ID NO: 7798210 - DNA, 19 bp, Homo sapiens
ttgaaattgtttgatatgg

SEQ ID NO: 7798211 - DNA, 23 bp, Homo sapiens
ttgaatttctcttgcaatattta

SEQ ID NO: 7798212 - DNA, 22 bp, Homo sapiens
ttcttttgcaagactattgatt

SEQ ID NO: 7798213 - DNA, 22 bp, Homo sapiens
ttcttttggactcaaagagaac

SEQ ID NO: 7798214 - DNA, 22 bp, Homo sapiens
ttcttttctttaggcattgtgt

SEQ ID NO: 7798215 - DNA, 22 bp, Homo sapiens
ttctttttaaagtgtgtatgca

SEQ ID NO: 7798216 - DNA, 22 bp, Homo sapiens
ttgaaatgagcaaactgtcagc

SEQ ID NO: 7798217 - DNA, 22 bp, Homo sapiens
ttgaaatcaccactagcatttg

SEQ ID NO: 7798218 - DNA, 22 bp, Homo sapiens
ttctgtgttgtgacattctaga

SEQ ID NO: 7798219 - DNA, 22 bp, Homo sapiens
ttcttagtggtagtcatctttg

SEQ ID NO: 7798220 - DNA, 22 bp, Homo sapiens
ttctgtctctgtgtttacatta

SEQ ID NO: 7798221 - DNA, 22 bp, Homo sapiens
ttctgtcttctcggttgtttac

SEQ ID NO: 7798222 - DNA, 22 bp, Homo sapiens
ttctgtcttcccactgaggagc

SEQ ID NO: 7798223 - DNA, 22 bp, Homo sapiens
ttctgtcttctcggttgtttac

SEQ ID NO: 7798224 - DNA, 23 bp, Homo sapiens
ttctgtcttgctgtcagctttct

SEQ ID NO: 7798225 - DNA, 22 bp, Homo sapiens
ttctgtctgtaaacttctcaat

SEQ ID NO: 7798226 - DNA, 22 bp, Homo sapiens
ttctgtgattcctccagccagc

SEQ ID NO: 7798227 - DNA, 22 bp, Homo sapiens
ttctgtgaggacttctcaagga

SEQ ID NO: 7798228 - DNA, 22 bp, Homo sapiens
ttctgtgactcctcagagattt

SEQ ID NO: 7798229 - DNA, 22 bp, Homo sapiens
ttctgtgtcttcttgttctgtg

SEQ ID NO: 7798230 - DNA, 22 bp, Homo sapiens
ttcagtttcaaatcctgtgaag

SEQ ID NO: 7798231 - DNA, 22 bp, Homo sapiens
ttcagtgtggtgcacagttttg

SEQ ID NO: 7798232 - DNA, 22 bp, Homo sapiens
ttcagttccatttcaggtgggt

SEQ ID NO: 7798233 - DNA, 22 bp, Homo sapiens
ttcagttccatttcaggtgggt

SEQ ID NO: 7798234 - DNA, 22 bp, Homo sapiens
ttcattgcagttcttcaggtta

SEQ ID NO: 7798235 - DNA, 22 bp, Homo sapiens
ttcatttgccatcagtgtaatg

SEQ ID NO: 7798236 - DNA, 22 bp, Homo sapiens
ttcatttttaccgcgtgtcaaa

SEQ ID NO: 7798237 - DNA, 23 bp, Homo sapiens
ttccaggcagagcagggattaga

SEQ ID NO: 7798238 - DNA, 22 bp, Homo sapiens
ttccaggctcccttggaggtgt

SEQ ID NO: 7798239 - DNA, 22 bp, Homo sapiens
ttccaggctatccggtgaaggg

SEQ ID NO: 7798240 - DNA, 22 bp, Homo sapiens
ttccaggcatgtcagacatagg

SEQ ID NO: 7798241 - DNA, 22 bp, Homo sapiens
ttccaggctgatgggccacagg

SEQ ID NO: 7798242 - DNA, 22 bp, Homo sapiens
ttccaggcttctctggggcgtc

SEQ ID NO: 7798243 - DNA, 22 bp, Homo sapiens
ttccagtctagtacctggatgc

SEQ ID NO: 7798244 - DNA, 22 bp, Homo sapiens
ttcacaattaactttatactta

SEQ ID NO: 7798245 - DNA, 22 bp, Homo sapiens
ttcagacttcttgactggcttt

SEQ ID NO: 7798246 - DNA, 22 bp, Homo sapiens
ttcagagaagcaaaggcagatt

SEQ ID NO: 7798247 - DNA, 22 bp, Homo sapiens
ttcagagacagcaaccaggaca

SEQ ID NO: 7798248 - DNA, 22 bp, Homo sapiens
ttcagagagaccaagtggcgtg

SEQ ID NO: 7798249 - DNA, 22 bp, Homo sapiens
ttcagagagaaaccagtgggaa

SEQ ID NO: 7798250 - DNA, 22 bp, Homo sapiens
ttcagagatggaaggcagaatg

SEQ ID NO: 7798251 - DNA, 22 bp, Homo sapiens
ttcagagagtccagtatgcagt

SEQ ID NO: 7798252 - DNA, 22 bp, Homo sapiens
ttcagcaaatggcttgagataa

SEQ ID NO: 7798253 - DNA, 22 bp, Homo sapiens
ttcagcaactcaaacctattag

SEQ ID NO: 7798254 - DNA, 22 bp, Homo sapiens
ttatataaagataacttttctt

SEQ ID NO: 7798255 - DNA, 22 bp, Homo sapiens
ttatagaatccagttgttgtat

SEQ ID NO: 7798256 - DNA, 22 bp, Homo sapiens
ttagctttcctactaataaata

SEQ ID NO: 7798257 - DNA, 22 bp, Homo sapiens
ttagctttcttggagaattaca

SEQ ID NO: 7798258 - DNA, 22 bp, Homo sapiens
ttaggaaaggaacattgaaacg

SEQ ID NO: 7798259 - DNA, 22 bp, Homo sapiens
tcctgcctgtttacctgtactt

SEQ ID NO: 7798260 - DNA, 18 bp, Homo sapiens
tcctgcctgtgccccagg

SEQ ID NO: 7798261 - DNA, 19 bp, Homo sapiens
tcctgcctggggccgcctg

SEQ ID NO: 7798262 - DNA, 22 bp, Homo sapiens
ttagccattctgataggtatgt

SEQ ID NO: 7798263 - DNA, 22 bp, Homo sapiens
ttagctctttgtagctatttct

SEQ ID NO: 7798264 - DNA, 22 bp, Homo sapiens
ttagctttagagccattactgg

SEQ ID NO: 7798265 - DNA, 22 bp, Homo sapiens
ttattaagtgcgtactgtatgc

SEQ ID NO: 7798266 - DNA, 22 bp, Homo sapiens
ttattaaaatgcggatttggct

SEQ ID NO: 7798267 - DNA, 22 bp, Homo sapiens
ttattaaaatgcggatttggct

SEQ ID NO: 7798268 - DNA, 22 bp, Homo sapiens
ttattaggtttacataaaggtt

SEQ ID NO: 7798269 - DNA, 22 bp, Homo sapiens
ttattaggttattctctgtact

SEQ ID NO: 7798270 - DNA, 22 bp, Homo sapiens
ttattagggtggtttatgttct

SEQ ID NO: 7798271 - DNA, 22 bp, Homo sapiens
ttattaggaaaaggtcagatgt

SEQ ID NO: 7798272 - DNA, 22 bp, Homo sapiens
ttattaggaactcaggattttt

SEQ ID NO: 7798273 - DNA, 22 bp, Homo sapiens
ttattagctgggcttcagggtg

SEQ ID NO: 7798274 - DNA, 22 bp, Homo sapiens
ttattggattcttgccccaggt

SEQ ID NO: 7798275 - DNA, 18 bp, Homo sapiens
ttattggtgctgctgttc

SEQ ID NO: 7798276 - DNA, 22 bp, Homo sapiens
ttattgtgtacttcctctgtgc

SEQ ID NO: 7798277 - DNA, 22 bp, Homo sapiens
ttattgtggactactgttctgg

SEQ ID NO: 7798278 - DNA, 18 bp, Homo sapiens
ttattgtggtcacagcac

SEQ ID NO: 7798279 - DNA, 22 bp, Homo sapiens
ttcaaacagtgtagaatatatg

SEQ ID NO: 7798280 - DNA, 22 bp, Homo sapiens
ttcaaactagttaaaagtcaga

SEQ ID NO: 7798281 - DNA, 22 bp, Homo sapiens
tttgatttactggatattctca

SEQ ID NO: 7798282 - DNA, 22 bp, Homo sapiens
tttgatttactggatattctca

SEQ ID NO: 7798283 - DNA, 22 bp, Homo sapiens
tttgctttgggaggttgtctgg

SEQ ID NO: 7798284 - DNA, 22 bp, Homo sapiens
tttgctttcttgattcagatta

SEQ ID NO: 7798285 - DNA, 22 bp, Homo sapiens
tttgctttcttgattcagatta

SEQ ID NO: 7798286 - DNA, 22 bp, Homo sapiens
tttgataattaaaaattgtagt

SEQ ID NO: 7798287 - DNA, 22 bp, Homo sapiens
tttgataacagtgaatatcatg

SEQ ID NO: 7798288 - DNA, 22 bp, Homo sapiens
tttgacagatccttaactcagc

SEQ ID NO: 7798289 - DNA, 22 bp, Homo sapiens
tttgaggttagctagcagatca

SEQ ID NO: 7798290 - DNA, 22 bp, Homo sapiens
tttggtttagggtcatttaaca

SEQ ID NO: 7798291 - DNA, 22 bp, Homo sapiens
tttggtaagtacccacctgggt

SEQ ID NO: 7798292 - DNA, 22 bp, Homo sapiens
tttgcttttgtgctctagtggt

SEQ ID NO: 7798293 - DNA, 22 bp, Homo sapiens
tttgacagacatttactacatt

SEQ ID NO: 7798294 - DNA, 22 bp, Homo sapiens
tttcttttgccctgtgggttag

SEQ ID NO: 7798295 - DNA, 21 bp, Homo sapiens
tttctttctggctctcacagt

SEQ ID NO: 7798296 - DNA, 22 bp, Homo sapiens
tttctttgtagtagcataatca

SEQ ID NO: 7798297 - DNA, 22 bp, Homo sapiens
tttctttgttgttatcacatca

SEQ ID NO: 7798298 - DNA, 22 bp, Homo sapiens
ttttctgtaagaggactttaat

SEQ ID NO: 7798299 - DNA, 22 bp, Homo sapiens
ttttctgtattattgtgcttca

SEQ ID NO: 7798300 - DNA, 22 bp, Homo sapiens
ttttccaaagtaccatgtccct

SEQ ID NO: 7798301 - DNA, 22 bp, Homo sapiens
ttttcattgagcacctgagtaa

SEQ ID NO: 7798302 - DNA, 19 bp, Homo sapiens
ttttcacatactggatcct

SEQ ID NO: 7798303 - DNA, 22 bp, Homo sapiens
ttttcacacaaggtgataagtt

SEQ ID NO: 7798304 - DNA, 22 bp, Homo sapiens
ttttattagtggctagatgggg

SEQ ID NO: 7798305 - DNA, 22 bp, Homo sapiens
ttttattggagtgataccaagc

SEQ ID NO: 7798306 - DNA, 22 bp, Homo sapiens
ttttattatctttgaatgggac

SEQ ID NO: 7798307 - DNA, 22 bp, Homo sapiens
ttttattgcaataaagtgtgta

SEQ ID NO: 7798308 - DNA, 22 bp, Homo sapiens
tttgttaaaatgcagattctgt

SEQ ID NO: 7798309 - DNA, 22 bp, Homo sapiens
tttgtgtttatgaagttattct

SEQ ID NO: 7798310 - DNA, 22 bp, Homo sapiens
tttgtgttgttttaagccacta

SEQ ID NO: 7798311 - DNA, 22 bp, Homo sapiens
tttgtgttgtacttctgtgcat

SEQ ID NO: 7798312 - DNA, 22 bp, Homo sapiens
tttgttagagtgtgggaggctg

SEQ ID NO: 7798313 - DNA, 22 bp, Homo sapiens
tttgttcaacaggtgaaataga

SEQ ID NO: 7798314 - DNA, 22 bp, Homo sapiens
tttgttaaggagtattgcttct

SEQ ID NO: 7798315 - DNA, 22 bp, Homo sapiens
tttgttacattaaaaagtaggt

SEQ ID NO: 7798316 - DNA, 22 bp, Homo sapiens
tttgttacaaagaaagaagagc

SEQ ID NO: 7798317 - DNA, 22 bp, Homo sapiens
tttgtaaatagcagtactcatg

SEQ ID NO: 7798318 - DNA, 22 bp, Homo sapiens
ttttatgtcataaggacactca

SEQ ID NO: 7798319 - DNA, 18 bp, Homo sapiens
ttttaatttcaggggtgg

SEQ ID NO: 7798320 - DNA, 22 bp, Homo sapiens
ttttaaatctccagttgacccc

SEQ ID NO: 7798321 - DNA, 22 bp, Homo sapiens
ttttaaactgcagaatttagaa

SEQ ID NO: 7798322 - DNA, 22 bp, Homo sapiens
tttgttcaatccagacaatagc

SEQ ID NO: 7798323 - DNA, 22 bp, Homo sapiens
tttttagagtgttaccagtata

SEQ ID NO: 7798324 - DNA, 22 bp, Homo sapiens
tttttacacttagcattgagcg

SEQ ID NO: 7798325 - DNA, 22 bp, Homo sapiens
tttttacacttagcattgagcg

SEQ ID NO: 7798326 - DNA, 22 bp, Homo sapiens
tttttacagtcatggtcactca

SEQ ID NO: 7798327 - DNA, 22 bp, Homo sapiens
ttttgtttgtgtccactgcagt

SEQ ID NO: 7798328 - DNA, 22 bp, Homo sapiens
ttttcttcctggattttggcat

SEQ ID NO: 7798329 - DNA, 22 bp, Homo sapiens
tttttcagccatgaattacact

SEQ ID NO: 7798330 - DNA, 22 bp, Homo sapiens
tttttatctacagattctcagc

SEQ ID NO: 7798331 - DNA, 22 bp, Homo sapiens
gtgcatgcaaattactgtaaag

SEQ ID NO: 7798332 - DNA, 22 bp, Homo sapiens
cagccctgtgctaagcaccctc

SEQ ID NO: 7798333 - DNA, 22 bp, Homo sapiens
gtgcatggtaagatgcttcaca

SEQ ID NO: 7798334 - DNA, 22 bp, Homo sapiens
cagccgtcagatgtgccgcagc

SEQ ID NO: 7798335 - DNA, 22 bp, Homo sapiens
cagctcctctggccagccctgc

SEQ ID NO: 7798336 - DNA, 21 bp, Homo sapiens
gtgaattaattatatgcctta

SEQ ID NO: 7798337 - DNA, 22 bp, Homo sapiens
gtgcaaaagtaattacagtttt

SEQ ID NO: 7798338 - DNA, 22 bp, Homo sapiens
gtgaggtagcagagacagtgaa

SEQ ID NO: 7798339 - DNA, 22 bp, Homo sapiens
gtgcagctgccgatcagatagg

SEQ ID NO: 7798340 - DNA, 22 bp, Homo sapiens
gtcttaagaatgaatgctgaga

SEQ ID NO: 7798341 - DNA, 22 bp, Homo sapiens
gtctttctgccatgtgaagaga

SEQ ID NO: 7798342 - DNA, 22 bp, Homo sapiens
gtctctgttatttccagggtca

SEQ ID NO: 7798343 - DNA, 22 bp, Homo sapiens
gtctctgtgtctgagagagccc

SEQ ID NO: 7798344 - DNA, 22 bp, Homo sapiens
gtctcagtccgtgctgttcagg

SEQ ID NO: 7798345 - DNA, 22 bp, Homo sapiens
gtctcaggttcgagcctcctta

SEQ ID NO: 7798346 - DNA, 22 bp, Homo sapiens
gtctcagtaagaaaggctcctg

SEQ ID NO: 7798347 - DNA, 22 bp, Homo sapiens
cagcaggttaacagaggctggt

SEQ ID NO: 7798348 - DNA, 22 bp, Homo sapiens
gtctcaagggggaactcactgt

SEQ ID NO: 7798349 - DNA, 22 bp, Homo sapiens
gtcctgagggcccaggcattct

SEQ ID NO: 7798350 - DNA, 22 bp, Homo sapiens
gtcctgagtcaagtgtgggcag

SEQ ID NO: 7798351 - DNA, 22 bp, Homo sapiens
gtcctgaggcaggatgggtttc

SEQ ID NO: 7798352 - DNA, 22 bp, Homo sapiens
gtcctgagaccatggccttagt

SEQ ID NO: 7798353 - DNA, 22 bp, Homo sapiens
gtcctgagatgtcacaaggttt

SEQ ID NO: 7798354 - DNA, 22 bp, Homo sapiens
gtcctgaatgcctttaggcaga

SEQ ID NO: 7798355 - DNA, 22 bp, Homo sapiens
gtcctaatctcttcttataagg

SEQ ID NO: 7798356 - DNA, 22 bp, Homo sapiens
cagaggcagccgggggagaacg

SEQ ID NO: 7798357 - DNA, 22 bp, Homo sapiens
cagaggcagaggtcatctctgg

SEQ ID NO: 7798358 - DNA, 22 bp, Homo sapiens
cagaggcagaccctccagggcg

SEQ ID NO: 7798359 - DNA, 22 bp, Homo sapiens
gggggatgctcaggaggctgct

SEQ ID NO: 7798360 - DNA, 22 bp, Homo sapiens
cagaggaagttccttgatgaga

SEQ ID NO: 7798361 - DNA, 22 bp, Homo sapiens
cagaggaaatgggaaggagata

SEQ ID NO: 7798362 - DNA, 22 bp, Homo sapiens
cagagagcttagtgtgctgcat

SEQ ID NO: 7798363 - DNA, 22 bp, Homo sapiens
cagagagcatgggaggcccgag

SEQ ID NO: 7798364 - DNA, 21 bp, Homo sapiens
cagagcagcgttctgctgtgg

SEQ ID NO: 7798365 - DNA, 22 bp, Homo sapiens
cagaagagtagctgaacaagtt

SEQ ID NO: 7798366 - DNA, 22 bp, Homo sapiens
cagagactggagtgcagtggcg

SEQ ID NO: 7798367 - DNA, 22 bp, Homo sapiens
cagagagagcaggaaacctccg

SEQ ID NO: 7798368 - DNA, 22 bp, Homo sapiens
cagagagagtcaaatctttgct

SEQ ID NO: 7798369 - DNA, 22 bp, Homo sapiens
cagaggctgaccctgctgttgt

SEQ ID NO: 7798370 - DNA, 22 bp, Homo sapiens
cagaggctgccagccatgtgca

SEQ ID NO: 7798371 - DNA, 21 bp, Homo sapiens
ggggtatacctatgagatagt

SEQ ID NO: 7798372 - DNA, 22 bp, Homo sapiens
cagagtgtggcatcttccaact

SEQ ID NO: 7798373 - DNA, 22 bp, Homo sapiens
cagagtgaaaactgagctcaaa

SEQ ID NO: 7798374 - DNA, 22 bp, Homo sapiens
ggggtctcactatgttacccag

SEQ ID NO: 7798375 - DNA, 22 bp, Homo sapiens
cagagttttgtgaacaacttgg

SEQ ID NO: 7798376 - DNA, 22 bp, Homo sapiens
cagataaatagatagataaact

SEQ ID NO: 7798377 - DNA, 22 bp, Homo sapiens
cagataataatatgacttcact

SEQ ID NO: 7798378 - DNA, 22 bp, Homo sapiens
ggtgcaaacgtaattgtggttt

SEQ ID NO: 7798379 - DNA, 22 bp, Homo sapiens
cagatggattttgtaggctgat

SEQ ID NO: 7798380 - DNA, 22 bp, Homo sapiens
cagatgcttgttggctggtctc

SEQ ID NO: 7798381 - DNA, 22 bp, Homo sapiens
cagatggaaggcatagaggttt

SEQ ID NO: 7798382 - DNA, 22 bp, Homo sapiens
cagatggagtcccgtggagttc

SEQ ID NO: 7798383 - DNA, 22 bp, Homo sapiens
ggtggcagggagtgtccctggg

SEQ ID NO: 7798384 - DNA, 22 bp, Homo sapiens
gtaagcctggaatttttgactt

SEQ ID NO: 7798385 - DNA, 22 bp, Homo sapiens
gtaagcctgagaaacaccacct

SEQ ID NO: 7798386 - DNA, 22 bp, Homo sapiens
gtaagcctctgctctatctggt

SEQ ID NO: 7798387 - DNA, 22 bp, Homo sapiens
gtaaacatcagccactctattt

SEQ ID NO: 7798388 - DNA, 22 bp, Homo sapiens
ggtgtcctttgggggctccgag

SEQ ID NO: 7798389 - DNA, 20 bp, Homo sapiens
cagaacatgagcatcgagcc

SEQ ID NO: 7798390 - DNA, 22 bp, Homo sapiens
cagaacattgttttctcatctg

SEQ ID NO: 7798391 - DNA, 22 bp, Homo sapiens
cagaagaggactgggtagctca

SEQ ID NO: 7798392 - DNA, 22 bp, Homo sapiens
cagaacattgttttctcatctg

SEQ ID NO: 7798393 - DNA, 22 bp, Homo sapiens
ggctgggagctggacaggccgg

SEQ ID NO: 7798394 - DNA, 22 bp, Homo sapiens
ggcttggaaattgcaggacaca

SEQ ID NO: 7798395 - DNA, 22 bp, Homo sapiens
cagaacacattttcagagtcaa

SEQ ID NO: 7798396 - DNA, 22 bp, Homo sapiens
cactgatactatagagacctca

SEQ ID NO: 7798397 - DNA, 22 bp, Homo sapiens
cactgtcttttgtgaagacaat

SEQ ID NO: 7798398 - DNA, 22 bp, Homo sapiens
ggctgctcaaggactctgatcg

SEQ ID NO: 7798399 - DNA, 22 bp, Homo sapiens
ggatcaggcgccatgggaagtg

SEQ ID NO: 7798400 - DNA, 22 bp, Homo sapiens
ggaggtggaggttgcagtgagc

SEQ ID NO: 7798401 - DNA, 22 bp, Homo sapiens
ggagtctgctcccagacatgat

SEQ ID NO: 7798402 - DNA, 22 bp, Homo sapiens
ggcaggagaaaggtctcttctt

SEQ ID NO: 7798403 - DNA, 22 bp, Homo sapiens
cacatgcatacctatgtgtata

SEQ ID NO: 7798404 - DNA, 22 bp, Homo sapiens
cacatgcattggcaaaagtgta

SEQ ID NO: 7798405 - DNA, 22 bp, Homo sapiens
cacatttctgtgagtcaatatt

SEQ ID NO: 7798406 - DNA, 22 bp, Homo sapiens
cacatttctgtacttaggtaga

SEQ ID NO: 7798407 - DNA, 22 bp, Homo sapiens
ggcagtagccagggactggcag

SEQ ID NO: 7798408 - DNA, 22 bp, Homo sapiens
ggccccaggcctttggtctggc

SEQ ID NO: 7798409 - DNA, 22 bp, Homo sapiens
ggccagcctggggctcccagac

SEQ ID NO: 7798410 - DNA, 20 bp, Homo sapiens
caccacagaattggggacag

SEQ ID NO: 7798411 - DNA, 22 bp, Homo sapiens
cacccaggcaggtggctgagaa

SEQ ID NO: 7798412 - DNA, 22 bp, Homo sapiens
cacccaggacaggccagatgtg

SEQ ID NO: 7798413 - DNA, 22 bp, Homo sapiens
cacccagcttttgcatcctccg

SEQ ID NO: 7798414 - DNA, 22 bp, Homo sapiens
cacccagcattggctaagagag

SEQ ID NO: 7798415 - DNA, 22 bp, Homo sapiens
cacccagccttcacacaggagt

SEQ ID NO: 7798416 - DNA, 22 bp, Homo sapiens
gctggcagcattagaccctggg

SEQ ID NO: 7798417 - DNA, 20 bp, Homo sapiens
gctggcagatgtcttgagat

SEQ ID NO: 7798418 - DNA, 19 bp, Homo sapiens
gctggcagatgtggccgtg

SEQ ID NO: 7798419 - DNA, 22 bp, Homo sapiens
gctggcagagctctgggctggg

SEQ ID NO: 7798420 - DNA, 22 bp, Homo sapiens
gctggcagagagctggtgagga

SEQ ID NO: 7798421 - DNA, 22 bp, Homo sapiens
caaatttaagtgaggtctttgt

SEQ ID NO: 7798422 - DNA, 22 bp, Homo sapiens
caaattctcaaggtttatccca

SEQ ID NO: 7798423 - DNA, 22 bp, Homo sapiens
caaattcagaaaattggtagag

SEQ ID NO: 7798424 - DNA, 22 bp, Homo sapiens
gctgaggtccagcattcgccta

SEQ ID NO: 7798425 - DNA, 20 bp, Homo sapiens
gctgaggtcattatgcctca

SEQ ID NO: 7798426 - DNA, 22 bp, Homo sapiens
caagtgtcttcaaaggctaaaa

SEQ ID NO: 7798427 - DNA, 22 bp, Homo sapiens
caagtgtctatatcagtgcttg

SEQ ID NO: 7798428 - DNA, 22 bp, Homo sapiens
caagtgtccatgatagtcttag

SEQ ID NO: 7798429 - DNA, 22 bp, Homo sapiens
caagtgtcttcaaaggctaaaa

SEQ ID NO: 7798430 - DNA, 22 bp, Homo sapiens
caagtgtccatgatagtcttag

SEQ ID NO: 7798431 - DNA, 22 bp, Homo sapiens
caatctgagttgggaatgtatt

SEQ ID NO: 7798432 - DNA, 22 bp, Homo sapiens
caatgatttttccattgcagga

SEQ ID NO: 7798433 - DNA, 22 bp, Homo sapiens
gcttccagaccccagtccctca

SEQ ID NO: 7798434 - DNA, 22 bp, Homo sapiens
gcttccagatcccatgctctta

SEQ ID NO: 7798435 - DNA, 22 bp, Homo sapiens
gcttccagcaaacactggctgc

SEQ ID NO: 7798436 - DNA, 22 bp, Homo sapiens
ggaacacagtgccttacaaact

SEQ ID NO: 7798437 - DNA, 20 bp, Homo sapiens
gcttccaggagggctgatat

SEQ ID NO: 7798438 - DNA, 22 bp, Homo sapiens
cacagccttactgagatccact

SEQ ID NO: 7798439 - DNA, 22 bp, Homo sapiens
cacagcctttagggtacacaca

SEQ ID NO: 7798440 - DNA, 22 bp, Homo sapiens
cacaggagagctgggaggtgcc

SEQ ID NO: 7798441 - DNA, 22 bp, Homo sapiens
ggagagctgacatcatgatgtt

SEQ ID NO: 7798442 - DNA, 22 bp, Homo sapiens
cacagcaaagacactctcaact

SEQ ID NO: 7798443 - DNA, 22 bp, Homo sapiens
cacagagaattcccatatgtga

SEQ ID NO: 7798444 - DNA, 19 bp, Homo sapiens
ggacacagaaagctgcatt

SEQ ID NO: 7798445 - DNA, 22 bp, Homo sapiens
atgcctgcttactccaggtgct

SEQ ID NO: 7798446 - DNA, 20 bp, Homo sapiens
atgcctctaattttgcaaac

SEQ ID NO: 7798447 - DNA, 22 bp, Homo sapiens
atgcccaatgtcacaatttttg

SEQ ID NO: 7798448 - DNA, 22 bp, Homo sapiens
gaatgtttaaggaaggcgtggc

SEQ ID NO: 7798449 - DNA, 22 bp, Homo sapiens
gaccctgccatgagtgacaggg

SEQ ID NO: 7798450 - DNA, 22 bp, Homo sapiens
gactggggtaaggtgaggaggt

SEQ ID NO: 7798451 - DNA, 22 bp, Homo sapiens
atgctttattattttgcaggga

SEQ ID NO: 7798452 - DNA, 22 bp, Homo sapiens
gacccggctccaggcccagcag

SEQ ID NO: 7798453 - DNA, 22 bp, Homo sapiens
atgctttattgttaggtcatgt

SEQ ID NO: 7798454 - DNA, 22 bp, Homo sapiens
gacagttttgctgaaattgagc

SEQ ID NO: 7798455 - DNA, 22 bp, Homo sapiens
atgcttgtactaaaaaaatatt

SEQ ID NO: 7798456 - DNA, 19 bp, Homo sapiens
atgctttatgttatttctt

SEQ ID NO: 7798457 - DNA, 22 bp, Homo sapiens
gacagtgtccctctggggtgga

SEQ ID NO: 7798458 - DNA, 22 bp, Homo sapiens
gacagtttaggttcaaatctca

SEQ ID NO: 7798459 - DNA, 22 bp, Homo sapiens
gacagggaggagcagagcttct

SEQ ID NO: 7798460 - DNA, 22 bp, Homo sapiens
cttgagaaaggaacaggaagct

SEQ ID NO: 7798461 - DNA, 22 bp, Homo sapiens
atcttcaaggaaaaaatacagt

SEQ ID NO: 7798462 - DNA, 22 bp, Homo sapiens
atgaagcaggcacagcttcagg

SEQ ID NO: 7798463 - DNA, 22 bp, Homo sapiens
cttgagggactctatgacttag

SEQ ID NO: 7798464 - DNA, 19 bp, Homo sapiens
atgaattgagcacttacta

SEQ ID NO: 7798465 - DNA, 22 bp, Homo sapiens
gaaaatctgcttatattatttt

SEQ ID NO: 7798466 - DNA, 22 bp, Homo sapiens
gaaatgaaacaggcttttaagg

SEQ ID NO: 7798467 - DNA, 22 bp, Homo sapiens
atgaggcatatcctcctatggt

SEQ ID NO: 7798468 - DNA, 22 bp, Homo sapiens
gaaatgattttagtttatcatg

SEQ ID NO: 7798469 - DNA, 22 bp, Homo sapiens
gaacatttgatgatgacattgg

SEQ ID NO: 7798470 - DNA, 22 bp, Homo sapiens
gaacttttgggaagccgtgtga

SEQ ID NO: 7798471 - DNA, 18 bp, Homo sapiens
gaacttttggctttgtgt

SEQ ID NO: 7798472 - DNA, 17 bp, Homo sapiens
gaacttttattaaattc

SEQ ID NO: 7798473 - DNA, 22 bp, Homo sapiens
gaacatttccagaaaggaacta

SEQ ID NO: 7798474 - DNA, 22 bp, Homo sapiens
gaacatttatgatgcaatacct

SEQ ID NO: 7798475 - DNA, 22 bp, Homo sapiens
gaagaaagattggcatgcttca

SEQ ID NO: 7798476 - DNA, 18 bp, Homo sapiens
atgcaagctatggatttg

SEQ ID NO: 7798477 - DNA, 22 bp, Homo sapiens
atgcaatatagggaagatagat

SEQ ID NO: 7798478 - DNA, 22 bp, Homo sapiens
gaggctgttaggagggactctg

SEQ ID NO: 7798479 - DNA, 22 bp, Homo sapiens
gaggctgctttgatgacaggag

SEQ ID NO: 7798480 - DNA, 22 bp, Homo sapiens
gagggatggtgtgagaggctca

SEQ ID NO: 7798481 - DNA, 22 bp, Homo sapiens
gagggatgtgcctgaaggcagg

SEQ ID NO: 7798482 - DNA, 22 bp, Homo sapiens
gagggatgtcaggggaccttgg

SEQ ID NO: 7798483 - DNA, 22 bp, Homo sapiens
gagggatggtgtgagaggctca

SEQ ID NO: 7798484 - DNA, 22 bp, Homo sapiens
gaggtaattactatgttcagat

SEQ ID NO: 7798485 - DNA, 22 bp, Homo sapiens
gagtgcaggcctgagcaccatc

SEQ ID NO: 7798486 - DNA, 23 bp, Homo sapiens
gagtgcagaatagacatgcagtg

SEQ ID NO: 7798487 - DNA, 22 bp, Homo sapiens
atgtttcatgactgagcaaaat

SEQ ID NO: 7798488 - DNA, 22 bp, Homo sapiens
atgtttcatttagatatcaggc

SEQ ID NO: 7798489 - DNA, 22 bp, Homo sapiens
atgtttcaaatatatagagttg

SEQ ID NO: 7798490 - DNA, 20 bp, Homo sapiens
atgtttaatgttgtccaccc

SEQ ID NO: 7798491 - DNA, 22 bp, Homo sapiens
gagttagagccatagagcacgg

SEQ ID NO: 7798492 - DNA, 22 bp, Homo sapiens
gagttagaagacagaatgtaaa

SEQ ID NO: 7798493 - DNA, 22 bp, Homo sapiens
gatatttacaaatttgccaata

SEQ ID NO: 7798494 - DNA, 22 bp, Homo sapiens
atgtttcatttagatatcaggc

SEQ ID NO: 7798495 - DNA, 22 bp, Homo sapiens
gagcacagggaatagacagata

SEQ ID NO: 7798496 - DNA, 22 bp, Homo sapiens
gagaggtggaggttgcagtgag

SEQ ID NO: 7798497 - DNA, 22 bp, Homo sapiens
gagaggctgaaatcacaggagc

SEQ ID NO: 7798498 - DNA, 22 bp, Homo sapiens
gagaggctggcagtgccaggtt

SEQ ID NO: 7798499 - DNA, 22 bp, Homo sapiens
gagcagtaggagaaccctgagc

SEQ ID NO: 7798500 - DNA, 21 bp, Homo sapiens
gagccttccctctgccctttc

SEQ ID NO: 7798501 - DNA, 22 bp, Homo sapiens
gagccttcatcgcagccttgtt

SEQ ID NO: 7798502 - DNA, 22 bp, Homo sapiens
gagctctgcagattgttttagg

SEQ ID NO: 7798503 - DNA, 22 bp, Homo sapiens
atgtaacttctgtgaatctgac

SEQ ID NO: 7798504 - DNA, 22 bp, Homo sapiens
atgtaatttatgttatccataa

SEQ ID NO: 7798505 - DNA, 22 bp, Homo sapiens
atgtaacattgaattatatagt

SEQ ID NO: 7798506 - DNA, 22 bp, Homo sapiens
gagctctgtccacacttggaga

SEQ ID NO: 7798507 - DNA, 22 bp, Homo sapiens
gagctctgcttgggttcttagg

SEQ ID NO: 7798508 - DNA, 22 bp, Homo sapiens
gagctttaggagaaggaggtca

SEQ ID NO: 7798509 - DNA, 22 bp, Homo sapiens
gagctttaagggcactggtctt

SEQ ID NO: 7798510 - DNA, 22 bp, Homo sapiens
gagctttaccttaggttctgtt

SEQ ID NO: 7798511 - DNA, 22 bp, Homo sapiens
gagctttacttctgactggtgc

SEQ ID NO: 7798512 - DNA, 22 bp, Homo sapiens
gagctttagctgagacctgctt

SEQ ID NO: 7798513 - DNA, 22 bp, Homo sapiens
gagctttaagggataaaatgat

SEQ ID NO: 7798514 - DNA, 22 bp, Homo sapiens
gctctagtaggaatgtccctct

SEQ ID NO: 7798515 - DNA, 22 bp, Homo sapiens
gctcctggatgttcaagtcggc

SEQ ID NO: 7798516 - DNA, 22 bp, Homo sapiens
gctccaggcagcatagtggatg

SEQ ID NO: 7798517 - DNA, 22 bp, Homo sapiens
gctaaataatcttcttctgaca

SEQ ID NO: 7798518 - DNA, 22 bp, Homo sapiens
gctaatgaaaaatagattatag

SEQ ID NO: 7798519 - DNA, 22 bp, Homo sapiens
gctaatgactgagtttttagca

SEQ ID NO: 7798520 - DNA, 22 bp, Homo sapiens
gctatgttcccttttgctataa

SEQ ID NO: 7798521 - DNA, 22 bp, Homo sapiens
gctatttttgagccatttataa

SEQ ID NO: 7798522 - DNA, 22 bp, Homo sapiens
gctcaaaggttgatagctgtgc

SEQ ID NO: 7798523 - DNA, 22 bp, Homo sapiens
gctgaggacatcatggaaggaa

SEQ ID NO: 7798524 - DNA, 22 bp, Homo sapiens
gctgagctgggacagtcctggg

SEQ ID NO: 7798525 - DNA, 22 bp, Homo sapiens
gctgaggaaaggctggaaggga

SEQ ID NO: 7798526 - DNA, 22 bp, Homo sapiens
caaatgaatatttccatgggtt

SEQ ID NO: 7798527 - DNA, 22 bp, Homo sapiens
caaatgaagtccaaagggctta

SEQ ID NO: 7798528 - DNA, 22 bp, Homo sapiens
caaatgaatagggagtgtgatg

SEQ ID NO: 7798529 - DNA, 22 bp, Homo sapiens
caaatgaaggtggtgggtcatt

SEQ ID NO: 7798530 - DNA, 22 bp, Homo sapiens
caaatgaagggagctgaagtct

SEQ ID NO: 7798531 - DNA, 22 bp, Homo sapiens
gctctgaacttccaccttttca

SEQ ID NO: 7798532 - DNA, 23 bp, Homo sapiens
atttacaggttaaatgaaatcag

SEQ ID NO: 7798533 - DNA, 22 bp, Homo sapiens
gcccagcaggggatggcagctc

SEQ ID NO: 7798534 - DNA, 22 bp, Homo sapiens
attttactaagtggatatctgt

SEQ ID NO: 7798535 - DNA, 22 bp, Homo sapiens
attttacataaggaaggtttaa

SEQ ID NO: 7798536 - DNA, 22 bp, Homo sapiens
attttacataaggaaggtttaa

SEQ ID NO: 7798537 - DNA, 23 bp, Homo sapiens
attttacaggtcagttccttgaa

SEQ ID NO: 7798538 - DNA, 21 bp, Homo sapiens
gcctgccctctgtgatggcca

SEQ ID NO: 7798539 - DNA, 22 bp, Homo sapiens
attttaaggcttatttaaaggc

SEQ ID NO: 7798540 - DNA, 20 bp, Homo sapiens
gcaaaataggctctgttggt

SEQ ID NO: 7798541 - DNA, 22 bp, Homo sapiens
atgtttctacagcgtccactga

SEQ ID NO: 7798542 - DNA, 22 bp, Homo sapiens
atgtttctagttgtatgtcact

SEQ ID NO: 7798543 - DNA, 22 bp, Homo sapiens
gcacagaggaagcacagactct

SEQ ID NO: 7798544 - DNA, 23 bp, Homo sapiens
gcacagagcagttaggggaagat

SEQ ID NO: 7798545 - DNA, 22 bp, Homo sapiens
gcagctttaaacattggaaata

SEQ ID NO: 7798546 - DNA, 22 bp, Homo sapiens
gcagctttaaaggaggctctga

SEQ ID NO: 7798547 - DNA, 22 bp, Homo sapiens
gcagctttaatctgaataagta

SEQ ID NO: 7798548 - DNA, 22 bp, Homo sapiens
gcagctttagaaacaagggctg

SEQ ID NO: 7798549 - DNA, 22 bp, Homo sapiens
gcagctttctaagctttattgc

SEQ ID NO: 7798550 - DNA, 22 bp, Homo sapiens
attggtggtgaggacatgccag

SEQ ID NO: 7798551 - DNA, 22 bp, Homo sapiens
gcagggattgtcaatgctgctc

SEQ ID NO: 7798552 - DNA, 22 bp, Homo sapiens
atttaaatgcttaagagggttt

SEQ ID NO: 7798553 - DNA, 22 bp, Homo sapiens
gcattcatgtccttcctgaacg

SEQ ID NO: 7798554 - DNA, 22 bp, Homo sapiens
gcattcaggaaccggaagggta

SEQ ID NO: 7798555 - DNA, 22 bp, Homo sapiens
attgtacaatgctgaggtttgg

SEQ ID NO: 7798556 - DNA, 22 bp, Homo sapiens
gcagtgctaaggattctgcctt

SEQ ID NO: 7798557 - DNA, 22 bp, Homo sapiens
gcagtgctaagtagctggccca

SEQ ID NO: 7798558 - DNA, 22 bp, Homo sapiens
gcagtgctgatcccatggcaga

SEQ ID NO: 7798559 - DNA, 22 bp, Homo sapiens
gcattattaatagctgcatgag

SEQ ID NO: 7798560 - DNA, 22 bp, Homo sapiens
catcattttattaaccaagaaa

SEQ ID NO: 7798561 - DNA, 22 bp, Homo sapiens
aggaggtgacagcctgcatctg

SEQ ID NO: 7798562 - DNA, 22 bp, Homo sapiens
aggaggtgagcggtcatgtggt

SEQ ID NO: 7798563 - DNA, 22 bp, Homo sapiens
cagttctctgtgcctcgctggg

SEQ ID NO: 7798564 - DNA, 22 bp, Homo sapiens
aggaggctgggcacagtggcct

SEQ ID NO: 7798565 - DNA, 22 bp, Homo sapiens
aggaggctgcaaccctgaggcc

SEQ ID NO: 7798566 - DNA, 22 bp, Homo sapiens
catcactgtcctcagcattcca

SEQ ID NO: 7798567 - DNA, 22 bp, Homo sapiens
cagtgaggagtccagggcagag

SEQ ID NO: 7798568 - DNA, 22 bp, Homo sapiens
aggacaaaggaccagatctgga

SEQ ID NO: 7798569 - DNA, 21 bp, Homo sapiens
cagtgaggccctcctgttccc

SEQ ID NO: 7798570 - DNA, 17 bp, Homo sapiens
cagtgaggcctttcctc

SEQ ID NO: 7798571 - DNA, 22 bp, Homo sapiens
cagtgagggaagatctcagcac

SEQ ID NO: 7798572 - DNA, 22 bp, Homo sapiens
cagtgaggctctgctgagcggt

SEQ ID NO: 7798573 - DNA, 22 bp, Homo sapiens
cagtgagggcccccttccaggt

SEQ ID NO: 7798574 - DNA, 22 bp, Homo sapiens
cagtgagggcattcagtgctgg

SEQ ID NO: 7798575 - DNA, 22 bp, Homo sapiens
aggagccaaattttagactctg

SEQ ID NO: 7798576 - DNA, 22 bp, Homo sapiens
aggcactgactcaagggagcca

SEQ ID NO: 7798577 - DNA, 22 bp, Homo sapiens
catgtctgagtagagtgtgatt

SEQ ID NO: 7798578 - DNA, 22 bp, Homo sapiens
aggagtttcaaagcttccatgt

SEQ ID NO: 7798579 - DNA, 22 bp, Homo sapiens
aggagtttggcacatgtatgca

SEQ ID NO: 7798580 - DNA, 22 bp, Homo sapiens
ccaaagcaagtcacatgatcaa

SEQ ID NO: 7798581 - DNA, 22 bp, Homo sapiens
ccaaagcaagtcacatgatcaa

SEQ ID NO: 7798582 - DNA, 22 bp, Homo sapiens
ccaaaatattagtgcttaagta

SEQ ID NO: 7798583 - DNA, 22 bp, Homo sapiens
aggcagagctgggttttgaaat

SEQ ID NO: 7798584 - DNA, 22 bp, Homo sapiens
ccaaaataacagcccaattcac

SEQ ID NO: 7798585 - DNA, 22 bp, Homo sapiens
agctgaaacccaggcctcagct

SEQ ID NO: 7798586 - DNA, 22 bp, Homo sapiens
agctgaaattttactgagtata

SEQ ID NO: 7798587 - DNA, 17 bp, Homo sapiens
agctgaaattgctgaag

SEQ ID NO: 7798588 - DNA, 22 bp, Homo sapiens
agctgaaagggtgttggagtgt

SEQ ID NO: 7798589 - DNA, 22 bp, Homo sapiens
agctgaaattctttgtcctcag

SEQ ID NO: 7798590 - DNA, 22 bp, Homo sapiens
agctgaaattcacaaggatcca

SEQ ID NO: 7798591 - DNA, 22 bp, Homo sapiens
caggaaatatctcctggcagag

SEQ ID NO: 7798592 - DNA, 22 bp, Homo sapiens
caggaaatcagaactcaagtgg

SEQ ID NO: 7798593 - DNA, 23 bp, Homo sapiens
caggaaatgaatccaggaggatg

SEQ ID NO: 7798594 - DNA, 22 bp, Homo sapiens
caggaaatgctatcatagctga

SEQ ID NO: 7798595 - DNA, 22 bp, Homo sapiens
caggaaatgaacaggaatgaac

SEQ ID NO: 7798596 - DNA, 22 bp, Homo sapiens
agctggagatcatgctgatact

SEQ ID NO: 7798597 - DNA, 22 bp, Homo sapiens
agctggtccttggcagttctca

SEQ ID NO: 7798598 - DNA, 22 bp, Homo sapiens
caggcttgctagaggagccaaa

SEQ ID NO: 7798599 - DNA, 22 bp, Homo sapiens
agctttatttgtcattcacggc

SEQ ID NO: 7798600 - DNA, 22 bp, Homo sapiens
agctttcgttccttagacacat

SEQ ID NO: 7798601 - DNA, 22 bp, Homo sapiens
agctttattcatgatttcaggg

SEQ ID NO: 7798602 - DNA, 22 bp, Homo sapiens
agctttatatttaatgaattct

SEQ ID NO: 7798603 - DNA, 22 bp, Homo sapiens
agctttattaactctccaggtg

SEQ ID NO: 7798604 - DNA, 23 bp, Homo sapiens
agcttctggttcaggtcaagcag

SEQ ID NO: 7798605 - DNA, 22 bp, Homo sapiens
agctttctctcagccaggctgc

SEQ ID NO: 7798606 - DNA, 22 bp, Homo sapiens
cagggacccgcacaggtagcat

SEQ ID NO: 7798607 - DNA, 22 bp, Homo sapiens
cagggactgagatccagactgt

SEQ ID NO: 7798608 - DNA, 22 bp, Homo sapiens
cagggaccctactagctcacac

SEQ ID NO: 7798609 - DNA, 22 bp, Homo sapiens
aggaaaacacagtattgatgga

SEQ ID NO: 7798610 - DNA, 22 bp, Homo sapiens
aggaaaacacagtattgatgga

SEQ ID NO: 7798611 - DNA, 22 bp, Homo sapiens
aggaaaaataaggcagcagggc

SEQ ID NO: 7798612 - DNA, 20 bp, Homo sapiens
aggaaaaatggaaactggag

SEQ ID NO: 7798613 - DNA, 22 bp, Homo sapiens
aggaaacaacttggcatgagcc

SEQ ID NO: 7798614 - DNA, 22 bp, Homo sapiens
aggaaaagtgtgaagtatggag

SEQ ID NO: 7798615 - DNA, 22 bp, Homo sapiens
cagggtttcaccatgttagcag

SEQ ID NO: 7798616 - DNA, 21 bp, Homo sapiens
aggaagatctggaggtcggcg

SEQ ID NO: 7798617 - DNA, 22 bp, Homo sapiens
caggtccctgcgccccggcctc

SEQ ID NO: 7798618 - DNA, 22 bp, Homo sapiens
ccaggacaagccagagggacag

SEQ ID NO: 7798619 - DNA, 20 bp, Homo sapiens
ccagctctgtggttagatac

SEQ ID NO: 7798620 - DNA, 22 bp, Homo sapiens
ccagactattgtgtgtcttggg

SEQ ID NO: 7798621 - DNA, 22 bp, Homo sapiens
ccagaccctgctctggggctct

SEQ ID NO: 7798622 - DNA, 22 bp, Homo sapiens
ccagacctaagcatcagtgcat

SEQ ID NO: 7798623 - DNA, 22 bp, Homo sapiens
ccagaccagactgacttgagcc

SEQ ID NO: 7798624 - DNA, 22 bp, Homo sapiens
aggccacagtactttgcagacc

SEQ ID NO: 7798625 - DNA, 22 bp, Homo sapiens
ccagagaaagctcacaggcagt

SEQ ID NO: 7798626 - DNA, 22 bp, Homo sapiens
aggccaggttcctcaatcttga

SEQ ID NO: 7798627 - DNA, 22 bp, Homo sapiens
aggccaggcaacattctgaagt

SEQ ID NO: 7798628 - DNA, 22 bp, Homo sapiens
aggccaggtggtcatgcttgct

SEQ ID NO: 7798629 - DNA, 22 bp, Homo sapiens
aggctggcgtcaggggctgtac

SEQ ID NO: 7798630 - DNA, 22 bp, Homo sapiens
aggctggccctactggctgcct

SEQ ID NO: 7798631 - DNA, 22 bp, Homo sapiens
ccatttgttgtgtattaatatt

SEQ ID NO: 7798632 - DNA, 22 bp, Homo sapiens
ccatttgtggtttatttgctct

SEQ ID NO: 7798633 - DNA, 22 bp, Homo sapiens
ccatttgtgatgtggcagcatc

SEQ ID NO: 7798634 - DNA, 22 bp, Homo sapiens
ccatttgtgcttcttcaaagca

SEQ ID NO: 7798635 - DNA, 22 bp, Homo sapiens
aggctggagagtgcagtggcgt

SEQ ID NO: 7798636 - DNA, 22 bp, Homo sapiens
aggctgcttcagctgcagggag

SEQ ID NO: 7798637 - DNA, 22 bp, Homo sapiens
aggctgctctgcgaagtcagct

SEQ ID NO: 7798638 - DNA, 21 bp, Homo sapiens
ccaggtcttggtccttggact

SEQ ID NO: 7798639 - DNA, 22 bp, Homo sapiens
ccaggctctgcgctggacatgg

SEQ ID NO: 7798640 - DNA, 22 bp, Homo sapiens
ccaggctgggcggggaacctgg

SEQ ID NO: 7798641 - DNA, 22 bp, Homo sapiens
ccagggcctgagggcgacgccc

SEQ ID NO: 7798642 - DNA, 22 bp, Homo sapiens
aggctgaggatcgtactttcca

SEQ ID NO: 7798643 - DNA, 22 bp, Homo sapiens
cccatgccttctgactcacagg

SEQ ID NO: 7798644 - DNA, 22 bp, Homo sapiens
ccctagggtttggccagagccc

SEQ ID NO: 7798645 - DNA, 22 bp, Homo sapiens
ccctagggctaagcaggactgc

SEQ ID NO: 7798646 - DNA, 22 bp, Homo sapiens
ccctgccagggtcctgacagac

SEQ ID NO: 7798647 - DNA, 20 bp, Homo sapiens
ccctcccagatgcttcccaa

SEQ ID NO: 7798648 - DNA, 22 bp, Homo sapiens
ccctgccaatcccgtctctctg

SEQ ID NO: 7798649 - DNA, 22 bp, Homo sapiens
cccaggctgcgtatccacaata

SEQ ID NO: 7798650 - DNA, 22 bp, Homo sapiens
agggctactgcctgccttcagg

SEQ ID NO: 7798651 - DNA, 22 bp, Homo sapiens
cctcaggatccgcaggtgcagt

SEQ ID NO: 7798652 - DNA, 22 bp, Homo sapiens
agggcgacaatggagagcgttt

SEQ ID NO: 7798653 - DNA, 22 bp, Homo sapiens
agggtagggcccggagacagac

SEQ ID NO: 7798654 - DNA, 22 bp, Homo sapiens
cctgagagtgagtgccacctta

SEQ ID NO: 7798655 - DNA, 22 bp, Homo sapiens
cctgagagtgagggcctcctta

SEQ ID NO: 7798656 - DNA, 22 bp, Homo sapiens
agggtatgttttaggctgagtt

SEQ ID NO: 7798657 - DNA, 22 bp, Homo sapiens
cctgaagagtgaatgtggcagt

SEQ ID NO: 7798658 - DNA, 22 bp, Homo sapiens
cctgaaatgactccagctgagt

SEQ ID NO: 7798659 - DNA, 22 bp, Homo sapiens
cctgaaatccatagtttacact

SEQ ID NO: 7798660 - DNA, 21 bp, Homo sapiens
cctgaaattctcactagctta

SEQ ID NO: 7798661 - DNA, 22 bp, Homo sapiens
cctgaaatgagttctgctcact

SEQ ID NO: 7798662 - DNA, 22 bp, Homo sapiens
cctgaaatttgaagacctgaat

SEQ ID NO: 7798663 - DNA, 22 bp, Homo sapiens
cctgaagaaaattccacgagaa

SEQ ID NO: 7798664 - DNA, 22 bp, Homo sapiens
cctgagagccagtgcctgccca

SEQ ID NO: 7798665 - DNA, 22 bp, Homo sapiens
cctgagagagtgagccctgaca

SEQ ID NO: 7798666 - DNA, 22 bp, Homo sapiens
cctgaagatgctgtggcctggt

SEQ ID NO: 7798667 - DNA, 22 bp, Homo sapiens
cctgagagccctagccaggcgc

SEQ ID NO: 7798668 - DNA, 22 bp, Homo sapiens
cctgagagggggccctagaaat

SEQ ID NO: 7798669 - DNA, 22 bp, Homo sapiens
cctgagagtaggtgtctcttta

SEQ ID NO: 7798670 - DNA, 22 bp, Homo sapiens
cctgagaggccctctcactgtc

SEQ ID NO: 7798671 - DNA, 22 bp, Homo sapiens
atatacagttttacagggtttc

SEQ ID NO: 7798672 - DNA, 22 bp, Homo sapiens
atatacacatttgcttatgtgt

SEQ ID NO: 7798673 - DNA, 22 bp, Homo sapiens
atatacagtatgtactgtggtt

SEQ ID NO: 7798674 - DNA, 22 bp, Homo sapiens
atatacagggagaaacagctta

SEQ ID NO: 7798675 - DNA, 22 bp, Homo sapiens
atagttttctatgcactgttat

SEQ ID NO: 7798676 - DNA, 22 bp, Homo sapiens
atataaagaagtggaaaatgag

SEQ ID NO: 7798677 - DNA, 22 bp, Homo sapiens
atataaagagcttagtatagtg

SEQ ID NO: 7798678 - DNA, 22 bp, Homo sapiens
ctggcctcatagccaagctgtg

SEQ ID NO: 7798679 - DNA, 22 bp, Homo sapiens
ctggcccttgacttacagcagg

SEQ ID NO: 7798680 - DNA, 22 bp, Homo sapiens
ctggcaggtttggtgtctggtg

SEQ ID NO: 7798681 - DNA, 22 bp, Homo sapiens
ctggcagtattaagagaagtga

SEQ ID NO: 7798682 - DNA, 22 bp, Homo sapiens
ctggcaggtttggtgtctggtg

SEQ ID NO: 7798683 - DNA, 22 bp, Homo sapiens
ctggcacaactccacctcagcg

SEQ ID NO: 7798684 - DNA, 22 bp, Homo sapiens
atacatgtgccatgttggtgta

SEQ ID NO: 7798685 - DNA, 22 bp, Homo sapiens
atacatgtgctatgttggtgta

SEQ ID NO: 7798686 - DNA, 22 bp, Homo sapiens
atacatgtgccgcgttggtgtg

SEQ ID NO: 7798687 - DNA, 22 bp, Homo sapiens
atacatgcgccatgttggtgtg

SEQ ID NO: 7798688 - DNA, 22 bp, Homo sapiens
ataaagcatttcccctgtgtgg

SEQ ID NO: 7798689 - DNA, 22 bp, Homo sapiens
ataaactggtaggaaaacagta

SEQ ID NO: 7798690 - DNA, 22 bp, Homo sapiens
ataaagatttctttttctctac

SEQ ID NO: 7798691 - DNA, 22 bp, Homo sapiens
ctgcagggagaggggacagcct

SEQ ID NO: 7798692 - DNA, 22 bp, Homo sapiens
ctgcagggaccacaagcaggtt

SEQ ID NO: 7798693 - DNA, 22 bp, Homo sapiens
ctgcagggaactgaggcccaga

SEQ ID NO: 7798694 - DNA, 22 bp, Homo sapiens
ataaaaaggacagatgtggtct

SEQ ID NO: 7798695 - DNA, 22 bp, Homo sapiens
ataaaaaggacagatgtggtct

SEQ ID NO: 7798696 - DNA, 22 bp, Homo sapiens
ataaaaggaaagcctgttgtga

SEQ ID NO: 7798697 - DNA, 22 bp, Homo sapiens
ctgctaaacctctctgagagct

SEQ ID NO: 7798698 - DNA, 22 bp, Homo sapiens
ctgcctgtattgtctgcttggg

SEQ ID NO: 7798699 - DNA, 22 bp, Homo sapiens
ctgcctgggttcaagtcctgtt

SEQ ID NO: 7798700 - DNA, 22 bp, Homo sapiens
atcagtttggaacattcaggcc

SEQ ID NO: 7798701 - DNA, 22 bp, Homo sapiens
atcagtttggtgctttcagtga

SEQ ID NO: 7798702 - DNA, 22 bp, Homo sapiens
atcagtttttattaatgtagct

SEQ ID NO: 7798703 - DNA, 22 bp, Homo sapiens
atcataaaccactttgtaatct

SEQ ID NO: 7798704 - DNA, 22 bp, Homo sapiens
atcaggtagatttaatattctg

SEQ ID NO: 7798705 - DNA, 22 bp, Homo sapiens
ctgtctctgataagctcgaggg

SEQ ID NO: 7798706 - DNA, 22 bp, Homo sapiens
ctgtaacttaatgagaggcaga

SEQ ID NO: 7798707 - DNA, 22 bp, Homo sapiens
ctgtaatcccagctacctggga

SEQ ID NO: 7798708 - DNA, 22 bp, Homo sapiens
ctgtaatcccagctactcggga

SEQ ID NO: 7798709 - DNA, 22 bp, Homo sapiens
atcacactgttattttagttaa

SEQ ID NO: 7798710 - DNA, 22 bp, Homo sapiens
atcacaatgtacgttaaaatgt

SEQ ID NO: 7798711 - DNA, 22 bp, Homo sapiens
ctgggaggacaacttggagctc

SEQ ID NO: 7798712 - DNA, 22 bp, Homo sapiens
ctgggaggattcattgaggtga

SEQ ID NO: 7798713 - DNA, 22 bp, Homo sapiens
ctgggaggtgaacagaaaaact

SEQ ID NO: 7798714 - DNA, 22 bp, Homo sapiens
ctggtcatcactctaacagact

SEQ ID NO: 7798715 - DNA, 22 bp, Homo sapiens
ctggtcatgccaggtttgctgc

SEQ ID NO: 7798716 - DNA, 22 bp, Homo sapiens
ctggtcccagaggcaagagatg

SEQ ID NO: 7798717 - DNA, 22 bp, Homo sapiens
ctggtcccagcagagctctgag

SEQ ID NO: 7798718 - DNA, 17 bp, Homo sapiens
ctggtcccaccaagccc

SEQ ID NO: 7798719 - DNA, 22 bp, Homo sapiens
ctggtccctggacctccctgga

SEQ ID NO: 7798720 - DNA, 18 bp, Homo sapiens
atattcaagaagacagag

SEQ ID NO: 7798721 - DNA, 22 bp, Homo sapiens
atattcactgagcataaagcca

SEQ ID NO: 7798722 - DNA, 22 bp, Homo sapiens
atattcaaattacatttactaa

SEQ ID NO: 7798723 - DNA, 22 bp, Homo sapiens
cttattagtgtctgtctgagtt

SEQ ID NO: 7798724 - DNA, 22 bp, Homo sapiens
cttattagagttgtgttctgtt

SEQ ID NO: 7798725 - DNA, 22 bp, Homo sapiens
cttattagaaagaaaagacatg

SEQ ID NO: 7798726 - DNA, 19 bp, Homo sapiens
cttattagagtgagagctt

SEQ ID NO: 7798727 - DNA, 22 bp, Homo sapiens
cttcaagaagacagcagagcat

SEQ ID NO: 7798728 - DNA, 22 bp, Homo sapiens
cttcaagatatttctagaatca

SEQ ID NO: 7798729 - DNA, 22 bp, Homo sapiens
cttaatctcacctgcaaagtcc

SEQ ID NO: 7798730 - DNA, 22 bp, Homo sapiens
cttaacttgatgtctctctgct

SEQ ID NO: 7798731 - DNA, 22 bp, Homo sapiens
ctgtttctccacactcttccca

SEQ ID NO: 7798732 - DNA, 22 bp, Homo sapiens
atctggtatgaggttttgcttt

SEQ ID NO: 7798733 - DNA, 22 bp, Homo sapiens
atctggttttggctgtgtccct

SEQ ID NO: 7798734 - DNA, 22 bp, Homo sapiens
atcttatttaacacagcaaaac

SEQ ID NO: 7798735 - DNA, 22 bp, Homo sapiens
atctgttcttgtgtcagtaatt

SEQ ID NO: 7798736 - DNA, 23 bp, Homo sapiens
atctgttcatctgacacagattc

SEQ ID NO: 7798737 - DNA, 22 bp, Homo sapiens
cttctgagatgttgttttacag

SEQ ID NO: 7798738 - DNA, 22 bp, Homo sapiens
cttctcggccgtgtggatgcgc

SEQ ID NO: 7798739 - DNA, 22 bp, Homo sapiens
cttctgtgctaaatgcaaaacc

SEQ ID NO: 7798740 - DNA, 22 bp, Homo sapiens
cttctgtggatatgttctctct

SEQ ID NO: 7798741 - DNA, 22 bp, Homo sapiens
cttctgtggtaaactttgttgt

SEQ ID NO: 7798742 - DNA, 22 bp, Homo sapiens
agtagatttttgaatgtaagtt

SEQ ID NO: 7798743 - DNA, 22 bp, Homo sapiens
agtagaaatgtaagaaggatta

SEQ ID NO: 7798744 - DNA, 22 bp, Homo sapiens
agtaggcatttaataaacatga

SEQ ID NO: 7798745 - DNA, 22 bp, Homo sapiens
agtaggcattgtgaaactgcat

SEQ ID NO: 7798746 - DNA, 22 bp, Homo sapiens
agtaggcagaagtggcattcgg

SEQ ID NO: 7798747 - DNA, 20 bp, Homo sapiens
agtaggcaaaggaaagatct

SEQ ID NO: 7798748 - DNA, 22 bp, Homo sapiens
agtaggactaggggttgaggca

SEQ ID NO: 7798749 - DNA, 22 bp, Homo sapiens
ccttctctctgaagaccccaaa

SEQ ID NO: 7798750 - DNA, 22 bp, Homo sapiens
agtaaacataatttacctgtag

SEQ ID NO: 7798751 - DNA, 22 bp, Homo sapiens
agtaaagcagagttgcagtaca

SEQ ID NO: 7798752 - DNA, 18 bp, Homo sapiens
agtaaagcttattacatg

SEQ ID NO: 7798753 - DNA, 22 bp, Homo sapiens
ctagtgaaatttgcaagtaatt

SEQ ID NO: 7798754 - DNA, 22 bp, Homo sapiens
ctattgtttctatgctctgagg

SEQ ID NO: 7798755 - DNA, 22 bp, Homo sapiens
ctagctgtgtaaaccgagctgc

SEQ ID NO: 7798756 - DNA, 22 bp, Homo sapiens
ctagagaaaactgtgtatcttg

SEQ ID NO: 7798757 - DNA, 22 bp, Homo sapiens
ctagagaaaactgtgtatcttg

SEQ ID NO: 7798758 - DNA, 22 bp, Homo sapiens
ctagagaaaaagcttaggtacg

SEQ ID NO: 7798759 - DNA, 22 bp, Homo sapiens
ctagagaaaatgatagcaggaa

SEQ ID NO: 7798760 - DNA, 22 bp, Homo sapiens
ctagcctgggatttgaacttat

SEQ ID NO: 7798761 - DNA, 22 bp, Homo sapiens
agtcacacactgtcagttctgc

SEQ ID NO: 7798762 - DNA, 22 bp, Homo sapiens
agtcacactggttgtttacagt

SEQ ID NO: 7798763 - DNA, 22 bp, Homo sapiens
agtcacagaaacccaggtgtgg

SEQ ID NO: 7798764 - DNA, 22 bp, Homo sapiens
agtcacagtttccctgagagag

SEQ ID NO: 7798765 - DNA, 22 bp, Homo sapiens
agtcacagttcctacccagtaa

SEQ ID NO: 7798766 - DNA, 20 bp, Homo sapiens
agggttcccttgttcagcag

SEQ ID NO: 7798767 - DNA, 22 bp, Homo sapiens
agggttcccatcacctccttcc

SEQ ID NO: 7798768 - DNA, 22 bp, Homo sapiens
aggtacagatgaaagtctagtt

SEQ ID NO: 7798769 - DNA, 22 bp, Homo sapiens
aggtcagaaaaggagagcattg

SEQ ID NO: 7798770 - DNA, 22 bp, Homo sapiens
cctgggaggctgtgggtctgct

SEQ ID NO: 7798771 - DNA, 20 bp, Homo sapiens
cctggggtacactggcatgt

SEQ ID NO: 7798772 - DNA, 22 bp, Homo sapiens
cctgtgggagcccaggcagata

SEQ ID NO: 7798773 - DNA, 22 bp, Homo sapiens
cctgtgggcttgagtgtagggt

SEQ ID NO: 7798774 - DNA, 22 bp, Homo sapiens
ccttccagccccatctcatcgt

SEQ ID NO: 7798775 - DNA, 22 bp, Homo sapiens
ccttccaagtgctgctttttcc

SEQ ID NO: 7798776 - DNA, 22 bp, Homo sapiens
agtctagggtggggtccacagg

SEQ ID NO: 7798777 - DNA, 22 bp, Homo sapiens
agtctcaagggatgtctctata

SEQ ID NO: 7798778 - DNA, 22 bp, Homo sapiens
agtctcagaaaagaagcatgga

SEQ ID NO: 7798779 - DNA, 22 bp, Homo sapiens
agtctcagaaaatatgcttttt

SEQ ID NO: 7798780 - DNA, 18 bp, Homo sapiens
agtctttatttctttcat

SEQ ID NO: 7798781 - DNA, 23 bp, Homo sapiens
ctcaccaagcgccgccgctgtgt

SEQ ID NO: 7798782 - DNA, 22 bp, Homo sapiens
agtgataatgtggtaattattt

SEQ ID NO: 7798783 - DNA, 22 bp, Homo sapiens
agtgataaccatgtgtgaatta

SEQ ID NO: 7798784 - DNA, 22 bp, Homo sapiens
agtgataaaggtgtgatatgaa

SEQ ID NO: 7798785 - DNA, 22 bp, Homo sapiens
agtgaggtaattagagctgctg

SEQ ID NO: 7798786 - DNA, 22 bp, Homo sapiens
agtgaaaacctaatcatgcagt

SEQ ID NO: 7798787 - DNA, 22 bp, Homo sapiens
agtgaaaacactagttcttgcc

SEQ ID NO: 7798788 - DNA, 22 bp, Homo sapiens
agtggcatcaactttatctgta

SEQ ID NO: 7798789 - DNA, 22 bp, Homo sapiens
agtggacttttagtatccttat

SEQ ID NO: 7798790 - DNA, 22 bp, Homo sapiens
agtgcatgttcactggcatggt

SEQ ID NO: 7798791 - DNA, 22 bp, Homo sapiens
agtgatgttgactagctataag

SEQ ID NO: 7798792 - DNA, 22 bp, Homo sapiens
agtgatgtgggagagtatagct

SEQ ID NO: 7798793 - DNA, 21 bp, Homo sapiens
agtgccagtaggtatggagga

SEQ ID NO: 7798794 - DNA, 22 bp, Homo sapiens
agtgccccatgggtgcctgggg

SEQ ID NO: 7798795 - DNA, 22 bp, Homo sapiens
agtggcctggagccccgcctgg

SEQ ID NO: 7798796 - DNA, 22 bp, Homo sapiens
agtgtcctcaggctttgttcct

SEQ ID NO: 7798797 - DNA, 22 bp, Homo sapiens
agtgtcaattctcaaatctcgg

SEQ ID NO: 7798798 - DNA, 22 bp, Homo sapiens
agtgtcacagacccaatcagga

SEQ ID NO: 7798799 - DNA, 17 bp, Homo sapiens
agtgtcagaagacagtt

SEQ ID NO: 7798800 - DNA, 22 bp, Homo sapiens
agtgtcaatgccaacagtatat

SEQ ID NO: 7798801 - DNA, 22 bp, Homo sapiens
agtgtcagcctgggcaaggaac

SEQ ID NO: 7798802 - DNA, 22 bp, Homo sapiens
agtgtcaaattaaataatctgg

SEQ ID NO: 7798803 - DNA, 19 bp, Homo sapiens
agtgtatttttttctgtag

SEQ ID NO: 7798804 - DNA, 22 bp, Homo sapiens
agtgtggcaggaatgactagaa

SEQ ID NO: 7798805 - DNA, 22 bp, Homo sapiens
agtgtggctgcgtagggctctc

SEQ ID NO: 7798806 - DNA, 18 bp, Homo sapiens
agtgttctcgttttataa

SEQ ID NO: 7798807 - DNA, 18 bp, Homo sapiens
agtgttctcgttttataa

SEQ ID NO: 7798808 - DNA, 17 bp, Homo sapiens
agtgtttccttatcatt

SEQ ID NO: 7798809 - DNA, 22 bp, Homo sapiens
agtgttttattagaacacagcc

SEQ ID NO: 7798810 - DNA, 22 bp, Homo sapiens
agttaaatcattactgacagag

SEQ ID NO: 7798811 - DNA, 22 bp, Homo sapiens
ctgagccagcgggctcactttt

SEQ ID NO: 7798812 - DNA, 22 bp, Homo sapiens
ctgagccactgcttgttcagtg

SEQ ID NO: 7798813 - DNA, 22 bp, Homo sapiens
agttccatccttccactgccct

SEQ ID NO: 7798814 - DNA, 22 bp, Homo sapiens
atcagtaaatattcattgtgca

SEQ ID NO: 7798815 - DNA, 22 bp, Homo sapiens
agaaagaggatgcagatctcat

SEQ ID NO: 7798816 - DNA, 22 bp, Homo sapiens
atcaaaatgctccagtgatggt

SEQ ID NO: 7798817 - DNA, 20 bp, Homo sapiens
atcaaaatcctattgaggtt

SEQ ID NO: 7798818 - DNA, 22 bp, Homo sapiens
agaaagcacgggccccaggctc

SEQ ID NO: 7798819 - DNA, 22 bp, Homo sapiens
agaaagcaccctgcactttctg

SEQ ID NO: 7798820 - DNA, 22 bp, Homo sapiens
agaaagcactctgtcttttacc

SEQ ID NO: 7798821 - DNA, 22 bp, Homo sapiens
agaaagcatctccattgtaggt

SEQ ID NO: 7798822 - DNA, 22 bp, Homo sapiens
agaaaaagaaagtggatttgtc

SEQ ID NO: 7798823 - DNA, 21 bp, Homo sapiens
atatttttgtttggactgtca

SEQ ID NO: 7798824 - DNA, 22 bp, Homo sapiens
atattttggtagctctcaatga

SEQ ID NO: 7798825 - DNA, 21 bp, Homo sapiens
agaaaaacacgatataagccc

SEQ ID NO: 7798826 - DNA, 22 bp, Homo sapiens
actttttagtttcctcaaacat

SEQ ID NO: 7798827 - DNA, 22 bp, Homo sapiens
acttttgaacaaactcctctgt

SEQ ID NO: 7798828 - DNA, 22 bp, Homo sapiens
acttttctgcagatgatctctt

SEQ ID NO: 7798829 - DNA, 22 bp, Homo sapiens
acttttgtgcaggtctctccca

SEQ ID NO: 7798830 - DNA, 22 bp, Homo sapiens
acttttctaagcaatggtcttg

SEQ ID NO: 7798831 - DNA, 22 bp, Homo sapiens
acttttctaagcaatggtcttg

SEQ ID NO: 7798832 - DNA, 22 bp, Homo sapiens
acttttcccttggtagagttgc

SEQ ID NO: 7798833 - DNA, 19 bp, Homo sapiens
agaaccactgctctcttca

SEQ ID NO: 7798834 - DNA, 22 bp, Homo sapiens
agaacatctaaatatctgagac

SEQ ID NO: 7798835 - DNA, 22 bp, Homo sapiens
atccaggaaggatggcattgag

SEQ ID NO: 7798836 - DNA, 20 bp, Homo sapiens
agaaggcaggagacaaaagg

SEQ ID NO: 7798837 - DNA, 22 bp, Homo sapiens
agaaggcaggttttaaaatgtc

SEQ ID NO: 7798838 - DNA, 22 bp, Homo sapiens
agaaggcagaaagtccaggtat

SEQ ID NO: 7798839 - DNA, 22 bp, Homo sapiens
agaaggagtgtacaggtcatgc

SEQ ID NO: 7798840 - DNA, 22 bp, Homo sapiens
atctctgtaattacatgatatt

SEQ ID NO: 7798841 - DNA, 22 bp, Homo sapiens
actgtttaaatatttgggctgg

SEQ ID NO: 7798842 - DNA, 22 bp, Homo sapiens
actgtttaaaggcttcctttct

SEQ ID NO: 7798843 - DNA, 18 bp, Homo sapiens
agtttttaggaagaaatg

SEQ ID NO: 7798844 - DNA, 18 bp, Homo sapiens
agtttttaggaagaaatg

SEQ ID NO: 7798845 - DNA, 22 bp, Homo sapiens
acttctattggtcatgataaaa

SEQ ID NO: 7798846 - DNA, 22 bp, Homo sapiens
acttcctgtaaatagaattcca

SEQ ID NO: 7798847 - DNA, 22 bp, Homo sapiens
acttaaaaagaatcttttcacg

SEQ ID NO: 7798848 - DNA, 18 bp, Homo sapiens
ataaagtgctaataatgg

SEQ ID NO: 7798849 - DNA, 22 bp, Homo sapiens
actgttttcttagctccctgct

SEQ ID NO: 7798850 - DNA, 22 bp, Homo sapiens
actgttttctgtaaagggccag

SEQ ID NO: 7798851 - DNA, 22 bp, Homo sapiens
actgttttctgtaaagggccag

SEQ ID NO: 7798852 - DNA, 22 bp, Homo sapiens
actgtttatagttttgagctga

SEQ ID NO: 7798853 - DNA, 21 bp, Homo sapiens
actttacaatttacatagtga

SEQ ID NO: 7798854 - DNA, 21 bp, Homo sapiens
actttacaatttacatagtga

SEQ ID NO: 7798855 - DNA, 22 bp, Homo sapiens
actttaaagcagaatggctatg

SEQ ID NO: 7798856 - DNA, 22 bp, Homo sapiens
actttaaagcagaatggctatg

SEQ ID NO: 7798857 - DNA, 21 bp, Homo sapiens
actttaatatacatgaggagg

SEQ ID NO: 7798858 - DNA, 22 bp, Homo sapiens
atacaaaatatatactggagac

SEQ ID NO: 7798859 - DNA, 22 bp, Homo sapiens
atacaaaaattagccgggagta

SEQ ID NO: 7798860 - DNA, 22 bp, Homo sapiens
atagagtgatgtaaggtatgtg

SEQ ID NO: 7798861 - DNA, 22 bp, Homo sapiens
actttgttcctttcacaaagaa

SEQ ID NO: 7798862 - DNA, 22 bp, Homo sapiens
actgggaggcaaagagcaagga

SEQ ID NO: 7798863 - DNA, 19 bp, Homo sapiens
actgcctgaggctcacagg

SEQ ID NO: 7798864 - DNA, 23 bp, Homo sapiens
actgcctgctactatgcccacgg

SEQ ID NO: 7798865 - DNA, 22 bp, Homo sapiens
actgcctgccttccaggtactg

SEQ ID NO: 7798866 - DNA, 22 bp, Homo sapiens
actgcctggcctggcctcactg

SEQ ID NO: 7798867 - DNA, 22 bp, Homo sapiens
actgccaatggtagtttgatgg

SEQ ID NO: 7798868 - DNA, 22 bp, Homo sapiens
agtgctcacctgtcaggtcaag

SEQ ID NO: 7798869 - DNA, 22 bp, Homo sapiens
agtgctccctagagttgtgcaa

SEQ ID NO: 7798870 - DNA, 22 bp, Homo sapiens
agtgctctctccccagtgctac

SEQ ID NO: 7798871 - DNA, 22 bp, Homo sapiens
agtgctctgggtccactccaga

SEQ ID NO: 7798872 - DNA, 22 bp, Homo sapiens
agtgctctgatctccttgggtt

SEQ ID NO: 7798873 - DNA, 22 bp, Homo sapiens
agtgctctaacagtcaaaaaag

SEQ ID NO: 7798874 - DNA, 22 bp, Homo sapiens
agtgctcctttcattgctgccc

SEQ ID NO: 7798875 - DNA, 22 bp, Homo sapiens
agtgctcctatggatcagttgt

SEQ ID NO: 7798876 - DNA, 18 bp, Homo sapiens
actctgcggaggccccag

SEQ ID NO: 7798877 - DNA, 22 bp, Homo sapiens
actgaattttaattagatctgc

SEQ ID NO: 7798878 - DNA, 21 bp, Homo sapiens
actctgaaaattaatagttat

SEQ ID NO: 7798879 - DNA, 23 bp, Homo sapiens
actgagcattagtatttttataa

SEQ ID NO: 7798880 - DNA, 22 bp, Homo sapiens
actgagagcgtgtacaaactta

SEQ ID NO: 7798881 - DNA, 22 bp, Homo sapiens
actgagcactcacttttgttat

SEQ ID NO: 7798882 - DNA, 22 bp, Homo sapiens
actgagcagaagagatctgtga

SEQ ID NO: 7798883 - DNA, 22 bp, Homo sapiens
actgagcagggttccgcatgga

SEQ ID NO: 7798884 - DNA, 22 bp, Homo sapiens
actgagatttacatgttctagt

SEQ ID NO: 7798885 - DNA, 22 bp, Homo sapiens
actagaaagtttccagagttat

SEQ ID NO: 7798886 - DNA, 22 bp, Homo sapiens
actagaaatgtattggtagctg

SEQ ID NO: 7798887 - DNA, 22 bp, Homo sapiens
actagaaattactcagaataaa

SEQ ID NO: 7798888 - DNA, 22 bp, Homo sapiens
actagaaagcaaaagccatttc

SEQ ID NO: 7798889 - DNA, 22 bp, Homo sapiens
actagaaagaagttttttgaga

SEQ ID NO: 7798890 - DNA, 22 bp, Homo sapiens
actagaaagcactaagctaggc

SEQ ID NO: 7798891 - DNA, 20 bp, Homo sapiens
actagaaagtcactgggggg

SEQ ID NO: 7798892 - DNA, 22 bp, Homo sapiens
actagaaactaatggattatta

SEQ ID NO: 7798893 - DNA, 22 bp, Homo sapiens
actagaaaattcctagaaacta

SEQ ID NO: 7798894 - DNA, 23 bp, Homo sapiens
actagaaaatgactttctccctg

SEQ ID NO: 7798895 - DNA, 22 bp, Homo sapiens
actacattatgaggaaagagtg

SEQ ID NO: 7798896 - DNA, 22 bp, Homo sapiens
actacattcatgctcgtgttgg

SEQ ID NO: 7798897 - DNA, 22 bp, Homo sapiens
actacatttgcagagaagcaat

SEQ ID NO: 7798898 - DNA, 22 bp, Homo sapiens
actacatttcctgacccctgtg

SEQ ID NO: 7798899 - DNA, 22 bp, Homo sapiens
actacatttctcagtacctgaa

SEQ ID NO: 7798900 - DNA, 22 bp, Homo sapiens
acctttgagtgtattgtctttc

SEQ ID NO: 7798901 - DNA, 22 bp, Homo sapiens
aggtcaaaatcaggcagggaag

SEQ ID NO: 7798902 - DNA, 22 bp, Homo sapiens
aggtcaaaatgcttttcaggtc

SEQ ID NO: 7798903 - DNA, 22 bp, Homo sapiens
agtatacatagagatggctgtt

SEQ ID NO: 7798904 - DNA, 22 bp, Homo sapiens
agtatacaaataaatgtgtaat

SEQ ID NO: 7798905 - DNA, 22 bp, Homo sapiens
agtataaagtggttttcagcac

SEQ ID NO: 7798906 - DNA, 22 bp, Homo sapiens
agtcacttaatctaagtctcag

SEQ ID NO: 7798907 - DNA, 22 bp, Homo sapiens
actcctgggtgcatttctgatt

SEQ ID NO: 7798908 - DNA, 22 bp, Homo sapiens
actcctgggtgctgaccagcgt

SEQ ID NO: 7798909 - DNA, 22 bp, Homo sapiens
actcctggggctgccatcacag

SEQ ID NO: 7798910 - DNA, 22 bp, Homo sapiens
actcctggggatccattccttt

SEQ ID NO: 7798911 - DNA, 22 bp, Homo sapiens
actcctggaaaagaacgcaggg

SEQ ID NO: 7798912 - DNA, 22 bp, Homo sapiens
actcctgggtgctgaccagcgt

SEQ ID NO: 7798913 - DNA, 22 bp, Homo sapiens
agtcaccctccaactctccact

SEQ ID NO: 7798914 - DNA, 22 bp, Homo sapiens
agctccaggtgcaagtcatggt

SEQ ID NO: 7798915 - DNA, 22 bp, Homo sapiens
agctcccagaaggccctgcgcc

SEQ ID NO: 7798916 - DNA, 22 bp, Homo sapiens
agctcccaattgacttgaacta

SEQ ID NO: 7798917 - DNA, 22 bp, Homo sapiens
agctcccagaagccagagtcgg

SEQ ID NO: 7798918 - DNA, 22 bp, Homo sapiens
agctgcagccgcagctgtggcc

SEQ ID NO: 7798919 - DNA, 22 bp, Homo sapiens
agctgcaggagtcgcctaggat

SEQ ID NO: 7798920 - DNA, 22 bp, Homo sapiens
agctgcagctacagtgttggtt

SEQ ID NO: 7798921 - DNA, 22 bp, Homo sapiens
agctttatggtgcctcacttga

SEQ ID NO: 7798922 - DNA, 23 bp, Homo sapiens
agcttcattgacctccgcagggg

SEQ ID NO: 7798923 - DNA, 23 bp, Homo sapiens
agctttgtgaaagcagacatggg

SEQ ID NO: 7798924 - DNA, 22 bp, Homo sapiens
agctttgtggctttgcaagact

SEQ ID NO: 7798925 - DNA, 22 bp, Homo sapiens
agctttggttgaggggagtgtg

SEQ ID NO: 7798926 - DNA, 22 bp, Homo sapiens
aggaaaaacctgttaatggtag

SEQ ID NO: 7798927 - DNA, 22 bp, Homo sapiens
aggaaaaaagtctgtgattata

SEQ ID NO: 7798928 - DNA, 22 bp, Homo sapiens
aggaaactgaagcccagagagg

SEQ ID NO: 7798929 - DNA, 22 bp, Homo sapiens
aggaaaaataaggcagcagggc

SEQ ID NO: 7798930 - DNA, 22 bp, Homo sapiens
aggaaactaattagtagaataa

SEQ ID NO: 7798931 - DNA, 22 bp, Homo sapiens
aggaagccaagcctgacactca

SEQ ID NO: 7798932 - DNA, 18 bp, Homo sapiens
aggaaagaaaggcaggtg

SEQ ID NO: 7798933 - DNA, 22 bp, Homo sapiens
agctgtgggcctgggagagctg

SEQ ID NO: 7798934 - DNA, 22 bp, Homo sapiens
agcttagaatgtgttaggaaag

SEQ ID NO: 7798935 - DNA, 22 bp, Homo sapiens
acataacaatcataggacatag

SEQ ID NO: 7798936 - DNA, 22 bp, Homo sapiens
aggcacaagaaactgctcccca

SEQ ID NO: 7798937 - DNA, 22 bp, Homo sapiens
aggcacagatttggggaaagca

SEQ ID NO: 7798938 - DNA, 22 bp, Homo sapiens
aggaggggttctcgggtgctga

SEQ ID NO: 7798939 - DNA, 22 bp, Homo sapiens
aggagggagatgcccatcctgg

SEQ ID NO: 7798940 - DNA, 22 bp, Homo sapiens
aggaggctgtggagcactccat

SEQ ID NO: 7798941 - DNA, 22 bp, Homo sapiens
aggaggcttttgcaggtgccac

SEQ ID NO: 7798942 - DNA, 22 bp, Homo sapiens
aggagggacaccaatatatgtt

SEQ ID NO: 7798943 - DNA, 22 bp, Homo sapiens
aggagccattttccaagggcga

SEQ ID NO: 7798944 - DNA, 22 bp, Homo sapiens
aggagccatgagtgacatcaca

SEQ ID NO: 7798945 - DNA, 22 bp, Homo sapiens
aggagctgcagattctgccttg

SEQ ID NO: 7798946 - DNA, 22 bp, Homo sapiens
aggagctggaatggtccttttg

SEQ ID NO: 7798947 - DNA, 22 bp, Homo sapiens
accctgggtcatatacagtgtg

SEQ ID NO: 7798948 - DNA, 22 bp, Homo sapiens
agggcctctgacgcccccagcc

SEQ ID NO: 7798949 - DNA, 22 bp, Homo sapiens
acccaccctactagcagtgtcc

SEQ ID NO: 7798950 - DNA, 22 bp, Homo sapiens
acccagggttcctgggtcccag

SEQ ID NO: 7798951 - DNA, 22 bp, Homo sapiens
acccagggtcaccccgtagggt

SEQ ID NO: 7798952 - DNA, 19 bp, Homo sapiens
acccagggttgatgtccag

SEQ ID NO: 7798953 - DNA, 19 bp, Homo sapiens
acccagggttgatgtccag

SEQ ID NO: 7798954 - DNA, 22 bp, Homo sapiens
acccagggtttgagctctgcag

SEQ ID NO: 7798955 - DNA, 22 bp, Homo sapiens
acccagagaactgtgccttgag

SEQ ID NO: 7798956 - DNA, 22 bp, Homo sapiens
acccagggaccccgctgacgcc

SEQ ID NO: 7798957 - DNA, 22 bp, Homo sapiens
acccagggtagagtgcagtggc

SEQ ID NO: 7798958 - DNA, 22 bp, Homo sapiens
acccagggtagagtgcagtggc

SEQ ID NO: 7798959 - DNA, 22 bp, Homo sapiens
accacagctttgcaccaggtgt

SEQ ID NO: 7798960 - DNA, 22 bp, Homo sapiens
accacaggaattgctctgtggt

SEQ ID NO: 7798961 - DNA, 22 bp, Homo sapiens
accaagagtccaagtgaggttg

SEQ ID NO: 7798962 - DNA, 22 bp, Homo sapiens
accaggaggccttggttctgag

SEQ ID NO: 7798963 - DNA, 22 bp, Homo sapiens
accaggagccacaggaggagcc

SEQ ID NO: 7798964 - DNA, 20 bp, Homo sapiens
accaggagatggaggcaggg

SEQ ID NO: 7798965 - DNA, 22 bp, Homo sapiens
agggcctctaccatccaaggtt

SEQ ID NO: 7798966 - DNA, 22 bp, Homo sapiens
accagtcttgttgccatgtctg

SEQ ID NO: 7798967 - DNA, 22 bp, Homo sapiens
accagtctgttgttgcagagtg

SEQ ID NO: 7798968 - DNA, 22 bp, Homo sapiens
acattctttctcttcaggaaac

SEQ ID NO: 7798969 - DNA, 22 bp, Homo sapiens
acattctttcgatgtctgattt

SEQ ID NO: 7798970 - DNA, 22 bp, Homo sapiens
acattctttgagttttgttaaa

SEQ ID NO: 7798971 - DNA, 22 bp, Homo sapiens
acattctttgagttttgttaaa

SEQ ID NO: 7798972 - DNA, 22 bp, Homo sapiens
acattctttcaccttgtgtcca

SEQ ID NO: 7798973 - DNA, 22 bp, Homo sapiens
acattctttcgatgtctgattt

SEQ ID NO: 7798974 - DNA, 22 bp, Homo sapiens
acattcttggactccactctag

SEQ ID NO: 7798975 - DNA, 23 bp, Homo sapiens
acattcttgattcaggccttagc

SEQ ID NO: 7798976 - DNA, 22 bp, Homo sapiens
acattcctcagtgccagttgag

SEQ ID NO: 7798977 - DNA, 22 bp, Homo sapiens
acattcctgaatgggcacattt

SEQ ID NO: 7798978 - DNA, 22 bp, Homo sapiens
aggccctgagaaaatccctgca

SEQ ID NO: 7798979 - DNA, 20 bp, Homo sapiens
acatgaaaggaaacaggaaa

SEQ ID NO: 7798980 - DNA, 22 bp, Homo sapiens
acatctttgctcttatagagct

SEQ ID NO: 7798981 - DNA, 22 bp, Homo sapiens
agctcttacatttaggtctatg

SEQ ID NO: 7798982 - DNA, 22 bp, Homo sapiens
agctcctgtggcagctcttctg

SEQ ID NO: 7798983 - DNA, 18 bp, Homo sapiens
agctcctggtctcaggga

SEQ ID NO: 7798984 - DNA, 22 bp, Homo sapiens
agctcctgggggttccaagcag

SEQ ID NO: 7798985 - DNA, 17 bp, Homo sapiens
agctcctggggtcttta

SEQ ID NO: 7798986 - DNA, 23 bp, Homo sapiens
agctcctgtaaggtggtcgtcac

SEQ ID NO: 7798987 - DNA, 22 bp, Homo sapiens
agctcctggcaaggtcatggtg

SEQ ID NO: 7798988 - DNA, 22 bp, Homo sapiens
agctcctggctttcctctcacc

SEQ ID NO: 7798989 - DNA, 22 bp, Homo sapiens
agctcctgggccatcacaacca

SEQ ID NO: 7798990 - DNA, 22 bp, Homo sapiens
agctaggacaggtagagatggg

SEQ ID NO: 7798991 - DNA, 20 bp, Homo sapiens
agctaggagaaagcatggag

SEQ ID NO: 7798992 - DNA, 22 bp, Homo sapiens
agctcctggaggtgcgcactcg

SEQ ID NO: 7798993 - DNA, 22 bp, Homo sapiens
agctccaggataagacaggtgc

SEQ ID NO: 7798994 - DNA, 22 bp, Homo sapiens
agctagaagtcctagataaagg

SEQ ID NO: 7798995 - DNA, 22 bp, Homo sapiens
cagcaacatgtggtagtgtagg

SEQ ID NO: 7798996 - DNA, 22 bp, Homo sapiens
cagatgaagatcatagaatagt

SEQ ID NO: 7798997 - DNA, 22 bp, Homo sapiens
agccctgattaaccttggcttt

SEQ ID NO: 7798998 - DNA, 22 bp, Homo sapiens
agcccatgcaacaggcctagcg

SEQ ID NO: 7798999 - DNA, 18 bp, Homo sapiens
cagagctcctggatgcag

SEQ ID NO: 7799000 - DNA, 22 bp, Homo sapiens
cagagctctgacagctacagcc

SEQ ID NO: 7799001 - DNA, 20 bp, Homo sapiens
cagagaccaggccaggtgtc

SEQ ID NO: 7799002 - DNA, 22 bp, Homo sapiens
cagagctcagagctgccaggca

SEQ ID NO: 7799003 - DNA, 20 bp, Homo sapiens
cagagctatccctttattta

SEQ ID NO: 7799004 - DNA, 22 bp, Homo sapiens
cagagccttcctagcagactct

SEQ ID NO: 7799005 - DNA, 22 bp, Homo sapiens
cactttatatgcattacctcat

SEQ ID NO: 7799006 - DNA, 22 bp, Homo sapiens
caccagccagagtgacagctcc

SEQ ID NO: 7799007 - DNA, 22 bp, Homo sapiens
agcagtaagtgaagactagttt

SEQ ID NO: 7799008 - DNA, 22 bp, Homo sapiens
agcagtccaactgaggtggcat

SEQ ID NO: 7799009 - DNA, 22 bp, Homo sapiens
agcaggtttaaactctaatgca

SEQ ID NO: 7799010 - DNA, 22 bp, Homo sapiens
agcaggttgtgatacactcaga

SEQ ID NO: 7799011 - DNA, 22 bp, Homo sapiens
agcatataggaaatgttgaatc

SEQ ID NO: 7799012 - DNA, 22 bp, Homo sapiens
agcagtgccgcatcttgtgacc

SEQ ID NO: 7799013 - DNA, 20 bp, Homo sapiens
agcacctgtgtagaagcatc

SEQ ID NO: 7799014 - DNA, 22 bp, Homo sapiens
agcactgtagttatagctaaca

SEQ ID NO: 7799015 - DNA, 22 bp, Homo sapiens
caataattgctttccagagtta

SEQ ID NO: 7799016 - DNA, 22 bp, Homo sapiens
caataatttacattggatacca

SEQ ID NO: 7799017 - DNA, 20 bp, Homo sapiens
caataatttacttccctatt

SEQ ID NO: 7799018 - DNA, 22 bp, Homo sapiens
caataatatcctgtgctgtttg

SEQ ID NO: 7799019 - DNA, 20 bp, Homo sapiens
agcagagtgcccatcccgga

SEQ ID NO: 7799020 - DNA, 22 bp, Homo sapiens
agagagcatggcacagaggggt

SEQ ID NO: 7799021 - DNA, 22 bp, Homo sapiens
agagagcatggcacagaggggt

SEQ ID NO: 7799022 - DNA, 22 bp, Homo sapiens
agacttctctaacttgaggacc

SEQ ID NO: 7799023 - DNA, 22 bp, Homo sapiens
agacttctataaatttgggaat

SEQ ID NO: 7799024 - DNA, 22 bp, Homo sapiens
agagaaaactcattgaggtgtc

SEQ ID NO: 7799025 - DNA, 22 bp, Homo sapiens
agagctctttgatttgcttctc

SEQ ID NO: 7799026 - DNA, 21 bp, Homo sapiens
agagcctgagatcttccagca

SEQ ID NO: 7799027 - DNA, 22 bp, Homo sapiens
agagcagatttcaaatattggc

SEQ ID NO: 7799028 - DNA, 22 bp, Homo sapiens
agagccaggcaggcaatgttga

SEQ ID NO: 7799029 - DNA, 22 bp, Homo sapiens
agagcccaggtcctggagaggg

SEQ ID NO: 7799030 - DNA, 22 bp, Homo sapiens
agagcccatcagtggcagtgga

SEQ ID NO: 7799031 - DNA, 22 bp, Homo sapiens
agagccaggccaggccggggca

SEQ ID NO: 7799032 - DNA, 22 bp, Homo sapiens
atgaggctctcaacaccttgag

SEQ ID NO: 7799033 - DNA, 22 bp, Homo sapiens
agaatattgaaagttcttgaca

SEQ ID NO: 7799034 - DNA, 22 bp, Homo sapiens
atgaggcacgtgttactggcct

SEQ ID NO: 7799035 - DNA, 22 bp, Homo sapiens
agacaagaaactgggagtctct

SEQ ID NO: 7799036 - DNA, 22 bp, Homo sapiens
agacaagttctgtgggtcacct

SEQ ID NO: 7799037 - DNA, 19 bp, Homo sapiens
agacaagtttccagaagcc

SEQ ID NO: 7799038 - DNA, 22 bp, Homo sapiens
atgaagggtgtccctgtgagca

SEQ ID NO: 7799039 - DNA, 22 bp, Homo sapiens
atgaaggcagttaaacgtcatc

SEQ ID NO: 7799040 - DNA, 22 bp, Homo sapiens
atgaaggatagggcaaaatttt

SEQ ID NO: 7799041 - DNA, 22 bp, Homo sapiens
agaccttagtagcttttaatgg

SEQ ID NO: 7799042 - DNA, 23 bp, Homo sapiens
agacctgcatctgataggccctg

SEQ ID NO: 7799043 - DNA, 22 bp, Homo sapiens
agacctgcagggccaggcctgc

SEQ ID NO: 7799044 - DNA, 22 bp, Homo sapiens
atgcatcaggcactaggaatag

SEQ ID NO: 7799045 - DNA, 19 bp, Homo sapiens
agagtattgaatttgccct

SEQ ID NO: 7799046 - DNA, 22 bp, Homo sapiens
agagtcagaaccaagatgaggc

SEQ ID NO: 7799047 - DNA, 22 bp, Homo sapiens
agagtcagaaagcagacagggg

SEQ ID NO: 7799048 - DNA, 22 bp, Homo sapiens
agagtcagcttatgacacagtc

SEQ ID NO: 7799049 - DNA, 22 bp, Homo sapiens
agagtcagactaagccatggtg

SEQ ID NO: 7799050 - DNA, 22 bp, Homo sapiens
agagtcagttagcgaatactta

SEQ ID NO: 7799051 - DNA, 22 bp, Homo sapiens
agagtcagtaacatatatggta

SEQ ID NO: 7799052 - DNA, 22 bp, Homo sapiens
agagtgcttaaagctggctttg

SEQ ID NO: 7799053 - DNA, 22 bp, Homo sapiens
agagtgagggggcactgagacg

SEQ ID NO: 7799054 - DNA, 23 bp, Homo sapiens
agagtgcagagatatgcttgtgt

SEQ ID NO: 7799055 - DNA, 21 bp, Homo sapiens
agagtctgagtgtgcaagggc

SEQ ID NO: 7799056 - DNA, 22 bp, Homo sapiens
agagtctgaatgctcagagttg

SEQ ID NO: 7799057 - DNA, 22 bp, Homo sapiens
agagggctggacgcaggttgga

SEQ ID NO: 7799058 - DNA, 22 bp, Homo sapiens
agagggctttgattctcagttc

SEQ ID NO: 7799059 - DNA, 22 bp, Homo sapiens
agaggggaaggatgtgatgtga

SEQ ID NO: 7799060 - DNA, 22 bp, Homo sapiens
agaggggaagtaatgaatgata

SEQ ID NO: 7799061 - DNA, 22 bp, Homo sapiens
agaggggaggcgaaccagagtc

SEQ ID NO: 7799062 - DNA, 23 bp, Homo sapiens
agaggggagcatctgctggctga

SEQ ID NO: 7799063 - DNA, 22 bp, Homo sapiens
agaggggagtcctaatctgatt

SEQ ID NO: 7799064 - DNA, 22 bp, Homo sapiens
attacagaagatatgctcaaca

SEQ ID NO: 7799065 - DNA, 22 bp, Homo sapiens
attacactaatgtgacaacaat

SEQ ID NO: 7799066 - DNA, 22 bp, Homo sapiens
attacacagcggttactactag

SEQ ID NO: 7799067 - DNA, 22 bp, Homo sapiens
agaggcaaggcaggattcttct

SEQ ID NO: 7799068 - DNA, 22 bp, Homo sapiens
attttagtacctcaagtatcca

SEQ ID NO: 7799069 - DNA, 22 bp, Homo sapiens
attttagttttagcatccatgc

SEQ ID NO: 7799070 - DNA, 22 bp, Homo sapiens
attttcaagggagaggcctctg

SEQ ID NO: 7799071 - DNA, 22 bp, Homo sapiens
agatgtgtttctagttcctgca

SEQ ID NO: 7799072 - DNA, 22 bp, Homo sapiens
agcaaagctatctctatggaga

SEQ ID NO: 7799073 - DNA, 22 bp, Homo sapiens
caaagataatcacagaataccc

SEQ ID NO: 7799074 - DNA, 22 bp, Homo sapiens
caaagatatgacatggaaaatg

SEQ ID NO: 7799075 - DNA, 22 bp, Homo sapiens
agatcagactttgtgactagga

SEQ ID NO: 7799076 - DNA, 22 bp, Homo sapiens
agatcatagcacaaaagtgaca

SEQ ID NO: 7799077 - DNA, 22 bp, Homo sapiens
agatcatatgaaaaatttcaag

SEQ ID NO: 7799078 - DNA, 22 bp, Homo sapiens
agatcatatgcagtaatgaact

SEQ ID NO: 7799079 - DNA, 22 bp, Homo sapiens
agatcatatgaaaaatttcaag

SEQ ID NO: 7799080 - DNA, 22 bp, Homo sapiens
agatattaatcgtacataaggt

SEQ ID NO: 7799081 - DNA, 22 bp, Homo sapiens
agatattaggaggattcataat

SEQ ID NO: 7799082 - DNA, 22 bp, Homo sapiens
attggtagttttgtatttctct

SEQ ID NO: 7799083 - DNA, 18 bp, Homo sapiens
attggtcctgtccaccca

SEQ ID NO: 7799084 - DNA, 22 bp, Homo sapiens
attggtccatttaccctctctt

SEQ ID NO: 7799085 - DNA, 22 bp, Homo sapiens
attggctttcttttgtgaaaat

SEQ ID NO: 7799086 - DNA, 22 bp, Homo sapiens
attggctttgatatctaaaggg

SEQ ID NO: 7799087 - DNA, 18 bp, Homo sapiens
aaattagatggacctgtg

SEQ ID NO: 7799088 - DNA, 22 bp, Homo sapiens
aaattatcatgattattgtgta

SEQ ID NO: 7799089 - DNA, 22 bp, Homo sapiens
aaattatcatgggggagaaaca

SEQ ID NO: 7799090 - DNA, 20 bp, Homo sapiens
aaatttaggaaattttacgc

SEQ ID NO: 7799091 - DNA, 22 bp, Homo sapiens
aaggacctgattttgagcatct

SEQ ID NO: 7799092 - DNA, 22 bp, Homo sapiens
aaggacctatattgtcagagga

SEQ ID NO: 7799093 - DNA, 22 bp, Homo sapiens
aaggacctgattttgagcatct

SEQ ID NO: 7799094 - DNA, 22 bp, Homo sapiens
aaggagaaatggtagatgtgca

SEQ ID NO: 7799095 - DNA, 18 bp, Homo sapiens
aagctgggaaggagacag

SEQ ID NO: 7799096 - DNA, 22 bp, Homo sapiens
aagctgattctaaaatttatta

SEQ ID NO: 7799097 - DNA, 22 bp, Homo sapiens
aagctttatgatctctcagcta

SEQ ID NO: 7799098 - DNA, 22 bp, Homo sapiens
aagctttatgacttggagacag

SEQ ID NO: 7799099 - DNA, 22 bp, Homo sapiens
aagcttttctcagtgtccttgg

SEQ ID NO: 7799100 - DNA, 22 bp, Homo sapiens
aagctttttggatttgcttcag

SEQ ID NO: 7799101 - DNA, 22 bp, Homo sapiens
aagctttagagatgagttcctt

SEQ ID NO: 7799102 - DNA, 22 bp, Homo sapiens
aagctgtcagtgtcaggctaaa

SEQ ID NO: 7799103 - DNA, 22 bp, Homo sapiens
aagctgtcaatgtatctagtct

SEQ ID NO: 7799104 - DNA, 22 bp, Homo sapiens
aagctgtcaggaggttaccttt

SEQ ID NO: 7799105 - DNA, 22 bp, Homo sapiens
aacaagtaagtttatatatatt

SEQ ID NO: 7799106 - DNA, 22 bp, Homo sapiens
aacaagtaagtttatatatatt

SEQ ID NO: 7799107 - DNA, 22 bp, Homo sapiens
aacaagatgttttgatatatgt

SEQ ID NO: 7799108 - DNA, 22 bp, Homo sapiens
aaatttcaagcaaagtagctat

SEQ ID NO: 7799109 - DNA, 22 bp, Homo sapiens
aaatttcagttacctttacgtt

SEQ ID NO: 7799110 - DNA, 22 bp, Homo sapiens
aaatttcagttggaatgagctc

SEQ ID NO: 7799111 - DNA, 22 bp, Homo sapiens
aaggcatttgttggatttctca

SEQ ID NO: 7799112 - DNA, 23 bp, Homo sapiens
aaggcattggcttctctcatttc

SEQ ID NO: 7799113 - DNA, 22 bp, Homo sapiens
aaatttctaagcagccacttcc

SEQ ID NO: 7799114 - DNA, 22 bp, Homo sapiens
aaggccagacaggaccacatct

SEQ ID NO: 7799115 - DNA, 23 bp, Homo sapiens
aaggccagaatttcaatggtgcc

SEQ ID NO: 7799116 - DNA, 22 bp, Homo sapiens
aacaatgaggatctgttctgag

SEQ ID NO: 7799117 - DNA, 22 bp, Homo sapiens
aaggggcctcacagatgggctt

SEQ ID NO: 7799118 - DNA, 22 bp, Homo sapiens
aataaaatggtcagttttctca

SEQ ID NO: 7799119 - DNA, 22 bp, Homo sapiens
aagtttctggaccttacctgct

SEQ ID NO: 7799120 - DNA, 22 bp, Homo sapiens
aagtttctgatattgttaaagc

SEQ ID NO: 7799121 - DNA, 22 bp, Homo sapiens
aacagtttgcctgaaatgtatt

SEQ ID NO: 7799122 - DNA, 22 bp, Homo sapiens
aacagtttgctttaagaggcac

SEQ ID NO: 7799123 - DNA, 22 bp, Homo sapiens
aacagtttgagctttgaatttc

SEQ ID NO: 7799124 - DNA, 22 bp, Homo sapiens
aacagtttcagttactgatgag

SEQ ID NO: 7799125 - DNA, 22 bp, Homo sapiens
aacagtttatgataaattctta

SEQ ID NO: 7799126 - DNA, 22 bp, Homo sapiens
aacagtttatgtaaatgtccag

SEQ ID NO: 7799127 - DNA, 22 bp, Homo sapiens
aagtatttcgttctgaaaaagt

SEQ ID NO: 7799128 - DNA, 23 bp, Homo sapiens
aagttcttttagatgtcttcgtg

SEQ ID NO: 7799129 - DNA, 22 bp, Homo sapiens
aagttcttgaagactttaaata

SEQ ID NO: 7799130 - DNA, 22 bp, Homo sapiens
aagttcttagacaagcttgtgg

SEQ ID NO: 7799131 - DNA, 23 bp, Homo sapiens
aagttcttaggttgatactaatg

SEQ ID NO: 7799132 - DNA, 22 bp, Homo sapiens
aacattcttcaaatatcactct

SEQ ID NO: 7799133 - DNA, 22 bp, Homo sapiens
aacagtttgtggatagcttgta

SEQ ID NO: 7799134 - DNA, 22 bp, Homo sapiens
aacagtttgggtaggtatgtag

SEQ ID NO: 7799135 - DNA, 22 bp, Homo sapiens
aacatgtttccagtgtaaggcc

SEQ ID NO: 7799136 - DNA, 22 bp, Homo sapiens
aacattctttggaggattattc

SEQ ID NO: 7799137 - DNA, 22 bp, Homo sapiens
aaccagatcgactgttaacagc

SEQ ID NO: 7799138 - DNA, 22 bp, Homo sapiens
aactcagttacatattagaata

SEQ ID NO: 7799139 - DNA, 22 bp, Homo sapiens
aagaggtcataccagataaggg

SEQ ID NO: 7799140 - DNA, 22 bp, Homo sapiens
acacacaggtaaaggagcctgg

SEQ ID NO: 7799141 - DNA, 19 bp, Homo sapiens
aagaggcaaccctcgagcc

SEQ ID NO: 7799142 - DNA, 22 bp, Homo sapiens
acacatttctcccagtctccat

SEQ ID NO: 7799143 - DNA, 22 bp, Homo sapiens
acacctttgccccaagtcatag

SEQ ID NO: 7799144 - DNA, 22 bp, Homo sapiens
aagagtaaatgtctaattagga

SEQ ID NO: 7799145 - DNA, 22 bp, Homo sapiens
aagagtcagcttctgtatgggt

SEQ ID NO: 7799146 - DNA, 22 bp, Homo sapiens
aagagtcatagagacattgatt

SEQ ID NO: 7799147 - DNA, 22 bp, Homo sapiens
aagagtttaattttgtctagac

SEQ ID NO: 7799148 - DNA, 20 bp, Homo sapiens
aagagtctttactgagctaa

SEQ ID NO: 7799149 - DNA, 22 bp, Homo sapiens
acagaagagcacatttagtatg

SEQ ID NO: 7799150 - DNA, 22 bp, Homo sapiens
acagaagaccagagagctaact

SEQ ID NO: 7799151 - DNA, 22 bp, Homo sapiens
aagcaaaaggttacacttctgg

SEQ ID NO: 7799152 - DNA, 22 bp, Homo sapiens
aagcaaaaggttacacttctgg

SEQ ID NO: 7799153 - DNA, 22 bp, Homo sapiens
acagaagaagttcaaggtgaag

SEQ ID NO: 7799154 - DNA, 22 bp, Homo sapiens
aagatagatgtcatcagcatat

SEQ ID NO: 7799155 - DNA, 22 bp, Homo sapiens
acagatgaattttaattgtgtt

SEQ ID NO: 7799156 - DNA, 23 bp, Homo sapiens
acagatgaaagtgtggctcagag

SEQ ID NO: 7799157 - DNA, 22 bp, Homo sapiens
acagatgaaacccagctagttg

SEQ ID NO: 7799158 - DNA, 22 bp, Homo sapiens
aagcaaagacagtttgagtgga

SEQ ID NO: 7799159 - DNA, 22 bp, Homo sapiens
aagcaaacaggagaagagctgt

SEQ ID NO: 7799160 - DNA, 22 bp, Homo sapiens
aatgtgttttatgagagaatat

SEQ ID NO: 7799161 - DNA, 22 bp, Homo sapiens
aatgtcttttaaatgttgaggt

SEQ ID NO: 7799162 - DNA, 22 bp, Homo sapiens
aatgttattacacttgtgaaat

SEQ ID NO: 7799163 - DNA, 22 bp, Homo sapiens
aatgttattacacttgtgaaat

SEQ ID NO: 7799164 - DNA, 20 bp, Homo sapiens
aactttctcccattggactg

SEQ ID NO: 7799165 - DNA, 22 bp, Homo sapiens
aactttctataggttgggattt

SEQ ID NO: 7799166 - DNA, 22 bp, Homo sapiens
aactttctctggatggcttcct

SEQ ID NO: 7799167 - DNA, 22 bp, Homo sapiens
aactcttaaaattttggcttgc

SEQ ID NO: 7799168 - DNA, 22 bp, Homo sapiens
aactctttccctttggtgccac

SEQ ID NO: 7799169 - DNA, 22 bp, Homo sapiens
aactctttcatctgtggcctgg

SEQ ID NO: 7799170 - DNA, 22 bp, Homo sapiens
aactctttggtctcaggaaagg

SEQ ID NO: 7799171 - DNA, 22 bp, Homo sapiens
aactctttctgaggattgggag

SEQ ID NO: 7799172 - DNA, 22 bp, Homo sapiens
aatgtattctgggaaaatgtta

SEQ ID NO: 7799173 - DNA, 22 bp, Homo sapiens
aatgtattctgggaaaatgtta

SEQ ID NO: 7799174 - DNA, 22 bp, Homo sapiens
aactcctgaggaaatggtctca

SEQ ID NO: 7799175 - DNA, 22 bp, Homo sapiens
aactctcagaacttttggtggg

SEQ ID NO: 7799176 - DNA, 20 bp, Homo sapiens
aatgtcttgagacatttcag

SEQ ID NO: 7799177 - DNA, 22 bp, Homo sapiens
aatgtctttaaagtgcaataga

SEQ ID NO: 7799178 - DNA, 22 bp, Homo sapiens
aatgtctttctcataacagata

SEQ ID NO: 7799179 - DNA, 22 bp, Homo sapiens
aagacattgtcattttataatt

SEQ ID NO: 7799180 - DNA, 22 bp, Homo sapiens
aagacaatgcattactaagaag

SEQ ID NO: 7799181 - DNA, 22 bp, Homo sapiens
acaactctcagttaaataaaga

SEQ ID NO: 7799182 - DNA, 22 bp, Homo sapiens
aattcaaattacaatagttgtt

SEQ ID NO: 7799183 - DNA, 20 bp, Homo sapiens
aattagatgtttaatcaata

SEQ ID NO: 7799184 - DNA, 22 bp, Homo sapiens
aattagagtggcgagtgattta

SEQ ID NO: 7799185 - DNA, 22 bp, Homo sapiens
aattagagatcgcaataacggg

SEQ ID NO: 7799186 - DNA, 22 bp, Homo sapiens
aaaggcctctgtcctagtgcct

SEQ ID NO: 7799187 - DNA, 22 bp, Homo sapiens
aaaggccttgagctgggtgcca

SEQ ID NO: 7799188 - DNA, 22 bp, Homo sapiens
aaacatctattatgtgctgagc

SEQ ID NO: 7799189 - DNA, 22 bp, Homo sapiens
aaacatctatcagcatttttta

SEQ ID NO: 7799190 - DNA, 22 bp, Homo sapiens
aaatagaattggaagcagagtt

SEQ ID NO: 7799191 - DNA, 22 bp, Homo sapiens
aaatatgtaaccaaggtgaagt

SEQ ID NO: 7799192 - DNA, 22 bp, Homo sapiens
aaatatgtaagattagcactag

SEQ ID NO: 7799193 - DNA, 23 bp, Homo sapiens
aaatatgtctgagggcaaagaat

SEQ ID NO: 7799194 - DNA, 22 bp, Homo sapiens
aaactacactttgggaccagca

SEQ ID NO: 7799195 - DNA, 22 bp, Homo sapiens
aaatcatgtgcagagatcagga

SEQ ID NO: 7799196 - DNA, 22 bp, Homo sapiens
aaatcatgaggacattatgcca

SEQ ID NO: 7799197 - DNA, 22 bp, Homo sapiens
aaatcagtccctcttggaattt

SEQ ID NO: 7799198 - DNA, 22 bp, Homo sapiens
aaatggcagtagaaaagaatcc

SEQ ID NO: 7799199 - DNA, 22 bp, Homo sapiens
aaatgctacacaggaattctca

SEQ ID NO: 7799200 - DNA, 22 bp, Homo sapiens
aaacatgagcacttgcttcata

SEQ ID NO: 7799201 - DNA, 22 bp, Homo sapiens
aaacatgagcacttgcttcata

SEQ ID NO: 7799202 - DNA, 22 bp, Homo sapiens
aaacatgagcatctcttcaagc

SEQ ID NO: 7799203 - DNA, 21 bp, Homo sapiens
aaacatctctgcttttgtgtc

SEQ ID NO: 7799204 - DNA, 22 bp, Homo sapiens
aaacatttttcttcatcatcct

SEQ ID NO: 7799205 - DNA, 22 bp, Homo sapiens
aaaccacatgccttcaaatgct

SEQ ID NO: 7799206 - DNA, 22 bp, Homo sapiens
aaacttgacagtgagacagttt

SEQ ID NO: 7799207 - DNA, 22 bp, Homo sapiens
aaacttgaggcaatgaaggtgt

SEQ ID NO: 7799208 - DNA, 22 bp, Homo sapiens
aaagaaggatgggagaaatcct

SEQ ID NO: 7799209 - DNA, 22 bp, Homo sapiens
aaagaaggacctggaggaggat

SEQ ID NO: 7799210 - DNA, 22 bp, Homo sapiens
aaagatggcccatgatctcttg

SEQ ID NO: 7799211 - DNA, 22 bp, Homo sapiens
aaaaagatgtcctgaagtttag

SEQ ID NO: 7799212 - DNA, 22 bp, Homo sapiens
aaaaagatgtcctgaagtttag

SEQ ID NO: 7799213 - DNA, 22 bp, Homo sapiens
aaaaagatagcattgtgctcct

SEQ ID NO: 7799214 - DNA, 21 bp, Homo sapiens
aaaaatgaagttgttcaggaa

SEQ ID NO: 7799215 - DNA, 22 bp, Homo sapiens
aaaaagacagaggatgaggcag

SEQ ID NO: 7799216 - DNA, 22 bp, Homo sapiens
aaaagtctgctttctattatca

SEQ ID NO: 7799217 - DNA, 22 bp, Homo sapiens
aaaaatgtcattatggaactga

SEQ ID NO: 7799218 - DNA, 22 bp, Homo sapiens
aaaaatgcttggacttaataaa

SEQ ID NO: 7799219 - DNA, 22 bp, Homo sapiens
aaaaatgctgtggtagctgtgt

SEQ ID NO: 7799220 - DNA, 22 bp, Homo sapiens
aaaatagatgaaaggaagtctg

SEQ ID NO: 7799221 - DNA, 22 bp, Homo sapiens
aaaagtgatgggatggcacttc

SEQ ID NO: 7799222 - DNA, 22 bp, Homo sapiens
aaaagtctgctttctattatca

SEQ ID NO: 7799223 - DNA, 22 bp, Homo sapiens
aaacaacttctgcactatgggt

SEQ ID NO: 7799224 - DNA, 22 bp, Homo sapiens
aaacaaatttcaagctgtgaca

SEQ ID NO: 7799225 - DNA, 22 bp, Homo sapiens
aaacaaatagtgcatgggaatt

SEQ ID NO: 7799226 - DNA, 22 bp, Homo sapiens
aaacaaagcatcttgctatgca

SEQ ID NO: 7799227 - DNA, 21 bp, Homo sapiens
aactgagaccagctaaagtgg

SEQ ID NO: 7799228 - DNA, 22 bp, Homo sapiens
aactcagtgtgtttcttagtat

SEQ ID NO: 7799229 - DNA, 23 bp, Homo sapiens
aactgagataatgtatgtaaagc

SEQ ID NO: 7799230 - DNA, 22 bp, Homo sapiens
aactgattgttggatgatagtg

SEQ ID NO: 7799231 - DNA, 20 bp, Homo sapiens
aacatttgtagtcaggcaca

SEQ ID NO: 7799232 - DNA, 22 bp, Homo sapiens
aacattaattacagtcaaacat

SEQ ID NO: 7799233 - DNA, 22 bp, Homo sapiens
aacatttcattggaagctatgt

SEQ ID NO: 7799234 - DNA, 22 bp, Homo sapiens
aacatttccggccttttgttct

SEQ ID NO: 7799235 - DNA, 22 bp, Homo sapiens
aacagtgagaaggtggacagga

SEQ ID NO: 7799236 - DNA, 22 bp, Homo sapiens
aacaaattagttgcaagactgg

SEQ ID NO: 7799237 - DNA, 22 bp, Homo sapiens
aacacattgccagagatcagca

SEQ ID NO: 7799238 - DNA, 22 bp, Homo sapiens
aacacatatttatatatgcaca

SEQ ID NO: 7799239 - DNA, 22 bp, Homo sapiens
aacaacttgcgttcagagatgt

SEQ ID NO: 7799240 - DNA, 22 bp, Homo sapiens
aacaagaagggaaggcatgatt

SEQ ID NO: 7799241 - DNA, 22 bp, Homo sapiens
aagagccagctagtgaagaggc

SEQ ID NO: 7799242 - DNA, 22 bp, Homo sapiens
aagagcatggaatggagatcca

SEQ ID NO: 7799243 - DNA, 22 bp, Homo sapiens
aagagcatattaatagtggaga

SEQ ID NO: 7799244 - DNA, 22 bp, Homo sapiens
aagagcatcaatgactcgcagt

SEQ ID NO: 7799245 - DNA, 22 bp, Homo sapiens
aagagcatcggtggagccccca

SEQ ID NO: 7799246 - DNA, 22 bp, Homo sapiens
aagagcatctatttcacagtgg

SEQ ID NO: 7799247 - DNA, 22 bp, Homo sapiens
aagacagaagtgatttgatgtg

SEQ ID NO: 7799248 - DNA, 22 bp, Homo sapiens
aagaatgttcttgtagtcatga

SEQ ID NO: 7799249 - DNA, 22 bp, Homo sapiens
aagaaagtgctttgtaaattat

SEQ ID NO: 7799250 - DNA, 22 bp, Homo sapiens
aacttttgtccgatctcctgga

SEQ ID NO: 7799251 - DNA, 22 bp, Homo sapiens
aacttttaaaatacacagacaa

SEQ ID NO: 7799252 - DNA, 22 bp, Homo sapiens
aacttttacaaattgtcatcat

SEQ ID NO: 7799253 - DNA, 22 bp, Homo sapiens
aacttttcacaggctagctctt

SEQ ID NO: 7799254 - DNA, 22 bp, Homo sapiens
aactttctttgcatctaagttt

SEQ ID NO: 7799255 - DNA, 22 bp, Homo sapiens
aactttgagtcattgcctcttt

SEQ ID NO: 7799256 - DNA, 22 bp, Homo sapiens
aactttgttttattcactgctg

SEQ ID NO: 7799257 - DNA, 22 bp, Homo sapiens
aagcagagttagcttgtcacct

SEQ ID NO: 7799258 - DNA, 22 bp, Homo sapiens
aaatatcatttataacttttaa

SEQ ID NO: 7799259 - DNA, 22 bp, Homo sapiens
aaatatcattctggtgcacaga

SEQ ID NO: 7799260 - DNA, 22 bp, Homo sapiens
aaatatcattctggtgcacaga

SEQ ID NO: 7799261 - DNA, 22 bp, Homo sapiens
aagcacctgcagttgacaaaaa

SEQ ID NO: 7799262 - DNA, 18 bp, Homo sapiens
aagaggaggagcaggttg

SEQ ID NO: 7799263 - DNA, 18 bp, Homo sapiens
aagaggaggaaacccagg

SEQ ID NO: 7799264 - DNA, 22 bp, Homo sapiens
aagcaaaggaaagctgactttt

SEQ ID NO: 7799265 - DNA, 22 bp, Homo sapiens
aagcaaaggcaggagcttgtga

SEQ ID NO: 7799266 - DNA, 22 bp, Homo sapiens
aagcaaagtgctttgcctccag

SEQ ID NO: 7799267 - DNA, 22 bp, Homo sapiens
aagcaaagtgaattttgccaag

SEQ ID NO: 7799268 - DNA, 22 bp, Homo sapiens
agagggctgctgcacagtgctc

SEQ ID NO: 7799269 - DNA, 22 bp, Homo sapiens
agagggctgcctcagtcagcta

SEQ ID NO: 7799270 - DNA, 22 bp, Homo sapiens
agagggcatgcttggtggcctg

SEQ ID NO: 7799271 - DNA, 22 bp, Homo sapiens
agaggcttggaggtgcaaggtt

SEQ ID NO: 7799272 - DNA, 22 bp, Homo sapiens
agagcaggcataaagctttgaa

SEQ ID NO: 7799273 - DNA, 22 bp, Homo sapiens
agattacagaagaataagtaga

SEQ ID NO: 7799274 - DNA, 22 bp, Homo sapiens
agattacagaagaataagtaga

SEQ ID NO: 7799275 - DNA, 22 bp, Homo sapiens
agatcttatttagctttaatca

SEQ ID NO: 7799276 - DNA, 22 bp, Homo sapiens
aattttgtttaagtgatctgct

SEQ ID NO: 7799277 - DNA, 22 bp, Homo sapiens
agagtaaagtacttggaatacc

SEQ ID NO: 7799278 - DNA, 20 bp, Homo sapiens
agaggttcagtctggagaag

SEQ ID NO: 7799279 - DNA, 22 bp, Homo sapiens
agataatgtcaaattctgtctg

SEQ ID NO: 7799280 - DNA, 22 bp, Homo sapiens
aattatgtagccatatgaaaca

SEQ ID NO: 7799281 - DNA, 22 bp, Homo sapiens
agagagagggaaactgctaaac

SEQ ID NO: 7799282 - DNA, 20 bp, Homo sapiens
agagagaggtaaattgagca

SEQ ID NO: 7799283 - DNA, 22 bp, Homo sapiens
agactgaataacaagcaaataa

SEQ ID NO: 7799284 - DNA, 22 bp, Homo sapiens
agactgaagtaagaatgcagct

SEQ ID NO: 7799285 - DNA, 22 bp, Homo sapiens
agactgaaatagtgcacaccaa

SEQ ID NO: 7799286 - DNA, 22 bp, Homo sapiens
aatgtagttcacaattggtact

SEQ ID NO: 7799287 - DNA, 22 bp, Homo sapiens
aatgtacagctgtctttcctcc

SEQ ID NO: 7799288 - DNA, 22 bp, Homo sapiens
agaatctaagtacacagacaga

SEQ ID NO: 7799289 - DNA, 22 bp, Homo sapiens
agaatcagtgctggctattagc

SEQ ID NO: 7799290 - DNA, 19 bp, Homo sapiens
agaatcatcttgaagtgat

SEQ ID NO: 7799291 - DNA, 19 bp, Homo sapiens
agaatcatcttgaagtgat

SEQ ID NO: 7799292 - DNA, 22 bp, Homo sapiens
agaataaatgctacctatcaca

SEQ ID NO: 7799293 - DNA, 22 bp, Homo sapiens
agaataaaatagtctgaagatg

SEQ ID NO: 7799294 - DNA, 21 bp, Homo sapiens
agcaggaggcagtcacagctc

SEQ ID NO: 7799295 - DNA, 22 bp, Homo sapiens
agcaggagggttttgtagagtc

SEQ ID NO: 7799296 - DNA, 19 bp, Homo sapiens
agcagttatatgcatggga

SEQ ID NO: 7799297 - DNA, 22 bp, Homo sapiens
agatttggtgtctggttgatat

SEQ ID NO: 7799298 - DNA, 22 bp, Homo sapiens
agatttgaaacttgcttcataa

SEQ ID NO: 7799299 - DNA, 18 bp, Homo sapiens
agattttgagaaatacaa

SEQ ID NO: 7799300 - DNA, 22 bp, Homo sapiens
agcactttcctggcaaatgtgg

SEQ ID NO: 7799301 - DNA, 22 bp, Homo sapiens
acacactttaaattaaacctct

SEQ ID NO: 7799302 - DNA, 22 bp, Homo sapiens
acacacttttgctaaaaattgt

SEQ ID NO: 7799303 - DNA, 22 bp, Homo sapiens
agcccaggtctcaaagtacagg

SEQ ID NO: 7799304 - DNA, 22 bp, Homo sapiens
agcccaggtgactcatacaccc

SEQ ID NO: 7799305 - DNA, 22 bp, Homo sapiens
agcatctgcttaatggcttaac

SEQ ID NO: 7799306 - DNA, 22 bp, Homo sapiens
agcattccacactgaagtctgc

SEQ ID NO: 7799307 - DNA, 22 bp, Homo sapiens
agctcagggcgatctgtctcgg

SEQ ID NO: 7799308 - DNA, 22 bp, Homo sapiens
agctcagggctccaggaccgct

SEQ ID NO: 7799309 - DNA, 22 bp, Homo sapiens
agctccaaggttgaggagtgag

SEQ ID NO: 7799310 - DNA, 20 bp, Homo sapiens
agccctgtaaatcccctgga

SEQ ID NO: 7799311 - DNA, 22 bp, Homo sapiens
agccctgtctctcactccaggt

SEQ ID NO: 7799312 - DNA, 22 bp, Homo sapiens
agccctggggctggtcttggaa

SEQ ID NO: 7799313 - DNA, 22 bp, Homo sapiens
acagacatgggccgctcttgag

SEQ ID NO: 7799314 - DNA, 22 bp, Homo sapiens
accttgaacccagcttgctgca

SEQ ID NO: 7799315 - DNA, 22 bp, Homo sapiens
accttctgaccagttatcttga

SEQ ID NO: 7799316 - DNA, 22 bp, Homo sapiens
acctgggaaagccgtggaaagg

SEQ ID NO: 7799317 - DNA, 22 bp, Homo sapiens
aagtaacacatgttacttctgc

SEQ ID NO: 7799318 - DNA, 22 bp, Homo sapiens
aagtaaaccacagagaagccac

SEQ ID NO: 7799319 - DNA, 22 bp, Homo sapiens
aagtgatttagtcttataaagg

SEQ ID NO: 7799320 - DNA, 22 bp, Homo sapiens
aagtgatgctacgactttgaca

SEQ ID NO: 7799321 - DNA, 22 bp, Homo sapiens
aagtgaggcctaggcactgggt

SEQ ID NO: 7799322 - DNA, 22 bp, Homo sapiens
aagtgaggtttctgctttcaga

SEQ ID NO: 7799323 - DNA, 22 bp, Homo sapiens
aagtgaatctcctttctttatt

SEQ ID NO: 7799324 - DNA, 22 bp, Homo sapiens
accttgtcttttatagaacaag

SEQ ID NO: 7799325 - DNA, 22 bp, Homo sapiens
actcagttatcatgtgtccaca

SEQ ID NO: 7799326 - DNA, 22 bp, Homo sapiens
aagtttgtcgaaattatcagca

SEQ ID NO: 7799327 - DNA, 22 bp, Homo sapiens
actgagaactcaagagaaaagg

SEQ ID NO: 7799328 - DNA, 22 bp, Homo sapiens
aataaatgttaagattgtctca

SEQ ID NO: 7799329 - DNA, 22 bp, Homo sapiens
aataaatgtttgttggatgttt

SEQ ID NO: 7799330 - DNA, 22 bp, Homo sapiens
aataacagtgccatgaaattga

SEQ ID NO: 7799331 - DNA, 22 bp, Homo sapiens
aataactggcacatatcacata

SEQ ID NO: 7799332 - DNA, 22 bp, Homo sapiens
acttccaggaggtgtcactgaa

SEQ ID NO: 7799333 - DNA, 22 bp, Homo sapiens
acttccaggaggtgtcactgaa

SEQ ID NO: 7799334 - DNA, 22 bp, Homo sapiens
acttattagctgtgtgaccttg

SEQ ID NO: 7799335 - DNA, 22 bp, Homo sapiens
acttatttattcattcagctca

SEQ ID NO: 7799336 - DNA, 22 bp, Homo sapiens
aatatgaattattgttacaagt

SEQ ID NO: 7799337 - DNA, 22 bp, Homo sapiens
aatatcttctaaggatagaact

SEQ ID NO: 7799338 - DNA, 22 bp, Homo sapiens
aatatcttctaaggatagaact

SEQ ID NO: 7799339 - DNA, 22 bp, Homo sapiens
aatatcagcacttttgtggtat

SEQ ID NO: 7799340 - DNA, 22 bp, Homo sapiens
acttcctgcaatcgtccactcc

SEQ ID NO: 7799341 - DNA, 21 bp, Homo sapiens
agaaaatggcgttttagattt

SEQ ID NO: 7799342 - DNA, 22 bp, Homo sapiens
agaaaattactccagagacaag

SEQ ID NO: 7799343 - DNA, 22 bp, Homo sapiens
aatatgttccacttaaagctgg

SEQ ID NO: 7799344 - DNA, 22 bp, Homo sapiens
aatatgttgagtctatctttat

SEQ ID NO: 7799345 - DNA, 22 bp, Homo sapiens
aatatgttcaaaatagatcact

SEQ ID NO: 7799346 - DNA, 22 bp, Homo sapiens
aatatgtttataagatatcttc

SEQ ID NO: 7799347 - DNA, 22 bp, Homo sapiens
aatatgtttataagatatcttc

SEQ ID NO: 7799348 - DNA, 22 bp, Homo sapiens
aatattagtttctcaagagaga

SEQ ID NO: 7799349 - DNA, 22 bp, Homo sapiens
aatcttaagctgaattctctcc

SEQ ID NO: 7799350 - DNA, 22 bp, Homo sapiens
aatcttaaagaatattctacca

SEQ ID NO: 7799351 - DNA, 22 bp, Homo sapiens
aatctgtcccttaactagtcat

SEQ ID NO: 7799352 - DNA, 22 bp, Homo sapiens
aatctatatgcttttcacatac

SEQ ID NO: 7799353 - DNA, 22 bp, Homo sapiens
accaggcagagctgggccttaa

SEQ ID NO: 7799354 - DNA, 22 bp, Homo sapiens
accaggcagcactttccttgca

SEQ ID NO: 7799355 - DNA, 22 bp, Homo sapiens
accaggcagcaccaaagccggt

SEQ ID NO: 7799356 - DNA, 22 bp, Homo sapiens
accaggcagtatggtgctgcaa

SEQ ID NO: 7799357 - DNA, 22 bp, Homo sapiens
accaggcagctgggggtgatgt

SEQ ID NO: 7799358 - DNA, 22 bp, Homo sapiens
accaggcagtcaccgtccagga

SEQ ID NO: 7799359 - DNA, 22 bp, Homo sapiens
accaggcaactgtgaatgggct

SEQ ID NO: 7799360 - DNA, 22 bp, Homo sapiens
accaggcactcttgtggcagtg

SEQ ID NO: 7799361 - DNA, 22 bp, Homo sapiens
accaggcactcctgaggtctga

SEQ ID NO: 7799362 - DNA, 22 bp, Homo sapiens
accaggcaaaaccacaggagca

SEQ ID NO: 7799363 - DNA, 17 bp, Homo sapiens
accaggcaacacgccca

SEQ ID NO: 7799364 - DNA, 22 bp, Homo sapiens
aaggttgctgttttgcttcaaa

SEQ ID NO: 7799365 - DNA, 22 bp, Homo sapiens
aaggttgcagcagtgttgatga

SEQ ID NO: 7799366 - DNA, 22 bp, Homo sapiens
accaggcatgatgtggagcaca

SEQ ID NO: 7799367 - DNA, 22 bp, Homo sapiens
aagtaaaatgtttcctttatta

SEQ ID NO: 7799368 - DNA, 22 bp, Homo sapiens
aagtaaaattcaatcttcactg

SEQ ID NO: 7799369 - DNA, 22 bp, Homo sapiens
aagtaaaagctttaccatgcgc

SEQ ID NO: 7799370 - DNA, 22 bp, Homo sapiens
aagtaaaatgtttcctttatta

SEQ ID NO: 7799371 - DNA, 22 bp, Homo sapiens
aagtaaaatgtttcctttatta

SEQ ID NO: 7799372 - DNA, 22 bp, Homo sapiens
aagtaaaacacacagtccaccg

SEQ ID NO: 7799373 - DNA, 22 bp, Homo sapiens
acattcttataagagtgaggca

SEQ ID NO: 7799374 - DNA, 22 bp, Homo sapiens
acattcttcagctttgtcaggc

SEQ ID NO: 7799375 - DNA, 22 bp, Homo sapiens
acattcttaacagttaaaaact

SEQ ID NO: 7799376 - DNA, 22 bp, Homo sapiens
acattcttaacagttaaaaact

SEQ ID NO: 7799377 - DNA, 22 bp, Homo sapiens
acatagaaatttatttcttaca

SEQ ID NO: 7799378 - DNA, 22 bp, Homo sapiens
acatgccaagatcctcgtcttt

SEQ ID NO: 7799379 - DNA, 22 bp, Homo sapiens
acatacttatgctaaaaatata

SEQ ID NO: 7799380 - DNA, 19 bp, Homo sapiens
acatggctctccagtctgg

SEQ ID NO: 7799381 - DNA, 22 bp, Homo sapiens
acatggctggcaccttaaattt

SEQ ID NO: 7799382 - DNA, 22 bp, Homo sapiens
acataataaaaataacagctca

SEQ ID NO: 7799383 - DNA, 22 bp, Homo sapiens
acatgtaaaaattaaggtaaga

SEQ ID NO: 7799384 - DNA, 22 bp, Homo sapiens
acatggtgagcggcaggcctat

SEQ ID NO: 7799385 - DNA, 22 bp, Homo sapiens
acattcaaccaatgtttgctat

SEQ ID NO: 7799386 - DNA, 22 bp, Homo sapiens
acattcaaaatatttctgatgt

SEQ ID NO: 7799387 - DNA, 22 bp, Homo sapiens
acattctggatgtctgatgaga

SEQ ID NO: 7799388 - DNA, 22 bp, Homo sapiens
aagccctgccacccattcactg

SEQ ID NO: 7799389 - DNA, 22 bp, Homo sapiens
aagccctggcccaaccttgatt

SEQ ID NO: 7799390 - DNA, 22 bp, Homo sapiens
aagccctggacggcccttcccc

SEQ ID NO: 7799391 - DNA, 19 bp, Homo sapiens
acaggcagaattgggtgtg

SEQ ID NO: 7799392 - DNA, 22 bp, Homo sapiens
acaggcagagaactcagccaga

SEQ ID NO: 7799393 - DNA, 22 bp, Homo sapiens
acaggcagagaactcagccaga

SEQ ID NO: 7799394 - DNA, 22 bp, Homo sapiens
acagctttttactaatagattg

SEQ ID NO: 7799395 - DNA, 22 bp, Homo sapiens
acagcttttcaattctgctgag

SEQ ID NO: 7799396 - DNA, 22 bp, Homo sapiens
acagcttttctgatagatcctg

SEQ ID NO: 7799397 - DNA, 22 bp, Homo sapiens
acagcttttgaaaaattactgg

SEQ ID NO: 7799398 - DNA, 22 bp, Homo sapiens
acagctttttactaatagattg

SEQ ID NO: 7799399 - DNA, 22 bp, Homo sapiens
acagctttatctcagggatcag

SEQ ID NO: 7799400 - DNA, 22 bp, Homo sapiens
acagctttgtgttaatgggaag

SEQ ID NO: 7799401 - DNA, 22 bp, Homo sapiens
acagctttgggcaatgctatga

SEQ ID NO: 7799402 - DNA, 22 bp, Homo sapiens
acagcttttatgggaccagcca

SEQ ID NO: 7799403 - DNA, 22 bp, Homo sapiens
acagcttttatgggaccagcca

SEQ ID NO: 7799404 - DNA, 22 bp, Homo sapiens
acagctttgttttccctgctga

SEQ ID NO: 7799405 - DNA, 22 bp, Homo sapiens
acagctttagtgtgggtggtgc

SEQ ID NO: 7799406 - DNA, 22 bp, Homo sapiens
acagatgaggaagagtcagcca

SEQ ID NO: 7799407 - DNA, 22 bp, Homo sapiens
acagatttaggactgtagcgat

SEQ ID NO: 7799408 - DNA, 22 bp, Homo sapiens
acagatgaggaagagtcagcca

SEQ ID NO: 7799409 - DNA, 22 bp, Homo sapiens
acagatgaggaagagtcagcca

SEQ ID NO: 7799410 - DNA, 22 bp, Homo sapiens
acagatttattgaagctgctgc

SEQ ID NO: 7799411 - DNA, 22 bp, Homo sapiens
acagatttgactggtacctggc

SEQ ID NO: 7799412 - DNA, 22 bp, Homo sapiens
acagattttaaatgacactccc

SEQ ID NO: 7799413 - DNA, 22 bp, Homo sapiens
acagatttgttcttttgggcta

SEQ ID NO: 7799414 - DNA, 22 bp, Homo sapiens
acagattttattattcaggtat

SEQ ID NO: 7799415 - DNA, 21 bp, Homo sapiens
acagattttatatctctgctg

SEQ ID NO: 7799416 - DNA, 22 bp, Homo sapiens
acagatttttggtaaataattt

SEQ ID NO: 7799417 - DNA, 22 bp, Homo sapiens
acagtgctaaacacttcttgaa

SEQ ID NO: 7799418 - DNA, 22 bp, Homo sapiens
acagtgctgtcaaatatgtttt

SEQ ID NO: 7799419 - DNA, 22 bp, Homo sapiens
acagtgctggctacaaccctgg

SEQ ID NO: 7799420 - DNA, 22 bp, Homo sapiens
acagtgctgatctagactgacc

SEQ ID NO: 7799421 - DNA, 22 bp, Homo sapiens
acagtgctgaacgacatggaag

SEQ ID NO: 7799422 - DNA, 22 bp, Homo sapiens
acagtgctcatgtgacatggtg

SEQ ID NO: 7799423 - DNA, 22 bp, Homo sapiens
acagtgctaatgatgccaagat

SEQ ID NO: 7799424 - DNA, 22 bp, Homo sapiens
acagtgctatcaatagctagaa

SEQ ID NO: 7799425 - DNA, 18 bp, Homo sapiens
acagtgctgtcactgctt

SEQ ID NO: 7799426 - DNA, 22 bp, Homo sapiens
acagtgtccccagctctgtgag

SEQ ID NO: 7799427 - DNA, 22 bp, Homo sapiens
acagtgtcatgtcgtgttcccc

SEQ ID NO: 7799428 - DNA, 22 bp, Homo sapiens
acagtgtcatcagtttctcaac

SEQ ID NO: 7799429 - DNA, 22 bp, Homo sapiens
acagtttactggccttgccgtt

SEQ ID NO: 7799430 - DNA, 22 bp, Homo sapiens
acagtgtccttgtggtccctgt

SEQ ID NO: 7799431 - DNA, 22 bp, Homo sapiens
acagtttacagggatttgagct

SEQ ID NO: 7799432 - DNA, 22 bp, Homo sapiens
tcacatatttaagaaagttaaa

SEQ ID NO: 7799433 - DNA, 18 bp, Homo sapiens
tcaaaatatttctgtgga

SEQ ID NO: 7799434 - DNA, 22 bp, Homo sapiens
tcaaaaatggtctttgagctgc

SEQ ID NO: 7799435 - DNA, 22 bp, Homo sapiens
tcaaaaatggtctttgagctgc

SEQ ID NO: 7799436 - DNA, 20 bp, Homo sapiens
tcaaaataggtgtgggcgga

SEQ ID NO: 7799437 - DNA, 22 bp, Homo sapiens
tcaaaagtttcacatagagata

SEQ ID NO: 7799438 - DNA, 22 bp, Homo sapiens
tcaatgatagtacaatcagcct

SEQ ID NO: 7799439 - DNA, 22 bp, Homo sapiens
tcaattctggtcctcaggaact

SEQ ID NO: 7799440 - DNA, 22 bp, Homo sapiens
tcaattctagagccttacattg

SEQ ID NO: 7799441 - DNA, 22 bp, Homo sapiens
tcaattctagagccttacattg

SEQ ID NO: 7799442 - DNA, 23 bp, Homo sapiens
tcaattatcaatggaaagaagtt

SEQ ID NO: 7799443 - DNA, 22 bp, Homo sapiens
tcaatgtttgttcatgaaaata

SEQ ID NO: 7799444 - DNA, 22 bp, Homo sapiens
tcaatgttcaagtatgacaatg

SEQ ID NO: 7799445 - DNA, 22 bp, Homo sapiens
tcaattctggtcctcaggaact

SEQ ID NO: 7799446 - DNA, 22 bp, Homo sapiens
tcagaacatcctggtttaaaat

SEQ ID NO: 7799447 - DNA, 22 bp, Homo sapiens
tcagaacagttcttaatattgc

SEQ ID NO: 7799448 - DNA, 22 bp, Homo sapiens
tcagaacagttcttaatattgc

SEQ ID NO: 7799449 - DNA, 22 bp, Homo sapiens
tcactgtaataggtttgaagat

SEQ ID NO: 7799450 - DNA, 22 bp, Homo sapiens
tcactgctttcaaaaattattg

SEQ ID NO: 7799451 - DNA, 20 bp, Homo sapiens
tcactggccagagtagccct

SEQ ID NO: 7799452 - DNA, 22 bp, Homo sapiens
tcactggcaacttgtgctccct

SEQ ID NO: 7799453 - DNA, 22 bp, Homo sapiens
tcacatctgttgatacagcatc

SEQ ID NO: 7799454 - DNA, 20 bp, Homo sapiens
tcacatctggcagctgatga

SEQ ID NO: 7799455 - DNA, 21 bp, Homo sapiens
tcacgtggtcacatgagcttt

SEQ ID NO: 7799456 - DNA, 22 bp, Homo sapiens
tcagaacattgacattcttatt

SEQ ID NO: 7799457 - DNA, 22 bp, Homo sapiens
tcagaagataaagctttttgtt

SEQ ID NO: 7799458 - DNA, 22 bp, Homo sapiens
tcagaagaaagatgttattact

SEQ ID NO: 7799459 - DNA, 22 bp, Homo sapiens
tcagagaatctctccttagttt

SEQ ID NO: 7799460 - DNA, 22 bp, Homo sapiens
tcagagaattgtttaatggaat

SEQ ID NO: 7799461 - DNA, 22 bp, Homo sapiens
tcagagaattgtttaatggaat

SEQ ID NO: 7799462 - DNA, 22 bp, Homo sapiens
tcagagaattcgattaaatgca

SEQ ID NO: 7799463 - DNA, 22 bp, Homo sapiens
tcagagaatgtgaatattaaac

SEQ ID NO: 7799464 - DNA, 22 bp, Homo sapiens
tcagagaagtaggctaatggtg

SEQ ID NO: 7799465 - DNA, 22 bp, Homo sapiens
tcagagaagtaaggtggggtgc

SEQ ID NO: 7799466 - DNA, 22 bp, Homo sapiens
tcagagaggattttaataagtg

SEQ ID NO: 7799467 - DNA, 23 bp, Homo sapiens
tcagagagctgttgagagctgcc

SEQ ID NO: 7799468 - DNA, 18 bp, Homo sapiens
tcagagagcagctttatt

SEQ ID NO: 7799469 - DNA, 22 bp, Homo sapiens
tcagagagcagaacttttttac

SEQ ID NO: 7799470 - DNA, 22 bp, Homo sapiens
tcagagagcctcaggcactgcc

SEQ ID NO: 7799471 - DNA, 22 bp, Homo sapiens
tcagagagctggtgggcagagg

SEQ ID NO: 7799472 - DNA, 22 bp, Homo sapiens
tcagagagaaatagtttttgac

SEQ ID NO: 7799473 - DNA, 18 bp, Homo sapiens
tcagagagaatagtaatt

SEQ ID NO: 7799474 - DNA, 20 bp, Homo sapiens
tcagagagagggtgccactt

SEQ ID NO: 7799475 - DNA, 22 bp, Homo sapiens
tcataaaatgctcctgatattg

SEQ ID NO: 7799476 - DNA, 22 bp, Homo sapiens
tcatctcagagaggtatgttag

SEQ ID NO: 7799477 - DNA, 22 bp, Homo sapiens
tcagtttgaatgttagcacagt

SEQ ID NO: 7799478 - DNA, 22 bp, Homo sapiens
tcagtgcttgacagctctggga

SEQ ID NO: 7799479 - DNA, 22 bp, Homo sapiens
tcagtgcttgcctctggaggag

SEQ ID NO: 7799480 - DNA, 22 bp, Homo sapiens
tcagtgcttttgtcacatggtc

SEQ ID NO: 7799481 - DNA, 22 bp, Homo sapiens
tcagttagggcctcagaagaca

SEQ ID NO: 7799482 - DNA, 22 bp, Homo sapiens
tcaggctctgagctgatgctaa

SEQ ID NO: 7799483 - DNA, 22 bp, Homo sapiens
tcagggactgcagagggaagct

SEQ ID NO: 7799484 - DNA, 22 bp, Homo sapiens
tcagctgtgatccatctatcta

SEQ ID NO: 7799485 - DNA, 22 bp, Homo sapiens
tcagcctgcgtcatggtgacac

SEQ ID NO: 7799486 - DNA, 22 bp, Homo sapiens
tcagcttgctaaaagggcatct

SEQ ID NO: 7799487 - DNA, 22 bp, Homo sapiens
tcagctttcctgcagctaaggg

SEQ ID NO: 7799488 - DNA, 22 bp, Homo sapiens
tcagctttctcaaagaagctgg

SEQ ID NO: 7799489 - DNA, 22 bp, Homo sapiens
tcagctttctatgttgctaaac

SEQ ID NO: 7799490 - DNA, 22 bp, Homo sapiens
tcagctttccttgctttagatt

SEQ ID NO: 7799491 - DNA, 22 bp, Homo sapiens
tcagctttccttgctttagatt

SEQ ID NO: 7799492 - DNA, 20 bp, Homo sapiens
tcagccattccttacctttc

SEQ ID NO: 7799493 - DNA, 22 bp, Homo sapiens
tcagaggtgcaagaagttctga

SEQ ID NO: 7799494 - DNA, 22 bp, Homo sapiens
tcaggagcttggtagtgtgatt

SEQ ID NO: 7799495 - DNA, 22 bp, Homo sapiens
tcaggagctgcactgggcccac

SEQ ID NO: 7799496 - DNA, 22 bp, Homo sapiens
tcaggagctcttccctggtgtg

SEQ ID NO: 7799497 - DNA, 22 bp, Homo sapiens
tcagctttctcaaagaagctgg

SEQ ID NO: 7799498 - DNA, 22 bp, Homo sapiens
tcagctttctctcgccatcagg

SEQ ID NO: 7799499 - DNA, 22 bp, Homo sapiens
tcagctttctcagaggcctaac

SEQ ID NO: 7799500 - DNA, 22 bp, Homo sapiens
tcaggaaagagtaatgtataca

SEQ ID NO: 7799501 - DNA, 22 bp, Homo sapiens
tcaggcaggaagcccctgcaca

SEQ ID NO: 7799502 - DNA, 22 bp, Homo sapiens
tcaggcaccccttgagtagggg

SEQ ID NO: 7799503 - DNA, 22 bp, Homo sapiens
tcaggcaaggcccttagagtgt

SEQ ID NO: 7799504 - DNA, 22 bp, Homo sapiens
tccaggaatgtgtgtgggctag

SEQ ID NO: 7799505 - DNA, 20 bp, Homo sapiens
tccaggagaactgggagccg

SEQ ID NO: 7799506 - DNA, 20 bp, Homo sapiens
tccaggagaactgggagccg

SEQ ID NO: 7799507 - DNA, 23 bp, Homo sapiens
tccaggagcatgctggctggcga

SEQ ID NO: 7799508 - DNA, 22 bp, Homo sapiens
tccaggaacgagaggctgggca

SEQ ID NO: 7799509 - DNA, 22 bp, Homo sapiens
tccaggaactcttgatggtgat

SEQ ID NO: 7799510 - DNA, 22 bp, Homo sapiens
tccaggaagccacactgggcct

SEQ ID NO: 7799511 - DNA, 22 bp, Homo sapiens
tcatgttttagtaaagtgaagg

SEQ ID NO: 7799512 - DNA, 22 bp, Homo sapiens
tcatgttttagctgcaaaatga

SEQ ID NO: 7799513 - DNA, 22 bp, Homo sapiens
tcatgttttagtaaagtgaagg

SEQ ID NO: 7799514 - DNA, 22 bp, Homo sapiens
tcatgttttagctgcaaaatga

SEQ ID NO: 7799515 - DNA, 22 bp, Homo sapiens
tcatgtttgttggaaatgtggc

SEQ ID NO: 7799516 - DNA, 22 bp, Homo sapiens
tcatgtttgttggaaatgtggc

SEQ ID NO: 7799517 - DNA, 22 bp, Homo sapiens
tcatgtttgccctaagaaaaag

SEQ ID NO: 7799518 - DNA, 22 bp, Homo sapiens
tcatgtttctcttacagcagct

SEQ ID NO: 7799519 - DNA, 22 bp, Homo sapiens
tcatggcttttattatgttgag

SEQ ID NO: 7799520 - DNA, 22 bp, Homo sapiens
tcatggctttttcactgttcgc

SEQ ID NO: 7799521 - DNA, 18 bp, Homo sapiens
tcatggctttagtccctc

SEQ ID NO: 7799522 - DNA, 22 bp, Homo sapiens
tcatggctggaagctcagttag

SEQ ID NO: 7799523 - DNA, 20 bp, Homo sapiens
tcatggctgctgagaggttc

SEQ ID NO: 7799524 - DNA, 19 bp, Homo sapiens
tccaccccagccagctctg

SEQ ID NO: 7799525 - DNA, 22 bp, Homo sapiens
tccacccccagacagctggtga

SEQ ID NO: 7799526 - DNA, 22 bp, Homo sapiens
tccagaaaaagtaatttatttg

SEQ ID NO: 7799527 - DNA, 22 bp, Homo sapiens
tccactccttatgccagacggt

SEQ ID NO: 7799528 - DNA, 21 bp, Homo sapiens
tccaccctctctgctcccagt

SEQ ID NO: 7799529 - DNA, 22 bp, Homo sapiens
tccaccctgcttttgtctttga

SEQ ID NO: 7799530 - DNA, 22 bp, Homo sapiens
tccaccctgctttcttatctcc

SEQ ID NO: 7799531 - DNA, 22 bp, Homo sapiens
tccagggagatactggctgcca

SEQ ID NO: 7799532 - DNA, 22 bp, Homo sapiens
tccagggagagccgctgctcca

SEQ ID NO: 7799533 - DNA, 22 bp, Homo sapiens
tccaggccattgactgcatcct

SEQ ID NO: 7799534 - DNA, 22 bp, Homo sapiens
tccaggaggaggaaggctgcca

SEQ ID NO: 7799535 - DNA, 22 bp, Homo sapiens
tccagtggcaccttggccctca

SEQ ID NO: 7799536 - DNA, 22 bp, Homo sapiens
tccagggagcaagtcaggccgg

SEQ ID NO: 7799537 - DNA, 22 bp, Homo sapiens
tcccagcctttcttttctgctg

SEQ ID NO: 7799538 - DNA, 22 bp, Homo sapiens
tccagtgtttttcttcacaggt

SEQ ID NO: 7799539 - DNA, 22 bp, Homo sapiens
tccagtgttgtcagatcatctg

SEQ ID NO: 7799540 - DNA, 19 bp, Homo sapiens
tccagtgtagctggtcatt

SEQ ID NO: 7799541 - DNA, 21 bp, Homo sapiens
tcccactgccacagcttcagg

SEQ ID NO: 7799542 - DNA, 22 bp, Homo sapiens
tcctccagctgtatcctgcctg

SEQ ID NO: 7799543 - DNA, 22 bp, Homo sapiens
tccgccaggactgagggcccat

SEQ ID NO: 7799544 - DNA, 22 bp, Homo sapiens
tccgggaggcagaggttgcagt

SEQ ID NO: 7799545 - DNA, 22 bp, Homo sapiens
tcctcagttataaataggaaac

SEQ ID NO: 7799546 - DNA, 22 bp, Homo sapiens
tcctcagtggggcattcattat

SEQ ID NO: 7799547 - DNA, 22 bp, Homo sapiens
tcctcagtcacggtagcacatt

SEQ ID NO: 7799548 - DNA, 22 bp, Homo sapiens
tccgggcaactgaagggaggtt

SEQ ID NO: 7799549 - DNA, 22 bp, Homo sapiens
tccctgatgccttgatccgtgg

SEQ ID NO: 7799550 - DNA, 22 bp, Homo sapiens
tccctgcacccttgctgggccc

SEQ ID NO: 7799551 - DNA, 22 bp, Homo sapiens
tccctgcacagccgagccatgc

SEQ ID NO: 7799552 - DNA, 22 bp, Homo sapiens
tccctgcagtaggcagccctcc

SEQ ID NO: 7799553 - DNA, 22 bp, Homo sapiens
tccctgcagcccctgagccttc

SEQ ID NO: 7799554 - DNA, 22 bp, Homo sapiens
tccctgcagctgtaggccggcg

SEQ ID NO: 7799555 - DNA, 22 bp, Homo sapiens
tccctgcaggtggggtggccag

SEQ ID NO: 7799556 - DNA, 22 bp, Homo sapiens
tccctgccctcagtgcacccgg

SEQ ID NO: 7799557 - DNA, 22 bp, Homo sapiens
tcccaggcaaaggcagctcatt

SEQ ID NO: 7799558 - DNA, 22 bp, Homo sapiens
tccctggggatgttggcctgcc

SEQ ID NO: 7799559 - DNA, 22 bp, Homo sapiens
tagcagggttttgaagagggtt

SEQ ID NO: 7799560 - DNA, 22 bp, Homo sapiens
tagcacagttcactatgataca

SEQ ID NO: 7799561 - DNA, 22 bp, Homo sapiens
tagcaaaaactgcagttacttt

SEQ ID NO: 7799562 - DNA, 22 bp, Homo sapiens
tagcacagcttcttgatgtcac

SEQ ID NO: 7799563 - DNA, 23 bp, Homo sapiens
tagaatcctctgagatggaatag

SEQ ID NO: 7799564 - DNA, 22 bp, Homo sapiens
tagaaggctttgagagatactt

SEQ ID NO: 7799565 - DNA, 22 bp, Homo sapiens
tagaaggcccattcatttgttc

SEQ ID NO: 7799566 - DNA, 22 bp, Homo sapiens
tagagctagcttcaaaatgcga

SEQ ID NO: 7799567 - DNA, 22 bp, Homo sapiens
taggttcactgtcttgaggagc

SEQ ID NO: 7799568 - DNA, 22 bp, Homo sapiens
taggttcacacatcttccagat

SEQ ID NO: 7799569 - DNA, 22 bp, Homo sapiens
taggttcacacatcttccagat

SEQ ID NO: 7799570 - DNA, 22 bp, Homo sapiens
taggttcagtgtcttgttctgc

SEQ ID NO: 7799571 - DNA, 22 bp, Homo sapiens
taggttcatgaaattttcagga

SEQ ID NO: 7799572 - DNA, 22 bp, Homo sapiens
taggttcatattctagaatcat

SEQ ID NO: 7799573 - DNA, 22 bp, Homo sapiens
taggttcacttagctgtgggaa

SEQ ID NO: 7799574 - DNA, 22 bp, Homo sapiens
taggttcagagaactgaaaata

SEQ ID NO: 7799575 - DNA, 22 bp, Homo sapiens
taggttcagagaactgaaaata

SEQ ID NO: 7799576 - DNA, 22 bp, Homo sapiens
taggtttaggagtgaaggtgaa

SEQ ID NO: 7799577 - DNA, 22 bp, Homo sapiens
taggtttactgaattagtggaa

SEQ ID NO: 7799578 - DNA, 22 bp, Homo sapiens
tagtattttagaaaaccatgaa

SEQ ID NO: 7799579 - DNA, 22 bp, Homo sapiens
tagtatttataatcatgcttaa

SEQ ID NO: 7799580 - DNA, 22 bp, Homo sapiens
tagtcacagtacaggataaaga

SEQ ID NO: 7799581 - DNA, 22 bp, Homo sapiens
tagtctaagaaatctttacttt

SEQ ID NO: 7799582 - DNA, 22 bp, Homo sapiens
taggaagtaaactttcttcagc

SEQ ID NO: 7799583 - DNA, 22 bp, Homo sapiens
taggaagtagataggttgttct

SEQ ID NO: 7799584 - DNA, 22 bp, Homo sapiens
taggaaatgctccattgcataa

SEQ ID NO: 7799585 - DNA, 22 bp, Homo sapiens
taggaaatggctcagttactgc

SEQ ID NO: 7799586 - DNA, 22 bp, Homo sapiens
taggaaatactgtaagtttggg

SEQ ID NO: 7799587 - DNA, 22 bp, Homo sapiens
taggaaatatttgaacatagga

SEQ ID NO: 7799588 - DNA, 22 bp, Homo sapiens
tagccatttttattaatgctgg

SEQ ID NO: 7799589 - DNA, 22 bp, Homo sapiens
tagccattgacttaaagcttat

SEQ ID NO: 7799590 - DNA, 22 bp, Homo sapiens
tattgaggatctcctgctaatt

SEQ ID NO: 7799591 - DNA, 22 bp, Homo sapiens
tattgaggtgcttagctggggg

SEQ ID NO: 7799592 - DNA, 22 bp, Homo sapiens
tatgtttatactttgatgtact

SEQ ID NO: 7799593 - DNA, 22 bp, Homo sapiens
tatgtttagtatccattttcag

SEQ ID NO: 7799594 - DNA, 22 bp, Homo sapiens
tattcacagctgccgcactcag

SEQ ID NO: 7799595 - DNA, 22 bp, Homo sapiens
tattcacatgaaaacaaatttt

SEQ ID NO: 7799596 - DNA, 22 bp, Homo sapiens
tatgtttaaatgtatgtgtatg

SEQ ID NO: 7799597 - DNA, 22 bp, Homo sapiens
tatgtttacgctggtagaatta

SEQ ID NO: 7799598 - DNA, 22 bp, Homo sapiens
tatgccagactgtgagcttctt

SEQ ID NO: 7799599 - DNA, 22 bp, Homo sapiens
tatgccagggactgtttcacca

SEQ ID NO: 7799600 - DNA, 22 bp, Homo sapiens
tatgctattcttcagagtgttc

SEQ ID NO: 7799601 - DNA, 22 bp, Homo sapiens
tatgtgtttgacaccctgcaag

SEQ ID NO: 7799602 - DNA, 22 bp, Homo sapiens
tatttcctgtggatacttttag

SEQ ID NO: 7799603 - DNA, 22 bp, Homo sapiens
tatttcagggagaataaatttg

SEQ ID NO: 7799604 - DNA, 22 bp, Homo sapiens
tattttcaccttctctggatat

SEQ ID NO: 7799605 - DNA, 22 bp, Homo sapiens
tattttcaccttctctggatat

SEQ ID NO: 7799606 - DNA, 22 bp, Homo sapiens
tatttgttgcgggaattgctat

SEQ ID NO: 7799607 - DNA, 22 bp, Homo sapiens
tatttgttgcgggaattgctat

SEQ ID NO: 7799608 - DNA, 22 bp, Homo sapiens
tatttgtttctagtggcagcaa

SEQ ID NO: 7799609 - DNA, 22 bp, Homo sapiens
tattttcaccatgtatccctgt

SEQ ID NO: 7799610 - DNA, 22 bp, Homo sapiens
tattttcattctgtgtgactgt

SEQ ID NO: 7799611 - DNA, 22 bp, Homo sapiens
tattttcattctgtgtgactgt

SEQ ID NO: 7799612 - DNA, 22 bp, Homo sapiens
tattttcatcttgtccttggat

SEQ ID NO: 7799613 - DNA, 22 bp, Homo sapiens
tatttgttgagttgttatgtct

SEQ ID NO: 7799614 - DNA, 22 bp, Homo sapiens
tatttgttgagttgttatgtct

SEQ ID NO: 7799615 - DNA, 22 bp, Homo sapiens
tatttgttgaatacccctgtct

SEQ ID NO: 7799616 - DNA, 22 bp, Homo sapiens
tatttgttccagagataaaaat

SEQ ID NO: 7799617 - DNA, 22 bp, Homo sapiens
tatttgttccagagataaaaat

SEQ ID NO: 7799618 - DNA, 19 bp, Homo sapiens
tatttcaggctcagagtct

SEQ ID NO: 7799619 - DNA, 22 bp, Homo sapiens
tatttcaacgtatgaaaagctg

SEQ ID NO: 7799620 - DNA, 22 bp, Homo sapiens
tatttcaacgtatgaaaagctg

SEQ ID NO: 7799621 - DNA, 22 bp, Homo sapiens
tatttcaccaccgctgatgaag

SEQ ID NO: 7799622 - DNA, 22 bp, Homo sapiens
tattgtacatttcaaagtagct

SEQ ID NO: 7799623 - DNA, 22 bp, Homo sapiens
tattggtcttctgttccctatt

SEQ ID NO: 7799624 - DNA, 22 bp, Homo sapiens
tattggtgatgacttgaggcca

SEQ ID NO: 7799625 - DNA, 22 bp, Homo sapiens
tatagatagactgacgatacag

SEQ ID NO: 7799626 - DNA, 22 bp, Homo sapiens
tagttaaagattctgttaagag

SEQ ID NO: 7799627 - DNA, 22 bp, Homo sapiens
tatacagaaccgcctgaagtct

SEQ ID NO: 7799628 - DNA, 22 bp, Homo sapiens
tagtgtatgttcagcttatatg

SEQ ID NO: 7799629 - DNA, 22 bp, Homo sapiens
tatcttcttgccaggctggtgt

SEQ ID NO: 7799630 - DNA, 22 bp, Homo sapiens
tatcttctcagtatatgggatg

SEQ ID NO: 7799631 - DNA, 22 bp, Homo sapiens
tatcttaaatgcatgatagaca

SEQ ID NO: 7799632 - DNA, 22 bp, Homo sapiens
tatcttaaaaatcgaagcagat

SEQ ID NO: 7799633 - DNA, 22 bp, Homo sapiens
tatctttaacttgcagtattta

SEQ ID NO: 7799634 - DNA, 22 bp, Homo sapiens
tatctttagaggaagagaatct

SEQ ID NO: 7799635 - DNA, 22 bp, Homo sapiens
tatgcagtggtatcattttaaa

SEQ ID NO: 7799636 - DNA, 22 bp, Homo sapiens
tatgcagcaccactcactgcag

SEQ ID NO: 7799637 - DNA, 22 bp, Homo sapiens
tatctttgtatcaatctccatt

SEQ ID NO: 7799638 - DNA, 22 bp, Homo sapiens
tatcaaaaggagttgaaagggg

SEQ ID NO: 7799639 - DNA, 22 bp, Homo sapiens
tatattttagacaccctcacgc

SEQ ID NO: 7799640 - DNA, 22 bp, Homo sapiens
tatcaatatctcagtgtgcttc

SEQ ID NO: 7799641 - DNA, 22 bp, Homo sapiens
tacacattagtcaagagtttga

SEQ ID NO: 7799642 - DNA, 22 bp, Homo sapiens
tacacatatgtccattaatcag

SEQ ID NO: 7799643 - DNA, 22 bp, Homo sapiens
taatttcttcatctctgcagct

SEQ ID NO: 7799644 - DNA, 22 bp, Homo sapiens
taattttccactctgtttatct

SEQ ID NO: 7799645 - DNA, 22 bp, Homo sapiens
taatttttccacgtacactggg

SEQ ID NO: 7799646 - DNA, 22 bp, Homo sapiens
tacaagctggcgcagttaagat

SEQ ID NO: 7799647 - DNA, 19 bp, Homo sapiens
tacaagcttaaagtaatgt

SEQ ID NO: 7799648 - DNA, 22 bp, Homo sapiens
tacaagctcgggcagctcatta

SEQ ID NO: 7799649 - DNA, 22 bp, Homo sapiens
tacaagctgaccctgaagatga

SEQ ID NO: 7799650 - DNA, 22 bp, Homo sapiens
tacaatatgtggccttttgtga

SEQ ID NO: 7799651 - DNA, 22 bp, Homo sapiens
tacaagcttttgtgtataaatg

SEQ ID NO: 7799652 - DNA, 23 bp, Homo sapiens
taatgagaagctttgtttcctga

SEQ ID NO: 7799653 - DNA, 22 bp, Homo sapiens
taatgaatgagaatataacaga

SEQ ID NO: 7799654 - DNA, 22 bp, Homo sapiens
taatgaatgagaatataacaga

SEQ ID NO: 7799655 - DNA, 22 bp, Homo sapiens
taatgaataaacttgagagtca

SEQ ID NO: 7799656 - DNA, 22 bp, Homo sapiens
taatttcactgatatgaagtca

SEQ ID NO: 7799657 - DNA, 22 bp, Homo sapiens
taatttcacagttcaacgcaca

SEQ ID NO: 7799658 - DNA, 22 bp, Homo sapiens
taatttcaccgttgctagaaat

SEQ ID NO: 7799659 - DNA, 22 bp, Homo sapiens
taatttcagtgggctctgggct

SEQ ID NO: 7799660 - DNA, 22 bp, Homo sapiens
taatttcagtgcaagctcacgg

SEQ ID NO: 7799661 - DNA, 22 bp, Homo sapiens
taatgcttaattttcacaagcc

SEQ ID NO: 7799662 - DNA, 22 bp, Homo sapiens
taatgcttttccttcaaataag

SEQ ID NO: 7799663 - DNA, 22 bp, Homo sapiens
taataacaattgtaggacatga

SEQ ID NO: 7799664 - DNA, 22 bp, Homo sapiens
taataaatgaaagtgctggcat

SEQ ID NO: 7799665 - DNA, 22 bp, Homo sapiens
taagttttaagcaatctgataa

SEQ ID NO: 7799666 - DNA, 22 bp, Homo sapiens
taagcaatgctgtagttcagtc

SEQ ID NO: 7799667 - DNA, 22 bp, Homo sapiens
tacagtttttattcatgacaag

SEQ ID NO: 7799668 - DNA, 22 bp, Homo sapiens
tacagtttttattcatgacaag

SEQ ID NO: 7799669 - DNA, 22 bp, Homo sapiens
tacagttactgttatatgtgct

SEQ ID NO: 7799670 - DNA, 22 bp, Homo sapiens
tacattatcttgttatctttca

SEQ ID NO: 7799671 - DNA, 22 bp, Homo sapiens
tacttattgttgaactgaatca

SEQ ID NO: 7799672 - DNA, 22 bp, Homo sapiens
tactgatatgatgtgctttaga

SEQ ID NO: 7799673 - DNA, 22 bp, Homo sapiens
tacgcctgtaatcccagcactt

SEQ ID NO: 7799674 - DNA, 22 bp, Homo sapiens
tacgcgaagaaggacctgatgg

SEQ ID NO: 7799675 - DNA, 22 bp, Homo sapiens
tacgcctgtaatcccagcactt

SEQ ID NO: 7799676 - DNA, 22 bp, Homo sapiens
tacccagcaatccctagaggtt

SEQ ID NO: 7799677 - DNA, 22 bp, Homo sapiens
tacccagcccatgcctacctca

SEQ ID NO: 7799678 - DNA, 22 bp, Homo sapiens
tacccagcttcaagtcaggact

SEQ ID NO: 7799679 - DNA, 22 bp, Homo sapiens
tacccagctcctcagaagacca

SEQ ID NO: 7799680 - DNA, 22 bp, Homo sapiens
tacctgcaaagttccttttgcc

SEQ ID NO: 7799681 - DNA, 22 bp, Homo sapiens
tacctgcacagccagccatgtg

SEQ ID NO: 7799682 - DNA, 19 bp, Homo sapiens
tacattccacacaatctct

SEQ ID NO: 7799683 - DNA, 22 bp, Homo sapiens
tacattccacaagcattgcttt

SEQ ID NO: 7799684 - DNA, 22 bp, Homo sapiens
tacattcccccaattaccaatg

SEQ ID NO: 7799685 - DNA, 22 bp, Homo sapiens
tacctggcagtcagtctttccg

SEQ ID NO: 7799686 - DNA, 22 bp, Homo sapiens
tacctgcagcgggaatccatta

SEQ ID NO: 7799687 - DNA, 22 bp, Homo sapiens
tacctgttttaaagctaaaagg

SEQ ID NO: 7799688 - DNA, 22 bp, Homo sapiens
tacctgttgtcacgataacact

SEQ ID NO: 7799689 - DNA, 22 bp, Homo sapiens
gttaggaacactggagcctaaa

SEQ ID NO: 7799690 - DNA, 22 bp, Homo sapiens
gttagggatcaggaacaagagc

SEQ ID NO: 7799691 - DNA, 22 bp, Homo sapiens
gttaggtagaagtttactttga

SEQ ID NO: 7799692 - DNA, 22 bp, Homo sapiens
gttagggagggtgcatatgtgt

SEQ ID NO: 7799693 - DNA, 22 bp, Homo sapiens
gttagggagtcaggtggctctt

SEQ ID NO: 7799694 - DNA, 22 bp, Homo sapiens
gttagggaagcgctgtgttctt

SEQ ID NO: 7799695 - DNA, 22 bp, Homo sapiens
gttacaaatgccaaagctgaga

SEQ ID NO: 7799696 - DNA, 22 bp, Homo sapiens
gttataaaatgcacagttgttt

SEQ ID NO: 7799697 - DNA, 22 bp, Homo sapiens
gttataaatacctaataggatt

SEQ ID NO: 7799698 - DNA, 22 bp, Homo sapiens
gttataaaggtgataatggtca

SEQ ID NO: 7799699 - DNA, 22 bp, Homo sapiens
gttccaaatttggatctttagg

SEQ ID NO: 7799700 - DNA, 22 bp, Homo sapiens
gtttctcacttaccaacacatg

SEQ ID NO: 7799701 - DNA, 22 bp, Homo sapiens
gtttataaggtaaaggagagag

SEQ ID NO: 7799702 - DNA, 22 bp, Homo sapiens
gtttataatgtctgtgccaaaa

SEQ ID NO: 7799703 - DNA, 22 bp, Homo sapiens
gtttataatccaactctgctcc

SEQ ID NO: 7799704 - DNA, 22 bp, Homo sapiens
gttttacacacctatgaaagac

SEQ ID NO: 7799705 - DNA, 22 bp, Homo sapiens
gttttacaaggttaatcagcag

SEQ ID NO: 7799706 - DNA, 23 bp, Homo sapiens
gttttacaggtgagaaaatggag

SEQ ID NO: 7799707 - DNA, 20 bp, Homo sapiens
gtttagcatggcagtgaaag

SEQ ID NO: 7799708 - DNA, 22 bp, Homo sapiens
gtttataaattctgcttttgtt

SEQ ID NO: 7799709 - DNA, 22 bp, Homo sapiens
gtttataaggcccaatatttct

SEQ ID NO: 7799710 - DNA, 22 bp, Homo sapiens
gtttagaatggcaaaattaagt

SEQ ID NO: 7799711 - DNA, 22 bp, Homo sapiens
gtttacattgctgtttgtgtct

SEQ ID NO: 7799712 - DNA, 22 bp, Homo sapiens
gtttacaaatattttaaatggt

SEQ ID NO: 7799713 - DNA, 22 bp, Homo sapiens
gttcctgggcctgcattcacca

SEQ ID NO: 7799714 - DNA, 22 bp, Homo sapiens
gtttaattttaggttgtcaagc

SEQ ID NO: 7799715 - DNA, 22 bp, Homo sapiens
taaacatgttgacatcttacct

SEQ ID NO: 7799716 - DNA, 22 bp, Homo sapiens
taaagtgtggacagtatctata

SEQ ID NO: 7799717 - DNA, 22 bp, Homo sapiens
taaagtgtggacagtatctata

SEQ ID NO: 7799718 - DNA, 22 bp, Homo sapiens
taaagtgtggatatgattagta

SEQ ID NO: 7799719 - DNA, 22 bp, Homo sapiens
taaagtgtgtatatacatatgg

SEQ ID NO: 7799720 - DNA, 22 bp, Homo sapiens
taaagttataaattacctgtca

SEQ ID NO: 7799721 - DNA, 22 bp, Homo sapiens
taaagtgtttgtatgcagataa

SEQ ID NO: 7799722 - DNA, 22 bp, Homo sapiens
taaagtgttgtacaaatgtatg

SEQ ID NO: 7799723 - DNA, 22 bp, Homo sapiens
taaagtttatttgaacatctct

SEQ ID NO: 7799724 - DNA, 22 bp, Homo sapiens
taaagtttattggcaccaccat

SEQ ID NO: 7799725 - DNA, 22 bp, Homo sapiens
taaagtttgtagcaattgatat

SEQ ID NO: 7799726 - DNA, 22 bp, Homo sapiens
taaagtttggcagacaataaca

SEQ ID NO: 7799727 - DNA, 22 bp, Homo sapiens
gttttataggtgaaatattact

SEQ ID NO: 7799728 - DNA, 22 bp, Homo sapiens
gttttatttccatgagagaccg

SEQ ID NO: 7799729 - DNA, 22 bp, Homo sapiens
gttttatttccatgagagaccg

SEQ ID NO: 7799730 - DNA, 22 bp, Homo sapiens
gttttattggaacacagccatg

SEQ ID NO: 7799731 - DNA, 22 bp, Homo sapiens
gttttattggaacacagccatg

SEQ ID NO: 7799732 - DNA, 22 bp, Homo sapiens
taaacatggctgtttcagttat

SEQ ID NO: 7799733 - DNA, 22 bp, Homo sapiens
taaacagagtgctagttcacgg

SEQ ID NO: 7799734 - DNA, 22 bp, Homo sapiens
taagagttagggctagcaatat

SEQ ID NO: 7799735 - DNA, 22 bp, Homo sapiens
taagaaatttagttatagaatg

SEQ ID NO: 7799736 - DNA, 22 bp, Homo sapiens
taacttagaagtttaattgtat

SEQ ID NO: 7799737 - DNA, 22 bp, Homo sapiens
taacttctggaaatgcatctgc

SEQ ID NO: 7799738 - DNA, 22 bp, Homo sapiens
taacacatatctacaacatgtg

SEQ ID NO: 7799739 - DNA, 22 bp, Homo sapiens
taacacatagatattttaactt

SEQ ID NO: 7799740 - DNA, 22 bp, Homo sapiens
taacacataagctgagaccatg

SEQ ID NO: 7799741 - DNA, 21 bp, Homo sapiens
taacacattttggtactttgg

SEQ ID NO: 7799742 - DNA, 22 bp, Homo sapiens
taaatactttacaggatgtctc

SEQ ID NO: 7799743 - DNA, 22 bp, Homo sapiens
taaatacttagttttgtgtcta

SEQ ID NO: 7799744 - DNA, 22 bp, Homo sapiens
taacacaaaagaatatgtgtgt

SEQ ID NO: 7799745 - DNA, 23 bp, Homo sapiens
gctctggcagcttgtgtcagcac

SEQ ID NO: 7799746 - DNA, 22 bp, Homo sapiens
gctctcagggtgatggcatact

SEQ ID NO: 7799747 - DNA, 22 bp, Homo sapiens
gctctcagatgctccagcagcc

SEQ ID NO: 7799748 - DNA, 22 bp, Homo sapiens
gctctcagaagagccaggctac

SEQ ID NO: 7799749 - DNA, 18 bp, Homo sapiens
gctcctggttggaaagaa

SEQ ID NO: 7799750 - DNA, 22 bp, Homo sapiens
gctcctggtgctgtagagattt

SEQ ID NO: 7799751 - DNA, 21 bp, Homo sapiens
gctcctggtgctgcgtggcgc

SEQ ID NO: 7799752 - DNA, 22 bp, Homo sapiens
gctcctggtgcaaagtttcttc

SEQ ID NO: 7799753 - DNA, 22 bp, Homo sapiens
gctcctggtctggagcttcaag

SEQ ID NO: 7799754 - DNA, 22 bp, Homo sapiens
gctgcaggagctggagctgtgg

SEQ ID NO: 7799755 - DNA, 22 bp, Homo sapiens
gctgcaggtttgtctagtctgg

SEQ ID NO: 7799756 - DNA, 22 bp, Homo sapiens
gctgccagtgtggcatgatgca

SEQ ID NO: 7799757 - DNA, 21 bp, Homo sapiens
gcctggcttcacaggcactga

SEQ ID NO: 7799758 - DNA, 22 bp, Homo sapiens
gcctcaggccgccctgctgctc

SEQ ID NO: 7799759 - DNA, 22 bp, Homo sapiens
gcgggccaccttggagagcgct

SEQ ID NO: 7799760 - DNA, 17 bp, Homo sapiens
gccttctctgccctcac

SEQ ID NO: 7799761 - DNA, 22 bp, Homo sapiens
gctggtagacctcactgcactc

SEQ ID NO: 7799762 - DNA, 22 bp, Homo sapiens
gctggtcagagagaaaggaggc

SEQ ID NO: 7799763 - DNA, 16 bp, Homo sapiens
gctgggagggagaggt

SEQ ID NO: 7799764 - DNA, 22 bp, Homo sapiens
gcttccagtaagttgctgccat

SEQ ID NO: 7799765 - DNA, 22 bp, Homo sapiens
gcttccacctactaaatgccac

SEQ ID NO: 7799766 - DNA, 22 bp, Homo sapiens
gctggcagccaagtgaagaggg

SEQ ID NO: 7799767 - DNA, 22 bp, Homo sapiens
gctggcagctggaagttgggct

SEQ ID NO: 7799768 - DNA, 22 bp, Homo sapiens
gctggcagagacaagaagacta

SEQ ID NO: 7799769 - DNA, 22 bp, Homo sapiens
gctggcaggagaaacggggtgc

SEQ ID NO: 7799770 - DNA, 22 bp, Homo sapiens
gctggcaggagaccatacccta

SEQ ID NO: 7799771 - DNA, 22 bp, Homo sapiens
gctggcaggagcctttcccttt

SEQ ID NO: 7799772 - DNA, 22 bp, Homo sapiens
gctggcaggataacttctaagc

SEQ ID NO: 7799773 - DNA, 22 bp, Homo sapiens
gctggcaggatagaagtctaat

SEQ ID NO: 7799774 - DNA, 22 bp, Homo sapiens
gctggcagggacagctgcgtgt

SEQ ID NO: 7799775 - DNA, 22 bp, Homo sapiens
gctggcagaagagctggttcaa

SEQ ID NO: 7799776 - DNA, 22 bp, Homo sapiens
gctggcagaatttcttcttgct

SEQ ID NO: 7799777 - DNA, 19 bp, Homo sapiens
gctggcagaattttgaacc

SEQ ID NO: 7799778 - DNA, 22 bp, Homo sapiens
gctggcagactgggggcagaac

SEQ ID NO: 7799779 - DNA, 22 bp, Homo sapiens
gctggcagacttcctctggaac

SEQ ID NO: 7799780 - DNA, 21 bp, Homo sapiens
gctgcccaaccctgcatctcc

SEQ ID NO: 7799781 - DNA, 22 bp, Homo sapiens
ggactcctctagaagttgaggc

SEQ ID NO: 7799782 - DNA, 23 bp, Homo sapiens
ggactaggcaacagatgggacag

SEQ ID NO: 7799783 - DNA, 22 bp, Homo sapiens
ggacggggagctggaaagggga

SEQ ID NO: 7799784 - DNA, 22 bp, Homo sapiens
ggacctgctctcccagttctct

SEQ ID NO: 7799785 - DNA, 22 bp, Homo sapiens
ggacctgccctggctcagatgc

SEQ ID NO: 7799786 - DNA, 22 bp, Homo sapiens
ggacctgccagaactcaggcta

SEQ ID NO: 7799787 - DNA, 22 bp, Homo sapiens
ggacctgcattttaacaagatc

SEQ ID NO: 7799788 - DNA, 22 bp, Homo sapiens
ggacctgaacataaaacgaggc

SEQ ID NO: 7799789 - DNA, 22 bp, Homo sapiens
ggacctgaacataaaacgaggc

SEQ ID NO: 7799790 - DNA, 22 bp, Homo sapiens
ggaaagggcagaggccttggag

SEQ ID NO: 7799791 - DNA, 22 bp, Homo sapiens
ggaaagctcagatcttgttgga

SEQ ID NO: 7799792 - DNA, 22 bp, Homo sapiens
ggaaagctttgttttcctcacc

SEQ ID NO: 7799793 - DNA, 22 bp, Homo sapiens
ggaaagctttgtacttgaaaac

SEQ ID NO: 7799794 - DNA, 18 bp, Homo sapiens
gcttcctgaaagctgccc

SEQ ID NO: 7799795 - DNA, 20 bp, Homo sapiens
gcttcccaattcttgatctg

SEQ ID NO: 7799796 - DNA, 22 bp, Homo sapiens
gcttcccaggcgcctgaccttt

SEQ ID NO: 7799797 - DNA, 23 bp, Homo sapiens
gcttcccagacaatactgcttcc

SEQ ID NO: 7799798 - DNA, 19 bp, Homo sapiens
gcttcccaccagccagccc

SEQ ID NO: 7799799 - DNA, 20 bp, Homo sapiens
gcatccagacacccagctgc

SEQ ID NO: 7799800 - DNA, 20 bp, Homo sapiens
gcatccagacacccagctgc

SEQ ID NO: 7799801 - DNA, 22 bp, Homo sapiens
gcatccagaggtagccactgtg

SEQ ID NO: 7799802 - DNA, 22 bp, Homo sapiens
gcatccagtcttggctcctgga

SEQ ID NO: 7799803 - DNA, 17 bp, Homo sapiens
gcatccagtaacatgcc

SEQ ID NO: 7799804 - DNA, 22 bp, Homo sapiens
gcatccaggactatatgatgat

SEQ ID NO: 7799805 - DNA, 22 bp, Homo sapiens
gcataaatgtgcacacacatgt

SEQ ID NO: 7799806 - DNA, 20 bp, Homo sapiens
gcatcctcccagcagagctg

SEQ ID NO: 7799807 - DNA, 22 bp, Homo sapiens
gcatgaaatgagcgaatataat

SEQ ID NO: 7799808 - DNA, 22 bp, Homo sapiens
gcatctgatccaatagatatat

SEQ ID NO: 7799809 - DNA, 22 bp, Homo sapiens
gcagtccaaagtggctctcacc

SEQ ID NO: 7799810 - DNA, 22 bp, Homo sapiens
gcagtcccatatctttaacata

SEQ ID NO: 7799811 - DNA, 22 bp, Homo sapiens
gcagtctatcttgtgatttaac

SEQ ID NO: 7799812 - DNA, 22 bp, Homo sapiens
gcagtctataaatcagctttgc

SEQ ID NO: 7799813 - DNA, 22 bp, Homo sapiens
gcagggctcaacaggacacccc

SEQ ID NO: 7799814 - DNA, 22 bp, Homo sapiens
gcattttaataagattcatagg

SEQ ID NO: 7799815 - DNA, 22 bp, Homo sapiens
gcatttttctaatcattggcat

SEQ ID NO: 7799816 - DNA, 22 bp, Homo sapiens
gccagcaggtggagagatcaag

SEQ ID NO: 7799817 - DNA, 22 bp, Homo sapiens
gccagcatagtaagcagtcatc

SEQ ID NO: 7799818 - DNA, 22 bp, Homo sapiens
gccagccataggccagcactgg

SEQ ID NO: 7799819 - DNA, 22 bp, Homo sapiens
gcccagggcttcaaagagagaa

SEQ ID NO: 7799820 - DNA, 22 bp, Homo sapiens
gcccaggggagtagtcaattta

SEQ ID NO: 7799821 - DNA, 22 bp, Homo sapiens
gcccaggggcagcgcatagtgg

SEQ ID NO: 7799822 - DNA, 23 bp, Homo sapiens
gcccagggactgggaatcagtgg

SEQ ID NO: 7799823 - DNA, 22 bp, Homo sapiens
gcccagggcagggcaagagtga

SEQ ID NO: 7799824 - DNA, 22 bp, Homo sapiens
gcccagggctgcaagtggacgc

SEQ ID NO: 7799825 - DNA, 22 bp, Homo sapiens
gcccagggcgatggtcggggcc

SEQ ID NO: 7799826 - DNA, 22 bp, Homo sapiens
gcctacatgcttttagtgtttc

SEQ ID NO: 7799827 - DNA, 22 bp, Homo sapiens
gcctacatttcccagttgaatg

SEQ ID NO: 7799828 - DNA, 22 bp, Homo sapiens
gccaggcacagttctaggtgct

SEQ ID NO: 7799829 - DNA, 23 bp, Homo sapiens
gccaggcacatggtggacacgca

SEQ ID NO: 7799830 - DNA, 22 bp, Homo sapiens
gccaggcaaattaaggaatgca

SEQ ID NO: 7799831 - DNA, 22 bp, Homo sapiens
gccaggcaatgtgttagaagcg

SEQ ID NO: 7799832 - DNA, 22 bp, Homo sapiens
gccaggttgctgacgacgatct

SEQ ID NO: 7799833 - DNA, 22 bp, Homo sapiens
gcactctcctggctgccacagt

SEQ ID NO: 7799834 - DNA, 22 bp, Homo sapiens
gcactgcatctactggcaagta

SEQ ID NO: 7799835 - DNA, 22 bp, Homo sapiens
gcaaatgaaggtggtgctacag

SEQ ID NO: 7799836 - DNA, 22 bp, Homo sapiens
gaggggtcttttgttgtcaggg

SEQ ID NO: 7799837 - DNA, 22 bp, Homo sapiens
gaggggctgggtagggcaaccc

SEQ ID NO: 7799838 - DNA, 22 bp, Homo sapiens
gagggggaaagtccctggagtc

SEQ ID NO: 7799839 - DNA, 22 bp, Homo sapiens
gcaagctgtccttttgcatggc

SEQ ID NO: 7799840 - DNA, 22 bp, Homo sapiens
gcaagcagttgtggcttctgag

SEQ ID NO: 7799841 - DNA, 22 bp, Homo sapiens
gcacagctcgagctcaggaggg

SEQ ID NO: 7799842 - DNA, 22 bp, Homo sapiens
gcacagctctccccaagacgaa

SEQ ID NO: 7799843 - DNA, 22 bp, Homo sapiens
gcacaggatgatgggttgaggg

SEQ ID NO: 7799844 - DNA, 22 bp, Homo sapiens
gcacagctcgagctcaggaggg

SEQ ID NO: 7799845 - DNA, 22 bp, Homo sapiens
gcacagctcctggtaagctggg

SEQ ID NO: 7799846 - DNA, 18 bp, Homo sapiens
gcacagctaggagggtcc

SEQ ID NO: 7799847 - DNA, 22 bp, Homo sapiens
gcaggaggagcattaactgagc

SEQ ID NO: 7799848 - DNA, 22 bp, Homo sapiens
gcaggagctggaaagtgatgtt

SEQ ID NO: 7799849 - DNA, 22 bp, Homo sapiens
gcaggagttagaggtttaatct

SEQ ID NO: 7799850 - DNA, 22 bp, Homo sapiens
gcaggagtgtggtgggacatcc

SEQ ID NO: 7799851 - DNA, 22 bp, Homo sapiens
gcaggaggccaggtatgcttta

SEQ ID NO: 7799852 - DNA, 22 bp, Homo sapiens
gcaggagtgacatggatgtgga

SEQ ID NO: 7799853 - DNA, 22 bp, Homo sapiens
gcaggagtatctatacattaaa

SEQ ID NO: 7799854 - DNA, 22 bp, Homo sapiens
gtagctctgtttaaagttcttt

SEQ ID NO: 7799855 - DNA, 22 bp, Homo sapiens
gtagctctgtttaaagttcttt

SEQ ID NO: 7799856 - DNA, 22 bp, Homo sapiens
gtagctatttatgatactcatg

SEQ ID NO: 7799857 - DNA, 21 bp, Homo sapiens
gtagataaagcattttcatta

SEQ ID NO: 7799858 - DNA, 22 bp, Homo sapiens
gtagaggctgaaatctgagggc

SEQ ID NO: 7799859 - DNA, 22 bp, Homo sapiens
gtagccattggcaatgaagcct

SEQ ID NO: 7799860 - DNA, 22 bp, Homo sapiens
gtagccagatctgctgtgtctg

SEQ ID NO: 7799861 - DNA, 22 bp, Homo sapiens
gtaaattatttcaagatcatct

SEQ ID NO: 7799862 - DNA, 22 bp, Homo sapiens
gtaatctcagctacttgggagg

SEQ ID NO: 7799863 - DNA, 22 bp, Homo sapiens
gtaatagtctcaaactcctgga

SEQ ID NO: 7799864 - DNA, 22 bp, Homo sapiens
gtaatagtctcaaactcctgga

SEQ ID NO: 7799865 - DNA, 17 bp, Homo sapiens
gtaaggcttgcagatgc

SEQ ID NO: 7799866 - DNA, 22 bp, Homo sapiens
gtaacagaaagtcatgctcatt

SEQ ID NO: 7799867 - DNA, 22 bp, Homo sapiens
gtcattcctatccatttgatac

SEQ ID NO: 7799868 - DNA, 22 bp, Homo sapiens
gtcaggtcttggaagataggct

SEQ ID NO: 7799869 - DNA, 22 bp, Homo sapiens
gtcaatataggtttcaaacatg

SEQ ID NO: 7799870 - DNA, 22 bp, Homo sapiens
gtcctctgcttcatgccctgat

SEQ ID NO: 7799871 - DNA, 22 bp, Homo sapiens
gtctcccatctctgtccttgtg

SEQ ID NO: 7799872 - DNA, 22 bp, Homo sapiens
gtctcctaaaccatcctggtac

SEQ ID NO: 7799873 - DNA, 19 bp, Homo sapiens
gtcctctcaacaacccggg

SEQ ID NO: 7799874 - DNA, 22 bp, Homo sapiens
gtgattttgagacctatatagt

SEQ ID NO: 7799875 - DNA, 18 bp, Homo sapiens
gtgcaatgaatagcagag

SEQ ID NO: 7799876 - DNA, 23 bp, Homo sapiens
gtctctagagtgtggagcaaaga

SEQ ID NO: 7799877 - DNA, 22 bp, Homo sapiens
gtcttagatttcaccgataatg

SEQ ID NO: 7799878 - DNA, 22 bp, Homo sapiens
gtgataaaattcaaatagctct

SEQ ID NO: 7799879 - DNA, 22 bp, Homo sapiens
gtgataaaggggaggaagtgtg

SEQ ID NO: 7799880 - DNA, 22 bp, Homo sapiens
gtgataaagacgtgtcataatt

SEQ ID NO: 7799881 - DNA, 22 bp, Homo sapiens
gtgataaaatagaaacagtggt

SEQ ID NO: 7799882 - DNA, 22 bp, Homo sapiens
gtgaggtggtacaatattaact

SEQ ID NO: 7799883 - DNA, 22 bp, Homo sapiens
gtgatacaggtgttctggatat

SEQ ID NO: 7799884 - DNA, 22 bp, Homo sapiens
gtgatgtcagcaagaataggaa

SEQ ID NO: 7799885 - DNA, 22 bp, Homo sapiens
gtgaggtgcctaataccgtgac

SEQ ID NO: 7799886 - DNA, 22 bp, Homo sapiens
gtgaggtctttgggaggtgatt

SEQ ID NO: 7799887 - DNA, 22 bp, Homo sapiens
ggggcaggagcccttcttcagc

SEQ ID NO: 7799888 - DNA, 21 bp, Homo sapiens
gggtataaaatggtatctcat

SEQ ID NO: 7799889 - DNA, 23 bp, Homo sapiens
gggggccgtcctggggattatag

SEQ ID NO: 7799890 - DNA, 22 bp, Homo sapiens
gggcctgaggcccagacactgg

SEQ ID NO: 7799891 - DNA, 22 bp, Homo sapiens
gggctccacctagggacactgg

SEQ ID NO: 7799892 - DNA, 23 bp, Homo sapiens
gggctccagtctctgctcagttg

SEQ ID NO: 7799893 - DNA, 22 bp, Homo sapiens
gggctctcaaggcagggcccca

SEQ ID NO: 7799894 - DNA, 22 bp, Homo sapiens
gggctctcgattagaccctggg

SEQ ID NO: 7799895 - DNA, 19 bp, Homo sapiens
gggctctcgagcaaccaac

SEQ ID NO: 7799896 - DNA, 22 bp, Homo sapiens
gggctctcgattagaccctggg

SEQ ID NO: 7799897 - DNA, 22 bp, Homo sapiens
ggtgcatggaaagagtaagtaa

SEQ ID NO: 7799898 - DNA, 22 bp, Homo sapiens
ggtgcatgtagccatcaagata

SEQ ID NO: 7799899 - DNA, 22 bp, Homo sapiens
ggtgcatggtggaggtgaccct

SEQ ID NO: 7799900 - DNA, 22 bp, Homo sapiens
ggtgccagtgggtctcaggata

SEQ ID NO: 7799901 - DNA, 22 bp, Homo sapiens
ggtgccaggctgtagtcagggt

SEQ ID NO: 7799902 - DNA, 22 bp, Homo sapiens
ggtgccagagtggcccaggggc

SEQ ID NO: 7799903 - DNA, 22 bp, Homo sapiens
ggtacaaagttagatttaactt

SEQ ID NO: 7799904 - DNA, 22 bp, Homo sapiens
ggtaataagatctgttacatgg

SEQ ID NO: 7799905 - DNA, 22 bp, Homo sapiens
ggtaccaccaattcagctgcca

SEQ ID NO: 7799906 - DNA, 22 bp, Homo sapiens
ggtacagacagggctgcctggg

SEQ ID NO: 7799907 - DNA, 22 bp, Homo sapiens
ggtaggagtattttgcagcagt

SEQ ID NO: 7799908 - DNA, 22 bp, Homo sapiens
ggatttcttccttcctcagaag

SEQ ID NO: 7799909 - DNA, 22 bp, Homo sapiens
ggcagcttctcccaggctgttt

SEQ ID NO: 7799910 - DNA, 22 bp, Homo sapiens
ggagatggtggaagctggtgca

SEQ ID NO: 7799911 - DNA, 22 bp, Homo sapiens
ggatgggaacttggtagggcat

SEQ ID NO: 7799912 - DNA, 22 bp, Homo sapiens
ggatgcaggaacacagcgacct

SEQ ID NO: 7799913 - DNA, 22 bp, Homo sapiens
ggcctggaagaggacagagaaa

SEQ ID NO: 7799914 - DNA, 22 bp, Homo sapiens
ggccaggccaagagggttggaa

SEQ ID NO: 7799915 - DNA, 22 bp, Homo sapiens
ggcctaggaaggggatgtaact

SEQ ID NO: 7799916 - DNA, 22 bp, Homo sapiens
ggccgtgctccaaagtcatcgt

SEQ ID NO: 7799917 - DNA, 22 bp, Homo sapiens
ggcatccagttctgatcaacaa

SEQ ID NO: 7799918 - DNA, 19 bp, Homo sapiens
ggcatccagaactaccagt

SEQ ID NO: 7799919 - DNA, 19 bp, Homo sapiens
ggcatccacgaatgcagag

SEQ ID NO: 7799920 - DNA, 22 bp, Homo sapiens
ggcatccaaataccaagatgta

SEQ ID NO: 7799921 - DNA, 22 bp, Homo sapiens
ggcatgagtggcagtgggcagt

SEQ ID NO: 7799922 - DNA, 22 bp, Homo sapiens
ggcaggagctctccagtttgcc

SEQ ID NO: 7799923 - DNA, 22 bp, Homo sapiens
ggcaggagaatggcgtgaactc

SEQ ID NO: 7799924 - DNA, 22 bp, Homo sapiens
ggctaccagataaattacagag

SEQ ID NO: 7799925 - DNA, 22 bp, Homo sapiens
ggctccctgcctgtcctcagtc

SEQ ID NO: 7799926 - DNA, 22 bp, Homo sapiens
ggctcccacccatagggcgagt

SEQ ID NO: 7799927 - DNA, 22 bp, Homo sapiens
ggctcccaggagggcctggagg

SEQ ID NO: 7799928 - DNA, 22 bp, Homo sapiens
gggaggttgaggctgcagtgag

SEQ ID NO: 7799929 - DNA, 22 bp, Homo sapiens
gggaggttctgttcgcacttga

SEQ ID NO: 7799930 - DNA, 22 bp, Homo sapiens
gggaggtgttccagtgttggta

SEQ ID NO: 7799931 - DNA, 22 bp, Homo sapiens
gggaggtgttctgccaacgcgg

SEQ ID NO: 7799932 - DNA, 22 bp, Homo sapiens
gggaggtgattaggaccatgta

SEQ ID NO: 7799933 - DNA, 22 bp, Homo sapiens
gggaggtgattaggaccatgta

SEQ ID NO: 7799934 - DNA, 22 bp, Homo sapiens
gggaggtgatggcaagcagcgg

SEQ ID NO: 7799935 - DNA, 21 bp, Homo sapiens
gggagggatggaaatgatgtt

SEQ ID NO: 7799936 - DNA, 19 bp, Homo sapiens
gggagctgaggtctttggt

SEQ ID NO: 7799937 - DNA, 22 bp, Homo sapiens
ggctttatagggtagaggatca

SEQ ID NO: 7799938 - DNA, 22 bp, Homo sapiens
ggctttatattgtttgagcaga

SEQ ID NO: 7799939 - DNA, 22 bp, Homo sapiens
ggctttatcaaatgagaccctg

SEQ ID NO: 7799940 - DNA, 22 bp, Homo sapiens
ggctttatgcacagcagatggt

SEQ ID NO: 7799941 - DNA, 22 bp, Homo sapiens
ggctttatgcagggatagaaat

SEQ ID NO: 7799942 - DNA, 22 bp, Homo sapiens
ggctttattaagcagggtaagt

SEQ ID NO: 7799943 - DNA, 22 bp, Homo sapiens
ggctttattaactcatccgtaa

SEQ ID NO: 7799944 - DNA, 22 bp, Homo sapiens
ggctttatgtttttcatgtggt

SEQ ID NO: 7799945 - DNA, 21 bp, Homo sapiens
ggctttatgctcacccagcct

SEQ ID NO: 7799946 - DNA, 22 bp, Homo sapiens
ggctttatttgcagccattgtt

SEQ ID NO: 7799947 - DNA, 22 bp, Homo sapiens
ggctttattatgtggccatgtg

SEQ ID NO: 7799948 - DNA, 22 bp, Homo sapiens
ggctttatttcactgtaccata

SEQ ID NO: 7799949 - DNA, 22 bp, Homo sapiens
ggctttatttcactgtaccata

SEQ ID NO: 7799950 - DNA, 22 bp, Homo sapiens
gggaagggacttgtttaaggtc

SEQ ID NO: 7799951 - DNA, 22 bp, Homo sapiens
ggctttgacatgctgaattaaa

SEQ ID NO: 7799952 - DNA, 22 bp, Homo sapiens
ggctttattttgcatgaatgct

SEQ ID NO: 7799953 - DNA, 22 bp, Homo sapiens
ggctttctagatctagctctgt

SEQ ID NO: 7799954 - DNA, 22 bp, Homo sapiens
ggctttcaaggaaaggcctcat

SEQ ID NO: 7799955 - DNA, 22 bp, Homo sapiens
ggctttctgagtcaaacactga

SEQ ID NO: 7799956 - DNA, 22 bp, Homo sapiens
cttcagttagagtttacaaagt

SEQ ID NO: 7799957 - DNA, 22 bp, Homo sapiens
cttcagttagccaattcaggtc

SEQ ID NO: 7799958 - DNA, 22 bp, Homo sapiens
cttataaagtccatctgaacaa

SEQ ID NO: 7799959 - DNA, 22 bp, Homo sapiens
cttataaagtccatctgaacaa

SEQ ID NO: 7799960 - DNA, 22 bp, Homo sapiens
cttagggaatcttagagctgga

SEQ ID NO: 7799961 - DNA, 22 bp, Homo sapiens
cttagggaattgggaggatgcc

SEQ ID NO: 7799962 - DNA, 22 bp, Homo sapiens
cttagggagaatgcctctgcag

SEQ ID NO: 7799963 - DNA, 22 bp, Homo sapiens
cttaggaagcttttgaggacaa

SEQ ID NO: 7799964 - DNA, 22 bp, Homo sapiens
cttagcttgttttcacctaaga

SEQ ID NO: 7799965 - DNA, 22 bp, Homo sapiens
cttagcagtgggtaccagggct

SEQ ID NO: 7799966 - DNA, 22 bp, Homo sapiens
cttctagatttttgtaattgtt

SEQ ID NO: 7799967 - DNA, 22 bp, Homo sapiens
cttctcagcttaggtatggttt

SEQ ID NO: 7799968 - DNA, 22 bp, Homo sapiens
cttctcagatctcagctttgag

SEQ ID NO: 7799969 - DNA, 22 bp, Homo sapiens
cttctcagcatggttactgtga

SEQ ID NO: 7799970 - DNA, 21 bp, Homo sapiens
ctgtttcttgtgaagtgacac

SEQ ID NO: 7799971 - DNA, 19 bp, Homo sapiens
ctgtttctgagcttgcttt

SEQ ID NO: 7799972 - DNA, 19 bp, Homo sapiens
ctgtttctgagcttgcttt

SEQ ID NO: 7799973 - DNA, 22 bp, Homo sapiens
ctgtttaatgaggtgtaacaac

SEQ ID NO: 7799974 - DNA, 22 bp, Homo sapiens
ctgtttaatgcaatgaaatgag

SEQ ID NO: 7799975 - DNA, 22 bp, Homo sapiens
cttaaaatctggcagttagcta

SEQ ID NO: 7799976 - DNA, 22 bp, Homo sapiens
cttaaaatctggcagttagcta

SEQ ID NO: 7799977 - DNA, 22 bp, Homo sapiens
cttaaacaggaaagagccaggt

SEQ ID NO: 7799978 - DNA, 20 bp, Homo sapiens
cttaaacacagagatagatt

SEQ ID NO: 7799979 - DNA, 22 bp, Homo sapiens
cttaaattggatgagttaagtt

SEQ ID NO: 7799980 - DNA, 22 bp, Homo sapiens
cttaaattttcatctacaagaa

SEQ ID NO: 7799981 - DNA, 22 bp, Homo sapiens
cttaattacccaatgtggtagg

SEQ ID NO: 7799982 - DNA, 22 bp, Homo sapiens
cttaaagttgacacagtccctg

SEQ ID NO: 7799983 - DNA, 22 bp, Homo sapiens
cttacaaaggagaggagatagg

SEQ ID NO: 7799984 - DNA, 22 bp, Homo sapiens
cttaatttttgtagtagatgga

SEQ ID NO: 7799985 - DNA, 22 bp, Homo sapiens
cttaatttcaaactgctagtga

SEQ ID NO: 7799986 - DNA, 22 bp, Homo sapiens
cttaatttaagcctagaatgca

SEQ ID NO: 7799987 - DNA, 22 bp, Homo sapiens
cttaatttaaaatagttcaggc

SEQ ID NO: 7799988 - DNA, 22 bp, Homo sapiens
cttacaaatacacttaggagag

SEQ ID NO: 7799989 - DNA, 22 bp, Homo sapiens
cttacaaatacacttaggagag

SEQ ID NO: 7799990 - DNA, 22 bp, Homo sapiens
cttacaaaggagaggagatagg

SEQ ID NO: 7799991 - DNA, 22 bp, Homo sapiens
cttacatactgagaaaatatcc

SEQ ID NO: 7799992 - DNA, 22 bp, Homo sapiens
cttctgaagtgtttgatgattg

SEQ ID NO: 7799993 - DNA, 22 bp, Homo sapiens
cttctggcaaaacaggcagaaa

SEQ ID NO: 7799994 - DNA, 23 bp, Homo sapiens
cttctggctctatatcagaattc

SEQ ID NO: 7799995 - DNA, 22 bp, Homo sapiens
cttgttttggctagtatgatgt

SEQ ID NO: 7799996 - DNA, 22 bp, Homo sapiens
cttgttttggaacagagtgaat

SEQ ID NO: 7799997 - DNA, 22 bp, Homo sapiens
ctttctttgcagtgagccagag

SEQ ID NO: 7799998 - DNA, 22 bp, Homo sapiens
ctttctttgtccaccaacaatg

SEQ ID NO: 7799999 - DNA, 22 bp, Homo sapiens
ctttaattgtagctcccataat

SEQ ID NO: 7800000 - DNA, 22 bp, Homo sapiens
ctttaaataatacaaggtccag

SEQ ID NO: 7800001 - DNA, 22 bp, Homo sapiens
ctttaattaggaagtataatga

SEQ ID NO: 7800002 - DNA, 22 bp, Homo sapiens
ctttaattcagatttgaaggga

SEQ ID NO: 7800003 - DNA, 22 bp, Homo sapiens
ctttaattctcaggtgcacata

SEQ ID NO: 7800004 - DNA, 22 bp, Homo sapiens
gaaaattattgaaaatggctct

SEQ ID NO: 7800005 - DNA, 22 bp, Homo sapiens
gaaaatacttcagtgttctggc

SEQ ID NO: 7800006 - DNA, 22 bp, Homo sapiens
gaaacagcacgtttggagagat

SEQ ID NO: 7800007 - DNA, 22 bp, Homo sapiens
gaaagatatttattggcaacag

SEQ ID NO: 7800008 - DNA, 22 bp, Homo sapiens
gaaagcatgtagcctgtatcca

SEQ ID NO: 7800009 - DNA, 22 bp, Homo sapiens
gaaagaggaaggagatgtatta

SEQ ID NO: 7800010 - DNA, 22 bp, Homo sapiens
cttttctctgcgggtctttcat

SEQ ID NO: 7800011 - DNA, 22 bp, Homo sapiens
cttttacagtggacctgccatt

SEQ ID NO: 7800012 - DNA, 21 bp, Homo sapiens
cttttacattcagtcatgatg

SEQ ID NO: 7800013 - DNA, 22 bp, Homo sapiens
cttttacatttgttgaagagta

SEQ ID NO: 7800014 - DNA, 22 bp, Homo sapiens
ctgggacatattgctagtgttg

SEQ ID NO: 7800015 - DNA, 22 bp, Homo sapiens
ctggggactcattcagagcata

SEQ ID NO: 7800016 - DNA, 22 bp, Homo sapiens
ctggtcactcctccacctgctt

SEQ ID NO: 7800017 - DNA, 22 bp, Homo sapiens
ctgtaaaacactgtagtatctg

SEQ ID NO: 7800018 - DNA, 22 bp, Homo sapiens
ctgtacaaagtagctgctggga

SEQ ID NO: 7800019 - DNA, 22 bp, Homo sapiens
ctggtgaccggacctcagtttt

SEQ ID NO: 7800020 - DNA, 22 bp, Homo sapiens
ctgtataaacatattttcaagt

SEQ ID NO: 7800021 - DNA, 22 bp, Homo sapiens
ctgtcaaagactaaggttctta

SEQ ID NO: 7800022 - DNA, 22 bp, Homo sapiens
ctgtctgtcaagttcatctcca

SEQ ID NO: 7800023 - DNA, 22 bp, Homo sapiens
ctgtctgtcaagttcatctcca

SEQ ID NO: 7800024 - DNA, 22 bp, Homo sapiens
ctgtgctctggcatcgctgcaa

SEQ ID NO: 7800025 - DNA, 22 bp, Homo sapiens
ctgtgctgattcagcacaggcc

SEQ ID NO: 7800026 - DNA, 22 bp, Homo sapiens
gaaggcattctattctacatat

SEQ ID NO: 7800027 - DNA, 22 bp, Homo sapiens
gaagggagaaggttgggtgacg

SEQ ID NO: 7800028 - DNA, 22 bp, Homo sapiens
gaaagctgtgaaatagtgctct

SEQ ID NO: 7800029 - DNA, 22 bp, Homo sapiens
gaaagctgggaaataaatatta

SEQ ID NO: 7800030 - DNA, 22 bp, Homo sapiens
gaaggggaaagttgagcaaata

SEQ ID NO: 7800031 - DNA, 19 bp, Homo sapiens
gaaggggaaggtgggtacc

SEQ ID NO: 7800032 - DNA, 22 bp, Homo sapiens
gaaggggactggcagctgcaga

SEQ ID NO: 7800033 - DNA, 22 bp, Homo sapiens
gacagacaggaggccacctgct

SEQ ID NO: 7800034 - DNA, 22 bp, Homo sapiens
gacagaactcaaacatgagaag

SEQ ID NO: 7800035 - DNA, 22 bp, Homo sapiens
gaatgatttggttgtttagatt

SEQ ID NO: 7800036 - DNA, 22 bp, Homo sapiens
gacacagttctgttctagtagg

SEQ ID NO: 7800037 - DNA, 22 bp, Homo sapiens
gacactgttatggtgaggtaag

SEQ ID NO: 7800038 - DNA, 22 bp, Homo sapiens
gacactgtgctagctgggctta

SEQ ID NO: 7800039 - DNA, 22 bp, Homo sapiens
gaatgaagcaggtcacacagtt

SEQ ID NO: 7800040 - DNA, 22 bp, Homo sapiens
gactctgggctgagccagggcc

SEQ ID NO: 7800041 - DNA, 22 bp, Homo sapiens
gactcctgcctcctctgtttgc

SEQ ID NO: 7800042 - DNA, 22 bp, Homo sapiens
gactcctggctttccctcttag

SEQ ID NO: 7800043 - DNA, 22 bp, Homo sapiens
gactgaggaggtaaggtttgaa

SEQ ID NO: 7800044 - DNA, 22 bp, Homo sapiens
gacatttaggtagcttccagtt

SEQ ID NO: 7800045 - DNA, 22 bp, Homo sapiens
gacatttaaattgcaggcagcc

SEQ ID NO: 7800046 - DNA, 22 bp, Homo sapiens
gacagagattgaatcaggaaat

SEQ ID NO: 7800047 - DNA, 22 bp, Homo sapiens
gacagagctcccagagatttgc

SEQ ID NO: 7800048 - DNA, 19 bp, Homo sapiens
gagacatgtagatagaaga

SEQ ID NO: 7800049 - DNA, 23 bp, Homo sapiens
gagaccagggccagctgtgtcat

SEQ ID NO: 7800050 - DNA, 22 bp, Homo sapiens
gagaaagatgtaggctgggagg

SEQ ID NO: 7800051 - DNA, 22 bp, Homo sapiens
gagaaagattgtccttcagggg

SEQ ID NO: 7800052 - DNA, 22 bp, Homo sapiens
gagaaagatgtaggctgggagg

SEQ ID NO: 7800053 - DNA, 22 bp, Homo sapiens
gagaaagcttcagaaatggcct

SEQ ID NO: 7800054 - DNA, 22 bp, Homo sapiens
gactgcctcagtttccctgcag

SEQ ID NO: 7800055 - DNA, 22 bp, Homo sapiens
gactgccagaatgtgaggcctg

SEQ ID NO: 7800056 - DNA, 22 bp, Homo sapiens
gagaaagatgaagagtggcgtt

SEQ ID NO: 7800057 - DNA, 22 bp, Homo sapiens
gagaaagacgtaggctgggagg

SEQ ID NO: 7800058 - DNA, 22 bp, Homo sapiens
gagaaagacgtaggctgggagg

SEQ ID NO: 7800059 - DNA, 22 bp, Homo sapiens
gagagaaaagggggaattgatt

SEQ ID NO: 7800060 - DNA, 21 bp, Homo sapiens
gagactctcatgttatttgga

SEQ ID NO: 7800061 - DNA, 22 bp, Homo sapiens
gagactgcatagatggccacaa

SEQ ID NO: 7800062 - DNA, 22 bp, Homo sapiens
gagggaggtgatactgaacgta

SEQ ID NO: 7800063 - DNA, 22 bp, Homo sapiens
gagggctgctggaaaaatgcag

SEQ ID NO: 7800064 - DNA, 22 bp, Homo sapiens
gagggctgtgaaggagcgggtt

SEQ ID NO: 7800065 - DNA, 22 bp, Homo sapiens
gaggcaggcagattgcttgagg

SEQ ID NO: 7800066 - DNA, 22 bp, Homo sapiens
gaggcaggaggattgcttgagc

SEQ ID NO: 7800067 - DNA, 22 bp, Homo sapiens
gaggcagggtgttgattacaga

SEQ ID NO: 7800068 - DNA, 22 bp, Homo sapiens
gagccctgttcaggcctcctca

SEQ ID NO: 7800069 - DNA, 22 bp, Homo sapiens
gagctgaggctcaggctggcgt

SEQ ID NO: 7800070 - DNA, 22 bp, Homo sapiens
gagctgaggccagagtcttctg

SEQ ID NO: 7800071 - DNA, 22 bp, Homo sapiens
gagctgagtatgaaggatgtga

SEQ ID NO: 7800072 - DNA, 22 bp, Homo sapiens
gagctgagtagaggctgctccc

SEQ ID NO: 7800073 - DNA, 23 bp, Homo sapiens
gagctgagtgtagggagactagg

SEQ ID NO: 7800074 - DNA, 22 bp, Homo sapiens
gaggaagaaagcataggtgggg

SEQ ID NO: 7800075 - DNA, 22 bp, Homo sapiens
gaggaaatggttgttcaggtgg

SEQ ID NO: 7800076 - DNA, 22 bp, Homo sapiens
gagcccagctgcggccctcagc

SEQ ID NO: 7800077 - DNA, 22 bp, Homo sapiens
gagcccaggctggggttcagag

SEQ ID NO: 7800078 - DNA, 18 bp, Homo sapiens
gagcatgggcagtgggga

SEQ ID NO: 7800079 - DNA, 22 bp, Homo sapiens
gagcatggcagctgagggcagg

SEQ ID NO: 7800080 - DNA, 22 bp, Homo sapiens
gagcatggatagaaggtgggat

SEQ ID NO: 7800081 - DNA, 22 bp, Homo sapiens
ctctctggaattaaagcccaat

SEQ ID NO: 7800082 - DNA, 22 bp, Homo sapiens
tttctctcctccaaaccaaaga

SEQ ID NO: 7800083 - DNA, 22 bp, Homo sapiens
tttctctctggccctgattgtc

SEQ ID NO: 7800084 - DNA, 22 bp, Homo sapiens
tttctctctgactgggagctga

SEQ ID NO: 7800085 - DNA, 22 bp, Homo sapiens
tttctctcttaaggagtttaaa

SEQ ID NO: 7800086 - DNA, 22 bp, Homo sapiens
tttctctctggccctgattgtc

SEQ ID NO: 7800087 - DNA, 23 bp, Homo sapiens
tttctctgagaagcagttctcta

SEQ ID NO: 7800088 - DNA, 22 bp, Homo sapiens
ctctctggcacttcattgctgt

SEQ ID NO: 7800089 - DNA, 22 bp, Homo sapiens
tttctgcaagtgtagataccca

SEQ ID NO: 7800090 - DNA, 22 bp, Homo sapiens
tttctgttgtacttaaactagg

SEQ ID NO: 7800091 - DNA, 19 bp, Homo sapiens
tttctgtttgcttctggtt

SEQ ID NO: 7800092 - DNA, 22 bp, Homo sapiens
tttctgttgtatggcttctgca

SEQ ID NO: 7800093 - DNA, 22 bp, Homo sapiens
tttctgttgttggtgtctggct

SEQ ID NO: 7800094 - DNA, 22 bp, Homo sapiens
tttcttatactatattgtcatc

SEQ ID NO: 7800095 - DNA, 22 bp, Homo sapiens
tttcttaggctctaaaatgact

SEQ ID NO: 7800096 - DNA, 22 bp, Homo sapiens
tttgaagtgtatgaaaatacag

SEQ ID NO: 7800097 - DNA, 22 bp, Homo sapiens
ctccctggtctttcccatcatt

SEQ ID NO: 7800098 - DNA, 22 bp, Homo sapiens
ctccctggtgactcccaaagct

SEQ ID NO: 7800099 - DNA, 22 bp, Homo sapiens
ctccctggtgtcccctccagga

SEQ ID NO: 7800100 - DNA, 22 bp, Homo sapiens
ctccctggaggcccagacctgg

SEQ ID NO: 7800101 - DNA, 23 bp, Homo sapiens
ctccctggagtttctggaagatg

SEQ ID NO: 7800102 - DNA, 23 bp, Homo sapiens
ctccctggcccttgggagacctg

SEQ ID NO: 7800103 - DNA, 22 bp, Homo sapiens
ctccctgggcctcagtttctct

SEQ ID NO: 7800104 - DNA, 22 bp, Homo sapiens
ctccccagctcgcgggtgacgg

SEQ ID NO: 7800105 - DNA, 22 bp, Homo sapiens
ttgtttaatccttgtacccatg

SEQ ID NO: 7800106 - DNA, 22 bp, Homo sapiens
ttgtttaatatcgtgaagtact

SEQ ID NO: 7800107 - DNA, 22 bp, Homo sapiens
ttgtttaatatcgtgaagtact

SEQ ID NO: 7800108 - DNA, 22 bp, Homo sapiens
ttgtttaatgcctcatacatct

SEQ ID NO: 7800109 - DNA, 22 bp, Homo sapiens
ttgtttcagcccagatctttac

SEQ ID NO: 7800110 - DNA, 22 bp, Homo sapiens
ttgtttcagctgtatgctatgt

SEQ ID NO: 7800111 - DNA, 22 bp, Homo sapiens
ctcaggctgtgatgtgatggca

SEQ ID NO: 7800112 - DNA, 22 bp, Homo sapiens
ctccccaagccttggcttctcc

SEQ ID NO: 7800113 - DNA, 22 bp, Homo sapiens
tttatatccatctttgaagtaa

SEQ ID NO: 7800114 - DNA, 22 bp, Homo sapiens
ctcctggaccagggctattggg

SEQ ID NO: 7800115 - DNA, 22 bp, Homo sapiens
ctcctggagcagcaggcgcagg

SEQ ID NO: 7800116 - DNA, 22 bp, Homo sapiens
ctcctggaccaccttgtggcca

SEQ ID NO: 7800117 - DNA, 22 bp, Homo sapiens
ctcctggacatggagcggagga

SEQ ID NO: 7800118 - DNA, 22 bp, Homo sapiens
ctcctggagggccaaagaaata

SEQ ID NO: 7800119 - DNA, 23 bp, Homo sapiens
ctcctggagggtccggccctgcc

SEQ ID NO: 7800120 - DNA, 22 bp, Homo sapiens
ctcctggaggctccaagggaga

SEQ ID NO: 7800121 - DNA, 22 bp, Homo sapiens
ctcctggatcttagccagattc

SEQ ID NO: 7800122 - DNA, 22 bp, Homo sapiens
tttacaattggttttctctaat

SEQ ID NO: 7800123 - DNA, 22 bp, Homo sapiens
ctcctggaagcccgccctgctg

SEQ ID NO: 7800124 - DNA, 22 bp, Homo sapiens
ctctaacaccacagtgtggttt

SEQ ID NO: 7800125 - DNA, 22 bp, Homo sapiens
tttcaaataccataaacctaat

SEQ ID NO: 7800126 - DNA, 22 bp, Homo sapiens
tttcaaataccataaacctaat

SEQ ID NO: 7800127 - DNA, 22 bp, Homo sapiens
tttcaaataccataaacctaat

SEQ ID NO: 7800128 - DNA, 22 bp, Homo sapiens
ctcctgtgggtcaccaataggc

SEQ ID NO: 7800129 - DNA, 22 bp, Homo sapiens
ctcctgtgcatgcatctcccta

SEQ ID NO: 7800130 - DNA, 22 bp, Homo sapiens
ctcctgggcttcgaaggctccc

SEQ ID NO: 7800131 - DNA, 22 bp, Homo sapiens
ctgcctgagtacaagtcccaga

SEQ ID NO: 7800132 - DNA, 22 bp, Homo sapiens
ctgcctgcaggacacctcgcta

SEQ ID NO: 7800133 - DNA, 22 bp, Homo sapiens
ctgcctgccttggcctccagga

SEQ ID NO: 7800134 - DNA, 22 bp, Homo sapiens
ctgcctgccacgttcagctgta

SEQ ID NO: 7800135 - DNA, 20 bp, Homo sapiens
ctgctccacccggctctcag

SEQ ID NO: 7800136 - DNA, 22 bp, Homo sapiens
ctgcaggggctggagttggctt

SEQ ID NO: 7800137 - DNA, 22 bp, Homo sapiens
ctgcctctataggagtccacca

SEQ ID NO: 7800138 - DNA, 22 bp, Homo sapiens
ctgaaagcaaagtaattcttaa

SEQ ID NO: 7800139 - DNA, 22 bp, Homo sapiens
ctgaaggaagcaggtggcctgt

SEQ ID NO: 7800140 - DNA, 22 bp, Homo sapiens
ctgaaggagcatagtcagtttt

SEQ ID NO: 7800141 - DNA, 22 bp, Homo sapiens
ctgaaggacttggtgatagttg

SEQ ID NO: 7800142 - DNA, 18 bp, Homo sapiens
ctgaaggatccaggtgta

SEQ ID NO: 7800143 - DNA, 22 bp, Homo sapiens
ctgaaggattagagagcactta

SEQ ID NO: 7800144 - DNA, 22 bp, Homo sapiens
ctgaaggatttagttctttgct

SEQ ID NO: 7800145 - DNA, 20 bp, Homo sapiens
tttttctgggcttccatagc

SEQ ID NO: 7800146 - DNA, 22 bp, Homo sapiens
tttttcttgtgctggatctaat

SEQ ID NO: 7800147 - DNA, 22 bp, Homo sapiens
ctgaaaaatatgttttggagaa

SEQ ID NO: 7800148 - DNA, 22 bp, Homo sapiens
ctgaaaatgttacacaggaaga

SEQ ID NO: 7800149 - DNA, 19 bp, Homo sapiens
ctgaaacacagagagggct

SEQ ID NO: 7800150 - DNA, 20 bp, Homo sapiens
ctgaaagacgtaacagtgca

SEQ ID NO: 7800151 - DNA, 22 bp, Homo sapiens
ctgaaacattgcaataacaaag

SEQ ID NO: 7800152 - DNA, 22 bp, Homo sapiens
ctgaaactacagtaaggagaac

SEQ ID NO: 7800153 - DNA, 22 bp, Homo sapiens
ctgaaactatggggaggggagc

SEQ ID NO: 7800154 - DNA, 19 bp, Homo sapiens
tttttacaagtaggtgtga

SEQ ID NO: 7800155 - DNA, 22 bp, Homo sapiens
tttttctctatgccaggggcct

SEQ ID NO: 7800156 - DNA, 22 bp, Homo sapiens
ttttctcaggtgcttatctaag

SEQ ID NO: 7800157 - DNA, 22 bp, Homo sapiens
ctgaggctgggcatggggtcca

SEQ ID NO: 7800158 - DNA, 22 bp, Homo sapiens
ctgagcaccccaggacctgcgc

SEQ ID NO: 7800159 - DNA, 22 bp, Homo sapiens
ctgagatctttatacgaggcac

SEQ ID NO: 7800160 - DNA, 22 bp, Homo sapiens
ctgagaggtaagcagcgcagtg

SEQ ID NO: 7800161 - DNA, 22 bp, Homo sapiens
ttcttaatggcaaaggatttta

SEQ ID NO: 7800162 - DNA, 22 bp, Homo sapiens
ttcttaaagaggcaaaacacag

SEQ ID NO: 7800163 - DNA, 22 bp, Homo sapiens
ctataaatctacccagcattgg

SEQ ID NO: 7800164 - DNA, 22 bp, Homo sapiens
ctataaatctacccagcattgg

SEQ ID NO: 7800165 - DNA, 23 bp, Homo sapiens
ttctgaaaatagatagtggctcc

SEQ ID NO: 7800166 - DNA, 22 bp, Homo sapiens
ttctgtctccctgatgtagagc

SEQ ID NO: 7800167 - DNA, 22 bp, Homo sapiens
ttctgaaataggagatagctgt

SEQ ID NO: 7800168 - DNA, 22 bp, Homo sapiens
ttgaagtctcatgatttaaaga

SEQ ID NO: 7800169 - DNA, 22 bp, Homo sapiens
ttgaagtcagttcatattttta

SEQ ID NO: 7800170 - DNA, 22 bp, Homo sapiens
ctcagaaaacctctttcttgat

SEQ ID NO: 7800171 - DNA, 22 bp, Homo sapiens
ttgaatctataatttcagtatt

SEQ ID NO: 7800172 - DNA, 22 bp, Homo sapiens
ctcagccatggggtggatcagc

SEQ ID NO: 7800173 - DNA, 22 bp, Homo sapiens
ttgcaaaaccatcctaagtaaa

SEQ ID NO: 7800174 - DNA, 22 bp, Homo sapiens
ttgctgagctttggcaaggaag

SEQ ID NO: 7800175 - DNA, 19 bp, Homo sapiens
ttgctggagaaaaaggaga

SEQ ID NO: 7800176 - DNA, 22 bp, Homo sapiens
ttgctggcaatttagagatttc

SEQ ID NO: 7800177 - DNA, 22 bp, Homo sapiens
ctcaggctaagaaggccaagtg

SEQ ID NO: 7800178 - DNA, 21 bp, Homo sapiens
ttctcagtgtccatgttagtt

SEQ ID NO: 7800179 - DNA, 22 bp, Homo sapiens
ttctcagtttcactgataacag

SEQ ID NO: 7800180 - DNA, 22 bp, Homo sapiens
ctagggcttccaagatgccttc

SEQ ID NO: 7800181 - DNA, 22 bp, Homo sapiens
ttctcctttgtaattctcatcc

SEQ ID NO: 7800182 - DNA, 22 bp, Homo sapiens
ctagtgtttggaagtcatagcc

SEQ ID NO: 7800183 - DNA, 22 bp, Homo sapiens
ctagtttaaagcagctgaaagg

SEQ ID NO: 7800184 - DNA, 22 bp, Homo sapiens
ctaaattatcatgagaattatg

SEQ ID NO: 7800185 - DNA, 22 bp, Homo sapiens
ctaaattatttgcacattagag

SEQ ID NO: 7800186 - DNA, 22 bp, Homo sapiens
ttctacatatatttttctcact

SEQ ID NO: 7800187 - DNA, 22 bp, Homo sapiens
ctaactttgtcatcttcccttt

SEQ ID NO: 7800188 - DNA, 22 bp, Homo sapiens
ctaactgtcatgcacatgtgtt

SEQ ID NO: 7800189 - DNA, 22 bp, Homo sapiens
ttctacatgagaaaatgtattt

SEQ ID NO: 7800190 - DNA, 22 bp, Homo sapiens
ctacagtgtgacaggcttggtg

SEQ ID NO: 7800191 - DNA, 22 bp, Homo sapiens
ctacagtgtcgtgtggtttctg

SEQ ID NO: 7800192 - DNA, 22 bp, Homo sapiens
cggctggtgtcgggcacagcaa

SEQ ID NO: 7800193 - DNA, 22 bp, Homo sapiens
ttcagtttgaattctgtagaac

SEQ ID NO: 7800194 - DNA, 22 bp, Homo sapiens
ttcagtttcttccctgtgaaat

SEQ ID NO: 7800195 - DNA, 22 bp, Homo sapiens
ttcagtttcttccctgtgaaat

SEQ ID NO: 7800196 - DNA, 22 bp, Homo sapiens
ttcagtttcgttatctatgaga

SEQ ID NO: 7800197 - DNA, 22 bp, Homo sapiens
ttcagtttctaaagatgttcct

SEQ ID NO: 7800198 - DNA, 22 bp, Homo sapiens
ttcctccttcccattcctgggg

SEQ ID NO: 7800199 - DNA, 22 bp, Homo sapiens
ttccacttttctctctcatgcc

SEQ ID NO: 7800200 - DNA, 22 bp, Homo sapiens
ttccagaaagttctggaactgg

SEQ ID NO: 7800201 - DNA, 22 bp, Homo sapiens
ttccagaaaaaaatgtatatct

SEQ ID NO: 7800202 - DNA, 22 bp, Homo sapiens
ttccagaaaactctgcctggta

SEQ ID NO: 7800203 - DNA, 22 bp, Homo sapiens
ttacctgttttacatgcacaac

SEQ ID NO: 7800204 - DNA, 22 bp, Homo sapiens
ttacctgtgtgtttgatacata

SEQ ID NO: 7800205 - DNA, 22 bp, Homo sapiens
ttacctgtgtcagtatatgaga

SEQ ID NO: 7800206 - DNA, 22 bp, Homo sapiens
ttacccagtgtggtttatagca

SEQ ID NO: 7800207 - DNA, 22 bp, Homo sapiens
ttatttttaaaagttcacacag

SEQ ID NO: 7800208 - DNA, 22 bp, Homo sapiens
ttatttttaaaagttcacacag

SEQ ID NO: 7800209 - DNA, 22 bp, Homo sapiens
ttattattttgtgtacagcaaa

SEQ ID NO: 7800210 - DNA, 22 bp, Homo sapiens
ttattattgtggttgcattatc

SEQ ID NO: 7800211 - DNA, 22 bp, Homo sapiens
ttatttttaaaagttcacacag

SEQ ID NO: 7800212 - DNA, 22 bp, Homo sapiens
ttcaaaaaggtatgttcaagtc

SEQ ID NO: 7800213 - DNA, 22 bp, Homo sapiens
ttatgggagcaattggggaggt

SEQ ID NO: 7800214 - DNA, 22 bp, Homo sapiens
ttatgtactctgcaatgtttga

SEQ ID NO: 7800215 - DNA, 22 bp, Homo sapiens
ttatgtacctgaattagtaaag

SEQ ID NO: 7800216 - DNA, 22 bp, Homo sapiens
cgcaccactgaattccagcctg

SEQ ID NO: 7800217 - DNA, 22 bp, Homo sapiens
tgttttctcttgaaaagcagtc

SEQ ID NO: 7800218 - DNA, 22 bp, Homo sapiens
tgttttctattacctgagattg

SEQ ID NO: 7800219 - DNA, 22 bp, Homo sapiens
ttaaaatagccagtgcccctct

SEQ ID NO: 7800220 - DNA, 22 bp, Homo sapiens
ttaaaagggatgttatctgtaa

SEQ ID NO: 7800221 - DNA, 22 bp, Homo sapiens
ttaatagtgctaaaccattgac

SEQ ID NO: 7800222 - DNA, 22 bp, Homo sapiens
ttacaatagttccttcttttgt

SEQ ID NO: 7800223 - DNA, 22 bp, Homo sapiens
ttacaagttcagattttctcat

SEQ ID NO: 7800224 - DNA, 22 bp, Homo sapiens
ttacaagtatttaagatgctgt

SEQ ID NO: 7800225 - DNA, 22 bp, Homo sapiens
ttacaagtactgaatatgattt

SEQ ID NO: 7800226 - DNA, 21 bp, Homo sapiens
cctgtggattttaaaattgga

SEQ ID NO: 7800227 - DNA, 22 bp, Homo sapiens
ttaatctgaatcagtaaacact

SEQ ID NO: 7800228 - DNA, 22 bp, Homo sapiens
ttaatcttatatgtaaaggtaa

SEQ ID NO: 7800229 - DNA, 22 bp, Homo sapiens
tgttggaattaggatacagagg

SEQ ID NO: 7800230 - DNA, 22 bp, Homo sapiens
tgttggaaaagaattaactagg

SEQ ID NO: 7800231 - DNA, 22 bp, Homo sapiens
tgttggaataagtgcttgaagg

SEQ ID NO: 7800232 - DNA, 22 bp, Homo sapiens
tggttccactaacctgagagcc

SEQ ID NO: 7800233 - DNA, 22 bp, Homo sapiens
tgtttcttacgtttttagaggc

SEQ ID NO: 7800234 - DNA, 22 bp, Homo sapiens
tgtttcttacgtttttagaggc

SEQ ID NO: 7800235 - DNA, 22 bp, Homo sapiens
tgtttcttatccaagtggtctg

SEQ ID NO: 7800236 - DNA, 22 bp, Homo sapiens
tgtttcttctcacacaaactca

SEQ ID NO: 7800237 - DNA, 22 bp, Homo sapiens
tgtttcttgagagtattaccct

SEQ ID NO: 7800238 - DNA, 22 bp, Homo sapiens
tgttttctagaaacaatgccta

SEQ ID NO: 7800239 - DNA, 22 bp, Homo sapiens
tgtttataccttggtataacca

SEQ ID NO: 7800240 - DNA, 22 bp, Homo sapiens
tgtttatacctgcaacctgtca

SEQ ID NO: 7800241 - DNA, 22 bp, Homo sapiens
cccttgagcctggaggagctct

SEQ ID NO: 7800242 - DNA, 21 bp, Homo sapiens
cccttgcctgcactcctcggc

SEQ ID NO: 7800243 - DNA, 23 bp, Homo sapiens
tggaaacattctgaatgtccatc

SEQ ID NO: 7800244 - DNA, 22 bp, Homo sapiens
tggaggaatcagggcttaggct

SEQ ID NO: 7800245 - DNA, 22 bp, Homo sapiens
tggaggaataacagcaacctta

SEQ ID NO: 7800246 - DNA, 23 bp, Homo sapiens
tggaggaaacacatcagaagacc

SEQ ID NO: 7800247 - DNA, 22 bp, Homo sapiens
tggaggcagtttaagtctgaga

SEQ ID NO: 7800248 - DNA, 22 bp, Homo sapiens
cccagtggcccagcatgtggtg

SEQ ID NO: 7800249 - DNA, 22 bp, Homo sapiens
tgctctggaatagtcctaggca

SEQ ID NO: 7800250 - DNA, 22 bp, Homo sapiens
tgcagggctaagtcagagcctg

SEQ ID NO: 7800251 - DNA, 22 bp, Homo sapiens
tgcttgtccctctttatgatgg

SEQ ID NO: 7800252 - DNA, 22 bp, Homo sapiens
ccccaggcagggcctaacagag

SEQ ID NO: 7800253 - DNA, 22 bp, Homo sapiens
cccagtgggtcactgcatctca

SEQ ID NO: 7800254 - DNA, 22 bp, Homo sapiens
cccagtggggagcttctgcctt

SEQ ID NO: 7800255 - DNA, 22 bp, Homo sapiens
cccagtggggagctgaggttca

SEQ ID NO: 7800256 - DNA, 22 bp, Homo sapiens
cccagtggtgctggcatctgtg

SEQ ID NO: 7800257 - DNA, 22 bp, Homo sapiens
cccagtgtctccaacatcagat

SEQ ID NO: 7800258 - DNA, 22 bp, Homo sapiens
cccagtgtcaccaacaggacac

SEQ ID NO: 7800259 - DNA, 22 bp, Homo sapiens
cccagtgtgcccctcctgcagc

SEQ ID NO: 7800260 - DNA, 22 bp, Homo sapiens
cctgcctgacagagaaggttca

SEQ ID NO: 7800261 - DNA, 22 bp, Homo sapiens
cctgcctcccagaggtcctcta

SEQ ID NO: 7800262 - DNA, 22 bp, Homo sapiens
tggtacaagcagactcagcaga

SEQ ID NO: 7800263 - DNA, 22 bp, Homo sapiens
tggtacaagatgttctaactga

SEQ ID NO: 7800264 - DNA, 22 bp, Homo sapiens
tggtacaactgtattaggcaaa

SEQ ID NO: 7800265 - DNA, 22 bp, Homo sapiens
tggtacaatcacagctcactgt

SEQ ID NO: 7800266 - DNA, 22 bp, Homo sapiens
tggtacaatggcatctatctat

SEQ ID NO: 7800267 - DNA, 22 bp, Homo sapiens
tgggtccacaaacatcagatat

SEQ ID NO: 7800268 - DNA, 22 bp, Homo sapiens
cctgcaggttgcagaggcggaa

SEQ ID NO: 7800269 - DNA, 22 bp, Homo sapiens
cctgcagtttgttgtgaccccg

SEQ ID NO: 7800270 - DNA, 22 bp, Homo sapiens
cctgcaggtttcccccggacgg

SEQ ID NO: 7800271 - DNA, 22 bp, Homo sapiens
cctgcagggtgctgccacagat

SEQ ID NO: 7800272 - DNA, 22 bp, Homo sapiens
tgggctccagcacctgtgctct

SEQ ID NO: 7800273 - DNA, 22 bp, Homo sapiens
tgggctccaatttgtcctttca

SEQ ID NO: 7800274 - DNA, 22 bp, Homo sapiens
tgggctccgttgcctggggcag

SEQ ID NO: 7800275 - DNA, 22 bp, Homo sapiens
tgggctcctcgtcactcgctgt

SEQ ID NO: 7800276 - DNA, 22 bp, Homo sapiens
tgggctccggcggcctcaggct

SEQ ID NO: 7800277 - DNA, 22 bp, Homo sapiens
cctgagtcttggcttcttggct

SEQ ID NO: 7800278 - DNA, 22 bp, Homo sapiens
cctgagtgacctgaggtctagt

SEQ ID NO: 7800279 - DNA, 22 bp, Homo sapiens
cctgagtgccatgagagcaccc

SEQ ID NO: 7800280 - DNA, 17 bp, Homo sapiens
cctgagtgggagaggaa

SEQ ID NO: 7800281 - DNA, 22 bp, Homo sapiens
cctgagtggtgctaagcagata

SEQ ID NO: 7800282 - DNA, 22 bp, Homo sapiens
cctgagtgtaataatgaaggca

SEQ ID NO: 7800283 - DNA, 22 bp, Homo sapiens
cctgataatattgacctacaga

SEQ ID NO: 7800284 - DNA, 22 bp, Homo sapiens
cctgataatgtaattgttaaat

SEQ ID NO: 7800285 - DNA, 22 bp, Homo sapiens
cctgataacacagatacaagat

SEQ ID NO: 7800286 - DNA, 22 bp, Homo sapiens
cctgataaaccctggaatttgt

SEQ ID NO: 7800287 - DNA, 22 bp, Homo sapiens
cctgcagggaatcgaggcagaa

SEQ ID NO: 7800288 - DNA, 22 bp, Homo sapiens
cctgcaggctgcaggccagttc

SEQ ID NO: 7800289 - DNA, 22 bp, Homo sapiens
tggctttaggagctatatacct

SEQ ID NO: 7800290 - DNA, 22 bp, Homo sapiens
tggctttacttaaactgaatca

SEQ ID NO: 7800291 - DNA, 22 bp, Homo sapiens
cctctcccgggtgccgctgggc

SEQ ID NO: 7800292 - DNA, 20 bp, Homo sapiens
cctcctggtcaggtgtgcag

SEQ ID NO: 7800293 - DNA, 22 bp, Homo sapiens
cctcctggggtgaaggatggga

SEQ ID NO: 7800294 - DNA, 22 bp, Homo sapiens
cctcctgggttcaagcgattct

SEQ ID NO: 7800295 - DNA, 22 bp, Homo sapiens
cctcctggtaattagcgaaagg

SEQ ID NO: 7800296 - DNA, 22 bp, Homo sapiens
cctcctggtccagcatctcttt

SEQ ID NO: 7800297 - DNA, 22 bp, Homo sapiens
tggcagtggtaccggctctcag

SEQ ID NO: 7800298 - DNA, 22 bp, Homo sapiens
tggcagtgggaatggacaaaca

SEQ ID NO: 7800299 - DNA, 22 bp, Homo sapiens
tggcagtgggaagctggaagtc

SEQ ID NO: 7800300 - DNA, 22 bp, Homo sapiens
tggcagtgtcttatcaggagtg

SEQ ID NO: 7800301 - DNA, 22 bp, Homo sapiens
tggcagtgtgggaggaaggtac

SEQ ID NO: 7800302 - DNA, 22 bp, Homo sapiens
cctccagggcccctctcactgg

SEQ ID NO: 7800303 - DNA, 22 bp, Homo sapiens
tggcatttggcttacttatgtt

SEQ ID NO: 7800304 - DNA, 19 bp, Homo sapiens
cctcccacggattccttcc

SEQ ID NO: 7800305 - DNA, 23 bp, Homo sapiens
cctcctgggcacaggcctgatgg

SEQ ID NO: 7800306 - DNA, 22 bp, Homo sapiens
cctcctgggagagcacggaggg

SEQ ID NO: 7800307 - DNA, 22 bp, Homo sapiens
cctcctgggccttgctctgtga

SEQ ID NO: 7800308 - DNA, 22 bp, Homo sapiens
cctcctgggctcctgtctgcac

SEQ ID NO: 7800309 - DNA, 22 bp, Homo sapiens
cctcctggcctgtgcagagccc

SEQ ID NO: 7800310 - DNA, 22 bp, Homo sapiens
cctcctgggacaggctggcaca

SEQ ID NO: 7800311 - DNA, 22 bp, Homo sapiens
cctcctgggactcattagcacc

SEQ ID NO: 7800312 - DNA, 22 bp, Homo sapiens
cctcctggcttttcccattgaa

SEQ ID NO: 7800313 - DNA, 22 bp, Homo sapiens
cctcctggcttttcccattgaa

SEQ ID NO: 7800314 - DNA, 22 bp, Homo sapiens
tctgttcttaaagcattcttgc

SEQ ID NO: 7800315 - DNA, 22 bp, Homo sapiens
tctgttcttctccactgtatgt

SEQ ID NO: 7800316 - DNA, 22 bp, Homo sapiens
tctgttcttgcttttctccaac

SEQ ID NO: 7800317 - DNA, 20 bp, Homo sapiens
tctgttattgcatgtacata

SEQ ID NO: 7800318 - DNA, 22 bp, Homo sapiens
ccaggcctcctgtgagtggacc

SEQ ID NO: 7800319 - DNA, 19 bp, Homo sapiens
ccaggcctcctgggaggtc

SEQ ID NO: 7800320 - DNA, 22 bp, Homo sapiens
ccaggcaggcgatggtgcagtg

SEQ ID NO: 7800321 - DNA, 22 bp, Homo sapiens
ccaggcaggcgatggtgcagtg

SEQ ID NO: 7800322 - DNA, 22 bp, Homo sapiens
tcttctctgtggcctggtggtg

SEQ ID NO: 7800323 - DNA, 22 bp, Homo sapiens
tcttagaaatgaagttctttct

SEQ ID NO: 7800324 - DNA, 22 bp, Homo sapiens
tcttctggatcgatcacattgt

SEQ ID NO: 7800325 - DNA, 22 bp, Homo sapiens
ccaggcagcaaattttctgaat

SEQ ID NO: 7800326 - DNA, 22 bp, Homo sapiens
ccaggaggctctgactggaccc

SEQ ID NO: 7800327 - DNA, 20 bp, Homo sapiens
tcttacaatcgttacatcca

SEQ ID NO: 7800328 - DNA, 22 bp, Homo sapiens
tcttacgaattcttagaggaca

SEQ ID NO: 7800329 - DNA, 22 bp, Homo sapiens
ccaggcagagggaatagcaagt

SEQ ID NO: 7800330 - DNA, 19 bp, Homo sapiens
ccaggcctctggggcctgt

SEQ ID NO: 7800331 - DNA, 22 bp, Homo sapiens
ccaggcctgcatctgctgcgca

SEQ ID NO: 7800332 - DNA, 22 bp, Homo sapiens
ccaggcctctggctgcttagtc

SEQ ID NO: 7800333 - DNA, 23 bp, Homo sapiens
ccaggcctctcagagggtgtgcc

SEQ ID NO: 7800334 - DNA, 22 bp, Homo sapiens
ccaggcctctggctgcttagtc

SEQ ID NO: 7800335 - DNA, 19 bp, Homo sapiens
ccaggcctctggggcctgt

SEQ ID NO: 7800336 - DNA, 22 bp, Homo sapiens
tcttgcacttcatgaatatgtt

SEQ ID NO: 7800337 - DNA, 19 bp, Homo sapiens
tcttgcagccccagcaggc

SEQ ID NO: 7800338 - DNA, 22 bp, Homo sapiens
tcttgcagaggcactgtgtcag

SEQ ID NO: 7800339 - DNA, 22 bp, Homo sapiens
tcttttctggactctgcatgga

SEQ ID NO: 7800340 - DNA, 22 bp, Homo sapiens
tcttttctggactctgcatgga

SEQ ID NO: 7800341 - DNA, 22 bp, Homo sapiens
tctttgtaaatgcctagcataa

SEQ ID NO: 7800342 - DNA, 22 bp, Homo sapiens
tcttttctgccacagcctgagc

SEQ ID NO: 7800343 - DNA, 22 bp, Homo sapiens
tcttttctgccacagcctgagc

SEQ ID NO: 7800344 - DNA, 22 bp, Homo sapiens
tcttttctgtaactcagtgtct

SEQ ID NO: 7800345 - DNA, 22 bp, Homo sapiens
tcttttcttcttaatggttaat

SEQ ID NO: 7800346 - DNA, 22 bp, Homo sapiens
tctttggttgcactgcaggtgt

SEQ ID NO: 7800347 - DNA, 22 bp, Homo sapiens
tcttttggaaatgatgtgcagg

SEQ ID NO: 7800348 - DNA, 22 bp, Homo sapiens
tgaaatgaatgtgattcgatag

SEQ ID NO: 7800349 - DNA, 22 bp, Homo sapiens
ccaggctgtaagagtgatgttg

SEQ ID NO: 7800350 - DNA, 22 bp, Homo sapiens
tgaaatgagataatttaagtgc

SEQ ID NO: 7800351 - DNA, 22 bp, Homo sapiens
ccagggatgcagaggttgcagt

SEQ ID NO: 7800352 - DNA, 22 bp, Homo sapiens
ccagggatgccaagctttacca

SEQ ID NO: 7800353 - DNA, 22 bp, Homo sapiens
ccagggcaggggctggagttca

SEQ ID NO: 7800354 - DNA, 22 bp, Homo sapiens
ccagggcaacgctgtctcagag

SEQ ID NO: 7800355 - DNA, 22 bp, Homo sapiens
tgaagtctttctgatcatttac

SEQ ID NO: 7800356 - DNA, 22 bp, Homo sapiens
tgaagtaggcagcatgctgaga

SEQ ID NO: 7800357 - DNA, 22 bp, Homo sapiens
ccatagcaagaggagcagaaat

SEQ ID NO: 7800358 - DNA, 23 bp, Homo sapiens
ccatcaggcctccgtgtccagcc

SEQ ID NO: 7800359 - DNA, 22 bp, Homo sapiens
ccatccaggctgtgggtgagct

SEQ ID NO: 7800360 - DNA, 22 bp, Homo sapiens
tgagtcagtgacatgaacttgt

SEQ ID NO: 7800361 - DNA, 22 bp, Homo sapiens
ccatcctgcaggacctccatat

SEQ ID NO: 7800362 - DNA, 22 bp, Homo sapiens
ccatcctgaatggtctcagcca

SEQ ID NO: 7800363 - DNA, 22 bp, Homo sapiens
tgagtcctgctgagcagagagg

SEQ ID NO: 7800364 - DNA, 22 bp, Homo sapiens
tgagtccgaagttgcagtgagc

SEQ ID NO: 7800365 - DNA, 19 bp, Homo sapiens
ccagtcccatacaggagat

SEQ ID NO: 7800366 - DNA, 22 bp, Homo sapiens
tgagccagtgtggtaaagctga

SEQ ID NO: 7800367 - DNA, 22 bp, Homo sapiens
tgagccagttcttcagatccat

SEQ ID NO: 7800368 - DNA, 22 bp, Homo sapiens
ccagtgcccagctgcccaggca

SEQ ID NO: 7800369 - DNA, 22 bp, Homo sapiens
ccagtgcataatcaatacagcc

SEQ ID NO: 7800370 - DNA, 22 bp, Homo sapiens
ccagtgcttctttgctagctgg

SEQ ID NO: 7800371 - DNA, 21 bp, Homo sapiens
ccagtgctacagctgcctgac

SEQ ID NO: 7800372 - DNA, 22 bp, Homo sapiens
tgagcagagacttcaagggcag

SEQ ID NO: 7800373 - DNA, 22 bp, Homo sapiens
tgagcagtaacagctcacaggg

SEQ ID NO: 7800374 - DNA, 21 bp, Homo sapiens
tgagcaggtgctgcttttatg

SEQ ID NO: 7800375 - DNA, 21 bp, Homo sapiens
tgagcaggtgcagggaagtgg

SEQ ID NO: 7800376 - DNA, 22 bp, Homo sapiens
tgagcaggtcaggaagtacatt

SEQ ID NO: 7800377 - DNA, 22 bp, Homo sapiens
tgcactccaggctgggtgacag

SEQ ID NO: 7800378 - DNA, 22 bp, Homo sapiens
cccaaggggagattttcttgag

SEQ ID NO: 7800379 - DNA, 22 bp, Homo sapiens
cccaaggaataggatcccagga

SEQ ID NO: 7800380 - DNA, 22 bp, Homo sapiens
cccaaggacacgggcagggaca

SEQ ID NO: 7800381 - DNA, 22 bp, Homo sapiens
cccaaggccttcaagccagctc

SEQ ID NO: 7800382 - DNA, 22 bp, Homo sapiens
tgcaatcagaaagttcagcggt

SEQ ID NO: 7800383 - DNA, 22 bp, Homo sapiens
tgataactctcagtttctcatg

SEQ ID NO: 7800384 - DNA, 22 bp, Homo sapiens
tgataactttaatttgatctga

SEQ ID NO: 7800385 - DNA, 22 bp, Homo sapiens
tgcacttcaaaaatgtcactga

SEQ ID NO: 7800386 - DNA, 22 bp, Homo sapiens
cccagagggctgaggatatgaa

SEQ ID NO: 7800387 - DNA, 22 bp, Homo sapiens
cccagagggaagggaatgaggt

SEQ ID NO: 7800388 - DNA, 22 bp, Homo sapiens
tgcaggaagtttcctgaacttt

SEQ ID NO: 7800389 - DNA, 22 bp, Homo sapiens
tgcaggaatattgatgaactta

SEQ ID NO: 7800390 - DNA, 22 bp, Homo sapiens
cccagcaggtcggtgctgcctg

SEQ ID NO: 7800391 - DNA, 22 bp, Homo sapiens
cccagcagggtctctgtgtcta

SEQ ID NO: 7800392 - DNA, 22 bp, Homo sapiens
cccagcaggcatgttgggagga

SEQ ID NO: 7800393 - DNA, 22 bp, Homo sapiens
tgcagggccttctagaccatgg

SEQ ID NO: 7800394 - DNA, 22 bp, Homo sapiens
cattaataaacatttcagaaga

SEQ ID NO: 7800395 - DNA, 22 bp, Homo sapiens
catgtgtatgcattcatacata

SEQ ID NO: 7800396 - DNA, 22 bp, Homo sapiens
tccaggcttgagaccaggctct

SEQ ID NO: 7800397 - DNA, 22 bp, Homo sapiens
catgtacactcatgtaactata

SEQ ID NO: 7800398 - DNA, 22 bp, Homo sapiens
catggaaagcactcagcccagt

SEQ ID NO: 7800399 - DNA, 23 bp, Homo sapiens
catggaaaactgaaagctgacct

SEQ ID NO: 7800400 - DNA, 23 bp, Homo sapiens
catggaaaactgaaagctgacct

SEQ ID NO: 7800401 - DNA, 22 bp, Homo sapiens
catggaaagcactcagcccagt

SEQ ID NO: 7800402 - DNA, 22 bp, Homo sapiens
catgtaaaaaattaggtcatct

SEQ ID NO: 7800403 - DNA, 22 bp, Homo sapiens
catgctgttgaatatgacattg

SEQ ID NO: 7800404 - DNA, 22 bp, Homo sapiens
catgctgttgaatatgacattg

SEQ ID NO: 7800405 - DNA, 22 bp, Homo sapiens
catgcttttcaatctatcttaa

SEQ ID NO: 7800406 - DNA, 22 bp, Homo sapiens
catgcttttcaatctatcttaa

SEQ ID NO: 7800407 - DNA, 22 bp, Homo sapiens
catgctgtcctgccagggatgg

SEQ ID NO: 7800408 - DNA, 22 bp, Homo sapiens
catgctcacttttatactgtaa

SEQ ID NO: 7800409 - DNA, 20 bp, Homo sapiens
catgccagaatgtgaggtag

SEQ ID NO: 7800410 - DNA, 22 bp, Homo sapiens
tcatcagggatattggcctgaa

SEQ ID NO: 7800411 - DNA, 18 bp, Homo sapiens
tccagagagggagaagtg

SEQ ID NO: 7800412 - DNA, 22 bp, Homo sapiens
catcagtgtctctctggtactt

SEQ ID NO: 7800413 - DNA, 22 bp, Homo sapiens
tcagtgtctgtgggcaggatgg

SEQ ID NO: 7800414 - DNA, 22 bp, Homo sapiens
tcagtgtcttctctttcctacc

SEQ ID NO: 7800415 - DNA, 22 bp, Homo sapiens
catcataaaattgagataactg

SEQ ID NO: 7800416 - DNA, 22 bp, Homo sapiens
tcagtgtcttgggcttgaatgc

SEQ ID NO: 7800417 - DNA, 22 bp, Homo sapiens
tcagtgtcttgacctgggtgtg

SEQ ID NO: 7800418 - DNA, 22 bp, Homo sapiens
tcagtgtgactgatggctttat

SEQ ID NO: 7800419 - DNA, 22 bp, Homo sapiens
tcagtgtgcacatggtagcagt

SEQ ID NO: 7800420 - DNA, 22 bp, Homo sapiens
tcagtgtggaaaatcctttggc

SEQ ID NO: 7800421 - DNA, 22 bp, Homo sapiens
catcctggttaccccatagtca

SEQ ID NO: 7800422 - DNA, 22 bp, Homo sapiens
catcctgagaggtctctctacc

SEQ ID NO: 7800423 - DNA, 22 bp, Homo sapiens
tcacttatgccagctctggaag

SEQ ID NO: 7800424 - DNA, 22 bp, Homo sapiens
tcacttatgtgtaggcagctta

SEQ ID NO: 7800425 - DNA, 21 bp, Homo sapiens
tcacttataatgtatttgctg

SEQ ID NO: 7800426 - DNA, 22 bp, Homo sapiens
tcacttatatttcaggagatat

SEQ ID NO: 7800427 - DNA, 22 bp, Homo sapiens
tcacttattaactcataccatt

SEQ ID NO: 7800428 - DNA, 20 bp, Homo sapiens
tcacttattctcaacttgtg

SEQ ID NO: 7800429 - DNA, 22 bp, Homo sapiens
tcacttattttctaaccaaagg

SEQ ID NO: 7800430 - DNA, 22 bp, Homo sapiens
tcacttattgctcatctcatgc

SEQ ID NO: 7800431 - DNA, 22 bp, Homo sapiens
cagtgtcaggatcagtatattt

SEQ ID NO: 7800432 - DNA, 22 bp, Homo sapiens
cagtgtctacagtggctggagg

SEQ ID NO: 7800433 - DNA, 22 bp, Homo sapiens
cagtgtcaccaggcgagtctcc

SEQ ID NO: 7800434 - DNA, 22 bp, Homo sapiens
cagtgtatcattagtgtgatga

SEQ ID NO: 7800435 - DNA, 22 bp, Homo sapiens
cagtgtataaactttaacatag

SEQ ID NO: 7800436 - DNA, 22 bp, Homo sapiens
cagtgtataaactttaacatag

SEQ ID NO: 7800437 - DNA, 22 bp, Homo sapiens
cagtgtaagctctagactagaa

SEQ ID NO: 7800438 - DNA, 22 bp, Homo sapiens
cagtggtttctgaacagtgtgc

SEQ ID NO: 7800439 - DNA, 17 bp, Homo sapiens
catcaaagaaatttcca

SEQ ID NO: 7800440 - DNA, 18 bp, Homo sapiens
tcaggctgccctgtgtct

SEQ ID NO: 7800441 - DNA, 21 bp, Homo sapiens
ccaagagcaatgctaaggaga

SEQ ID NO: 7800442 - DNA, 20 bp, Homo sapiens
ccaagagcatgcatgaggaa

SEQ ID NO: 7800443 - DNA, 22 bp, Homo sapiens
tcctgaggtggattgagcagag

SEQ ID NO: 7800444 - DNA, 22 bp, Homo sapiens
tcctgaggtatatgctttgcag

SEQ ID NO: 7800445 - DNA, 21 bp, Homo sapiens
tcctgccttagtccagagcag

SEQ ID NO: 7800446 - DNA, 22 bp, Homo sapiens
ccacagggcctttcctgctggc

SEQ ID NO: 7800447 - DNA, 16 bp, Homo sapiens
tcctggcctttggaag

SEQ ID NO: 7800448 - DNA, 22 bp, Homo sapiens
tcctggccttgcgtcttgggag

SEQ ID NO: 7800449 - DNA, 22 bp, Homo sapiens
tcctggccttgctcctgatgcc

SEQ ID NO: 7800450 - DNA, 22 bp, Homo sapiens
tcctggctcaggcccctggtgc

SEQ ID NO: 7800451 - DNA, 21 bp, Homo sapiens
ccacaggggctcccctgtcag

SEQ ID NO: 7800452 - DNA, 22 bp, Homo sapiens
tcctggccttagcgaggcggtc

SEQ ID NO: 7800453 - DNA, 22 bp, Homo sapiens
tcctggcctgtctggagtagct

SEQ ID NO: 7800454 - DNA, 22 bp, Homo sapiens
tcctggccttatccccaaactg

SEQ ID NO: 7800455 - DNA, 20 bp, Homo sapiens
tcctggccttctcgggcagt

SEQ ID NO: 7800456 - DNA, 22 bp, Homo sapiens
catttcattcctttgaaagtgg

SEQ ID NO: 7800457 - DNA, 22 bp, Homo sapiens
catttcagtgtcttgtgatgaa

SEQ ID NO: 7800458 - DNA, 21 bp, Homo sapiens
catttcatgattatagaaatg

SEQ ID NO: 7800459 - DNA, 22 bp, Homo sapiens
catttctaccaaatgtgactgg

SEQ ID NO: 7800460 - DNA, 22 bp, Homo sapiens
catttctagggatcataaagta

SEQ ID NO: 7800461 - DNA, 21 bp, Homo sapiens
catttctaagcctggctatag

SEQ ID NO: 7800462 - DNA, 22 bp, Homo sapiens
catttccactctgggagtcaga

SEQ ID NO: 7800463 - DNA, 22 bp, Homo sapiens
tccatataatgggattccttat

SEQ ID NO: 7800464 - DNA, 22 bp, Homo sapiens
catttcaccttagagaattatt

SEQ ID NO: 7800465 - DNA, 22 bp, Homo sapiens
catttattggcatgtagtaggt

SEQ ID NO: 7800466 - DNA, 22 bp, Homo sapiens
catttcacagtaaagtgatttc

SEQ ID NO: 7800467 - DNA, 22 bp, Homo sapiens
cattttcatgagtttctgttca

SEQ ID NO: 7800468 - DNA, 22 bp, Homo sapiens
cattttgtaagtctctcttgtt

SEQ ID NO: 7800469 - DNA, 22 bp, Homo sapiens
cattttgtgctagacactatgg

SEQ ID NO: 7800470 - DNA, 22 bp, Homo sapiens
cattttcagcacccatctgaaa

SEQ ID NO: 7800471 - DNA, 21 bp, Homo sapiens
catttctattgatgagaaaag

SEQ ID NO: 7800472 - DNA, 22 bp, Homo sapiens
ccagaggctgggttcacctcag

SEQ ID NO: 7800473 - DNA, 20 bp, Homo sapiens
ccagagcagccactgaagtt

SEQ ID NO: 7800474 - DNA, 22 bp, Homo sapiens
ccagagagggcgccacctggag

SEQ ID NO: 7800475 - DNA, 22 bp, Homo sapiens
ccagagcccagggtcatgcagg

SEQ ID NO: 7800476 - DNA, 22 bp, Homo sapiens
tctctgtacagtacatgccgtg

SEQ ID NO: 7800477 - DNA, 22 bp, Homo sapiens
tctctgtaaaatgtggatgata

SEQ ID NO: 7800478 - DNA, 22 bp, Homo sapiens
tctctgtattctgatattcact

SEQ ID NO: 7800479 - DNA, 21 bp, Homo sapiens
tctctgtatccatgggttcca

SEQ ID NO: 7800480 - DNA, 22 bp, Homo sapiens
tctctgtatcccagaaccaaaa

SEQ ID NO: 7800481 - DNA, 22 bp, Homo sapiens
tctctgtagttgggcagctgct

SEQ ID NO: 7800482 - DNA, 22 bp, Homo sapiens
tctctgtagggctgcttgagta

SEQ ID NO: 7800483 - DNA, 22 bp, Homo sapiens
tctctgtagagacagcactgtg

SEQ ID NO: 7800484 - DNA, 22 bp, Homo sapiens
ccagaggggtgggcctggttta

SEQ ID NO: 7800485 - DNA, 22 bp, Homo sapiens
tctcagtggtgttttgagtcca

SEQ ID NO: 7800486 - DNA, 22 bp, Homo sapiens
tctcagtgtggtgcttaggata

SEQ ID NO: 7800487 - DNA, 22 bp, Homo sapiens
tctagaatgacatgcaagagta

SEQ ID NO: 7800488 - DNA, 18 bp, Homo sapiens
tctagaaacccagactct

SEQ ID NO: 7800489 - DNA, 18 bp, Homo sapiens
tctagaaacccagactct

SEQ ID NO: 7800490 - DNA, 22 bp, Homo sapiens
tctagaaagccaaattaggaat

SEQ ID NO: 7800491 - DNA, 18 bp, Homo sapiens
tctagaaacttctctcct

SEQ ID NO: 7800492 - DNA, 22 bp, Homo sapiens
tctagaaagtactagagctggt

SEQ ID NO: 7800493 - DNA, 22 bp, Homo sapiens
tctagaaagtactagagctggt

SEQ ID NO: 7800494 - DNA, 22 bp, Homo sapiens
tctagaaagtttgtactgattt

SEQ ID NO: 7800495 - DNA, 22 bp, Homo sapiens
tctagaaattttgccttgtatt

SEQ ID NO: 7800496 - DNA, 22 bp, Homo sapiens
tctagaaagtttgtactgattt

SEQ ID NO: 7800497 - DNA, 22 bp, Homo sapiens
tcctgtttcaacccttacactg

SEQ ID NO: 7800498 - DNA, 22 bp, Homo sapiens
tcctgtttccaatttgttgggt

SEQ ID NO: 7800499 - DNA, 21 bp, Homo sapiens
tctaatgacatcctctgacaa

SEQ ID NO: 7800500 - DNA, 22 bp, Homo sapiens
tcctgtttttgtaatcgactct

SEQ ID NO: 7800501 - DNA, 22 bp, Homo sapiens
tcctgtttctcctgcaaaatcc

SEQ ID NO: 7800502 - DNA, 23 bp, Homo sapiens
tctaatgcaattagaaattaggg

SEQ ID NO: 7800503 - DNA, 22 bp, Homo sapiens
tctagaaacatgacattgatct

SEQ ID NO: 7800504 - DNA, 17 bp, Homo sapiens
tcctgtttatcattgat

SEQ ID NO: 7800505 - DNA, 22 bp, Homo sapiens
tcctgtttatctgtgtgactcg

SEQ ID NO: 7800506 - DNA, 22 bp, Homo sapiens
tcctgtttaggctgtggtctgg

SEQ ID NO: 7800507 - DNA, 20 bp, Homo sapiens
ccaccctgctaagaatacac

SEQ ID NO: 7800508 - DNA, 22 bp, Homo sapiens
ccaccctgagccgcaagagcag

SEQ ID NO: 7800509 - DNA, 22 bp, Homo sapiens
ccaccctaacaatccttactgt

SEQ ID NO: 7800510 - DNA, 22 bp, Homo sapiens
ccacccatgtgactacctcatg

SEQ ID NO: 7800511 - DNA, 22 bp, Homo sapiens
tcaaagcatggttttgaaagac

SEQ ID NO: 7800512 - DNA, 22 bp, Homo sapiens
tcaaagcatcagtcaatttagg

SEQ ID NO: 7800513 - DNA, 20 bp, Homo sapiens
tcaaagcactgcctgtcatc

SEQ ID NO: 7800514 - DNA, 22 bp, Homo sapiens
tcaaagcacacttagtggtaga

SEQ ID NO: 7800515 - DNA, 22 bp, Homo sapiens
tcaaagcaatttcaccagtgcc

SEQ ID NO: 7800516 - DNA, 19 bp, Homo sapiens
tcaaagcaagcatgttctg

SEQ ID NO: 7800517 - DNA, 22 bp, Homo sapiens
tattccagatgaaatcattcag

SEQ ID NO: 7800518 - DNA, 22 bp, Homo sapiens
tcaaattatttaggatagtgct

SEQ ID NO: 7800519 - DNA, 22 bp, Homo sapiens
tcaaattagtggaataataatg

SEQ ID NO: 7800520 - DNA, 22 bp, Homo sapiens
cagtctttgttcccattactga

SEQ ID NO: 7800521 - DNA, 22 bp, Homo sapiens
cagtcttatcctgaaaacaaca

SEQ ID NO: 7800522 - DNA, 22 bp, Homo sapiens
tcaaatgctgcctttgtgtgcc

SEQ ID NO: 7800523 - DNA, 22 bp, Homo sapiens
tcaaatgctcagactcctgtgg

SEQ ID NO: 7800524 - DNA, 22 bp, Homo sapiens
cagtctggaggtcagctggctt

SEQ ID NO: 7800525 - DNA, 22 bp, Homo sapiens
cagtctctcagctttcagctgt

SEQ ID NO: 7800526 - DNA, 22 bp, Homo sapiens
tcacactaagacaaaataattt

SEQ ID NO: 7800527 - DNA, 22 bp, Homo sapiens
tatgaagaaacctatcctctag

SEQ ID NO: 7800528 - DNA, 22 bp, Homo sapiens
tatgaactgtgagtgtgatggg

SEQ ID NO: 7800529 - DNA, 23 bp, Homo sapiens
tatgaactgcattgctggtgtgt

SEQ ID NO: 7800530 - DNA, 22 bp, Homo sapiens
tatgaactgctcttgtgttttg

SEQ ID NO: 7800531 - DNA, 22 bp, Homo sapiens
tatgcaaagtcctaagaaagaa

SEQ ID NO: 7800532 - DNA, 22 bp, Homo sapiens
tatgaagacaatgatagcatga

SEQ ID NO: 7800533 - DNA, 22 bp, Homo sapiens
tatgtacatcgttgaattcaaa

SEQ ID NO: 7800534 - DNA, 22 bp, Homo sapiens
tatgtacatcgttgaattcaaa

SEQ ID NO: 7800535 - DNA, 22 bp, Homo sapiens
tatgtacatggagagcaattga

SEQ ID NO: 7800536 - DNA, 22 bp, Homo sapiens
tatgtacatgatttcatttgct

SEQ ID NO: 7800537 - DNA, 22 bp, Homo sapiens
tatgtacatcttgagcaatgaa

SEQ ID NO: 7800538 - DNA, 22 bp, Homo sapiens
tatatatatgcacacacaccta

SEQ ID NO: 7800539 - DNA, 22 bp, Homo sapiens
tatattcacttgtgtccaacca

SEQ ID NO: 7800540 - DNA, 22 bp, Homo sapiens
tatacagtttgagttcttgcat

SEQ ID NO: 7800541 - DNA, 22 bp, Homo sapiens
taggtagtttcctgttgttggg

SEQ ID NO: 7800542 - DNA, 22 bp, Homo sapiens
tagtaaattaaaatattgactt

SEQ ID NO: 7800543 - DNA, 22 bp, Homo sapiens
tagtaaatgtgaaatgtgggga

SEQ ID NO: 7800544 - DNA, 22 bp, Homo sapiens
taggtataggattctaggttgg

SEQ ID NO: 7800545 - DNA, 22 bp, Homo sapiens
tacagtttgtatggtcaggaat

SEQ ID NO: 7800546 - DNA, 22 bp, Homo sapiens
tacagtttaacactttggagaa

SEQ ID NO: 7800547 - DNA, 22 bp, Homo sapiens
tacagtttacatgagaggaagc

SEQ ID NO: 7800548 - DNA, 22 bp, Homo sapiens
tacagttatatgtgataagtaa

SEQ ID NO: 7800549 - DNA, 22 bp, Homo sapiens
tacagagagtacagcatccaca

SEQ ID NO: 7800550 - DNA, 22 bp, Homo sapiens
tacagagactttatggcacaaa

SEQ ID NO: 7800551 - DNA, 22 bp, Homo sapiens
tacagagacccacaagagactg

SEQ ID NO: 7800552 - DNA, 22 bp, Homo sapiens
caggcctgtctgcacatgaggc

SEQ ID NO: 7800553 - DNA, 22 bp, Homo sapiens
caggcctgtgacaccgtgtctg

SEQ ID NO: 7800554 - DNA, 22 bp, Homo sapiens
caggccctcgtggtgagctggg

SEQ ID NO: 7800555 - DNA, 22 bp, Homo sapiens
tacactttatggatcctacttt

SEQ ID NO: 7800556 - DNA, 22 bp, Homo sapiens
tacactttatggatcctacttt

SEQ ID NO: 7800557 - DNA, 22 bp, Homo sapiens
tacacttttcaatgtagtctgt

SEQ ID NO: 7800558 - DNA, 22 bp, Homo sapiens
tacactgtgacaatcatgacag

SEQ ID NO: 7800559 - DNA, 22 bp, Homo sapiens
tacacagggaaaggtctcagag

SEQ ID NO: 7800560 - DNA, 22 bp, Homo sapiens
cagggcataagatgaggctgta

SEQ ID NO: 7800561 - DNA, 22 bp, Homo sapiens
cagggcagtaccgccctctggc

SEQ ID NO: 7800562 - DNA, 22 bp, Homo sapiens
cagggcagtttgtgcctatgag

SEQ ID NO: 7800563 - DNA, 22 bp, Homo sapiens
tagcagtgttgccgttggctgc

SEQ ID NO: 7800564 - DNA, 22 bp, Homo sapiens
tagcagtgtctaggtaggccat

SEQ ID NO: 7800565 - DNA, 22 bp, Homo sapiens
cagggatgaccagagggatgtg

SEQ ID NO: 7800566 - DNA, 22 bp, Homo sapiens
cagggatgaccagagggatgtg

SEQ ID NO: 7800567 - DNA, 22 bp, Homo sapiens
cagggatggcctggcgggccac

SEQ ID NO: 7800568 - DNA, 22 bp, Homo sapiens
cagggatgagcagatggagcaa

SEQ ID NO: 7800569 - DNA, 22 bp, Homo sapiens
cagggatgagcagatggagcaa

SEQ ID NO: 7800570 - DNA, 22 bp, Homo sapiens
cagggatgagaaagctctctaa

SEQ ID NO: 7800571 - DNA, 22 bp, Homo sapiens
cagggatgagagatggcacaga

SEQ ID NO: 7800572 - DNA, 22 bp, Homo sapiens
cagggatggagagactactggc

SEQ ID NO: 7800573 - DNA, 22 bp, Homo sapiens
cagggatgctgttaaacatcct

SEQ ID NO: 7800574 - DNA, 22 bp, Homo sapiens
cagggatgctgcttaggcagtt

SEQ ID NO: 7800575 - DNA, 22 bp, Homo sapiens
tagacatttctggttattgaca

SEQ ID NO: 7800576 - DNA, 22 bp, Homo sapiens
tagacagttaaactactggtgg

SEQ ID NO: 7800577 - DNA, 22 bp, Homo sapiens
tacccaggaggaaactgaggct

SEQ ID NO: 7800578 - DNA, 22 bp, Homo sapiens
tacccagggcttttctgatgca

SEQ ID NO: 7800579 - DNA, 22 bp, Homo sapiens
tacccaggggctgagcagaggt

SEQ ID NO: 7800580 - DNA, 22 bp, Homo sapiens
tagaaagacagaggttttgtct

SEQ ID NO: 7800581 - DNA, 22 bp, Homo sapiens
tagaaagcagaaaccatcagag

SEQ ID NO: 7800582 - DNA, 22 bp, Homo sapiens
tagaaagcaaaatcctaccaag

SEQ ID NO: 7800583 - DNA, 22 bp, Homo sapiens
tagaaagactgtccagatttca

SEQ ID NO: 7800584 - DNA, 22 bp, Homo sapiens
tagaaagagcatagtattataa

SEQ ID NO: 7800585 - DNA, 22 bp, Homo sapiens
tagaaagagcatagtattataa

SEQ ID NO: 7800586 - DNA, 22 bp, Homo sapiens
tttacagatgaggatactgagg

SEQ ID NO: 7800587 - DNA, 22 bp, Homo sapiens
tttacagcaacagtgcagaggt

SEQ ID NO: 7800588 - DNA, 22 bp, Homo sapiens
tttacagcattgctgaaagttc

SEQ ID NO: 7800589 - DNA, 22 bp, Homo sapiens
tttaagatcatttgtattatcc

SEQ ID NO: 7800590 - DNA, 22 bp, Homo sapiens
tttaagacttagatttattggg

SEQ ID NO: 7800591 - DNA, 22 bp, Homo sapiens
tttacacattattttcagtgtg

SEQ ID NO: 7800592 - DNA, 22 bp, Homo sapiens
ttgtttaaaagaaatcatagaa

SEQ ID NO: 7800593 - DNA, 22 bp, Homo sapiens
tttaacatgtaattgctgcttt

SEQ ID NO: 7800594 - DNA, 22 bp, Homo sapiens
tttaacctctaatttagttctc

SEQ ID NO: 7800595 - DNA, 22 bp, Homo sapiens
tttaagaagttatgttataaat

SEQ ID NO: 7800596 - DNA, 23 bp, Homo sapiens
tttaactttccaataattcattg

SEQ ID NO: 7800597 - DNA, 22 bp, Homo sapiens
tttatgagcaatgctgagggga

SEQ ID NO: 7800598 - DNA, 22 bp, Homo sapiens
tttatctttggatcttcagaaa

SEQ ID NO: 7800599 - DNA, 22 bp, Homo sapiens
tttatgtttgcattttcaaaga

SEQ ID NO: 7800600 - DNA, 22 bp, Homo sapiens
tttatgtttgcattttcaaaga

SEQ ID NO: 7800601 - DNA, 22 bp, Homo sapiens
tttatgtcccttcaaatgttta

SEQ ID NO: 7800602 - DNA, 22 bp, Homo sapiens
tttatgttcctcttgagctttc

SEQ ID NO: 7800603 - DNA, 22 bp, Homo sapiens
tttatgtgatgcatcccagaaa

SEQ ID NO: 7800604 - DNA, 20 bp, Homo sapiens
tttattggcctttcaggaac

SEQ ID NO: 7800605 - DNA, 22 bp, Homo sapiens
tttattggatgggtcagctcta

SEQ ID NO: 7800606 - DNA, 22 bp, Homo sapiens
tttattggatatttacaagata

SEQ ID NO: 7800607 - DNA, 22 bp, Homo sapiens
tttattggatggatggatggat

SEQ ID NO: 7800608 - DNA, 22 bp, Homo sapiens
tttattggaacacagccatgac

SEQ ID NO: 7800609 - DNA, 22 bp, Homo sapiens
tttattgggtgcagtgcccaca

SEQ ID NO: 7800610 - DNA, 22 bp, Homo sapiens
tttattgggcctggaggatcta

SEQ ID NO: 7800611 - DNA, 22 bp, Homo sapiens
tttattgtcaatctattcccag

SEQ ID NO: 7800612 - DNA, 22 bp, Homo sapiens
tttatctgtagagcttcaccta

SEQ ID NO: 7800613 - DNA, 22 bp, Homo sapiens
tttatctgtcatttcccatatc

SEQ ID NO: 7800614 - DNA, 22 bp, Homo sapiens
tttatctgttgtacctgcattg

SEQ ID NO: 7800615 - DNA, 22 bp, Homo sapiens
tttatctgttgtacatttatgc

SEQ ID NO: 7800616 - DNA, 22 bp, Homo sapiens
tttagtgtaagcataaagaaca

SEQ ID NO: 7800617 - DNA, 19 bp, Homo sapiens
tttagcttacgtttcattg

SEQ ID NO: 7800618 - DNA, 22 bp, Homo sapiens
tttagcttttgtgtcagataag

SEQ ID NO: 7800619 - DNA, 22 bp, Homo sapiens
tttaggatgctctattctgact

SEQ ID NO: 7800620 - DNA, 23 bp, Homo sapiens
tttatttatttaggctgagggat

SEQ ID NO: 7800621 - DNA, 22 bp, Homo sapiens
tttcaagtactgtaaacatgct

SEQ ID NO: 7800622 - DNA, 22 bp, Homo sapiens
tttcaaggatgttatataaatg

SEQ ID NO: 7800623 - DNA, 22 bp, Homo sapiens
tttcacaagtttcaggattctg

SEQ ID NO: 7800624 - DNA, 22 bp, Homo sapiens
tttcaagttctgttcctaaact

SEQ ID NO: 7800625 - DNA, 22 bp, Homo sapiens
tttcaagtggcgagataaggaa

SEQ ID NO: 7800626 - DNA, 22 bp, Homo sapiens
tttcagtttttgctcgatgtat

SEQ ID NO: 7800627 - DNA, 22 bp, Homo sapiens
tttcagtttttgctcgatgtat

SEQ ID NO: 7800628 - DNA, 22 bp, Homo sapiens
tttcagtttgaaggaaaggcca

SEQ ID NO: 7800629 - DNA, 22 bp, Homo sapiens
tttcagtttccagctttgtcat

SEQ ID NO: 7800630 - DNA, 22 bp, Homo sapiens
tttcacattggcttctatttct

SEQ ID NO: 7800631 - DNA, 22 bp, Homo sapiens
tttcataatactgtacatgaaa

SEQ ID NO: 7800632 - DNA, 22 bp, Homo sapiens
tttccagagctgagaaggcttg

SEQ ID NO: 7800633 - DNA, 22 bp, Homo sapiens
tttccagagggtgctcagggcg

SEQ ID NO: 7800634 - DNA, 22 bp, Homo sapiens
tttccaaataaggtcacattct

SEQ ID NO: 7800635 - DNA, 22 bp, Homo sapiens
tttctaaactggattcagcctg

SEQ ID NO: 7800636 - DNA, 22 bp, Homo sapiens
tttctaaaatagattttatggt

SEQ ID NO: 7800637 - DNA, 22 bp, Homo sapiens
tttcgtcaattgtaacaaatgt

SEQ ID NO: 7800638 - DNA, 22 bp, Homo sapiens
tttctaacagcaaatgtttatc

SEQ ID NO: 7800639 - DNA, 22 bp, Homo sapiens
ttggcacctccctaggaagaag

SEQ ID NO: 7800640 - DNA, 22 bp, Homo sapiens
ttggaatcctgagatgagaatt

SEQ ID NO: 7800641 - DNA, 22 bp, Homo sapiens
ttgctttacaaaaattgatggt

SEQ ID NO: 7800642 - DNA, 20 bp, Homo sapiens
ttgctttatcagacatgata

SEQ ID NO: 7800643 - DNA, 22 bp, Homo sapiens
ttgctttatattcaagagagga

SEQ ID NO: 7800644 - DNA, 22 bp, Homo sapiens
ttgctttagggcaaatatttca

SEQ ID NO: 7800645 - DNA, 22 bp, Homo sapiens
ttggaacatgccggggtccagg

SEQ ID NO: 7800646 - DNA, 22 bp, Homo sapiens
ttggaacaggattcaattaaag

SEQ ID NO: 7800647 - DNA, 22 bp, Homo sapiens
ttgccatcccttacctcagtca

SEQ ID NO: 7800648 - DNA, 22 bp, Homo sapiens
ttgaggtattgatattttatga

SEQ ID NO: 7800649 - DNA, 22 bp, Homo sapiens
ttgccttactgcattcagtaaa

SEQ ID NO: 7800650 - DNA, 22 bp, Homo sapiens
ttgccatttatactgcaagtca

SEQ ID NO: 7800651 - DNA, 22 bp, Homo sapiens
ttgccattaaaacatgttatct

SEQ ID NO: 7800652 - DNA, 22 bp, Homo sapiens
ttgctattttgagagtcatagt

SEQ ID NO: 7800653 - DNA, 22 bp, Homo sapiens
ttgctcatatttgcatgtgttt

SEQ ID NO: 7800654 - DNA, 22 bp, Homo sapiens
ttgctaccattgataccagcac

SEQ ID NO: 7800655 - DNA, 22 bp, Homo sapiens
ttgctatttcctgaaataagca

SEQ ID NO: 7800656 - DNA, 22 bp, Homo sapiens
ttgtgctcctatgagaatctaa

SEQ ID NO: 7800657 - DNA, 22 bp, Homo sapiens
ttgtgctcctgtgagaatctag

SEQ ID NO: 7800658 - DNA, 22 bp, Homo sapiens
ttgtgcagagttgcctttattt

SEQ ID NO: 7800659 - DNA, 22 bp, Homo sapiens
ttgtgatactgagcttggcatt

SEQ ID NO: 7800660 - DNA, 22 bp, Homo sapiens
ttgtgagtagtgccgcaataaa

SEQ ID NO: 7800661 - DNA, 22 bp, Homo sapiens
ttgtgagatgatttgaaagtgt

SEQ ID NO: 7800662 - DNA, 22 bp, Homo sapiens
ttggggtatggagtttaaaagt

SEQ ID NO: 7800663 - DNA, 22 bp, Homo sapiens
ttgtacttaaatatgcaaatag

SEQ ID NO: 7800664 - DNA, 22 bp, Homo sapiens
ttgtagaaaattctcttggata

SEQ ID NO: 7800665 - DNA, 22 bp, Homo sapiens
ttgtagaaaattagatgcatgg

SEQ ID NO: 7800666 - DNA, 22 bp, Homo sapiens
ttgtagaatcattatttctagt

SEQ ID NO: 7800667 - DNA, 22 bp, Homo sapiens
ttgtagaatttggatctcggca

SEQ ID NO: 7800668 - DNA, 22 bp, Homo sapiens
ttgtagctaggtttttgtagaa

SEQ ID NO: 7800669 - DNA, 22 bp, Homo sapiens
ttgtatttcctataacctttct

SEQ ID NO: 7800670 - DNA, 22 bp, Homo sapiens
ttgtatgtttctgtgcacatga

SEQ ID NO: 7800671 - DNA, 22 bp, Homo sapiens
ttggctatgcttgtgttcagtt

SEQ ID NO: 7800672 - DNA, 22 bp, Homo sapiens
ttggccctggggccagcttcga

SEQ ID NO: 7800673 - DNA, 22 bp, Homo sapiens
ttgggctcaggagtttgagacc

SEQ ID NO: 7800674 - DNA, 22 bp, Homo sapiens
ttgggctcaggagtttgagacc

SEQ ID NO: 7800675 - DNA, 22 bp, Homo sapiens
ttggcttggagagttgaaatgt

SEQ ID NO: 7800676 - DNA, 22 bp, Homo sapiens
ttgggaagaaacatgtccatca

SEQ ID NO: 7800677 - DNA, 23 bp, Homo sapiens
ttgggaaatagttaagacatgag

SEQ ID NO: 7800678 - DNA, 19 bp, Homo sapiens
ttccaaaatcaggatttga

SEQ ID NO: 7800679 - DNA, 22 bp, Homo sapiens
ttccatacgactgaggtctcgg

SEQ ID NO: 7800680 - DNA, 22 bp, Homo sapiens
ttccccaggggctcctgccttt

SEQ ID NO: 7800681 - DNA, 22 bp, Homo sapiens
ttcccagttagtcatttttaca

SEQ ID NO: 7800682 - DNA, 22 bp, Homo sapiens
ttcaagtcaatttttgaatgac

SEQ ID NO: 7800683 - DNA, 22 bp, Homo sapiens
ttcaagtaggccagctgcatgg

SEQ ID NO: 7800684 - DNA, 22 bp, Homo sapiens
ttcaatatctctaagaatgagg

SEQ ID NO: 7800685 - DNA, 21 bp, Homo sapiens
ttcaatgaaaacaaagtgagg

SEQ ID NO: 7800686 - DNA, 23 bp, Homo sapiens
ttcagaagaaatgagtacaggag

SEQ ID NO: 7800687 - DNA, 22 bp, Homo sapiens
ttcataggtttgctgtgaacat

SEQ ID NO: 7800688 - DNA, 22 bp, Homo sapiens
ttcatagcagtccctttctggg

SEQ ID NO: 7800689 - DNA, 22 bp, Homo sapiens
ttcatagtgcttaatttgataa

SEQ ID NO: 7800690 - DNA, 22 bp, Homo sapiens
ttcatagtgtttccttccagtg

SEQ ID NO: 7800691 - DNA, 22 bp, Homo sapiens
ttatacaggagattccttactt

SEQ ID NO: 7800692 - DNA, 22 bp, Homo sapiens
ttagttagtccctggtaccttt

SEQ ID NO: 7800693 - DNA, 22 bp, Homo sapiens
ttagttagtggggctgtcagtc

SEQ ID NO: 7800694 - DNA, 22 bp, Homo sapiens
ttagttcatagaatgtaacagg

SEQ ID NO: 7800695 - DNA, 23 bp, Homo sapiens
tcctccttttgcttgtgcttccc

SEQ ID NO: 7800696 - DNA, 22 bp, Homo sapiens
ttagtgtttaaaggtttcagag

SEQ ID NO: 7800697 - DNA, 22 bp, Homo sapiens
ttagtgttagggcctgttacct

SEQ ID NO: 7800698 - DNA, 17 bp, Homo sapiens
ttagtgtatctgttttg

SEQ ID NO: 7800699 - DNA, 22 bp, Homo sapiens
ttatttgtggcatatgagacga

SEQ ID NO: 7800700 - DNA, 22 bp, Homo sapiens
ttatttaggagaaggaaccctg

SEQ ID NO: 7800701 - DNA, 22 bp, Homo sapiens
ttatttaattttctcactcaga

SEQ ID NO: 7800702 - DNA, 22 bp, Homo sapiens
ttatgtttgagtatatgactca

SEQ ID NO: 7800703 - DNA, 22 bp, Homo sapiens
ttatgtttgagtatatgactca

SEQ ID NO: 7800704 - DNA, 22 bp, Homo sapiens
ttatgttatgctatttcagata

SEQ ID NO: 7800705 - DNA, 22 bp, Homo sapiens
ttatgttttaagtgtgtatctt

SEQ ID NO: 7800706 - DNA, 22 bp, Homo sapiens
ttattgtttaaagccatgtaaa

SEQ ID NO: 7800707 - DNA, 22 bp, Homo sapiens
ttatttaaaagtggtaagattc

SEQ ID NO: 7800708 - DNA, 22 bp, Homo sapiens
ttatttaatgtgatctgaagag

SEQ ID NO: 7800709 - DNA, 21 bp, Homo sapiens
ttcaaaatggtgtgtttgtct

SEQ ID NO: 7800710 - DNA, 21 bp, Homo sapiens
ttcaaaatggtgtgtttgtct

SEQ ID NO: 7800711 - DNA, 22 bp, Homo sapiens
ttcaaaatgcacaaagggctag

SEQ ID NO: 7800712 - DNA, 22 bp, Homo sapiens
ttcaaaatccgggaggcgcccc

SEQ ID NO: 7800713 - DNA, 23 bp, Homo sapiens
ttcaaaactggaaaatcagatgc

SEQ ID NO: 7800714 - DNA, 22 bp, Homo sapiens
ttattttctcctcagaaagtgg

SEQ ID NO: 7800715 - DNA, 22 bp, Homo sapiens
ttattttcagctaggaaagcca

SEQ ID NO: 7800716 - DNA, 22 bp, Homo sapiens
ttattttaccttcctctgagct

SEQ ID NO: 7800717 - DNA, 22 bp, Homo sapiens
ttattttctcctcagaaagtgg

SEQ ID NO: 7800718 - DNA, 22 bp, Homo sapiens
ttattttgccacaggtgacctt

SEQ ID NO: 7800719 - DNA, 22 bp, Homo sapiens
ttcaagcaccaaattagtaggc

SEQ ID NO: 7800720 - DNA, 22 bp, Homo sapiens
ttcaagcagagatatttcaaga

SEQ ID NO: 7800721 - DNA, 22 bp, Homo sapiens
ttcaaaattgttctaagctctg

SEQ ID NO: 7800722 - DNA, 22 bp, Homo sapiens
ttcaaaattgttctaagctctg

SEQ ID NO: 7800723 - DNA, 22 bp, Homo sapiens
ttctgattgctgatgaggccca

SEQ ID NO: 7800724 - DNA, 22 bp, Homo sapiens
ttctgattgctgatgaggccca

SEQ ID NO: 7800725 - DNA, 22 bp, Homo sapiens
ttctgagggctaatgtactgta

SEQ ID NO: 7800726 - DNA, 22 bp, Homo sapiens
ttctctttatgtatttagtggg

SEQ ID NO: 7800727 - DNA, 22 bp, Homo sapiens
ttctgagctgcaacactaacat

SEQ ID NO: 7800728 - DNA, 22 bp, Homo sapiens
ttctgaggcatagaggatgaga

SEQ ID NO: 7800729 - DNA, 22 bp, Homo sapiens
ttctgcattcaaattatgtgag

SEQ ID NO: 7800730 - DNA, 23 bp, Homo sapiens
ttctctttagatttacattactc

SEQ ID NO: 7800731 - DNA, 22 bp, Homo sapiens
ttctcttcccactttctgtatt

SEQ ID NO: 7800732 - DNA, 22 bp, Homo sapiens
ttctcccatctcagtcttacat

SEQ ID NO: 7800733 - DNA, 22 bp, Homo sapiens
ttctccatttaacttccttatg

SEQ ID NO: 7800734 - DNA, 22 bp, Homo sapiens
ttctaactctgttatgtgtttc

SEQ ID NO: 7800735 - DNA, 22 bp, Homo sapiens
ttctaactctacactagctttg

SEQ ID NO: 7800736 - DNA, 22 bp, Homo sapiens
ttctaaattttggaagatgcag

SEQ ID NO: 7800737 - DNA, 22 bp, Homo sapiens
ttctaaaaccaattctgcttct

SEQ ID NO: 7800738 - DNA, 18 bp, Homo sapiens
ttcggcagatacgcttgg

SEQ ID NO: 7800739 - DNA, 22 bp, Homo sapiens
ttctcaactctcaagagaagct

SEQ ID NO: 7800740 - DNA, 22 bp, Homo sapiens
ttctcaactctcaagagaagct

SEQ ID NO: 7800741 - DNA, 22 bp, Homo sapiens
ttctaactttcaaggtcctttc

SEQ ID NO: 7800742 - DNA, 22 bp, Homo sapiens
ttctcacagtacctaacatgta

SEQ ID NO: 7800743 - DNA, 22 bp, Homo sapiens
ttctcactatgtatgtagattg

SEQ ID NO: 7800744 - DNA, 22 bp, Homo sapiens
ttcttcagatggtgagacctcc

SEQ ID NO: 7800745 - DNA, 22 bp, Homo sapiens
ttcttctcctaaggagagtcct

SEQ ID NO: 7800746 - DNA, 22 bp, Homo sapiens
ttcttctaaatgtgcttattaa

SEQ ID NO: 7800747 - DNA, 22 bp, Homo sapiens
ttcttctgacactgatgctgta

SEQ ID NO: 7800748 - DNA, 20 bp, Homo sapiens
ttcttctctagttatcttca

SEQ ID NO: 7800749 - DNA, 22 bp, Homo sapiens
ttcttctgattgccttctgcaa

SEQ ID NO: 7800750 - DNA, 22 bp, Homo sapiens
ttcttctgcctcccacctgata

SEQ ID NO: 7800751 - DNA, 22 bp, Homo sapiens
ttcttcttctggctgcacctgg

SEQ ID NO: 7800752 - DNA, 22 bp, Homo sapiens
ttcttcttcaagtgctgcattc

SEQ ID NO: 7800753 - DNA, 22 bp, Homo sapiens
ttctttgcccttaatgaaataa

SEQ ID NO: 7800754 - DNA, 22 bp, Homo sapiens
ttctttctttgtagtcctgaac

SEQ ID NO: 7800755 - DNA, 23 bp, Homo sapiens
ttgaaagattgctaagtaaaaat

SEQ ID NO: 7800756 - DNA, 22 bp, Homo sapiens
ttgaaaatatcacaggagcagc

SEQ ID NO: 7800757 - DNA, 22 bp, Homo sapiens
ttgagggtctggatctgctgct

SEQ ID NO: 7800758 - DNA, 22 bp, Homo sapiens
ttgaggtagtacttattattgg

SEQ ID NO: 7800759 - DNA, 22 bp, Homo sapiens
ttttattgtcaatgaagacaga

SEQ ID NO: 7800760 - DNA, 22 bp, Homo sapiens
ttttattgtctcccagttctgg

SEQ ID NO: 7800761 - DNA, 22 bp, Homo sapiens
ttttattgtctgtattgcctat

SEQ ID NO: 7800762 - DNA, 16 bp, Homo sapiens
ttttattgtgacagcc

SEQ ID NO: 7800763 - DNA, 18 bp, Homo sapiens
ttttactcatagcaggcc

SEQ ID NO: 7800764 - DNA, 22 bp, Homo sapiens
ttttacttcattcctgacttca

SEQ ID NO: 7800765 - DNA, 22 bp, Homo sapiens
ttttattggtaatgataaaagt

SEQ ID NO: 7800766 - DNA, 22 bp, Homo sapiens
ttttattggtaatgataaaagt

SEQ ID NO: 7800767 - DNA, 22 bp, Homo sapiens
ttttagaagtgcctatcctatg

SEQ ID NO: 7800768 - DNA, 22 bp, Homo sapiens
ttttattgggagtcctctactg

SEQ ID NO: 7800769 - DNA, 22 bp, Homo sapiens
ttttaattttagcccttctggt

SEQ ID NO: 7800770 - DNA, 22 bp, Homo sapiens
ttttacagttccatgcaaagcg

SEQ ID NO: 7800771 - DNA, 23 bp, Homo sapiens
ttttccagaatcgactctgtaga

SEQ ID NO: 7800772 - DNA, 17 bp, Homo sapiens
ttttggtgagttgtttc

SEQ ID NO: 7800773 - DNA, 22 bp, Homo sapiens
ttttggcttttcctcagcaagc

SEQ ID NO: 7800774 - DNA, 22 bp, Homo sapiens
ttttggctcttggtaggtcaga

SEQ ID NO: 7800775 - DNA, 22 bp, Homo sapiens
tttttgtagtcattagaagagg

SEQ ID NO: 7800776 - DNA, 17 bp, Homo sapiens
ttttgttcatcttcaaa

SEQ ID NO: 7800777 - DNA, 22 bp, Homo sapiens
ttttgtgttgtaatgtcagcta

SEQ ID NO: 7800778 - DNA, 22 bp, Homo sapiens
ttttgttgacctctcccacctt

SEQ ID NO: 7800779 - DNA, 19 bp, Homo sapiens
ttttgtgtagctgctggtt

SEQ ID NO: 7800780 - DNA, 22 bp, Homo sapiens
ttttgtgtccttcacatcatgt

SEQ ID NO: 7800781 - DNA, 23 bp, Homo sapiens
ttttgtgtgacttaatatctctt

SEQ ID NO: 7800782 - DNA, 22 bp, Homo sapiens
ttttgtgttgccatgttaagca

SEQ ID NO: 7800783 - DNA, 22 bp, Homo sapiens
tttgcttgttcaagatttctgt

SEQ ID NO: 7800784 - DNA, 22 bp, Homo sapiens
tttgtcctctccatgtacaata

SEQ ID NO: 7800785 - DNA, 22 bp, Homo sapiens
tttgcatttgttcaagtattga

SEQ ID NO: 7800786 - DNA, 22 bp, Homo sapiens
tttgcattgcattaagtattct

SEQ ID NO: 7800787 - DNA, 22 bp, Homo sapiens
tttgcattgtaatatttagttc

SEQ ID NO: 7800788 - DNA, 22 bp, Homo sapiens
tttgctgtgggatatccatgtg

SEQ ID NO: 7800789 - DNA, 20 bp, Homo sapiens
tttgctgtgggtgtaagaat

SEQ ID NO: 7800790 - DNA, 22 bp, Homo sapiens
tttgctgaactaaaattctgaa

SEQ ID NO: 7800791 - DNA, 22 bp, Homo sapiens
tttgcattagtttagatttcaa

SEQ ID NO: 7800792 - DNA, 20 bp, Homo sapiens
tttgagaccagtctgcccaa

SEQ ID NO: 7800793 - DNA, 22 bp, Homo sapiens
tttgcagtgttcatcagtattt

SEQ ID NO: 7800794 - DNA, 22 bp, Homo sapiens
tttctagttctaccacagtaat

SEQ ID NO: 7800795 - DNA, 22 bp, Homo sapiens
tttctagtcttccctacctccc

SEQ ID NO: 7800796 - DNA, 22 bp, Homo sapiens
tttctagagtgggcatgtctta

SEQ ID NO: 7800797 - DNA, 22 bp, Homo sapiens
tttctagatgcggggcttgtgc

SEQ ID NO: 7800798 - DNA, 22 bp, Homo sapiens
tttctagctgtaggaagctgag

SEQ ID NO: 7800799 - DNA, 22 bp, Homo sapiens
tttgaaatatgtgatgagagag

SEQ ID NO: 7800800 - DNA, 22 bp, Homo sapiens
tttgaaatgtatcagtataggt

SEQ ID NO: 7800801 - DNA, 22 bp, Homo sapiens
tttctattggcgtcactgttgt

SEQ ID NO: 7800802 - DNA, 20 bp, Homo sapiens
tttctatggggccagcacat

SEQ ID NO: 7800803 - DNA, 22 bp, Homo sapiens
tttgacattaaggaacatatat

SEQ ID NO: 7800804 - DNA, 22 bp, Homo sapiens
tttgacatgcaaagcactttag

SEQ ID NO: 7800805 - DNA, 22 bp, Homo sapiens
tttgaacagggaatgttccaca

SEQ ID NO: 7800806 - DNA, 22 bp, Homo sapiens
tttgaagacatttgaatacttt

SEQ ID NO: 7800807 - DNA, 22 bp, Homo sapiens
ttttttggataataaacgatct

SEQ ID NO: 7800808 - DNA, 22 bp, Homo sapiens
ttttttgtagcaagcgcagata

SEQ ID NO: 7800809 - DNA, 22 bp, Homo sapiens
ttttttggtgctcctaggaagg

SEQ ID NO: 7800810 - DNA, 22 bp, Homo sapiens
gaggagctgcagggggagtcta

SEQ ID NO: 7800811 - DNA, 22 bp, Homo sapiens
gaggagctctgctccatccttc

SEQ ID NO: 7800812 - DNA, 22 bp, Homo sapiens
gaggagctgagccacgtcctgg

SEQ ID NO: 7800813 - DNA, 19 bp, Homo sapiens
atgtacccagtgtcaatcc

SEQ ID NO: 7800814 - DNA, 22 bp, Homo sapiens
gaggagctcatgaaagcggtgt

SEQ ID NO: 7800815 - DNA, 22 bp, Homo sapiens
atgtacatttagatcatttctg

SEQ ID NO: 7800816 - DNA, 18 bp, Homo sapiens
atgtacatgtactcacac

SEQ ID NO: 7800817 - DNA, 22 bp, Homo sapiens
atgtacattttcctaatgtttt

SEQ ID NO: 7800818 - DNA, 22 bp, Homo sapiens
gaggccaggggcctggagatga

SEQ ID NO: 7800819 - DNA, 22 bp, Homo sapiens
gaggagctggcagcgtctccgc

SEQ ID NO: 7800820 - DNA, 22 bp, Homo sapiens
gaggagctgggaccctgtcatc

SEQ ID NO: 7800821 - DNA, 22 bp, Homo sapiens
atggtatacaattatggactgt

SEQ ID NO: 7800822 - DNA, 22 bp, Homo sapiens
atggtacaattttcatttgtgg

SEQ ID NO: 7800823 - DNA, 22 bp, Homo sapiens
atggtacagataatacatgctg

SEQ ID NO: 7800824 - DNA, 22 bp, Homo sapiens
atggtacatagtttaaataagg

SEQ ID NO: 7800825 - DNA, 22 bp, Homo sapiens
atggtacagtgcactgaatgga

SEQ ID NO: 7800826 - DNA, 22 bp, Homo sapiens
atggtacaatgatggatagtgg

SEQ ID NO: 7800827 - DNA, 22 bp, Homo sapiens
atggtacaaaatgtataaagtc

SEQ ID NO: 7800828 - DNA, 22 bp, Homo sapiens
atgggtttccctctgaaattat

SEQ ID NO: 7800829 - DNA, 22 bp, Homo sapiens
atgggtttataggtggactttt

SEQ ID NO: 7800830 - DNA, 22 bp, Homo sapiens
gaggcctgggagcctgtcctcc

SEQ ID NO: 7800831 - DNA, 22 bp, Homo sapiens
gaggcctgggttacctactcgt

SEQ ID NO: 7800832 - DNA, 22 bp, Homo sapiens
atgtctgctttccttttaatca

SEQ ID NO: 7800833 - DNA, 22 bp, Homo sapiens
gaggcctggctgggaggaggtg

SEQ ID NO: 7800834 - DNA, 22 bp, Homo sapiens
gaggcctggctctgccctcctg

SEQ ID NO: 7800835 - DNA, 22 bp, Homo sapiens
gaggcctggagccgcctaggcg

SEQ ID NO: 7800836 - DNA, 22 bp, Homo sapiens
atgtcttttatggagatgtcat

SEQ ID NO: 7800837 - DNA, 22 bp, Homo sapiens
atgtcttttatgattacgggat

SEQ ID NO: 7800838 - DNA, 22 bp, Homo sapiens
atgtgaaaaatttcttattaca

SEQ ID NO: 7800839 - DNA, 22 bp, Homo sapiens
gaggctgcggggaggagcctgc

SEQ ID NO: 7800840 - DNA, 22 bp, Homo sapiens
gagaacacatgcagactgggta

SEQ ID NO: 7800841 - DNA, 22 bp, Homo sapiens
atggcagtgtttcagtttttgg

SEQ ID NO: 7800842 - DNA, 22 bp, Homo sapiens
atggcagggcacagctctagtt

SEQ ID NO: 7800843 - DNA, 22 bp, Homo sapiens
atggcagggactgtggcccttg

SEQ ID NO: 7800844 - DNA, 22 bp, Homo sapiens
cttggcagggtggaggatgcag

SEQ ID NO: 7800845 - DNA, 22 bp, Homo sapiens
cttggcagtttcggaaggatga

SEQ ID NO: 7800846 - DNA, 22 bp, Homo sapiens
cttggcagagggctgggctcag

SEQ ID NO: 7800847 - DNA, 22 bp, Homo sapiens
cttgtaaatgcagattctgatt

SEQ ID NO: 7800848 - DNA, 22 bp, Homo sapiens
atctatcacctttaggtttgtt

SEQ ID NO: 7800849 - DNA, 22 bp, Homo sapiens
cttgcctgtggctagttggctc

SEQ ID NO: 7800850 - DNA, 22 bp, Homo sapiens
cttgcctttgtcttcaaaggct

SEQ ID NO: 7800851 - DNA, 18 bp, Homo sapiens
cttgttcttctcttggcg

SEQ ID NO: 7800852 - DNA, 18 bp, Homo sapiens
cttgttcttctcttggcg

SEQ ID NO: 7800853 - DNA, 22 bp, Homo sapiens
cttgttctgtgcttcttacatt

SEQ ID NO: 7800854 - DNA, 22 bp, Homo sapiens
atgaaaagggagtgatatttgt

SEQ ID NO: 7800855 - DNA, 22 bp, Homo sapiens
cttgttatctccgtgtccttgt

SEQ ID NO: 7800856 - DNA, 22 bp, Homo sapiens
atgaaaacggaccagagctatt

SEQ ID NO: 7800857 - DNA, 22 bp, Homo sapiens
atgaaatgaagttggcctggct

SEQ ID NO: 7800858 - DNA, 22 bp, Homo sapiens
atgaaatgtatgagtctgggtt

SEQ ID NO: 7800859 - DNA, 23 bp, Homo sapiens
atgaaatgctggctcagggaggt

SEQ ID NO: 7800860 - DNA, 22 bp, Homo sapiens
cttttcaggctacattatggga

SEQ ID NO: 7800861 - DNA, 22 bp, Homo sapiens
cttttattttgaattaagggct

SEQ ID NO: 7800862 - DNA, 22 bp, Homo sapiens
ctttggtggaggggtgcaggca

SEQ ID NO: 7800863 - DNA, 22 bp, Homo sapiens
atgcagctgacattttcatgtt

SEQ ID NO: 7800864 - DNA, 22 bp, Homo sapiens
atgcagctatttgagcatgtca

SEQ ID NO: 7800865 - DNA, 23 bp, Homo sapiens
atgcaggacttataaggtaaggt

SEQ ID NO: 7800866 - DNA, 22 bp, Homo sapiens
atgcatctgtagtgttatatga

SEQ ID NO: 7800867 - DNA, 20 bp, Homo sapiens
atgcatctggtatctttcct

SEQ ID NO: 7800868 - DNA, 22 bp, Homo sapiens
atgcatctatgacttagacatt

SEQ ID NO: 7800869 - DNA, 22 bp, Homo sapiens
atgcatcttatcaaaaattata

SEQ ID NO: 7800870 - DNA, 22 bp, Homo sapiens
atgcatcttttcaaggtatttc

SEQ ID NO: 7800871 - DNA, 22 bp, Homo sapiens
atgcaaacatgaagagaaagag

SEQ ID NO: 7800872 - DNA, 22 bp, Homo sapiens
atgcaaacattcgcttgtctct

SEQ ID NO: 7800873 - DNA, 22 bp, Homo sapiens
atgcaaacatgtttcctctaag

SEQ ID NO: 7800874 - DNA, 20 bp, Homo sapiens
atgattttgcactaacttca

SEQ ID NO: 7800875 - DNA, 22 bp, Homo sapiens
atgcaaaagtaactgtgatttt

SEQ ID NO: 7800876 - DNA, 22 bp, Homo sapiens
atgatacaagcaaaactaatca

SEQ ID NO: 7800877 - DNA, 22 bp, Homo sapiens
atgagtgtgaagttagctcagt

SEQ ID NO: 7800878 - DNA, 22 bp, Homo sapiens
gaaagcacccaagatttccttc

SEQ ID NO: 7800879 - DNA, 22 bp, Homo sapiens
atgaggcagctggctttctccc

SEQ ID NO: 7800880 - DNA, 22 bp, Homo sapiens
atgaggcagcccttcccttctc

SEQ ID NO: 7800881 - DNA, 22 bp, Homo sapiens
atgaagcaacagccctcctatt

SEQ ID NO: 7800882 - DNA, 22 bp, Homo sapiens
atgaagcagaatttcccactct

SEQ ID NO: 7800883 - DNA, 18 bp, Homo sapiens
gcctgctctgctctcccc

SEQ ID NO: 7800884 - DNA, 22 bp, Homo sapiens
atttctcagtaggtgcacagtg

SEQ ID NO: 7800885 - DNA, 22 bp, Homo sapiens
gcctcagaaagcttttattcat

SEQ ID NO: 7800886 - DNA, 22 bp, Homo sapiens
atttctcactgagcagataaaa

SEQ ID NO: 7800887 - DNA, 22 bp, Homo sapiens
atttctcagcacttcctatctc

SEQ ID NO: 7800888 - DNA, 22 bp, Homo sapiens
gcgagcctctggagtcctctgg

SEQ ID NO: 7800889 - DNA, 22 bp, Homo sapiens
caaacttacgtagtcttactac

SEQ ID NO: 7800890 - DNA, 22 bp, Homo sapiens
gctcaggagctgacagcctcaa

SEQ ID NO: 7800891 - DNA, 22 bp, Homo sapiens
gcgcaccacctccaggtggccg

SEQ ID NO: 7800892 - DNA, 22 bp, Homo sapiens
gcgagtgccgagagggcagggc

SEQ ID NO: 7800893 - DNA, 22 bp, Homo sapiens
gcgagtgccgagagggcagggc

SEQ ID NO: 7800894 - DNA, 22 bp, Homo sapiens
caaactgagcatcagaaagttt

SEQ ID NO: 7800895 - DNA, 22 bp, Homo sapiens
atttccttgcaagtttctgtaa

SEQ ID NO: 7800896 - DNA, 22 bp, Homo sapiens
atttccttgcaagtttctgtaa

SEQ ID NO: 7800897 - DNA, 22 bp, Homo sapiens
atttccttcccagatttggttc

SEQ ID NO: 7800898 - DNA, 22 bp, Homo sapiens
atttcatagattgtaaatccct

SEQ ID NO: 7800899 - DNA, 22 bp, Homo sapiens
atttcatatgtatcacctagcc

SEQ ID NO: 7800900 - DNA, 22 bp, Homo sapiens
atttcagggtaaaaagtgttca

SEQ ID NO: 7800901 - DNA, 22 bp, Homo sapiens
atttcaggatagcctagttttg

SEQ ID NO: 7800902 - DNA, 22 bp, Homo sapiens
atttattgagacttaacaaccc

SEQ ID NO: 7800903 - DNA, 22 bp, Homo sapiens
atttattgagcctttcctatgt

SEQ ID NO: 7800904 - DNA, 22 bp, Homo sapiens
atttattgagagggaggggaat

SEQ ID NO: 7800905 - DNA, 22 bp, Homo sapiens
gccaggcatttgttaggtgctg

SEQ ID NO: 7800906 - DNA, 22 bp, Homo sapiens
gccaggcatttattgattgaat

SEQ ID NO: 7800907 - DNA, 22 bp, Homo sapiens
gccaggcattctagaagtagtg

SEQ ID NO: 7800908 - DNA, 22 bp, Homo sapiens
atttattggatgcttacttggg

SEQ ID NO: 7800909 - DNA, 22 bp, Homo sapiens
atttacagaaacttaatcatag

SEQ ID NO: 7800910 - DNA, 22 bp, Homo sapiens
attgcttttccttaacacatgc

SEQ ID NO: 7800911 - DNA, 22 bp, Homo sapiens
attgcttttgagctagaatttt

SEQ ID NO: 7800912 - DNA, 22 bp, Homo sapiens
attgcttttagtgaaattatat

SEQ ID NO: 7800913 - DNA, 22 bp, Homo sapiens
atttaatttacatttgacagag

SEQ ID NO: 7800914 - DNA, 22 bp, Homo sapiens
atttaatgtcgagctattgtag

SEQ ID NO: 7800915 - DNA, 22 bp, Homo sapiens
atttaaattttctgatggagag

SEQ ID NO: 7800916 - DNA, 22 bp, Homo sapiens
attattcaatcatattaaaagt

SEQ ID NO: 7800917 - DNA, 22 bp, Homo sapiens
attattaaagctacatcaagga

SEQ ID NO: 7800918 - DNA, 22 bp, Homo sapiens
gcaagtacaaacgcatcggctg

SEQ ID NO: 7800919 - DNA, 21 bp, Homo sapiens
gcaagtactatcatcattatc

SEQ ID NO: 7800920 - DNA, 17 bp, Homo sapiens
gcaagggatgggagatt

SEQ ID NO: 7800921 - DNA, 22 bp, Homo sapiens
attagaatgcagggttcattgt

SEQ ID NO: 7800922 - DNA, 22 bp, Homo sapiens
attaatttttctgacagccaca

SEQ ID NO: 7800923 - DNA, 22 bp, Homo sapiens
attacaaaagaagggagaaggt

SEQ ID NO: 7800924 - DNA, 22 bp, Homo sapiens
attaagctccaagttgctctga

SEQ ID NO: 7800925 - DNA, 22 bp, Homo sapiens
attaatatacactgttagcatg

SEQ ID NO: 7800926 - DNA, 22 bp, Homo sapiens
attaatttccaggcactgtgct

SEQ ID NO: 7800927 - DNA, 22 bp, Homo sapiens
attaattttacctttgtaaaca

SEQ ID NO: 7800928 - DNA, 22 bp, Homo sapiens
attaatattggttcattagctg

SEQ ID NO: 7800929 - DNA, 22 bp, Homo sapiens
gatgaggcaggagtttgcttgt

SEQ ID NO: 7800930 - DNA, 22 bp, Homo sapiens
gatgaggcgagcacgttgtttg

SEQ ID NO: 7800931 - DNA, 22 bp, Homo sapiens
attaaaattccaaggtatgcca

SEQ ID NO: 7800932 - DNA, 22 bp, Homo sapiens
atgtgtttgtcctgcagaaata

SEQ ID NO: 7800933 - DNA, 22 bp, Homo sapiens
atgtgtttataattactcaatc

SEQ ID NO: 7800934 - DNA, 22 bp, Homo sapiens
atgtgtttaccaggggaacatg

SEQ ID NO: 7800935 - DNA, 22 bp, Homo sapiens
atgtgtgtgtttaatcctcaaa

SEQ ID NO: 7800936 - DNA, 22 bp, Homo sapiens
atgttttaccctttgcacaaac

SEQ ID NO: 7800937 - DNA, 22 bp, Homo sapiens
atgttttaccctttgcacaaac

SEQ ID NO: 7800938 - DNA, 22 bp, Homo sapiens
atgttttatattttgcagcagt

SEQ ID NO: 7800939 - DNA, 22 bp, Homo sapiens
atgttttgctggatgttggcta

SEQ ID NO: 7800940 - DNA, 22 bp, Homo sapiens
attattggacacttcttctgca

SEQ ID NO: 7800941 - DNA, 22 bp, Homo sapiens
attattggtacaccgtagtcat

SEQ ID NO: 7800942 - DNA, 22 bp, Homo sapiens
attcagttagccacagctattc

SEQ ID NO: 7800943 - DNA, 22 bp, Homo sapiens
attcctcatttgttgagaacca

SEQ ID NO: 7800944 - DNA, 22 bp, Homo sapiens
attctacacctctctcatttag

SEQ ID NO: 7800945 - DNA, 22 bp, Homo sapiens
attctacacaacatgatgatgg

SEQ ID NO: 7800946 - DNA, 22 bp, Homo sapiens
attctcagctttcaaatagaca

SEQ ID NO: 7800947 - DNA, 22 bp, Homo sapiens
attctcagctttcaaatagaca

SEQ ID NO: 7800948 - DNA, 22 bp, Homo sapiens
attctgttacttggtgatcttc

SEQ ID NO: 7800949 - DNA, 22 bp, Homo sapiens
attcttcactgtttcagaatga

SEQ ID NO: 7800950 - DNA, 22 bp, Homo sapiens
attcttcaccatggataatttg

SEQ ID NO: 7800951 - DNA, 22 bp, Homo sapiens
attcttcaaagagtgtcaaagt

SEQ ID NO: 7800952 - DNA, 22 bp, Homo sapiens
attcttcaaagagtgtcaaagt

SEQ ID NO: 7800953 - DNA, 22 bp, Homo sapiens
attgacagaaaattggatggca

SEQ ID NO: 7800954 - DNA, 22 bp, Homo sapiens
attcttcagcaggggacactat

SEQ ID NO: 7800955 - DNA, 22 bp, Homo sapiens
attcttcagaatatctggcact

SEQ ID NO: 7800956 - DNA, 22 bp, Homo sapiens
cactggcccataaaggcctggg

SEQ ID NO: 7800957 - DNA, 22 bp, Homo sapiens
cactggcccagccaggcctgtt

SEQ ID NO: 7800958 - DNA, 22 bp, Homo sapiens
gggaaagagaggtggacgcagg

SEQ ID NO: 7800959 - DNA, 22 bp, Homo sapiens
cagacaggcaggtgagagctcc

SEQ ID NO: 7800960 - DNA, 22 bp, Homo sapiens
gggaggtgaaaggtcatgtgtg

SEQ ID NO: 7800961 - DNA, 22 bp, Homo sapiens
gggaggtgaaaggttgctgcag

SEQ ID NO: 7800962 - DNA, 22 bp, Homo sapiens
gggcaagtccggtgcccagagc

SEQ ID NO: 7800963 - DNA, 22 bp, Homo sapiens
cagagctgcacattctatgatg

SEQ ID NO: 7800964 - DNA, 22 bp, Homo sapiens
cagagctgagtcttcaaggttg

SEQ ID NO: 7800965 - DNA, 23 bp, Homo sapiens
cagagctgattaaacttaatctc

SEQ ID NO: 7800966 - DNA, 22 bp, Homo sapiens
cagagctgattggatccagaga

SEQ ID NO: 7800967 - DNA, 22 bp, Homo sapiens
cagagctgtcatttgccagtga

SEQ ID NO: 7800968 - DNA, 22 bp, Homo sapiens
cagagctggtgttacaagtcca

SEQ ID NO: 7800969 - DNA, 22 bp, Homo sapiens
cagagctggtgtgtcctggcat

SEQ ID NO: 7800970 - DNA, 22 bp, Homo sapiens
cagaggccaggctgcctgactg

SEQ ID NO: 7800971 - DNA, 22 bp, Homo sapiens
cagaggcctggcttggacacct

SEQ ID NO: 7800972 - DNA, 22 bp, Homo sapiens
gggtctccatgttaacatcact

SEQ ID NO: 7800973 - DNA, 22 bp, Homo sapiens
gtatctatgatcctttatatct

SEQ ID NO: 7800974 - DNA, 22 bp, Homo sapiens
gtatgaaagcatcattcctgct

SEQ ID NO: 7800975 - DNA, 22 bp, Homo sapiens
cagcagcctcttgtgcctgtgg

SEQ ID NO: 7800976 - DNA, 22 bp, Homo sapiens
gtatgcatcgactcaagtctga

SEQ ID NO: 7800977 - DNA, 22 bp, Homo sapiens
cagagtcagagctccatggagt

SEQ ID NO: 7800978 - DNA, 20 bp, Homo sapiens
gtaaaatatggtctttgggt

SEQ ID NO: 7800979 - DNA, 22 bp, Homo sapiens
ggttccttctgaggtccctgta

SEQ ID NO: 7800980 - DNA, 22 bp, Homo sapiens
ggttctcttcctcctgactgag

SEQ ID NO: 7800981 - DNA, 22 bp, Homo sapiens
ggttcccggatctccgagtccc

SEQ ID NO: 7800982 - DNA, 22 bp, Homo sapiens
cagcatttagaatttgaagtgt

SEQ ID NO: 7800983 - DNA, 22 bp, Homo sapiens
cagcattttcttaatgtaggtg

SEQ ID NO: 7800984 - DNA, 22 bp, Homo sapiens
cagccaggttcaagtccttata

SEQ ID NO: 7800985 - DNA, 22 bp, Homo sapiens
cacagggaggcggtcactggct

SEQ ID NO: 7800986 - DNA, 19 bp, Homo sapiens
cacagggagaccacatgtc

SEQ ID NO: 7800987 - DNA, 22 bp, Homo sapiens
cacagggagaggaacagcgcag

SEQ ID NO: 7800988 - DNA, 22 bp, Homo sapiens
ggatgtgaatctgggctgagac

SEQ ID NO: 7800989 - DNA, 22 bp, Homo sapiens
ggatgtagtgcaaggagtgaat

SEQ ID NO: 7800990 - DNA, 22 bp, Homo sapiens
ggatgggagcagaggacgacca

SEQ ID NO: 7800991 - DNA, 22 bp, Homo sapiens
ggaggccaaggcaggtggatcg

SEQ ID NO: 7800992 - DNA, 22 bp, Homo sapiens
cacagcttcccaaagtggacct

SEQ ID NO: 7800993 - DNA, 22 bp, Homo sapiens
cacagctggtgcactagctctg

SEQ ID NO: 7800994 - DNA, 22 bp, Homo sapiens
cacagctgaagtagccatgtgg

SEQ ID NO: 7800995 - DNA, 22 bp, Homo sapiens
ggcacagggggctgaggactag

SEQ ID NO: 7800996 - DNA, 22 bp, Homo sapiens
ggcagcagtggctgctattgtc

SEQ ID NO: 7800997 - DNA, 22 bp, Homo sapiens
ggcagagctctggactgagaac

SEQ ID NO: 7800998 - DNA, 16 bp, Homo sapiens
cacagtgctgctgctc

SEQ ID NO: 7800999 - DNA, 22 bp, Homo sapiens
cacccccacctgtgggctcctg

SEQ ID NO: 7801000 - DNA, 22 bp, Homo sapiens
cacccagcacagagggaggcga

SEQ ID NO: 7801001 - DNA, 22 bp, Homo sapiens
cacccagcagcacttaagacta

SEQ ID NO: 7801002 - DNA, 22 bp, Homo sapiens
ggcagtggttagaaacatgagc

SEQ ID NO: 7801003 - DNA, 22 bp, Homo sapiens
ggcctctcatgcccagagccaa

SEQ ID NO: 7801004 - DNA, 22 bp, Homo sapiens
ggcctctcagggcagagaccct

SEQ ID NO: 7801005 - DNA, 22 bp, Homo sapiens
caagagctgaggctggagaggt

SEQ ID NO: 7801006 - DNA, 22 bp, Homo sapiens
caagataagatcatttacacta

SEQ ID NO: 7801007 - DNA, 22 bp, Homo sapiens
caagataatttattctgagttt

SEQ ID NO: 7801008 - DNA, 22 bp, Homo sapiens
caacatttgagtaaagaaatgg

SEQ ID NO: 7801009 - DNA, 22 bp, Homo sapiens
caacatataatatttgagttct

SEQ ID NO: 7801010 - DNA, 22 bp, Homo sapiens
gctgccacattttcaggactaa

SEQ ID NO: 7801011 - DNA, 19 bp, Homo sapiens
gctcctggatgacctgtgg

SEQ ID NO: 7801012 - DNA, 22 bp, Homo sapiens
gctcctggagagattgagaaag

SEQ ID NO: 7801013 - DNA, 18 bp, Homo sapiens
gctcctggagtctgactc

SEQ ID NO: 7801014 - DNA, 18 bp, Homo sapiens
gctcctggaccaggtcac

SEQ ID NO: 7801015 - DNA, 22 bp, Homo sapiens
caaagtaaactaccactgtttc

SEQ ID NO: 7801016 - DNA, 22 bp, Homo sapiens
caaggcagcgttcctttctgga

SEQ ID NO: 7801017 - DNA, 22 bp, Homo sapiens
gctgtacaaggcctctgccatc

SEQ ID NO: 7801018 - DNA, 20 bp, Homo sapiens
caaggcagaccagagtgagt

SEQ ID NO: 7801019 - DNA, 22 bp, Homo sapiens
caaggcagaattcagactcagg

SEQ ID NO: 7801020 - DNA, 22 bp, Homo sapiens
gcttgggaaactggggaaacca

SEQ ID NO: 7801021 - DNA, 22 bp, Homo sapiens
gcttgggaagggccctgtgtac

SEQ ID NO: 7801022 - DNA, 19 bp, Homo sapiens
gcttgggagagggagctaa

SEQ ID NO: 7801023 - DNA, 22 bp, Homo sapiens
cacaaaagtaggaggcaggcgg

SEQ ID NO: 7801024 - DNA, 22 bp, Homo sapiens
gcttggccagcagccgggatgc

SEQ ID NO: 7801025 - DNA, 22 bp, Homo sapiens
cacaatattggccgggctggtc

SEQ ID NO: 7801026 - DNA, 23 bp, Homo sapiens
cacaaaggttccattctctcacc

SEQ ID NO: 7801027 - DNA, 21 bp, Homo sapiens
ggaaaactttccttgtctgaa

SEQ ID NO: 7801028 - DNA, 18 bp, Homo sapiens
cacaatttacagatgaca

SEQ ID NO: 7801029 - DNA, 23 bp, Homo sapiens
cacacccatcactaagagctcct

SEQ ID NO: 7801030 - DNA, 19 bp, Homo sapiens
cacacccatgcttgccaag

SEQ ID NO: 7801031 - DNA, 22 bp, Homo sapiens
cacaccagaggttacctgcaaa

SEQ ID NO: 7801032 - DNA, 22 bp, Homo sapiens
cacacatttcagatgctacaat

SEQ ID NO: 7801033 - DNA, 22 bp, Homo sapiens
ctctgtgaacccctcctttctt

SEQ ID NO: 7801034 - DNA, 22 bp, Homo sapiens
ctctgtgattctcatgtaccac

SEQ ID NO: 7801035 - DNA, 22 bp, Homo sapiens
agtgtacaaaatgatagataaa

SEQ ID NO: 7801036 - DNA, 22 bp, Homo sapiens
ctcttcttggcccccatgaggg

SEQ ID NO: 7801037 - DNA, 22 bp, Homo sapiens
ctctgtatgaatcatatggagt

SEQ ID NO: 7801038 - DNA, 22 bp, Homo sapiens
ctctgtatagaaaggaaacatt

SEQ ID NO: 7801039 - DNA, 22 bp, Homo sapiens
agtggcttcatttctgccagaa

SEQ ID NO: 7801040 - DNA, 22 bp, Homo sapiens
ctcctgcatggttgtgctattg

SEQ ID NO: 7801041 - DNA, 22 bp, Homo sapiens
ctcctgagtagtagcattgtca

SEQ ID NO: 7801042 - DNA, 22 bp, Homo sapiens
ctcctgcaagcctccccaagca

SEQ ID NO: 7801043 - DNA, 23 bp, Homo sapiens
ctccttggtatgccatgcccagc

SEQ ID NO: 7801044 - DNA, 22 bp, Homo sapiens
ctccttggtgtagtactgagca

SEQ ID NO: 7801045 - DNA, 23 bp, Homo sapiens
agtgctggagaagcttctggctt

SEQ ID NO: 7801046 - DNA, 22 bp, Homo sapiens
ctcctgaggacttctattgggt

SEQ ID NO: 7801047 - DNA, 22 bp, Homo sapiens
ctcctgaggaaaagcttggtca

SEQ ID NO: 7801048 - DNA, 20 bp, Homo sapiens
ctctcccagcacagcttcct

SEQ ID NO: 7801049 - DNA, 22 bp, Homo sapiens
ctcgggcaggagggccctctcc

SEQ ID NO: 7801050 - DNA, 22 bp, Homo sapiens
ctcggcaggtggaggttgtagt

SEQ ID NO: 7801051 - DNA, 22 bp, Homo sapiens
agtgctgggctatctactgcta

SEQ ID NO: 7801052 - DNA, 22 bp, Homo sapiens
ctcagaagctctgctcctttgc

SEQ ID NO: 7801053 - DNA, 18 bp, Homo sapiens
ctcagacatgcttctttt

SEQ ID NO: 7801054 - DNA, 22 bp, Homo sapiens
ctcagacttgctttttatggaa

SEQ ID NO: 7801055 - DNA, 22 bp, Homo sapiens
ctcagcaattacctgtgtctct

SEQ ID NO: 7801056 - DNA, 19 bp, Homo sapiens
ctcagcaagatagaaatgg

SEQ ID NO: 7801057 - DNA, 22 bp, Homo sapiens
ctcagatgtgttggatggaaaa

SEQ ID NO: 7801058 - DNA, 22 bp, Homo sapiens
ctcagatgtagaaagattgtga

SEQ ID NO: 7801059 - DNA, 22 bp, Homo sapiens
cggggtccctgcccacccatac

SEQ ID NO: 7801060 - DNA, 22 bp, Homo sapiens
cggggtccgggcagtaggctgc

SEQ ID NO: 7801061 - DNA, 22 bp, Homo sapiens
ctcaaatagaactgatctataa

SEQ ID NO: 7801062 - DNA, 21 bp, Homo sapiens
ctcaaaattctttctgttgga

SEQ ID NO: 7801063 - DNA, 22 bp, Homo sapiens
ctcaaaatggttaattttaata

SEQ ID NO: 7801064 - DNA, 23 bp, Homo sapiens
ctcaaccctagtaagggagtagg

SEQ ID NO: 7801065 - DNA, 22 bp, Homo sapiens
agtctcagcaagcatggctagt

SEQ ID NO: 7801066 - DNA, 23 bp, Homo sapiens
agtctcagctggaaacatgtgtc

SEQ ID NO: 7801067 - DNA, 22 bp, Homo sapiens
agtctcagccacacagacctat

SEQ ID NO: 7801068 - DNA, 22 bp, Homo sapiens
ctcagctcaaaattcacctttg

SEQ ID NO: 7801069 - DNA, 22 bp, Homo sapiens
agtctcaggcagaggaaggcta

SEQ ID NO: 7801070 - DNA, 22 bp, Homo sapiens
agtctcagggccacccggggaa

SEQ ID NO: 7801071 - DNA, 22 bp, Homo sapiens
agtctccacccatgacagtaca

SEQ ID NO: 7801072 - DNA, 22 bp, Homo sapiens
ctccagaattgtccattggaaa

SEQ ID NO: 7801073 - DNA, 22 bp, Homo sapiens
cctggcagcccagagcgccgct

SEQ ID NO: 7801074 - DNA, 22 bp, Homo sapiens
cctggcagcctcagccaattct

SEQ ID NO: 7801075 - DNA, 22 bp, Homo sapiens
cctggacctgcagcatcagcat

SEQ ID NO: 7801076 - DNA, 22 bp, Homo sapiens
cctggcacagatccttcataca

SEQ ID NO: 7801077 - DNA, 22 bp, Homo sapiens
cctggcagcgtgccgagctgcg

SEQ ID NO: 7801078 - DNA, 22 bp, Homo sapiens
cctggcagcgccgaagctggcc

SEQ ID NO: 7801079 - DNA, 22 bp, Homo sapiens
cctggaagtcattcctcgttcc

SEQ ID NO: 7801080 - DNA, 22 bp, Homo sapiens
cctggacaatgagatgtcaggg

SEQ ID NO: 7801081 - DNA, 22 bp, Homo sapiens
cctggctgcttcctctgccatg

SEQ ID NO: 7801082 - DNA, 22 bp, Homo sapiens
cctggctggtggcagcgacaag

SEQ ID NO: 7801083 - DNA, 21 bp, Homo sapiens
cctggccaatctgatagggtt

SEQ ID NO: 7801084 - DNA, 22 bp, Homo sapiens
cctggccacccagccttggcca

SEQ ID NO: 7801085 - DNA, 22 bp, Homo sapiens
cctggcagctgtttggcttggc

SEQ ID NO: 7801086 - DNA, 22 bp, Homo sapiens
cctggcagctccgtggccttcc

SEQ ID NO: 7801087 - DNA, 22 bp, Homo sapiens
cctggcagctaagtgctttgag

SEQ ID NO: 7801088 - DNA, 22 bp, Homo sapiens
cctggcagctcctccccggcgg

SEQ ID NO: 7801089 - DNA, 22 bp, Homo sapiens
cctctgccacctcccacgaggc

SEQ ID NO: 7801090 - DNA, 20 bp, Homo sapiens
agggtcagtagcacagagct

SEQ ID NO: 7801091 - DNA, 22 bp, Homo sapiens
cctgggagaactgctgggttgg

SEQ ID NO: 7801092 - DNA, 19 bp, Homo sapiens
ccttgcctgtccctgcagc

SEQ ID NO: 7801093 - DNA, 22 bp, Homo sapiens
ccttggccctagcctcaggcaa

SEQ ID NO: 7801094 - DNA, 22 bp, Homo sapiens
cctttattcaattagtcctaat

SEQ ID NO: 7801095 - DNA, 22 bp, Homo sapiens
cctttattcaattagtcctaat

SEQ ID NO: 7801096 - DNA, 22 bp, Homo sapiens
cctttggtcttgatgaactgtt

SEQ ID NO: 7801097 - DNA, 22 bp, Homo sapiens
cctttggtcacctccactctta

SEQ ID NO: 7801098 - DNA, 22 bp, Homo sapiens
ccttttatactctgtcctctgg

SEQ ID NO: 7801099 - DNA, 22 bp, Homo sapiens
cgaggcagggaagctgcaaaag

SEQ ID NO: 7801100 - DNA, 22 bp, Homo sapiens
cgaggaggaaacgcggagaact

SEQ ID NO: 7801101 - DNA, 22 bp, Homo sapiens
cggccaggcacagtggcccacg

SEQ ID NO: 7801102 - DNA, 22 bp, Homo sapiens
cggctcactgcagctccgcctc

SEQ ID NO: 7801103 - DNA, 22 bp, Homo sapiens
atcatgttgctcaaaattaaac

SEQ ID NO: 7801104 - DNA, 22 bp, Homo sapiens
atcattttatggctgagaggac

SEQ ID NO: 7801105 - DNA, 22 bp, Homo sapiens
atcatttttaagagactcttct

SEQ ID NO: 7801106 - DNA, 22 bp, Homo sapiens
atccaacacgtatttgctggcc

SEQ ID NO: 7801107 - DNA, 22 bp, Homo sapiens
atccacagagaggaagaatagt

SEQ ID NO: 7801108 - DNA, 22 bp, Homo sapiens
atcctacaaagcagggctatgg

SEQ ID NO: 7801109 - DNA, 22 bp, Homo sapiens
atcctagaatcagcccttgctg

SEQ ID NO: 7801110 - DNA, 22 bp, Homo sapiens
atcctcagacctcagcaaagcc

SEQ ID NO: 7801111 - DNA, 22 bp, Homo sapiens
atcatgtacttgacaaatatgt

SEQ ID NO: 7801112 - DNA, 22 bp, Homo sapiens
atcatgttaaatatttcaatct

SEQ ID NO: 7801113 - DNA, 22 bp, Homo sapiens
ctgtgatggtcaggccctatct

SEQ ID NO: 7801114 - DNA, 22 bp, Homo sapiens
ctgtgcaaaggccttatgtttt

SEQ ID NO: 7801115 - DNA, 22 bp, Homo sapiens
ctgtgcaagacttactttaata

SEQ ID NO: 7801116 - DNA, 22 bp, Homo sapiens
ctgtctgttttgtatacaggcc

SEQ ID NO: 7801117 - DNA, 22 bp, Homo sapiens
ctgtccagtctttagcaagctg

SEQ ID NO: 7801118 - DNA, 22 bp, Homo sapiens
atatttgttagagtctatgtgt

SEQ ID NO: 7801119 - DNA, 22 bp, Homo sapiens
atatatatcgagttcatgtctc

SEQ ID NO: 7801120 - DNA, 22 bp, Homo sapiens
atatatatgctgatggctgcca

SEQ ID NO: 7801121 - DNA, 22 bp, Homo sapiens
ctgggcacagaccccctgggcc

SEQ ID NO: 7801122 - DNA, 22 bp, Homo sapiens
atataacatacatacagaaaag

SEQ ID NO: 7801123 - DNA, 20 bp, Homo sapiens
atataataaattttggttac

SEQ ID NO: 7801124 - DNA, 22 bp, Homo sapiens
atatgtatgtacgcacatattc

SEQ ID NO: 7801125 - DNA, 22 bp, Homo sapiens
atatgtattgagtgccaactgt

SEQ ID NO: 7801126 - DNA, 22 bp, Homo sapiens
atatttctgggggtgtgtttct

SEQ ID NO: 7801127 - DNA, 20 bp, Homo sapiens
atatttcttaagaactttca

SEQ ID NO: 7801128 - DNA, 22 bp, Homo sapiens
atatatcatgagtaaaacttga

SEQ ID NO: 7801129 - DNA, 22 bp, Homo sapiens
atatatattgcccaggctggtt

SEQ ID NO: 7801130 - DNA, 22 bp, Homo sapiens
agtttggaaaatgagacaagga

SEQ ID NO: 7801131 - DNA, 23 bp, Homo sapiens
agtttctttgagacttgccctgt

SEQ ID NO: 7801132 - DNA, 22 bp, Homo sapiens
ctgcagagcagccagtccccca

SEQ ID NO: 7801133 - DNA, 22 bp, Homo sapiens
agtttacaaagtttcactgttc

SEQ ID NO: 7801134 - DNA, 22 bp, Homo sapiens
agtttaaatcatgttttgtaac

SEQ ID NO: 7801135 - DNA, 22 bp, Homo sapiens
ataaatatcactgttgtccctc

SEQ ID NO: 7801136 - DNA, 22 bp, Homo sapiens
ataaaagttcaagagagtacag

SEQ ID NO: 7801137 - DNA, 20 bp, Homo sapiens
ataaaataactgccacaaga

SEQ ID NO: 7801138 - DNA, 22 bp, Homo sapiens
ataaaagtctgcttatttgggc

SEQ ID NO: 7801139 - DNA, 19 bp, Homo sapiens
agttcttgtcctgtctgtt

SEQ ID NO: 7801140 - DNA, 22 bp, Homo sapiens
agttgggagttatagactctat

SEQ ID NO: 7801141 - DNA, 22 bp, Homo sapiens
ctgaggcttggaggggtctggt

SEQ ID NO: 7801142 - DNA, 22 bp, Homo sapiens
ctgaggtagccatggcccaagt

SEQ ID NO: 7801143 - DNA, 22 bp, Homo sapiens
ataatatttggataggacagta

SEQ ID NO: 7801144 - DNA, 22 bp, Homo sapiens
ataatcaaagtcctatgacatc

SEQ ID NO: 7801145 - DNA, 22 bp, Homo sapiens
ataatatttgcattactgtgat

SEQ ID NO: 7801146 - DNA, 22 bp, Homo sapiens
ctgcccacagttctctgccatg

SEQ ID NO: 7801147 - DNA, 20 bp, Homo sapiens
ctgcccactagaactacctg

SEQ ID NO: 7801148 - DNA, 22 bp, Homo sapiens
ctgcccaccacacctgctcctg

SEQ ID NO: 7801149 - DNA, 22 bp, Homo sapiens
ctgctctggctgtgtacttcag

SEQ ID NO: 7801150 - DNA, 22 bp, Homo sapiens
ctgctctgctgatcagtgtctc

SEQ ID NO: 7801151 - DNA, 22 bp, Homo sapiens
ctgctctgagaggctcttccta

SEQ ID NO: 7801152 - DNA, 22 bp, Homo sapiens
ctgctctgcagcttggactccc

SEQ ID NO: 7801153 - DNA, 22 bp, Homo sapiens
atacagaatactaattcctgag

SEQ ID NO: 7801154 - DNA, 22 bp, Homo sapiens
ctggagagaccgaaagaggctg

SEQ ID NO: 7801155 - DNA, 22 bp, Homo sapiens
atacagatgggtcagatttcat

SEQ ID NO: 7801156 - DNA, 22 bp, Homo sapiens
atactcagctgctagacagaag

SEQ ID NO: 7801157 - DNA, 22 bp, Homo sapiens
ctggagggctgcagcgaggctg

SEQ ID NO: 7801158 - DNA, 22 bp, Homo sapiens
ctggagggctggactaaggaaa

SEQ ID NO: 7801159 - DNA, 22 bp, Homo sapiens
atacttctagaaatactatgca

SEQ ID NO: 7801160 - DNA, 22 bp, Homo sapiens
atacttctcatgggctctgagc

SEQ ID NO: 7801161 - DNA, 22 bp, Homo sapiens
atacttctttagcatattgaac

SEQ ID NO: 7801162 - DNA, 22 bp, Homo sapiens
atacttctttaagagtaagtct

SEQ ID NO: 7801163 - DNA, 22 bp, Homo sapiens
atacttctggtgacaaagtctt

SEQ ID NO: 7801164 - DNA, 22 bp, Homo sapiens
atactttagagctagattgcct

SEQ ID NO: 7801165 - DNA, 22 bp, Homo sapiens
agctggaggataactcacttct

SEQ ID NO: 7801166 - DNA, 22 bp, Homo sapiens
caggaggttggtagcagtagat

SEQ ID NO: 7801167 - DNA, 22 bp, Homo sapiens
caggaggttgtaagagcaggcc

SEQ ID NO: 7801168 - DNA, 22 bp, Homo sapiens
caggaggttgagggtgcagtga

SEQ ID NO: 7801169 - DNA, 22 bp, Homo sapiens
caggaggtggagctcaagtggt

SEQ ID NO: 7801170 - DNA, 22 bp, Homo sapiens
caggaggtgccctctagtggca

SEQ ID NO: 7801171 - DNA, 22 bp, Homo sapiens
agctctgacaaggattttctgc

SEQ ID NO: 7801172 - DNA, 22 bp, Homo sapiens
agctctgatccataatttatac

SEQ ID NO: 7801173 - DNA, 22 bp, Homo sapiens
cagcttctggcgtggagcctga

SEQ ID NO: 7801174 - DNA, 22 bp, Homo sapiens
cagcttcttcagtcctggagct

SEQ ID NO: 7801175 - DNA, 21 bp, Homo sapiens
cagcttcttctgtgacctggt

SEQ ID NO: 7801176 - DNA, 22 bp, Homo sapiens
cagctctccaccctcctggttc

SEQ ID NO: 7801177 - DNA, 22 bp, Homo sapiens
cagctttgtgcaatgcagtctc

SEQ ID NO: 7801178 - DNA, 22 bp, Homo sapiens
cagctttgtggccttgacctcg

SEQ ID NO: 7801179 - DNA, 22 bp, Homo sapiens
cagctttttagaatctagggca

SEQ ID NO: 7801180 - DNA, 22 bp, Homo sapiens
cagctttttagaatctagggca

SEQ ID NO: 7801181 - DNA, 22 bp, Homo sapiens
cagcttttaggactgtgagaaa

SEQ ID NO: 7801182 - DNA, 22 bp, Homo sapiens
cagctttggcccagtcgggagg

SEQ ID NO: 7801183 - DNA, 22 bp, Homo sapiens
cagctttgccaagtaaggtctt

SEQ ID NO: 7801184 - DNA, 22 bp, Homo sapiens
cagctttgcaggctggtcagtg

SEQ ID NO: 7801185 - DNA, 22 bp, Homo sapiens
agctgcagtcaagctgggccac

SEQ ID NO: 7801186 - DNA, 22 bp, Homo sapiens
agctgcaggcctctcctgggga

SEQ ID NO: 7801187 - DNA, 22 bp, Homo sapiens
agctgcaggcgccggggccgat

SEQ ID NO: 7801188 - DNA, 22 bp, Homo sapiens
agctgcagtatgaggctggtgg

SEQ ID NO: 7801189 - DNA, 22 bp, Homo sapiens
agctgaggccacgagtgaaggg

SEQ ID NO: 7801190 - DNA, 22 bp, Homo sapiens
agctgaggcctgatttcgccgt

SEQ ID NO: 7801191 - DNA, 22 bp, Homo sapiens
cagcttgaaatattaggagatg

SEQ ID NO: 7801192 - DNA, 22 bp, Homo sapiens
agctgaggcatggacaggctgc

SEQ ID NO: 7801193 - DNA, 22 bp, Homo sapiens
agctgaggcatgatgctatcag

SEQ ID NO: 7801194 - DNA, 23 bp, Homo sapiens
agctgaggctgtgggtgtcagag

SEQ ID NO: 7801195 - DNA, 22 bp, Homo sapiens
agctgaggctctgagagggaag

SEQ ID NO: 7801196 - DNA, 22 bp, Homo sapiens
caggcctcccggtgcacactga

SEQ ID NO: 7801197 - DNA, 22 bp, Homo sapiens
caggcctggcccccggcacacc

SEQ ID NO: 7801198 - DNA, 22 bp, Homo sapiens
caggcctgggcttcggggctga

SEQ ID NO: 7801199 - DNA, 22 bp, Homo sapiens
caggcctggttgagccctgaga

SEQ ID NO: 7801200 - DNA, 22 bp, Homo sapiens
caggcctccactccacgcagac

SEQ ID NO: 7801201 - DNA, 22 bp, Homo sapiens
agctgttccaggcctcattgct

SEQ ID NO: 7801202 - DNA, 22 bp, Homo sapiens
agctgtttccataaatgagaca

SEQ ID NO: 7801203 - DNA, 22 bp, Homo sapiens
agctgttttctaatgcatttga

SEQ ID NO: 7801204 - DNA, 21 bp, Homo sapiens
agctgtttgaagctatattgg

SEQ ID NO: 7801205 - DNA, 22 bp, Homo sapiens
agcttacagttcaatgacaaag

SEQ ID NO: 7801206 - DNA, 22 bp, Homo sapiens
agcttctgttcatcttccaggc

SEQ ID NO: 7801207 - DNA, 22 bp, Homo sapiens
agcttgatttctctgcagtgtg

SEQ ID NO: 7801208 - DNA, 22 bp, Homo sapiens
aggaaatgcaggcaaatactct

SEQ ID NO: 7801209 - DNA, 22 bp, Homo sapiens
aggaaatgggaatagatggtat

SEQ ID NO: 7801210 - DNA, 22 bp, Homo sapiens
cagggccagcgcccaggcccag

SEQ ID NO: 7801211 - DNA, 22 bp, Homo sapiens
aggaaatgtacaaatgaagatg

SEQ ID NO: 7801212 - DNA, 22 bp, Homo sapiens
aggaaatgtagtcctcatctcc

SEQ ID NO: 7801213 - DNA, 22 bp, Homo sapiens
agctttacctgccttggggcac

SEQ ID NO: 7801214 - DNA, 22 bp, Homo sapiens
aggaaactaaagcccagagagg

SEQ ID NO: 7801215 - DNA, 22 bp, Homo sapiens
agctttatatgttgtttctcca

SEQ ID NO: 7801216 - DNA, 22 bp, Homo sapiens
agctttatagaaaggatcagtg

SEQ ID NO: 7801217 - DNA, 22 bp, Homo sapiens
agctttatataaaagagtacat

SEQ ID NO: 7801218 - DNA, 20 bp, Homo sapiens
aggaaagcctgtgtgagtct

SEQ ID NO: 7801219 - DNA, 22 bp, Homo sapiens
aggaaagcttggcaaactaaat

SEQ ID NO: 7801220 - DNA, 22 bp, Homo sapiens
aggaaagcaatggctgagaaca

SEQ ID NO: 7801221 - DNA, 22 bp, Homo sapiens
aggaaagccaatctctcttgac

SEQ ID NO: 7801222 - DNA, 23 bp, Homo sapiens
aggaaagcattcatttttaccat

SEQ ID NO: 7801223 - DNA, 22 bp, Homo sapiens
aggaaagcaatggctgagaaca

SEQ ID NO: 7801224 - DNA, 22 bp, Homo sapiens
aggaaagatggaaggaggataa

SEQ ID NO: 7801225 - DNA, 22 bp, Homo sapiens
cagtcctgcccaggctgacaga

SEQ ID NO: 7801226 - DNA, 22 bp, Homo sapiens
cagtcctgaggaagagctgctg

SEQ ID NO: 7801227 - DNA, 22 bp, Homo sapiens
cagtcctgagccaatcatgatg

SEQ ID NO: 7801228 - DNA, 22 bp, Homo sapiens
cagtcctgggcacagccctggg

SEQ ID NO: 7801229 - DNA, 22 bp, Homo sapiens
cagtcctgggcacagccctggg

SEQ ID NO: 7801230 - DNA, 22 bp, Homo sapiens
cagtctctcttgtagtgcagct

SEQ ID NO: 7801231 - DNA, 22 bp, Homo sapiens
cagtctctggtgagttgacagt

SEQ ID NO: 7801232 - DNA, 22 bp, Homo sapiens
cagtctctggtgagttgacagt

SEQ ID NO: 7801233 - DNA, 22 bp, Homo sapiens
cagtctctgtgccagatcctgg

SEQ ID NO: 7801234 - DNA, 22 bp, Homo sapiens
aggaggagcagctttttgtctc

SEQ ID NO: 7801235 - DNA, 22 bp, Homo sapiens
aggaggaggctggagtacaccc

SEQ ID NO: 7801236 - DNA, 22 bp, Homo sapiens
aggagatagtcaaagcttcttg

SEQ ID NO: 7801237 - DNA, 22 bp, Homo sapiens
aggagccatgagcaggaggcaa

SEQ ID NO: 7801238 - DNA, 22 bp, Homo sapiens
aggagaggcatcaagaaaatcg

SEQ ID NO: 7801239 - DNA, 22 bp, Homo sapiens
aggcacaggaatgtcatccagt

SEQ ID NO: 7801240 - DNA, 22 bp, Homo sapiens
aggcacaggaggtggtaagaag

SEQ ID NO: 7801241 - DNA, 22 bp, Homo sapiens
aggcacaggaggtggtaagaag

SEQ ID NO: 7801242 - DNA, 22 bp, Homo sapiens
aggcacaggaacaggaaaagag

SEQ ID NO: 7801243 - DNA, 20 bp, Homo sapiens
catgcctgctggtatctggc

SEQ ID NO: 7801244 - DNA, 22 bp, Homo sapiens
catgccatttcttctctttatg

SEQ ID NO: 7801245 - DNA, 22 bp, Homo sapiens
catgccatttggtggattgaga

SEQ ID NO: 7801246 - DNA, 22 bp, Homo sapiens
catgccatttttctagattgag

SEQ ID NO: 7801247 - DNA, 22 bp, Homo sapiens
catgccaggtttgagtatcttg

SEQ ID NO: 7801248 - DNA, 23 bp, Homo sapiens
catgccagtttgtgcaggcagat

SEQ ID NO: 7801249 - DNA, 22 bp, Homo sapiens
catgccatttacttggaggaga

SEQ ID NO: 7801250 - DNA, 22 bp, Homo sapiens
catgccattaacattagctagc

SEQ ID NO: 7801251 - DNA, 20 bp, Homo sapiens
catgccatgtctactgaggc

SEQ ID NO: 7801252 - DNA, 22 bp, Homo sapiens
catgccagttttgagatgcacc

SEQ ID NO: 7801253 - DNA, 22 bp, Homo sapiens
aggaggtgttgatagaaggttt

SEQ ID NO: 7801254 - DNA, 22 bp, Homo sapiens
aggaggtgctagagaagatgtt

SEQ ID NO: 7801255 - DNA, 22 bp, Homo sapiens
aggaggtggcaactgtcgacag

SEQ ID NO: 7801256 - DNA, 22 bp, Homo sapiens
aggaggtgctgtttgtcctgga

SEQ ID NO: 7801257 - DNA, 22 bp, Homo sapiens
aggaggtggctgaacttgaggg

SEQ ID NO: 7801258 - DNA, 22 bp, Homo sapiens
aggaggtgtagatttcctgtca

SEQ ID NO: 7801259 - DNA, 22 bp, Homo sapiens
aggaggtggcctgagcgtgccc

SEQ ID NO: 7801260 - DNA, 22 bp, Homo sapiens
aggaggtgcgtggtgatcccct

SEQ ID NO: 7801261 - DNA, 22 bp, Homo sapiens
catgaaatgttagaattagaca

SEQ ID NO: 7801262 - DNA, 22 bp, Homo sapiens
catgaaaatgtcaagttctgct

SEQ ID NO: 7801263 - DNA, 22 bp, Homo sapiens
catgaaacatcagagatttctc

SEQ ID NO: 7801264 - DNA, 22 bp, Homo sapiens
catttacatttaaggttaatat

SEQ ID NO: 7801265 - DNA, 22 bp, Homo sapiens
catggcggtcaggatgtaggtg

SEQ ID NO: 7801266 - DNA, 22 bp, Homo sapiens
catggctcacaggatgggctag

SEQ ID NO: 7801267 - DNA, 22 bp, Homo sapiens
cattaagatttttttctactgg

SEQ ID NO: 7801268 - DNA, 22 bp, Homo sapiens
cattattaattcagcacatgct

SEQ ID NO: 7801269 - DNA, 22 bp, Homo sapiens
cattcctgagggccccctactt

SEQ ID NO: 7801270 - DNA, 22 bp, Homo sapiens
cattcctattatgtccctagtg

SEQ ID NO: 7801271 - DNA, 22 bp, Homo sapiens
cattccaagtatatacatgata

SEQ ID NO: 7801272 - DNA, 22 bp, Homo sapiens
cattcccatgactcctgctcag

SEQ ID NO: 7801273 - DNA, 22 bp, Homo sapiens
cattcccacgtgttctttgctt

SEQ ID NO: 7801274 - DNA, 22 bp, Homo sapiens
cattccagatgaggccaggccc

SEQ ID NO: 7801275 - DNA, 23 bp, Homo sapiens
ccagtgattgcctggaaggaggt

SEQ ID NO: 7801276 - DNA, 23 bp, Homo sapiens
ccagtgattgcctggaaggaggt

SEQ ID NO: 7801277 - DNA, 22 bp, Homo sapiens
ccagtctgtactttgctctgtt

SEQ ID NO: 7801278 - DNA, 22 bp, Homo sapiens
aggctgagcaaagggccttacc

SEQ ID NO: 7801279 - DNA, 22 bp, Homo sapiens
ccaggcattgtgagtgggcagg

SEQ ID NO: 7801280 - DNA, 22 bp, Homo sapiens
ccaggcatggggagagccagat

SEQ ID NO: 7801281 - DNA, 21 bp, Homo sapiens
ccaggcatgactgcagagagc

SEQ ID NO: 7801282 - DNA, 22 bp, Homo sapiens
aggcctcctggctccaggcctt

SEQ ID NO: 7801283 - DNA, 22 bp, Homo sapiens
ccaggcagggctcaaggaacct

SEQ ID NO: 7801284 - DNA, 22 bp, Homo sapiens
aggcctcatagtagacctgccc

SEQ ID NO: 7801285 - DNA, 22 bp, Homo sapiens
aggcctccagccacatgccagt

SEQ ID NO: 7801286 - DNA, 17 bp, Homo sapiens
aggcctccctccaggcc

SEQ ID NO: 7801287 - DNA, 22 bp, Homo sapiens
ccaggcctagcccctgagggta

SEQ ID NO: 7801288 - DNA, 22 bp, Homo sapiens
ccaggcctagcccctgagggta

SEQ ID NO: 7801289 - DNA, 22 bp, Homo sapiens
ccaggccctgctcctcacacca

SEQ ID NO: 7801290 - DNA, 22 bp, Homo sapiens
ccaggcctcacctgcccaccta

SEQ ID NO: 7801291 - DNA, 22 bp, Homo sapiens
aggctcccaagcactgacccca

SEQ ID NO: 7801292 - DNA, 21 bp, Homo sapiens
aggctcccagaaatgggcatc

SEQ ID NO: 7801293 - DNA, 22 bp, Homo sapiens
aggccccaaagcagtgcaagta

SEQ ID NO: 7801294 - DNA, 22 bp, Homo sapiens
aggccaggaccattagcccaga

SEQ ID NO: 7801295 - DNA, 22 bp, Homo sapiens
aggccaggaatccttgtcccag

SEQ ID NO: 7801296 - DNA, 22 bp, Homo sapiens
aggccaggacacttaagtaaga

SEQ ID NO: 7801297 - DNA, 20 bp, Homo sapiens
aggccaggaaatgtagttct

SEQ ID NO: 7801298 - DNA, 22 bp, Homo sapiens
aggccaggatagcatggatcag

SEQ ID NO: 7801299 - DNA, 22 bp, Homo sapiens
ccactgctcctgaccaaggtca

SEQ ID NO: 7801300 - DNA, 22 bp, Homo sapiens
aggcagtttaggcagcgattta

SEQ ID NO: 7801301 - DNA, 23 bp, Homo sapiens
aggcagtgggggccactttgctt

SEQ ID NO: 7801302 - DNA, 22 bp, Homo sapiens
aggcatctaacagagatcttta

SEQ ID NO: 7801303 - DNA, 22 bp, Homo sapiens
aggcatctatacattatgttca

SEQ ID NO: 7801304 - DNA, 22 bp, Homo sapiens
aggcagccctgtgctggatgct

SEQ ID NO: 7801305 - DNA, 22 bp, Homo sapiens
aggcagtggagctggaataggc

SEQ ID NO: 7801306 - DNA, 22 bp, Homo sapiens
cccagcagtgacccagtgatac

SEQ ID NO: 7801307 - DNA, 22 bp, Homo sapiens
ccatgaattcactccatgctag

SEQ ID NO: 7801308 - DNA, 22 bp, Homo sapiens
ccatgacccctggcatccaggg

SEQ ID NO: 7801309 - DNA, 22 bp, Homo sapiens
ccatcctgtctgtggcctcagg

SEQ ID NO: 7801310 - DNA, 22 bp, Homo sapiens
cccagctctgcagacctgccct

SEQ ID NO: 7801311 - DNA, 22 bp, Homo sapiens
cccagcctctgtttgctcctct

SEQ ID NO: 7801312 - DNA, 22 bp, Homo sapiens
ccccatgaagtagggtctctga

SEQ ID NO: 7801313 - DNA, 22 bp, Homo sapiens
ccccatgaagtagggtctctga

SEQ ID NO: 7801314 - DNA, 22 bp, Homo sapiens
ccccagggactggtttcatgga

SEQ ID NO: 7801315 - DNA, 19 bp, Homo sapiens
ccccagggtaggctagggg

SEQ ID NO: 7801316 - DNA, 22 bp, Homo sapiens
ccccagggtcagtgtgtggagg

SEQ ID NO: 7801317 - DNA, 22 bp, Homo sapiens
agggagagtagatatcaggtgt

SEQ ID NO: 7801318 - DNA, 22 bp, Homo sapiens
agggaagaagctggtagtaggt

SEQ ID NO: 7801319 - DNA, 22 bp, Homo sapiens
ccctgtttggatggggacccag

SEQ ID NO: 7801320 - DNA, 22 bp, Homo sapiens
ccctgtttatttttggagagaa

SEQ ID NO: 7801321 - DNA, 22 bp, Homo sapiens
ccctgtttaagaaacctgtaaa

SEQ ID NO: 7801322 - DNA, 22 bp, Homo sapiens
ccctgttttaagttgatattga

SEQ ID NO: 7801323 - DNA, 22 bp, Homo sapiens
cctcaaataagttttatttatc

SEQ ID NO: 7801324 - DNA, 22 bp, Homo sapiens
cccttcaagctctctgggtttt

SEQ ID NO: 7801325 - DNA, 22 bp, Homo sapiens
cctcaagtcaattctgtctcgc

SEQ ID NO: 7801326 - DNA, 22 bp, Homo sapiens
cctccccacagcccaggagact

SEQ ID NO: 7801327 - DNA, 22 bp, Homo sapiens
cctcccagtgcctccagagcag

SEQ ID NO: 7801328 - DNA, 22 bp, Homo sapiens
cctccccacccacggctggtgg

SEQ ID NO: 7801329 - DNA, 22 bp, Homo sapiens
cctctccttgcacccgtcccgc

SEQ ID NO: 7801330 - DNA, 22 bp, Homo sapiens
agggaggaccaatgtgtggtta

SEQ ID NO: 7801331 - DNA, 22 bp, Homo sapiens
agggaggagaatggactccttc

SEQ ID NO: 7801332 - DNA, 22 bp, Homo sapiens
agggccaggatcacagccaaga

SEQ ID NO: 7801333 - DNA, 22 bp, Homo sapiens
agggccaggaacacctgaaggg

SEQ ID NO: 7801334 - DNA, 18 bp, Homo sapiens
agggccagctgtgagtag

SEQ ID NO: 7801335 - DNA, 22 bp, Homo sapiens
agggccagccgacttccagcct

SEQ ID NO: 7801336 - DNA, 22 bp, Homo sapiens
agggccagctagagccctcgcc

SEQ ID NO: 7801337 - DNA, 22 bp, Homo sapiens
agggccagggaagctgtatttt

SEQ ID NO: 7801338 - DNA, 22 bp, Homo sapiens
agctaggagattttgtgaggct

SEQ ID NO: 7801339 - DNA, 22 bp, Homo sapiens
agctaggataagcagagactgg

SEQ ID NO: 7801340 - DNA, 22 bp, Homo sapiens
agctcagaactgcagacatgtg

SEQ ID NO: 7801341 - DNA, 22 bp, Homo sapiens
agccttgaacactgactgaagg

SEQ ID NO: 7801342 - DNA, 22 bp, Homo sapiens
agccttctctgaaattctgttt

SEQ ID NO: 7801343 - DNA, 22 bp, Homo sapiens
agccttgcatgatttcattcat

SEQ ID NO: 7801344 - DNA, 22 bp, Homo sapiens
agccttgatcttggtaacagga

SEQ ID NO: 7801345 - DNA, 22 bp, Homo sapiens
agccttgaaccaattgtttagc

SEQ ID NO: 7801346 - DNA, 22 bp, Homo sapiens
agccttgagttcaagtgctggc

SEQ ID NO: 7801347 - DNA, 22 bp, Homo sapiens
agccttgagcagttcacttggt

SEQ ID NO: 7801348 - DNA, 22 bp, Homo sapiens
agccttgacactggggaaactg

SEQ ID NO: 7801349 - DNA, 22 bp, Homo sapiens
agctcccattatcttctgaaac

SEQ ID NO: 7801350 - DNA, 22 bp, Homo sapiens
agctcccaggcagtcatgagga

SEQ ID NO: 7801351 - DNA, 22 bp, Homo sapiens
agctcccaggcagtcatgagga

SEQ ID NO: 7801352 - DNA, 22 bp, Homo sapiens
agctcccagcagagctggccac

SEQ ID NO: 7801353 - DNA, 22 bp, Homo sapiens
agctcctgtgtgaagcctccct

SEQ ID NO: 7801354 - DNA, 22 bp, Homo sapiens
cagccctggcgcccccagatct

SEQ ID NO: 7801355 - DNA, 22 bp, Homo sapiens
agctcctgaaaagcgcttgctt

SEQ ID NO: 7801356 - DNA, 22 bp, Homo sapiens
agccttcataatcttgggcttt

SEQ ID NO: 7801357 - DNA, 22 bp, Homo sapiens
agccttcagtaagggcttagca

SEQ ID NO: 7801358 - DNA, 22 bp, Homo sapiens
agccttcagtaaatccactgtg

SEQ ID NO: 7801359 - DNA, 23 bp, Homo sapiens
agccttcaggcaatgtcagtaga

SEQ ID NO: 7801360 - DNA, 22 bp, Homo sapiens
cagaggctcagatggccctggc

SEQ ID NO: 7801361 - DNA, 22 bp, Homo sapiens
cactgaaacaggtattgctggt

SEQ ID NO: 7801362 - DNA, 22 bp, Homo sapiens
cagaagaatggtgtctgagctc

SEQ ID NO: 7801363 - DNA, 22 bp, Homo sapiens
cagaagagatgaaatagtatta

SEQ ID NO: 7801364 - DNA, 22 bp, Homo sapiens
cagaagaaagtggggagacaag

SEQ ID NO: 7801365 - DNA, 22 bp, Homo sapiens
cagaagcattgactccttgctc

SEQ ID NO: 7801366 - DNA, 22 bp, Homo sapiens
cagaagctttgtctagtcttga

SEQ ID NO: 7801367 - DNA, 22 bp, Homo sapiens
agccctagagaaccagcctgtg

SEQ ID NO: 7801368 - DNA, 22 bp, Homo sapiens
agcccggcttccccggttgcta

SEQ ID NO: 7801369 - DNA, 22 bp, Homo sapiens
cagagcaacaccctttacatcg

SEQ ID NO: 7801370 - DNA, 22 bp, Homo sapiens
agcaggagatggggcgtgatgt

SEQ ID NO: 7801371 - DNA, 22 bp, Homo sapiens
agcaggagcatttccatgattc

SEQ ID NO: 7801372 - DNA, 22 bp, Homo sapiens
agcaggagacatgggggtggtg

SEQ ID NO: 7801373 - DNA, 22 bp, Homo sapiens
agcaggagaacactgtggctct

SEQ ID NO: 7801374 - DNA, 22 bp, Homo sapiens
cacagtatgatctaaagtaagt

SEQ ID NO: 7801375 - DNA, 22 bp, Homo sapiens
caccagggccccaggctgtgcc

SEQ ID NO: 7801376 - DNA, 22 bp, Homo sapiens
agcataagttggtacagccact

SEQ ID NO: 7801377 - DNA, 22 bp, Homo sapiens
agcataaaggtcaacgttttag

SEQ ID NO: 7801378 - DNA, 22 bp, Homo sapiens
agcataaaggcactagaaagag

SEQ ID NO: 7801379 - DNA, 22 bp, Homo sapiens
cacatctgacttccagtgcagg

SEQ ID NO: 7801380 - DNA, 22 bp, Homo sapiens
cacatctgaaaagatgcacaag

SEQ ID NO: 7801381 - DNA, 22 bp, Homo sapiens
cacatcagggctgcttgggggt

SEQ ID NO: 7801382 - DNA, 19 bp, Homo sapiens
cacatcagcagggctgtgg

SEQ ID NO: 7801383 - DNA, 22 bp, Homo sapiens
cacatcaggtagacctacagag

SEQ ID NO: 7801384 - DNA, 22 bp, Homo sapiens
attttctgagtccagaatttac

SEQ ID NO: 7801385 - DNA, 23 bp, Homo sapiens
agcacagactagaaaggtctttc

SEQ ID NO: 7801386 - DNA, 22 bp, Homo sapiens
agcacagagttgcagagagcgt

SEQ ID NO: 7801387 - DNA, 22 bp, Homo sapiens
caaattaatgtgtctcaaaata

SEQ ID NO: 7801388 - DNA, 22 bp, Homo sapiens
caaattaatgtgtctcaaaata

SEQ ID NO: 7801389 - DNA, 22 bp, Homo sapiens
agcagacaattgcctggatgga

SEQ ID NO: 7801390 - DNA, 21 bp, Homo sapiens
agcagacacttgtgaccttcc

SEQ ID NO: 7801391 - DNA, 22 bp, Homo sapiens
caaggcaggaagcctgtcttat

SEQ ID NO: 7801392 - DNA, 22 bp, Homo sapiens
caacttcttggcttcctaatgg

SEQ ID NO: 7801393 - DNA, 22 bp, Homo sapiens
agcagcaagtgtaactgaatat

SEQ ID NO: 7801394 - DNA, 22 bp, Homo sapiens
agcagcaataataaagtaatac

SEQ ID NO: 7801395 - DNA, 22 bp, Homo sapiens
caaggcaggccagtttcaaggc

SEQ ID NO: 7801396 - DNA, 22 bp, Homo sapiens
caaggcatgcaatgtcttcagg

SEQ ID NO: 7801397 - DNA, 22 bp, Homo sapiens
caaggcatactcctttctcagc

SEQ ID NO: 7801398 - DNA, 22 bp, Homo sapiens
atggagttctgccagcgctgct

SEQ ID NO: 7801399 - DNA, 22 bp, Homo sapiens
agactacatatgccacatgaag

SEQ ID NO: 7801400 - DNA, 20 bp, Homo sapiens
agactcagtttctatgctct

SEQ ID NO: 7801401 - DNA, 22 bp, Homo sapiens
atgggaggcagcagagcccagc

SEQ ID NO: 7801402 - DNA, 22 bp, Homo sapiens
atgggaggcaaagatcgcagaa

SEQ ID NO: 7801403 - DNA, 22 bp, Homo sapiens
atgggaggatgctcgggtgctc

SEQ ID NO: 7801404 - DNA, 22 bp, Homo sapiens
atgtacacacaagtttgcacgc

SEQ ID NO: 7801405 - DNA, 20 bp, Homo sapiens
atgtaaaattataaggctga

SEQ ID NO: 7801406 - DNA, 20 bp, Homo sapiens
atgtaaaagacagggagtag

SEQ ID NO: 7801407 - DNA, 22 bp, Homo sapiens
atgtccaagtcacagattttca

SEQ ID NO: 7801408 - DNA, 21 bp, Homo sapiens
atgtcaaatgctttattttat

SEQ ID NO: 7801409 - DNA, 22 bp, Homo sapiens
atgtccagagccggcctgctga

SEQ ID NO: 7801410 - DNA, 22 bp, Homo sapiens
atgtccagagccggcctgctga

SEQ ID NO: 7801411 - DNA, 22 bp, Homo sapiens
atgtccagagaacatttgcttt

SEQ ID NO: 7801412 - DNA, 22 bp, Homo sapiens
atgtccagagtgtcctggaaag

SEQ ID NO: 7801413 - DNA, 22 bp, Homo sapiens
atgtccagagtaaagcacattc

SEQ ID NO: 7801414 - DNA, 22 bp, Homo sapiens
atgtccagccaaccactggatt

SEQ ID NO: 7801415 - DNA, 20 bp, Homo sapiens
atgtccagtgactggaccat

SEQ ID NO: 7801416 - DNA, 22 bp, Homo sapiens
atgtccagtttctacacacata

SEQ ID NO: 7801417 - DNA, 22 bp, Homo sapiens
atgtccagggggcttgactggt

SEQ ID NO: 7801418 - DNA, 22 bp, Homo sapiens
atgtccaggatctatccccaga

SEQ ID NO: 7801419 - DNA, 22 bp, Homo sapiens
atgtccagggcacacagcagtg

SEQ ID NO: 7801420 - DNA, 22 bp, Homo sapiens
agaatcagatgaagactcctgc

SEQ ID NO: 7801421 - DNA, 22 bp, Homo sapiens
agaaggccatgtcttggtactt

SEQ ID NO: 7801422 - DNA, 22 bp, Homo sapiens
atctttatatatctcctctgaa

SEQ ID NO: 7801423 - DNA, 22 bp, Homo sapiens
atctttagtgtgaatttattga

SEQ ID NO: 7801424 - DNA, 22 bp, Homo sapiens
agaagaggggtgtccctgtggc

SEQ ID NO: 7801425 - DNA, 22 bp, Homo sapiens
agaagaacttagctttctatct

SEQ ID NO: 7801426 - DNA, 22 bp, Homo sapiens
atcttgttaaaatgcagattct

SEQ ID NO: 7801427 - DNA, 22 bp, Homo sapiens
atcttgttaaaaagcagattct

SEQ ID NO: 7801428 - DNA, 22 bp, Homo sapiens
atcttgttaaagtgcagatttt

SEQ ID NO: 7801429 - DNA, 22 bp, Homo sapiens
atcttgttaaagtgcagattct

SEQ ID NO: 7801430 - DNA, 22 bp, Homo sapiens
atctttaccaccaaagaatgct

SEQ ID NO: 7801431 - DNA, 19 bp, Homo sapiens
atctttagcaactttcaaa

SEQ ID NO: 7801432 - DNA, 22 bp, Homo sapiens
atctttagacaggaagcaatca

SEQ ID NO: 7801433 - DNA, 22 bp, Homo sapiens
atctttagagtcatctgagtgt

SEQ ID NO: 7801434 - DNA, 22 bp, Homo sapiens
atctttaggcaagttacttaac

SEQ ID NO: 7801435 - DNA, 22 bp, Homo sapiens
atctttagcattactttattca

SEQ ID NO: 7801436 - DNA, 21 bp, Homo sapiens
agaattcttaagtattctaat

SEQ ID NO: 7801437 - DNA, 22 bp, Homo sapiens
agacaatatataattttagttg

SEQ ID NO: 7801438 - DNA, 22 bp, Homo sapiens
agaatgcatctaaaagcagaga

SEQ ID NO: 7801439 - DNA, 22 bp, Homo sapiens
agaatcaggacctgtggctgtc

SEQ ID NO: 7801440 - DNA, 22 bp, Homo sapiens
agaatcaggaagacagcctggc

SEQ ID NO: 7801441 - DNA, 22 bp, Homo sapiens
agaatgcttcctttgaaactga

SEQ ID NO: 7801442 - DNA, 22 bp, Homo sapiens
agaatgctccagagctgaaaga

SEQ ID NO: 7801443 - DNA, 22 bp, Homo sapiens
agaatgtcaacagcctctcaag

SEQ ID NO: 7801444 - DNA, 22 bp, Homo sapiens
atgcaggattagaaagttgcct

SEQ ID NO: 7801445 - DNA, 22 bp, Homo sapiens
atgcaggagttggaaaaaatga

SEQ ID NO: 7801446 - DNA, 21 bp, Homo sapiens
agacaggtcagggagaggtga

SEQ ID NO: 7801447 - DNA, 22 bp, Homo sapiens
agacacagtctgtctggaggag

SEQ ID NO: 7801448 - DNA, 22 bp, Homo sapiens
agacacagctgcaggaggtggg

SEQ ID NO: 7801449 - DNA, 22 bp, Homo sapiens
agacacagtctgtctggaggag

SEQ ID NO: 7801450 - DNA, 22 bp, Homo sapiens
agacacagtgctgggtgctgag

SEQ ID NO: 7801451 - DNA, 22 bp, Homo sapiens
attataaacctttgagggtggg

SEQ ID NO: 7801452 - DNA, 22 bp, Homo sapiens
attagattgtaaatgttttcac

SEQ ID NO: 7801453 - DNA, 22 bp, Homo sapiens
attagcaacatggtgaatatgt

SEQ ID NO: 7801454 - DNA, 22 bp, Homo sapiens
attaaacaatgtaaagttcttg

SEQ ID NO: 7801455 - DNA, 22 bp, Homo sapiens
atgtttgtgttacactctgcag

SEQ ID NO: 7801456 - DNA, 22 bp, Homo sapiens
atgtttgtaggtaagtgacact

SEQ ID NO: 7801457 - DNA, 22 bp, Homo sapiens
atgtttgtcaggattgtaatta

SEQ ID NO: 7801458 - DNA, 22 bp, Homo sapiens
atgtttgtgtttcccattcagg

SEQ ID NO: 7801459 - DNA, 22 bp, Homo sapiens
atgtttgttgaacatctactgc

SEQ ID NO: 7801460 - DNA, 22 bp, Homo sapiens
atgtttgttgaacatctactgc

SEQ ID NO: 7801461 - DNA, 22 bp, Homo sapiens
atgttacaatccaacaaaatta

SEQ ID NO: 7801462 - DNA, 22 bp, Homo sapiens
atgttacaattcaaaatgctgc

SEQ ID NO: 7801463 - DNA, 22 bp, Homo sapiens
atgttacacataggcataaatg

SEQ ID NO: 7801464 - DNA, 22 bp, Homo sapiens
atgtttatgttgggctatattt

SEQ ID NO: 7801465 - DNA, 22 bp, Homo sapiens
atgtttctgaagtttacagata

SEQ ID NO: 7801466 - DNA, 22 bp, Homo sapiens
atgtttctgaagtttacagata

SEQ ID NO: 7801467 - DNA, 22 bp, Homo sapiens
attataaagaacatgtgtgtgg

SEQ ID NO: 7801468 - DNA, 22 bp, Homo sapiens
attataaagaacatgtgtgtgg

SEQ ID NO: 7801469 - DNA, 22 bp, Homo sapiens
attataaatattttctaggggt

SEQ ID NO: 7801470 - DNA, 22 bp, Homo sapiens
attctgggttcatgagtgagct

SEQ ID NO: 7801471 - DNA, 22 bp, Homo sapiens
agagggtgctggagagacattg

SEQ ID NO: 7801472 - DNA, 22 bp, Homo sapiens
agatgtgactgggcaagttact

SEQ ID NO: 7801473 - DNA, 22 bp, Homo sapiens
agcaaacagtttctggggatct

SEQ ID NO: 7801474 - DNA, 22 bp, Homo sapiens
agcaaacattcagcagattggc

SEQ ID NO: 7801475 - DNA, 22 bp, Homo sapiens
agcaaacagtgtgctaagaaat

SEQ ID NO: 7801476 - DNA, 22 bp, Homo sapiens
agcaaaataaggtaatttattg

SEQ ID NO: 7801477 - DNA, 20 bp, Homo sapiens
agcaaaatgcaagattttca

SEQ ID NO: 7801478 - DNA, 22 bp, Homo sapiens
agcaaacacaagaggtaatttc

SEQ ID NO: 7801479 - DNA, 22 bp, Homo sapiens
agcaaacagatgtctcctttag

SEQ ID NO: 7801480 - DNA, 20 bp, Homo sapiens
agcaaacaggctccaccaga

SEQ ID NO: 7801481 - DNA, 22 bp, Homo sapiens
agatgaaaatacgtgactttaa

SEQ ID NO: 7801482 - DNA, 22 bp, Homo sapiens
atttattgaagcttattacgtt

SEQ ID NO: 7801483 - DNA, 22 bp, Homo sapiens
agatgaagatatctgcaggggc

SEQ ID NO: 7801484 - DNA, 22 bp, Homo sapiens
atttaggtagctgtctaagtgt

SEQ ID NO: 7801485 - DNA, 22 bp, Homo sapiens
atttattatgggatttggctca

SEQ ID NO: 7801486 - DNA, 22 bp, Homo sapiens
atttattattgtggttacttct

SEQ ID NO: 7801487 - DNA, 22 bp, Homo sapiens
atttattgaacactgactatgt

SEQ ID NO: 7801488 - DNA, 23 bp, Homo sapiens
attcttcattatcttctagaaaa

SEQ ID NO: 7801489 - DNA, 22 bp, Homo sapiens
attcttcatgttgaagctgtca

SEQ ID NO: 7801490 - DNA, 22 bp, Homo sapiens
attcttcatttactgttacttg

SEQ ID NO: 7801491 - DNA, 22 bp, Homo sapiens
attcttcatacctactgaggtt

SEQ ID NO: 7801492 - DNA, 22 bp, Homo sapiens
atttaagactgacttcaccagt

SEQ ID NO: 7801493 - DNA, 23 bp, Homo sapiens
atttaatgctgagttgaatgtta

SEQ ID NO: 7801494 - DNA, 22 bp, Homo sapiens
acatttaatgatcctactgtga

SEQ ID NO: 7801495 - DNA, 22 bp, Homo sapiens
acatttaagttaaaacctcagt

SEQ ID NO: 7801496 - DNA, 22 bp, Homo sapiens
acattgtgatccgactgattaa

SEQ ID NO: 7801497 - DNA, 22 bp, Homo sapiens
acatttaaccaaactgtttaat

SEQ ID NO: 7801498 - DNA, 22 bp, Homo sapiens
acatttaatgatcctactgtga

SEQ ID NO: 7801499 - DNA, 22 bp, Homo sapiens
aggcctgcctggagcctggctg

SEQ ID NO: 7801500 - DNA, 22 bp, Homo sapiens
acatgagatcacaaagataaat

SEQ ID NO: 7801501 - DNA, 22 bp, Homo sapiens
acatgagaagctgcaacatgac

SEQ ID NO: 7801502 - DNA, 22 bp, Homo sapiens
acatgagagaaaagtattctga

SEQ ID NO: 7801503 - DNA, 22 bp, Homo sapiens
acccaggcctgagagacaggag

SEQ ID NO: 7801504 - DNA, 22 bp, Homo sapiens
acccaggctgcttctcagtggc

SEQ ID NO: 7801505 - DNA, 22 bp, Homo sapiens
agggcctgggccagcacccttt

SEQ ID NO: 7801506 - DNA, 22 bp, Homo sapiens
accctaataatcacagactagt

SEQ ID NO: 7801507 - DNA, 22 bp, Homo sapiens
acccggagtcggaggttgcagt

SEQ ID NO: 7801508 - DNA, 22 bp, Homo sapiens
accattctttacacttatttct

SEQ ID NO: 7801509 - DNA, 22 bp, Homo sapiens
accattctgtctctttacaaat

SEQ ID NO: 7801510 - DNA, 23 bp, Homo sapiens
agggcatgaagcagaggacgtgg

SEQ ID NO: 7801511 - DNA, 22 bp, Homo sapiens
acatttttattcatcaaagcag

SEQ ID NO: 7801512 - DNA, 22 bp, Homo sapiens
acattttttagagtcccacatt

SEQ ID NO: 7801513 - DNA, 22 bp, Homo sapiens
acatttttgggttgatgtctga

SEQ ID NO: 7801514 - DNA, 21 bp, Homo sapiens
accaaaacctatactttctgt

SEQ ID NO: 7801515 - DNA, 22 bp, Homo sapiens
aggctggagtgtgcagtggcgc

SEQ ID NO: 7801516 - DNA, 22 bp, Homo sapiens
aggctggcagccacctcagcag

SEQ ID NO: 7801517 - DNA, 22 bp, Homo sapiens
aggctggatttatggggacttc

SEQ ID NO: 7801518 - DNA, 19 bp, Homo sapiens
acagtttgggaaatgagca

SEQ ID NO: 7801519 - DNA, 22 bp, Homo sapiens
acagtttggcgtgattgatagt

SEQ ID NO: 7801520 - DNA, 22 bp, Homo sapiens
acagttattctttatgcaacca

SEQ ID NO: 7801521 - DNA, 22 bp, Homo sapiens
acagttattttcccagcattta

SEQ ID NO: 7801522 - DNA, 22 bp, Homo sapiens
acagtgattattagttggtggt

SEQ ID NO: 7801523 - DNA, 22 bp, Homo sapiens
acagtgttttagaaaagcttga

SEQ ID NO: 7801524 - DNA, 20 bp, Homo sapiens
acagtgtttttgagtagagc

SEQ ID NO: 7801525 - DNA, 22 bp, Homo sapiens
acaggtggggcacttggagcct

SEQ ID NO: 7801526 - DNA, 22 bp, Homo sapiens
acaggtggtaaaatggactgtc

SEQ ID NO: 7801527 - DNA, 22 bp, Homo sapiens
acaggtggcttattggctgatt

SEQ ID NO: 7801528 - DNA, 22 bp, Homo sapiens
acaggtggccccgagggagtgg

SEQ ID NO: 7801529 - DNA, 22 bp, Homo sapiens
acaggtggtagagtggaaagag

SEQ ID NO: 7801530 - DNA, 22 bp, Homo sapiens
acagggattttccaggctaccc

SEQ ID NO: 7801531 - DNA, 22 bp, Homo sapiens
acagggattatgactgacagcc

SEQ ID NO: 7801532 - DNA, 22 bp, Homo sapiens
acaggtggaggctttaggaggt

SEQ ID NO: 7801533 - DNA, 22 bp, Homo sapiens
acagcactttacttctcagtga

SEQ ID NO: 7801534 - DNA, 22 bp, Homo sapiens
agctttatcagaggagtctcta

SEQ ID NO: 7801535 - DNA, 22 bp, Homo sapiens
agctttatcacaatattggcta

SEQ ID NO: 7801536 - DNA, 22 bp, Homo sapiens
agctttatgcttcctacaagct

SEQ ID NO: 7801537 - DNA, 22 bp, Homo sapiens
agctttatgaggagaccttagt

SEQ ID NO: 7801538 - DNA, 22 bp, Homo sapiens
agctttatcccttgcccatcga

SEQ ID NO: 7801539 - DNA, 22 bp, Homo sapiens
agctttatcttcacctgggaat

SEQ ID NO: 7801540 - DNA, 22 bp, Homo sapiens
acagctgtgttttataatcagc

SEQ ID NO: 7801541 - DNA, 22 bp, Homo sapiens
acagctgtgaagcaagcactct

SEQ ID NO: 7801542 - DNA, 21 bp, Homo sapiens
acaggctctggggatgctggg

SEQ ID NO: 7801543 - DNA, 22 bp, Homo sapiens
agctttatgggagcttagataa

SEQ ID NO: 7801544 - DNA, 19 bp, Homo sapiens
aggaatggaattaattctg

SEQ ID NO: 7801545 - DNA, 18 bp, Homo sapiens
acaggctgtgggaatggt

SEQ ID NO: 7801546 - DNA, 22 bp, Homo sapiens
actaaatagcctctggtagttg

SEQ ID NO: 7801547 - DNA, 22 bp, Homo sapiens
actaaatagttttgacagaaca

SEQ ID NO: 7801548 - DNA, 22 bp, Homo sapiens
actaaatagttttgacagaaca

SEQ ID NO: 7801549 - DNA, 22 bp, Homo sapiens
actaaatatttgagaggtgtag

SEQ ID NO: 7801550 - DNA, 22 bp, Homo sapiens
actaaagctcacagagttgaac

SEQ ID NO: 7801551 - DNA, 22 bp, Homo sapiens
actaaagatgtctaaatatatt

SEQ ID NO: 7801552 - DNA, 19 bp, Homo sapiens
actaaaaatgatgtttgag

SEQ ID NO: 7801553 - DNA, 22 bp, Homo sapiens
acctgtttagaaagcttatgag

SEQ ID NO: 7801554 - DNA, 22 bp, Homo sapiens
acctgtttacctgcacctgttt

SEQ ID NO: 7801555 - DNA, 22 bp, Homo sapiens
acctgtttgtgtttggactgca

SEQ ID NO: 7801556 - DNA, 22 bp, Homo sapiens
acctgtttgtgtccattagtga

SEQ ID NO: 7801557 - DNA, 22 bp, Homo sapiens
acctgtttctctctgagttact

SEQ ID NO: 7801558 - DNA, 22 bp, Homo sapiens
acctgtttggaggaggtgttag

SEQ ID NO: 7801559 - DNA, 22 bp, Homo sapiens
acctgttttcagaaaatgcaga

SEQ ID NO: 7801560 - DNA, 22 bp, Homo sapiens
acctgttttcctatctagattg

SEQ ID NO: 7801561 - DNA, 22 bp, Homo sapiens
acctgtttgttaagaaagcttc

SEQ ID NO: 7801562 - DNA, 22 bp, Homo sapiens
acctgttttagtctttaatcat

SEQ ID NO: 7801563 - DNA, 22 bp, Homo sapiens
accttcaagtatgtgggctgaa

SEQ ID NO: 7801564 - DNA, 22 bp, Homo sapiens
accttcaatgaaaataatagtc

SEQ ID NO: 7801565 - DNA, 22 bp, Homo sapiens
accttcaagattgtgggtcaat

SEQ ID NO: 7801566 - DNA, 22 bp, Homo sapiens
accttcaagaaacatttccttg

SEQ ID NO: 7801567 - DNA, 21 bp, Homo sapiens
accttcaagccagaggtggtc

SEQ ID NO: 7801568 - DNA, 22 bp, Homo sapiens
accttcaactcaaagtgtccca

SEQ ID NO: 7801569 - DNA, 22 bp, Homo sapiens
accttcaaactagatagaagtt

SEQ ID NO: 7801570 - DNA, 22 bp, Homo sapiens
accttcaattatttttgttcca

SEQ ID NO: 7801571 - DNA, 22 bp, Homo sapiens
agggttaattggtgtcctgagg

SEQ ID NO: 7801572 - DNA, 19 bp, Homo sapiens
agggttacccgctgccacc

SEQ ID NO: 7801573 - DNA, 22 bp, Homo sapiens
aggtagaaggaccagaatttat

SEQ ID NO: 7801574 - DNA, 22 bp, Homo sapiens
acctgtttaccctgggctcccc

SEQ ID NO: 7801575 - DNA, 22 bp, Homo sapiens
acctgccttctcaaggacatga

SEQ ID NO: 7801576 - DNA, 22 bp, Homo sapiens
actccagggctccaccccagat

SEQ ID NO: 7801577 - DNA, 23 bp, Homo sapiens
actgaaaggatcctagcagagac

SEQ ID NO: 7801578 - DNA, 22 bp, Homo sapiens
actgaaatatttagaagtgaag

SEQ ID NO: 7801579 - DNA, 22 bp, Homo sapiens
actgaaatggggacagtcctta

SEQ ID NO: 7801580 - DNA, 22 bp, Homo sapiens
actgaaatgaaatctatcatct

SEQ ID NO: 7801581 - DNA, 22 bp, Homo sapiens
actggcagagaccctgatggcc

SEQ ID NO: 7801582 - DNA, 22 bp, Homo sapiens
actggcagaactggtgattgtc

SEQ ID NO: 7801583 - DNA, 22 bp, Homo sapiens
actggcagaattgaatagttgt

SEQ ID NO: 7801584 - DNA, 22 bp, Homo sapiens
actggcagaacgtgatgcgggt

SEQ ID NO: 7801585 - DNA, 22 bp, Homo sapiens
actggcagaggatagcactaat

SEQ ID NO: 7801586 - DNA, 22 bp, Homo sapiens
actggcagaggttggacaccat

SEQ ID NO: 7801587 - DNA, 22 bp, Homo sapiens
actggcagagggaaaaccattc

SEQ ID NO: 7801588 - DNA, 22 bp, Homo sapiens
actggcagcagcagcccttggg

SEQ ID NO: 7801589 - DNA, 22 bp, Homo sapiens
actggcagccacaactggcagg

SEQ ID NO: 7801590 - DNA, 20 bp, Homo sapiens
actgctgtagaccatctgca

SEQ ID NO: 7801591 - DNA, 22 bp, Homo sapiens
actgaattagggaacactgaac

SEQ ID NO: 7801592 - DNA, 22 bp, Homo sapiens
actgcctgtagctcttcatctc

SEQ ID NO: 7801593 - DNA, 19 bp, Homo sapiens
actggcagctgtagtctgt

SEQ ID NO: 7801594 - DNA, 22 bp, Homo sapiens
actggcaggctgctggccggcg

SEQ ID NO: 7801595 - DNA, 20 bp, Homo sapiens
actggcagcctgcctgctgt

SEQ ID NO: 7801596 - DNA, 22 bp, Homo sapiens
actggcagctgtaggatgcatg

SEQ ID NO: 7801597 - DNA, 22 bp, Homo sapiens
actggcagtagagggagcgcat

SEQ ID NO: 7801598 - DNA, 19 bp, Homo sapiens
actggcagggctgcggtgg

SEQ ID NO: 7801599 - DNA, 22 bp, Homo sapiens
actggcagggggagccccgaga

SEQ ID NO: 7801600 - DNA, 22 bp, Homo sapiens
actggcaggtccatcgcccttt

SEQ ID NO: 7801601 - DNA, 22 bp, Homo sapiens
actggcagtttgagaatgcatt

SEQ ID NO: 7801602 - DNA, 22 bp, Homo sapiens
actggcagtgtcgtttacatga

SEQ ID NO: 7801603 - DNA, 22 bp, Homo sapiens
actggcagtggcagcagaaaga

SEQ ID NO: 7801604 - DNA, 19 bp, Homo sapiens
actggcagtttctgcatgg

SEQ ID NO: 7801605 - DNA, 22 bp, Homo sapiens
actgtaaaatacataagtattg

SEQ ID NO: 7801606 - DNA, 22 bp, Homo sapiens
agtttacatgacgtgtatttca

SEQ ID NO: 7801607 - DNA, 22 bp, Homo sapiens
agtttacatcttcaatctcatt

SEQ ID NO: 7801608 - DNA, 22 bp, Homo sapiens
actgtcatgatcgaagatgtca

SEQ ID NO: 7801609 - DNA, 22 bp, Homo sapiens
actgtcttgctatgagctccca

SEQ ID NO: 7801610 - DNA, 22 bp, Homo sapiens
actgtcttccaggtctggaggt

SEQ ID NO: 7801611 - DNA, 22 bp, Homo sapiens
actgtctttgagctggaggagg

SEQ ID NO: 7801612 - DNA, 22 bp, Homo sapiens
actgtgaacggactgaagccca

SEQ ID NO: 7801613 - DNA, 22 bp, Homo sapiens
agtttccaaagcatgttcacac

SEQ ID NO: 7801614 - DNA, 23 bp, Homo sapiens
agtttccacccagggtagaaggg

SEQ ID NO: 7801615 - DNA, 22 bp, Homo sapiens
agtttcctcatctgtaaaatga

SEQ ID NO: 7801616 - DNA, 22 bp, Homo sapiens
actgttaaagtaattaattgtc

SEQ ID NO: 7801617 - DNA, 22 bp, Homo sapiens
acttcaaattttcagaagaaat

SEQ ID NO: 7801618 - DNA, 22 bp, Homo sapiens
acttcaaacaattaacagagaa

SEQ ID NO: 7801619 - DNA, 22 bp, Homo sapiens
acttatttcttggatgatcctg

SEQ ID NO: 7801620 - DNA, 22 bp, Homo sapiens
acttctttcacaatgtttctag

SEQ ID NO: 7801621 - DNA, 22 bp, Homo sapiens
acttggaaaattcaaaatggca

SEQ ID NO: 7801622 - DNA, 22 bp, Homo sapiens
acttggaaagatgcaacacagt

SEQ ID NO: 7801623 - DNA, 20 bp, Homo sapiens
acttggaactcatttttctt

SEQ ID NO: 7801624 - DNA, 22 bp, Homo sapiens
acttggatatgttcactagacc

SEQ ID NO: 7801625 - DNA, 23 bp, Homo sapiens
acttggaagcagtgaacaacttt

SEQ ID NO: 7801626 - DNA, 22 bp, Homo sapiens
atccagagactggggctgggat

SEQ ID NO: 7801627 - DNA, 22 bp, Homo sapiens
atccagagaggttaggtgacat

SEQ ID NO: 7801628 - DNA, 19 bp, Homo sapiens
atcagcaaggtaggatgtg

SEQ ID NO: 7801629 - DNA, 22 bp, Homo sapiens
atcagcaagcatttattgagtg

SEQ ID NO: 7801630 - DNA, 22 bp, Homo sapiens
atcagcaagatgtaatttctat

SEQ ID NO: 7801631 - DNA, 22 bp, Homo sapiens
atcagagtgtaagttctttcct

SEQ ID NO: 7801632 - DNA, 22 bp, Homo sapiens
agaaacatcctgctttccattt

SEQ ID NO: 7801633 - DNA, 22 bp, Homo sapiens
agaaacatcattgtttggtatt

SEQ ID NO: 7801634 - DNA, 22 bp, Homo sapiens
agaaacatcattggaacacaag

SEQ ID NO: 7801635 - DNA, 22 bp, Homo sapiens
atatacacatctttttaaatat

SEQ ID NO: 7801636 - DNA, 22 bp, Homo sapiens
atataattctcaggtttgacta

SEQ ID NO: 7801637 - DNA, 22 bp, Homo sapiens
atatataacctggataaggctt

SEQ ID NO: 7801638 - DNA, 22 bp, Homo sapiens
actttgtaataactcctgagtt

SEQ ID NO: 7801639 - DNA, 22 bp, Homo sapiens
actttgtaaattgttgtgactc

SEQ ID NO: 7801640 - DNA, 22 bp, Homo sapiens
atatattttgaatagcctctgt

SEQ ID NO: 7801641 - DNA, 22 bp, Homo sapiens
atatcttctttattttgtgagg

SEQ ID NO: 7801642 - DNA, 22 bp, Homo sapiens
atatctgtgtttcccttttgct

SEQ ID NO: 7801643 - DNA, 22 bp, Homo sapiens
atatctggggactgaatttaga

SEQ ID NO: 7801644 - DNA, 22 bp, Homo sapiens
atatatttgagaatattcatga

SEQ ID NO: 7801645 - DNA, 22 bp, Homo sapiens
atatgaaaatgttttagctgta

SEQ ID NO: 7801646 - DNA, 22 bp, Homo sapiens
agaaaattagattttactgtgt

SEQ ID NO: 7801647 - DNA, 22 bp, Homo sapiens
agaaaatttaaagagacacaca

SEQ ID NO: 7801648 - DNA, 22 bp, Homo sapiens
aaaacttagctaggcaagtttt

SEQ ID NO: 7801649 - DNA, 22 bp, Homo sapiens
aaaactgaaccttgagatcttt

SEQ ID NO: 7801650 - DNA, 22 bp, Homo sapiens
aaaattaagtgtctgggaagcc

SEQ ID NO: 7801651 - DNA, 22 bp, Homo sapiens
aaaattatggagtatcccaaag

SEQ ID NO: 7801652 - DNA, 22 bp, Homo sapiens
aaaagtaattgcaattttgtag

SEQ ID NO: 7801653 - DNA, 22 bp, Homo sapiens
aaaaccaggtagcaaaggagac

SEQ ID NO: 7801654 - DNA, 22 bp, Homo sapiens
aaaaagtctgcaaaggaggttg

SEQ ID NO: 7801655 - DNA, 22 bp, Homo sapiens
aaacacaagatggcctcttctg

SEQ ID NO: 7801656 - DNA, 22 bp, Homo sapiens
aaaattcattcctcagactgcc

SEQ ID NO: 7801657 - DNA, 22 bp, Homo sapiens
aaaattctcttgatcttgacag

SEQ ID NO: 7801658 - DNA, 22 bp, Homo sapiens
aaaattgaagtgatcaggaact

SEQ ID NO: 7801659 - DNA, 19 bp, Homo sapiens
aaaattgcgtattttgagg

SEQ ID NO: 7801660 - DNA, 20 bp, Homo sapiens
aaagagcccttggagcaggc

SEQ ID NO: 7801661 - DNA, 21 bp, Homo sapiens
aaagagcccgctgagaggttc

SEQ ID NO: 7801662 - DNA, 22 bp, Homo sapiens
aaaattggttcctttctgaggc

SEQ ID NO: 7801663 - DNA, 20 bp, Homo sapiens
aaaatatgtataactcttct

SEQ ID NO: 7801664 - DNA, 22 bp, Homo sapiens
aaaatatgaagttgtcagtatg

SEQ ID NO: 7801665 - DNA, 22 bp, Homo sapiens
aaaatactgtggagtgttgaaa

SEQ ID NO: 7801666 - DNA, 22 bp, Homo sapiens
aaacattagacaccatatgctc

SEQ ID NO: 7801667 - DNA, 22 bp, Homo sapiens
aaacattcacatttgctagtaa

SEQ ID NO: 7801668 - DNA, 20 bp, Homo sapiens
aaacattcatgtacaagtga

SEQ ID NO: 7801669 - DNA, 22 bp, Homo sapiens
aaactgtaagagaataaactac

SEQ ID NO: 7801670 - DNA, 22 bp, Homo sapiens
aaactgtaaacacagcagtaca

SEQ ID NO: 7801671 - DNA, 22 bp, Homo sapiens
aaacagataatgctataaatgg

SEQ ID NO: 7801672 - DNA, 22 bp, Homo sapiens
aaacagataatgctataaatgg

SEQ ID NO: 7801673 - DNA, 22 bp, Homo sapiens
aaacagataagggacaatttca

SEQ ID NO: 7801674 - DNA, 22 bp, Homo sapiens
aaacactgaagacctatctggt

SEQ ID NO: 7801675 - DNA, 22 bp, Homo sapiens
aaacactgaaaattttggtcat

SEQ ID NO: 7801676 - DNA, 22 bp, Homo sapiens
aaacatctcaaagaggtatttg

SEQ ID NO: 7801677 - DNA, 22 bp, Homo sapiens
aaacagatgagttataatagcc

SEQ ID NO: 7801678 - DNA, 22 bp, Homo sapiens
aaagatgttatgaaataactat

SEQ ID NO: 7801679 - DNA, 20 bp, Homo sapiens
aaagagaagcctcaccttgt

SEQ ID NO: 7801680 - DNA, 22 bp, Homo sapiens
aaagagaaacttagaagcctga

SEQ ID NO: 7801681 - DNA, 22 bp, Homo sapiens
aaagagaaaatgatctgtacat

SEQ ID NO: 7801682 - DNA, 22 bp, Homo sapiens
aaagaaatagatggcatttaaa

SEQ ID NO: 7801683 - DNA, 22 bp, Homo sapiens
aaactttttcttaggtatgtct

SEQ ID NO: 7801684 - DNA, 22 bp, Homo sapiens
aaacttttcttggggacctgcc

SEQ ID NO: 7801685 - DNA, 22 bp, Homo sapiens
aaacttttggtcctcatgggtt

SEQ ID NO: 7801686 - DNA, 22 bp, Homo sapiens
aaactttttattctaatgtcta

SEQ ID NO: 7801687 - DNA, 22 bp, Homo sapiens
aaacttttttaggttcataggc

SEQ ID NO: 7801688 - DNA, 22 bp, Homo sapiens
aaatagttagccctgcatatat

SEQ ID NO: 7801689 - DNA, 22 bp, Homo sapiens
aaactgtcattttatatagtta

SEQ ID NO: 7801690 - DNA, 22 bp, Homo sapiens
aaatagttcagcttgtaaaccc

SEQ ID NO: 7801691 - DNA, 22 bp, Homo sapiens
aaacttttataaagctgcagat

SEQ ID NO: 7801692 - DNA, 22 bp, Homo sapiens
aaacttttcctgctcttgtcct

SEQ ID NO: 7801693 - DNA, 22 bp, Homo sapiens
aaacttcattttcaactgcaaa

SEQ ID NO: 7801694 - DNA, 22 bp, Homo sapiens
aagccttcagagttggctggtc

SEQ ID NO: 7801695 - DNA, 22 bp, Homo sapiens
aagccttcagtccgttgcagag

SEQ ID NO: 7801696 - DNA, 22 bp, Homo sapiens
aagccctgttctttctctcacc

SEQ ID NO: 7801697 - DNA, 22 bp, Homo sapiens
aagccctgtcaccctgacttca

SEQ ID NO: 7801698 - DNA, 22 bp, Homo sapiens
aagccctgtaaattgcccttaa

SEQ ID NO: 7801699 - DNA, 22 bp, Homo sapiens
aaatctgttgtaatgtttttta

SEQ ID NO: 7801700 - DNA, 22 bp, Homo sapiens
aaatctttccctttactatcca

SEQ ID NO: 7801701 - DNA, 22 bp, Homo sapiens
aagatattcaaagatttattag

SEQ ID NO: 7801702 - DNA, 22 bp, Homo sapiens
aagatgttgtcgttagtgatga

SEQ ID NO: 7801703 - DNA, 22 bp, Homo sapiens
aagaacatggtaggataacaaa

SEQ ID NO: 7801704 - DNA, 22 bp, Homo sapiens
aagaacatgctataattatctt

SEQ ID NO: 7801705 - DNA, 22 bp, Homo sapiens
aaagtgatgccaggagtctggt

SEQ ID NO: 7801706 - DNA, 22 bp, Homo sapiens
aaagtgaggacttgagtactgt

SEQ ID NO: 7801707 - DNA, 22 bp, Homo sapiens
aaagtgatttaagtacctcagg

SEQ ID NO: 7801708 - DNA, 22 bp, Homo sapiens
aaagtttggatccagcaaaaga

SEQ ID NO: 7801709 - DNA, 22 bp, Homo sapiens
aaagttttagaactaggaagca

SEQ ID NO: 7801710 - DNA, 22 bp, Homo sapiens
aaagttttagctgtccagttcc

SEQ ID NO: 7801711 - DNA, 22 bp, Homo sapiens
aagataaactcttgatttctga

SEQ ID NO: 7801712 - DNA, 22 bp, Homo sapiens
aaagcagattctgatgcagtag

SEQ ID NO: 7801713 - DNA, 19 bp, Homo sapiens
aaagcagaggagcatctga

SEQ ID NO: 7801714 - DNA, 22 bp, Homo sapiens
aaagcagaggtgatatgactta

SEQ ID NO: 7801715 - DNA, 22 bp, Homo sapiens
aaagcagactgatttgcatcac

SEQ ID NO: 7801716 - DNA, 22 bp, Homo sapiens
aaagcagagatcatggcttgta

SEQ ID NO: 7801717 - DNA, 22 bp, Homo sapiens
aaagcagagcagggcacttatg

SEQ ID NO: 7801718 - DNA, 22 bp, Homo sapiens
aacacttatccacatttgaaag

SEQ ID NO: 7801719 - DNA, 22 bp, Homo sapiens
aaagcaagatgcatccgtcaag

SEQ ID NO: 7801720 - DNA, 22 bp, Homo sapiens
aaagcaaacagaaccccaagct

SEQ ID NO: 7801721 - DNA, 22 bp, Homo sapiens
aacacattttgcctaggcaata

SEQ ID NO: 7801722 - DNA, 22 bp, Homo sapiens
aaagatttcagaagcctgtgcc

SEQ ID NO: 7801723 - DNA, 22 bp, Homo sapiens
aaagccttcaagtagatgtaag

SEQ ID NO: 7801724 - DNA, 22 bp, Homo sapiens
aaagccttctgtctagcagata

SEQ ID NO: 7801725 - DNA, 22 bp, Homo sapiens
aaagccttcttcggtctgtgat

SEQ ID NO: 7801726 - DNA, 22 bp, Homo sapiens
aaagccttgagatcctatagtt

SEQ ID NO: 7801727 - DNA, 22 bp, Homo sapiens
aaagcctcccaggttatgagta

SEQ ID NO: 7801728 - DNA, 22 bp, Homo sapiens
aaagccttgggatttgtgatca

SEQ ID NO: 7801729 - DNA, 22 bp, Homo sapiens
aaagcctttgtctcaggctctg

SEQ ID NO: 7801730 - DNA, 22 bp, Homo sapiens
aaagccttttatgatcagttaa

SEQ ID NO: 7801731 - DNA, 22 bp, Homo sapiens
aaagccttttctgtttaacaca

SEQ ID NO: 7801732 - DNA, 22 bp, Homo sapiens
aacccaggagatggaggttgtg

SEQ ID NO: 7801733 - DNA, 22 bp, Homo sapiens
aacccaggagacggagtttgtg

SEQ ID NO: 7801734 - DNA, 22 bp, Homo sapiens
aacccaggaggcagaggctgca

SEQ ID NO: 7801735 - DNA, 22 bp, Homo sapiens
aacccaggagccggaggttgtg

SEQ ID NO: 7801736 - DNA, 22 bp, Homo sapiens
aacccaggacagagctttgtgg

SEQ ID NO: 7801737 - DNA, 22 bp, Homo sapiens
aacccagccgtgtagctgccgc

SEQ ID NO: 7801738 - DNA, 22 bp, Homo sapiens
aacccaggaggcggaggttgtg

SEQ ID NO: 7801739 - DNA, 22 bp, Homo sapiens
aacccaggaggtggaggttgtg

SEQ ID NO: 7801740 - DNA, 22 bp, Homo sapiens
aacccaggaggcagatgttgtg

SEQ ID NO: 7801741 - DNA, 22 bp, Homo sapiens
aacccaggagttggaggctgtg

SEQ ID NO: 7801742 - DNA, 22 bp, Homo sapiens
aacccagggtgaggggagtcta

SEQ ID NO: 7801743 - DNA, 22 bp, Homo sapiens
aacccgggaggcagaggttgtg

SEQ ID NO: 7801744 - DNA, 22 bp, Homo sapiens
aaccccgctcaggctgggtgag

SEQ ID NO: 7801745 - DNA, 22 bp, Homo sapiens
aaaggcagagttgttggaggca

SEQ ID NO: 7801746 - DNA, 22 bp, Homo sapiens
aactgtaagagaataaatgtgt

SEQ ID NO: 7801747 - DNA, 22 bp, Homo sapiens
aaaggttttggtaaggctttaa

SEQ ID NO: 7801748 - DNA, 22 bp, Homo sapiens
aactgtcttatttatatttctg

SEQ ID NO: 7801749 - DNA, 22 bp, Homo sapiens
aagaacatgaacacaatgttta

SEQ ID NO: 7801750 - DNA, 22 bp, Homo sapiens
aagaacatgaacctcttctaac

SEQ ID NO: 7801751 - DNA, 22 bp, Homo sapiens
aaagtaacctagtaatagtgtc

SEQ ID NO: 7801752 - DNA, 22 bp, Homo sapiens
aacacagggactcccaggagaa

SEQ ID NO: 7801753 - DNA, 22 bp, Homo sapiens
aaatttctaagtcaagaagaac

SEQ ID NO: 7801754 - DNA, 22 bp, Homo sapiens
aaatttgttcaatgtctatttg

SEQ ID NO: 7801755 - DNA, 22 bp, Homo sapiens
aaatttctgttgttttgagcca

SEQ ID NO: 7801756 - DNA, 22 bp, Homo sapiens
aacactttttagtaaagattga

SEQ ID NO: 7801757 - DNA, 22 bp, Homo sapiens
aacagagcattctgcactacaa

SEQ ID NO: 7801758 - DNA, 22 bp, Homo sapiens
aaatgtcatatttaagtaggaa

SEQ ID NO: 7801759 - DNA, 22 bp, Homo sapiens
aaatgtcaaggtgatagatgca

SEQ ID NO: 7801760 - DNA, 22 bp, Homo sapiens
aaggaaagacaggacggaattc

SEQ ID NO: 7801761 - DNA, 22 bp, Homo sapiens
aaattattttcagaatggagaa

SEQ ID NO: 7801762 - DNA, 23 bp, Homo sapiens
aaattattgctcttcaattgcct

SEQ ID NO: 7801763 - DNA, 22 bp, Homo sapiens
aaggctggggtgcagacggcct

SEQ ID NO: 7801764 - DNA, 22 bp, Homo sapiens
aacatgaaaagcccagagaggt

SEQ ID NO: 7801765 - DNA, 22 bp, Homo sapiens
aacatgaaaagcccagagaggt

SEQ ID NO: 7801766 - DNA, 22 bp, Homo sapiens
aacatctttgataaacttagtg

SEQ ID NO: 7801767 - DNA, 22 bp, Homo sapiens
aacatgaaaactacctgtgatt

SEQ ID NO: 7801768 - DNA, 22 bp, Homo sapiens
aagtgtctagcacctggatgca

SEQ ID NO: 7801769 - DNA, 22 bp, Homo sapiens
aagtgtcctcattcaacatgca

SEQ ID NO: 7801770 - DNA, 22 bp, Homo sapiens
aacagctgcttcagtacttgaa

SEQ ID NO: 7801771 - DNA, 22 bp, Homo sapiens
aatggcttctgaagcacacttt

SEQ ID NO: 7801772 - DNA, 22 bp, Homo sapiens
aactagaacgtctagttgctgg

SEQ ID NO: 7801773 - DNA, 22 bp, Homo sapiens
aactagaaagaacatatttcca

SEQ ID NO: 7801774 - DNA, 20 bp, Homo sapiens
aactagaaagcacccatgga

SEQ ID NO: 7801775 - DNA, 22 bp, Homo sapiens
aactagaaaaagactttctgag

SEQ ID NO: 7801776 - DNA, 22 bp, Homo sapiens
aactagaaaacaagatgctgat

SEQ ID NO: 7801777 - DNA, 22 bp, Homo sapiens
aactagaaatcactacaggtat

SEQ ID NO: 7801778 - DNA, 23 bp, Homo sapiens
aatgacagtgtgtgattgaagaa

SEQ ID NO: 7801779 - DNA, 22 bp, Homo sapiens
aatgacagagcactgaacttgg

SEQ ID NO: 7801780 - DNA, 22 bp, Homo sapiens
aaccttttgcaagtgccttgac

SEQ ID NO: 7801781 - DNA, 22 bp, Homo sapiens
aacctgcatgtttctaaaagca

SEQ ID NO: 7801782 - DNA, 22 bp, Homo sapiens
aacctgcagtttttattctgag

SEQ ID NO: 7801783 - DNA, 22 bp, Homo sapiens
aacccgggaggcggaggttgtg

SEQ ID NO: 7801784 - DNA, 23 bp, Homo sapiens
aacctagactacttactatgtgg

SEQ ID NO: 7801785 - DNA, 22 bp, Homo sapiens
aacctcaaactcttgggcttaa

SEQ ID NO: 7801786 - DNA, 22 bp, Homo sapiens
aagcaccaccctcccaacctgt

SEQ ID NO: 7801787 - DNA, 22 bp, Homo sapiens
aagcagaggtagggtgtgcagt

SEQ ID NO: 7801788 - DNA, 22 bp, Homo sapiens
aagatgataggacttgcttaag

SEQ ID NO: 7801789 - DNA, 22 bp, Homo sapiens
aagatgcatgctgaagctggct

SEQ ID NO: 7801790 - DNA, 22 bp, Homo sapiens
aagcaaagagataaccttttgg

SEQ ID NO: 7801791 - DNA, 22 bp, Homo sapiens
acacatatatacatatttgtgc

SEQ ID NO: 7801792 - DNA, 22 bp, Homo sapiens
acacatgagaaacatcagttgt

SEQ ID NO: 7801793 - DNA, 22 bp, Homo sapiens
acacatttatggatcgcagaaa

SEQ ID NO: 7801794 - DNA, 22 bp, Homo sapiens
aagatgaatcagtatgtgtcct

SEQ ID NO: 7801795 - DNA, 22 bp, Homo sapiens
aagagcactaacagagctgata

SEQ ID NO: 7801796 - DNA, 22 bp, Homo sapiens
acacaaagttggatgacaaaat

SEQ ID NO: 7801797 - DNA, 19 bp, Homo sapiens
acaatgttgttggacactc

SEQ ID NO: 7801798 - DNA, 22 bp, Homo sapiens
aagagacaatgtcttttggata

SEQ ID NO: 7801799 - DNA, 22 bp, Homo sapiens
aagagaaggtgaggaagccggt

SEQ ID NO: 7801800 - DNA, 22 bp, Homo sapiens
aagagaaggattctgagcctgg

SEQ ID NO: 7801801 - DNA, 22 bp, Homo sapiens
aagagaaagcagactttgtcat

SEQ ID NO: 7801802 - DNA, 22 bp, Homo sapiens
aatttgttagcatactctagtt

SEQ ID NO: 7801803 - DNA, 22 bp, Homo sapiens
aatttgttacacagcaatataa

SEQ ID NO: 7801804 - DNA, 22 bp, Homo sapiens
aatttgttacacagcaatataa

SEQ ID NO: 7801805 - DNA, 22 bp, Homo sapiens
aatttgttttcaagtcactgga

SEQ ID NO: 7801806 - DNA, 22 bp, Homo sapiens
aatttgttataacttgggctga

SEQ ID NO: 7801807 - DNA, 22 bp, Homo sapiens
aatttgttttcaagtcactgga

SEQ ID NO: 7801808 - DNA, 22 bp, Homo sapiens
aatttcagaacccaaattagcg

SEQ ID NO: 7801809 - DNA, 22 bp, Homo sapiens
aatttcagaacccaaattagcg

SEQ ID NO: 7801810 - DNA, 22 bp, Homo sapiens
aatttcagatattaaagaatga

SEQ ID NO: 7801811 - DNA, 22 bp, Homo sapiens
aatttcagttgctaataagttc

SEQ ID NO: 7801812 - DNA, 22 bp, Homo sapiens
aatttcagatgtcataaatata

SEQ ID NO: 7801813 - DNA, 22 bp, Homo sapiens
aactttcttggatgtctcaaca

SEQ ID NO: 7801814 - DNA, 22 bp, Homo sapiens
aactttcttgtgacatttgggg

SEQ ID NO: 7801815 - DNA, 22 bp, Homo sapiens
aactggaatgaaatttacgatg

SEQ ID NO: 7801816 - DNA, 22 bp, Homo sapiens
aactggaaccttttattcagtc

SEQ ID NO: 7801817 - DNA, 22 bp, Homo sapiens
aactggaaagatcagtaggaag

SEQ ID NO: 7801818 - DNA, 22 bp, Homo sapiens
aatggcttttaaaaatagcatt

SEQ ID NO: 7801819 - DNA, 22 bp, Homo sapiens
aatgggaaaagagtatgattta

SEQ ID NO: 7801820 - DNA, 22 bp, Homo sapiens
aagaaaacaatgacttgccagc

SEQ ID NO: 7801821 - DNA, 22 bp, Homo sapiens
aagaaaacgttttgaggagttt

SEQ ID NO: 7801822 - DNA, 22 bp, Homo sapiens
aagaaaatcagttctggtcagt

SEQ ID NO: 7801823 - DNA, 22 bp, Homo sapiens
aagaaaatcagttctggtcagt

SEQ ID NO: 7801824 - DNA, 22 bp, Homo sapiens
aagaaaatcagttctggtcagt

SEQ ID NO: 7801825 - DNA, 22 bp, Homo sapiens
aagaaagataaggtttgcttgg

SEQ ID NO: 7801826 - DNA, 22 bp, Homo sapiens
aattcccatttgcagaaaatca

SEQ ID NO: 7801827 - DNA, 22 bp, Homo sapiens
aattcccaccttctctcttttg

SEQ ID NO: 7801828 - DNA, 21 bp, Homo sapiens
aattcccagaaacagcacaag

SEQ ID NO: 7801829 - DNA, 22 bp, Homo sapiens
aattcccactatatgccaagca

SEQ ID NO: 7801830 - DNA, 22 bp, Homo sapiens
aattctacattggttcacattt

SEQ ID NO: 7801831 - DNA, 22 bp, Homo sapiens
aattctataggcaagctatttt

SEQ ID NO: 7801832 - DNA, 22 bp, Homo sapiens
aattcctctatctttcttcaag

SEQ ID NO: 7801833 - DNA, 22 bp, Homo sapiens
aatttcactgataaagactcca

SEQ ID NO: 7801834 - DNA, 22 bp, Homo sapiens
aatttcactggaaaagataatt

SEQ ID NO: 7801835 - DNA, 22 bp, Homo sapiens
aatttcacctatcacttaagcc

SEQ ID NO: 7801836 - DNA, 17 bp, Homo sapiens
aagaacactcaatagca

SEQ ID NO: 7801837 - DNA, 22 bp, Homo sapiens
aatttaagagcatagctccaac

SEQ ID NO: 7801838 - DNA, 22 bp, Homo sapiens
aatgatttcccctacacagaag

SEQ ID NO: 7801839 - DNA, 22 bp, Homo sapiens
aatgatgagttctaatagaccc

SEQ ID NO: 7801840 - DNA, 22 bp, Homo sapiens
agaaattattagtgaatagtct

SEQ ID NO: 7801841 - DNA, 22 bp, Homo sapiens
agaaattcctaaggtacacaag

SEQ ID NO: 7801842 - DNA, 23 bp, Homo sapiens
aatgagttgggcagcatacaggc

SEQ ID NO: 7801843 - DNA, 22 bp, Homo sapiens
aatgagttctggttcattttat

SEQ ID NO: 7801844 - DNA, 22 bp, Homo sapiens
agaacaatgttaaattattaag

SEQ ID NO: 7801845 - DNA, 22 bp, Homo sapiens
aatcagtttcttggcaagttta

SEQ ID NO: 7801846 - DNA, 22 bp, Homo sapiens
aatcagttgtccaaagttcaca

SEQ ID NO: 7801847 - DNA, 22 bp, Homo sapiens
aatcagacagttctggattcaa

SEQ ID NO: 7801848 - DNA, 22 bp, Homo sapiens
aatactatgtagccaaaataat

SEQ ID NO: 7801849 - DNA, 22 bp, Homo sapiens
aatactgagatcccacaaagca

SEQ ID NO: 7801850 - DNA, 22 bp, Homo sapiens
actttaaaactgatcatcagag

SEQ ID NO: 7801851 - DNA, 22 bp, Homo sapiens
actgttgaagtgccagcttgat

SEQ ID NO: 7801852 - DNA, 22 bp, Homo sapiens
actgttctgccaactttggtta

SEQ ID NO: 7801853 - DNA, 23 bp, Homo sapiens
actttattgaccccaggtcagtt

SEQ ID NO: 7801854 - DNA, 23 bp, Homo sapiens
actttattgaccccaggtcagtt

SEQ ID NO: 7801855 - DNA, 22 bp, Homo sapiens
actttcttggtcccatgtttga

SEQ ID NO: 7801856 - DNA, 22 bp, Homo sapiens
actttctgtggttaccagggag

SEQ ID NO: 7801857 - DNA, 22 bp, Homo sapiens
actttatttcctattgcatcca

SEQ ID NO: 7801858 - DNA, 22 bp, Homo sapiens
actttatttcctattgcatcca

SEQ ID NO: 7801859 - DNA, 22 bp, Homo sapiens
acgtgcaggatctggttggcga

SEQ ID NO: 7801860 - DNA, 22 bp, Homo sapiens
acggtgctgggtattggggttc

SEQ ID NO: 7801861 - DNA, 22 bp, Homo sapiens
acggggctagagaaggtttctt

SEQ ID NO: 7801862 - DNA, 22 bp, Homo sapiens
acctacatacggaaatatttac

SEQ ID NO: 7801863 - DNA, 22 bp, Homo sapiens
acctacatagttaagtaacaaa

SEQ ID NO: 7801864 - DNA, 22 bp, Homo sapiens
acctacatcaagggagtggtag

SEQ ID NO: 7801865 - DNA, 22 bp, Homo sapiens
acctacatggctttaagtaagt

SEQ ID NO: 7801866 - DNA, 20 bp, Homo sapiens
acctacatgtatagtgaggg

SEQ ID NO: 7801867 - DNA, 22 bp, Homo sapiens
acctacatgttccacatagttg

SEQ ID NO: 7801868 - DNA, 23 bp, Homo sapiens
acctacattatagggatatgggt

SEQ ID NO: 7801869 - DNA, 22 bp, Homo sapiens
aagtcgtggcaggcttgcacga

SEQ ID NO: 7801870 - DNA, 22 bp, Homo sapiens
aagtctaaacacatatttaaaa

SEQ ID NO: 7801871 - DNA, 22 bp, Homo sapiens
aagtctaagtttgtaacttgga

SEQ ID NO: 7801872 - DNA, 22 bp, Homo sapiens
aagtctaacctattccggtgtt

SEQ ID NO: 7801873 - DNA, 22 bp, Homo sapiens
actctccacccactcactctgt

SEQ ID NO: 7801874 - DNA, 23 bp, Homo sapiens
actccccagtctcttcttgccaa

SEQ ID NO: 7801875 - DNA, 22 bp, Homo sapiens
actagtttgaaaatatctgatt

SEQ ID NO: 7801876 - DNA, 22 bp, Homo sapiens
actgaggtttacttgaaggaga

SEQ ID NO: 7801877 - DNA, 22 bp, Homo sapiens
actgataagttgcttgctctca

SEQ ID NO: 7801878 - DNA, 22 bp, Homo sapiens
aaggcctgggaggcctctcttc

SEQ ID NO: 7801879 - DNA, 22 bp, Homo sapiens
aaggccttggttctgagcaata

SEQ ID NO: 7801880 - DNA, 22 bp, Homo sapiens
aaggcagataagaattcagcaa

SEQ ID NO: 7801881 - DNA, 22 bp, Homo sapiens
acattcttccagctggctgttg

SEQ ID NO: 7801882 - DNA, 22 bp, Homo sapiens
acattcttcttgtgaatttact

SEQ ID NO: 7801883 - DNA, 22 bp, Homo sapiens
acattcttcttgtgaatttact

SEQ ID NO: 7801884 - DNA, 22 bp, Homo sapiens
acattcttgaagtgaagtttat

SEQ ID NO: 7801885 - DNA, 22 bp, Homo sapiens
aaggctccctcttctcgagtgt

SEQ ID NO: 7801886 - DNA, 22 bp, Homo sapiens
aaggcctttgccccgatacagg

SEQ ID NO: 7801887 - DNA, 22 bp, Homo sapiens
acatttcatgttttccagagca

SEQ ID NO: 7801888 - DNA, 22 bp, Homo sapiens
acatttctggagtttctcaaca

SEQ ID NO: 7801889 - DNA, 22 bp, Homo sapiens
acatttcttccacatgctgctg

SEQ ID NO: 7801890 - DNA, 22 bp, Homo sapiens
acatttcttccctttagcagaa

SEQ ID NO: 7801891 - DNA, 19 bp, Homo sapiens
acatttaaattcagatctc

SEQ ID NO: 7801892 - DNA, 19 bp, Homo sapiens
aaggctggagaaggcctct

SEQ ID NO: 7801893 - DNA, 22 bp, Homo sapiens
acatttaaatatgccttatatt

SEQ ID NO: 7801894 - DNA, 22 bp, Homo sapiens
acatttaaatatgccttatatt

SEQ ID NO: 7801895 - DNA, 22 bp, Homo sapiens
acatttaaatacctatgtttct

SEQ ID NO: 7801896 - DNA, 21 bp, Homo sapiens
accaggcttgtgggagggagc

SEQ ID NO: 7801897 - DNA, 22 bp, Homo sapiens
acattttacaccaagacttctt

SEQ ID NO: 7801898 - DNA, 22 bp, Homo sapiens
acattttacaccaagacttctt

SEQ ID NO: 7801899 - DNA, 22 bp, Homo sapiens
acatagaacctggcacatagta

SEQ ID NO: 7801900 - DNA, 22 bp, Homo sapiens
acagtgtttatgtacagattgt

SEQ ID NO: 7801901 - DNA, 22 bp, Homo sapiens
aaggcagaggaaggtctagttt

SEQ ID NO: 7801902 - DNA, 22 bp, Homo sapiens
aaggagacatttgcagagcacc

SEQ ID NO: 7801903 - DNA, 22 bp, Homo sapiens
aaggagacttggcatcacttaa

SEQ ID NO: 7801904 - DNA, 22 bp, Homo sapiens
aaggaggaataaagaggtggtg

SEQ ID NO: 7801905 - DNA, 17 bp, Homo sapiens
acagtgtctatgaaatg

SEQ ID NO: 7801906 - DNA, 16 bp, Homo sapiens
acagtgtctcaagcac

SEQ ID NO: 7801907 - DNA, 22 bp, Homo sapiens
aagcattttagataaagcatca

SEQ ID NO: 7801908 - DNA, 22 bp, Homo sapiens
aagcattttgttttaagaatga

SEQ ID NO: 7801909 - DNA, 19 bp, Homo sapiens
acagcctgttggtggggct

SEQ ID NO: 7801910 - DNA, 22 bp, Homo sapiens
aagccctgggatgttcagcagt

SEQ ID NO: 7801911 - DNA, 22 bp, Homo sapiens
aagccttcctgagtgcaaggcc

SEQ ID NO: 7801912 - DNA, 22 bp, Homo sapiens
aagccttccctttttgagctca

SEQ ID NO: 7801913 - DNA, 22 bp, Homo sapiens
aagccctggggttgcacaaggc

SEQ ID NO: 7801914 - DNA, 22 bp, Homo sapiens
aagccttgattcactctgtgga

SEQ ID NO: 7801915 - DNA, 22 bp, Homo sapiens
aagccttgcctatttgatgaca

SEQ ID NO: 7801916 - DNA, 22 bp, Homo sapiens
aagccttgctcttgaaaaagtt

SEQ ID NO: 7801917 - DNA, 22 bp, Homo sapiens
aagccttggggctcctctgtat

SEQ ID NO: 7801918 - DNA, 22 bp, Homo sapiens
aagcgccatggttcctgcgcag

SEQ ID NO: 7801919 - DNA, 22 bp, Homo sapiens
agaggctctgccgcctcaggta

SEQ ID NO: 7801920 - DNA, 22 bp, Homo sapiens
aattcttcaagtgctttggaga

SEQ ID NO: 7801921 - DNA, 22 bp, Homo sapiens
aattcttaatcccataaagtga

SEQ ID NO: 7801922 - DNA, 22 bp, Homo sapiens
aattctgatgatactgcattgt

SEQ ID NO: 7801923 - DNA, 22 bp, Homo sapiens
aattcttggaaacattactgga

SEQ ID NO: 7801924 - DNA, 22 bp, Homo sapiens
acaaagtagtcaaagtagatga

SEQ ID NO: 7801925 - DNA, 22 bp, Homo sapiens
acaaagcttagacctaagagat

SEQ ID NO: 7801926 - DNA, 20 bp, Homo sapiens
agaggcttccttgggaggag

SEQ ID NO: 7801927 - DNA, 22 bp, Homo sapiens
agaggcttctcggatggggcag

SEQ ID NO: 7801928 - DNA, 22 bp, Homo sapiens
agataactcattttgtatatcc

SEQ ID NO: 7801929 - DNA, 22 bp, Homo sapiens
acaacaatctaccctagcttct

SEQ ID NO: 7801930 - DNA, 22 bp, Homo sapiens
acaacaaagacacttgaaatga

SEQ ID NO: 7801931 - DNA, 22 bp, Homo sapiens
agataactggtttacattattg

SEQ ID NO: 7801932 - DNA, 22 bp, Homo sapiens
agataagtactgttattattgc

SEQ ID NO: 7801933 - DNA, 22 bp, Homo sapiens
agataatgaatgccatgacatt

SEQ ID NO: 7801934 - DNA, 22 bp, Homo sapiens
acaagatagcttagaagattca

SEQ ID NO: 7801935 - DNA, 22 bp, Homo sapiens
acaagagcattgcaggtgtgtt

SEQ ID NO: 7801936 - DNA, 22 bp, Homo sapiens
acaatcttattagtagtataga

SEQ ID NO: 7801937 - DNA, 22 bp, Homo sapiens
acaatctggaaaagttaactat

SEQ ID NO: 7801938 - DNA, 23 bp, Homo sapiens
acaagatagggataaaaagataa

SEQ ID NO: 7801939 - DNA, 23 bp, Homo sapiens
acaagatagggataaaaagataa

SEQ ID NO: 7801940 - DNA, 22 bp, Homo sapiens
agagccagttgttaagcactta

SEQ ID NO: 7801941 - DNA, 22 bp, Homo sapiens
agagccaggctcccatggggca

SEQ ID NO: 7801942 - DNA, 22 bp, Homo sapiens
agagccaggcggctgggcacct

SEQ ID NO: 7801943 - DNA, 22 bp, Homo sapiens
agagccaggtgtagtctcggag

SEQ ID NO: 7801944 - DNA, 22 bp, Homo sapiens
agagccagttaagcacttacag

SEQ ID NO: 7801945 - DNA, 22 bp, Homo sapiens
agagccagttacaactgtggag

SEQ ID NO: 7801946 - DNA, 22 bp, Homo sapiens
agagccaggctctacctgggtt

SEQ ID NO: 7801947 - DNA, 22 bp, Homo sapiens
agagccaggtgctgctgtttga

SEQ ID NO: 7801948 - DNA, 22 bp, Homo sapiens
aattaaaaaaggagagcttgct

SEQ ID NO: 7801949 - DNA, 20 bp, Homo sapiens
agaccctctggactgggccc

SEQ ID NO: 7801950 - DNA, 22 bp, Homo sapiens
agaccctctccatgcccactgc

SEQ ID NO: 7801951 - DNA, 18 bp, Homo sapiens
agaccctctaagggcagt

SEQ ID NO: 7801952 - DNA, 22 bp, Homo sapiens
aattaaaagataacccatgagt

SEQ ID NO: 7801953 - DNA, 22 bp, Homo sapiens
aatgtcttcagtgtatacatgg

SEQ ID NO: 7801954 - DNA, 22 bp, Homo sapiens
aatgggaagtcactactgttac

SEQ ID NO: 7801955 - DNA, 22 bp, Homo sapiens
agacaattaaaaaattatgctt

SEQ ID NO: 7801956 - DNA, 22 bp, Homo sapiens
aatggcactttataaatgttaa

SEQ ID NO: 7801957 - DNA, 22 bp, Homo sapiens
acacagatattttgaatacata

SEQ ID NO: 7801958 - DNA, 23 bp, Homo sapiens
agcagcaaaaatttatctttctg

SEQ ID NO: 7801959 - DNA, 22 bp, Homo sapiens
acactgattgtagtctgtggtg

SEQ ID NO: 7801960 - DNA, 22 bp, Homo sapiens
acactctacagagcaatctacc

SEQ ID NO: 7801961 - DNA, 22 bp, Homo sapiens
acacatgtgattctaagacagc

SEQ ID NO: 7801962 - DNA, 22 bp, Homo sapiens
acacatgttcaagaatgttcag

SEQ ID NO: 7801963 - DNA, 22 bp, Homo sapiens
acacatgtatggcacttacatt

SEQ ID NO: 7801964 - DNA, 19 bp, Homo sapiens
acacatgtaacagtttttc

SEQ ID NO: 7801965 - DNA, 22 bp, Homo sapiens
acacatgtacagattagtattt

SEQ ID NO: 7801966 - DNA, 22 bp, Homo sapiens
acagagccactttggtgcctac

SEQ ID NO: 7801967 - DNA, 20 bp, Homo sapiens
agccctgtttcctggagaga

SEQ ID NO: 7801968 - DNA, 22 bp, Homo sapiens
acagagctgggatctgaaccca

SEQ ID NO: 7801969 - DNA, 22 bp, Homo sapiens
acagagctcccagccatctcct

SEQ ID NO: 7801970 - DNA, 22 bp, Homo sapiens
acagatggaatgtgttatggga

SEQ ID NO: 7801971 - DNA, 22 bp, Homo sapiens
acagatgagttaaagcagagtg

SEQ ID NO: 7801972 - DNA, 22 bp, Homo sapiens
acagatgaggcccatcagtctg

SEQ ID NO: 7801973 - DNA, 22 bp, Homo sapiens
acagatgaggcccatcagtctg

SEQ ID NO: 7801974 - DNA, 22 bp, Homo sapiens
acagatgagttaaagcagagtg

SEQ ID NO: 7801975 - DNA, 22 bp, Homo sapiens
agctcctgcttgacagaagagg

SEQ ID NO: 7801976 - DNA, 22 bp, Homo sapiens
agctcctgctctttgtccctaa

SEQ ID NO: 7801977 - DNA, 22 bp, Homo sapiens
agctcctgcccaggaaggctct

SEQ ID NO: 7801978 - DNA, 22 bp, Homo sapiens
agctcctgcagactcctgctca

SEQ ID NO: 7801979 - DNA, 22 bp, Homo sapiens
acagatggagctactaggtaaa

SEQ ID NO: 7801980 - DNA, 22 bp, Homo sapiens
acagatggccatattactatat

SEQ ID NO: 7801981 - DNA, 21 bp, Homo sapiens
acagatgggatgagcacactg

SEQ ID NO: 7801982 - DNA, 22 bp, Homo sapiens
acagatggttattgtcatttct

SEQ ID NO: 7801983 - DNA, 22 bp, Homo sapiens
acagattcactgcactggccat

SEQ ID NO: 7801984 - DNA, 22 bp, Homo sapiens
acagacacaggcgtggagtcgc

SEQ ID NO: 7801985 - DNA, 22 bp, Homo sapiens
acactttatgtctagatctggg

SEQ ID NO: 7801986 - DNA, 22 bp, Homo sapiens
acacttttaagactttaatgaa

SEQ ID NO: 7801987 - DNA, 22 bp, Homo sapiens
acagaaacccagaaaacctctc

SEQ ID NO: 7801988 - DNA, 22 bp, Homo sapiens
acagaaaatgccagaagggtgg

SEQ ID NO: 7801989 - DNA, 22 bp, Homo sapiens
acacttttgtgtatatccagtt

SEQ ID NO: 7801990 - DNA, 22 bp, Homo sapiens
acacttttgtttgaagtctcca

SEQ ID NO: 7801991 - DNA, 22 bp, Homo sapiens
acagagagctgtgattgagtta

SEQ ID NO: 7801992 - DNA, 22 bp, Homo sapiens
acagagagctgtgattgagtta

SEQ ID NO: 7801993 - DNA, 22 bp, Homo sapiens
acagagagaggcccgaggctgc

SEQ ID NO: 7801994 - DNA, 22 bp, Homo sapiens
acagagagaaacaatcagcagc

SEQ ID NO: 7801995 - DNA, 22 bp, Homo sapiens
acagagagaaacaatcagcagc

SEQ ID NO: 7801996 - DNA, 22 bp, Homo sapiens
acagagagaattgggtttacag

SEQ ID NO: 7801997 - DNA, 21 bp, Homo sapiens
acagagaaagagcagcctcct

SEQ ID NO: 7801998 - DNA, 22 bp, Homo sapiens
acagactgtgagtatgcatagt

SEQ ID NO: 7801999 - DNA, 22 bp, Homo sapiens
agccagggtctctcgctctgtt

SEQ ID NO: 7802000 - DNA, 22 bp, Homo sapiens
taacagagtaacaggtatgtaa

SEQ ID NO: 7802001 - DNA, 22 bp, Homo sapiens
taaatctttaggaagctcaaac

SEQ ID NO: 7802002 - DNA, 22 bp, Homo sapiens
taaatgagggctgacatgattg

SEQ ID NO: 7802003 - DNA, 22 bp, Homo sapiens
taaatgagtaatatagctgttt

SEQ ID NO: 7802004 - DNA, 22 bp, Homo sapiens
taaatgagtaatatagctgttt

SEQ ID NO: 7802005 - DNA, 22 bp, Homo sapiens
taaatgagatgtacataactca

SEQ ID NO: 7802006 - DNA, 22 bp, Homo sapiens
taaaggattttgtataatataa

SEQ ID NO: 7802007 - DNA, 22 bp, Homo sapiens
taaagctgttcagtgcagaaag

SEQ ID NO: 7802008 - DNA, 22 bp, Homo sapiens
taaaactagtggttgggactaa

SEQ ID NO: 7802009 - DNA, 22 bp, Homo sapiens
gtttttgtcgagttccttgacc

SEQ ID NO: 7802010 - DNA, 22 bp, Homo sapiens
gtttttgtccatggaggcaaac

SEQ ID NO: 7802011 - DNA, 22 bp, Homo sapiens
gtttttctaggaccatgtgatt

SEQ ID NO: 7802012 - DNA, 22 bp, Homo sapiens
gtttaaataattaggggcctgt

SEQ ID NO: 7802013 - DNA, 22 bp, Homo sapiens
gtttaatcagaggaattataga

SEQ ID NO: 7802014 - DNA, 22 bp, Homo sapiens
gtggtgtttgagctgccaggga

SEQ ID NO: 7802015 - DNA, 21 bp, Homo sapiens
gtggttctagagaaacagaat

SEQ ID NO: 7802016 - DNA, 22 bp, Homo sapiens
gtgtaaaaacatactatttcta

SEQ ID NO: 7802017 - DNA, 22 bp, Homo sapiens
gtgtaaaaacatactatttcta

SEQ ID NO: 7802018 - DNA, 22 bp, Homo sapiens
gtggtttgttttattcctggaa

SEQ ID NO: 7802019 - DNA, 22 bp, Homo sapiens
gtgtcactggaatactgtctgt

SEQ ID NO: 7802020 - DNA, 22 bp, Homo sapiens
gtgtaagtatctttgtatcttt

SEQ ID NO: 7802021 - DNA, 18 bp, Homo sapiens
gtggggtgttgtgaggat

SEQ ID NO: 7802022 - DNA, 21 bp, Homo sapiens
gttattttaagtgagctttgc

SEQ ID NO: 7802023 - DNA, 21 bp, Homo sapiens
gttattttaagtgagctttgc

SEQ ID NO: 7802024 - DNA, 22 bp, Homo sapiens
gttattttaacttctcagtaat

SEQ ID NO: 7802025 - DNA, 22 bp, Homo sapiens
gttattttaacttctcagtaat

SEQ ID NO: 7802026 - DNA, 22 bp, Homo sapiens
gttattttaacttctcagtaat

SEQ ID NO: 7802027 - DNA, 22 bp, Homo sapiens
gttattttatctctgagaggtt

SEQ ID NO: 7802028 - DNA, 22 bp, Homo sapiens
gttattttatctctgagaggtt

SEQ ID NO: 7802029 - DNA, 21 bp, Homo sapiens
gttattttaagtgagctttgc

SEQ ID NO: 7802030 - DNA, 22 bp, Homo sapiens
gttattttatctctgagaggtt

SEQ ID NO: 7802031 - DNA, 22 bp, Homo sapiens
gttcaaaattcaaatggtatac

SEQ ID NO: 7802032 - DNA, 22 bp, Homo sapiens
gttattttcattggctcagact

SEQ ID NO: 7802033 - DNA, 22 bp, Homo sapiens
gttattttcattggctcagact

SEQ ID NO: 7802034 - DNA, 22 bp, Homo sapiens
gttattttcattggctcagact

SEQ ID NO: 7802035 - DNA, 22 bp, Homo sapiens
gttcaagaccagcctggccaac

SEQ ID NO: 7802036 - DNA, 22 bp, Homo sapiens
gttgtacaggcagggaaactga

SEQ ID NO: 7802037 - DNA, 22 bp, Homo sapiens
gttgtacatatgaggataagtt

SEQ ID NO: 7802038 - DNA, 22 bp, Homo sapiens
gttgtcttagtcagaaatatgc

SEQ ID NO: 7802039 - DNA, 22 bp, Homo sapiens
gttctcatagtggaaaataggt

SEQ ID NO: 7802040 - DNA, 22 bp, Homo sapiens
gttctccctgtcccctgagctt

SEQ ID NO: 7802041 - DNA, 22 bp, Homo sapiens
gttctctcagcgatagtgatgg

SEQ ID NO: 7802042 - DNA, 22 bp, Homo sapiens
gtgtccagagaaactcacagct

SEQ ID NO: 7802043 - DNA, 22 bp, Homo sapiens
gtccagtgacaagtagctggcc

SEQ ID NO: 7802044 - DNA, 22 bp, Homo sapiens
gtccagtcactgtcaatgttcc

SEQ ID NO: 7802045 - DNA, 22 bp, Homo sapiens
gtccaggtctggaccctgagcc

SEQ ID NO: 7802046 - DNA, 19 bp, Homo sapiens
gtccagtgttttccagtca

SEQ ID NO: 7802047 - DNA, 22 bp, Homo sapiens
gtccagtgtgtttatcttggat

SEQ ID NO: 7802048 - DNA, 22 bp, Homo sapiens
gtcccagggcaaggctgtttct

SEQ ID NO: 7802049 - DNA, 22 bp, Homo sapiens
gtcaggaaaaattgataatttt

SEQ ID NO: 7802050 - DNA, 22 bp, Homo sapiens
gtcaggaaaacccgggttgact

SEQ ID NO: 7802051 - DNA, 19 bp, Homo sapiens
gtcagctggaactctgaaa

SEQ ID NO: 7802052 - DNA, 22 bp, Homo sapiens
gtcaggactctgacccgtcccg

SEQ ID NO: 7802053 - DNA, 22 bp, Homo sapiens
gtcaggcagcctggagattcag

SEQ ID NO: 7802054 - DNA, 22 bp, Homo sapiens
gtcaggcatttaggatgagttc

SEQ ID NO: 7802055 - DNA, 19 bp, Homo sapiens
gtcaggcacgtgagagcat

SEQ ID NO: 7802056 - DNA, 22 bp, Homo sapiens
gtcgctgaggagatgtgcaagg

SEQ ID NO: 7802057 - DNA, 22 bp, Homo sapiens
gtctctgagctctgagctggct

SEQ ID NO: 7802058 - DNA, 22 bp, Homo sapiens
gtctggctcccactcttacaaa

SEQ ID NO: 7802059 - DNA, 22 bp, Homo sapiens
gtctggctctggaaggcaaagg

SEQ ID NO: 7802060 - DNA, 22 bp, Homo sapiens
gtctggctttgctcagatgctg

SEQ ID NO: 7802061 - DNA, 22 bp, Homo sapiens
gtctggctttatatttgctatt

SEQ ID NO: 7802062 - DNA, 22 bp, Homo sapiens
ggtgtccacattccctggcagg

SEQ ID NO: 7802063 - DNA, 22 bp, Homo sapiens
ggtggcataagaacactaaaga

SEQ ID NO: 7802064 - DNA, 22 bp, Homo sapiens
ggtggcagaggtgcatcagccc

SEQ ID NO: 7802065 - DNA, 22 bp, Homo sapiens
ggtgcaaaagtaatttggtttt

SEQ ID NO: 7802066 - DNA, 22 bp, Homo sapiens
gtaaacattactgtgctgtata

SEQ ID NO: 7802067 - DNA, 22 bp, Homo sapiens
gtaaacatgctgtgtactcagc

SEQ ID NO: 7802068 - DNA, 22 bp, Homo sapiens
gtaaaatagaataacgtggcta

SEQ ID NO: 7802069 - DNA, 22 bp, Homo sapiens
gtaaacatgctgtgtactcagc

SEQ ID NO: 7802070 - DNA, 22 bp, Homo sapiens
ggtgtcctcggattcagggcag

SEQ ID NO: 7802071 - DNA, 23 bp, Homo sapiens
gtaaaatacgcagtgcagtgtga

SEQ ID NO: 7802072 - DNA, 22 bp, Homo sapiens
gtaaatataaatgctagctgcc

SEQ ID NO: 7802073 - DNA, 22 bp, Homo sapiens
gtacatttactgatgaaaagta

SEQ ID NO: 7802074 - DNA, 19 bp, Homo sapiens
gtacagtggtaagctatga

SEQ ID NO: 7802075 - DNA, 22 bp, Homo sapiens
gtataggtttggctctctccag

SEQ ID NO: 7802076 - DNA, 22 bp, Homo sapiens
gtggattacaagacagttgaga

SEQ ID NO: 7802077 - DNA, 23 bp, Homo sapiens
gtgcgccaggacaacctgacgga

SEQ ID NO: 7802078 - DNA, 22 bp, Homo sapiens
gtgctactagtttcatttttca

SEQ ID NO: 7802079 - DNA, 22 bp, Homo sapiens
gtgggagaaattagctctagtt

SEQ ID NO: 7802080 - DNA, 22 bp, Homo sapiens
gtggcaggagactggaagatgg

SEQ ID NO: 7802081 - DNA, 22 bp, Homo sapiens
gtggcagggcaatgctccctct

SEQ ID NO: 7802082 - DNA, 22 bp, Homo sapiens
gtggcagtgggatgctatcagg

SEQ ID NO: 7802083 - DNA, 22 bp, Homo sapiens
gtggcagtgccgtttggttcag

SEQ ID NO: 7802084 - DNA, 22 bp, Homo sapiens
gtggcagttttgacatcacaaa

SEQ ID NO: 7802085 - DNA, 22 bp, Homo sapiens
gtggcagttctgtgtctcttgt

SEQ ID NO: 7802086 - DNA, 22 bp, Homo sapiens
ggcagactgtaataggagaatt

SEQ ID NO: 7802087 - DNA, 22 bp, Homo sapiens
ggcagactttttctctgaaggg

SEQ ID NO: 7802088 - DNA, 22 bp, Homo sapiens
ggcagagaatctggctgtttac

SEQ ID NO: 7802089 - DNA, 22 bp, Homo sapiens
ggcagacctctccagccccaca

SEQ ID NO: 7802090 - DNA, 22 bp, Homo sapiens
ggcacagagttggcagagctgc

SEQ ID NO: 7802091 - DNA, 22 bp, Homo sapiens
ggaggtgggagcctccagtggt

SEQ ID NO: 7802092 - DNA, 22 bp, Homo sapiens
ggaggtgggagcctccagtggt

SEQ ID NO: 7802093 - DNA, 22 bp, Homo sapiens
ggaggggtctctagcgaggaga

SEQ ID NO: 7802094 - DNA, 22 bp, Homo sapiens
ggagggggactgacactgattt

SEQ ID NO: 7802095 - DNA, 22 bp, Homo sapiens
ggaggggagtctcccaaagccg

SEQ ID NO: 7802096 - DNA, 22 bp, Homo sapiens
ggaggggaggtccagctgatct

SEQ ID NO: 7802097 - DNA, 22 bp, Homo sapiens
ggagggggaattcagccccagc

SEQ ID NO: 7802098 - DNA, 22 bp, Homo sapiens
ggaactgattaagtcatgagaa

SEQ ID NO: 7802099 - DNA, 22 bp, Homo sapiens
ggaactggagaatgccctcttt

SEQ ID NO: 7802100 - DNA, 22 bp, Homo sapiens
ggaactgaggaacgaactggga

SEQ ID NO: 7802101 - DNA, 22 bp, Homo sapiens
ggaactgggttagggtctcttc

SEQ ID NO: 7802102 - DNA, 17 bp, Homo sapiens
ggaagaaaaggatcatc

SEQ ID NO: 7802103 - DNA, 18 bp, Homo sapiens
ggaagaaaaggaactcag

SEQ ID NO: 7802104 - DNA, 22 bp, Homo sapiens
ggaagaaatctggttaagagat

SEQ ID NO: 7802105 - DNA, 22 bp, Homo sapiens
ggaagaaaggtggacaacaggt

SEQ ID NO: 7802106 - DNA, 22 bp, Homo sapiens
ggaagaaaatgggcaacaggtg

SEQ ID NO: 7802107 - DNA, 22 bp, Homo sapiens
ggaagggtttaagcaggagagt

SEQ ID NO: 7802108 - DNA, 22 bp, Homo sapiens
ggaagggtttggaaagccgaga

SEQ ID NO: 7802109 - DNA, 22 bp, Homo sapiens
ggaaggggtgtcgcccatggat

SEQ ID NO: 7802110 - DNA, 22 bp, Homo sapiens
ggaagaaatgctcttctatgcg

SEQ ID NO: 7802111 - DNA, 22 bp, Homo sapiens
ggaaacacatgatcagacatct

SEQ ID NO: 7802112 - DNA, 22 bp, Homo sapiens
gcttctggcagtgcagccacca

SEQ ID NO: 7802113 - DNA, 22 bp, Homo sapiens
ggaaaacaagagaatgatgttt

SEQ ID NO: 7802114 - DNA, 22 bp, Homo sapiens
ggaaaactgaggctctcagcag

SEQ ID NO: 7802115 - DNA, 22 bp, Homo sapiens
gcttaattctggctcagtttcc

SEQ ID NO: 7802116 - DNA, 22 bp, Homo sapiens
gcttacaagatcgtgctccagt

SEQ ID NO: 7802117 - DNA, 22 bp, Homo sapiens
gcttattttatcctattcacta

SEQ ID NO: 7802118 - DNA, 22 bp, Homo sapiens
gcttattttcaccttctctcag

SEQ ID NO: 7802119 - DNA, 22 bp, Homo sapiens
gcttctattatttggagctgag

SEQ ID NO: 7802120 - DNA, 22 bp, Homo sapiens
gcttctatccctccactgcact

SEQ ID NO: 7802121 - DNA, 22 bp, Homo sapiens
gcttcatagcattcattgcctg

SEQ ID NO: 7802122 - DNA, 22 bp, Homo sapiens
gcttcctggagggagagagctg

SEQ ID NO: 7802123 - DNA, 22 bp, Homo sapiens
gcttcacagaatcaatagttgg

SEQ ID NO: 7802124 - DNA, 22 bp, Homo sapiens
ggagatcttgcttgaaggcatg

SEQ ID NO: 7802125 - DNA, 22 bp, Homo sapiens
ggaagtgaggaaatattttgtt

SEQ ID NO: 7802126 - DNA, 22 bp, Homo sapiens
ggaagtagaggtcattctgaat

SEQ ID NO: 7802127 - DNA, 22 bp, Homo sapiens
ggaagtagaagtaatgaaatca

SEQ ID NO: 7802128 - DNA, 22 bp, Homo sapiens
ggagaaggaagaaagctactat

SEQ ID NO: 7802129 - DNA, 22 bp, Homo sapiens
ggaggccagggtgggtggatcg

SEQ ID NO: 7802130 - DNA, 22 bp, Homo sapiens
ggaggccagcctgaggctgagg

SEQ ID NO: 7802131 - DNA, 22 bp, Homo sapiens
ggaggcagaatagagtgtgggt

SEQ ID NO: 7802132 - DNA, 22 bp, Homo sapiens
ggaggaggcggcagaagttcct

SEQ ID NO: 7802133 - DNA, 22 bp, Homo sapiens
ggaggaggcaagtaccagatgc

SEQ ID NO: 7802134 - DNA, 22 bp, Homo sapiens
ggaggaaatccttagtaaggca

SEQ ID NO: 7802135 - DNA, 22 bp, Homo sapiens
ggagctgagttcttcagccggg

SEQ ID NO: 7802136 - DNA, 22 bp, Homo sapiens
ggagctgaggctgaggcctcac

SEQ ID NO: 7802137 - DNA, 22 bp, Homo sapiens
ggagctgaaggggtgggctcag

SEQ ID NO: 7802138 - DNA, 22 bp, Homo sapiens
ggagctgagacccagtggctga

SEQ ID NO: 7802139 - DNA, 22 bp, Homo sapiens
ggagctgaaccccatcgtgctg

SEQ ID NO: 7802140 - DNA, 22 bp, Homo sapiens
ggagctgaaccccatcgtgctg

SEQ ID NO: 7802141 - DNA, 22 bp, Homo sapiens
ggaggaaatgaaaggagggttt

SEQ ID NO: 7802142 - DNA, 22 bp, Homo sapiens
ggaggacaggggctgcagcaca

SEQ ID NO: 7802143 - DNA, 22 bp, Homo sapiens
ggaggacactggctctgccttc

SEQ ID NO: 7802144 - DNA, 22 bp, Homo sapiens
ggcccaaggcccaggtcgagct

SEQ ID NO: 7802145 - DNA, 19 bp, Homo sapiens
ggcccctctcacaggagtt

SEQ ID NO: 7802146 - DNA, 22 bp, Homo sapiens
ggccagaggccacagctgtgtc

SEQ ID NO: 7802147 - DNA, 22 bp, Homo sapiens
ggctcaggactgcagcgtagag

SEQ ID NO: 7802148 - DNA, 22 bp, Homo sapiens
ggccttgagcagggagaaacca

SEQ ID NO: 7802149 - DNA, 22 bp, Homo sapiens
ggccttgagagccagtgcaggc

SEQ ID NO: 7802150 - DNA, 22 bp, Homo sapiens
ggccttgacagttaagagacct

SEQ ID NO: 7802151 - DNA, 19 bp, Homo sapiens
ggccttgatgagtggggag

SEQ ID NO: 7802152 - DNA, 22 bp, Homo sapiens
ggccttgatgttcttgggagat

SEQ ID NO: 7802153 - DNA, 22 bp, Homo sapiens
ggccttgatcctccagagcact

SEQ ID NO: 7802154 - DNA, 22 bp, Homo sapiens
ggccttgatctctctaactgct

SEQ ID NO: 7802155 - DNA, 22 bp, Homo sapiens
ggccctctgctcacttcctatt

SEQ ID NO: 7802156 - DNA, 22 bp, Homo sapiens
ggccctctgtggctgccatgga

SEQ ID NO: 7802157 - DNA, 22 bp, Homo sapiens
ggccctcttttatccatcataa

SEQ ID NO: 7802158 - DNA, 22 bp, Homo sapiens
ggctttgtggggtgaagtaaag

SEQ ID NO: 7802159 - DNA, 22 bp, Homo sapiens
ggctttgtggggtgaagtaaag

SEQ ID NO: 7802160 - DNA, 19 bp, Homo sapiens
ggcttcgaggctggggaag

SEQ ID NO: 7802161 - DNA, 22 bp, Homo sapiens
gggaacagagtgccagactgac

SEQ ID NO: 7802162 - DNA, 22 bp, Homo sapiens
ggctgctctgccttccagctgg

SEQ ID NO: 7802163 - DNA, 23 bp, Homo sapiens
ggctgctcttttcatgctgtttc

SEQ ID NO: 7802164 - DNA, 22 bp, Homo sapiens
ggctgagttgagaggattactt

SEQ ID NO: 7802165 - DNA, 22 bp, Homo sapiens
gggcggatcatttgaggtcagg

SEQ ID NO: 7802166 - DNA, 22 bp, Homo sapiens
gggcggatcatttgaggtcagg

SEQ ID NO: 7802167 - DNA, 22 bp, Homo sapiens
gggcggatcatttgaggtcagg

SEQ ID NO: 7802168 - DNA, 22 bp, Homo sapiens
gggcggatcacctgaggtcagg

SEQ ID NO: 7802169 - DNA, 22 bp, Homo sapiens
gggcggatcacctgaggtcagg

SEQ ID NO: 7802170 - DNA, 22 bp, Homo sapiens
gggcggatcacctgaggtcagg

SEQ ID NO: 7802171 - DNA, 22 bp, Homo sapiens
gggccaggtatcgtctttagta

SEQ ID NO: 7802172 - DNA, 22 bp, Homo sapiens
gggccaggagtggagatatggg

SEQ ID NO: 7802173 - DNA, 22 bp, Homo sapiens
gggccaggtcggtgaatggtca

SEQ ID NO: 7802174 - DNA, 22 bp, Homo sapiens
gggccaggtggaccccagcctc

SEQ ID NO: 7802175 - DNA, 22 bp, Homo sapiens
gggaccagtgtctgtgagaaaa

SEQ ID NO: 7802176 - DNA, 22 bp, Homo sapiens
gggaccctgggaggctggcgca

SEQ ID NO: 7802177 - DNA, 19 bp, Homo sapiens
gggacctgactaattggca

SEQ ID NO: 7802178 - DNA, 22 bp, Homo sapiens
gggacctgaggaggggtttcag

SEQ ID NO: 7802179 - DNA, 22 bp, Homo sapiens
gggacctgggccagaggacagt

SEQ ID NO: 7802180 - DNA, 22 bp, Homo sapiens
gggacctgggccagaggacagt

SEQ ID NO: 7802181 - DNA, 22 bp, Homo sapiens
gggacctggcgagggtcacaca

SEQ ID NO: 7802182 - DNA, 22 bp, Homo sapiens
gggacctggcacctttgctctg

SEQ ID NO: 7802183 - DNA, 23 bp, Homo sapiens
gggacctggtaggaggtgattgg

SEQ ID NO: 7802184 - DNA, 22 bp, Homo sapiens
gggacctggtctagcactgagc

SEQ ID NO: 7802185 - DNA, 22 bp, Homo sapiens
gggacctggggactccttgttc

SEQ ID NO: 7802186 - DNA, 22 bp, Homo sapiens
gggacctgccattgctcacagg

SEQ ID NO: 7802187 - DNA, 22 bp, Homo sapiens
gggacctgccaaggccacccag

SEQ ID NO: 7802188 - DNA, 22 bp, Homo sapiens
gggacctgaggccctgctccac

SEQ ID NO: 7802189 - DNA, 22 bp, Homo sapiens
gggacctggacatgtgtgtgct

SEQ ID NO: 7802190 - DNA, 22 bp, Homo sapiens
gggacctgcgccactcactgtc

SEQ ID NO: 7802191 - DNA, 22 bp, Homo sapiens
gggacgagatcttggcagtgtg

SEQ ID NO: 7802192 - DNA, 22 bp, Homo sapiens
gggagaaggagctagttcttga

SEQ ID NO: 7802193 - DNA, 22 bp, Homo sapiens
gggagggaaggaggcgccgtgt

SEQ ID NO: 7802194 - DNA, 22 bp, Homo sapiens
gggatggagggtagagcaagtg

SEQ ID NO: 7802195 - DNA, 22 bp, Homo sapiens
gggatggatcttggctgaggct

SEQ ID NO: 7802196 - DNA, 22 bp, Homo sapiens
gggatggggagctggaaagggg

SEQ ID NO: 7802197 - DNA, 22 bp, Homo sapiens
gggtctctcatgcagttgctgt

SEQ ID NO: 7802198 - DNA, 22 bp, Homo sapiens
gggtctctcctccccagctgtg

SEQ ID NO: 7802199 - DNA, 22 bp, Homo sapiens
gggtctctcctccccagctgtg

SEQ ID NO: 7802200 - DNA, 22 bp, Homo sapiens
gggtctggcatgctgagatgga

SEQ ID NO: 7802201 - DNA, 19 bp, Homo sapiens
ggggagaactagagacagc

SEQ ID NO: 7802202 - DNA, 22 bp, Homo sapiens
gggggctctgactccctcagct

SEQ ID NO: 7802203 - DNA, 22 bp, Homo sapiens
ggggacctggccacccatcctt

SEQ ID NO: 7802204 - DNA, 22 bp, Homo sapiens
ggggaccttcccagagcagttg

SEQ ID NO: 7802205 - DNA, 22 bp, Homo sapiens
ggggacctgggcttcaagggtt

SEQ ID NO: 7802206 - DNA, 22 bp, Homo sapiens
ggggacctaggctctgtctctt

SEQ ID NO: 7802207 - DNA, 22 bp, Homo sapiens
ggggacctttccatttctgaga

SEQ ID NO: 7802208 - DNA, 22 bp, Homo sapiens
gggggtcccaagctgggctgct

SEQ ID NO: 7802209 - DNA, 22 bp, Homo sapiens
ggggtactggctggagccccac

SEQ ID NO: 7802210 - DNA, 22 bp, Homo sapiens
ggggaccctcaggactgcgtct

SEQ ID NO: 7802211 - DNA, 20 bp, Homo sapiens
gggctaggtagccatttggc

SEQ ID NO: 7802212 - DNA, 22 bp, Homo sapiens
gctcctggccagcacagggccc

SEQ ID NO: 7802213 - DNA, 22 bp, Homo sapiens
gctcctggcaggcagtgtgtgt

SEQ ID NO: 7802214 - DNA, 22 bp, Homo sapiens
gctcctggcatcctgcttttaa

SEQ ID NO: 7802215 - DNA, 22 bp, Homo sapiens
gctcctggctccaggcagccaa

SEQ ID NO: 7802216 - DNA, 22 bp, Homo sapiens
gctcctggctctctgagggctg

SEQ ID NO: 7802217 - DNA, 22 bp, Homo sapiens
gctccaggagagggaagcagat

SEQ ID NO: 7802218 - DNA, 22 bp, Homo sapiens
gctccaggaggatgaccttcct

SEQ ID NO: 7802219 - DNA, 22 bp, Homo sapiens
gctcatgactgtaatcccagca

SEQ ID NO: 7802220 - DNA, 22 bp, Homo sapiens
gcctgtttactttgccgcagga

SEQ ID NO: 7802221 - DNA, 22 bp, Homo sapiens
gcctgtttatctatcatgaact

SEQ ID NO: 7802222 - DNA, 22 bp, Homo sapiens
gcctgtttccatcaacacatgc

SEQ ID NO: 7802223 - DNA, 22 bp, Homo sapiens
gcctgtttccctgacgcttaca

SEQ ID NO: 7802224 - DNA, 22 bp, Homo sapiens
gcctgtttctcctccttggccc

SEQ ID NO: 7802225 - DNA, 22 bp, Homo sapiens
gcctgtttctaatctcatttct

SEQ ID NO: 7802226 - DNA, 22 bp, Homo sapiens
gcctgtttgagaatagtcaggg

SEQ ID NO: 7802227 - DNA, 22 bp, Homo sapiens
gcctgtttgactggtctctgct

SEQ ID NO: 7802228 - DNA, 22 bp, Homo sapiens
gcctgtttggaatctgtttaat

SEQ ID NO: 7802229 - DNA, 22 bp, Homo sapiens
gcctgtttggcatcattggttg

SEQ ID NO: 7802230 - DNA, 22 bp, Homo sapiens
gcctgtttggctgctgacattg

SEQ ID NO: 7802231 - DNA, 22 bp, Homo sapiens
gcctgtttgttatgtcatggta

SEQ ID NO: 7802232 - DNA, 22 bp, Homo sapiens
gcctgttttagatgcattgatg

SEQ ID NO: 7802233 - DNA, 22 bp, Homo sapiens
gcctgtttgtttgcaaaggagc

SEQ ID NO: 7802234 - DNA, 22 bp, Homo sapiens
gcctgttttcctgctgtggttg

SEQ ID NO: 7802235 - DNA, 22 bp, Homo sapiens
gcctgtttttgcttcgtttaag

SEQ ID NO: 7802236 - DNA, 16 bp, Homo sapiens
gctcctgggccctcga

SEQ ID NO: 7802237 - DNA, 22 bp, Homo sapiens
gctcctgggccctgggctaact

SEQ ID NO: 7802238 - DNA, 19 bp, Homo sapiens
gctcctgggcctcactcat

SEQ ID NO: 7802239 - DNA, 22 bp, Homo sapiens
gctcctggcttcactgacatca

SEQ ID NO: 7802240 - DNA, 22 bp, Homo sapiens
gctcctggctctggccaaggga

SEQ ID NO: 7802241 - DNA, 22 bp, Homo sapiens
gctcctgggctctaccttgcta

SEQ ID NO: 7802242 - DNA, 22 bp, Homo sapiens
gctcctgggtgtggctgcccct

SEQ ID NO: 7802243 - DNA, 22 bp, Homo sapiens
gctcctgggtgtggctgcccct

SEQ ID NO: 7802244 - DNA, 18 bp, Homo sapiens
gctgaaattctaaacaaa

SEQ ID NO: 7802245 - DNA, 22 bp, Homo sapiens
gctgaaattcagattcctaggc

SEQ ID NO: 7802246 - DNA, 22 bp, Homo sapiens
gctgaaattagactgcagaagt

SEQ ID NO: 7802247 - DNA, 22 bp, Homo sapiens
gctgaaatgtctttagcagtgt

SEQ ID NO: 7802248 - DNA, 22 bp, Homo sapiens
gctgaaatgggcactgaaggcc

SEQ ID NO: 7802249 - DNA, 22 bp, Homo sapiens
gctcttctaaagaatgtacagg

SEQ ID NO: 7802250 - DNA, 22 bp, Homo sapiens
gctggccttgtgtctgaggaag

SEQ ID NO: 7802251 - DNA, 22 bp, Homo sapiens
gctgaggcaagatttgaaccca

SEQ ID NO: 7802252 - DNA, 22 bp, Homo sapiens
gctgaggattgaagagttgcca

SEQ ID NO: 7802253 - DNA, 22 bp, Homo sapiens
gctgctctcagagctcatgctg

SEQ ID NO: 7802254 - DNA, 22 bp, Homo sapiens
gctgctctggctctgcagtgtc

SEQ ID NO: 7802255 - DNA, 22 bp, Homo sapiens
gctgctctacccatgcatctgt

SEQ ID NO: 7802256 - DNA, 22 bp, Homo sapiens
gctgctctgttaattgctgtaa

SEQ ID NO: 7802257 - DNA, 18 bp, Homo sapiens
gcctgccaactcctgatc

SEQ ID NO: 7802258 - DNA, 22 bp, Homo sapiens
gcctgcttcctagccttccaag

SEQ ID NO: 7802259 - DNA, 22 bp, Homo sapiens
gcctggacaccgcccttgcaga

SEQ ID NO: 7802260 - DNA, 22 bp, Homo sapiens
gcctggcaggcctgggccagca

SEQ ID NO: 7802261 - DNA, 22 bp, Homo sapiens
gcctggcaggcctgttggggct

SEQ ID NO: 7802262 - DNA, 22 bp, Homo sapiens
gcctggcatatagtagttgtgc

SEQ ID NO: 7802263 - DNA, 22 bp, Homo sapiens
gcctggcaggggcctgggagtg

SEQ ID NO: 7802264 - DNA, 21 bp, Homo sapiens
gcctggcaggtggaagggctc

SEQ ID NO: 7802265 - DNA, 22 bp, Homo sapiens
gcctgggaaatggtggggtcag

SEQ ID NO: 7802266 - DNA, 22 bp, Homo sapiens
gcctggcctgaactaggaggtg

SEQ ID NO: 7802267 - DNA, 22 bp, Homo sapiens
gcctggccgggtcttggatttt

SEQ ID NO: 7802268 - DNA, 22 bp, Homo sapiens
gcctgtttaagtattctgacat

SEQ ID NO: 7802269 - DNA, 22 bp, Homo sapiens
gccattgagattgaagtaagca

SEQ ID NO: 7802270 - DNA, 22 bp, Homo sapiens
gccattgggctgtagttttttg

SEQ ID NO: 7802271 - DNA, 22 bp, Homo sapiens
gccattgatgtgaaagtaagac

SEQ ID NO: 7802272 - DNA, 22 bp, Homo sapiens
gcccaggctggagtgcagtagc

SEQ ID NO: 7802273 - DNA, 18 bp, Homo sapiens
gccagtgggtccaggtgc

SEQ ID NO: 7802274 - DNA, 22 bp, Homo sapiens
gccagggaaactgcagaccagc

SEQ ID NO: 7802275 - DNA, 22 bp, Homo sapiens
gccagtgggacccgctgtgggc

SEQ ID NO: 7802276 - DNA, 22 bp, Homo sapiens
gccatatacccactgtctccat

SEQ ID NO: 7802277 - DNA, 22 bp, Homo sapiens
gccaggctgctggctgctgtcc

SEQ ID NO: 7802278 - DNA, 22 bp, Homo sapiens
gccaggctcttggttatgtttt

SEQ ID NO: 7802279 - DNA, 22 bp, Homo sapiens
gccctctcttctgcagcctcca

SEQ ID NO: 7802280 - DNA, 22 bp, Homo sapiens
gcccttggaacagcctcctgct

SEQ ID NO: 7802281 - DNA, 20 bp, Homo sapiens
gccctcagtcttgtctttat

SEQ ID NO: 7802282 - DNA, 22 bp, Homo sapiens
gccctctcggcatagcaggggc

SEQ ID NO: 7802283 - DNA, 22 bp, Homo sapiens
gccctcagctcctggacacatg

SEQ ID NO: 7802284 - DNA, 22 bp, Homo sapiens
gccggggctggggagagacatg

SEQ ID NO: 7802285 - DNA, 22 bp, Homo sapiens
gccgggaccaaggccacggagc

SEQ ID NO: 7802286 - DNA, 22 bp, Homo sapiens
gcctcctgttatgccatgtgcc

SEQ ID NO: 7802287 - DNA, 22 bp, Homo sapiens
gatggccttgttttctcccttc

SEQ ID NO: 7802288 - DNA, 22 bp, Homo sapiens
gatggcctgggtccccttccgg

SEQ ID NO: 7802289 - DNA, 22 bp, Homo sapiens
gatgggcgtggcgcgtttggtg

SEQ ID NO: 7802290 - DNA, 22 bp, Homo sapiens
gatgcctggcacccagcaagga

SEQ ID NO: 7802291 - DNA, 22 bp, Homo sapiens
gatgcctgtggtgagcacacat

SEQ ID NO: 7802292 - DNA, 22 bp, Homo sapiens
gattgtggaagtcagtggttct

SEQ ID NO: 7802293 - DNA, 22 bp, Homo sapiens
gatttacaaagctctctagtgt

SEQ ID NO: 7802294 - DNA, 22 bp, Homo sapiens
gatttatttttaatcagcaggg

SEQ ID NO: 7802295 - DNA, 22 bp, Homo sapiens
gatttattgtccctgtcctgct

SEQ ID NO: 7802296 - DNA, 22 bp, Homo sapiens
gattctttacatctctgctgac

SEQ ID NO: 7802297 - DNA, 22 bp, Homo sapiens
gattctttagcccagaaagtta

SEQ ID NO: 7802298 - DNA, 22 bp, Homo sapiens
gattctttactcagattttgtt

SEQ ID NO: 7802299 - DNA, 22 bp, Homo sapiens
gattctttggcctttattgaca

SEQ ID NO: 7802300 - DNA, 22 bp, Homo sapiens
gattctttgacagggtgttggg

SEQ ID NO: 7802301 - DNA, 22 bp, Homo sapiens
gattagttgattaagagtcaga

SEQ ID NO: 7802302 - DNA, 22 bp, Homo sapiens
gattagatgactaatgagctgt

SEQ ID NO: 7802303 - DNA, 22 bp, Homo sapiens
gattaagagaagtttcttatcg

SEQ ID NO: 7802304 - DNA, 22 bp, Homo sapiens
gatgtttggctcaaacgagtgt

SEQ ID NO: 7802305 - DNA, 22 bp, Homo sapiens
gatgtttatatctaacttaagt

SEQ ID NO: 7802306 - DNA, 22 bp, Homo sapiens
gcaaacatgtgctcattttgtg

SEQ ID NO: 7802307 - DNA, 22 bp, Homo sapiens
gcaaacatctttatttggcaag

SEQ ID NO: 7802308 - DNA, 22 bp, Homo sapiens
gcaaacatgctgagaaataaga

SEQ ID NO: 7802309 - DNA, 22 bp, Homo sapiens
gatttttatataaagtgagaaa

SEQ ID NO: 7802310 - DNA, 22 bp, Homo sapiens
gattttgtcaaattccaaatgt

SEQ ID NO: 7802311 - DNA, 22 bp, Homo sapiens
gattttctgagccttcaaattt

SEQ ID NO: 7802312 - DNA, 22 bp, Homo sapiens
gatttcttgataattcaaatcc

SEQ ID NO: 7802313 - DNA, 22 bp, Homo sapiens
gatttgtttcaagttagcatct

SEQ ID NO: 7802314 - DNA, 21 bp, Homo sapiens
gattttaaagagactgccaca

SEQ ID NO: 7802315 - DNA, 22 bp, Homo sapiens
gattttcatgataaacttgtga

SEQ ID NO: 7802316 - DNA, 22 bp, Homo sapiens
gattttcattatagctagtttc

SEQ ID NO: 7802317 - DNA, 22 bp, Homo sapiens
gattttcatttgcactctagaa

SEQ ID NO: 7802318 - DNA, 22 bp, Homo sapiens
gcagaagctgggcagcgaggtg

SEQ ID NO: 7802319 - DNA, 22 bp, Homo sapiens
gcagaacaacgtaggagtggag

SEQ ID NO: 7802320 - DNA, 17 bp, Homo sapiens
gcagaaaagtcaaggga

SEQ ID NO: 7802321 - DNA, 22 bp, Homo sapiens
gcactttgtggattgtatttcc

SEQ ID NO: 7802322 - DNA, 22 bp, Homo sapiens
gcagagcagtgcttgcccagcg

SEQ ID NO: 7802323 - DNA, 22 bp, Homo sapiens
gcagagccatgggaggtttttg

SEQ ID NO: 7802324 - DNA, 22 bp, Homo sapiens
gcaccgccttggaccgcccgct

SEQ ID NO: 7802325 - DNA, 22 bp, Homo sapiens
gcacccagtttgtctcagggtt

SEQ ID NO: 7802326 - DNA, 22 bp, Homo sapiens
gcacccagggacttggctggcc

SEQ ID NO: 7802327 - DNA, 22 bp, Homo sapiens
gcacccaggcttgggcagcaac

SEQ ID NO: 7802328 - DNA, 22 bp, Homo sapiens
gcacaataatttttttaagagg

SEQ ID NO: 7802329 - DNA, 22 bp, Homo sapiens
gcacccaggccggcgactgcag

SEQ ID NO: 7802330 - DNA, 19 bp, Homo sapiens
gcagtgtcatggtaggagc

SEQ ID NO: 7802331 - DNA, 22 bp, Homo sapiens
gcagtgtcagtgcctgggtggt

SEQ ID NO: 7802332 - DNA, 21 bp, Homo sapiens
gcagtgtcatggtttcaagtt

SEQ ID NO: 7802333 - DNA, 22 bp, Homo sapiens
gcagtgtccagggtggtctgca

SEQ ID NO: 7802334 - DNA, 22 bp, Homo sapiens
gcagtgtctttgacctccaccc

SEQ ID NO: 7802335 - DNA, 22 bp, Homo sapiens
gcagtagtgtcagtacagcaaa

SEQ ID NO: 7802336 - DNA, 22 bp, Homo sapiens
gccacagcttagatcacagcct

SEQ ID NO: 7802337 - DNA, 22 bp, Homo sapiens
gccagatgtagatagcaaggta

SEQ ID NO: 7802338 - DNA, 22 bp, Homo sapiens
gccagcagccacagaagtcact

SEQ ID NO: 7802339 - DNA, 21 bp, Homo sapiens
gcattaaaagcagttgttggt

SEQ ID NO: 7802340 - DNA, 22 bp, Homo sapiens
gcatggcttctgccaggcacct

SEQ ID NO: 7802341 - DNA, 22 bp, Homo sapiens
gcatgtctgtaattacagagcc

SEQ ID NO: 7802342 - DNA, 22 bp, Homo sapiens
gcatgtaatcactctaggaagg

SEQ ID NO: 7802343 - DNA, 22 bp, Homo sapiens
gcagctcagtaaaagaggagca

SEQ ID NO: 7802344 - DNA, 22 bp, Homo sapiens
gcagagccgtgaatggatttca

SEQ ID NO: 7802345 - DNA, 22 bp, Homo sapiens
gcagagcctgacgggatttttc

SEQ ID NO: 7802346 - DNA, 22 bp, Homo sapiens
gcaggagctgctctcctgacga

SEQ ID NO: 7802347 - DNA, 22 bp, Homo sapiens
gcaggagttagggtaaaaatga

SEQ ID NO: 7802348 - DNA, 22 bp, Homo sapiens
gcaggagccaggccgagctggt

SEQ ID NO: 7802349 - DNA, 22 bp, Homo sapiens
gcaggagttcaattgcccatga

SEQ ID NO: 7802350 - DNA, 19 bp, Homo sapiens
gcaggcacagccctgggtg

SEQ ID NO: 7802351 - DNA, 22 bp, Homo sapiens
gcaggggctaaggacacagaga

SEQ ID NO: 7802352 - DNA, 22 bp, Homo sapiens
gcagggaccttgcccaccctcc

SEQ ID NO: 7802353 - DNA, 22 bp, Homo sapiens
gcagggacgcagcactctccgt

SEQ ID NO: 7802354 - DNA, 22 bp, Homo sapiens
gatcatgtgatttgaagtaatg

SEQ ID NO: 7802355 - DNA, 22 bp, Homo sapiens
gatcagtaagtgaataatgagt

SEQ ID NO: 7802356 - DNA, 22 bp, Homo sapiens
gatcaatactattaagatcata

SEQ ID NO: 7802357 - DNA, 22 bp, Homo sapiens
gatattttgagaaatcctatga

SEQ ID NO: 7802358 - DNA, 22 bp, Homo sapiens
gatagtcacctcccttaacttt

SEQ ID NO: 7802359 - DNA, 19 bp, Homo sapiens
gatagctgatgaccatcat

SEQ ID NO: 7802360 - DNA, 22 bp, Homo sapiens
gataagcactatataagtattt

SEQ ID NO: 7802361 - DNA, 22 bp, Homo sapiens
gatgaaaatcttgagatgtcga

SEQ ID NO: 7802362 - DNA, 22 bp, Homo sapiens
gatgattttgatgcagtaaaga

SEQ ID NO: 7802363 - DNA, 22 bp, Homo sapiens
gatgaaggggctggtgccctct

SEQ ID NO: 7802364 - DNA, 22 bp, Homo sapiens
gagtgtggatcccagaagcaga

SEQ ID NO: 7802365 - DNA, 22 bp, Homo sapiens
gagttaaaaatgcctccatgga

SEQ ID NO: 7802366 - DNA, 22 bp, Homo sapiens
gagtgtgtgcatgatctcttat

SEQ ID NO: 7802367 - DNA, 22 bp, Homo sapiens
gagtgtgtgacttcactttagc

SEQ ID NO: 7802368 - DNA, 22 bp, Homo sapiens
gagttaaaggaaaataacttta

SEQ ID NO: 7802369 - DNA, 22 bp, Homo sapiens
gagtgtcagtgcctggcttgtt

SEQ ID NO: 7802370 - DNA, 22 bp, Homo sapiens
gagttgatcattatttggtttc

SEQ ID NO: 7802371 - DNA, 22 bp, Homo sapiens
gataaattatcaggggtttaaa

SEQ ID NO: 7802372 - DNA, 20 bp, Homo sapiens
gataaattgtctcttaagtg

SEQ ID NO: 7802373 - DNA, 22 bp, Homo sapiens
gataaattgcactttttcttac

SEQ ID NO: 7802374 - DNA, 19 bp, Homo sapiens
gagtcctgtgctccttgtt

SEQ ID NO: 7802375 - DNA, 22 bp, Homo sapiens
gagtctaagtagaatgtgaaaa

SEQ ID NO: 7802376 - DNA, 22 bp, Homo sapiens
gagtctaaggaaaaatagagta

SEQ ID NO: 7802377 - DNA, 22 bp, Homo sapiens
gagtctctgctatgttttctct

SEQ ID NO: 7802378 - DNA, 22 bp, Homo sapiens
gagtcttaggcaaaaataatgg

SEQ ID NO: 7802379 - DNA, 22 bp, Homo sapiens
gagtgagggcagcaggggctgc

SEQ ID NO: 7802380 - DNA, 22 bp, Homo sapiens
gagtgcatggactactggcttg

SEQ ID NO: 7802381 - DNA, 22 bp, Homo sapiens
gagtgctcctggatggatttcc

SEQ ID NO: 7802382 - DNA, 22 bp, Homo sapiens
gagtgctccgtcttggacaggg

SEQ ID NO: 7802383 - DNA, 22 bp, Homo sapiens
gagtgctcgggcctctgcctgc

SEQ ID NO: 7802384 - DNA, 20 bp, Homo sapiens
gagtcacagaagaagctgaa

SEQ ID NO: 7802385 - DNA, 22 bp, Homo sapiens
gagtcagaaactcactctatag

SEQ ID NO: 7802386 - DNA, 22 bp, Homo sapiens
gagtcagaagaaactatttaca

SEQ ID NO: 7802387 - DNA, 22 bp, Homo sapiens
gagtcagaattgtattttaaac

SEQ ID NO: 7802388 - DNA, 22 bp, Homo sapiens
gagtcagatgaagataaaaggg

SEQ ID NO: 7802389 - DNA, 22 bp, Homo sapiens
gagtcaggagtcctgtgtgaga

SEQ ID NO: 7802390 - DNA, 22 bp, Homo sapiens
gagtcaggatgcaaggggatgg

SEQ ID NO: 7802391 - DNA, 22 bp, Homo sapiens
gagtcaggcatgaaggtaatta

SEQ ID NO: 7802392 - DNA, 22 bp, Homo sapiens
gagtcaggctagaggtgagtct

SEQ ID NO: 7802393 - DNA, 22 bp, Homo sapiens
gagggtgtctgcgtaactggca

SEQ ID NO: 7802394 - DNA, 22 bp, Homo sapiens
gaggggcacagtaaagggtccc

SEQ ID NO: 7802395 - DNA, 22 bp, Homo sapiens
gaggggatgcagagaggcttat

SEQ ID NO: 7802396 - DNA, 22 bp, Homo sapiens
gaggcctgaggctgcctggagc

SEQ ID NO: 7802397 - DNA, 22 bp, Homo sapiens
gaggcctgcagcgtggtccctg

SEQ ID NO: 7802398 - DNA, 22 bp, Homo sapiens
gagggatgcagaaacagaggcc

SEQ ID NO: 7802399 - DNA, 22 bp, Homo sapiens
gagggatggtagttgacactga

SEQ ID NO: 7802400 - DNA, 22 bp, Homo sapiens
gagagtctaggaacctcatata

SEQ ID NO: 7802401 - DNA, 22 bp, Homo sapiens
gagagtctagtgcacctagttt

SEQ ID NO: 7802402 - DNA, 22 bp, Homo sapiens
gagagttcttgcctgggtatta

SEQ ID NO: 7802403 - DNA, 22 bp, Homo sapiens
gagatcatcttttttagattcc

SEQ ID NO: 7802404 - DNA, 22 bp, Homo sapiens
gagctggaggcagtgctgaggt

SEQ ID NO: 7802405 - DNA, 22 bp, Homo sapiens
gaggacagagccgcctggcaag

SEQ ID NO: 7802406 - DNA, 20 bp, Homo sapiens
gaggcctcagcctcagctcc

SEQ ID NO: 7802407 - DNA, 18 bp, Homo sapiens
gaggcctgagaaccaggt

SEQ ID NO: 7802408 - DNA, 22 bp, Homo sapiens
gaggcctgaaaggggacctatg

SEQ ID NO: 7802409 - DNA, 22 bp, Homo sapiens
gaggcctcctctgagacatctg

SEQ ID NO: 7802410 - DNA, 23 bp, Homo sapiens
gaggcagctcctgcagtgccctg

SEQ ID NO: 7802411 - DNA, 22 bp, Homo sapiens
gaggaggtggagtcatgcagag

SEQ ID NO: 7802412 - DNA, 22 bp, Homo sapiens
gaggagggttggccttaggtag

SEQ ID NO: 7802413 - DNA, 22 bp, Homo sapiens
gaggaggtcccccgacatgcct

SEQ ID NO: 7802414 - DNA, 22 bp, Homo sapiens
gaggaggtcgctgctgagcccc

SEQ ID NO: 7802415 - DNA, 22 bp, Homo sapiens
gaggagggagaattaggcttaa

SEQ ID NO: 7802416 - DNA, 22 bp, Homo sapiens
gacccagggtggtcacctgaaa

SEQ ID NO: 7802417 - DNA, 22 bp, Homo sapiens
gacccagggtatccagagctgc

SEQ ID NO: 7802418 - DNA, 22 bp, Homo sapiens
gacccaggcccaaggctgccag

SEQ ID NO: 7802419 - DNA, 18 bp, Homo sapiens
gacccagcagatgggctt

SEQ ID NO: 7802420 - DNA, 22 bp, Homo sapiens
gacccagaaggagtgccctaga

SEQ ID NO: 7802421 - DNA, 22 bp, Homo sapiens
gacccagctaaccaggtgggga

SEQ ID NO: 7802422 - DNA, 22 bp, Homo sapiens
gacccagcctggtttttatagg

SEQ ID NO: 7802423 - DNA, 22 bp, Homo sapiens
gacccagcttaagtcacatgtt

SEQ ID NO: 7802424 - DNA, 22 bp, Homo sapiens
gaccatcctggccaacgtggta

SEQ ID NO: 7802425 - DNA, 22 bp, Homo sapiens
gactttaaaagtttgtgcttgg

SEQ ID NO: 7802426 - DNA, 22 bp, Homo sapiens
gacttcttcatgtcttttccac

SEQ ID NO: 7802427 - DNA, 22 bp, Homo sapiens
gacttcctaagattcaggaatg

SEQ ID NO: 7802428 - DNA, 22 bp, Homo sapiens
gacttcaaaagctgacattcat

SEQ ID NO: 7802429 - DNA, 22 bp, Homo sapiens
gactggaaagcctgtcctcaga

SEQ ID NO: 7802430 - DNA, 22 bp, Homo sapiens
gactgtggggggcggacacaag

SEQ ID NO: 7802431 - DNA, 22 bp, Homo sapiens
gagaaaatcttgggtcaagaat

SEQ ID NO: 7802432 - DNA, 22 bp, Homo sapiens
gagaaaatgtcagacttggtcg

SEQ ID NO: 7802433 - DNA, 22 bp, Homo sapiens
gagacacacattctggagagaa

SEQ ID NO: 7802434 - DNA, 22 bp, Homo sapiens
gaattcttttctttctgaaagt

SEQ ID NO: 7802435 - DNA, 23 bp, Homo sapiens
gaattcttaaggtcactaaagtc

SEQ ID NO: 7802436 - DNA, 22 bp, Homo sapiens
gaattagacatgctttgctttt

SEQ ID NO: 7802437 - DNA, 22 bp, Homo sapiens
gaagttcaactgccatgcttgg

SEQ ID NO: 7802438 - DNA, 22 bp, Homo sapiens
gaagtgaagagattagaaatca

SEQ ID NO: 7802439 - DNA, 22 bp, Homo sapiens
gaagtgaaggttactctagatt

SEQ ID NO: 7802440 - DNA, 22 bp, Homo sapiens
gaaggaagtcattagtgcagac

SEQ ID NO: 7802441 - DNA, 22 bp, Homo sapiens
gaaggcctagggatgctctgcg

SEQ ID NO: 7802442 - DNA, 22 bp, Homo sapiens
gaaggagagggtcaaggataat

SEQ ID NO: 7802443 - DNA, 22 bp, Homo sapiens
cttttacactcatctgggaggg

SEQ ID NO: 7802444 - DNA, 22 bp, Homo sapiens
ctttgttatctgtaaatggtta

SEQ ID NO: 7802445 - DNA, 22 bp, Homo sapiens
ctttgtcattttgtctctcagt

SEQ ID NO: 7802446 - DNA, 22 bp, Homo sapiens
ctttgtgtctgttaataattat

SEQ ID NO: 7802447 - DNA, 22 bp, Homo sapiens
gaaaacatccagagatagacct

SEQ ID NO: 7802448 - DNA, 22 bp, Homo sapiens
gaaaagagtcctgtgtgaggag

SEQ ID NO: 7802449 - DNA, 21 bp, Homo sapiens
gaaaagcaagggagtagaaca

SEQ ID NO: 7802450 - DNA, 22 bp, Homo sapiens
gaaaagtatgtttattttgact

SEQ ID NO: 7802451 - DNA, 22 bp, Homo sapiens
gaaaagtatgtttattttgact

SEQ ID NO: 7802452 - DNA, 22 bp, Homo sapiens
gaaaggcatcttcagtctctga

SEQ ID NO: 7802453 - DNA, 22 bp, Homo sapiens
gaaagtttataggttatataat

SEQ ID NO: 7802454 - DNA, 22 bp, Homo sapiens
gaaagtttctcacacatgcaga

SEQ ID NO: 7802455 - DNA, 19 bp, Homo sapiens
gaacacttactatatttct

SEQ ID NO: 7802456 - DNA, 22 bp, Homo sapiens
gaactcagagcctgagctagga

SEQ ID NO: 7802457 - DNA, 22 bp, Homo sapiens
gaacacaggtggcccggcaggg

SEQ ID NO: 7802458 - DNA, 22 bp, Homo sapiens
gaacacatcacattttacagtg

SEQ ID NO: 7802459 - DNA, 22 bp, Homo sapiens
gaaagttttcatatataccaaa

SEQ ID NO: 7802460 - DNA, 22 bp, Homo sapiens
cttgggaccctcacatttgatg

SEQ ID NO: 7802461 - DNA, 22 bp, Homo sapiens
cttggctgttgggcattgagaa

SEQ ID NO: 7802462 - DNA, 22 bp, Homo sapiens
cttgggaatgctaacagatgac

SEQ ID NO: 7802463 - DNA, 22 bp, Homo sapiens
ctttgtatggtggcacttccgt

SEQ ID NO: 7802464 - DNA, 22 bp, Homo sapiens
ctttacaattcaagggaactct

SEQ ID NO: 7802465 - DNA, 22 bp, Homo sapiens
cttcttcttttaataaatgtct

SEQ ID NO: 7802466 - DNA, 22 bp, Homo sapiens
cttctttactttctagaaataa

SEQ ID NO: 7802467 - DNA, 22 bp, Homo sapiens
cttgaaatccagatttcagagg

SEQ ID NO: 7802468 - DNA, 19 bp, Homo sapiens
cttgaaatgagactgaagg

SEQ ID NO: 7802469 - DNA, 22 bp, Homo sapiens
cttgaaatgacaggagcacatc

SEQ ID NO: 7802470 - DNA, 22 bp, Homo sapiens
cttctttcccaggcatgtttta

SEQ ID NO: 7802471 - DNA, 22 bp, Homo sapiens
cttctttccttcctccagtggc

SEQ ID NO: 7802472 - DNA, 22 bp, Homo sapiens
cttctttagggatctcttgctg

SEQ ID NO: 7802473 - DNA, 22 bp, Homo sapiens
cttctttagggatctcttgctg

SEQ ID NO: 7802474 - DNA, 22 bp, Homo sapiens
cttctttcaagaatggattagg

SEQ ID NO: 7802475 - DNA, 22 bp, Homo sapiens
cttctttcttttgatcacaggt

SEQ ID NO: 7802476 - DNA, 22 bp, Homo sapiens
cttctttgaaaaaggcagtcag

SEQ ID NO: 7802477 - DNA, 22 bp, Homo sapiens
ctggctgggttccaggattcca

SEQ ID NO: 7802478 - DNA, 22 bp, Homo sapiens
ctggctggtcatgtcatgagcc

SEQ ID NO: 7802479 - DNA, 22 bp, Homo sapiens
ctggctggttccctgctccagg

SEQ ID NO: 7802480 - DNA, 22 bp, Homo sapiens
ctggctggttccctgctccagg

SEQ ID NO: 7802481 - DNA, 22 bp, Homo sapiens
cttctcagtcttggttagagag

SEQ ID NO: 7802482 - DNA, 22 bp, Homo sapiens
ctcctgacacagtccacacttg

SEQ ID NO: 7802483 - DNA, 22 bp, Homo sapiens
ctcctgagctctgaggaagctt

SEQ ID NO: 7802484 - DNA, 22 bp, Homo sapiens
ctcctggctatgactacatttc

SEQ ID NO: 7802485 - DNA, 22 bp, Homo sapiens
tttagaatgtgactgtatttga

SEQ ID NO: 7802486 - DNA, 22 bp, Homo sapiens
tttagaatgttagcgttaaagg

SEQ ID NO: 7802487 - DNA, 22 bp, Homo sapiens
tttagaatgttagcgttaaagg

SEQ ID NO: 7802488 - DNA, 22 bp, Homo sapiens
tttagaattggctagtgggaat

SEQ ID NO: 7802489 - DNA, 22 bp, Homo sapiens
tttaaattctgtctgccgctta

SEQ ID NO: 7802490 - DNA, 22 bp, Homo sapiens
tttaaatttgtgtttagagggt

SEQ ID NO: 7802491 - DNA, 22 bp, Homo sapiens
tttaaaaaactagtctgagtct

SEQ ID NO: 7802492 - DNA, 22 bp, Homo sapiens
tttacatttccctctgtcagtt

SEQ ID NO: 7802493 - DNA, 17 bp, Homo sapiens
tttagaatacaatgttt

SEQ ID NO: 7802494 - DNA, 22 bp, Homo sapiens
tttaacagatgctatgtctacc

SEQ ID NO: 7802495 - DNA, 22 bp, Homo sapiens
tttacatgagtagcagatgttc

SEQ ID NO: 7802496 - DNA, 22 bp, Homo sapiens
ctctccaggactttggcccaat

SEQ ID NO: 7802497 - DNA, 22 bp, Homo sapiens
tttcagttactgctatatcatt

SEQ ID NO: 7802498 - DNA, 22 bp, Homo sapiens
tttcagttaagtggctagtccc

SEQ ID NO: 7802499 - DNA, 23 bp, Homo sapiens
tttcagttccagaaaaggggagc

SEQ ID NO: 7802500 - DNA, 20 bp, Homo sapiens
tttcagttggttaatggcat

SEQ ID NO: 7802501 - DNA, 22 bp, Homo sapiens
tttcagttgccaagctaattct

SEQ ID NO: 7802502 - DNA, 22 bp, Homo sapiens
tttcagttgattgcttgggtta

SEQ ID NO: 7802503 - DNA, 23 bp, Homo sapiens
tttcagttgagaatgcacggacc

SEQ ID NO: 7802504 - DNA, 22 bp, Homo sapiens
tttcagttgcagtggttgtcta

SEQ ID NO: 7802505 - DNA, 22 bp, Homo sapiens
ctcctgggctcatatcattcag

SEQ ID NO: 7802506 - DNA, 22 bp, Homo sapiens
ctcctggctcgcccccagctga

SEQ ID NO: 7802507 - DNA, 18 bp, Homo sapiens
ctcctgggctgcagatgc

SEQ ID NO: 7802508 - DNA, 22 bp, Homo sapiens
ctctccagaatatgccgccgtg

SEQ ID NO: 7802509 - DNA, 22 bp, Homo sapiens
ctctccagcctttagcccacgc

SEQ ID NO: 7802510 - DNA, 22 bp, Homo sapiens
ctcagtttgtgtgatattgtct

SEQ ID NO: 7802511 - DNA, 22 bp, Homo sapiens
ctcagtttctgacattaaaatc

SEQ ID NO: 7802512 - DNA, 22 bp, Homo sapiens
ttgggatctcaaatccagctat

SEQ ID NO: 7802513 - DNA, 22 bp, Homo sapiens
ttggccaacatggtgaaacccc

SEQ ID NO: 7802514 - DNA, 22 bp, Homo sapiens
ctcataaagtgagaatatgacc

SEQ ID NO: 7802515 - DNA, 22 bp, Homo sapiens
ctcataaacaattctttgaggt

SEQ ID NO: 7802516 - DNA, 22 bp, Homo sapiens
tttaaaaaactagtctgagtct

SEQ ID NO: 7802517 - DNA, 22 bp, Homo sapiens
ctccagtgcacccagaggattt

SEQ ID NO: 7802518 - DNA, 22 bp, Homo sapiens
ctccagtgagtgagcaggcgac

SEQ ID NO: 7802519 - DNA, 22 bp, Homo sapiens
ctccagtgagcgcggggcatgg

SEQ ID NO: 7802520 - DNA, 22 bp, Homo sapiens
ttgtattttgttatgctactgc

SEQ ID NO: 7802521 - DNA, 22 bp, Homo sapiens
ttgtattttgttatgctactgc

SEQ ID NO: 7802522 - DNA, 22 bp, Homo sapiens
ttgtgtactacagtatgccaca

SEQ ID NO: 7802523 - DNA, 22 bp, Homo sapiens
ttgtgtactgttggttgatatt

SEQ ID NO: 7802524 - DNA, 22 bp, Homo sapiens
ttgttaaaatgcatattctggt

SEQ ID NO: 7802525 - DNA, 22 bp, Homo sapiens
ttgttaaagatgcagattccat

SEQ ID NO: 7802526 - DNA, 22 bp, Homo sapiens
ttgtatttgattgtcatatcgt

SEQ ID NO: 7802527 - DNA, 22 bp, Homo sapiens
ctccagggatgagacagagtag

SEQ ID NO: 7802528 - DNA, 22 bp, Homo sapiens
ctccaggcccctggccttctgc

SEQ ID NO: 7802529 - DNA, 22 bp, Homo sapiens
ttggtacatgttaaggaagagt

SEQ ID NO: 7802530 - DNA, 22 bp, Homo sapiens
ttggtacattacagtttgattg

SEQ ID NO: 7802531 - DNA, 22 bp, Homo sapiens
ttggtaaaatcatagtggtaac

SEQ ID NO: 7802532 - DNA, 22 bp, Homo sapiens
ttgggttttgatacatgtctaa

SEQ ID NO: 7802533 - DNA, 22 bp, Homo sapiens
ttgggttttcccttgaaactga

SEQ ID NO: 7802534 - DNA, 22 bp, Homo sapiens
ttggtacatgcagatatttagt

SEQ ID NO: 7802535 - DNA, 22 bp, Homo sapiens
ttggtacaatgtgctaggtagg

SEQ ID NO: 7802536 - DNA, 22 bp, Homo sapiens
ttggtacagatgaggtattctc

SEQ ID NO: 7802537 - DNA, 22 bp, Homo sapiens
ttggtacaaaaccatgaaagaa

SEQ ID NO: 7802538 - DNA, 22 bp, Homo sapiens
ttggtacaaaagtaactgtggt

SEQ ID NO: 7802539 - DNA, 22 bp, Homo sapiens
ttgggtctgtttagctgagaag

SEQ ID NO: 7802540 - DNA, 22 bp, Homo sapiens
ttgggtcttatggctggagtag

SEQ ID NO: 7802541 - DNA, 23 bp, Homo sapiens
cggctgctcggccgagtcctcgg

SEQ ID NO: 7802542 - DNA, 22 bp, Homo sapiens
cggctgctgcctgagtcgctgt

SEQ ID NO: 7802543 - DNA, 22 bp, Homo sapiens
ttcacttatttcttgagtagca

SEQ ID NO: 7802544 - DNA, 22 bp, Homo sapiens
ttcagaaaaaacttcaataagt

SEQ ID NO: 7802545 - DNA, 22 bp, Homo sapiens
ttcacttaacatcatatcatga

SEQ ID NO: 7802546 - DNA, 22 bp, Homo sapiens
ttcacttatagggatgttattg

SEQ ID NO: 7802547 - DNA, 22 bp, Homo sapiens
ttcacttaaaggttttagcatc

SEQ ID NO: 7802548 - DNA, 22 bp, Homo sapiens
ttcacttaacatttaccaagga

SEQ ID NO: 7802549 - DNA, 22 bp, Homo sapiens
ttcatgaggtacctgtgatcat

SEQ ID NO: 7802550 - DNA, 22 bp, Homo sapiens
ttcattcccaagagtaaacata

SEQ ID NO: 7802551 - DNA, 22 bp, Homo sapiens
ttcattccttctgtaccttgcc

SEQ ID NO: 7802552 - DNA, 22 bp, Homo sapiens
ttcattcctgagcccatattta

SEQ ID NO: 7802553 - DNA, 22 bp, Homo sapiens
ttcattccttccctaagcaact

SEQ ID NO: 7802554 - DNA, 23 bp, Homo sapiens
ttcatgagattatctgcatgtgt

SEQ ID NO: 7802555 - DNA, 22 bp, Homo sapiens
ttcagaaaggtaaatggatttc

SEQ ID NO: 7802556 - DNA, 22 bp, Homo sapiens
ttcagaaaggataattggaagg

SEQ ID NO: 7802557 - DNA, 19 bp, Homo sapiens
ttcattctcttattgttgt

SEQ ID NO: 7802558 - DNA, 22 bp, Homo sapiens
ttcattcttatttgtgatctgg

SEQ ID NO: 7802559 - DNA, 22 bp, Homo sapiens
ctaactttttgattcttgggga

SEQ ID NO: 7802560 - DNA, 22 bp, Homo sapiens
ttcccttaaattatggcatcta

SEQ ID NO: 7802561 - DNA, 22 bp, Homo sapiens
ttcccacattctttacattcat

SEQ ID NO: 7802562 - DNA, 22 bp, Homo sapiens
ttcccacagtgttgaatcctct

SEQ ID NO: 7802563 - DNA, 22 bp, Homo sapiens
ctacaaaagtaattgtggtttt

SEQ ID NO: 7802564 - DNA, 22 bp, Homo sapiens
ttctgtatctttcttcaagatt

SEQ ID NO: 7802565 - DNA, 22 bp, Homo sapiens
ttctgtcaaatgccagtagaga

SEQ ID NO: 7802566 - DNA, 22 bp, Homo sapiens
ttctgtatgtacatatgtgtat

SEQ ID NO: 7802567 - DNA, 22 bp, Homo sapiens
ttctgtatttagtttgaggaca

SEQ ID NO: 7802568 - DNA, 22 bp, Homo sapiens
ttcttggaaatacattcaataa

SEQ ID NO: 7802569 - DNA, 22 bp, Homo sapiens
ttctgtcatgctcatgtaattg

SEQ ID NO: 7802570 - DNA, 22 bp, Homo sapiens
ttctgtcatgctcatgtaattg

SEQ ID NO: 7802571 - DNA, 22 bp, Homo sapiens
ttctgtcatcctttctagatgt

SEQ ID NO: 7802572 - DNA, 22 bp, Homo sapiens
ttctgtcacagtgctggtatca

SEQ ID NO: 7802573 - DNA, 22 bp, Homo sapiens
ctagggacagaaagagggtaga

SEQ ID NO: 7802574 - DNA, 22 bp, Homo sapiens
ctagggacctcagctcctggag

SEQ ID NO: 7802575 - DNA, 22 bp, Homo sapiens
ctagggactgggaccttagtta

SEQ ID NO: 7802576 - DNA, 22 bp, Homo sapiens
ctaggcagctttgggtgtgaag

SEQ ID NO: 7802577 - DNA, 18 bp, Homo sapiens
ttgataaacaatttcatt

SEQ ID NO: 7802578 - DNA, 21 bp, Homo sapiens
ttgaggagtgagagtgggttt

SEQ ID NO: 7802579 - DNA, 23 bp, Homo sapiens
ttgaggagtgctttttctatcca

SEQ ID NO: 7802580 - DNA, 22 bp, Homo sapiens
ttgaggagtggcgctggactta

SEQ ID NO: 7802581 - DNA, 22 bp, Homo sapiens
ttgataaaatgatgaaatcact

SEQ ID NO: 7802582 - DNA, 22 bp, Homo sapiens
ttgataaaatgatatcttcttt

SEQ ID NO: 7802583 - DNA, 22 bp, Homo sapiens
ttgaggaggacagaaacattta

SEQ ID NO: 7802584 - DNA, 22 bp, Homo sapiens
ttgaggaggaactgtgaggcaa

SEQ ID NO: 7802585 - DNA, 22 bp, Homo sapiens
ttgaggaggcctttcagggctt

SEQ ID NO: 7802586 - DNA, 22 bp, Homo sapiens
ttgaggaggtcctgggtttact

SEQ ID NO: 7802587 - DNA, 22 bp, Homo sapiens
ttgaggaggtagtacagagtat

SEQ ID NO: 7802588 - DNA, 22 bp, Homo sapiens
ttgaggaggtatgactaggtac

SEQ ID NO: 7802589 - DNA, 22 bp, Homo sapiens
ttgaggagtcaggggcacggaa

SEQ ID NO: 7802590 - DNA, 22 bp, Homo sapiens
ttgaggagtacaaagcatgctt

SEQ ID NO: 7802591 - DNA, 22 bp, Homo sapiens
ttgaggagtagaagctttgaat

SEQ ID NO: 7802592 - DNA, 23 bp, Homo sapiens
ttgaggagcagcgctttttaccg

SEQ ID NO: 7802593 - DNA, 22 bp, Homo sapiens
ttgaggagcaggatgggaggct

SEQ ID NO: 7802594 - DNA, 22 bp, Homo sapiens
ttgaggaggaaaagggggtacc

SEQ ID NO: 7802595 - DNA, 22 bp, Homo sapiens
ttgaggagaagactttgcttcc

SEQ ID NO: 7802596 - DNA, 22 bp, Homo sapiens
ttgaggagcactagtcaggtat

SEQ ID NO: 7802597 - DNA, 20 bp, Homo sapiens
ttgaggagatattgaatact

SEQ ID NO: 7802598 - DNA, 22 bp, Homo sapiens
ttcttgttctcctcatttagag

SEQ ID NO: 7802599 - DNA, 22 bp, Homo sapiens
ttcttgttctggttctgttagc

SEQ ID NO: 7802600 - DNA, 22 bp, Homo sapiens
ttcttgttctggttctgttagc

SEQ ID NO: 7802601 - DNA, 22 bp, Homo sapiens
ttcttggccaccagatctcact

SEQ ID NO: 7802602 - DNA, 22 bp, Homo sapiens
ttcttgtactggagatacatga

SEQ ID NO: 7802603 - DNA, 22 bp, Homo sapiens
ctattttcattcttacattgtc

SEQ ID NO: 7802604 - DNA, 22 bp, Homo sapiens
ctattttcccatatggttgaca

SEQ ID NO: 7802605 - DNA, 22 bp, Homo sapiens
ctattttccgcagcaggaagta

SEQ ID NO: 7802606 - DNA, 22 bp, Homo sapiens
ctattttctgtctctatagagt

SEQ ID NO: 7802607 - DNA, 22 bp, Homo sapiens
ctattttctgtctctatagagt

SEQ ID NO: 7802608 - DNA, 23 bp, Homo sapiens
ttttattgatatgtagctgttgt

SEQ ID NO: 7802609 - DNA, 18 bp, Homo sapiens
ctctgggagaggcataca

SEQ ID NO: 7802610 - DNA, 22 bp, Homo sapiens
tttgtacatcctaattctgagt

SEQ ID NO: 7802611 - DNA, 21 bp, Homo sapiens
ttttattgatgaatggccact

SEQ ID NO: 7802612 - DNA, 23 bp, Homo sapiens
ctgaagagccaacaaaaagcttg

SEQ ID NO: 7802613 - DNA, 22 bp, Homo sapiens
ctgaagaggacgcagcagcaag

SEQ ID NO: 7802614 - DNA, 22 bp, Homo sapiens
ctgaacttattgagtgcttgct

SEQ ID NO: 7802615 - DNA, 22 bp, Homo sapiens
ctgaacttctctgagcctcagt

SEQ ID NO: 7802616 - DNA, 22 bp, Homo sapiens
ctgccgttgtgaagctcttaga

SEQ ID NO: 7802617 - DNA, 22 bp, Homo sapiens
ctgaggagaaatgggatggttc

SEQ ID NO: 7802618 - DNA, 22 bp, Homo sapiens
ctgaggagggaagtccccaaag

SEQ ID NO: 7802619 - DNA, 22 bp, Homo sapiens
ctgaggaggctaatttgaggat

SEQ ID NO: 7802620 - DNA, 22 bp, Homo sapiens
ctgaggagaaagatggtccaag

SEQ ID NO: 7802621 - DNA, 22 bp, Homo sapiens
ctgagagaatcatgctgcaggt

SEQ ID NO: 7802622 - DNA, 22 bp, Homo sapiens
ctgaggaggggcctgagtgaga

SEQ ID NO: 7802623 - DNA, 22 bp, Homo sapiens
ctgaggagtcagcttactcact

SEQ ID NO: 7802624 - DNA, 22 bp, Homo sapiens
ctgaggagtcagttccactcag

SEQ ID NO: 7802625 - DNA, 22 bp, Homo sapiens
ctgaggagtgggtgggcagtga

SEQ ID NO: 7802626 - DNA, 22 bp, Homo sapiens
ctgaggagttggtgaataagcc

SEQ ID NO: 7802627 - DNA, 22 bp, Homo sapiens
ctgaggagtttcttatatgtgt

SEQ ID NO: 7802628 - DNA, 22 bp, Homo sapiens
ctgaggagtttgggttgttcaa

SEQ ID NO: 7802629 - DNA, 22 bp, Homo sapiens
ctgatgttcatttcttttgtac

SEQ ID NO: 7802630 - DNA, 22 bp, Homo sapiens
ctggcacgcccacgtaggcact

SEQ ID NO: 7802631 - DNA, 22 bp, Homo sapiens
ctggatgcttcctctctgctag

SEQ ID NO: 7802632 - DNA, 20 bp, Homo sapiens
ctggatgctaaaacacacac

SEQ ID NO: 7802633 - DNA, 22 bp, Homo sapiens
ctggatgctgagaggtaccaag

SEQ ID NO: 7802634 - DNA, 22 bp, Homo sapiens
ctggattaagtaaaatagagga

SEQ ID NO: 7802635 - DNA, 18 bp, Homo sapiens
ctggattaagacagtgct

SEQ ID NO: 7802636 - DNA, 22 bp, Homo sapiens
ctggcagtctgcctcttcactg

SEQ ID NO: 7802637 - DNA, 22 bp, Homo sapiens
ctggcagtctggtggaaggcct

SEQ ID NO: 7802638 - DNA, 22 bp, Homo sapiens
ctggcagtctgcctcttcactg

SEQ ID NO: 7802639 - DNA, 22 bp, Homo sapiens
ctggcagttggcattggcatct

SEQ ID NO: 7802640 - DNA, 22 bp, Homo sapiens
ctggcagtttgccaggagctcg

SEQ ID NO: 7802641 - DNA, 22 bp, Homo sapiens
ctggcagtttgccaggagctcg

SEQ ID NO: 7802642 - DNA, 22 bp, Homo sapiens
ctggcatgaaatggcatctcat

SEQ ID NO: 7802643 - DNA, 22 bp, Homo sapiens
ctggcagggtgggctttgcttt

SEQ ID NO: 7802644 - DNA, 22 bp, Homo sapiens
ctggccaccaagagcttgctca

SEQ ID NO: 7802645 - DNA, 23 bp, Homo sapiens
ctggccaccatctttctggcttc

SEQ ID NO: 7802646 - DNA, 18 bp, Homo sapiens
ctggcattcttccctgga

SEQ ID NO: 7802647 - DNA, 21 bp, Homo sapiens
ctggcattatgatagcgtcct

SEQ ID NO: 7802648 - DNA, 22 bp, Homo sapiens
ctggcccagagagcagagctta

SEQ ID NO: 7802649 - DNA, 22 bp, Homo sapiens
ctggcctctgtgttcaccatag

SEQ ID NO: 7802650 - DNA, 22 bp, Homo sapiens
ctggcccttctcttgcttcctg

SEQ ID NO: 7802651 - DNA, 22 bp, Homo sapiens
ctggccctgtggcctaaggact

SEQ ID NO: 7802652 - DNA, 23 bp, Homo sapiens
ctggctccgaagactccaggatc

SEQ ID NO: 7802653 - DNA, 21 bp, Homo sapiens
ctggactgaggagacagtcgc

SEQ ID NO: 7802654 - DNA, 22 bp, Homo sapiens
ctggaccctgtttccctaggtc

SEQ ID NO: 7802655 - DNA, 22 bp, Homo sapiens
ctggagggagattcaaaggagg

SEQ ID NO: 7802656 - DNA, 22 bp, Homo sapiens
ctggagttttggaaaaatgctt

SEQ ID NO: 7802657 - DNA, 22 bp, Homo sapiens
ctggagttcagtggcgtgaaca

SEQ ID NO: 7802658 - DNA, 22 bp, Homo sapiens
ctggaggtgggggcaagagtgt

SEQ ID NO: 7802659 - DNA, 22 bp, Homo sapiens
ctgcctgggccggccaccctct

SEQ ID NO: 7802660 - DNA, 22 bp, Homo sapiens
ctgcctgggccatgcccagtcc

SEQ ID NO: 7802661 - DNA, 22 bp, Homo sapiens
ctgcctggctaaactcaagtcg

SEQ ID NO: 7802662 - DNA, 22 bp, Homo sapiens
ctgctttagacaactgctggga

SEQ ID NO: 7802663 - DNA, 20 bp, Homo sapiens
ctgcctggaggcctctacct

SEQ ID NO: 7802664 - DNA, 17 bp, Homo sapiens
ctgcctggagtcccatc

SEQ ID NO: 7802665 - DNA, 22 bp, Homo sapiens
ctgcctggcatagtctggtcga

SEQ ID NO: 7802666 - DNA, 22 bp, Homo sapiens
ctgcctggccacaacccagggt

SEQ ID NO: 7802667 - DNA, 22 bp, Homo sapiens
ctgcctggaccggcagccctcc

SEQ ID NO: 7802668 - DNA, 22 bp, Homo sapiens
ctgcctgctcaccagggctctg

SEQ ID NO: 7802669 - DNA, 22 bp, Homo sapiens
ctggaaaatgaagaagcagagg

SEQ ID NO: 7802670 - DNA, 22 bp, Homo sapiens
ctggaattgcataatatgtcct

SEQ ID NO: 7802671 - DNA, 22 bp, Homo sapiens
tggcaaggccacaggtgcagtt

SEQ ID NO: 7802672 - DNA, 22 bp, Homo sapiens
tggccaggcaggtagaacggcc

SEQ ID NO: 7802673 - DNA, 23 bp, Homo sapiens
tggccaggcataaaggtgggtgg

SEQ ID NO: 7802674 - DNA, 22 bp, Homo sapiens
cctagggtcagtgtggcaggag

SEQ ID NO: 7802675 - DNA, 22 bp, Homo sapiens
tggccaggaggctgcttctgac

SEQ ID NO: 7802676 - DNA, 22 bp, Homo sapiens
tggatctcggcaatgcgggact

SEQ ID NO: 7802677 - DNA, 22 bp, Homo sapiens
tggcaaggaagagcctggtgca

SEQ ID NO: 7802678 - DNA, 22 bp, Homo sapiens
ccctccagggagccatgctggg

SEQ ID NO: 7802679 - DNA, 19 bp, Homo sapiens
ccctcattcacttattctc

SEQ ID NO: 7802680 - DNA, 22 bp, Homo sapiens
tggccctgctggacacgcctgc

SEQ ID NO: 7802681 - DNA, 22 bp, Homo sapiens
tggctcagtttagcagctcagt

SEQ ID NO: 7802682 - DNA, 22 bp, Homo sapiens
cctccctgctcctcaactggca

SEQ ID NO: 7802683 - DNA, 22 bp, Homo sapiens
cctcccttcagtagagcccaat

SEQ ID NO: 7802684 - DNA, 22 bp, Homo sapiens
cctccctggtggctctggtcta

SEQ ID NO: 7802685 - DNA, 22 bp, Homo sapiens
cctccagcgcgatccactccgg

SEQ ID NO: 7802686 - DNA, 22 bp, Homo sapiens
cctctcagcgattcctcttgga

SEQ ID NO: 7802687 - DNA, 22 bp, Homo sapiens
ccccagggaagctttgcttact

SEQ ID NO: 7802688 - DNA, 22 bp, Homo sapiens
cccccagatgcgagccatagcc

SEQ ID NO: 7802689 - DNA, 22 bp, Homo sapiens
ccccagccagcaggacctctga

SEQ ID NO: 7802690 - DNA, 22 bp, Homo sapiens
ccccagcagcacctggggcagt

SEQ ID NO: 7802691 - DNA, 20 bp, Homo sapiens
cccagggacctgagctccat

SEQ ID NO: 7802692 - DNA, 22 bp, Homo sapiens
tgctcccacactactcggaggc

SEQ ID NO: 7802693 - DNA, 22 bp, Homo sapiens
cccagggaggcccaggctctgc

SEQ ID NO: 7802694 - DNA, 22 bp, Homo sapiens
tgctctggagtggcttgtgcac

SEQ ID NO: 7802695 - DNA, 22 bp, Homo sapiens
cccaggctcctgactcattcta

SEQ ID NO: 7802696 - DNA, 22 bp, Homo sapiens
tgctcccaaacctgacaggctc

SEQ ID NO: 7802697 - DNA, 22 bp, Homo sapiens
tgctccagtgcctgccccacag

SEQ ID NO: 7802698 - DNA, 22 bp, Homo sapiens
tgctccagtgagctggccatcc

SEQ ID NO: 7802699 - DNA, 22 bp, Homo sapiens
tgctccaggtgtgcctctcatg

SEQ ID NO: 7802700 - DNA, 22 bp, Homo sapiens
cccaggcacaccccgaacggaa

SEQ ID NO: 7802701 - DNA, 22 bp, Homo sapiens
cccaggcacactgaagtgacat

SEQ ID NO: 7802702 - DNA, 22 bp, Homo sapiens
cccaggcacatccactctgtga

SEQ ID NO: 7802703 - DNA, 22 bp, Homo sapiens
cccaggcacagattatcccaat

SEQ ID NO: 7802704 - DNA, 22 bp, Homo sapiens
cccaggcagagagctggtgagc

SEQ ID NO: 7802705 - DNA, 22 bp, Homo sapiens
cccaggcactcttggtcatttt

SEQ ID NO: 7802706 - DNA, 22 bp, Homo sapiens
cccaggcagaattagtgtttca

SEQ ID NO: 7802707 - DNA, 22 bp, Homo sapiens
cccaggcaggagtgtggtggct

SEQ ID NO: 7802708 - DNA, 22 bp, Homo sapiens
cccaggcagggacgtgctctgg

SEQ ID NO: 7802709 - DNA, 22 bp, Homo sapiens
cccaggcagtagaaagaagagg

SEQ ID NO: 7802710 - DNA, 22 bp, Homo sapiens
cccaggcagtgtgtgcatgcgt

SEQ ID NO: 7802711 - DNA, 22 bp, Homo sapiens
cccaggcagtgctgatccctca

SEQ ID NO: 7802712 - DNA, 22 bp, Homo sapiens
cccaggcagtctggctctaaag

SEQ ID NO: 7802713 - DNA, 22 bp, Homo sapiens
cccaggcagcggggtctccttg

SEQ ID NO: 7802714 - DNA, 22 bp, Homo sapiens
cccaggcagcctgcagggaagg

SEQ ID NO: 7802715 - DNA, 20 bp, Homo sapiens
cccaggcagagctagcggca

SEQ ID NO: 7802716 - DNA, 22 bp, Homo sapiens
cccaggcagcccttctgacgca

SEQ ID NO: 7802717 - DNA, 22 bp, Homo sapiens
cccaggcagccccagaagcttg

SEQ ID NO: 7802718 - DNA, 22 bp, Homo sapiens
cccaggaggtgtgcccaactcg

SEQ ID NO: 7802719 - DNA, 18 bp, Homo sapiens
cccagcttagcgcccctc

SEQ ID NO: 7802720 - DNA, 22 bp, Homo sapiens
cccagcttctgagggggccttg

SEQ ID NO: 7802721 - DNA, 19 bp, Homo sapiens
cccagcttgaccacctgct

SEQ ID NO: 7802722 - DNA, 22 bp, Homo sapiens
cccagcttgcaaatgggttgct

SEQ ID NO: 7802723 - DNA, 22 bp, Homo sapiens
cccagcttgcccaggactgagg

SEQ ID NO: 7802724 - DNA, 22 bp, Homo sapiens
cccagcttgcgggcggcaggag

SEQ ID NO: 7802725 - DNA, 22 bp, Homo sapiens
cccagcttgtctgattcagcct

SEQ ID NO: 7802726 - DNA, 22 bp, Homo sapiens
tgcagggaatctgtggctggac

SEQ ID NO: 7802727 - DNA, 22 bp, Homo sapiens
tgcagggaatgcttgcagcatg

SEQ ID NO: 7802728 - DNA, 22 bp, Homo sapiens
tgcagggagctctggggtgcag

SEQ ID NO: 7802729 - DNA, 22 bp, Homo sapiens
tgcagggacaggctctggggat

SEQ ID NO: 7802730 - DNA, 22 bp, Homo sapiens
tgcagggaggccccgcagccct

SEQ ID NO: 7802731 - DNA, 22 bp, Homo sapiens
tgcagggagggcccagcaatct

SEQ ID NO: 7802732 - DNA, 22 bp, Homo sapiens
cccagcctactctgccatagca

SEQ ID NO: 7802733 - DNA, 22 bp, Homo sapiens
cccagccttccaccctggacta

SEQ ID NO: 7802734 - DNA, 22 bp, Homo sapiens
cccagcctttgcttcctggttc

SEQ ID NO: 7802735 - DNA, 22 bp, Homo sapiens
cccagcctgtgacagccgtcct

SEQ ID NO: 7802736 - DNA, 22 bp, Homo sapiens
cctgggagagtctgtggtctcc

SEQ ID NO: 7802737 - DNA, 22 bp, Homo sapiens
cctgggagccaagcctctgtgt

SEQ ID NO: 7802738 - DNA, 21 bp, Homo sapiens
cctgggagatcagctgccttc

SEQ ID NO: 7802739 - DNA, 22 bp, Homo sapiens
tgtgccagggcctccaaaagcc

SEQ ID NO: 7802740 - DNA, 22 bp, Homo sapiens
tgtgccagtcatccagatgtgt

SEQ ID NO: 7802741 - DNA, 22 bp, Homo sapiens
tgtgccagttttgtctaagccc

SEQ ID NO: 7802742 - DNA, 22 bp, Homo sapiens
tgtctgtattagtcagcattct

SEQ ID NO: 7802743 - DNA, 22 bp, Homo sapiens
tgtctggtgggttgacaggcag

SEQ ID NO: 7802744 - DNA, 21 bp, Homo sapiens
tgtctttaggacctgttaaat

SEQ ID NO: 7802745 - DNA, 22 bp, Homo sapiens
tgtctgtctgtccttctcatta

SEQ ID NO: 7802746 - DNA, 19 bp, Homo sapiens
cctggctctgagcccagcc

SEQ ID NO: 7802747 - DNA, 22 bp, Homo sapiens
cctggctcttcgggagtttgtt

SEQ ID NO: 7802748 - DNA, 21 bp, Homo sapiens
cctggctgcacagttgctggt

SEQ ID NO: 7802749 - DNA, 22 bp, Homo sapiens
cctggctgaggggccaaggacc

SEQ ID NO: 7802750 - DNA, 22 bp, Homo sapiens
tgtgaggtaacgctgctctgtt

SEQ ID NO: 7802751 - DNA, 22 bp, Homo sapiens
tgtctttatatatttggaaaat

SEQ ID NO: 7802752 - DNA, 22 bp, Homo sapiens
cctgggagctgtggaaaggctg

SEQ ID NO: 7802753 - DNA, 22 bp, Homo sapiens
tgtgcttgtcgtggagccaggc

SEQ ID NO: 7802754 - DNA, 22 bp, Homo sapiens
tgtgttcaatccctagtctcag

SEQ ID NO: 7802755 - DNA, 22 bp, Homo sapiens
tgtgttcaccaaagtgtagaaa

SEQ ID NO: 7802756 - DNA, 22 bp, Homo sapiens
tgtgttcagaatttgctgcttt

SEQ ID NO: 7802757 - DNA, 22 bp, Homo sapiens
tgtgttcatgtatgtatacata

SEQ ID NO: 7802758 - DNA, 22 bp, Homo sapiens
tgtgttcatcatgatatcaggt

SEQ ID NO: 7802759 - DNA, 22 bp, Homo sapiens
tgtgttcatttaactgttcttt

SEQ ID NO: 7802760 - DNA, 22 bp, Homo sapiens
tgtgttcatttctctctgctgt

SEQ ID NO: 7802761 - DNA, 19 bp, Homo sapiens
cctgggtccactcagacta

SEQ ID NO: 7802762 - DNA, 22 bp, Homo sapiens
tgtgtgtcagtcttgtttaggg

SEQ ID NO: 7802763 - DNA, 19 bp, Homo sapiens
tgtgtggttggtgaaactc

SEQ ID NO: 7802764 - DNA, 22 bp, Homo sapiens
cctggcaggtggaggttgcagt

SEQ ID NO: 7802765 - DNA, 22 bp, Homo sapiens
cctggcagggctgcagtaatgg

SEQ ID NO: 7802766 - DNA, 22 bp, Homo sapiens
cctggcaggtagcattgaggag

SEQ ID NO: 7802767 - DNA, 22 bp, Homo sapiens
cctggcagtcaggggagtcctt

SEQ ID NO: 7802768 - DNA, 22 bp, Homo sapiens
cctggcaggttacaaccagtta

SEQ ID NO: 7802769 - DNA, 22 bp, Homo sapiens
cctggcaggtggcgccctcggc

SEQ ID NO: 7802770 - DNA, 22 bp, Homo sapiens
cctggcaggcccctcctggatt

SEQ ID NO: 7802771 - DNA, 22 bp, Homo sapiens
cctggcaggcaagaggaaggga

SEQ ID NO: 7802772 - DNA, 22 bp, Homo sapiens
cctggcaggactgttgtaagaa

SEQ ID NO: 7802773 - DNA, 20 bp, Homo sapiens
cctggcaggcgggttactta

SEQ ID NO: 7802774 - DNA, 22 bp, Homo sapiens
cctggcaggctggggacagtgc

SEQ ID NO: 7802775 - DNA, 22 bp, Homo sapiens
cctggcaggctggggacagtgc

SEQ ID NO: 7802776 - DNA, 22 bp, Homo sapiens
cctggcagactgtgagggcagg

SEQ ID NO: 7802777 - DNA, 22 bp, Homo sapiens
cctggcagcagcacatgccttc

SEQ ID NO: 7802778 - DNA, 23 bp, Homo sapiens
cctggcagcaaacgaggaggtta

SEQ ID NO: 7802779 - DNA, 18 bp, Homo sapiens
cctggcagccatgcgcgc

SEQ ID NO: 7802780 - DNA, 22 bp, Homo sapiens
cctggcagcaggtgggcccgtg

SEQ ID NO: 7802781 - DNA, 22 bp, Homo sapiens
cctggcagcattggtagagatt

SEQ ID NO: 7802782 - DNA, 22 bp, Homo sapiens
cctggcagttttgcccaggatt

SEQ ID NO: 7802783 - DNA, 22 bp, Homo sapiens
cctggcagtggtgaagaagagg

SEQ ID NO: 7802784 - DNA, 22 bp, Homo sapiens
cctggcagttcatcaaatggca

SEQ ID NO: 7802785 - DNA, 19 bp, Homo sapiens
tgtcccagactccgtgtct

SEQ ID NO: 7802786 - DNA, 22 bp, Homo sapiens
tgtccagtgattctcatgagcc

SEQ ID NO: 7802787 - DNA, 22 bp, Homo sapiens
tgtctcagaatggctcataata

SEQ ID NO: 7802788 - DNA, 22 bp, Homo sapiens
tgtctcaggggcattgaaataa

SEQ ID NO: 7802789 - DNA, 22 bp, Homo sapiens
tgtctcagggcagcagcagggg

SEQ ID NO: 7802790 - DNA, 18 bp, Homo sapiens
tgtctcaggctgaaacag

SEQ ID NO: 7802791 - DNA, 22 bp, Homo sapiens
tgtctcagctgtgcttcattgg

SEQ ID NO: 7802792 - DNA, 22 bp, Homo sapiens
tgtctcaggcccaagccagtaa

SEQ ID NO: 7802793 - DNA, 22 bp, Homo sapiens
tgtctcagatacgccatcaagg

SEQ ID NO: 7802794 - DNA, 22 bp, Homo sapiens
tgtctcagagtgttgtattaga

SEQ ID NO: 7802795 - DNA, 22 bp, Homo sapiens
tgtctcagagtatccctgaact

SEQ ID NO: 7802796 - DNA, 23 bp, Homo sapiens
tgtctcagactgaggggtttccc

SEQ ID NO: 7802797 - DNA, 22 bp, Homo sapiens
tgtcctgcaagccctaatgaat

SEQ ID NO: 7802798 - DNA, 22 bp, Homo sapiens
cctggcccacatggcttctccc

SEQ ID NO: 7802799 - DNA, 18 bp, Homo sapiens
tgtctcagttctgctatg

SEQ ID NO: 7802800 - DNA, 22 bp, Homo sapiens
tgtctcagttcccttctctgga

SEQ ID NO: 7802801 - DNA, 22 bp, Homo sapiens
tgtctcagtatacgaaacactt

SEQ ID NO: 7802802 - DNA, 22 bp, Homo sapiens
tgtctcagtacactccgatgtt

SEQ ID NO: 7802803 - DNA, 22 bp, Homo sapiens
tgtctcaggtacatgcgtcctg

SEQ ID NO: 7802804 - DNA, 22 bp, Homo sapiens
tgtctctggctgcagcctgttc

SEQ ID NO: 7802805 - DNA, 22 bp, Homo sapiens
cctggctccagctgcctgtcct

SEQ ID NO: 7802806 - DNA, 22 bp, Homo sapiens
cctggctccaaagctgtgactc

SEQ ID NO: 7802807 - DNA, 22 bp, Homo sapiens
cctggctcccccatcatagctg

SEQ ID NO: 7802808 - DNA, 22 bp, Homo sapiens
cctggctcccggaacagggtct

SEQ ID NO: 7802809 - DNA, 22 bp, Homo sapiens
cctggccctggaatagggcagg

SEQ ID NO: 7802810 - DNA, 22 bp, Homo sapiens
cctggctccctgcacagggctc

SEQ ID NO: 7802811 - DNA, 22 bp, Homo sapiens
cctggctcctgcacagatcttt

SEQ ID NO: 7802812 - DNA, 22 bp, Homo sapiens
cctggctccgtgtcacgtgccc

SEQ ID NO: 7802813 - DNA, 22 bp, Homo sapiens
cctggctcctgcctctgcaggg

SEQ ID NO: 7802814 - DNA, 22 bp, Homo sapiens
cctggctctctgcagatcctgg

SEQ ID NO: 7802815 - DNA, 22 bp, Homo sapiens
cctggctctagaggccactcct

SEQ ID NO: 7802816 - DNA, 22 bp, Homo sapiens
cctggctcgctgacctcagggg

SEQ ID NO: 7802817 - DNA, 22 bp, Homo sapiens
tgtaaactgtagaaaatacttt

SEQ ID NO: 7802818 - DNA, 22 bp, Homo sapiens
tgtaaacatatgtatgtatgta

SEQ ID NO: 7802819 - DNA, 22 bp, Homo sapiens
tgtaaacatatgtatgtatgta

SEQ ID NO: 7802820 - DNA, 22 bp, Homo sapiens
cctggagaggcgctgcagagga

SEQ ID NO: 7802821 - DNA, 22 bp, Homo sapiens
tgtattaacattaataaaatgg

SEQ ID NO: 7802822 - DNA, 22 bp, Homo sapiens
cctggcagaaagagttacacct

SEQ ID NO: 7802823 - DNA, 21 bp, Homo sapiens
cctggcagaagcctgatatgc

SEQ ID NO: 7802824 - DNA, 22 bp, Homo sapiens
cctggcactgaccaggcactga

SEQ ID NO: 7802825 - DNA, 22 bp, Homo sapiens
cctggcacatgcagtactcaag

SEQ ID NO: 7802826 - DNA, 22 bp, Homo sapiens
cctggcacatgatagatgctca

SEQ ID NO: 7802827 - DNA, 22 bp, Homo sapiens
cctggcacatctaactcactct

SEQ ID NO: 7802828 - DNA, 22 bp, Homo sapiens
cctggcagaatattaaagtgca

SEQ ID NO: 7802829 - DNA, 22 bp, Homo sapiens
cctggcagacagcactgaagct

SEQ ID NO: 7802830 - DNA, 22 bp, Homo sapiens
tgtatgtatgtatgtatttggg

SEQ ID NO: 7802831 - DNA, 17 bp, Homo sapiens
cctgcccagagacagat

SEQ ID NO: 7802832 - DNA, 20 bp, Homo sapiens
tggtcctcacaggtcctccc

SEQ ID NO: 7802833 - DNA, 22 bp, Homo sapiens
cctgccagtgcctcccactggt

SEQ ID NO: 7802834 - DNA, 22 bp, Homo sapiens
cctgccagtgcctcccactggt

SEQ ID NO: 7802835 - DNA, 19 bp, Homo sapiens
tggtcccatactgctggcc

SEQ ID NO: 7802836 - DNA, 22 bp, Homo sapiens
cagctgctgcccttggctgcag

SEQ ID NO: 7802837 - DNA, 22 bp, Homo sapiens
cagctgtctcagggaggtgatc

SEQ ID NO: 7802838 - DNA, 22 bp, Homo sapiens
cagctgtctgaagcaggagtcc

SEQ ID NO: 7802839 - DNA, 22 bp, Homo sapiens
cagctgtctaagttgagcagga

SEQ ID NO: 7802840 - DNA, 22 bp, Homo sapiens
cagctgtctttgcacagtttag

SEQ ID NO: 7802841 - DNA, 22 bp, Homo sapiens
cagctgtctggggagtgctcgc

SEQ ID NO: 7802842 - DNA, 22 bp, Homo sapiens
gtgtatgttctacttaatatta

SEQ ID NO: 7802843 - DNA, 22 bp, Homo sapiens
gtgtacagtaagtgaatctagg

SEQ ID NO: 7802844 - DNA, 22 bp, Homo sapiens
gtggtacagctgaaaggcttgc

SEQ ID NO: 7802845 - DNA, 22 bp, Homo sapiens
gtgtatccttattcacacacat

SEQ ID NO: 7802846 - DNA, 22 bp, Homo sapiens
gtgtatctcatgttcttctctg

SEQ ID NO: 7802847 - DNA, 22 bp, Homo sapiens
gtggctttggaattgtagactc

SEQ ID NO: 7802848 - DNA, 22 bp, Homo sapiens
cagctgagtctgaggttctttg

SEQ ID NO: 7802849 - DNA, 22 bp, Homo sapiens
cagctgaggtcttttttatgtg

SEQ ID NO: 7802850 - DNA, 22 bp, Homo sapiens
cagctctttgagtattccattt

SEQ ID NO: 7802851 - DNA, 22 bp, Homo sapiens
cagctgaaagaaggaagtgtca

SEQ ID NO: 7802852 - DNA, 22 bp, Homo sapiens
cagctgaacatgtagagcatct

SEQ ID NO: 7802853 - DNA, 22 bp, Homo sapiens
gtggcagtgaaggtcatagcat

SEQ ID NO: 7802854 - DNA, 22 bp, Homo sapiens
gtggcaggttccgtagacagca

SEQ ID NO: 7802855 - DNA, 22 bp, Homo sapiens
gtggcagtcgctgacagataca

SEQ ID NO: 7802856 - DNA, 22 bp, Homo sapiens
cagctttctgtctcatgactga

SEQ ID NO: 7802857 - DNA, 22 bp, Homo sapiens
cagctttcttccttctgtctgt

SEQ ID NO: 7802858 - DNA, 22 bp, Homo sapiens
cagctttccagagacctgcccc

SEQ ID NO: 7802859 - DNA, 22 bp, Homo sapiens
cagctttccccgtgcctcagcc

SEQ ID NO: 7802860 - DNA, 22 bp, Homo sapiens
cagctttatttcacgtgtttgt

SEQ ID NO: 7802861 - DNA, 23 bp, Homo sapiens
cagctttcagggctttagggaag

SEQ ID NO: 7802862 - DNA, 20 bp, Homo sapiens
cagctttagatctttgatta

SEQ ID NO: 7802863 - DNA, 22 bp, Homo sapiens
cagctttaggactcataataaa

SEQ ID NO: 7802864 - DNA, 22 bp, Homo sapiens
cagctttaggactcataataaa

SEQ ID NO: 7802865 - DNA, 22 bp, Homo sapiens
cagctttagtaacccactgctc

SEQ ID NO: 7802866 - DNA, 17 bp, Homo sapiens
cagctttatgctactgt

SEQ ID NO: 7802867 - DNA, 22 bp, Homo sapiens
cagctttattaatgattgtctt

SEQ ID NO: 7802868 - DNA, 22 bp, Homo sapiens
cagctttattgaggtataattg

SEQ ID NO: 7802869 - DNA, 17 bp, Homo sapiens
cagctttatgctactgt

SEQ ID NO: 7802870 - DNA, 16 bp, Homo sapiens
cagctttatgtcagtg

SEQ ID NO: 7802871 - DNA, 22 bp, Homo sapiens
cagcttgtgcaaaggtcctggg

SEQ ID NO: 7802872 - DNA, 22 bp, Homo sapiens
cagcttgttaccgagggagggt

SEQ ID NO: 7802873 - DNA, 22 bp, Homo sapiens
cagcttgttttatttggggacc

SEQ ID NO: 7802874 - DNA, 22 bp, Homo sapiens
cagctttaccaatatttggaaa

SEQ ID NO: 7802875 - DNA, 22 bp, Homo sapiens
cagctttacctttaggagtaac

SEQ ID NO: 7802876 - DNA, 22 bp, Homo sapiens
cagctttagagaaaacatattt

SEQ ID NO: 7802877 - DNA, 22 bp, Homo sapiens
cagctttagagaaaacatattt

SEQ ID NO: 7802878 - DNA, 20 bp, Homo sapiens
cagcttggatgagaggctga

SEQ ID NO: 7802879 - DNA, 22 bp, Homo sapiens
gttattagaagtgaaggattgt

SEQ ID NO: 7802880 - DNA, 22 bp, Homo sapiens
gttattagtaagactcgcacat

SEQ ID NO: 7802881 - DNA, 22 bp, Homo sapiens
gttattctaccactatgtacag

SEQ ID NO: 7802882 - DNA, 22 bp, Homo sapiens
gtgtttgtttagtgcagagaga

SEQ ID NO: 7802883 - DNA, 22 bp, Homo sapiens
gtgtttgtgagctaggtgacat

SEQ ID NO: 7802884 - DNA, 22 bp, Homo sapiens
gttacagtcaggagatattttg

SEQ ID NO: 7802885 - DNA, 22 bp, Homo sapiens
gttacaaatgtaaattctgggg

SEQ ID NO: 7802886 - DNA, 22 bp, Homo sapiens
gttaaagtgatcttgtcaggtt

SEQ ID NO: 7802887 - DNA, 22 bp, Homo sapiens
gtgttttggccattagtgtgat

SEQ ID NO: 7802888 - DNA, 22 bp, Homo sapiens
gttaaacaataactggcacaca

SEQ ID NO: 7802889 - DNA, 22 bp, Homo sapiens
gtttcaaagcacagctcacatt

SEQ ID NO: 7802890 - DNA, 22 bp, Homo sapiens
gtttcaaagcacagctcacatt

SEQ ID NO: 7802891 - DNA, 22 bp, Homo sapiens
gtttattgggtattgtggagcc

SEQ ID NO: 7802892 - DNA, 22 bp, Homo sapiens
gtttattgataaaagctggaca

SEQ ID NO: 7802893 - DNA, 22 bp, Homo sapiens
gtttacattaagtattagcatc

SEQ ID NO: 7802894 - DNA, 22 bp, Homo sapiens
gtttacatgtaatgtgttattg

SEQ ID NO: 7802895 - DNA, 22 bp, Homo sapiens
gtttacatgtactcattatact

SEQ ID NO: 7802896 - DNA, 18 bp, Homo sapiens
gtttacattactgaatag

SEQ ID NO: 7802897 - DNA, 22 bp, Homo sapiens
gtttattattcaacttcatgtt

SEQ ID NO: 7802898 - DNA, 22 bp, Homo sapiens
gtttacatattttaattggtga

SEQ ID NO: 7802899 - DNA, 22 bp, Homo sapiens
gtttacatattttaattggtga

SEQ ID NO: 7802900 - DNA, 22 bp, Homo sapiens
gtttacagtggcttcattggat

SEQ ID NO: 7802901 - DNA, 22 bp, Homo sapiens
gtttacagtactcacttgcatt

SEQ ID NO: 7802902 - DNA, 22 bp, Homo sapiens
caggaacatttaaccacagggt

SEQ ID NO: 7802903 - DNA, 22 bp, Homo sapiens
caggaacagctgacctgacaat

SEQ ID NO: 7802904 - DNA, 22 bp, Homo sapiens
gttcttcagattccatttcagt

SEQ ID NO: 7802905 - DNA, 22 bp, Homo sapiens
gttcttcagccctcaggtccta

SEQ ID NO: 7802906 - DNA, 22 bp, Homo sapiens
gttctgtagtcatagagcaatt

SEQ ID NO: 7802907 - DNA, 22 bp, Homo sapiens
gttggcagagagaagcctagca

SEQ ID NO: 7802908 - DNA, 22 bp, Homo sapiens
gttgggaagcagatggatgagc

SEQ ID NO: 7802909 - DNA, 22 bp, Homo sapiens
tacatatgtatttgtgtatacg

SEQ ID NO: 7802910 - DNA, 22 bp, Homo sapiens
tacatatgagttcgttctatgc

SEQ ID NO: 7802911 - DNA, 22 bp, Homo sapiens
tacatatgaactttataacttg

SEQ ID NO: 7802912 - DNA, 19 bp, Homo sapiens
tacaagcttttttggcagg

SEQ ID NO: 7802913 - DNA, 22 bp, Homo sapiens
tacaatagggaggtttagggga

SEQ ID NO: 7802914 - DNA, 22 bp, Homo sapiens
tacagctggactggtagctgtg

SEQ ID NO: 7802915 - DNA, 22 bp, Homo sapiens
taatgttagtatgtaatcttat

SEQ ID NO: 7802916 - DNA, 22 bp, Homo sapiens
caggcagctgactgtcagatat

SEQ ID NO: 7802917 - DNA, 22 bp, Homo sapiens
caggcagccctgcaccaagtgt

SEQ ID NO: 7802918 - DNA, 22 bp, Homo sapiens
caggcagctgctgggttcagcc

SEQ ID NO: 7802919 - DNA, 22 bp, Homo sapiens
caggcagctgcgacaagagagc

SEQ ID NO: 7802920 - DNA, 22 bp, Homo sapiens
caggcagggagccactgtataa

SEQ ID NO: 7802921 - DNA, 22 bp, Homo sapiens
taaggcacccttctgagtagag

SEQ ID NO: 7802922 - DNA, 22 bp, Homo sapiens
caggcacaggggaatgtctttt

SEQ ID NO: 7802923 - DNA, 22 bp, Homo sapiens
caggcacaagatcggctagata

SEQ ID NO: 7802924 - DNA, 22 bp, Homo sapiens
caggcacaaatttctagataag

SEQ ID NO: 7802925 - DNA, 22 bp, Homo sapiens
caggatggtctcgatctcctga

SEQ ID NO: 7802926 - DNA, 15 bp, Homo sapiens
taacttttttgggct

SEQ ID NO: 7802927 - DNA, 21 bp, Homo sapiens
taacttttgtgcctatcttgt

SEQ ID NO: 7802928 - DNA, 22 bp, Homo sapiens
taacttttgtgatctgtcgatt

SEQ ID NO: 7802929 - DNA, 21 bp, Homo sapiens
taacttttgtgcctatcttgt

SEQ ID NO: 7802930 - DNA, 22 bp, Homo sapiens
taacttttctaggtgtgataat

SEQ ID NO: 7802931 - DNA, 22 bp, Homo sapiens
taacttttacttaccatctgag

SEQ ID NO: 7802932 - DNA, 22 bp, Homo sapiens
taacttttgtgatctgtcgatt

SEQ ID NO: 7802933 - DNA, 22 bp, Homo sapiens
taacttttacatttggctcact

SEQ ID NO: 7802934 - DNA, 22 bp, Homo sapiens
taacttttacatttggctcact

SEQ ID NO: 7802935 - DNA, 22 bp, Homo sapiens
taacattaggtagacataagcc

SEQ ID NO: 7802936 - DNA, 22 bp, Homo sapiens
taacaagtcattttaaattatg

SEQ ID NO: 7802937 - DNA, 22 bp, Homo sapiens
taacaatacccattctaattac

SEQ ID NO: 7802938 - DNA, 22 bp, Homo sapiens
taacacttgaagccatttttgc

SEQ ID NO: 7802939 - DNA, 22 bp, Homo sapiens
taaagtgcaggctactcagaag

SEQ ID NO: 7802940 - DNA, 22 bp, Homo sapiens
taaagcataatgaatatctaga

SEQ ID NO: 7802941 - DNA, 22 bp, Homo sapiens
caggagcaaggagcagtgggat

SEQ ID NO: 7802942 - DNA, 22 bp, Homo sapiens
caggagatgacagggaagaacc

SEQ ID NO: 7802943 - DNA, 21 bp, Homo sapiens
taaatgtgagcagggctgggc

SEQ ID NO: 7802944 - DNA, 22 bp, Homo sapiens
taaatgtaccttctgccttact

SEQ ID NO: 7802945 - DNA, 22 bp, Homo sapiens
caggaggcagcgctctcaggac

SEQ ID NO: 7802946 - DNA, 22 bp, Homo sapiens
caggagttcaaggttgcagtga

SEQ ID NO: 7802947 - DNA, 22 bp, Homo sapiens
caggataaatagtaaatgtaag

SEQ ID NO: 7802948 - DNA, 22 bp, Homo sapiens
caggagtttctattgttccaaa

SEQ ID NO: 7802949 - DNA, 22 bp, Homo sapiens
caggagtggtgtgagggactcc

SEQ ID NO: 7802950 - DNA, 22 bp, Homo sapiens
caggaggcatatttaaatccaa

SEQ ID NO: 7802951 - DNA, 22 bp, Homo sapiens
caggaggccaactgtgggactt

SEQ ID NO: 7802952 - DNA, 22 bp, Homo sapiens
caggaggctcctagggctctgt

SEQ ID NO: 7802953 - DNA, 22 bp, Homo sapiens
caggagggcccgagactcttcc

SEQ ID NO: 7802954 - DNA, 22 bp, Homo sapiens
caggagggcccgagactcttcc

SEQ ID NO: 7802955 - DNA, 22 bp, Homo sapiens
caggacaaagccctttgagaaa

SEQ ID NO: 7802956 - DNA, 22 bp, Homo sapiens
caggaaggaaagggtgtggaga

SEQ ID NO: 7802957 - DNA, 22 bp, Homo sapiens
caggaagggggatccttggaag

SEQ ID NO: 7802958 - DNA, 22 bp, Homo sapiens
caggaagtagagttggccagcc

SEQ ID NO: 7802959 - DNA, 22 bp, Homo sapiens
caggaagtcgcagagctggggg

SEQ ID NO: 7802960 - DNA, 22 bp, Homo sapiens
caggaagccttccttgtctgct

SEQ ID NO: 7802961 - DNA, 22 bp, Homo sapiens
taaacatttgttattcttgttt

SEQ ID NO: 7802962 - DNA, 22 bp, Homo sapiens
caggagacaagttagcagctga

SEQ ID NO: 7802963 - DNA, 22 bp, Homo sapiens
taaaatcagccgaccatggtgg

SEQ ID NO: 7802964 - DNA, 22 bp, Homo sapiens
taaaatcagccgaccatggtgg

SEQ ID NO: 7802965 - DNA, 22 bp, Homo sapiens
taaaatcattctggtgtcagta

SEQ ID NO: 7802966 - DNA, 22 bp, Homo sapiens
taaaatgacttcctccaacatc

SEQ ID NO: 7802967 - DNA, 22 bp, Homo sapiens
taaaatgacttcctccaacatc

SEQ ID NO: 7802968 - DNA, 22 bp, Homo sapiens
taaaaatcttatgaatggcaag

SEQ ID NO: 7802969 - DNA, 22 bp, Homo sapiens
gttttcctgagcccagagatgc

SEQ ID NO: 7802970 - DNA, 22 bp, Homo sapiens
ccacaaaactgtgtgtcaaaga

SEQ ID NO: 7802971 - DNA, 19 bp, Homo sapiens
ccacaaaattattttagtt

SEQ ID NO: 7802972 - DNA, 22 bp, Homo sapiens
tcctgcagtgtgtctcctgcac

SEQ ID NO: 7802973 - DNA, 22 bp, Homo sapiens
tcctgcagttacatcccagcca

SEQ ID NO: 7802974 - DNA, 22 bp, Homo sapiens
ccacagaggacaactgcctggc

SEQ ID NO: 7802975 - DNA, 20 bp, Homo sapiens
tcctgcagttcctaggaggg

SEQ ID NO: 7802976 - DNA, 22 bp, Homo sapiens
tcctgccacctgcacagctccc

SEQ ID NO: 7802977 - DNA, 22 bp, Homo sapiens
ccacagcatgcaggcctgacac

SEQ ID NO: 7802978 - DNA, 18 bp, Homo sapiens
ccacagcagagttcttac

SEQ ID NO: 7802979 - DNA, 22 bp, Homo sapiens
ccacagcacctgcagccagttg

SEQ ID NO: 7802980 - DNA, 22 bp, Homo sapiens
ccacagcaccgctgccagtccc

SEQ ID NO: 7802981 - DNA, 22 bp, Homo sapiens
ccaaagtattaaatcttagcaa

SEQ ID NO: 7802982 - DNA, 22 bp, Homo sapiens
catttgaagacttagaagagga

SEQ ID NO: 7802983 - DNA, 23 bp, Homo sapiens
catttgatcctcacaataaatgg

SEQ ID NO: 7802984 - DNA, 22 bp, Homo sapiens
tccctgcctgacagcacccacc

SEQ ID NO: 7802985 - DNA, 23 bp, Homo sapiens
tccaggcacgcatttcttctagc

SEQ ID NO: 7802986 - DNA, 22 bp, Homo sapiens
tccaggcacagagttggtcagt

SEQ ID NO: 7802987 - DNA, 22 bp, Homo sapiens
tccaggcacgaggccctgtgca

SEQ ID NO: 7802988 - DNA, 22 bp, Homo sapiens
tccaggcagagcaacaaaatat

SEQ ID NO: 7802989 - DNA, 22 bp, Homo sapiens
tccaggcactatatatactttt

SEQ ID NO: 7802990 - DNA, 20 bp, Homo sapiens
tccaggcagacagctatggg

SEQ ID NO: 7802991 - DNA, 17 bp, Homo sapiens
tccaggcagcaactgag

SEQ ID NO: 7802992 - DNA, 17 bp, Homo sapiens
tccaggcagcaactgag

SEQ ID NO: 7802993 - DNA, 21 bp, Homo sapiens
tcccagggccaggtgccatca

SEQ ID NO: 7802994 - DNA, 22 bp, Homo sapiens
tcccagggcactcaccctccct

SEQ ID NO: 7802995 - DNA, 22 bp, Homo sapiens
tcccagggcactcaccctccct

SEQ ID NO: 7802996 - DNA, 22 bp, Homo sapiens
tcccagggcagctgtccagaag

SEQ ID NO: 7802997 - DNA, 22 bp, Homo sapiens
tcccagggccgcaaacgagttt

SEQ ID NO: 7802998 - DNA, 22 bp, Homo sapiens
tcccagggctctagagtgctgg

SEQ ID NO: 7802999 - DNA, 22 bp, Homo sapiens
tcccagggcttttctcatgctt

SEQ ID NO: 7803000 - DNA, 22 bp, Homo sapiens
tcccagggtcagtggtgaggcc

SEQ ID NO: 7803001 - DNA, 22 bp, Homo sapiens
tcccagggtatcctgtagtaaa

SEQ ID NO: 7803002 - DNA, 22 bp, Homo sapiens
tcccagggggatgaacactgcc

SEQ ID NO: 7803003 - DNA, 19 bp, Homo sapiens
tctctctgtacattagata

SEQ ID NO: 7803004 - DNA, 22 bp, Homo sapiens
tctcctgggaggacaaggaagg

SEQ ID NO: 7803005 - DNA, 22 bp, Homo sapiens
tctcctgggaggacaaggaagg

SEQ ID NO: 7803006 - DNA, 22 bp, Homo sapiens
ccacagggtgtcatcagcttga

SEQ ID NO: 7803007 - DNA, 22 bp, Homo sapiens
tcctggtcagtgccaaactggt

SEQ ID NO: 7803008 - DNA, 22 bp, Homo sapiens
tcctggtctacactgcattggg

SEQ ID NO: 7803009 - DNA, 22 bp, Homo sapiens
tctgataatggacttctcatct

SEQ ID NO: 7803010 - DNA, 22 bp, Homo sapiens
tctgataatgtgcttcgtgacc

SEQ ID NO: 7803011 - DNA, 22 bp, Homo sapiens
ccagcctggggaggcagcttct

SEQ ID NO: 7803012 - DNA, 22 bp, Homo sapiens
tctgataaatgccatctttttg

SEQ ID NO: 7803013 - DNA, 22 bp, Homo sapiens
tctgataacaaccatgtctggc

SEQ ID NO: 7803014 - DNA, 22 bp, Homo sapiens
tctgataaataacatttggaaa

SEQ ID NO: 7803015 - DNA, 20 bp, Homo sapiens
tctgataaaaactactccat

SEQ ID NO: 7803016 - DNA, 22 bp, Homo sapiens
tctgataactctggccccaggc

SEQ ID NO: 7803017 - DNA, 22 bp, Homo sapiens
tctgataagacagctgatttga

SEQ ID NO: 7803018 - DNA, 20 bp, Homo sapiens
tctgataactggttgtgatt

SEQ ID NO: 7803019 - DNA, 23 bp, Homo sapiens
tctgataagggagagggaagcag

SEQ ID NO: 7803020 - DNA, 22 bp, Homo sapiens
tctgataagtggtgtatactgt

SEQ ID NO: 7803021 - DNA, 22 bp, Homo sapiens
ccagccttactgcccttcagtg

SEQ ID NO: 7803022 - DNA, 21 bp, Homo sapiens
tctgccagctgaagaggtgga

SEQ ID NO: 7803023 - DNA, 22 bp, Homo sapiens
tctgccagaagttctgagagta

SEQ ID NO: 7803024 - DNA, 22 bp, Homo sapiens
tctgaaatattggtaatacttt

SEQ ID NO: 7803025 - DNA, 22 bp, Homo sapiens
tctgaaatatattttgagtgtt

SEQ ID NO: 7803026 - DNA, 22 bp, Homo sapiens
tctgaaataggagccatgtaga

SEQ ID NO: 7803027 - DNA, 22 bp, Homo sapiens
tctgaaataggcttcttttggt

SEQ ID NO: 7803028 - DNA, 22 bp, Homo sapiens
tctgaaataggaaagcaaatgg

SEQ ID NO: 7803029 - DNA, 22 bp, Homo sapiens
tctgaaatctgtaagcactagc

SEQ ID NO: 7803030 - DNA, 22 bp, Homo sapiens
tctgaaatctaatgctctgtgg

SEQ ID NO: 7803031 - DNA, 22 bp, Homo sapiens
tctgaaatcctttatcttggct

SEQ ID NO: 7803032 - DNA, 22 bp, Homo sapiens
ccagccacgaagctcccttcat

SEQ ID NO: 7803033 - DNA, 22 bp, Homo sapiens
ccagccactgggccactgccag

SEQ ID NO: 7803034 - DNA, 22 bp, Homo sapiens
ccagccactgggccactgccag

SEQ ID NO: 7803035 - DNA, 22 bp, Homo sapiens
ccagccccgggaacctggccgt

SEQ ID NO: 7803036 - DNA, 19 bp, Homo sapiens
ccagcccatagtccatcac

SEQ ID NO: 7803037 - DNA, 22 bp, Homo sapiens
ccagcccaaacaagccgccttc

SEQ ID NO: 7803038 - DNA, 22 bp, Homo sapiens
tctgagatttgtatggtgagac

SEQ ID NO: 7803039 - DNA, 22 bp, Homo sapiens
tctgaggaccatcggggagctg

SEQ ID NO: 7803040 - DNA, 22 bp, Homo sapiens
ccaggaagcctcagatgctgag

SEQ ID NO: 7803041 - DNA, 23 bp, Homo sapiens
tctgtctgtgtatgtgcagaaag

SEQ ID NO: 7803042 - DNA, 22 bp, Homo sapiens
tctgtcttagccatctcaggct

SEQ ID NO: 7803043 - DNA, 18 bp, Homo sapiens
tctgtctgtacaagtatc

SEQ ID NO: 7803044 - DNA, 22 bp, Homo sapiens
ccaggaggcagaggttgtagtg

SEQ ID NO: 7803045 - DNA, 22 bp, Homo sapiens
ccaggaggcggaaggtacagtg

SEQ ID NO: 7803046 - DNA, 22 bp, Homo sapiens
tctggctttattccttcactga

SEQ ID NO: 7803047 - DNA, 22 bp, Homo sapiens
tctggcttggacacaatcttcc

SEQ ID NO: 7803048 - DNA, 22 bp, Homo sapiens
tctggcttctcctagagcaatg

SEQ ID NO: 7803049 - DNA, 22 bp, Homo sapiens
catccagggcagccatggcctg

SEQ ID NO: 7803050 - DNA, 22 bp, Homo sapiens
catccagggcagccatggcctg

SEQ ID NO: 7803051 - DNA, 23 bp, Homo sapiens
catccaggagctgagtctgactg

SEQ ID NO: 7803052 - DNA, 23 bp, Homo sapiens
catccaggagctgagtctgactg

SEQ ID NO: 7803053 - DNA, 22 bp, Homo sapiens
catccaggcaccacaaccagct

SEQ ID NO: 7803054 - DNA, 22 bp, Homo sapiens
catccaggcaccacaaccagct

SEQ ID NO: 7803055 - DNA, 22 bp, Homo sapiens
catccagagtccaaggctgggc

SEQ ID NO: 7803056 - DNA, 22 bp, Homo sapiens
catcacagggggctagaagtct

SEQ ID NO: 7803057 - DNA, 22 bp, Homo sapiens
tcagggattgcaaaattcatcc

SEQ ID NO: 7803058 - DNA, 22 bp, Homo sapiens
tcagggattgcaaaattcatcc

SEQ ID NO: 7803059 - DNA, 22 bp, Homo sapiens
catatactgcatacatatgtgt

SEQ ID NO: 7803060 - DNA, 20 bp, Homo sapiens
catatatacctagaagtgga

SEQ ID NO: 7803061 - DNA, 22 bp, Homo sapiens
catataaatacaacatgtgtta

SEQ ID NO: 7803062 - DNA, 22 bp, Homo sapiens
catataatgtttgaagatgtgg

SEQ ID NO: 7803063 - DNA, 22 bp, Homo sapiens
cagtttctgttttaaatagcag

SEQ ID NO: 7803064 - DNA, 22 bp, Homo sapiens
cagtttcttctattttgaacta

SEQ ID NO: 7803065 - DNA, 22 bp, Homo sapiens
cagtttatatgtcagagctgta

SEQ ID NO: 7803066 - DNA, 22 bp, Homo sapiens
catacattttgcatatttacca

SEQ ID NO: 7803067 - DNA, 22 bp, Homo sapiens
catagaaaagagtaggtaatgt

SEQ ID NO: 7803068 - DNA, 22 bp, Homo sapiens
tccaggcaagggaggagcatgg

SEQ ID NO: 7803069 - DNA, 22 bp, Homo sapiens
tccaggcaagggaggagcatgg

SEQ ID NO: 7803070 - DNA, 22 bp, Homo sapiens
tccaggcaaggataataaacat

SEQ ID NO: 7803071 - DNA, 22 bp, Homo sapiens
tccaggcaagggaggagcatgg

SEQ ID NO: 7803072 - DNA, 22 bp, Homo sapiens
tccaggcaaagtgctgggctgc

SEQ ID NO: 7803073 - DNA, 22 bp, Homo sapiens
tccaggcaaaaaccaactacag

SEQ ID NO: 7803074 - DNA, 22 bp, Homo sapiens
tccaggcaaaaaccaactacag

SEQ ID NO: 7803075 - DNA, 22 bp, Homo sapiens
tccaggcaaaaggaactgcttg

SEQ ID NO: 7803076 - DNA, 22 bp, Homo sapiens
tccaggcaaagccttgtagacg

SEQ ID NO: 7803077 - DNA, 22 bp, Homo sapiens
tccaggcaaagggactagcagg

SEQ ID NO: 7803078 - DNA, 22 bp, Homo sapiens
catggcttttagccctacatga

SEQ ID NO: 7803079 - DNA, 22 bp, Homo sapiens
catgtacatgcctactatcaat

SEQ ID NO: 7803080 - DNA, 23 bp, Homo sapiens
catgtctgctttcatgctacaac

SEQ ID NO: 7803081 - DNA, 22 bp, Homo sapiens
tcattttgcctgccatttgagt

SEQ ID NO: 7803082 - DNA, 22 bp, Homo sapiens
tcattttgcctgccatttgagt

SEQ ID NO: 7803083 - DNA, 22 bp, Homo sapiens
catgcaaaggtcaagatcagga

SEQ ID NO: 7803084 - DNA, 22 bp, Homo sapiens
catctttagttattgaatatag

SEQ ID NO: 7803085 - DNA, 22 bp, Homo sapiens
tcagttctaacagtttagaaca

SEQ ID NO: 7803086 - DNA, 18 bp, Homo sapiens
tcatttgttttgcatgaa

SEQ ID NO: 7803087 - DNA, 17 bp, Homo sapiens
tcatttgttgtgactag

SEQ ID NO: 7803088 - DNA, 22 bp, Homo sapiens
tcatttcaagttctgacagcta

SEQ ID NO: 7803089 - DNA, 22 bp, Homo sapiens
tcatgtcagtttcttctataaa

SEQ ID NO: 7803090 - DNA, 22 bp, Homo sapiens
tcatgtcagctgttgatgtgca

SEQ ID NO: 7803091 - DNA, 22 bp, Homo sapiens
catgatgttatctaaatctggt

SEQ ID NO: 7803092 - DNA, 22 bp, Homo sapiens
catgataacttcattacacaat

SEQ ID NO: 7803093 - DNA, 22 bp, Homo sapiens
catgataacttcattacacaat

SEQ ID NO: 7803094 - DNA, 22 bp, Homo sapiens
tcagtttatggtctagttcatg

SEQ ID NO: 7803095 - DNA, 22 bp, Homo sapiens
tcagtttataaattgtatttag

SEQ ID NO: 7803096 - DNA, 22 bp, Homo sapiens
tcagtttaagatgactaacaat

SEQ ID NO: 7803097 - DNA, 22 bp, Homo sapiens
tcagtttaatacccagatgcct

SEQ ID NO: 7803098 - DNA, 22 bp, Homo sapiens
catgagaatgaagaagacttaa

SEQ ID NO: 7803099 - DNA, 22 bp, Homo sapiens
catgagaatgaagaagacttaa

SEQ ID NO: 7803100 - DNA, 22 bp, Homo sapiens
tcaccagggctccagccagcct

SEQ ID NO: 7803101 - DNA, 23 bp, Homo sapiens
tcagaacaatgccttaggggcat

SEQ ID NO: 7803102 - DNA, 22 bp, Homo sapiens
tcagaacaattcctttataaca

SEQ ID NO: 7803103 - DNA, 22 bp, Homo sapiens
tcactcctcaggctagcatcat

SEQ ID NO: 7803104 - DNA, 22 bp, Homo sapiens
tcactcaggctggagtgcagtg

SEQ ID NO: 7803105 - DNA, 22 bp, Homo sapiens
cagtcctctctgtgtctgcacc

SEQ ID NO: 7803106 - DNA, 22 bp, Homo sapiens
tattggctgcagcttcctctgt

SEQ ID NO: 7803107 - DNA, 22 bp, Homo sapiens
tattgggcagacatcaggctta

SEQ ID NO: 7803108 - DNA, 22 bp, Homo sapiens
tatttagaacagacaatagaaa

SEQ ID NO: 7803109 - DNA, 22 bp, Homo sapiens
cagtgatatttatcctactcac

SEQ ID NO: 7803110 - DNA, 22 bp, Homo sapiens
cagtgagtgtgggaagtctctg

SEQ ID NO: 7803111 - DNA, 22 bp, Homo sapiens
cagtgaggtggatggatggcct

SEQ ID NO: 7803112 - DNA, 22 bp, Homo sapiens
cagtgaggtggatggatggcct

SEQ ID NO: 7803113 - DNA, 22 bp, Homo sapiens
cagtgaggtgcccagcctgccc

SEQ ID NO: 7803114 - DNA, 22 bp, Homo sapiens
cagtgaggtgcccagcctgccc

SEQ ID NO: 7803115 - DNA, 22 bp, Homo sapiens
cagtgaggtggagtagttccca

SEQ ID NO: 7803116 - DNA, 21 bp, Homo sapiens
cagtgaggtccccagcctagg

SEQ ID NO: 7803117 - DNA, 21 bp, Homo sapiens
cagtgaggtccccagcctagg

SEQ ID NO: 7803118 - DNA, 22 bp, Homo sapiens
cagtgaggtagacagctttttc

SEQ ID NO: 7803119 - DNA, 18 bp, Homo sapiens
cagtctaattcccttccc

SEQ ID NO: 7803120 - DNA, 22 bp, Homo sapiens
cagtctaatctgttactcatta

SEQ ID NO: 7803121 - DNA, 22 bp, Homo sapiens
cagtctaacttcacagcctgga

SEQ ID NO: 7803122 - DNA, 22 bp, Homo sapiens
cagtctaagttaatttccacaa

SEQ ID NO: 7803123 - DNA, 22 bp, Homo sapiens
cagtctaagactcacgccaaga

SEQ ID NO: 7803124 - DNA, 22 bp, Homo sapiens
cagtgattttaaactatggatg

SEQ ID NO: 7803125 - DNA, 22 bp, Homo sapiens
cagtgattaaaacatgacagcc

SEQ ID NO: 7803126 - DNA, 22 bp, Homo sapiens
tatctcagctggatcagtggaa

SEQ ID NO: 7803127 - DNA, 23 bp, Homo sapiens
tatctcagaggaatgtagttact

SEQ ID NO: 7803128 - DNA, 22 bp, Homo sapiens
caggtctgttttcaaggtcagt

SEQ ID NO: 7803129 - DNA, 22 bp, Homo sapiens
caggtctttgttgcagcatgga

SEQ ID NO: 7803130 - DNA, 22 bp, Homo sapiens
tatgttttaggaattaattgtt

SEQ ID NO: 7803131 - DNA, 22 bp, Homo sapiens
tatgtttgttatcacaactagg

SEQ ID NO: 7803132 - DNA, 22 bp, Homo sapiens
tatgtttgttatcacaactagg

SEQ ID NO: 7803133 - DNA, 22 bp, Homo sapiens
tatgtttttaagagaatgcatt

SEQ ID NO: 7803134 - DNA, 22 bp, Homo sapiens
tatgtttttaagagaatgcatt

SEQ ID NO: 7803135 - DNA, 22 bp, Homo sapiens
tatgtttttcagacgtcctaca

SEQ ID NO: 7803136 - DNA, 22 bp, Homo sapiens
tattaaagggaagttatgcatg

SEQ ID NO: 7803137 - DNA, 22 bp, Homo sapiens
tattaaagagagaatcatcatc

SEQ ID NO: 7803138 - DNA, 22 bp, Homo sapiens
tattaaatatatctgttagttg

SEQ ID NO: 7803139 - DNA, 22 bp, Homo sapiens
tatacagttaagtttcttcagt

SEQ ID NO: 7803140 - DNA, 22 bp, Homo sapiens
tatacagtatcttttgaaggca

SEQ ID NO: 7803141 - DNA, 21 bp, Homo sapiens
tatacagtaattaagtggtat

SEQ ID NO: 7803142 - DNA, 23 bp, Homo sapiens
tatacagtctccaggcagtcctt

SEQ ID NO: 7803143 - DNA, 22 bp, Homo sapiens
tatctattccaaatatcagcgt

SEQ ID NO: 7803144 - DNA, 22 bp, Homo sapiens
tagttttagtcccattttacag

SEQ ID NO: 7803145 - DNA, 22 bp, Homo sapiens
tataagcacatccttgactgat

SEQ ID NO: 7803146 - DNA, 22 bp, Homo sapiens
caggggcaagaatgctgtcagc

SEQ ID NO: 7803147 - DNA, 22 bp, Homo sapiens
ttattcagtctgtctagggagt

SEQ ID NO: 7803148 - DNA, 22 bp, Homo sapiens
ttattattgattcgctctcaaa

SEQ ID NO: 7803149 - DNA, 22 bp, Homo sapiens
ttattcttggatctgagtctct

SEQ ID NO: 7803150 - DNA, 22 bp, Homo sapiens
ttatttatgttaacagtcgaga

SEQ ID NO: 7803151 - DNA, 22 bp, Homo sapiens
ttagtcttcttccttatatgtt

SEQ ID NO: 7803152 - DNA, 22 bp, Homo sapiens
ttagtcttggtgagtcttggtt

SEQ ID NO: 7803153 - DNA, 22 bp, Homo sapiens
ttattattccccaagtcattat

SEQ ID NO: 7803154 - DNA, 22 bp, Homo sapiens
ttattattgattcgctctcaaa

SEQ ID NO: 7803155 - DNA, 22 bp, Homo sapiens
ttatgatttgccacagattggt

SEQ ID NO: 7803156 - DNA, 22 bp, Homo sapiens
ttatgatttgccacagattggt

SEQ ID NO: 7803157 - DNA, 22 bp, Homo sapiens
ttagaaaggggtgaatcaatgg

SEQ ID NO: 7803158 - DNA, 22 bp, Homo sapiens
ttagataatgtagagatatgag

SEQ ID NO: 7803159 - DNA, 22 bp, Homo sapiens
ttagataatgtagagatatgag

SEQ ID NO: 7803160 - DNA, 22 bp, Homo sapiens
ttagggacagctctgtaggtga

SEQ ID NO: 7803161 - DNA, 19 bp, Homo sapiens
ttagggacatgaattctag

SEQ ID NO: 7803162 - DNA, 22 bp, Homo sapiens
ttagggacaaatttgcagaacc

SEQ ID NO: 7803163 - DNA, 22 bp, Homo sapiens
ttagggaaggctgctgtcagct

SEQ ID NO: 7803164 - DNA, 22 bp, Homo sapiens
ttaggaagaaggaggcagtatt

SEQ ID NO: 7803165 - DNA, 22 bp, Homo sapiens
ttagatttacaagcactgttta

SEQ ID NO: 7803166 - DNA, 22 bp, Homo sapiens
ttaataagtagtagttattgtt

SEQ ID NO: 7803167 - DNA, 22 bp, Homo sapiens
ttaataataatgagcccatttt

SEQ ID NO: 7803168 - DNA, 21 bp, Homo sapiens
ttaatgctatgcagaaaatct

SEQ ID NO: 7803169 - DNA, 22 bp, Homo sapiens
ttaaactgcagactcagtgttc

SEQ ID NO: 7803170 - DNA, 22 bp, Homo sapiens
ttaaagaggcaggttaaataat

SEQ ID NO: 7803171 - DNA, 22 bp, Homo sapiens
ttaataaagtatgaattggaaa

SEQ ID NO: 7803172 - DNA, 22 bp, Homo sapiens
ttacaactggtgaattttatgg

SEQ ID NO: 7803173 - DNA, 21 bp, Homo sapiens
ttacaacatttgtgttctatg

SEQ ID NO: 7803174 - DNA, 22 bp, Homo sapiens
ttacaaagtgctgcaccatttt

SEQ ID NO: 7803175 - DNA, 22 bp, Homo sapiens
ttaatgttttaagttatagaga

SEQ ID NO: 7803176 - DNA, 22 bp, Homo sapiens
ttacagatactttgtaggcaag

SEQ ID NO: 7803177 - DNA, 22 bp, Homo sapiens
ttacacaaaaataagatatggc

SEQ ID NO: 7803178 - DNA, 22 bp, Homo sapiens
ttacacttttgacaaacctgag

SEQ ID NO: 7803179 - DNA, 22 bp, Homo sapiens
ttacattttagttaacctgtga

SEQ ID NO: 7803180 - DNA, 22 bp, Homo sapiens
ttacatttcccccttggaggct

SEQ ID NO: 7803181 - DNA, 22 bp, Homo sapiens
ttacatttggctatgtcctcta

SEQ ID NO: 7803182 - DNA, 22 bp, Homo sapiens
ttacagcagcagggacagacta

SEQ ID NO: 7803183 - DNA, 22 bp, Homo sapiens
ttacagcatttaatgagatctg

SEQ ID NO: 7803184 - DNA, 21 bp, Homo sapiens
ttacagcaatgttagcaggaa

SEQ ID NO: 7803185 - DNA, 22 bp, Homo sapiens
ttatttctactattttgcctga

SEQ ID NO: 7803186 - DNA, 22 bp, Homo sapiens
ttatttctactattttgcctga

SEQ ID NO: 7803187 - DNA, 22 bp, Homo sapiens
ttatttgtaaaggtccatagta

SEQ ID NO: 7803188 - DNA, 22 bp, Homo sapiens
ttatttggttattgtaattggg

SEQ ID NO: 7803189 - DNA, 22 bp, Homo sapiens
ttatttggcaatgcttcaccat

SEQ ID NO: 7803190 - DNA, 22 bp, Homo sapiens
ttatttgtgaatcatttatcta

SEQ ID NO: 7803191 - DNA, 22 bp, Homo sapiens
ttcacattggtgatatgtttct

SEQ ID NO: 7803192 - DNA, 22 bp, Homo sapiens
ttcagcatgggtgtgataaatg

SEQ ID NO: 7803193 - DNA, 22 bp, Homo sapiens
ttcagcctgttcatgctgttgc

SEQ ID NO: 7803194 - DNA, 23 bp, Homo sapiens
ttcaggaaatgaatacagacaca

SEQ ID NO: 7803195 - DNA, 22 bp, Homo sapiens
ttcaggaaggtcctatagcaga

SEQ ID NO: 7803196 - DNA, 22 bp, Homo sapiens
ttcaggaataattatcatatga

SEQ ID NO: 7803197 - DNA, 20 bp, Homo sapiens
ttcaggaataagatagcagc

SEQ ID NO: 7803198 - DNA, 22 bp, Homo sapiens
ttcactgaattaatttccttct

SEQ ID NO: 7803199 - DNA, 22 bp, Homo sapiens
ttcattgaaccactttattctt

SEQ ID NO: 7803200 - DNA, 22 bp, Homo sapiens
ttcattgagtggtttattctaa

SEQ ID NO: 7803201 - DNA, 22 bp, Homo sapiens
ttcattcatcacatgcagctgg

SEQ ID NO: 7803202 - DNA, 21 bp, Homo sapiens
ttcattcatggcataatatag

SEQ ID NO: 7803203 - DNA, 22 bp, Homo sapiens
ttcattcacccaggaaacatct

SEQ ID NO: 7803204 - DNA, 22 bp, Homo sapiens
ttcattcaaggggttcctgatt

SEQ ID NO: 7803205 - DNA, 23 bp, Homo sapiens
ttcattcaaaaggaaaagtcatg

SEQ ID NO: 7803206 - DNA, 22 bp, Homo sapiens
ttcaggaatcaaccaagtcatt

SEQ ID NO: 7803207 - DNA, 22 bp, Homo sapiens
ttcaggaatataggcattgaca

SEQ ID NO: 7803208 - DNA, 22 bp, Homo sapiens
ttcatgtttgtaggactgaggc

SEQ ID NO: 7803209 - DNA, 23 bp, Homo sapiens
ttccagagtccacatctgccacc

SEQ ID NO: 7803210 - DNA, 22 bp, Homo sapiens
ttccagaggtagcaatgacttg

SEQ ID NO: 7803211 - DNA, 17 bp, Homo sapiens
ttccagcatgttactaa

SEQ ID NO: 7803212 - DNA, 22 bp, Homo sapiens
tgtgggaggattcagaattggg

SEQ ID NO: 7803213 - DNA, 22 bp, Homo sapiens
tgtggggaagagtatgacttgg

SEQ ID NO: 7803214 - DNA, 23 bp, Homo sapiens
tgtgtacacaatagatgaggttt

SEQ ID NO: 7803215 - DNA, 22 bp, Homo sapiens
tgtgtacacaagtatatataca

SEQ ID NO: 7803216 - DNA, 22 bp, Homo sapiens
tgtgtacacacagatatataca

SEQ ID NO: 7803217 - DNA, 22 bp, Homo sapiens
tgtgtgtgacaacctagttcag

SEQ ID NO: 7803218 - DNA, 22 bp, Homo sapiens
tgtgtggattcatctcaaagag

SEQ ID NO: 7803219 - DNA, 22 bp, Homo sapiens
tgtgttaagtatttgatacact

SEQ ID NO: 7803220 - DNA, 22 bp, Homo sapiens
tgttaaaaccacaggtgaggac

SEQ ID NO: 7803221 - DNA, 22 bp, Homo sapiens
tgttaaaaattcagctctagat

SEQ ID NO: 7803222 - DNA, 22 bp, Homo sapiens
tgtgtgtgtttctgctcataca

SEQ ID NO: 7803223 - DNA, 22 bp, Homo sapiens
tgtgtgtgtttacagtttctca

SEQ ID NO: 7803224 - DNA, 22 bp, Homo sapiens
tgtgtgtgttcctcctcagcta

SEQ ID NO: 7803225 - DNA, 18 bp, Homo sapiens
tgtttatttttctcttac

SEQ ID NO: 7803226 - DNA, 22 bp, Homo sapiens
tgtttgctctgactatcttgcg

SEQ ID NO: 7803227 - DNA, 22 bp, Homo sapiens
tgtttggaaacactggcagaaa

SEQ ID NO: 7803228 - DNA, 22 bp, Homo sapiens
tgttttagttctgtcttgcatg

SEQ ID NO: 7803229 - DNA, 22 bp, Homo sapiens
tgttttatgagccatataacct

SEQ ID NO: 7803230 - DNA, 23 bp, Homo sapiens
tgtttgtttctatgagagatagc

SEQ ID NO: 7803231 - DNA, 22 bp, Homo sapiens
ttaaaaaccatcttcctttcct

SEQ ID NO: 7803232 - DNA, 20 bp, Homo sapiens
ttaaaaagagtcacaggaga

SEQ ID NO: 7803233 - DNA, 22 bp, Homo sapiens
ttaaaagaatcctgttatcctc

SEQ ID NO: 7803234 - DNA, 22 bp, Homo sapiens
ttaaaattatggcccatttgga

SEQ ID NO: 7803235 - DNA, 22 bp, Homo sapiens
ttaaaatttccccaccatgtat

SEQ ID NO: 7803236 - DNA, 22 bp, Homo sapiens
ttaaaatttccccaccatgtat

SEQ ID NO: 7803237 - DNA, 18 bp, Homo sapiens
tgtttattctcctgacag

SEQ ID NO: 7803238 - DNA, 22 bp, Homo sapiens
tgtttattgagtgcctactata

SEQ ID NO: 7803239 - DNA, 22 bp, Homo sapiens
tgtttattcatggctaatgaaa

SEQ ID NO: 7803240 - DNA, 18 bp, Homo sapiens
tgttaaatgaagatttgc

SEQ ID NO: 7803241 - DNA, 22 bp, Homo sapiens
tgttaaatgtattatgtgttct

SEQ ID NO: 7803242 - DNA, 22 bp, Homo sapiens
tgttcttgagcctttagaccta

SEQ ID NO: 7803243 - DNA, 22 bp, Homo sapiens
tgttctttgctgttgatgtaga

SEQ ID NO: 7803244 - DNA, 22 bp, Homo sapiens
tgttcttttctctaaactgata

SEQ ID NO: 7803245 - DNA, 22 bp, Homo sapiens
tgttctttgccagtgatttaat

SEQ ID NO: 7803246 - DNA, 22 bp, Homo sapiens
tgttagggtcctgtgcaggggc

SEQ ID NO: 7803247 - DNA, 22 bp, Homo sapiens
tgtgcacattctaggactagta

SEQ ID NO: 7803248 - DNA, 19 bp, Homo sapiens
tgtgcctctatagcatgtg

SEQ ID NO: 7803249 - DNA, 22 bp, Homo sapiens
tgtgctctgcccctgactgttt

SEQ ID NO: 7803250 - DNA, 22 bp, Homo sapiens
tgtgctctgactttctcctggt

SEQ ID NO: 7803251 - DNA, 17 bp, Homo sapiens
tgtgctctctcactcag

SEQ ID NO: 7803252 - DNA, 22 bp, Homo sapiens
tgtgctcttctgttacttgtag

SEQ ID NO: 7803253 - DNA, 22 bp, Homo sapiens
tgtgctctggagttgccttcac

SEQ ID NO: 7803254 - DNA, 22 bp, Homo sapiens
tgtgattctcagaagagggaag

SEQ ID NO: 7803255 - DNA, 22 bp, Homo sapiens
tgtgatttcactggtgacatgt

SEQ ID NO: 7803256 - DNA, 22 bp, Homo sapiens
tgtctgaagcagccagtgctgt

SEQ ID NO: 7803257 - DNA, 22 bp, Homo sapiens
tgtctgagtgcatatgtgctgg

SEQ ID NO: 7803258 - DNA, 22 bp, Homo sapiens
tgtctctgaggtgagggtcagc

SEQ ID NO: 7803259 - DNA, 22 bp, Homo sapiens
tgtctctgagatgactcccacc

SEQ ID NO: 7803260 - DNA, 23 bp, Homo sapiens
tgtctccatctcattacttgggg

SEQ ID NO: 7803261 - DNA, 22 bp, Homo sapiens
tgtcttaatttccctttgtcat

SEQ ID NO: 7803262 - DNA, 19 bp, Homo sapiens
tgtctgctgatgactctat

SEQ ID NO: 7803263 - DNA, 22 bp, Homo sapiens
tgtctggcatagttgctccctg

SEQ ID NO: 7803264 - DNA, 22 bp, Homo sapiens
tgtgaaaagcaggctactttct

SEQ ID NO: 7803265 - DNA, 22 bp, Homo sapiens
tgtgaaaaaagttctagaagga

SEQ ID NO: 7803266 - DNA, 22 bp, Homo sapiens
tgtctttaaaattaaacacatc

SEQ ID NO: 7803267 - DNA, 19 bp, Homo sapiens
tgtctttaactggaaccac

SEQ ID NO: 7803268 - DNA, 22 bp, Homo sapiens
tgtctttaagcaaacagtgttt

SEQ ID NO: 7803269 - DNA, 17 bp, Homo sapiens
tgtcttctgaagagagc

SEQ ID NO: 7803270 - DNA, 22 bp, Homo sapiens
tgtcttcgctacaatgaaaagg

SEQ ID NO: 7803271 - DNA, 22 bp, Homo sapiens
tgggatgtctttaggggaagag

SEQ ID NO: 7803272 - DNA, 22 bp, Homo sapiens
tgggaggccgaggcaggtggat

SEQ ID NO: 7803273 - DNA, 22 bp, Homo sapiens
tgggaggccaaggcaggcggat

SEQ ID NO: 7803274 - DNA, 22 bp, Homo sapiens
tgggcaggggccctgcttccgt

SEQ ID NO: 7803275 - DNA, 22 bp, Homo sapiens
tgggcagcagcaaagccagact

SEQ ID NO: 7803276 - DNA, 22 bp, Homo sapiens
tgggcagtggctgggcctctct

SEQ ID NO: 7803277 - DNA, 22 bp, Homo sapiens
tgggctcaatctgcttctgttt

SEQ ID NO: 7803278 - DNA, 22 bp, Homo sapiens
tgggcgacagagcaagactccg

SEQ ID NO: 7803279 - DNA, 22 bp, Homo sapiens
tgggcgacagagcaagactccg

SEQ ID NO: 7803280 - DNA, 22 bp, Homo sapiens
tgggggagccttcacagtagct

SEQ ID NO: 7803281 - DNA, 22 bp, Homo sapiens
tggggaggttcgggaatcttgt

SEQ ID NO: 7803282 - DNA, 22 bp, Homo sapiens
tggggaggaagtcagatttcag

SEQ ID NO: 7803283 - DNA, 22 bp, Homo sapiens
tgggcttcataattggtcctag

SEQ ID NO: 7803284 - DNA, 22 bp, Homo sapiens
tgggtagagtggagggataaga

SEQ ID NO: 7803285 - DNA, 22 bp, Homo sapiens
tggggtggggttactcattctg

SEQ ID NO: 7803286 - DNA, 22 bp, Homo sapiens
tggggtggaacccttctgctgg

SEQ ID NO: 7803287 - DNA, 22 bp, Homo sapiens
tggggtggaacccttctgctgg

SEQ ID NO: 7803288 - DNA, 22 bp, Homo sapiens
tgggtggtccaggctcagcaga

SEQ ID NO: 7803289 - DNA, 22 bp, Homo sapiens
tgggtggtcttgcttcccagga

SEQ ID NO: 7803290 - DNA, 22 bp, Homo sapiens
tgggtggttgctgaggctcctt

SEQ ID NO: 7803291 - DNA, 21 bp, Homo sapiens
tgggtgggcagagtctcttca

SEQ ID NO: 7803292 - DNA, 22 bp, Homo sapiens
tggtaagaacccatcagagaag

SEQ ID NO: 7803293 - DNA, 22 bp, Homo sapiens
tggtcacacatgtatctcaatg

SEQ ID NO: 7803294 - DNA, 22 bp, Homo sapiens
tggtatttccaggcttatggta

SEQ ID NO: 7803295 - DNA, 22 bp, Homo sapiens
tggtatgaccgtggtgcaagca

SEQ ID NO: 7803296 - DNA, 22 bp, Homo sapiens
tggtatgtaaattgtaactcaa

SEQ ID NO: 7803297 - DNA, 22 bp, Homo sapiens
tggtatgtaaattgtaactcaa

SEQ ID NO: 7803298 - DNA, 22 bp, Homo sapiens
tggtcattaattcttaccttta

SEQ ID NO: 7803299 - DNA, 22 bp, Homo sapiens
tggtctcccagagcagggacgc

SEQ ID NO: 7803300 - DNA, 22 bp, Homo sapiens
tggtctctgcaggccaggctca

SEQ ID NO: 7803301 - DNA, 22 bp, Homo sapiens
tggtgcaggtgttgatgcagga

SEQ ID NO: 7803302 - DNA, 22 bp, Homo sapiens
tgtaaaataccattccttgtca

SEQ ID NO: 7803303 - DNA, 23 bp, Homo sapiens
tgtaaaatggggtagtgttacca

SEQ ID NO: 7803304 - DNA, 22 bp, Homo sapiens
tgtaaaataattctccatgttt

SEQ ID NO: 7803305 - DNA, 22 bp, Homo sapiens
tgtaaacaaatgcattcttgct

SEQ ID NO: 7803306 - DNA, 18 bp, Homo sapiens
tgtaaacactttcattct

SEQ ID NO: 7803307 - DNA, 18 bp, Homo sapiens
tgtaaacactttcattct

SEQ ID NO: 7803308 - DNA, 22 bp, Homo sapiens
tgtaaatgaagtatgctttact

SEQ ID NO: 7803309 - DNA, 22 bp, Homo sapiens
tggttaagtccagaaaggaagc

SEQ ID NO: 7803310 - DNA, 22 bp, Homo sapiens
tgtaagaaaagtaaatagtgac

SEQ ID NO: 7803311 - DNA, 22 bp, Homo sapiens
tgtaagaataatgatttctaag

SEQ ID NO: 7803312 - DNA, 22 bp, Homo sapiens
tgtacaaagagtatagctttga

SEQ ID NO: 7803313 - DNA, 22 bp, Homo sapiens
tgtacagactgtatttacaagt

SEQ ID NO: 7803314 - DNA, 22 bp, Homo sapiens
tgtacagaggtgtacatatgat

SEQ ID NO: 7803315 - DNA, 19 bp, Homo sapiens
tgtacaaggattatgcagg

SEQ ID NO: 7803316 - DNA, 22 bp, Homo sapiens
tgtcacaaaaatcagtaattgc

SEQ ID NO: 7803317 - DNA, 22 bp, Homo sapiens
tgtcaaaaataagagagattgt

SEQ ID NO: 7803318 - DNA, 22 bp, Homo sapiens
tgtatttttagacctttagacc

SEQ ID NO: 7803319 - DNA, 22 bp, Homo sapiens
tgtatttttagacctttagacc

SEQ ID NO: 7803320 - DNA, 22 bp, Homo sapiens
tgtcaaaatgactttactacag

SEQ ID NO: 7803321 - DNA, 22 bp, Homo sapiens
tgtcaaaaccagcaattttgtt

SEQ ID NO: 7803322 - DNA, 22 bp, Homo sapiens
tgtcaaaaataagagagattgt

SEQ ID NO: 7803323 - DNA, 21 bp, Homo sapiens
tgtcacagattctcagcttgc

SEQ ID NO: 7803324 - DNA, 22 bp, Homo sapiens
tgtcacagagcgtgcaacagaa

SEQ ID NO: 7803325 - DNA, 22 bp, Homo sapiens
tgtattttgtgaggatcactct

SEQ ID NO: 7803326 - DNA, 22 bp, Homo sapiens
tgtattttcagagtggcatttc

SEQ ID NO: 7803327 - DNA, 22 bp, Homo sapiens
tgtatgcacatatataggtaca

SEQ ID NO: 7803328 - DNA, 22 bp, Homo sapiens
tgtagaaaattggagcattcat

SEQ ID NO: 7803329 - DNA, 22 bp, Homo sapiens
tgtagaaattagtaagatcaac

SEQ ID NO: 7803330 - DNA, 22 bp, Homo sapiens
tgtagaaattagtaagatcaac

SEQ ID NO: 7803331 - DNA, 22 bp, Homo sapiens
tgtagaaagaatatgtttcata

SEQ ID NO: 7803332 - DNA, 22 bp, Homo sapiens
tgtagctctccagccagcaagg

SEQ ID NO: 7803333 - DNA, 17 bp, Homo sapiens
tgtagcttctccttctc

SEQ ID NO: 7803334 - DNA, 22 bp, Homo sapiens
tgtcctttttcttaggaaatat

SEQ ID NO: 7803335 - DNA, 22 bp, Homo sapiens
tgtcctgggtccctgctagaag

SEQ ID NO: 7803336 - DNA, 22 bp, Homo sapiens
tgtcctgggtggatgcttcatt

SEQ ID NO: 7803337 - DNA, 22 bp, Homo sapiens
tgtcctcagatatgtctactct

SEQ ID NO: 7803338 - DNA, 19 bp, Homo sapiens
tgtcctcacagagcataac

SEQ ID NO: 7803339 - DNA, 22 bp, Homo sapiens
tgtcctcacaggaatgaacttt

SEQ ID NO: 7803340 - DNA, 22 bp, Homo sapiens
tgtccaggtcagcagcagggac

SEQ ID NO: 7803341 - DNA, 22 bp, Homo sapiens
tgtcatttagtcctctgtgtgt

SEQ ID NO: 7803342 - DNA, 22 bp, Homo sapiens
tgtcatttatgcttcttcagtg

SEQ ID NO: 7803343 - DNA, 20 bp, Homo sapiens
tgtcatttatttatcaaatg

SEQ ID NO: 7803344 - DNA, 22 bp, Homo sapiens
tgtcatttattctcttattcta

SEQ ID NO: 7803345 - DNA, 20 bp, Homo sapiens
tgtcatttatttatcaaatg

SEQ ID NO: 7803346 - DNA, 22 bp, Homo sapiens
tgtcatttactccataccctca

SEQ ID NO: 7803347 - DNA, 22 bp, Homo sapiens
tgtcatttaatagatatgatgg

SEQ ID NO: 7803348 - DNA, 22 bp, Homo sapiens
tgtcatttggtgccaggaaaga

SEQ ID NO: 7803349 - DNA, 22 bp, Homo sapiens
tgtcatttcctgaatgctgagt

SEQ ID NO: 7803350 - DNA, 22 bp, Homo sapiens
tgtcattttatgtatgtggtct

SEQ ID NO: 7803351 - DNA, 22 bp, Homo sapiens
tgtcattttcagcttatgcttc

SEQ ID NO: 7803352 - DNA, 22 bp, Homo sapiens
tgtcattttctaatctgttgtc

SEQ ID NO: 7803353 - DNA, 22 bp, Homo sapiens
tgtcattttcatcctaaggagc

SEQ ID NO: 7803354 - DNA, 22 bp, Homo sapiens
tgtcattttctggttagttaat

SEQ ID NO: 7803355 - DNA, 22 bp, Homo sapiens
tgtccagagtcacagagctcaa

SEQ ID NO: 7803356 - DNA, 22 bp, Homo sapiens
tgtcagttacctagcacaagaa

SEQ ID NO: 7803357 - DNA, 22 bp, Homo sapiens
tgtcagtttggctctaaagttt

SEQ ID NO: 7803358 - DNA, 22 bp, Homo sapiens
tgtcagtgtctatgaagaattt

SEQ ID NO: 7803359 - DNA, 22 bp, Homo sapiens
tgtcagtgccaactttgctggt

SEQ ID NO: 7803360 - DNA, 19 bp, Homo sapiens
tgtcagtgatacatgcttt

SEQ ID NO: 7803361 - DNA, 21 bp, Homo sapiens
tgtcactttaagctagctcta

SEQ ID NO: 7803362 - DNA, 19 bp, Homo sapiens
tgctgtcctcagagtaagt

SEQ ID NO: 7803363 - DNA, 22 bp, Homo sapiens
tgctgtctgcaacagtactaca

SEQ ID NO: 7803364 - DNA, 22 bp, Homo sapiens
tgctgtgaggttgagaaggaag

SEQ ID NO: 7803365 - DNA, 22 bp, Homo sapiens
tgcttaaaggatagtttaaact

SEQ ID NO: 7803366 - DNA, 22 bp, Homo sapiens
tgctggtaccgcgcctccgcca

SEQ ID NO: 7803367 - DNA, 19 bp, Homo sapiens
tgctggaacatcagtagct

SEQ ID NO: 7803368 - DNA, 22 bp, Homo sapiens
tgctgccacatttaaagagggg

SEQ ID NO: 7803369 - DNA, 22 bp, Homo sapiens
tgctggctcctcgaggcttcgt

SEQ ID NO: 7803370 - DNA, 22 bp, Homo sapiens
tgctggctggatcagagattgg

SEQ ID NO: 7803371 - DNA, 19 bp, Homo sapiens
tgctggaggttgacagggt

SEQ ID NO: 7803372 - DNA, 17 bp, Homo sapiens
tgctggcaacatacaaa

SEQ ID NO: 7803373 - DNA, 18 bp, Homo sapiens
tgctggcaactactattg

SEQ ID NO: 7803374 - DNA, 22 bp, Homo sapiens
tgctggcatcttaatgttctgt

SEQ ID NO: 7803375 - DNA, 22 bp, Homo sapiens
tgctggcacgtggaccaggaga

SEQ ID NO: 7803376 - DNA, 22 bp, Homo sapiens
tgcctgtcttcaggagtgtcac

SEQ ID NO: 7803377 - DNA, 22 bp, Homo sapiens
tgcctggctaatttttgtatcc

SEQ ID NO: 7803378 - DNA, 22 bp, Homo sapiens
tgcctggccctgacagccctgg

SEQ ID NO: 7803379 - DNA, 20 bp, Homo sapiens
tgcctggcctttctctgccc

SEQ ID NO: 7803380 - DNA, 21 bp, Homo sapiens
tgcctggcctttgcttttcct

SEQ ID NO: 7803381 - DNA, 20 bp, Homo sapiens
tgcctggcctttctctgccc

SEQ ID NO: 7803382 - DNA, 22 bp, Homo sapiens
tgccttgacagttgtaagacct

SEQ ID NO: 7803383 - DNA, 22 bp, Homo sapiens
tgccttgaacatagtggacagt

SEQ ID NO: 7803384 - DNA, 22 bp, Homo sapiens
tgcgaccctagccccctcactt

SEQ ID NO: 7803385 - DNA, 22 bp, Homo sapiens
tgctatttaacttttatgtgta

SEQ ID NO: 7803386 - DNA, 21 bp, Homo sapiens
tgctatttaatttttctgttc

SEQ ID NO: 7803387 - DNA, 22 bp, Homo sapiens
tgctatataatggaatttctaa

SEQ ID NO: 7803388 - DNA, 22 bp, Homo sapiens
tgctatggaaaacagaatggca

SEQ ID NO: 7803389 - DNA, 19 bp, Homo sapiens
tgctatttgaagaagtgta

SEQ ID NO: 7803390 - DNA, 22 bp, Homo sapiens
tgctatttggcacttttgacct

SEQ ID NO: 7803391 - DNA, 22 bp, Homo sapiens
tgctatttgggggctacatgat

SEQ ID NO: 7803392 - DNA, 22 bp, Homo sapiens
tgctatttgtgagtgtcttcgt

SEQ ID NO: 7803393 - DNA, 22 bp, Homo sapiens
tgctattttagacatactttgt

SEQ ID NO: 7803394 - DNA, 22 bp, Homo sapiens
tgctattttggtctacagcact

SEQ ID NO: 7803395 - DNA, 22 bp, Homo sapiens
tgctatttttatcttgatcaaa

SEQ ID NO: 7803396 - DNA, 21 bp, Homo sapiens
tgctcatgagcccacagctgc

SEQ ID NO: 7803397 - DNA, 22 bp, Homo sapiens
tgctcagcttcagaggatcccc

SEQ ID NO: 7803398 - DNA, 22 bp, Homo sapiens
tgctcattggcgatctgaggga

SEQ ID NO: 7803399 - DNA, 17 bp, Homo sapiens
tgctcaaatacttttga

SEQ ID NO: 7803400 - DNA, 22 bp, Homo sapiens
tgctcagcagatctcaggagat

SEQ ID NO: 7803401 - DNA, 22 bp, Homo sapiens
tgctcagcagtcaaggtcatag

SEQ ID NO: 7803402 - DNA, 22 bp, Homo sapiens
tgctcagcgccaaagctgatgg

SEQ ID NO: 7803403 - DNA, 22 bp, Homo sapiens
tgctctgggaccgtcattaaaa

SEQ ID NO: 7803404 - DNA, 22 bp, Homo sapiens
tgctctgggattcagcagcctg

SEQ ID NO: 7803405 - DNA, 22 bp, Homo sapiens
tgctctggggctccccaccaga

SEQ ID NO: 7803406 - DNA, 22 bp, Homo sapiens
tgctcgccccacatgccctcat

SEQ ID NO: 7803407 - DNA, 22 bp, Homo sapiens
tgctcctggatgaggtactcca

SEQ ID NO: 7803408 - DNA, 22 bp, Homo sapiens
tgctcctgctgcatgcatctcc

SEQ ID NO: 7803409 - DNA, 22 bp, Homo sapiens
tgctcctgctgcatgcatctcc

SEQ ID NO: 7803410 - DNA, 22 bp, Homo sapiens
tgctcccttgccagaggggaag

SEQ ID NO: 7803411 - DNA, 22 bp, Homo sapiens
tgctgagcgcatccggcggccg

SEQ ID NO: 7803412 - DNA, 22 bp, Homo sapiens
tgctcttcaccattacatcatg

SEQ ID NO: 7803413 - DNA, 22 bp, Homo sapiens
tgctcttcacagtttcagcatc

SEQ ID NO: 7803414 - DNA, 22 bp, Homo sapiens
tgctctggtaactcacttccat

SEQ ID NO: 7803415 - DNA, 22 bp, Homo sapiens
tgctctgggttcttgctgttac

SEQ ID NO: 7803416 - DNA, 22 bp, Homo sapiens
tggaaggggttacgcagcagga

SEQ ID NO: 7803417 - DNA, 23 bp, Homo sapiens
tggaatcagccttttttccaagg

SEQ ID NO: 7803418 - DNA, 20 bp, Homo sapiens
tggacctgtctctttaggga

SEQ ID NO: 7803419 - DNA, 22 bp, Homo sapiens
tggacctggggtggcctcctct

SEQ ID NO: 7803420 - DNA, 21 bp, Homo sapiens
tggacctgtccttctcgctgt

SEQ ID NO: 7803421 - DNA, 19 bp, Homo sapiens
tggacctgtgcccatggct

SEQ ID NO: 7803422 - DNA, 22 bp, Homo sapiens
tggacctgctggatgggcaggt

SEQ ID NO: 7803423 - DNA, 22 bp, Homo sapiens
tggacctgcgtaggtgctgggc

SEQ ID NO: 7803424 - DNA, 22 bp, Homo sapiens
tggacctgagcctggccctgcc

SEQ ID NO: 7803425 - DNA, 22 bp, Homo sapiens
tggacctgaagaataggaagta

SEQ ID NO: 7803426 - DNA, 23 bp, Homo sapiens
tggacctgaaccagtgcctctgt

SEQ ID NO: 7803427 - DNA, 22 bp, Homo sapiens
tggaccactctggtgcccatgt

SEQ ID NO: 7803428 - DNA, 22 bp, Homo sapiens
tggaatggaaacaaactgagga

SEQ ID NO: 7803429 - DNA, 23 bp, Homo sapiens
tggacagcagcagcagtgtcacc

SEQ ID NO: 7803430 - DNA, 22 bp, Homo sapiens
tggacacacatgtatgtcagag

SEQ ID NO: 7803431 - DNA, 22 bp, Homo sapiens
tggaaagcagttcttagaatcg

SEQ ID NO: 7803432 - DNA, 22 bp, Homo sapiens
tggaaatacaagaagtatgtca

SEQ ID NO: 7803433 - DNA, 23 bp, Homo sapiens
tggaagaaaatggtttggctgtg

SEQ ID NO: 7803434 - DNA, 22 bp, Homo sapiens
tggaaaacattgagataccaag

SEQ ID NO: 7803435 - DNA, 22 bp, Homo sapiens
tggaaaactttggtggtgaggg

SEQ ID NO: 7803436 - DNA, 22 bp, Homo sapiens
tggaaaacaaagctctcattat

SEQ ID NO: 7803437 - DNA, 22 bp, Homo sapiens
tggaaaattagtagtgaaaggc

SEQ ID NO: 7803438 - DNA, 17 bp, Homo sapiens
tggaaacaaaacttatt

SEQ ID NO: 7803439 - DNA, 22 bp, Homo sapiens
tggaaacacccacgcatgcata

SEQ ID NO: 7803440 - DNA, 22 bp, Homo sapiens
tggaaacactgcatgttcaccc

SEQ ID NO: 7803441 - DNA, 22 bp, Homo sapiens
tggaaagaggaagtgcccagca

SEQ ID NO: 7803442 - DNA, 22 bp, Homo sapiens
tggaaagaggtagaggatctgg

SEQ ID NO: 7803443 - DNA, 22 bp, Homo sapiens
tggaaaaaaattggctagcttc

SEQ ID NO: 7803444 - DNA, 22 bp, Homo sapiens
tgctttataacttagtttatgg

SEQ ID NO: 7803445 - DNA, 22 bp, Homo sapiens
tgctttatagacaaggaagtag

SEQ ID NO: 7803446 - DNA, 22 bp, Homo sapiens
tgctttataggggattgcaggc

SEQ ID NO: 7803447 - DNA, 22 bp, Homo sapiens
tgctttatcaaagctatagtga

SEQ ID NO: 7803448 - DNA, 22 bp, Homo sapiens
tgctttatatctctcttcttag

SEQ ID NO: 7803449 - DNA, 22 bp, Homo sapiens
tgctttatctgacttggcgctg

SEQ ID NO: 7803450 - DNA, 22 bp, Homo sapiens
tgctttatctgtgagaacctga

SEQ ID NO: 7803451 - DNA, 21 bp, Homo sapiens
tgctttatgggaaaaatgtca

SEQ ID NO: 7803452 - DNA, 22 bp, Homo sapiens
tgctttatgtggctgatactca

SEQ ID NO: 7803453 - DNA, 22 bp, Homo sapiens
tgctttatgttatcagaagggt

SEQ ID NO: 7803454 - DNA, 22 bp, Homo sapiens
tgctttatggagcccatctcat

SEQ ID NO: 7803455 - DNA, 22 bp, Homo sapiens
tgctttatggatttgtgtcctg

SEQ ID NO: 7803456 - DNA, 20 bp, Homo sapiens
tgctttatgctatactttgt

SEQ ID NO: 7803457 - DNA, 18 bp, Homo sapiens
tgctttatgcttatataa

SEQ ID NO: 7803458 - DNA, 22 bp, Homo sapiens
tgctttattcgacatctggtag

SEQ ID NO: 7803459 - DNA, 22 bp, Homo sapiens
tgctttattcccttctgatgtg

SEQ ID NO: 7803460 - DNA, 22 bp, Homo sapiens
tgctttattaagagagaaattt

SEQ ID NO: 7803461 - DNA, 22 bp, Homo sapiens
tgctttattcagtctctgccat

SEQ ID NO: 7803462 - DNA, 22 bp, Homo sapiens
tgctttattcagggtttacccc

SEQ ID NO: 7803463 - DNA, 22 bp, Homo sapiens
tgctttctttagctcctgagtc

SEQ ID NO: 7803464 - DNA, 22 bp, Homo sapiens
tgctttataaccatttctgtgg

SEQ ID NO: 7803465 - DNA, 22 bp, Homo sapiens
tgctttaaccatcttgtttgga

SEQ ID NO: 7803466 - DNA, 22 bp, Homo sapiens
tgcttctttatgatgtatgatt

SEQ ID NO: 7803467 - DNA, 22 bp, Homo sapiens
tgcttgaacaaggataaatttg

SEQ ID NO: 7803468 - DNA, 22 bp, Homo sapiens
tggagagcaagtcgcagacatg

SEQ ID NO: 7803469 - DNA, 22 bp, Homo sapiens
tggagagatgtctgttcaaggt

SEQ ID NO: 7803470 - DNA, 22 bp, Homo sapiens
tggagaggtttaaacaaaagtt

SEQ ID NO: 7803471 - DNA, 22 bp, Homo sapiens
tggaggtgggagggactgtcct

SEQ ID NO: 7803472 - DNA, 22 bp, Homo sapiens
tggaggtggcatctgacagctg

SEQ ID NO: 7803473 - DNA, 22 bp, Homo sapiens
tggaggtggtgcccagcaattt

SEQ ID NO: 7803474 - DNA, 22 bp, Homo sapiens
tggaggtggggctcaggaatct

SEQ ID NO: 7803475 - DNA, 20 bp, Homo sapiens
tggaggtggtctgctgtcct

SEQ ID NO: 7803476 - DNA, 22 bp, Homo sapiens
tggaggtggcacaagggaggtc

SEQ ID NO: 7803477 - DNA, 22 bp, Homo sapiens
tggaggtggagttggaaactga

SEQ ID NO: 7803478 - DNA, 22 bp, Homo sapiens
tggagggctaagctgagggata

SEQ ID NO: 7803479 - DNA, 22 bp, Homo sapiens
tggatgctgtaggacacgctct

SEQ ID NO: 7803480 - DNA, 22 bp, Homo sapiens
tggatgctatggagtatttaga

SEQ ID NO: 7803481 - DNA, 20 bp, Homo sapiens
tggatgctgcacgtagatgg

SEQ ID NO: 7803482 - DNA, 22 bp, Homo sapiens
tggatgctgagaacactgcctg

SEQ ID NO: 7803483 - DNA, 22 bp, Homo sapiens
tggaggtgtggagtcaaaggga

SEQ ID NO: 7803484 - DNA, 16 bp, Homo sapiens
tggaggtgtttctagt

SEQ ID NO: 7803485 - DNA, 22 bp, Homo sapiens
tggaggtgtataaggtagcttc

SEQ ID NO: 7803486 - DNA, 22 bp, Homo sapiens
tggaggtgtccaactcgtgggt

SEQ ID NO: 7803487 - DNA, 23 bp, Homo sapiens
tggaggcaggatgctaaggagtc

SEQ ID NO: 7803488 - DNA, 22 bp, Homo sapiens
tggaggcaactgaagatgtagt

SEQ ID NO: 7803489 - DNA, 22 bp, Homo sapiens
tggcctctgggaaagcagattc

SEQ ID NO: 7803490 - DNA, 20 bp, Homo sapiens
tggcctctgagatgccacgg

SEQ ID NO: 7803491 - DNA, 22 bp, Homo sapiens
tggcctctgtgggagctgagca

SEQ ID NO: 7803492 - DNA, 22 bp, Homo sapiens
tggcctgactgtcaggctgtat

SEQ ID NO: 7803493 - DNA, 22 bp, Homo sapiens
tggcctgccactgccacgccac

SEQ ID NO: 7803494 - DNA, 22 bp, Homo sapiens
tggccctggtggcacagcctgc

SEQ ID NO: 7803495 - DNA, 22 bp, Homo sapiens
tggccctcgtccgacaggtggg

SEQ ID NO: 7803496 - DNA, 22 bp, Homo sapiens
tggcccaggggctcttggtgtt

SEQ ID NO: 7803497 - DNA, 22 bp, Homo sapiens
tggcccagggagttcatggtgt

SEQ ID NO: 7803498 - DNA, 22 bp, Homo sapiens
tggccagtggactaagttctga

SEQ ID NO: 7803499 - DNA, 22 bp, Homo sapiens
tggccaggtgtgggttctcaga

SEQ ID NO: 7803500 - DNA, 22 bp, Homo sapiens
tggccaggttgggctttgcagc

SEQ ID NO: 7803501 - DNA, 19 bp, Homo sapiens
tggccaggtactgtctgct

SEQ ID NO: 7803502 - DNA, 23 bp, Homo sapiens
tggccaggtagaggaggtagtga

SEQ ID NO: 7803503 - DNA, 23 bp, Homo sapiens
tggccagggtactacacccaccc

SEQ ID NO: 7803504 - DNA, 22 bp, Homo sapiens
tggccaggggagttcccctcca

SEQ ID NO: 7803505 - DNA, 22 bp, Homo sapiens
tggccaggcctcttggtgccca

SEQ ID NO: 7803506 - DNA, 22 bp, Homo sapiens
tggccaggctggtctggaacgc

SEQ ID NO: 7803507 - DNA, 22 bp, Homo sapiens
tggccaggcattcagataagac

SEQ ID NO: 7803508 - DNA, 22 bp, Homo sapiens
tggccaggccggggacagaact

SEQ ID NO: 7803509 - DNA, 17 bp, Homo sapiens
tggccaggccccgccag

SEQ ID NO: 7803510 - DNA, 22 bp, Homo sapiens
tggccacagtgtccagcagcag

SEQ ID NO: 7803511 - DNA, 22 bp, Homo sapiens
tggccagacagagaggctttgt

SEQ ID NO: 7803512 - DNA, 22 bp, Homo sapiens
tggcatttctggccatttgtgt

SEQ ID NO: 7803513 - DNA, 22 bp, Homo sapiens
tggcatttcacctttcatttcc

SEQ ID NO: 7803514 - DNA, 22 bp, Homo sapiens
tggcatttcacctttcatttcc

SEQ ID NO: 7803515 - DNA, 22 bp, Homo sapiens
tggcatgtatacttgagtagga

SEQ ID NO: 7803516 - DNA, 22 bp, Homo sapiens
tggcagtagatccagtctctct

SEQ ID NO: 7803517 - DNA, 22 bp, Homo sapiens
tggcagtagatccagtctctct

SEQ ID NO: 7803518 - DNA, 22 bp, Homo sapiens
tggcagtctgcctcttcaccat

SEQ ID NO: 7803519 - DNA, 18 bp, Homo sapiens
tggcagtgaggtaggcat

SEQ ID NO: 7803520 - DNA, 22 bp, Homo sapiens
tggcagggtgccagttgcgagt

SEQ ID NO: 7803521 - DNA, 19 bp, Homo sapiens
tggcaggtagtgagcagtc

SEQ ID NO: 7803522 - DNA, 22 bp, Homo sapiens
tggcatctccgacagtcttgat

SEQ ID NO: 7803523 - DNA, 22 bp, Homo sapiens
tggcagtggataggggagcggt

SEQ ID NO: 7803524 - DNA, 22 bp, Homo sapiens
tggcagtggctcagagtgcaga

SEQ ID NO: 7803525 - DNA, 22 bp, Homo sapiens
tggcagtggctcagagtgcaga

SEQ ID NO: 7803526 - DNA, 19 bp, Homo sapiens
tggcagtgtggggtatgaa

SEQ ID NO: 7803527 - DNA, 22 bp, Homo sapiens
tggcactcactctcagagtctg

SEQ ID NO: 7803528 - DNA, 22 bp, Homo sapiens
tggcagagaacacggctgatct

SEQ ID NO: 7803529 - DNA, 22 bp, Homo sapiens
tggattagtttcaaggcagcaa

SEQ ID NO: 7803530 - DNA, 22 bp, Homo sapiens
tggattagtttaacaatgtggc

SEQ ID NO: 7803531 - DNA, 22 bp, Homo sapiens
tggattagttaagaaatgttag

SEQ ID NO: 7803532 - DNA, 22 bp, Homo sapiens
tggattattgtaagacaaagta

SEQ ID NO: 7803533 - DNA, 22 bp, Homo sapiens
tggcacagagggacccagcagc

SEQ ID NO: 7803534 - DNA, 22 bp, Homo sapiens
tggcacagcccagagctcttga

SEQ ID NO: 7803535 - DNA, 22 bp, Homo sapiens
tggcacagacagatcaggagtc

SEQ ID NO: 7803536 - DNA, 22 bp, Homo sapiens
tggcacagaaaaatgctccatt

SEQ ID NO: 7803537 - DNA, 22 bp, Homo sapiens
tggcagagtgcagaagaggcat

SEQ ID NO: 7803538 - DNA, 22 bp, Homo sapiens
tggcaggggaggtgcttgctta

SEQ ID NO: 7803539 - DNA, 22 bp, Homo sapiens
tggcaggaaccaggaggctctc

SEQ ID NO: 7803540 - DNA, 22 bp, Homo sapiens
tggcaggaaagtaacagagcac

SEQ ID NO: 7803541 - DNA, 20 bp, Homo sapiens
tggcaggactggctccaccc

SEQ ID NO: 7803542 - DNA, 22 bp, Homo sapiens
tggctgtgtccctgtccagagt

SEQ ID NO: 7803543 - DNA, 22 bp, Homo sapiens
tggcttcaagtctaggttctac

SEQ ID NO: 7803544 - DNA, 22 bp, Homo sapiens
tggctggtcacatggtaggtct

SEQ ID NO: 7803545 - DNA, 22 bp, Homo sapiens
tggcttcttcatatgtgatctt

SEQ ID NO: 7803546 - DNA, 21 bp, Homo sapiens
tgggacctagctttgcacagg

SEQ ID NO: 7803547 - DNA, 21 bp, Homo sapiens
tgggacctatttcaactggat

SEQ ID NO: 7803548 - DNA, 22 bp, Homo sapiens
tgggacctgaagcaggttggca

SEQ ID NO: 7803549 - DNA, 22 bp, Homo sapiens
tgggacctctcttgagagagca

SEQ ID NO: 7803550 - DNA, 22 bp, Homo sapiens
tgggacctgccctggccccatc

SEQ ID NO: 7803551 - DNA, 22 bp, Homo sapiens
tgggacctgctcctggaatgag

SEQ ID NO: 7803552 - DNA, 22 bp, Homo sapiens
tgggacctgctcttggaatgag

SEQ ID NO: 7803553 - DNA, 16 bp, Homo sapiens
tgggacctgtggccaa

SEQ ID NO: 7803554 - DNA, 22 bp, Homo sapiens
tgggacctgttacattgagtta

SEQ ID NO: 7803555 - DNA, 23 bp, Homo sapiens
tgggacctgtttgcccacagatg

SEQ ID NO: 7803556 - DNA, 22 bp, Homo sapiens
tgggactcactcttttggccag

SEQ ID NO: 7803557 - DNA, 22 bp, Homo sapiens
tgggaagggtcaacagctggaa

SEQ ID NO: 7803558 - DNA, 22 bp, Homo sapiens
tgggagaaactgtctctcccac

SEQ ID NO: 7803559 - DNA, 23 bp, Homo sapiens
tggctctgagaggttcagatgct

SEQ ID NO: 7803560 - DNA, 22 bp, Homo sapiens
tggctctcaatggctgtactat

SEQ ID NO: 7803561 - DNA, 22 bp, Homo sapiens
tggctccttccgcagcatgcct

SEQ ID NO: 7803562 - DNA, 22 bp, Homo sapiens
tggcctggttgttgctgccgtt

SEQ ID NO: 7803563 - DNA, 22 bp, Homo sapiens
tggctcagagcagggactctgg

SEQ ID NO: 7803564 - DNA, 22 bp, Homo sapiens
tggctcaggatctaagcagaat

SEQ ID NO: 7803565 - DNA, 22 bp, Homo sapiens
tggctcccgcagaccctgtgct

SEQ ID NO: 7803566 - DNA, 22 bp, Homo sapiens
tggctcctaatgctgcccagac

SEQ ID NO: 7803567 - DNA, 22 bp, Homo sapiens
tgaacttttatttgatgacagg

SEQ ID NO: 7803568 - DNA, 18 bp, Homo sapiens
tgaacttttcctgctgct

SEQ ID NO: 7803569 - DNA, 22 bp, Homo sapiens
tgaagaaacagaccaagaggat

SEQ ID NO: 7803570 - DNA, 22 bp, Homo sapiens
tgaagaaacgcagagaggtagg

SEQ ID NO: 7803571 - DNA, 22 bp, Homo sapiens
tgaactctcccccattgccctc

SEQ ID NO: 7803572 - DNA, 18 bp, Homo sapiens
tgaactttggtgtctctc

SEQ ID NO: 7803573 - DNA, 22 bp, Homo sapiens
tgaaattcaaaacacatttgtc

SEQ ID NO: 7803574 - DNA, 22 bp, Homo sapiens
tgaaattagtgaagttacagtt

SEQ ID NO: 7803575 - DNA, 23 bp, Homo sapiens
tgaaagcaatgggtctatagtat

SEQ ID NO: 7803576 - DNA, 22 bp, Homo sapiens
tgaaagcacaagttctaacagg

SEQ ID NO: 7803577 - DNA, 22 bp, Homo sapiens
tgaaagcactcacttctgctct

SEQ ID NO: 7803578 - DNA, 22 bp, Homo sapiens
tgaaagataagttattatgtac

SEQ ID NO: 7803579 - DNA, 22 bp, Homo sapiens
tgaaagcaacctgtaacagtga

SEQ ID NO: 7803580 - DNA, 22 bp, Homo sapiens
tgaaagattgtgattcaatatg

SEQ ID NO: 7803581 - DNA, 23 bp, Homo sapiens
tgaaatattcttttgcatgagct

SEQ ID NO: 7803582 - DNA, 22 bp, Homo sapiens
tgaaatgtagattaggcattct

SEQ ID NO: 7803583 - DNA, 22 bp, Homo sapiens
tgaaatgtttgggtccagaagt

SEQ ID NO: 7803584 - DNA, 22 bp, Homo sapiens
tgaaatgttaatcacacaaagg

SEQ ID NO: 7803585 - DNA, 22 bp, Homo sapiens
tgaaaatggcctgaagaagcaa

SEQ ID NO: 7803586 - DNA, 22 bp, Homo sapiens
tgaaacaaaagtatgtagcttg

SEQ ID NO: 7803587 - DNA, 22 bp, Homo sapiens
tgaaaatgcacgctggaaagca

SEQ ID NO: 7803588 - DNA, 22 bp, Homo sapiens
tgaaaactccaagtttcatcag

SEQ ID NO: 7803589 - DNA, 22 bp, Homo sapiens
tgaaaacttgacaagtgaggta

SEQ ID NO: 7803590 - DNA, 22 bp, Homo sapiens
tcttttgttgcctacttattaa

SEQ ID NO: 7803591 - DNA, 22 bp, Homo sapiens
tctttttctgcacacgtgtccc

SEQ ID NO: 7803592 - DNA, 22 bp, Homo sapiens
tctttttctgcacacgtgtccc

SEQ ID NO: 7803593 - DNA, 22 bp, Homo sapiens
tgaaacaaaccagtaattttgt

SEQ ID NO: 7803594 - DNA, 22 bp, Homo sapiens
tctttggactttccaatttgtt

SEQ ID NO: 7803595 - DNA, 22 bp, Homo sapiens
tctttggagtgttatcagtaat

SEQ ID NO: 7803596 - DNA, 19 bp, Homo sapiens
tctttgtacaagtctctgc

SEQ ID NO: 7803597 - DNA, 20 bp, Homo sapiens
tcttttattggcagatcctg

SEQ ID NO: 7803598 - DNA, 21 bp, Homo sapiens
tcttttcctttctgtgtgcaa

SEQ ID NO: 7803599 - DNA, 22 bp, Homo sapiens
tcttttagaaaagttgaatgta

SEQ ID NO: 7803600 - DNA, 22 bp, Homo sapiens
tgacgtcaactgcaaaggcctt

SEQ ID NO: 7803601 - DNA, 22 bp, Homo sapiens
tgacctgcagtcaagaggggaa

SEQ ID NO: 7803602 - DNA, 18 bp, Homo sapiens
tgacctgcgcttcacggt

SEQ ID NO: 7803603 - DNA, 22 bp, Homo sapiens
tgacctgcgtaggtggtttctg

SEQ ID NO: 7803604 - DNA, 22 bp, Homo sapiens
tgacctgtcacattttgatgaa

SEQ ID NO: 7803605 - DNA, 20 bp, Homo sapiens
tgacttcttcatgctgtact

SEQ ID NO: 7803606 - DNA, 22 bp, Homo sapiens
tgaccctttcattattctcatt

SEQ ID NO: 7803607 - DNA, 22 bp, Homo sapiens
tgacattttatcaatatcacag

SEQ ID NO: 7803608 - DNA, 22 bp, Homo sapiens
tgacatttttaaaaccactagt

SEQ ID NO: 7803609 - DNA, 22 bp, Homo sapiens
tgacatttcttgttgatataaa

SEQ ID NO: 7803610 - DNA, 22 bp, Homo sapiens
tgacatttgagcatacatgtaa

SEQ ID NO: 7803611 - DNA, 21 bp, Homo sapiens
tgacatttagtagcattgtca

SEQ ID NO: 7803612 - DNA, 22 bp, Homo sapiens
tgacatttatcttctacaatga

SEQ ID NO: 7803613 - DNA, 22 bp, Homo sapiens
tgacatttaatccctaaatatt

SEQ ID NO: 7803614 - DNA, 22 bp, Homo sapiens
tgacaggaggcttgaggccagg

SEQ ID NO: 7803615 - DNA, 22 bp, Homo sapiens
tgaagcagttctcagaagtggg

SEQ ID NO: 7803616 - DNA, 22 bp, Homo sapiens
tgaataatcttgggtattaata

SEQ ID NO: 7803617 - DNA, 21 bp, Homo sapiens
tgaaggggtggcagtgtgctt

SEQ ID NO: 7803618 - DNA, 22 bp, Homo sapiens
tgaaggggttcagcatgggggt

SEQ ID NO: 7803619 - DNA, 22 bp, Homo sapiens
tgacaaagacaaagatatgtcc

SEQ ID NO: 7803620 - DNA, 22 bp, Homo sapiens
tgacaaagcatgatggtgacag

SEQ ID NO: 7803621 - DNA, 23 bp, Homo sapiens
tgacaaagcgagactccagctca

SEQ ID NO: 7803622 - DNA, 22 bp, Homo sapiens
tgacaattgtgggcagtttgtg

SEQ ID NO: 7803623 - DNA, 22 bp, Homo sapiens
tgaataattcctttttgtcaag

SEQ ID NO: 7803624 - DNA, 22 bp, Homo sapiens
tgaatcctagttgaagataagg

SEQ ID NO: 7803625 - DNA, 22 bp, Homo sapiens
tgaatcatggataaatagctta

SEQ ID NO: 7803626 - DNA, 22 bp, Homo sapiens
tgaatcatgccactgagctccc

SEQ ID NO: 7803627 - DNA, 22 bp, Homo sapiens
tgagatgtcatagttcagttca

SEQ ID NO: 7803628 - DNA, 22 bp, Homo sapiens
tgagatgtaaggtatgcttact

SEQ ID NO: 7803629 - DNA, 22 bp, Homo sapiens
tgagatcattgacttgttcctg

SEQ ID NO: 7803630 - DNA, 22 bp, Homo sapiens
tgagatgcaggagatgggactg

SEQ ID NO: 7803631 - DNA, 22 bp, Homo sapiens
tgagaggatattttgggaggat

SEQ ID NO: 7803632 - DNA, 22 bp, Homo sapiens
tgagaggagtgattgtaaaatt

SEQ ID NO: 7803633 - DNA, 22 bp, Homo sapiens
tgagaggaacaggcagtaggtt

SEQ ID NO: 7803634 - DNA, 18 bp, Homo sapiens
tgagaggctattttttgc

SEQ ID NO: 7803635 - DNA, 18 bp, Homo sapiens
tgagaggctattttttgc

SEQ ID NO: 7803636 - DNA, 22 bp, Homo sapiens
tgagaaacacaggcatgaatag

SEQ ID NO: 7803637 - DNA, 22 bp, Homo sapiens
tgactttaaaataacaagttta

SEQ ID NO: 7803638 - DNA, 22 bp, Homo sapiens
tgagaaaatccagaggctagtt

SEQ ID NO: 7803639 - DNA, 22 bp, Homo sapiens
tgagaaaattactataattgtc

SEQ ID NO: 7803640 - DNA, 22 bp, Homo sapiens
tgagaacatttgcagggagagt

SEQ ID NO: 7803641 - DNA, 22 bp, Homo sapiens
tgagacagcagtcagggaaata

SEQ ID NO: 7803642 - DNA, 19 bp, Homo sapiens
tgagacagaagatgagcct

SEQ ID NO: 7803643 - DNA, 22 bp, Homo sapiens
tgagcaccaggcaccacagctc

SEQ ID NO: 7803644 - DNA, 22 bp, Homo sapiens
tgagcagagtcgctccagagtg

SEQ ID NO: 7803645 - DNA, 21 bp, Homo sapiens
tgagcaggagtcatgggaatg

SEQ ID NO: 7803646 - DNA, 22 bp, Homo sapiens
tgagcaggagataaacaggtag

SEQ ID NO: 7803647 - DNA, 22 bp, Homo sapiens
tgagcaggcaaacaatggttat

SEQ ID NO: 7803648 - DNA, 22 bp, Homo sapiens
tgagcaggcgcagcaggaggtc

SEQ ID NO: 7803649 - DNA, 22 bp, Homo sapiens
tgagccaggagtttgaggctgt

SEQ ID NO: 7803650 - DNA, 22 bp, Homo sapiens
tgagccagctccttgcctgtca

SEQ ID NO: 7803651 - DNA, 22 bp, Homo sapiens
tgagccagcaggcctccagtgg

SEQ ID NO: 7803652 - DNA, 22 bp, Homo sapiens
tgagccaggctcaagtgatcct

SEQ ID NO: 7803653 - DNA, 20 bp, Homo sapiens
tgagccaggctaggaagggc

SEQ ID NO: 7803654 - DNA, 22 bp, Homo sapiens
tgagccaggctccatgccacct

SEQ ID NO: 7803655 - DNA, 19 bp, Homo sapiens
tgagccagggaggccatgc

SEQ ID NO: 7803656 - DNA, 22 bp, Homo sapiens
tgagcagggactttgagtgtag

SEQ ID NO: 7803657 - DNA, 22 bp, Homo sapiens
tgagcatctttttacaggttta

SEQ ID NO: 7803658 - DNA, 23 bp, Homo sapiens
tgagcatcacaggagaaccaggc

SEQ ID NO: 7803659 - DNA, 22 bp, Homo sapiens
tgagccagataagggctcacgc

SEQ ID NO: 7803660 - DNA, 22 bp, Homo sapiens
tgagccaggttaagacaggagc

SEQ ID NO: 7803661 - DNA, 22 bp, Homo sapiens
tgagccaggtctcactcacctt

SEQ ID NO: 7803662 - DNA, 22 bp, Homo sapiens
tgagccaggttttccatcattc

SEQ ID NO: 7803663 - DNA, 20 bp, Homo sapiens
tgagccagtcaagctacatt

SEQ ID NO: 7803664 - DNA, 22 bp, Homo sapiens
tgagccagtctctcagaaccct

SEQ ID NO: 7803665 - DNA, 22 bp, Homo sapiens
tgagccctaagggtcaagcagg

SEQ ID NO: 7803666 - DNA, 22 bp, Homo sapiens
tgagccctaatttacaacatct

SEQ ID NO: 7803667 - DNA, 22 bp, Homo sapiens
tgagccctccaaacccaggatt

SEQ ID NO: 7803668 - DNA, 22 bp, Homo sapiens
tgagcccttgacatcgcccact

SEQ ID NO: 7803669 - DNA, 22 bp, Homo sapiens
tgagccctggctctttcactta

SEQ ID NO: 7803670 - DNA, 22 bp, Homo sapiens
tgagctggaggacaggagggta

SEQ ID NO: 7803671 - DNA, 22 bp, Homo sapiens
tgagctggtcttgagtgtagct

SEQ ID NO: 7803672 - DNA, 22 bp, Homo sapiens
tgagctctgttagggctggaac

SEQ ID NO: 7803673 - DNA, 22 bp, Homo sapiens
tgagcttacgtgggaacagact

SEQ ID NO: 7803674 - DNA, 22 bp, Homo sapiens
tgaggaggtcagagtctggctg

SEQ ID NO: 7803675 - DNA, 22 bp, Homo sapiens
tgaggaggcccaggttggggct

SEQ ID NO: 7803676 - DNA, 22 bp, Homo sapiens
tgaggaggtgggcacacagagt

SEQ ID NO: 7803677 - DNA, 22 bp, Homo sapiens
tgaggaggtgggcacacagagt

SEQ ID NO: 7803678 - DNA, 22 bp, Homo sapiens
tgaggaaagaaaggcatgcatg

SEQ ID NO: 7803679 - DNA, 22 bp, Homo sapiens
tgaggcaaggctgaatgaaggc

SEQ ID NO: 7803680 - DNA, 19 bp, Homo sapiens
tgaggcaagatggctctgg

SEQ ID NO: 7803681 - DNA, 22 bp, Homo sapiens
tgaggcaatccctagggtaagg

SEQ ID NO: 7803682 - DNA, 22 bp, Homo sapiens
tgaggcaaagttcaagctgaaa

SEQ ID NO: 7803683 - DNA, 22 bp, Homo sapiens
tgaggatggttaaagaacattg

SEQ ID NO: 7803684 - DNA, 23 bp, Homo sapiens
tgaggcaggcggatcacgaggtc

SEQ ID NO: 7803685 - DNA, 22 bp, Homo sapiens
tgagtcacacatttcttcatac

SEQ ID NO: 7803686 - DNA, 22 bp, Homo sapiens
tgagtagagaattcagctaagg

SEQ ID NO: 7803687 - DNA, 22 bp, Homo sapiens
tgagtaggtggttaagcatgga

SEQ ID NO: 7803688 - DNA, 22 bp, Homo sapiens
tgaggtggttcaagagccttgt

SEQ ID NO: 7803689 - DNA, 22 bp, Homo sapiens
tgaggtggtttgtatcactggg

SEQ ID NO: 7803690 - DNA, 22 bp, Homo sapiens
tgaggtggtgctaatctctgct

SEQ ID NO: 7803691 - DNA, 22 bp, Homo sapiens
tgaggtggccgaggagcaggac

SEQ ID NO: 7803692 - DNA, 22 bp, Homo sapiens
tgaggtggcacacacttcctgc

SEQ ID NO: 7803693 - DNA, 22 bp, Homo sapiens
tgaggtggaaggatcctttgaa

SEQ ID NO: 7803694 - DNA, 22 bp, Homo sapiens
tgaggtgggtggcttctgttat

SEQ ID NO: 7803695 - DNA, 22 bp, Homo sapiens
tgaggtgggcttgtggatttgc

SEQ ID NO: 7803696 - DNA, 22 bp, Homo sapiens
tgaggggccgcccaagcacttc

SEQ ID NO: 7803697 - DNA, 23 bp, Homo sapiens
tgagggacatggtggcttctgag

SEQ ID NO: 7803698 - DNA, 22 bp, Homo sapiens
tgagggactcccggccctgcca

SEQ ID NO: 7803699 - DNA, 22 bp, Homo sapiens
tgcaacctgcactctgtcttta

SEQ ID NO: 7803700 - DNA, 22 bp, Homo sapiens
tgcaagcaagtttttgaagtgg

SEQ ID NO: 7803701 - DNA, 21 bp, Homo sapiens
tgcaatccagcctgggcgaca

SEQ ID NO: 7803702 - DNA, 22 bp, Homo sapiens
tgcaaaaagagcgaggagccct

SEQ ID NO: 7803703 - DNA, 22 bp, Homo sapiens
tgcaaaagaatatagatattgt

SEQ ID NO: 7803704 - DNA, 22 bp, Homo sapiens
tgatttttaaaattctccttgc

SEQ ID NO: 7803705 - DNA, 22 bp, Homo sapiens
tgatttcatagtatatacatga

SEQ ID NO: 7803706 - DNA, 22 bp, Homo sapiens
tgcaaacaactgtttaatgctg

SEQ ID NO: 7803707 - DNA, 22 bp, Homo sapiens
tgcaaacaatttcctataaagt

SEQ ID NO: 7803708 - DNA, 17 bp, Homo sapiens
tgcaaacaatcacatat

SEQ ID NO: 7803709 - DNA, 22 bp, Homo sapiens
tgcaaacacttcaacgtgcatc

SEQ ID NO: 7803710 - DNA, 22 bp, Homo sapiens
tgcaaacaccacagagacaatt

SEQ ID NO: 7803711 - DNA, 22 bp, Homo sapiens
tgcaaacagaaaagctactttg

SEQ ID NO: 7803712 - DNA, 20 bp, Homo sapiens
tgcaaacacagagtgtatga

SEQ ID NO: 7803713 - DNA, 22 bp, Homo sapiens
tgcaaacatccgactgaaagcc

SEQ ID NO: 7803714 - DNA, 22 bp, Homo sapiens
tgcaaacatcaatggcctgagc

SEQ ID NO: 7803715 - DNA, 22 bp, Homo sapiens
tgcaaacagttaagatgcaggc

SEQ ID NO: 7803716 - DNA, 22 bp, Homo sapiens
tgcaaacaggcatttcacaaac

SEQ ID NO: 7803717 - DNA, 22 bp, Homo sapiens
tgcaaacagccttgaaagaggg

SEQ ID NO: 7803718 - DNA, 22 bp, Homo sapiens
tgcaaacagaaagtttattgtg

SEQ ID NO: 7803719 - DNA, 22 bp, Homo sapiens
tgcaaacaggagagtaagtata

SEQ ID NO: 7803720 - DNA, 22 bp, Homo sapiens
tgcaaacaggagagtaagtata

SEQ ID NO: 7803721 - DNA, 20 bp, Homo sapiens
tgcaaacattacttgggtgt

SEQ ID NO: 7803722 - DNA, 22 bp, Homo sapiens
tgattcatcagaataggagttt

SEQ ID NO: 7803723 - DNA, 22 bp, Homo sapiens
tgatgtttaatactatgctttt

SEQ ID NO: 7803724 - DNA, 22 bp, Homo sapiens
tgatgaaagttcagtagtgaat

SEQ ID NO: 7803725 - DNA, 22 bp, Homo sapiens
tgatggaaataaaagcatagct

SEQ ID NO: 7803726 - DNA, 18 bp, Homo sapiens
tgagtggaatgagggggc

SEQ ID NO: 7803727 - DNA, 22 bp, Homo sapiens
tgagtgaccagaagtccccctc

SEQ ID NO: 7803728 - DNA, 22 bp, Homo sapiens
tgagtgaggctgggcagtccct

SEQ ID NO: 7803729 - DNA, 22 bp, Homo sapiens
tgatatttaagcaaaaatatgg

SEQ ID NO: 7803730 - DNA, 22 bp, Homo sapiens
tgatagagcactaagtagtgta

SEQ ID NO: 7803731 - DNA, 20 bp, Homo sapiens
tgcagcacgggccctttcca

SEQ ID NO: 7803732 - DNA, 22 bp, Homo sapiens
tgcagattcaaatgaaatgcaa

SEQ ID NO: 7803733 - DNA, 22 bp, Homo sapiens
tgcagaaacagtcattaatgta

SEQ ID NO: 7803734 - DNA, 21 bp, Homo sapiens
tgcagaaatggtttttctaag

SEQ ID NO: 7803735 - DNA, 22 bp, Homo sapiens
tgcagaaattcagaaagcataa

SEQ ID NO: 7803736 - DNA, 22 bp, Homo sapiens
tgcacagcgggtgtctgtcagg

SEQ ID NO: 7803737 - DNA, 22 bp, Homo sapiens
tgcacaggaggctgtggagaag

SEQ ID NO: 7803738 - DNA, 22 bp, Homo sapiens
tgcacaggtgagactcaggaag

SEQ ID NO: 7803739 - DNA, 22 bp, Homo sapiens
tgcagctcattggtgtcctggt

SEQ ID NO: 7803740 - DNA, 22 bp, Homo sapiens
tgcaggagcagagatggctgga

SEQ ID NO: 7803741 - DNA, 22 bp, Homo sapiens
tgcaggagataatggtgcttag

SEQ ID NO: 7803742 - DNA, 22 bp, Homo sapiens
tgcaggagagctggtctggccc

SEQ ID NO: 7803743 - DNA, 22 bp, Homo sapiens
tgcaggagacataatagggact

SEQ ID NO: 7803744 - DNA, 22 bp, Homo sapiens
tgcaggagacataatagggact

SEQ ID NO: 7803745 - DNA, 22 bp, Homo sapiens
tgcaggagtccaatcaggagac

SEQ ID NO: 7803746 - DNA, 22 bp, Homo sapiens
tgcaggagggagggttacagtt

SEQ ID NO: 7803747 - DNA, 22 bp, Homo sapiens
tgcaggaggattttgtggagct

SEQ ID NO: 7803748 - DNA, 22 bp, Homo sapiens
tgcaggaggattttgtggagct

SEQ ID NO: 7803749 - DNA, 22 bp, Homo sapiens
tgcaggagcccttgggctctgg

SEQ ID NO: 7803750 - DNA, 19 bp, Homo sapiens
tgcaggaggactgagcaga

SEQ ID NO: 7803751 - DNA, 22 bp, Homo sapiens
tgcaggagctgtgcggtgaggg

SEQ ID NO: 7803752 - DNA, 22 bp, Homo sapiens
tgcattccatgtgtttcctgag

SEQ ID NO: 7803753 - DNA, 22 bp, Homo sapiens
tgcatatacccgcatttacata

SEQ ID NO: 7803754 - DNA, 19 bp, Homo sapiens
tgcataaattatatacttt

SEQ ID NO: 7803755 - DNA, 22 bp, Homo sapiens
tgcataaaacatgatttctgct

SEQ ID NO: 7803756 - DNA, 22 bp, Homo sapiens
tgcagttcaaggttgtacagct

SEQ ID NO: 7803757 - DNA, 22 bp, Homo sapiens
tgccagaacagctcatctggcc

SEQ ID NO: 7803758 - DNA, 22 bp, Homo sapiens
tgccagcacttctggctgtctg

SEQ ID NO: 7803759 - DNA, 23 bp, Homo sapiens
tgccagcagggaatgggaaggac

SEQ ID NO: 7803760 - DNA, 22 bp, Homo sapiens
tgccagccagggaagctcaccc

SEQ ID NO: 7803761 - DNA, 22 bp, Homo sapiens
tgcagggaaaacccaggatgct

SEQ ID NO: 7803762 - DNA, 22 bp, Homo sapiens
tgcagggaaagggcactgggct

SEQ ID NO: 7803763 - DNA, 22 bp, Homo sapiens
tgcagggaaagtgttggcagca

SEQ ID NO: 7803764 - DNA, 22 bp, Homo sapiens
tgcagggaagcaagggtggctc

SEQ ID NO: 7803765 - DNA, 22 bp, Homo sapiens
tgcagggaatccagtctagggt

SEQ ID NO: 7803766 - DNA, 22 bp, Homo sapiens
tgcagggattatgtaggggttg

SEQ ID NO: 7803767 - DNA, 22 bp, Homo sapiens
tgcagggattagaggccgggga

SEQ ID NO: 7803768 - DNA, 23 bp, Homo sapiens
tgcagggcaagttagagacccca

SEQ ID NO: 7803769 - DNA, 22 bp, Homo sapiens
tgcagggattgttggcatccat

SEQ ID NO: 7803770 - DNA, 22 bp, Homo sapiens
tgcagtggttgagagcccagac

SEQ ID NO: 7803771 - DNA, 23 bp, Homo sapiens
tgcaggggaggcttaaagcaggt

SEQ ID NO: 7803772 - DNA, 20 bp, Homo sapiens
tgcagggctgcctcccagct

SEQ ID NO: 7803773 - DNA, 22 bp, Homo sapiens
tgcccagcacccagcatgatgc

SEQ ID NO: 7803774 - DNA, 17 bp, Homo sapiens
tgccagcctgtcccagg

SEQ ID NO: 7803775 - DNA, 19 bp, Homo sapiens
tgcctggcaccagctccac

SEQ ID NO: 7803776 - DNA, 19 bp, Homo sapiens
tgcctggcaccagctccac

SEQ ID NO: 7803777 - DNA, 22 bp, Homo sapiens
tgcctgatgcaggagtatcaga

SEQ ID NO: 7803778 - DNA, 22 bp, Homo sapiens
tgcctgccatgcagaaagctga

SEQ ID NO: 7803779 - DNA, 22 bp, Homo sapiens
tgcctctctaacccatgcccaa

SEQ ID NO: 7803780 - DNA, 22 bp, Homo sapiens
tgcctgactgctgccaccacta

SEQ ID NO: 7803781 - DNA, 22 bp, Homo sapiens
tgcccttgggatttaggtaagg

SEQ ID NO: 7803782 - DNA, 22 bp, Homo sapiens
tgccctgggaggctttcctgtt

SEQ ID NO: 7803783 - DNA, 22 bp, Homo sapiens
tgccctgggaacacagatgcca

SEQ ID NO: 7803784 - DNA, 23 bp, Homo sapiens
tgccgtgttagaaatgttttaca

SEQ ID NO: 7803785 - DNA, 22 bp, Homo sapiens
tgcctacattccttgcttatgg

SEQ ID NO: 7803786 - DNA, 22 bp, Homo sapiens
tgcctaggctggagtgtagtgg

SEQ ID NO: 7803787 - DNA, 22 bp, Homo sapiens
tgccctggaggggcttacagtc

SEQ ID NO: 7803788 - DNA, 22 bp, Homo sapiens
taagaatacctctcagctcttt

SEQ ID NO: 7803789 - DNA, 22 bp, Homo sapiens
tcctggacaagcccttcaccct

SEQ ID NO: 7803790 - DNA, 22 bp, Homo sapiens
tcctggacagatccccatcatc

SEQ ID NO: 7803791 - DNA, 22 bp, Homo sapiens
tcctggactggctcagcaccct

SEQ ID NO: 7803792 - DNA, 22 bp, Homo sapiens
tcctggactcaggaccacagga

SEQ ID NO: 7803793 - DNA, 22 bp, Homo sapiens
tcctggagaatcctgccacctg

SEQ ID NO: 7803794 - DNA, 22 bp, Homo sapiens
tcctggctcctggagacctgct

SEQ ID NO: 7803795 - DNA, 17 bp, Homo sapiens
tcctggcctggtgtgtg

SEQ ID NO: 7803796 - DNA, 22 bp, Homo sapiens
tcctggcctcgctgtccacctt

SEQ ID NO: 7803797 - DNA, 22 bp, Homo sapiens
tcctggcctctgagtcaagaac

SEQ ID NO: 7803798 - DNA, 20 bp, Homo sapiens
tcctggcctccctggggctc

SEQ ID NO: 7803799 - DNA, 22 bp, Homo sapiens
tcctggcctccgttctctgcat

SEQ ID NO: 7803800 - DNA, 22 bp, Homo sapiens
tcctggctcgattgctaccaat

SEQ ID NO: 7803801 - DNA, 22 bp, Homo sapiens
tcctggctcgattgctaccaat

SEQ ID NO: 7803802 - DNA, 17 bp, Homo sapiens
tcctggctctgccactg

SEQ ID NO: 7803803 - DNA, 22 bp, Homo sapiens
tcctggctctgctgcctcctag

SEQ ID NO: 7803804 - DNA, 22 bp, Homo sapiens
tcctggctctctacaaaccaga

SEQ ID NO: 7803805 - DNA, 22 bp, Homo sapiens
tcctggcctagctcaccctgga

SEQ ID NO: 7803806 - DNA, 22 bp, Homo sapiens
tcctggcctcacagtcctgggt

SEQ ID NO: 7803807 - DNA, 22 bp, Homo sapiens
tcctggccgctggcccctgaga

SEQ ID NO: 7803808 - DNA, 22 bp, Homo sapiens
tcctggcctagagtttgtgttc

SEQ ID NO: 7803809 - DNA, 22 bp, Homo sapiens
tcctggccgccgcgtggggccg

SEQ ID NO: 7803810 - DNA, 22 bp, Homo sapiens
tcctggccctctgcaaacgcca

SEQ ID NO: 7803811 - DNA, 22 bp, Homo sapiens
tcctggccctgtggcctgcagt

SEQ ID NO: 7803812 - DNA, 22 bp, Homo sapiens
tcctggcccgatccctgtgaag

SEQ ID NO: 7803813 - DNA, 16 bp, Homo sapiens
tcctggcccctatgga

SEQ ID NO: 7803814 - DNA, 22 bp, Homo sapiens
tcctggcccactatgccagcat

SEQ ID NO: 7803815 - DNA, 22 bp, Homo sapiens
tcctggcccactcctagcttct

SEQ ID NO: 7803816 - DNA, 21 bp, Homo sapiens
tcctggcccactctatcccca

SEQ ID NO: 7803817 - DNA, 22 bp, Homo sapiens
tcctggccacccgacagaagtc

SEQ ID NO: 7803818 - DNA, 18 bp, Homo sapiens
tcctggccacactacctt

SEQ ID NO: 7803819 - DNA, 22 bp, Homo sapiens
tcctggccacacattaatagtg

SEQ ID NO: 7803820 - DNA, 22 bp, Homo sapiens
tcctggccaggatgacctaaca

SEQ ID NO: 7803821 - DNA, 22 bp, Homo sapiens
tcctggccagaggacaaagctg

SEQ ID NO: 7803822 - DNA, 22 bp, Homo sapiens
tcctggccatgcaagatgagga

SEQ ID NO: 7803823 - DNA, 22 bp, Homo sapiens
tcctggccataggctatttcag

SEQ ID NO: 7803824 - DNA, 22 bp, Homo sapiens
tcctggcccaatctgcccatga

SEQ ID NO: 7803825 - DNA, 21 bp, Homo sapiens
tcctggccagggcactaggca

SEQ ID NO: 7803826 - DNA, 22 bp, Homo sapiens
tcctggccaagtagatgtggcg

SEQ ID NO: 7803827 - DNA, 19 bp, Homo sapiens
tcctggcatttgtaggaaa

SEQ ID NO: 7803828 - DNA, 22 bp, Homo sapiens
tcctggcatttacaaacccacc

SEQ ID NO: 7803829 - DNA, 22 bp, Homo sapiens
tcctggcattgtgcagggtgtg

SEQ ID NO: 7803830 - DNA, 22 bp, Homo sapiens
tcctggccaagttactctctgc

SEQ ID NO: 7803831 - DNA, 22 bp, Homo sapiens
tcctggcacattgcaggggctc

SEQ ID NO: 7803832 - DNA, 17 bp, Homo sapiens
tcctggcagtcccctgg

SEQ ID NO: 7803833 - DNA, 22 bp, Homo sapiens
tcctggcagtgcttgttttgga

SEQ ID NO: 7803834 - DNA, 22 bp, Homo sapiens
tcctggcatccgtgggtctgtg

SEQ ID NO: 7803835 - DNA, 19 bp, Homo sapiens
tcctggcatcttcctccct

SEQ ID NO: 7803836 - DNA, 22 bp, Homo sapiens
tcctggcagttcagccccctaa

SEQ ID NO: 7803837 - DNA, 22 bp, Homo sapiens
tcctggcataatggctttgctc

SEQ ID NO: 7803838 - DNA, 19 bp, Homo sapiens
tcctggcacagtggaacca

SEQ ID NO: 7803839 - DNA, 22 bp, Homo sapiens
tcctggcacaaccctttaccag

SEQ ID NO: 7803840 - DNA, 22 bp, Homo sapiens
tcctggcaaagatgttggtgtt

SEQ ID NO: 7803841 - DNA, 22 bp, Homo sapiens
tcctggcaaagcaagttatgaa

SEQ ID NO: 7803842 - DNA, 22 bp, Homo sapiens
tcctggatctactctcaattgg

SEQ ID NO: 7803843 - DNA, 22 bp, Homo sapiens
tcctggatggagctgccctcgc

SEQ ID NO: 7803844 - DNA, 22 bp, Homo sapiens
tcctggagtgtcttccccaagg

SEQ ID NO: 7803845 - DNA, 22 bp, Homo sapiens
tcctgtgccatctctagagact

SEQ ID NO: 7803846 - DNA, 22 bp, Homo sapiens
tcctgtcttaatgatctcgtgc

SEQ ID NO: 7803847 - DNA, 22 bp, Homo sapiens
tcctggtggtctgtgcttcttc

SEQ ID NO: 7803848 - DNA, 22 bp, Homo sapiens
tcctggtggctttccctgcctt

SEQ ID NO: 7803849 - DNA, 22 bp, Homo sapiens
tcctgggtagagacctgatgaa

SEQ ID NO: 7803850 - DNA, 22 bp, Homo sapiens
tcctgggtagcctgtccaagat

SEQ ID NO: 7803851 - DNA, 21 bp, Homo sapiens
tcctggctttatgctacctct

SEQ ID NO: 7803852 - DNA, 22 bp, Homo sapiens
tcctggcttttcttggctcatc

SEQ ID NO: 7803853 - DNA, 22 bp, Homo sapiens
tcctggcttctgtctccttatt

SEQ ID NO: 7803854 - DNA, 22 bp, Homo sapiens
tcctggcttccacacctgtcat

SEQ ID NO: 7803855 - DNA, 22 bp, Homo sapiens
tcctggcttaggtttccagaac

SEQ ID NO: 7803856 - DNA, 22 bp, Homo sapiens
tcctggcttaggtttccagaac

SEQ ID NO: 7803857 - DNA, 22 bp, Homo sapiens
tcctggcttccactcctctgtt

SEQ ID NO: 7803858 - DNA, 22 bp, Homo sapiens
tcctggctggaatttctcactc

SEQ ID NO: 7803859 - DNA, 22 bp, Homo sapiens
tcctggctgtcactcgggttga

SEQ ID NO: 7803860 - DNA, 22 bp, Homo sapiens
tcctgggaccaggcacctactg

SEQ ID NO: 7803861 - DNA, 22 bp, Homo sapiens
tcctgggcagcctctctggaag

SEQ ID NO: 7803862 - DNA, 22 bp, Homo sapiens
tcctgggcacaagtgagtctcc

SEQ ID NO: 7803863 - DNA, 22 bp, Homo sapiens
tcctgggcctgtactccatccg

SEQ ID NO: 7803864 - DNA, 22 bp, Homo sapiens
tcctgggcccaggctgccaggg

SEQ ID NO: 7803865 - DNA, 22 bp, Homo sapiens
tctaggtggatgaggaacatag

SEQ ID NO: 7803866 - DNA, 22 bp, Homo sapiens
tctagggaacatgggtcaagct

SEQ ID NO: 7803867 - DNA, 22 bp, Homo sapiens
tctagttagtggttgatactgt

SEQ ID NO: 7803868 - DNA, 22 bp, Homo sapiens
tctataaaactcaagagcaatt

SEQ ID NO: 7803869 - DNA, 22 bp, Homo sapiens
tctattaatgattcaatagtgt

SEQ ID NO: 7803870 - DNA, 22 bp, Homo sapiens
tctcacaagctcaaggattagt

SEQ ID NO: 7803871 - DNA, 22 bp, Homo sapiens
tctatttttatagttgaagtgc

SEQ ID NO: 7803872 - DNA, 22 bp, Homo sapiens
tctattttgtttccagctctac

SEQ ID NO: 7803873 - DNA, 22 bp, Homo sapiens
tctattttcttgccaaaactgc

SEQ ID NO: 7803874 - DNA, 22 bp, Homo sapiens
tctagaaacaggtttctagaaa

SEQ ID NO: 7803875 - DNA, 23 bp, Homo sapiens
tctagaaaatgaaagaatgcagt

SEQ ID NO: 7803876 - DNA, 22 bp, Homo sapiens
tctagaaaaccaatattacatg

SEQ ID NO: 7803877 - DNA, 22 bp, Homo sapiens
tctagaaaaacaaagtatctga

SEQ ID NO: 7803878 - DNA, 22 bp, Homo sapiens
tctagaaaaaaactgctgtgga

SEQ ID NO: 7803879 - DNA, 22 bp, Homo sapiens
tctaccagggtcacagaggccc

SEQ ID NO: 7803880 - DNA, 22 bp, Homo sapiens
tctaccatgtgctgtgcattgg

SEQ ID NO: 7803881 - DNA, 22 bp, Homo sapiens
tctacctggagtccgttgttaa

SEQ ID NO: 7803882 - DNA, 22 bp, Homo sapiens
tctacattttaacaagatgccc

SEQ ID NO: 7803883 - DNA, 22 bp, Homo sapiens
tctacattttcacaaggtctcc

SEQ ID NO: 7803884 - DNA, 22 bp, Homo sapiens
tctacattttctttatgtacat

SEQ ID NO: 7803885 - DNA, 22 bp, Homo sapiens
tctacattccttttataatatc

SEQ ID NO: 7803886 - DNA, 22 bp, Homo sapiens
tctacactccagagtctcatca

SEQ ID NO: 7803887 - DNA, 22 bp, Homo sapiens
tctaacttagggaatactttag

SEQ ID NO: 7803888 - DNA, 22 bp, Homo sapiens
tctaacttgaactcatgactgt

SEQ ID NO: 7803889 - DNA, 22 bp, Homo sapiens
tctaacttgaactcatgactgt

SEQ ID NO: 7803890 - DNA, 22 bp, Homo sapiens
tctaacttagggaatactttag

SEQ ID NO: 7803891 - DNA, 22 bp, Homo sapiens
tctaattttggcattttaacct

SEQ ID NO: 7803892 - DNA, 22 bp, Homo sapiens
tctacaaagaagaattaatgtc

SEQ ID NO: 7803893 - DNA, 22 bp, Homo sapiens
tctaagaaatcagatgatgagg

SEQ ID NO: 7803894 - DNA, 22 bp, Homo sapiens
tctaacttgtgagtatagatga

SEQ ID NO: 7803895 - DNA, 22 bp, Homo sapiens
tctaacttgtatgtatagtttt

SEQ ID NO: 7803896 - DNA, 22 bp, Homo sapiens
tctaacttgtatgtatagtttt

SEQ ID NO: 7803897 - DNA, 22 bp, Homo sapiens
tccttggctagtactggccagc

SEQ ID NO: 7803898 - DNA, 22 bp, Homo sapiens
tccttggcatgccgtcttctcc

SEQ ID NO: 7803899 - DNA, 22 bp, Homo sapiens
tcctttgcttctgtcattctcc

SEQ ID NO: 7803900 - DNA, 22 bp, Homo sapiens
tcgcaccattgcactccagcca

SEQ ID NO: 7803901 - DNA, 22 bp, Homo sapiens
tcgcaccattgcactccagcca

SEQ ID NO: 7803902 - DNA, 22 bp, Homo sapiens
tctaaaaaagtctgttcacttg

SEQ ID NO: 7803903 - DNA, 23 bp, Homo sapiens
tctaaaattcatcatttacgttc

SEQ ID NO: 7803904 - DNA, 22 bp, Homo sapiens
tctaaacagtttcactcttaat

SEQ ID NO: 7803905 - DNA, 22 bp, Homo sapiens
tctaaacactaagtcttgatgc

SEQ ID NO: 7803906 - DNA, 22 bp, Homo sapiens
tctaaacacgtctctttgaata

SEQ ID NO: 7803907 - DNA, 19 bp, Homo sapiens
tctaaactctatactggta

SEQ ID NO: 7803908 - DNA, 22 bp, Homo sapiens
tctaaacttcactttaagtgct

SEQ ID NO: 7803909 - DNA, 21 bp, Homo sapiens
tcgtgcagcagctgaggcttg

SEQ ID NO: 7803910 - DNA, 22 bp, Homo sapiens
tcgccatggaagtccttgcgga

SEQ ID NO: 7803911 - DNA, 18 bp, Homo sapiens
tccttgaggtatctctat

SEQ ID NO: 7803912 - DNA, 23 bp, Homo sapiens
tccttcctttgagaggctccatc

SEQ ID NO: 7803913 - DNA, 23 bp, Homo sapiens
tccttcctttgagaggctccatc

SEQ ID NO: 7803914 - DNA, 23 bp, Homo sapiens
tccttcaagttaggaagtgaaca

SEQ ID NO: 7803915 - DNA, 22 bp, Homo sapiens
tccttcaagtgcagtacctgag

SEQ ID NO: 7803916 - DNA, 22 bp, Homo sapiens
tccttcaatcacccagtgggga

SEQ ID NO: 7803917 - DNA, 22 bp, Homo sapiens
tccttcaaagctcctagtgagc

SEQ ID NO: 7803918 - DNA, 22 bp, Homo sapiens
tccttcaaaagttgagagagcc

SEQ ID NO: 7803919 - DNA, 22 bp, Homo sapiens
tccttcaagatgccacagcttt

SEQ ID NO: 7803920 - DNA, 22 bp, Homo sapiens
tccttcaactttttacttgccc

SEQ ID NO: 7803921 - DNA, 22 bp, Homo sapiens
tctctcagggggaaggctgaag

SEQ ID NO: 7803922 - DNA, 22 bp, Homo sapiens
tctctggggatgcttattcttg

SEQ ID NO: 7803923 - DNA, 19 bp, Homo sapiens
tctctggggacactttcac

SEQ ID NO: 7803924 - DNA, 22 bp, Homo sapiens
tctctgggcctccctttccaag

SEQ ID NO: 7803925 - DNA, 22 bp, Homo sapiens
tctctgggcctgttttctcatc

SEQ ID NO: 7803926 - DNA, 22 bp, Homo sapiens
tctctgggtaaagttctctcat

SEQ ID NO: 7803927 - DNA, 22 bp, Homo sapiens
tctctggggcctttctacatca

SEQ ID NO: 7803928 - DNA, 22 bp, Homo sapiens
tctctgggggtagaactcaggc

SEQ ID NO: 7803929 - DNA, 22 bp, Homo sapiens
tctcttctaacactagaaattc

SEQ ID NO: 7803930 - DNA, 22 bp, Homo sapiens
tctcttattttgcctttgacaa

SEQ ID NO: 7803931 - DNA, 22 bp, Homo sapiens
tctcttcacattcctggcaaac

SEQ ID NO: 7803932 - DNA, 22 bp, Homo sapiens
tctcttctatttgagactattt

SEQ ID NO: 7803933 - DNA, 22 bp, Homo sapiens
tctcttctgaaacctgtcttta

SEQ ID NO: 7803934 - DNA, 22 bp, Homo sapiens
tctctggtcccacctggccatt

SEQ ID NO: 7803935 - DNA, 22 bp, Homo sapiens
tctgaaagaagggcagtctttt

SEQ ID NO: 7803936 - DNA, 22 bp, Homo sapiens
tctgaaaatgttgactttgttt

SEQ ID NO: 7803937 - DNA, 22 bp, Homo sapiens
tctgaaagatgagtggtccatt

SEQ ID NO: 7803938 - DNA, 22 bp, Homo sapiens
tctgaaatagaagtgtctttct

SEQ ID NO: 7803939 - DNA, 22 bp, Homo sapiens
tctgaaatactgcaggttctct

SEQ ID NO: 7803940 - DNA, 22 bp, Homo sapiens
tctgaaataagggagaagggaa

SEQ ID NO: 7803941 - DNA, 22 bp, Homo sapiens
tctgaaataactgatgccagat

SEQ ID NO: 7803942 - DNA, 22 bp, Homo sapiens
tctgaaataaatgcactgttag

SEQ ID NO: 7803943 - DNA, 22 bp, Homo sapiens
tctgaagacatatgatatggtg

SEQ ID NO: 7803944 - DNA, 22 bp, Homo sapiens
tctgaactccagccctgctctc

SEQ ID NO: 7803945 - DNA, 22 bp, Homo sapiens
tctgaagaataggatgttgtgt

SEQ ID NO: 7803946 - DNA, 22 bp, Homo sapiens
tctgaaatgcaaatttgactga

SEQ ID NO: 7803947 - DNA, 22 bp, Homo sapiens
tctgaaatggcagcgggaatga

SEQ ID NO: 7803948 - DNA, 22 bp, Homo sapiens
tctgaaatgcaggcaatttgct

SEQ ID NO: 7803949 - DNA, 22 bp, Homo sapiens
tctgaaatggcgatggccgttg

SEQ ID NO: 7803950 - DNA, 22 bp, Homo sapiens
tctgaaatggggctgaagcact

SEQ ID NO: 7803951 - DNA, 22 bp, Homo sapiens
tctgaaattccttccagacttt

SEQ ID NO: 7803952 - DNA, 22 bp, Homo sapiens
tctgaaattgttagtaaaaatg

SEQ ID NO: 7803953 - DNA, 22 bp, Homo sapiens
tctgaaattttagttatagaaa

SEQ ID NO: 7803954 - DNA, 22 bp, Homo sapiens
tctgaaattcacagttgagtca

SEQ ID NO: 7803955 - DNA, 22 bp, Homo sapiens
tctgaaatgttctcttgttttg

SEQ ID NO: 7803956 - DNA, 21 bp, Homo sapiens
tctccccattcttattcccat

SEQ ID NO: 7803957 - DNA, 22 bp, Homo sapiens
tctccccagaccctggacataa

SEQ ID NO: 7803958 - DNA, 22 bp, Homo sapiens
tctccccagctgagctgccctt

SEQ ID NO: 7803959 - DNA, 22 bp, Homo sapiens
tctccccaaccatggcactcac

SEQ ID NO: 7803960 - DNA, 22 bp, Homo sapiens
tctcccattcagcttgcagtca

SEQ ID NO: 7803961 - DNA, 21 bp, Homo sapiens
tctccagtatccttctctgag

SEQ ID NO: 7803962 - DNA, 22 bp, Homo sapiens
tctcctggtcacctcagaagtc

SEQ ID NO: 7803963 - DNA, 20 bp, Homo sapiens
tctcctggtctggtccgtgc

SEQ ID NO: 7803964 - DNA, 20 bp, Homo sapiens
tctcctggtgacagtaccca

SEQ ID NO: 7803965 - DNA, 22 bp, Homo sapiens
tctcctggtttgttaaataatt

SEQ ID NO: 7803966 - DNA, 22 bp, Homo sapiens
tctcctgggtaaaagggttgat

SEQ ID NO: 7803967 - DNA, 22 bp, Homo sapiens
tctcctggccctgtcgccatct

SEQ ID NO: 7803968 - DNA, 22 bp, Homo sapiens
tctcctgggcttggttgaagtt

SEQ ID NO: 7803969 - DNA, 18 bp, Homo sapiens
tctcctgggtaggggcct

SEQ ID NO: 7803970 - DNA, 21 bp, Homo sapiens
tctcctgggtccaacccatgc

SEQ ID NO: 7803971 - DNA, 22 bp, Homo sapiens
tctcctgggtgctttatcagaa

SEQ ID NO: 7803972 - DNA, 22 bp, Homo sapiens
tctcctggtacccttcctagca

SEQ ID NO: 7803973 - DNA, 22 bp, Homo sapiens
tctcctggtatgtatgcacctg

SEQ ID NO: 7803974 - DNA, 20 bp, Homo sapiens
tctcgcactcggagcagccg

SEQ ID NO: 7803975 - DNA, 22 bp, Homo sapiens
tctcctcaccaccagcagcaga

SEQ ID NO: 7803976 - DNA, 22 bp, Homo sapiens
tctcctggaagaataccacact

SEQ ID NO: 7803977 - DNA, 22 bp, Homo sapiens
tctcctggaagtgattcccctg

SEQ ID NO: 7803978 - DNA, 22 bp, Homo sapiens
tctcctgctcagaacagcctca

SEQ ID NO: 7803979 - DNA, 22 bp, Homo sapiens
tctcctggatagatactatcca

SEQ ID NO: 7803980 - DNA, 22 bp, Homo sapiens
tctcctggatggaccttctctt

SEQ ID NO: 7803981 - DNA, 22 bp, Homo sapiens
tctcctggcatttggttgagta

SEQ ID NO: 7803982 - DNA, 22 bp, Homo sapiens
tctcctggcatgtgggtcatct

SEQ ID NO: 7803983 - DNA, 22 bp, Homo sapiens
tctcctggagcccagatgctgg

SEQ ID NO: 7803984 - DNA, 22 bp, Homo sapiens
tctcctggagcaggaaggtggg

SEQ ID NO: 7803985 - DNA, 22 bp, Homo sapiens
tctcattcataccctacatgct

SEQ ID NO: 7803986 - DNA, 22 bp, Homo sapiens
tctcagtgagcttttctatgtt

SEQ ID NO: 7803987 - DNA, 22 bp, Homo sapiens
tctcaggtaagcttctttgatg

SEQ ID NO: 7803988 - DNA, 22 bp, Homo sapiens
tctcaggtaaaagggtatctac

SEQ ID NO: 7803989 - DNA, 22 bp, Homo sapiens
tctcaggtggcccccatgagtg

SEQ ID NO: 7803990 - DNA, 22 bp, Homo sapiens
tctcatacatgtttgcagaaag

SEQ ID NO: 7803991 - DNA, 22 bp, Homo sapiens
tctcatacgtttccaggtgtca

SEQ ID NO: 7803992 - DNA, 22 bp, Homo sapiens
tctcagaactttatatgtatca

SEQ ID NO: 7803993 - DNA, 22 bp, Homo sapiens
tctcagaacacccttctatggt

SEQ ID NO: 7803994 - DNA, 23 bp, Homo sapiens
tctcagaaaggagaagtaatttg

SEQ ID NO: 7803995 - DNA, 22 bp, Homo sapiens
tctcagaaatgacaggaggtac

SEQ ID NO: 7803996 - DNA, 23 bp, Homo sapiens
tctcagaggattcctgggccttg

SEQ ID NO: 7803997 - DNA, 22 bp, Homo sapiens
tctcagagcttcagttattttc

SEQ ID NO: 7803998 - DNA, 22 bp, Homo sapiens
tctcagagtaattctttaaggt

SEQ ID NO: 7803999 - DNA, 22 bp, Homo sapiens
tctcagaggcccgacgttctcc

SEQ ID NO: 7804000 - DNA, 22 bp, Homo sapiens
tcttgggatagtgtctcatggc

SEQ ID NO: 7804001 - DNA, 22 bp, Homo sapiens
tcttgggcatgtgtttgatttc

SEQ ID NO: 7804002 - DNA, 22 bp, Homo sapiens
tctttacacaagacaagaataa

SEQ ID NO: 7804003 - DNA, 22 bp, Homo sapiens
tctttacatcacaattgtatgg

SEQ ID NO: 7804004 - DNA, 22 bp, Homo sapiens
tcttgattacaaataacatcat

SEQ ID NO: 7804005 - DNA, 22 bp, Homo sapiens
tcttggcagtggaataccagga

SEQ ID NO: 7804006 - DNA, 22 bp, Homo sapiens
tcttggaataccccgaaggtca

SEQ ID NO: 7804007 - DNA, 22 bp, Homo sapiens
tcttggaagtagaacacagtct

SEQ ID NO: 7804008 - DNA, 22 bp, Homo sapiens
tctttccctgtgttagcctgta

SEQ ID NO: 7804009 - DNA, 22 bp, Homo sapiens
tctttcggccatagcgatgatt

SEQ ID NO: 7804010 - DNA, 22 bp, Homo sapiens
tctttgaatcctttacatctga

SEQ ID NO: 7804011 - DNA, 22 bp, Homo sapiens
tctttctgtaagctccatggaa

SEQ ID NO: 7804012 - DNA, 21 bp, Homo sapiens
tctttctgaaatctcagtctg

SEQ ID NO: 7804013 - DNA, 22 bp, Homo sapiens
tctttattgctactggtttgtc

SEQ ID NO: 7804014 - DNA, 22 bp, Homo sapiens
tctttattgctactggtttgtc

SEQ ID NO: 7804015 - DNA, 22 bp, Homo sapiens
tctttcattctagtctgaggtt

SEQ ID NO: 7804016 - DNA, 22 bp, Homo sapiens
tctttccatggccacacagtct

SEQ ID NO: 7804017 - DNA, 22 bp, Homo sapiens
tctttcccagtagctctcccag

SEQ ID NO: 7804018 - DNA, 22 bp, Homo sapiens
tctttatgttgatttcctcagg

SEQ ID NO: 7804019 - DNA, 20 bp, Homo sapiens
tctttagatttatcttatgt

SEQ ID NO: 7804020 - DNA, 22 bp, Homo sapiens
tcttcctgcttggtgtgtctgg

SEQ ID NO: 7804021 - DNA, 22 bp, Homo sapiens
tcttcctgcttggtgtgtctgg

SEQ ID NO: 7804022 - DNA, 22 bp, Homo sapiens
tcttcctggcattgatgctgca

SEQ ID NO: 7804023 - DNA, 22 bp, Homo sapiens
tcttcctgctttggtgaggctt

SEQ ID NO: 7804024 - DNA, 22 bp, Homo sapiens
tcttcctgtcaatgagaattaa

SEQ ID NO: 7804025 - DNA, 22 bp, Homo sapiens
tcttctgtgagaattcaagcaa

SEQ ID NO: 7804026 - DNA, 22 bp, Homo sapiens
tcttgaaagcatgagatggaca

SEQ ID NO: 7804027 - DNA, 23 bp, Homo sapiens
tcttgaaaagcctacagcagttc

SEQ ID NO: 7804028 - DNA, 22 bp, Homo sapiens
tcttctttgaatcatagtgacc

SEQ ID NO: 7804029 - DNA, 22 bp, Homo sapiens
tcttcttcctcatttatacata

SEQ ID NO: 7804030 - DNA, 22 bp, Homo sapiens
tcttctgttaccacagcgatga

SEQ ID NO: 7804031 - DNA, 20 bp, Homo sapiens
tcttctgttgccttgttctg

SEQ ID NO: 7804032 - DNA, 22 bp, Homo sapiens
tcttattttttaatgacagaga

SEQ ID NO: 7804033 - DNA, 22 bp, Homo sapiens
tcttcaaagaattttagtaatt

SEQ ID NO: 7804034 - DNA, 22 bp, Homo sapiens
tcttattttttaatgacagaga

SEQ ID NO: 7804035 - DNA, 22 bp, Homo sapiens
tcttcatctcagattaacagga

SEQ ID NO: 7804036 - DNA, 22 bp, Homo sapiens
tcttcagtatttggataacatt

SEQ ID NO: 7804037 - DNA, 22 bp, Homo sapiens
tcttcagtgcacctgatgtctt

SEQ ID NO: 7804038 - DNA, 22 bp, Homo sapiens
tctgggttcttgatgctacctt

SEQ ID NO: 7804039 - DNA, 22 bp, Homo sapiens
tctgtacagtaccagatagtaa

SEQ ID NO: 7804040 - DNA, 22 bp, Homo sapiens
tctgtacagtaccagatagtaa

SEQ ID NO: 7804041 - DNA, 21 bp, Homo sapiens
tctgtacatcattgagtcccc

SEQ ID NO: 7804042 - DNA, 22 bp, Homo sapiens
tctgtacatttgtgttgtgaat

SEQ ID NO: 7804043 - DNA, 22 bp, Homo sapiens
tctgtagtctctgatatatctg

SEQ ID NO: 7804044 - DNA, 22 bp, Homo sapiens
tctgtagtctgtgccatagctg

SEQ ID NO: 7804045 - DNA, 22 bp, Homo sapiens
tctgtattctatggcagttggt

SEQ ID NO: 7804046 - DNA, 22 bp, Homo sapiens
tctgtcaatatatgtgctgcag

SEQ ID NO: 7804047 - DNA, 22 bp, Homo sapiens
tctgtattttaagatgctgttt

SEQ ID NO: 7804048 - DNA, 22 bp, Homo sapiens
tctgtattttaagatgctgttt

SEQ ID NO: 7804049 - DNA, 22 bp, Homo sapiens
tctgtcattttgtatctacatg

SEQ ID NO: 7804050 - DNA, 22 bp, Homo sapiens
tctgtcatctgtaacaggaggg

SEQ ID NO: 7804051 - DNA, 22 bp, Homo sapiens
tctgtcatctgttcagtgctca

SEQ ID NO: 7804052 - DNA, 22 bp, Homo sapiens
tctgtcatgtttccattacatg

SEQ ID NO: 7804053 - DNA, 22 bp, Homo sapiens
tctgtgaatgtgaccttatttg

SEQ ID NO: 7804054 - DNA, 20 bp, Homo sapiens
tctgtgcacctgctacaagg

SEQ ID NO: 7804055 - DNA, 17 bp, Homo sapiens
tctgtgatagtgtagat

SEQ ID NO: 7804056 - DNA, 22 bp, Homo sapiens
tctgtgatagtttttcagctat

SEQ ID NO: 7804057 - DNA, 22 bp, Homo sapiens
tctgtctttgtcaggaccagag

SEQ ID NO: 7804058 - DNA, 21 bp, Homo sapiens
tctgtggtatggccatcttcc

SEQ ID NO: 7804059 - DNA, 22 bp, Homo sapiens
tctgtgctcaagttctgcctct

SEQ ID NO: 7804060 - DNA, 21 bp, Homo sapiens
tctgttggaggcctctcttcc

SEQ ID NO: 7804061 - DNA, 22 bp, Homo sapiens
tctgtttagatgctttatctgt

SEQ ID NO: 7804062 - DNA, 22 bp, Homo sapiens
tctgtttaatgggaatgatact

SEQ ID NO: 7804063 - DNA, 22 bp, Homo sapiens
tctgtttagactcagttgaaac

SEQ ID NO: 7804064 - DNA, 22 bp, Homo sapiens
tctgtttatgcatatttaaaac

SEQ ID NO: 7804065 - DNA, 22 bp, Homo sapiens
tctgtttaggcaaaatagctac

SEQ ID NO: 7804066 - DNA, 22 bp, Homo sapiens
tctgttatgcataagcatcagt

SEQ ID NO: 7804067 - DNA, 22 bp, Homo sapiens
tctgttgactcctagcagccat

SEQ ID NO: 7804068 - DNA, 23 bp, Homo sapiens
tctgttcttttagctgatcattt

SEQ ID NO: 7804069 - DNA, 22 bp, Homo sapiens
tctgtgtggtagtttcagtgaa

SEQ ID NO: 7804070 - DNA, 20 bp, Homo sapiens
tctgtgtgccatcacctaac

SEQ ID NO: 7804071 - DNA, 22 bp, Homo sapiens
tctgtgtgaccataagccagct

SEQ ID NO: 7804072 - DNA, 22 bp, Homo sapiens
tctgtgtgaccataagccagct

SEQ ID NO: 7804073 - DNA, 18 bp, Homo sapiens
tctgtgttctgtcattgc

SEQ ID NO: 7804074 - DNA, 22 bp, Homo sapiens
tctgttatctcaagtcacaaga

SEQ ID NO: 7804075 - DNA, 22 bp, Homo sapiens
tcttaagtacctcctttatcac

SEQ ID NO: 7804076 - DNA, 22 bp, Homo sapiens
tcttaactgacagtttaatggg

SEQ ID NO: 7804077 - DNA, 22 bp, Homo sapiens
tcttaactgacagtttaatggg

SEQ ID NO: 7804078 - DNA, 22 bp, Homo sapiens
tcttaactatcatttgaacacc

SEQ ID NO: 7804079 - DNA, 22 bp, Homo sapiens
tcttaaagcttacttcaattgt

SEQ ID NO: 7804080 - DNA, 22 bp, Homo sapiens
tctgtttattcaatttctatat

SEQ ID NO: 7804081 - DNA, 22 bp, Homo sapiens
tctgtttcttcttctgttatat

SEQ ID NO: 7804082 - DNA, 22 bp, Homo sapiens
tctgattagagcattcttgagt

SEQ ID NO: 7804083 - DNA, 22 bp, Homo sapiens
tctgcaaactggctcttactgc

SEQ ID NO: 7804084 - DNA, 22 bp, Homo sapiens
tctgcaaatattagcttagaca

SEQ ID NO: 7804085 - DNA, 22 bp, Homo sapiens
tctgcaagatcattaaagcaga

SEQ ID NO: 7804086 - DNA, 23 bp, Homo sapiens
tctgcaagataatgaagatgata

SEQ ID NO: 7804087 - DNA, 22 bp, Homo sapiens
tctgcaacattcctctccccac

SEQ ID NO: 7804088 - DNA, 22 bp, Homo sapiens
tctgacattttgagaatgacat

SEQ ID NO: 7804089 - DNA, 22 bp, Homo sapiens
tctgacttgcatcttaaaggag

SEQ ID NO: 7804090 - DNA, 22 bp, Homo sapiens
tctgacttccttttctgatcca

SEQ ID NO: 7804091 - DNA, 22 bp, Homo sapiens
tctgacattagattaattggaa

SEQ ID NO: 7804092 - DNA, 22 bp, Homo sapiens
tctgaattttgatgtgcattga

SEQ ID NO: 7804093 - DNA, 22 bp, Homo sapiens
tctgacttttctcactgttgtg

SEQ ID NO: 7804094 - DNA, 22 bp, Homo sapiens
tctgagctgctaggtatgcatt

SEQ ID NO: 7804095 - DNA, 22 bp, Homo sapiens
tctgagctatgtaagacttgga

SEQ ID NO: 7804096 - DNA, 22 bp, Homo sapiens
tctgagctaatcctgttgccga

SEQ ID NO: 7804097 - DNA, 22 bp, Homo sapiens
tctgagcaccttatattcttga

SEQ ID NO: 7804098 - DNA, 22 bp, Homo sapiens
tctgcatattgttaatggaatg

SEQ ID NO: 7804099 - DNA, 22 bp, Homo sapiens
tctgccaggccacacagggcac

SEQ ID NO: 7804100 - DNA, 22 bp, Homo sapiens
tctgccaggtggggagaggcca

SEQ ID NO: 7804101 - DNA, 23 bp, Homo sapiens
tctgccagtgtgtgccaggagcc

SEQ ID NO: 7804102 - DNA, 23 bp, Homo sapiens
tctgccagtgtgtgccaggagcc

SEQ ID NO: 7804103 - DNA, 22 bp, Homo sapiens
tctgccagtttatagacaagcc

SEQ ID NO: 7804104 - DNA, 22 bp, Homo sapiens
tctgcctgttgctagaatgtca

SEQ ID NO: 7804105 - DNA, 22 bp, Homo sapiens
tctgcctgtggtggaggaagtt

SEQ ID NO: 7804106 - DNA, 22 bp, Homo sapiens
tctgcctggatgatggcagggc

SEQ ID NO: 7804107 - DNA, 22 bp, Homo sapiens
tctgcccaggaggtcccatggg

SEQ ID NO: 7804108 - DNA, 22 bp, Homo sapiens
tctgcctgagcagagggaggcc

SEQ ID NO: 7804109 - DNA, 22 bp, Homo sapiens
tctgcctgagggagctgaggaa

SEQ ID NO: 7804110 - DNA, 22 bp, Homo sapiens
tctgcctgcagtgtggcagggc

SEQ ID NO: 7804111 - DNA, 22 bp, Homo sapiens
tctgctgctgcagctacactat

SEQ ID NO: 7804112 - DNA, 22 bp, Homo sapiens
tctggacatgcttgaataatat

SEQ ID NO: 7804113 - DNA, 22 bp, Homo sapiens
tctggagaggggcctagaattt

SEQ ID NO: 7804114 - DNA, 22 bp, Homo sapiens
tctggagagcagatgcctctgg

SEQ ID NO: 7804115 - DNA, 22 bp, Homo sapiens
tctggagaaagttgagtttgtg

SEQ ID NO: 7804116 - DNA, 22 bp, Homo sapiens
tctggatgaaagggctatatat

SEQ ID NO: 7804117 - DNA, 22 bp, Homo sapiens
tctggagtgtttctaattactg

SEQ ID NO: 7804118 - DNA, 22 bp, Homo sapiens
tctggagtaggacctgaaaata

SEQ ID NO: 7804119 - DNA, 22 bp, Homo sapiens
tctggcagtttgagaaaggcta

SEQ ID NO: 7804120 - DNA, 22 bp, Homo sapiens
tctggcagttccttgttgatat

SEQ ID NO: 7804121 - DNA, 21 bp, Homo sapiens
tctggcagtggtctttcaaat

SEQ ID NO: 7804122 - DNA, 22 bp, Homo sapiens
tctggcagttgccgcttcagtc

SEQ ID NO: 7804123 - DNA, 22 bp, Homo sapiens
tctggcagtggatgagggcagc

SEQ ID NO: 7804124 - DNA, 22 bp, Homo sapiens
tctggcagtgatttctgtgatc

SEQ ID NO: 7804125 - DNA, 22 bp, Homo sapiens
tctggcaggttcccatgttatg

SEQ ID NO: 7804126 - DNA, 20 bp, Homo sapiens
tctggcaggtgaacgagctg

SEQ ID NO: 7804127 - DNA, 22 bp, Homo sapiens
tctggcagtaataggggagaga

SEQ ID NO: 7804128 - DNA, 22 bp, Homo sapiens
tctggcagtgaagtcatgaggt

SEQ ID NO: 7804129 - DNA, 22 bp, Homo sapiens
tctggcagtgagcaacttgaca

SEQ ID NO: 7804130 - DNA, 22 bp, Homo sapiens
tctggcagcaagataacaatgg

SEQ ID NO: 7804131 - DNA, 22 bp, Homo sapiens
tctggcagggtcagggcccagg

SEQ ID NO: 7804132 - DNA, 22 bp, Homo sapiens
tctggcagatcttcccacgttt

SEQ ID NO: 7804133 - DNA, 22 bp, Homo sapiens
tctggcagagtgataggataag

SEQ ID NO: 7804134 - DNA, 19 bp, Homo sapiens
tctggcaggtaattaggga

SEQ ID NO: 7804135 - DNA, 22 bp, Homo sapiens
tctggcagggtgtgtatttaca

SEQ ID NO: 7804136 - DNA, 22 bp, Homo sapiens
tctggcaggtcaatcattcttt

SEQ ID NO: 7804137 - DNA, 22 bp, Homo sapiens
tctggcagagtcagtgcacaca

SEQ ID NO: 7804138 - DNA, 22 bp, Homo sapiens
tctggcagaggaaggaggcctg

SEQ ID NO: 7804139 - DNA, 22 bp, Homo sapiens
tctggcagaagtgctgtcagta

SEQ ID NO: 7804140 - DNA, 22 bp, Homo sapiens
tctggcagaaggcagaaattca

SEQ ID NO: 7804141 - DNA, 22 bp, Homo sapiens
tctggcagagatatccatccca

SEQ ID NO: 7804142 - DNA, 21 bp, Homo sapiens
acagagaaagagcagcctcct

SEQ ID NO: 7804143 - DNA, 22 bp, Homo sapiens
acacattatagagagtataata

SEQ ID NO: 7804144 - DNA, 22 bp, Homo sapiens
aatgggaagtcactactgttac

SEQ ID NO: 7804145 - DNA, 22 bp, Homo sapiens
aatggcactttataaatgttaa

SEQ ID NO: 7804146 - DNA, 22 bp, Homo sapiens
agacaatgtcaaggtgatcatc

SEQ ID NO: 7804147 - DNA, 22 bp, Homo sapiens
aatgtgtaaaaggttttcttca

SEQ ID NO: 7804148 - DNA, 22 bp, Homo sapiens
acaagcatgtggtaaaaagacc

SEQ ID NO: 7804149 - DNA, 22 bp, Homo sapiens
acaacaaagacacttgaaatga

SEQ ID NO: 7804150 - DNA, 22 bp, Homo sapiens
aattgcatgttaatgactaagt

SEQ ID NO: 7804151 - DNA, 22 bp, Homo sapiens
aagctaagggtgtttaagcagg

SEQ ID NO: 7804152 - DNA, 22 bp, Homo sapiens
aagctaagtggaagtcttatca

SEQ ID NO: 7804153 - DNA, 22 bp, Homo sapiens
aagctatgagctaggcatctct

SEQ ID NO: 7804154 - DNA, 22 bp, Homo sapiens
aagccaagagttaactatttgt

SEQ ID NO: 7804155 - DNA, 22 bp, Homo sapiens
aagcatttttcacagcaacagc

SEQ ID NO: 7804156 - DNA, 22 bp, Homo sapiens
aagctatgttcctgcactgctc

SEQ ID NO: 7804157 - DNA, 22 bp, Homo sapiens
aagctatgggggagtttcaacc

SEQ ID NO: 7804158 - DNA, 22 bp, Homo sapiens
aagctcattaattagaagctaa

SEQ ID NO: 7804159 - DNA, 22 bp, Homo sapiens
acagggcagaaatgttgcatct

SEQ ID NO: 7804160 - DNA, 22 bp, Homo sapiens
acagggcagcaactttgtgcct

SEQ ID NO: 7804161 - DNA, 22 bp, Homo sapiens
acagtcttatgcatacactatt

SEQ ID NO: 7804162 - DNA, 22 bp, Homo sapiens
acagtcttgcacttctatcagc

SEQ ID NO: 7804163 - DNA, 22 bp, Homo sapiens
aaggagagtacaggagttggta

SEQ ID NO: 7804164 - DNA, 22 bp, Homo sapiens
aaggaggaatgtagccagctcc

SEQ ID NO: 7804165 - DNA, 22 bp, Homo sapiens
aaggaggaatttcagggtgaat

SEQ ID NO: 7804166 - DNA, 22 bp, Homo sapiens
acatttaaatacctatgtttct

SEQ ID NO: 7804167 - DNA, 22 bp, Homo sapiens
acatttaaatatgccttatatt

SEQ ID NO: 7804168 - DNA, 22 bp, Homo sapiens
aagtctaaacacatatttaaaa

SEQ ID NO: 7804169 - DNA, 22 bp, Homo sapiens
aatatagttctagaaatatttt

SEQ ID NO: 7804170 - DNA, 22 bp, Homo sapiens
aatatagtgttagctcatttga

SEQ ID NO: 7804171 - DNA, 22 bp, Homo sapiens
aatatagttctggtattgttaa

SEQ ID NO: 7804172 - DNA, 22 bp, Homo sapiens
aatcagagccctctgagcttca

SEQ ID NO: 7804173 - DNA, 21 bp, Homo sapiens
aatcagaggcttcctagttgg

SEQ ID NO: 7804174 - DNA, 22 bp, Homo sapiens
aatcagaacttctcagggtggg

SEQ ID NO: 7804175 - DNA, 22 bp, Homo sapiens
aatcagcaaatgcttactcagg

SEQ ID NO: 7804176 - DNA, 22 bp, Homo sapiens
aatcagcaggcttctaaatttt

SEQ ID NO: 7804177 - DNA, 22 bp, Homo sapiens
aatgatgtgagtttttattctc

SEQ ID NO: 7804178 - DNA, 22 bp, Homo sapiens
aagaacaactgctttaaaagca

SEQ ID NO: 7804179 - DNA, 22 bp, Homo sapiens
aagaaatgtgaatattgaatag

SEQ ID NO: 7804180 - DNA, 22 bp, Homo sapiens
aagaaacaaccactgctctcct

SEQ ID NO: 7804181 - DNA, 22 bp, Homo sapiens
aagaaaacaatgacttgccagc

SEQ ID NO: 7804182 - DNA, 19 bp, Homo sapiens
aactggataatggccacat

SEQ ID NO: 7804183 - DNA, 22 bp, Homo sapiens
aactttctgtctgagctgcaga

SEQ ID NO: 7804184 - DNA, 22 bp, Homo sapiens
aattttaagcatatgactggtt

SEQ ID NO: 7804185 - DNA, 22 bp, Homo sapiens
aattttaatcagtggtgctgag

SEQ ID NO: 7804186 - DNA, 22 bp, Homo sapiens
aattttaagcatatgactggtt

SEQ ID NO: 7804187 - DNA, 22 bp, Homo sapiens
aattttaatcagtggtgctgag

SEQ ID NO: 7804188 - DNA, 22 bp, Homo sapiens
aagactttctgtaaagctacag

SEQ ID NO: 7804189 - DNA, 22 bp, Homo sapiens
aagacttgaccaggttgaaggc

SEQ ID NO: 7804190 - DNA, 22 bp, Homo sapiens
aagagaatatcgatagcactct

SEQ ID NO: 7804191 - DNA, 22 bp, Homo sapiens
aagcaataatcccaaagtgctg

SEQ ID NO: 7804192 - DNA, 22 bp, Homo sapiens
aagatgataggacttgcttaag

SEQ ID NO: 7804193 - DNA, 22 bp, Homo sapiens
aagatgatgcagactttgatgt

SEQ ID NO: 7804194 - DNA, 22 bp, Homo sapiens
aagatgatagatctgtcaatgt

SEQ ID NO: 7804195 - DNA, 22 bp, Homo sapiens
aagcacatttggaaaacatgga

SEQ ID NO: 7804196 - DNA, 20 bp, Homo sapiens
aagcaatatagtgcaaatgt

SEQ ID NO: 7804197 - DNA, 22 bp, Homo sapiens
aagcaatatactgatatgatta

SEQ ID NO: 7804198 - DNA, 19 bp, Homo sapiens
aagcaatgttgtgaatcta

SEQ ID NO: 7804199 - DNA, 23 bp, Homo sapiens
aatgacaggcaatgtaattgtgt

SEQ ID NO: 7804200 - DNA, 22 bp, Homo sapiens
aatgacagtgttgggccagatg

SEQ ID NO: 7804201 - DNA, 22 bp, Homo sapiens
aacatatttggctgatattccc

SEQ ID NO: 7804202 - DNA, 22 bp, Homo sapiens
aatagacaagcaccctggtaaa

SEQ ID NO: 7804203 - DNA, 22 bp, Homo sapiens
aatagacaattctagccaacat

SEQ ID NO: 7804204 - DNA, 22 bp, Homo sapiens
aatagactttctttttagaaca

SEQ ID NO: 7804205 - DNA, 22 bp, Homo sapiens
aaatgcatttcactaatgtttc

SEQ ID NO: 7804206 - DNA, 22 bp, Homo sapiens
aaatgcattggtttctacttgt

SEQ ID NO: 7804207 - DNA, 22 bp, Homo sapiens
aaatgcatgtgctatagatgtg

SEQ ID NO: 7804208 - DNA, 22 bp, Homo sapiens
aaatgcatgtatgtaatatgct

SEQ ID NO: 7804209 - DNA, 22 bp, Homo sapiens
aaatgcattctgttttcactag

SEQ ID NO: 7804210 - DNA, 22 bp, Homo sapiens
aaatgtcaaggtgatagatgca

SEQ ID NO: 7804211 - DNA, 22 bp, Homo sapiens
aaatttgtcaacttcatatgtt

SEQ ID NO: 7804212 - DNA, 22 bp, Homo sapiens
aaattttaaggctggaacttaa

SEQ ID NO: 7804213 - DNA, 22 bp, Homo sapiens
aaaggtttttatttatcctgga

SEQ ID NO: 7804214 - DNA, 22 bp, Homo sapiens
aaaggttttgccctgggtattc

SEQ ID NO: 7804215 - DNA, 22 bp, Homo sapiens
aaaggcataggatgtggaatcg

SEQ ID NO: 7804216 - DNA, 22 bp, Homo sapiens
aacatttgtttggcttcaatta

SEQ ID NO: 7804217 - DNA, 22 bp, Homo sapiens
aaagatttcagaagcctgtgcc

SEQ ID NO: 7804218 - DNA, 22 bp, Homo sapiens
aaagatttgagttctgcttata

SEQ ID NO: 7804219 - DNA, 22 bp, Homo sapiens
aaagatgttttataagttatgg

SEQ ID NO: 7804220 - DNA, 22 bp, Homo sapiens
aaagccattgcagagcaggatt

SEQ ID NO: 7804221 - DNA, 22 bp, Homo sapiens
aaagcccatgtggaagtacagg

SEQ ID NO: 7804222 - DNA, 22 bp, Homo sapiens
aaagttttagaactaggaagca

SEQ ID NO: 7804223 - DNA, 22 bp, Homo sapiens
aaagtgattatgctgtcaaaga

SEQ ID NO: 7804224 - DNA, 22 bp, Homo sapiens
aagactgaatttgcatagttgg

SEQ ID NO: 7804225 - DNA, 22 bp, Homo sapiens
aagactgatgtccagtcccatg

SEQ ID NO: 7804226 - DNA, 22 bp, Homo sapiens
aagcaggagatgcaggaatgta

SEQ ID NO: 7804227 - DNA, 22 bp, Homo sapiens
aaatgcatggtaaatgattgcc

SEQ ID NO: 7804228 - DNA, 22 bp, Homo sapiens
aaatgcatgtagaataatagag

SEQ ID NO: 7804229 - DNA, 22 bp, Homo sapiens
aaatgcatgtagaataatagag

SEQ ID NO: 7804230 - DNA, 22 bp, Homo sapiens
aaatagtcctgggaatagtact

SEQ ID NO: 7804231 - DNA, 22 bp, Homo sapiens
aaactttttattctaatgtcta

SEQ ID NO: 7804232 - DNA, 22 bp, Homo sapiens
aaagagaaaatgatctgtacat

SEQ ID NO: 7804233 - DNA, 22 bp, Homo sapiens
aaagagaacttttacccaagaa

SEQ ID NO: 7804234 - DNA, 22 bp, Homo sapiens
aaacatgttttctgaatatttt

SEQ ID NO: 7804235 - DNA, 22 bp, Homo sapiens
aaacatgtaattctgcttaaga

SEQ ID NO: 7804236 - DNA, 22 bp, Homo sapiens
aaaatatgaagttgtcagtatg

SEQ ID NO: 7804237 - DNA, 21 bp, Homo sapiens
aaaatgtgagcgtgatgctta

SEQ ID NO: 7804238 - DNA, 22 bp, Homo sapiens
aaaatatgtataactcttctgc

SEQ ID NO: 7804239 - DNA, 22 bp, Homo sapiens
aaaatgtgatctacaaatgcaa

SEQ ID NO: 7804240 - DNA, 17 bp, Homo sapiens
aaagagcttggagtgtt

SEQ ID NO: 7804241 - DNA, 22 bp, Homo sapiens
aaagagctaacattgccgagat

SEQ ID NO: 7804242 - DNA, 22 bp, Homo sapiens
aaagagctcggaaagtgttgaa

SEQ ID NO: 7804243 - DNA, 22 bp, Homo sapiens
aaagagctgatagcatctgttt

SEQ ID NO: 7804244 - DNA, 22 bp, Homo sapiens
aaagagctgagacctggtggag

SEQ ID NO: 7804245 - DNA, 22 bp, Homo sapiens
aaaagtaattgcaattttgtag

SEQ ID NO: 7804246 - DNA, 22 bp, Homo sapiens
aaaaggtagattctccttctat

SEQ ID NO: 7804247 - DNA, 22 bp, Homo sapiens
aaaattaagtgtctgggaagcc

SEQ ID NO: 7804248 - DNA, 22 bp, Homo sapiens
aaaattatggagtatcccaaag

SEQ ID NO: 7804249 - DNA, 22 bp, Homo sapiens
agaaaataaattgatggtggaa

SEQ ID NO: 7804250 - DNA, 22 bp, Homo sapiens
atatatttactctcctgttgca

SEQ ID NO: 7804251 - DNA, 22 bp, Homo sapiens
atatatttgagaatattcatga

SEQ ID NO: 7804252 - DNA, 22 bp, Homo sapiens
atagtttacaaaaatgatgcat

SEQ ID NO: 7804253 - DNA, 22 bp, Homo sapiens
atagtttaaggaactatgcgat

SEQ ID NO: 7804254 - DNA, 22 bp, Homo sapiens
atcattctattgttgagctgcc

SEQ ID NO: 7804255 - DNA, 23 bp, Homo sapiens
atcattctccaatctggagcagg

SEQ ID NO: 7804256 - DNA, 22 bp, Homo sapiens
atcattctgatggtcaatgcta

SEQ ID NO: 7804257 - DNA, 22 bp, Homo sapiens
atcatttaaaacaagtctctat

SEQ ID NO: 7804258 - DNA, 22 bp, Homo sapiens
atcatttatgccccaattagat

SEQ ID NO: 7804259 - DNA, 22 bp, Homo sapiens
acttcattgtaatattatagca

SEQ ID NO: 7804260 - DNA, 22 bp, Homo sapiens
actgttaacggtatgatgctcg

SEQ ID NO: 7804261 - DNA, 22 bp, Homo sapiens
actgtgtattcctatatagtaa

SEQ ID NO: 7804262 - DNA, 22 bp, Homo sapiens
actgtgaaagctaacatcttag

SEQ ID NO: 7804263 - DNA, 22 bp, Homo sapiens
actgctattgatgtcacacttt

SEQ ID NO: 7804264 - DNA, 22 bp, Homo sapiens
actgctttagacctagagctct

SEQ ID NO: 7804265 - DNA, 22 bp, Homo sapiens
actatataagattggcattttt

SEQ ID NO: 7804266 - DNA, 22 bp, Homo sapiens
acagggattatgactgacagcc

SEQ ID NO: 7804267 - DNA, 22 bp, Homo sapiens
acagggattttccaggctaccc

SEQ ID NO: 7804268 - DNA, 22 bp, Homo sapiens
acagggcaacctctgggagact

SEQ ID NO: 7804269 - DNA, 21 bp, Homo sapiens
acagttttaaggagcacatgg

SEQ ID NO: 7804270 - DNA, 22 bp, Homo sapiens
accaaaacctgctactaaagga

SEQ ID NO: 7804271 - DNA, 21 bp, Homo sapiens
accaaaacctatactttctgt

SEQ ID NO: 7804272 - DNA, 22 bp, Homo sapiens
accattctgtctctttacaaat

SEQ ID NO: 7804273 - DNA, 22 bp, Homo sapiens
agggagctctaagtagagggac

SEQ ID NO: 7804274 - DNA, 22 bp, Homo sapiens
agggagctcagttggaagcggt

SEQ ID NO: 7804275 - DNA, 22 bp, Homo sapiens
acatttaatgatcctactgtga

SEQ ID NO: 7804276 - DNA, 22 bp, Homo sapiens
acatttatataactcactagga

SEQ ID NO: 7804277 - DNA, 22 bp, Homo sapiens
acatttaaccaaactgtttaat

SEQ ID NO: 7804278 - DNA, 19 bp, Homo sapiens
acatttaaattcagatctc

SEQ ID NO: 7804279 - DNA, 22 bp, Homo sapiens
acattgtatacagacttagtca

SEQ ID NO: 7804280 - DNA, 22 bp, Homo sapiens
atttaagattgcgtattcatgt

SEQ ID NO: 7804281 - DNA, 22 bp, Homo sapiens
atttaagaggctgctagagtat

SEQ ID NO: 7804282 - DNA, 22 bp, Homo sapiens
attcttcatacctactgaggtt

SEQ ID NO: 7804283 - DNA, 22 bp, Homo sapiens
attcttcatttactgttacttg

SEQ ID NO: 7804284 - DNA, 22 bp, Homo sapiens
attcttcatggctgtgagtcct

SEQ ID NO: 7804285 - DNA, 23 bp, Homo sapiens
attcttcattatcttctagaaaa

SEQ ID NO: 7804286 - DNA, 22 bp, Homo sapiens
atttagtagagaaattaagaaa

SEQ ID NO: 7804287 - DNA, 22 bp, Homo sapiens
agagtgggacacgggcgctgtc

SEQ ID NO: 7804288 - DNA, 22 bp, Homo sapiens
atttagcaagagtacaaaataa

SEQ ID NO: 7804289 - DNA, 22 bp, Homo sapiens
agatgaaaatacgtgactttaa

SEQ ID NO: 7804290 - DNA, 21 bp, Homo sapiens
atttccaagggtacctaagat

SEQ ID NO: 7804291 - DNA, 22 bp, Homo sapiens
agcaaaataaggtaatttattg

SEQ ID NO: 7804292 - DNA, 22 bp, Homo sapiens
agcaaacagtgtgctaagaaat

SEQ ID NO: 7804293 - DNA, 22 bp, Homo sapiens
attctctgtttccaagatgaaa

SEQ ID NO: 7804294 - DNA, 22 bp, Homo sapiens
attataaagaacatgtgtgtgg

SEQ ID NO: 7804295 - DNA, 22 bp, Homo sapiens
attcacacacatttagagcaga

SEQ ID NO: 7804296 - DNA, 22 bp, Homo sapiens
attaaacaatgtaaagttcttg

SEQ ID NO: 7804297 - DNA, 22 bp, Homo sapiens
attacagtaacagctacaatgc

SEQ ID NO: 7804298 - DNA, 22 bp, Homo sapiens
agaagaatacttgatgttcatg

SEQ ID NO: 7804299 - DNA, 22 bp, Homo sapiens
agaagaatttctctcatgattt

SEQ ID NO: 7804300 - DNA, 22 bp, Homo sapiens
atgtctgtggcattatatgttt

SEQ ID NO: 7804301 - DNA, 22 bp, Homo sapiens
atgtctgtgtgatcttggataa

SEQ ID NO: 7804302 - DNA, 22 bp, Homo sapiens
atgtctgtttatccttcaagat

SEQ ID NO: 7804303 - DNA, 22 bp, Homo sapiens
atgggaggcaaagatcgcagaa

SEQ ID NO: 7804304 - DNA, 22 bp, Homo sapiens
atgggaggcagacactaagttc

SEQ ID NO: 7804305 - DNA, 22 bp, Homo sapiens
atgggaggaagagaagatgtct

SEQ ID NO: 7804306 - DNA, 21 bp, Homo sapiens
atggctggtggctcagcctcc

SEQ ID NO: 7804307 - DNA, 22 bp, Homo sapiens
atggctggtctcccatggaaaa

SEQ ID NO: 7804308 - DNA, 22 bp, Homo sapiens
caaatgttttttagtataagta

SEQ ID NO: 7804309 - DNA, 22 bp, Homo sapiens
caaatgtttcttatctattgtt

SEQ ID NO: 7804310 - DNA, 22 bp, Homo sapiens
caaatgttaagacaggatcaag

SEQ ID NO: 7804311 - DNA, 22 bp, Homo sapiens
caaatgttaaatgtgttaagac

SEQ ID NO: 7804312 - DNA, 22 bp, Homo sapiens
caaatgcagtccctttgttgct

SEQ ID NO: 7804313 - DNA, 22 bp, Homo sapiens
caaatgcaggtcataacctgag

SEQ ID NO: 7804314 - DNA, 22 bp, Homo sapiens
caaatgcatagaaagatgaaac

SEQ ID NO: 7804315 - DNA, 22 bp, Homo sapiens
caaatgcagattcaggagttct

SEQ ID NO: 7804316 - DNA, 22 bp, Homo sapiens
caaatgatgcatggctagtgag

SEQ ID NO: 7804317 - DNA, 22 bp, Homo sapiens
caaatgcaaaatataaccctgt

SEQ ID NO: 7804318 - DNA, 22 bp, Homo sapiens
caaatgcaggtcagcaggtgtc

SEQ ID NO: 7804319 - DNA, 22 bp, Homo sapiens
caaatgatactgtttttagtct

SEQ ID NO: 7804320 - DNA, 22 bp, Homo sapiens
caaatgatagagccgattatca

SEQ ID NO: 7804321 - DNA, 21 bp, Homo sapiens
agcaatttttcctcctctgca

SEQ ID NO: 7804322 - DNA, 22 bp, Homo sapiens
attttctatgttgtaattgtta

SEQ ID NO: 7804323 - DNA, 22 bp, Homo sapiens
attttctcacaatgcagaagga

SEQ ID NO: 7804324 - DNA, 22 bp, Homo sapiens
agcaggtgatgtgagtctggaa

SEQ ID NO: 7804325 - DNA, 22 bp, Homo sapiens
cacagtatttgtttttctgagt

SEQ ID NO: 7804326 - DNA, 21 bp, Homo sapiens
agcaggtgctgttggaggaaa

SEQ ID NO: 7804327 - DNA, 17 bp, Homo sapiens
cagaaggaagcatggca

SEQ ID NO: 7804328 - DNA, 23 bp, Homo sapiens
cagaagacagtctcaagacaagg

SEQ ID NO: 7804329 - DNA, 22 bp, Homo sapiens
agccacagcaacaagtgcaatt

SEQ ID NO: 7804330 - DNA, 22 bp, Homo sapiens
agccttgggcaatttggacact

SEQ ID NO: 7804331 - DNA, 22 bp, Homo sapiens
cctagaatgtacttaatagatg

SEQ ID NO: 7804332 - DNA, 22 bp, Homo sapiens
aggcatttaaagatgtaagact

SEQ ID NO: 7804333 - DNA, 22 bp, Homo sapiens
aggcattttgttcaagatgaca

SEQ ID NO: 7804334 - DNA, 22 bp, Homo sapiens
cattccaagtatatacatgata

SEQ ID NO: 7804335 - DNA, 22 bp, Homo sapiens
aggagagaatgttccaggcttg

SEQ ID NO: 7804336 - DNA, 22 bp, Homo sapiens
aggaggaggtgggacacagtga

SEQ ID NO: 7804337 - DNA, 22 bp, Homo sapiens
aggaggaggtaagaaaagcata

SEQ ID NO: 7804338 - DNA, 17 bp, Homo sapiens
agcttgtttttgaaagc

SEQ ID NO: 7804339 - DNA, 21 bp, Homo sapiens
agctgcagccatgtacatggc

SEQ ID NO: 7804340 - DNA, 22 bp, Homo sapiens
cagctttgattctttctgccat

SEQ ID NO: 7804341 - DNA, 22 bp, Homo sapiens
atactcaatttgttggaaagca

SEQ ID NO: 7804342 - DNA, 22 bp, Homo sapiens
ctgctctgctgatcagtgtctc

SEQ ID NO: 7804343 - DNA, 22 bp, Homo sapiens
ctgctctggctgtgtacttcag

SEQ ID NO: 7804344 - DNA, 22 bp, Homo sapiens
ctgctctggtctcttcatgttt

SEQ ID NO: 7804345 - DNA, 22 bp, Homo sapiens
atatgatgtgctatgtcactag

SEQ ID NO: 7804346 - DNA, 22 bp, Homo sapiens
atatgtatgtacgcacatattc

SEQ ID NO: 7804347 - DNA, 22 bp, Homo sapiens
atatgtggcattatttctgagg

SEQ ID NO: 7804348 - DNA, 19 bp, Homo sapiens
ctgggaggtgttcagagaa

SEQ ID NO: 7804349 - DNA, 22 bp, Homo sapiens
atatatacaactagattaaaag

SEQ ID NO: 7804350 - DNA, 22 bp, Homo sapiens
atccaaaatttactgtagcatt

SEQ ID NO: 7804351 - DNA, 18 bp, Homo sapiens
atccaaaaagatggaagt

SEQ ID NO: 7804352 - DNA, 22 bp, Homo sapiens
atcattctagctgttgtgttga

SEQ ID NO: 7804353 - DNA, 22 bp, Homo sapiens
atcattctagtccttatggtct

SEQ ID NO: 7804354 - DNA, 22 bp, Homo sapiens
aggtgcctgtcgtctctggtta

SEQ ID NO: 7804355 - DNA, 22 bp, Homo sapiens
cctctgccacctcccacgaggc

SEQ ID NO: 7804356 - DNA, 22 bp, Homo sapiens
cctgccctaatccagagactag

SEQ ID NO: 7804357 - DNA, 22 bp, Homo sapiens
cctgctctgccaagtcctcttt

SEQ ID NO: 7804358 - DNA, 22 bp, Homo sapiens
ctcagagttctcctgggaggtg

SEQ ID NO: 7804359 - DNA, 22 bp, Homo sapiens
ctcagagtccccacatctgggt

SEQ ID NO: 7804360 - DNA, 22 bp, Homo sapiens
ctcaccatggatcttccatttc

SEQ ID NO: 7804361 - DNA, 22 bp, Homo sapiens
cacacattaatatcaaaggctc

SEQ ID NO: 7804362 - DNA, 22 bp, Homo sapiens
ggaaaactgaggctctcagcag

SEQ ID NO: 7804363 - DNA, 22 bp, Homo sapiens
cacaaaatatcaagcactttta

SEQ ID NO: 7804364 - DNA, 22 bp, Homo sapiens
gctgtgctgattcattccctgc

SEQ ID NO: 7804365 - DNA, 22 bp, Homo sapiens
gctgtgcttttggtagatccca

SEQ ID NO: 7804366 - DNA, 22 bp, Homo sapiens
caaagtaattacggttttggcc

SEQ ID NO: 7804367 - DNA, 22 bp, Homo sapiens
gctgcagtgagccaagatcgtg

SEQ ID NO: 7804368 - DNA, 22 bp, Homo sapiens
caagaggctaaactgggctatt

SEQ ID NO: 7804369 - DNA, 22 bp, Homo sapiens
caaggagaaaacggcttctgaa

SEQ ID NO: 7804370 - DNA, 22 bp, Homo sapiens
caagagctcaccggagagcatt

SEQ ID NO: 7804371 - DNA, 22 bp, Homo sapiens
caagacaagatctaagcatgct

SEQ ID NO: 7804372 - DNA, 22 bp, Homo sapiens
gctgctggcactggagtgagcc

SEQ ID NO: 7804373 - DNA, 22 bp, Homo sapiens
gctgctggagagcgagactgtt

SEQ ID NO: 7804374 - DNA, 22 bp, Homo sapiens
cactgagagatgtgtcacagca

SEQ ID NO: 7804375 - DNA, 22 bp, Homo sapiens
cactgcttttcagacagttatt

SEQ ID NO: 7804376 - DNA, 22 bp, Homo sapiens
cactggaagttcattctcagaa

SEQ ID NO: 7804377 - DNA, 22 bp, Homo sapiens
cacagggaggcagccatgctcc

SEQ ID NO: 7804378 - DNA, 19 bp, Homo sapiens
gtatatttatatggctgta

SEQ ID NO: 7804379 - DNA, 22 bp, Homo sapiens
gggaaactgtccagttctcccc

SEQ ID NO: 7804380 - DNA, 22 bp, Homo sapiens
attcttcagatcagcagggcct

SEQ ID NO: 7804381 - DNA, 22 bp, Homo sapiens
attcttcacaaatatatagaag

SEQ ID NO: 7804382 - DNA, 22 bp, Homo sapiens
attcttcaccatggataatttg

SEQ ID NO: 7804383 - DNA, 22 bp, Homo sapiens
attcttcactgtttcagaatga

SEQ ID NO: 7804384 - DNA, 22 bp, Homo sapiens
attcttacaaatgaaactgcaa

SEQ ID NO: 7804385 - DNA, 22 bp, Homo sapiens
attcttactccatagaatgaat

SEQ ID NO: 7804386 - DNA, 22 bp, Homo sapiens
attcttacaaagcagagtctgt

SEQ ID NO: 7804387 - DNA, 22 bp, Homo sapiens
attcttattaaatagccagaag

SEQ ID NO: 7804388 - DNA, 22 bp, Homo sapiens
attctatagacagaaggtcaat

SEQ ID NO: 7804389 - DNA, 22 bp, Homo sapiens
atgttttctagagtttaaaatc

SEQ ID NO: 7804390 - DNA, 22 bp, Homo sapiens
atgttttcaaagtaaacttgta

SEQ ID NO: 7804391 - DNA, 22 bp, Homo sapiens
atgttttccccaaatgatcttc

SEQ ID NO: 7804392 - DNA, 22 bp, Homo sapiens
attaaatgatggcatgtcttat

SEQ ID NO: 7804393 - DNA, 22 bp, Homo sapiens
attaaatgttggacgtatacat

SEQ ID NO: 7804394 - DNA, 22 bp, Homo sapiens
attaaattaagtggctaattta

SEQ ID NO: 7804395 - DNA, 22 bp, Homo sapiens
attaaattagcaaactgtgaaa

SEQ ID NO: 7804396 - DNA, 20 bp, Homo sapiens
attagagctacatggctaca

SEQ ID NO: 7804397 - DNA, 22 bp, Homo sapiens
atttaatgtcgagctattgtag

SEQ ID NO: 7804398 - DNA, 22 bp, Homo sapiens
attgcttttcagacaatgaggc

SEQ ID NO: 7804399 - DNA, 22 bp, Homo sapiens
atttccttcccagatttggttc

SEQ ID NO: 7804400 - DNA, 22 bp, Homo sapiens
atttccttcggacagtttgggt

SEQ ID NO: 7804401 - DNA, 22 bp, Homo sapiens
caaaaaacacagatgtctgtgt

SEQ ID NO: 7804402 - DNA, 22 bp, Homo sapiens
atgagtgttgctcattgcagaa

SEQ ID NO: 7804403 - DNA, 22 bp, Homo sapiens
atgcaaataaacagtctagttg

SEQ ID NO: 7804404 - DNA, 22 bp, Homo sapiens
atgcatgcattgtttatcatgg

SEQ ID NO: 7804405 - DNA, 22 bp, Homo sapiens
atgaaatgtctggatctttttc

SEQ ID NO: 7804406 - DNA, 22 bp, Homo sapiens
atctttttgacatggtgatggt

SEQ ID NO: 7804407 - DNA, 18 bp, Homo sapiens
cttgttcttctcttggcg

SEQ ID NO: 7804408 - DNA, 22 bp, Homo sapiens
cttgcctttgtcttcaaaggct

SEQ ID NO: 7804409 - DNA, 22 bp, Homo sapiens
atctagaacaattattgtcaca

SEQ ID NO: 7804410 - DNA, 22 bp, Homo sapiens
cttggcagatccaaaaatgaca

SEQ ID NO: 7804411 - DNA, 22 bp, Homo sapiens
gagaggaactcccagtgcctgg

SEQ ID NO: 7804412 - DNA, 22 bp, Homo sapiens
gagaaatgcatgcatgtcatca

SEQ ID NO: 7804413 - DNA, 22 bp, Homo sapiens
gagaaagggataatttgaagag

SEQ ID NO: 7804414 - DNA, 22 bp, Homo sapiens
gagaaagggataatttgaagag

SEQ ID NO: 7804415 - DNA, 20 bp, Homo sapiens
atggaggaagggcaagagaa

SEQ ID NO: 7804416 - DNA, 22 bp, Homo sapiens
atgtctttcttgtgtcccaaga

SEQ ID NO: 7804417 - DNA, 22 bp, Homo sapiens
atgtctttgccatagttcatat

SEQ ID NO: 7804418 - DNA, 22 bp, Homo sapiens
tatacagttaagtttcttcagt

SEQ ID NO: 7804419 - DNA, 22 bp, Homo sapiens
tatacagtcttttgctatattc

SEQ ID NO: 7804420 - DNA, 22 bp, Homo sapiens
tatttagttatctttcataaaa

SEQ ID NO: 7804421 - DNA, 22 bp, Homo sapiens
tattggaatttagttagagaat

SEQ ID NO: 7804422 - DNA, 22 bp, Homo sapiens
tcagtttcacagtctgtgcaga

SEQ ID NO: 7804423 - DNA, 22 bp, Homo sapiens
tcagttcttagtaatgcagtct

SEQ ID NO: 7804424 - DNA, 22 bp, Homo sapiens
catgcaaaggtcaagatcagga

SEQ ID NO: 7804425 - DNA, 22 bp, Homo sapiens
catgtctttcaaaccacacagt

SEQ ID NO: 7804426 - DNA, 22 bp, Homo sapiens
catgtgcagactctgacaggct

SEQ ID NO: 7804427 - DNA, 22 bp, Homo sapiens
catacattgctcattcagtatc

SEQ ID NO: 7804428 - DNA, 22 bp, Homo sapiens
cagtttgtatttattactcata

SEQ ID NO: 7804429 - DNA, 22 bp, Homo sapiens
catagacaaagatcagaagagt

SEQ ID NO: 7804430 - DNA, 22 bp, Homo sapiens
tctctctgtgacagctttgctg

SEQ ID NO: 7804431 - DNA, 22 bp, Homo sapiens
tctcccaaggcacagaaagagt

SEQ ID NO: 7804432 - DNA, 22 bp, Homo sapiens
catttattagttagttcgatgt

SEQ ID NO: 7804433 - DNA, 22 bp, Homo sapiens
catttgcaaaccaacaagatga

SEQ ID NO: 7804434 - DNA, 22 bp, Homo sapiens
catttgcaagagataaatgttt

SEQ ID NO: 7804435 - DNA, 22 bp, Homo sapiens
catttgaaattcttagaacaaa

SEQ ID NO: 7804436 - DNA, 22 bp, Homo sapiens
ccacaaattaggttttgcttgt

SEQ ID NO: 7804437 - DNA, 22 bp, Homo sapiens
ccaaatgtgcctgtttcaacaa

SEQ ID NO: 7804438 - DNA, 22 bp, Homo sapiens
ccaaatgctccactgactttgg

SEQ ID NO: 7804439 - DNA, 19 bp, Homo sapiens
taaaaactgaaggaagcag

SEQ ID NO: 7804440 - DNA, 22 bp, Homo sapiens
taaacatttgttattcttgttt

SEQ ID NO: 7804441 - DNA, 22 bp, Homo sapiens
taaaatgatctctcatgttctt

SEQ ID NO: 7804442 - DNA, 22 bp, Homo sapiens
caggaggaaagttccactcaac

SEQ ID NO: 7804443 - DNA, 22 bp, Homo sapiens
taaatatcagtccagctcttcc

SEQ ID NO: 7804444 - DNA, 22 bp, Homo sapiens
taaagccacgctggaaatcagg

SEQ ID NO: 7804445 - DNA, 22 bp, Homo sapiens
taaagtcatctttaaacatgcc

SEQ ID NO: 7804446 - DNA, 22 bp, Homo sapiens
taacattaggtagacataagcc

SEQ ID NO: 7804447 - DNA, 22 bp, Homo sapiens
taagaaacatgatacttttcct

SEQ ID NO: 7804448 - DNA, 22 bp, Homo sapiens
taagacaattcttcagtcacaa

SEQ ID NO: 7804449 - DNA, 22 bp, Homo sapiens
taagatttttaaaatgtcctca

SEQ ID NO: 7804450 - DNA, 22 bp, Homo sapiens
tacaagttgcagaaagttgttt

SEQ ID NO: 7804451 - DNA, 22 bp, Homo sapiens
tacaaatgggttaaaatatagt

SEQ ID NO: 7804452 - DNA, 22 bp, Homo sapiens
tacaaatgagttgtatgaacca

SEQ ID NO: 7804453 - DNA, 22 bp, Homo sapiens
tacaaatgcctgacacacagat

SEQ ID NO: 7804454 - DNA, 22 bp, Homo sapiens
gttcttcaccaaggtcagaggc

SEQ ID NO: 7804455 - DNA, 22 bp, Homo sapiens
gttcttcaggctgagcagagag

SEQ ID NO: 7804456 - DNA, 22 bp, Homo sapiens
gttcttcagcattagaagtcat

SEQ ID NO: 7804457 - DNA, 22 bp, Homo sapiens
tggtccctaggaaagcagtgtt

SEQ ID NO: 7804458 - DNA, 23 bp, Homo sapiens
tggtccctgagagctggggaggg

SEQ ID NO: 7804459 - DNA, 22 bp, Homo sapiens
cctctgtgctttgtccagcctc

SEQ ID NO: 7804460 - DNA, 22 bp, Homo sapiens
cctctgtgcctcgtgtcctctg

SEQ ID NO: 7804461 - DNA, 22 bp, Homo sapiens
tgtcatgtctgtaaatacacca

SEQ ID NO: 7804462 - DNA, 22 bp, Homo sapiens
tgtcctggaaaaatggagagtt

SEQ ID NO: 7804463 - DNA, 22 bp, Homo sapiens
tgtctatttgaattatcctaat

SEQ ID NO: 7804464 - DNA, 22 bp, Homo sapiens
cctgggctttgctggcaaggcc

SEQ ID NO: 7804465 - DNA, 22 bp, Homo sapiens
cctgggtctgtattggtaggta

SEQ ID NO: 7804466 - DNA, 22 bp, Homo sapiens
cctgggtccctgagagatgatt

SEQ ID NO: 7804467 - DNA, 20 bp, Homo sapiens
cctggctgcattcaggacgg

SEQ ID NO: 7804468 - DNA, 22 bp, Homo sapiens
tgtctttacttagaagttcagg

SEQ ID NO: 7804469 - DNA, 22 bp, Homo sapiens
tgccaagattatcgaagtctta

SEQ ID NO: 7804470 - DNA, 22 bp, Homo sapiens
tgctgagacagtggataggggc

SEQ ID NO: 7804471 - DNA, 22 bp, Homo sapiens
cctctcagcgattcctcttgga

SEQ ID NO: 7804472 - DNA, 22 bp, Homo sapiens
cctctgtaagccttagtctaga

SEQ ID NO: 7804473 - DNA, 21 bp, Homo sapiens
cctctgtagttaagtttccta

SEQ ID NO: 7804474 - DNA, 22 bp, Homo sapiens
tggctgaggtaactatgaataa

SEQ ID NO: 7804475 - DNA, 18 bp, Homo sapiens
ctggagtcacagtgggga

SEQ ID NO: 7804476 - DNA, 22 bp, Homo sapiens
ctggagtcagcaaggacgaggc

SEQ ID NO: 7804477 - DNA, 22 bp, Homo sapiens
ctggaggagcaatatggttagg

SEQ ID NO: 7804478 - DNA, 22 bp, Homo sapiens
ctggctccctggacatggggcc

SEQ ID NO: 7804479 - DNA, 22 bp, Homo sapiens
ctggctccctcgctgaggtgct

SEQ ID NO: 7804480 - DNA, 22 bp, Homo sapiens
ctggctctatctccaaggctgg

SEQ ID NO: 7804481 - DNA, 22 bp, Homo sapiens
ctggcaggtatctaaagttgtc

SEQ ID NO: 7804482 - DNA, 22 bp, Homo sapiens
ctgagtccttgggcttagagtg

SEQ ID NO: 7804483 - DNA, 22 bp, Homo sapiens
ctgagagagtaaagtagaatta

SEQ ID NO: 7804484 - DNA, 22 bp, Homo sapiens
ctgccatgctcaagaagtcttt

SEQ ID NO: 7804485 - DNA, 22 bp, Homo sapiens
ctgaaagcaaatacatgaatct

SEQ ID NO: 7804486 - DNA, 22 bp, Homo sapiens
tttgtcttgtaagttaaattca

SEQ ID NO: 7804487 - DNA, 19 bp, Homo sapiens
ctctggcttccaaagcatc

SEQ ID NO: 7804488 - DNA, 19 bp, Homo sapiens
ctctggcttccaaagcatc

SEQ ID NO: 7804489 - DNA, 22 bp, Homo sapiens
ctctggctgtttgcagctcaag

SEQ ID NO: 7804490 - DNA, 22 bp, Homo sapiens
ctctggctgcggggcgcgtgga

SEQ ID NO: 7804491 - DNA, 22 bp, Homo sapiens
ttcttggcatcatgaaaaatta

SEQ ID NO: 7804492 - DNA, 21 bp, Homo sapiens
ttcttggcaggtgtatcataa

SEQ ID NO: 7804493 - DNA, 22 bp, Homo sapiens
ttcttggctgttcatggtcagg

SEQ ID NO: 7804494 - DNA, 22 bp, Homo sapiens
ttcttggccaccagatctcact

SEQ ID NO: 7804495 - DNA, 23 bp, Homo sapiens
ttcttggccccagtgacttctac

SEQ ID NO: 7804496 - DNA, 19 bp, Homo sapiens
ctcagcacttttacacagg

SEQ ID NO: 7804497 - DNA, 22 bp, Homo sapiens
ttgataaaatgatgaaatcact

SEQ ID NO: 7804498 - DNA, 22 bp, Homo sapiens
ttcccaagtctccaatgtggga

SEQ ID NO: 7804499 - DNA, 22 bp, Homo sapiens
ttccaaagtgctggaattacat

SEQ ID NO: 7804500 - DNA, 22 bp, Homo sapiens
ttcattcttatttgtgatctgg

SEQ ID NO: 7804501 - DNA, 22 bp, Homo sapiens
ttcattcttcagagctgcgctt

SEQ ID NO: 7804502 - DNA, 22 bp, Homo sapiens
ttcattcttgggatcagagagt

SEQ ID NO: 7804503 - DNA, 19 bp, Homo sapiens
ttcattctcttattgttgt

SEQ ID NO: 7804504 - DNA, 22 bp, Homo sapiens
ttcattctgtttggaaaggtgg

SEQ ID NO: 7804505 - DNA, 22 bp, Homo sapiens
ttcattctgggctctaaggaac

SEQ ID NO: 7804506 - DNA, 22 bp, Homo sapiens
cggctgggtagaggtgccgggt

SEQ ID NO: 7804507 - DNA, 22 bp, Homo sapiens
ttgggaggtcataaatctgttc

SEQ ID NO: 7804508 - DNA, 22 bp, Homo sapiens
ttgggaggtaatggagccaagt

SEQ ID NO: 7804509 - DNA, 22 bp, Homo sapiens
ttggaaaaattgcctgatgtct

SEQ ID NO: 7804510 - DNA, 22 bp, Homo sapiens
ctcctgggctgggaactcagcc

SEQ ID NO: 7804511 - DNA, 22 bp, Homo sapiens
ctcctgggagcagggatggatg

SEQ ID NO: 7804512 - DNA, 22 bp, Homo sapiens
ctcctgggagctgtggcagagc

SEQ ID NO: 7804513 - DNA, 17 bp, Homo sapiens
tttagaatacaatgttt

SEQ ID NO: 7804514 - DNA, 22 bp, Homo sapiens
tttaaatttgtgtttagagggt

SEQ ID NO: 7804515 - DNA, 22 bp, Homo sapiens
tttaaatttagaagaaacactg

SEQ ID NO: 7804516 - DNA, 22 bp, Homo sapiens
tttaaattctgtctgccgctta

SEQ ID NO: 7804517 - DNA, 22 bp, Homo sapiens
tttaaattatagttaatgtctg

SEQ ID NO: 7804518 - DNA, 22 bp, Homo sapiens
tttagaatgtgactgtatttga

SEQ ID NO: 7804519 - DNA, 22 bp, Homo sapiens
ctggctggttggggagaagaca

SEQ ID NO: 7804520 - DNA, 22 bp, Homo sapiens
ctggctggggccttagataaga

SEQ ID NO: 7804521 - DNA, 22 bp, Homo sapiens
ctggctggggtaccagttgaac

SEQ ID NO: 7804522 - DNA, 22 bp, Homo sapiens
ctggctgggcagacagaatgct

SEQ ID NO: 7804523 - DNA, 22 bp, Homo sapiens
ctttatctgtgtcctcttgcct

SEQ ID NO: 7804524 - DNA, 22 bp, Homo sapiens
cttggctgaactccaggatgca

SEQ ID NO: 7804525 - DNA, 22 bp, Homo sapiens
cttggctgcttttgtgcacatt

SEQ ID NO: 7804526 - DNA, 22 bp, Homo sapiens
gaaatttacaactttctcatgg

SEQ ID NO: 7804527 - DNA, 22 bp, Homo sapiens
gaactcattagcctgctttcag

SEQ ID NO: 7804528 - DNA, 22 bp, Homo sapiens
ctttgttaggggctcagggtgg

SEQ ID NO: 7804529 - DNA, 22 bp, Homo sapiens
ctttgtttatatttctcctcga

SEQ ID NO: 7804530 - DNA, 22 bp, Homo sapiens
gaaggctgatgacagattctgc

SEQ ID NO: 7804531 - DNA, 22 bp, Homo sapiens
gaaggcttgccgggaagcggca

SEQ ID NO: 7804532 - DNA, 20 bp, Homo sapiens
gaaggcttggacagtgacag

SEQ ID NO: 7804533 - DNA, 22 bp, Homo sapiens
gaaggcttgcaagtggttcata

SEQ ID NO: 7804534 - DNA, 22 bp, Homo sapiens
gaaggcttgcagctctgtggca

SEQ ID NO: 7804535 - DNA, 22 bp, Homo sapiens
gaaggctttttgggtaattgta

SEQ ID NO: 7804536 - DNA, 19 bp, Homo sapiens
gaaggcttttggtatgttt

SEQ ID NO: 7804537 - DNA, 22 bp, Homo sapiens
gaaggcttggttttttcaacac

SEQ ID NO: 7804538 - DNA, 22 bp, Homo sapiens
gaaggctttagagagatataaa

SEQ ID NO: 7804539 - DNA, 22 bp, Homo sapiens
gaaggcttttctaccagatctt

SEQ ID NO: 7804540 - DNA, 22 bp, Homo sapiens
gaaggcttattttctttgtaaa

SEQ ID NO: 7804541 - DNA, 22 bp, Homo sapiens
gaaggcttcaaaaggtgtaatt

SEQ ID NO: 7804542 - DNA, 22 bp, Homo sapiens
gaaggcttcccacctgatattt

SEQ ID NO: 7804543 - DNA, 22 bp, Homo sapiens
gaaggcttcctggaggaggtgg

SEQ ID NO: 7804544 - DNA, 22 bp, Homo sapiens
gaaggcttctccagggcttact

SEQ ID NO: 7804545 - DNA, 22 bp, Homo sapiens
gaaggcttcctgatgccaacca

SEQ ID NO: 7804546 - DNA, 21 bp, Homo sapiens
gaaggcttctgcctggaggag

SEQ ID NO: 7804547 - DNA, 22 bp, Homo sapiens
gaaggcttgattgaggaatgcc

SEQ ID NO: 7804548 - DNA, 22 bp, Homo sapiens
gaatttaagaggatgaatctgt

SEQ ID NO: 7804549 - DNA, 19 bp, Homo sapiens
gacaggaaggctaccagta

SEQ ID NO: 7804550 - DNA, 18 bp, Homo sapiens
gactttaaaacactgctc

SEQ ID NO: 7804551 - DNA, 22 bp, Homo sapiens
gagatatttattcatactgtca

SEQ ID NO: 7804552 - DNA, 22 bp, Homo sapiens
gataaaattcttattttacccg

SEQ ID NO: 7804553 - DNA, 22 bp, Homo sapiens
gataaaatatgtggcctttagt

SEQ ID NO: 7804554 - DNA, 22 bp, Homo sapiens
gatgacttatgtttacaaatgt

SEQ ID NO: 7804555 - DNA, 22 bp, Homo sapiens
gatgaaaaattgctgtgtcata

SEQ ID NO: 7804556 - DNA, 22 bp, Homo sapiens
gatgaaattgttttgatacttt

SEQ ID NO: 7804557 - DNA, 22 bp, Homo sapiens
gatctggtacaggcctgcagcc

SEQ ID NO: 7804558 - DNA, 22 bp, Homo sapiens
gatataaattaatcaagtgcaa

SEQ ID NO: 7804559 - DNA, 21 bp, Homo sapiens
gcaggggatagaaatggtctg

SEQ ID NO: 7804560 - DNA, 22 bp, Homo sapiens
gcaggtggtccccgtggagtgg

SEQ ID NO: 7804561 - DNA, 22 bp, Homo sapiens
gcaggtggcagaggtgggatct

SEQ ID NO: 7804562 - DNA, 22 bp, Homo sapiens
gcagagcattggagggaccctg

SEQ ID NO: 7804563 - DNA, 22 bp, Homo sapiens
gatttctgtggcttgtacatat

SEQ ID NO: 7804564 - DNA, 22 bp, Homo sapiens
gatttctgttgagaaacatggg

SEQ ID NO: 7804565 - DNA, 22 bp, Homo sapiens
gcaaacaaggacatacatcctg

SEQ ID NO: 7804566 - DNA, 22 bp, Homo sapiens
gcaatgcaatcagatgattatt

SEQ ID NO: 7804567 - DNA, 22 bp, Homo sapiens
gatgccctgcatgagtcctgct

SEQ ID NO: 7804568 - DNA, 22 bp, Homo sapiens
gccctctggcacagagatgcag

SEQ ID NO: 7804569 - DNA, 22 bp, Homo sapiens
gcctgggaagactaagtgggag

SEQ ID NO: 7804570 - DNA, 20 bp, Homo sapiens
gctgaggattcctggcccct

SEQ ID NO: 7804571 - DNA, 22 bp, Homo sapiens
gctggagatagaatggccactg

SEQ ID NO: 7804572 - DNA, 22 bp, Homo sapiens
gctggagctgagttccctgggc

SEQ ID NO: 7804573 - DNA, 22 bp, Homo sapiens
gccttagcatcttaaagctgtg

SEQ ID NO: 7804574 - DNA, 22 bp, Homo sapiens
ggggggtgacaagtagaggttg

SEQ ID NO: 7804575 - DNA, 22 bp, Homo sapiens
gggtgaataggggaaggctatt

SEQ ID NO: 7804576 - DNA, 22 bp, Homo sapiens
gggcagaggggcgcttccctct

SEQ ID NO: 7804577 - DNA, 22 bp, Homo sapiens
gggatggctcaaaggagtcagg

SEQ ID NO: 7804578 - DNA, 21 bp, Homo sapiens
gggatctgaggcaagtctcct

SEQ ID NO: 7804579 - DNA, 22 bp, Homo sapiens
ggctgagttgagaggattactt

SEQ ID NO: 7804580 - DNA, 22 bp, Homo sapiens
gggaacagcatatctgaagggt

SEQ ID NO: 7804581 - DNA, 22 bp, Homo sapiens
ggcccctcagcatctgagtcag

SEQ ID NO: 7804582 - DNA, 22 bp, Homo sapiens
ggaggaaatccttagtaaggca

SEQ ID NO: 7804583 - DNA, 22 bp, Homo sapiens
ggagaaggaagaaagctactat

SEQ ID NO: 7804584 - DNA, 22 bp, Homo sapiens
ggagctattactgtaacgaaca

SEQ ID NO: 7804585 - DNA, 22 bp, Homo sapiens
gcttcatttctctctgtagacc

SEQ ID NO: 7804586 - DNA, 22 bp, Homo sapiens
gcttccttccttacattggtgg

SEQ ID NO: 7804587 - DNA, 21 bp, Homo sapiens
gcttatagaaacatcaccaga

SEQ ID NO: 7804588 - DNA, 22 bp, Homo sapiens
gcttagagcagctcacaacatg

SEQ ID NO: 7804589 - DNA, 22 bp, Homo sapiens
gcttaatgagcagagaatctac

SEQ ID NO: 7804590 - DNA, 20 bp, Homo sapiens
ggaaacatttttatttccat

SEQ ID NO: 7804591 - DNA, 22 bp, Homo sapiens
ggcagagactgggttggcagag

SEQ ID NO: 7804592 - DNA, 22 bp, Homo sapiens
gtggcagggcaatgctccctct

SEQ ID NO: 7804593 - DNA, 22 bp, Homo sapiens
gtggaaaagaaagtcttccttg

SEQ ID NO: 7804594 - DNA, 22 bp, Homo sapiens
gtatatatcggcactattttaa

SEQ ID NO: 7804595 - DNA, 22 bp, Homo sapiens
gtatatatgtgtgaacatgtat

SEQ ID NO: 7804596 - DNA, 22 bp, Homo sapiens
gtacatttactgatgaaaagta

SEQ ID NO: 7804597 - DNA, 22 bp, Homo sapiens
gtacatattataaaatacagct

SEQ ID NO: 7804598 - DNA, 22 bp, Homo sapiens
gtggtcaggggctgaggtgccc

SEQ ID NO: 7804599 - DNA, 22 bp, Homo sapiens
gtttttctaggaccatgtgatt

SEQ ID NO: 7804600 - DNA, 21 bp, Homo sapiens
taaagctagaaccttagcttt

SEQ ID NO: 7804601 - DNA, 22 bp, Homo sapiens
taaagctattgctgtttattgt

SEQ ID NO: 7804602 - DNA, 22 bp, Homo sapiens
taaagctattatagttatgttt

SEQ ID NO: 7804603 - DNA, 22 bp, Homo sapiens
taaagctatgcttaatttatca

SEQ ID NO: 7804604 - DNA, 22 bp, Homo sapiens
taaatgataataatgctagtgt

SEQ ID NO: 7804605 - DNA, 22 bp, Homo sapiens
taaatcagggagtcatctgcga

SEQ ID NO: 7804606 - DNA, 22 bp, Homo sapiens
taaatcagtaaggcatattctc

SEQ ID NO: 7804607 - DNA, 22 bp, Homo sapiens
taaatcagtttctcttattggt

SEQ ID NO: 7804608 - DNA, 22 bp, Homo sapiens
taaatcagtagatatggtatag

SEQ ID NO: 7804609 - DNA, 17 bp, Homo sapiens
tctgctctgccaatcca

SEQ ID NO: 7804610 - DNA, 22 bp, Homo sapiens
tctgctctccatacttccgcac

SEQ ID NO: 7804611 - DNA, 22 bp, Homo sapiens
tctgctgagtcagacctctggg

SEQ ID NO: 7804612 - DNA, 22 bp, Homo sapiens
tctggctccctggagctccaca

SEQ ID NO: 7804613 - DNA, 22 bp, Homo sapiens
tctgcaagtagatgacagtgag

SEQ ID NO: 7804614 - DNA, 19 bp, Homo sapiens
tctgagctgatatgacatt

SEQ ID NO: 7804615 - DNA, 22 bp, Homo sapiens
tctgacctgaatgaaacagatg

SEQ ID NO: 7804616 - DNA, 22 bp, Homo sapiens
tctgcaagcgtcacatgattct

SEQ ID NO: 7804617 - DNA, 22 bp, Homo sapiens
tctgcaagctaaggaagcatct

SEQ ID NO: 7804618 - DNA, 22 bp, Homo sapiens
tctgttaacaggagagaatgat

SEQ ID NO: 7804619 - DNA, 22 bp, Homo sapiens
tctgttaacctggtcttggctt

SEQ ID NO: 7804620 - DNA, 22 bp, Homo sapiens
tctgtgctcaagttctgcctct

SEQ ID NO: 7804621 - DNA, 22 bp, Homo sapiens
tctgtgctaggcagcctggccc

SEQ ID NO: 7804622 - DNA, 22 bp, Homo sapiens
tctgtgctgtctcagagaaagc

SEQ ID NO: 7804623 - DNA, 22 bp, Homo sapiens
tctgtgctttccctgccttctt

SEQ ID NO: 7804624 - DNA, 22 bp, Homo sapiens
tctgtgtctgttacttcactgc

SEQ ID NO: 7804625 - DNA, 22 bp, Homo sapiens
tctgtcaaggcaactgcatttt

SEQ ID NO: 7804626 - DNA, 22 bp, Homo sapiens
tctgtcaaggcaactgcatttt

SEQ ID NO: 7804627 - DNA, 22 bp, Homo sapiens
tctgtcaatatatgtgctgcag

SEQ ID NO: 7804628 - DNA, 22 bp, Homo sapiens
tctgggtgtagggcctggcaac

SEQ ID NO: 7804629 - DNA, 22 bp, Homo sapiens
tctgggtgaccctgggcaaggc

SEQ ID NO: 7804630 - DNA, 22 bp, Homo sapiens
tcttattttgttagatgctgta

SEQ ID NO: 7804631 - DNA, 22 bp, Homo sapiens
tcttatttgcaactggctcaga

SEQ ID NO: 7804632 - DNA, 22 bp, Homo sapiens
tcttcaaatacagtcatattga

SEQ ID NO: 7804633 - DNA, 22 bp, Homo sapiens
tcttcaaatgctagtaatatca

SEQ ID NO: 7804634 - DNA, 21 bp, Homo sapiens
tcttgaaaagttagattctct

SEQ ID NO: 7804635 - DNA, 22 bp, Homo sapiens
tctttataaaagtcattatgtc

SEQ ID NO: 7804636 - DNA, 22 bp, Homo sapiens
tcttggctggtcatttaaaatc

SEQ ID NO: 7804637 - DNA, 22 bp, Homo sapiens
tctcagcagggccatcctgagc

SEQ ID NO: 7804638 - DNA, 22 bp, Homo sapiens
tctcataatagcatttctcacc

SEQ ID NO: 7804639 - DNA, 22 bp, Homo sapiens
tctcattcataccctacatgct

SEQ ID NO: 7804640 - DNA, 18 bp, Homo sapiens
tctcattacaatctttgt

SEQ ID NO: 7804641 - DNA, 22 bp, Homo sapiens
tctcatttggctttgttttaaa

SEQ ID NO: 7804642 - DNA, 22 bp, Homo sapiens
tctcatttgcctcatctataaa

SEQ ID NO: 7804643 - DNA, 22 bp, Homo sapiens
tctccacaagctgatgctagga

SEQ ID NO: 7804644 - DNA, 22 bp, Homo sapiens
tctctttaagtataatcttata

SEQ ID NO: 7804645 - DNA, 23 bp, Homo sapiens
tctctggttaggggagattggtg

SEQ ID NO: 7804646 - DNA, 22 bp, Homo sapiens
tctctgggtttttgtcctgtac

SEQ ID NO: 7804647 - DNA, 22 bp, Homo sapiens
tctctgtctttgttgtcttcac

SEQ ID NO: 7804648 - DNA, 22 bp, Homo sapiens
tctcttcacatgcttgctccaa

SEQ ID NO: 7804649 - DNA, 22 bp, Homo sapiens
tctcttccttgacctattgtaa

SEQ ID NO: 7804650 - DNA, 22 bp, Homo sapiens
tctctggggatggacctgggag

SEQ ID NO: 7804651 - DNA, 22 bp, Homo sapiens
tctctgggctcaggagcccggc

SEQ ID NO: 7804652 - DNA, 19 bp, Homo sapiens
tctctggcttgtctgcctg

SEQ ID NO: 7804653 - DNA, 22 bp, Homo sapiens
tctctgggaaatggagaatttt

SEQ ID NO: 7804654 - DNA, 21 bp, Homo sapiens
tctctgggccctcctgtgggg

SEQ ID NO: 7804655 - DNA, 22 bp, Homo sapiens
tctctggcagacacctccctga

SEQ ID NO: 7804656 - DNA, 20 bp, Homo sapiens
tctctggccagaaacaacag

SEQ ID NO: 7804657 - DNA, 21 bp, Homo sapiens
tctctggaattagaccatgtt

SEQ ID NO: 7804658 - DNA, 22 bp, Homo sapiens
tcgtctgtgaaattgggataag

SEQ ID NO: 7804659 - DNA, 22 bp, Homo sapiens
tctaaagatgtttattgacata

SEQ ID NO: 7804660 - DNA, 22 bp, Homo sapiens
tctactgccacttaagacattt

SEQ ID NO: 7804661 - DNA, 22 bp, Homo sapiens
tctattttatactcaaatcttc

SEQ ID NO: 7804662 - DNA, 22 bp, Homo sapiens
tcctgggcaaagaggggcagtg

SEQ ID NO: 7804663 - DNA, 22 bp, Homo sapiens
tcctgggatgcataaaatatgt

SEQ ID NO: 7804664 - DNA, 22 bp, Homo sapiens
tcctgggtagagacctgatgaa

SEQ ID NO: 7804665 - DNA, 22 bp, Homo sapiens
tcctgggtggtggtaggagcag

SEQ ID NO: 7804666 - DNA, 22 bp, Homo sapiens
tcctgggtccatggcagccgaa

SEQ ID NO: 7804667 - DNA, 22 bp, Homo sapiens
tcctggctctctacaaaccaga

SEQ ID NO: 7804668 - DNA, 22 bp, Homo sapiens
tgcctcaggcacctggcaggtt

SEQ ID NO: 7804669 - DNA, 22 bp, Homo sapiens
tgccatttactgagattagaag

SEQ ID NO: 7804670 - DNA, 22 bp, Homo sapiens
tgccatttctcacatatgtatg

SEQ ID NO: 7804671 - DNA, 22 bp, Homo sapiens
tgccattttgagatgttaatga

SEQ ID NO: 7804672 - DNA, 22 bp, Homo sapiens
tgccatttttgagtggggcctc

SEQ ID NO: 7804673 - DNA, 22 bp, Homo sapiens
tgcatttaagaaaacatgagtc

SEQ ID NO: 7804674 - DNA, 22 bp, Homo sapiens
tgcatttagttttaataaagga

SEQ ID NO: 7804675 - DNA, 22 bp, Homo sapiens
tgcagttttatcacatatatag

SEQ ID NO: 7804676 - DNA, 22 bp, Homo sapiens
tgcagttttggccattgaaggc

SEQ ID NO: 7804677 - DNA, 22 bp, Homo sapiens
tgcatgtggacccctggtgcct

SEQ ID NO: 7804678 - DNA, 22 bp, Homo sapiens
tgcatctttttccaagtttatt

SEQ ID NO: 7804679 - DNA, 22 bp, Homo sapiens
tgcatgctctgtagaaagcagg

SEQ ID NO: 7804680 - DNA, 23 bp, Homo sapiens
tgcatgctaacacagtgcacagg

SEQ ID NO: 7804681 - DNA, 22 bp, Homo sapiens
tgagtgcctttgattgggcatg

SEQ ID NO: 7804682 - DNA, 22 bp, Homo sapiens
tgagtgcctaccaagtgctgga

SEQ ID NO: 7804683 - DNA, 22 bp, Homo sapiens
tgattaaattaattaagatgag

SEQ ID NO: 7804684 - DNA, 23 bp, Homo sapiens
tgattacaagggccaaagaaagg

SEQ ID NO: 7804685 - DNA, 22 bp, Homo sapiens
tgcaaatgggcatctccaagtg

SEQ ID NO: 7804686 - DNA, 22 bp, Homo sapiens
tgcaaatgcccatttattttct

SEQ ID NO: 7804687 - DNA, 22 bp, Homo sapiens
tgcaaatgagttgcagatcagg

SEQ ID NO: 7804688 - DNA, 22 bp, Homo sapiens
tgcaagggtgtttgagctgccc

SEQ ID NO: 7804689 - DNA, 22 bp, Homo sapiens
tgcaaggggtttatgcagatga

SEQ ID NO: 7804690 - DNA, 22 bp, Homo sapiens
tgcaagaggagactgtactcag

SEQ ID NO: 7804691 - DNA, 22 bp, Homo sapiens
tgcaagaggaattctagaagca

SEQ ID NO: 7804692 - DNA, 22 bp, Homo sapiens
tgcaagagctgtggcaaaagca

SEQ ID NO: 7804693 - DNA, 22 bp, Homo sapiens
tgcaagaggtaaaatgaaagga

SEQ ID NO: 7804694 - DNA, 22 bp, Homo sapiens
tgcaagagcccagggccaggaa

SEQ ID NO: 7804695 - DNA, 22 bp, Homo sapiens
tgcaagagcagaaagaactgag

SEQ ID NO: 7804696 - DNA, 22 bp, Homo sapiens
tgcaagagacagacatgactca

SEQ ID NO: 7804697 - DNA, 22 bp, Homo sapiens
tgcaatttcaaatatcagaaag

SEQ ID NO: 7804698 - DNA, 22 bp, Homo sapiens
tgcaatttgacgtcagcacagt

SEQ ID NO: 7804699 - DNA, 22 bp, Homo sapiens
tgcaatttggcttccattttct

SEQ ID NO: 7804700 - DNA, 22 bp, Homo sapiens
tgagtattttaagttctcaatc

SEQ ID NO: 7804701 - DNA, 19 bp, Homo sapiens
tgaggccaaggtcacagat

SEQ ID NO: 7804702 - DNA, 22 bp, Homo sapiens
tgaggccaagaaaagctgggtg

SEQ ID NO: 7804703 - DNA, 22 bp, Homo sapiens
tgaggccaagcctcctctgcca

SEQ ID NO: 7804704 - DNA, 22 bp, Homo sapiens
tgaggccaaaatgactcaaatg

SEQ ID NO: 7804705 - DNA, 22 bp, Homo sapiens
tgaggccaggacccccagcagg

SEQ ID NO: 7804706 - DNA, 18 bp, Homo sapiens
tgaggccagagtgggcat

SEQ ID NO: 7804707 - DNA, 22 bp, Homo sapiens
tgaggccacttccccacagccc

SEQ ID NO: 7804708 - DNA, 22 bp, Homo sapiens
tgaggccacagtatcagaacag

SEQ ID NO: 7804709 - DNA, 22 bp, Homo sapiens
tgaggccaatgaccctgggcag

SEQ ID NO: 7804710 - DNA, 22 bp, Homo sapiens
tgaggccaggatcccaggctct

SEQ ID NO: 7804711 - DNA, 22 bp, Homo sapiens
tgaggaagccaaacagctacac

SEQ ID NO: 7804712 - DNA, 22 bp, Homo sapiens
tgaggaagttgatctcatcagt

SEQ ID NO: 7804713 - DNA, 22 bp, Homo sapiens
tgagccttccttgtcatatcat

SEQ ID NO: 7804714 - DNA, 22 bp, Homo sapiens
tgagaatttgcatttctaacaa

SEQ ID NO: 7804715 - DNA, 22 bp, Homo sapiens
tgagaattttttgtcatgcatt

SEQ ID NO: 7804716 - DNA, 22 bp, Homo sapiens
tgagaaatggcagcattactgg

SEQ ID NO: 7804717 - DNA, 22 bp, Homo sapiens
tgagatgtaaggtatgcttact

SEQ ID NO: 7804718 - DNA, 21 bp, Homo sapiens
tgaatttccctctatcattct

SEQ ID NO: 7804719 - DNA, 20 bp, Homo sapiens
tgaattctgggtttatctgc

SEQ ID NO: 7804720 - DNA, 22 bp, Homo sapiens
tgaaggctgggctcagccagct

SEQ ID NO: 7804721 - DNA, 22 bp, Homo sapiens
tgaaggcctccccgagcattag

SEQ ID NO: 7804722 - DNA, 22 bp, Homo sapiens
tgaaggctttttaaagcatttg

SEQ ID NO: 7804723 - DNA, 22 bp, Homo sapiens
tgaagccattactgtgttaggg

SEQ ID NO: 7804724 - DNA, 22 bp, Homo sapiens
tgaaggaggaatgtggcctcca

SEQ ID NO: 7804725 - DNA, 22 bp, Homo sapiens
tgacctctgtcctgcagtctgg

SEQ ID NO: 7804726 - DNA, 22 bp, Homo sapiens
tcttttctccagacctgggatc

SEQ ID NO: 7804727 - DNA, 22 bp, Homo sapiens
tctttggattaaaatatttgta

SEQ ID NO: 7804728 - DNA, 22 bp, Homo sapiens
tctttggatatcgctagaccgt

SEQ ID NO: 7804729 - DNA, 22 bp, Homo sapiens
tctttggagtgttatcagtaat

SEQ ID NO: 7804730 - DNA, 22 bp, Homo sapiens
tctttggactttccaatttgtt

SEQ ID NO: 7804731 - DNA, 22 bp, Homo sapiens
tctttggaatgctagcattcta

SEQ ID NO: 7804732 - DNA, 22 bp, Homo sapiens
tctttggaattctctgcagccc

SEQ ID NO: 7804733 - DNA, 22 bp, Homo sapiens
tctttggaaggagcagtttttg

SEQ ID NO: 7804734 - DNA, 22 bp, Homo sapiens
tgaaacatttgatgatctttgg

SEQ ID NO: 7804735 - DNA, 22 bp, Homo sapiens
tgaaacattgcactgtatgaat

SEQ ID NO: 7804736 - DNA, 22 bp, Homo sapiens
tgaaacattatagaatatttat

SEQ ID NO: 7804737 - DNA, 22 bp, Homo sapiens
tgaaacataaagttatcttcag

SEQ ID NO: 7804738 - DNA, 22 bp, Homo sapiens
tctttttttcctgtgcagagct

SEQ ID NO: 7804739 - DNA, 22 bp, Homo sapiens
tgaaaaaacaagttggcccatt

SEQ ID NO: 7804740 - DNA, 22 bp, Homo sapiens
tgaaaatttccatcagttatat

SEQ ID NO: 7804741 - DNA, 23 bp, Homo sapiens
tgaaatattcttttgcatgagct

SEQ ID NO: 7804742 - DNA, 22 bp, Homo sapiens
tgaaatatgctcccattcactt

SEQ ID NO: 7804743 - DNA, 22 bp, Homo sapiens
tgaaatcagtatgtctttctca

SEQ ID NO: 7804744 - DNA, 22 bp, Homo sapiens
tgaaatatccagcccagcagga

SEQ ID NO: 7804745 - DNA, 22 bp, Homo sapiens
tgaaatatcattttcatctccc

SEQ ID NO: 7804746 - DNA, 22 bp, Homo sapiens
tgaagaaacgcagagaggtagg

SEQ ID NO: 7804747 - DNA, 22 bp, Homo sapiens
tggctattgagtgatctctaga

SEQ ID NO: 7804748 - DNA, 22 bp, Homo sapiens
tggctgaaagcctggcctgcca

SEQ ID NO: 7804749 - DNA, 22 bp, Homo sapiens
tggctgagtttcatgcatcatg

SEQ ID NO: 7804750 - DNA, 21 bp, Homo sapiens
tggctgagtggatgcatgaat

SEQ ID NO: 7804751 - DNA, 22 bp, Homo sapiens
tggctggggccacagttttcct

SEQ ID NO: 7804752 - DNA, 22 bp, Homo sapiens
tggcaggggaggtgcttgctta

SEQ ID NO: 7804753 - DNA, 22 bp, Homo sapiens
tggcagggtcttgctgtgttgc

SEQ ID NO: 7804754 - DNA, 22 bp, Homo sapiens
tggcatgtggcagctggttcag

SEQ ID NO: 7804755 - DNA, 22 bp, Homo sapiens
tggcatttagagaaatgaagga

SEQ ID NO: 7804756 - DNA, 18 bp, Homo sapiens
tggaggaaaaatctcatg

SEQ ID NO: 7804757 - DNA, 22 bp, Homo sapiens
tggagtccccgagaggcctgca

SEQ ID NO: 7804758 - DNA, 22 bp, Homo sapiens
tggaggtggcatctgacagctg

SEQ ID NO: 7804759 - DNA, 22 bp, Homo sapiens
tgcttctttactataggcaatt

SEQ ID NO: 7804760 - DNA, 22 bp, Homo sapiens
tgctttgcaaataatagaatgt

SEQ ID NO: 7804761 - DNA, 22 bp, Homo sapiens
tgctttgcactgactccttcct

SEQ ID NO: 7804762 - DNA, 21 bp, Homo sapiens
tgctttatgggaaaaatgtca

SEQ ID NO: 7804763 - DNA, 22 bp, Homo sapiens
tggaaagagatgttgtttctga

SEQ ID NO: 7804764 - DNA, 22 bp, Homo sapiens
tggacaggatctgagactgaga

SEQ ID NO: 7804765 - DNA, 22 bp, Homo sapiens
tggactctgaactggcactgac

SEQ ID NO: 7804766 - DNA, 22 bp, Homo sapiens
tggactcttggaccttctctaa

SEQ ID NO: 7804767 - DNA, 22 bp, Homo sapiens
tggaagagcaggcagacaatgc

SEQ ID NO: 7804768 - DNA, 22 bp, Homo sapiens
tggaagagaaaggagtggatct

SEQ ID NO: 7804769 - DNA, 22 bp, Homo sapiens
tggaagatcaaccaggattgac

SEQ ID NO: 7804770 - DNA, 22 bp, Homo sapiens
tggaagcactactttaatgcat

SEQ ID NO: 7804771 - DNA, 22 bp, Homo sapiens
tgctgaggaaagaggataaaag

SEQ ID NO: 7804772 - DNA, 22 bp, Homo sapiens
tgctcagtagcagtgtgctgct

SEQ ID NO: 7804773 - DNA, 22 bp, Homo sapiens
tgctatttctatctcatttaaa

SEQ ID NO: 7804774 - DNA, 22 bp, Homo sapiens
tgctatttaacttttatgtgta

SEQ ID NO: 7804775 - DNA, 22 bp, Homo sapiens
tgcctgtggaaaggctggtgct

SEQ ID NO: 7804776 - DNA, 23 bp, Homo sapiens
tgctggagtttactcaggccagc

SEQ ID NO: 7804777 - DNA, 23 bp, Homo sapiens
tgctggctgtgttattgccaaca

SEQ ID NO: 7804778 - DNA, 22 bp, Homo sapiens
tgctggctatttaaagaagaaa

SEQ ID NO: 7804779 - DNA, 22 bp, Homo sapiens
tgcttaaagtagtggattgtta

SEQ ID NO: 7804780 - DNA, 22 bp, Homo sapiens
tgcttaaacatccagacagtat

SEQ ID NO: 7804781 - DNA, 22 bp, Homo sapiens
tgcttaaaccctgatcatgtgt

SEQ ID NO: 7804782 - DNA, 22 bp, Homo sapiens
tgcttaaacacatacatacata

SEQ ID NO: 7804783 - DNA, 22 bp, Homo sapiens
tgcttaaacatactatttatat

SEQ ID NO: 7804784 - DNA, 22 bp, Homo sapiens
tgcttaataggagttgaacatt

SEQ ID NO: 7804785 - DNA, 22 bp, Homo sapiens
tgcttaatcaagaagcctattt

SEQ ID NO: 7804786 - DNA, 22 bp, Homo sapiens
tgcttataatgttactgacaac

SEQ ID NO: 7804787 - DNA, 22 bp, Homo sapiens
tgcttaaaatgatgattatttt

SEQ ID NO: 7804788 - DNA, 22 bp, Homo sapiens
tgcttaaaatagttcatttttg

SEQ ID NO: 7804789 - DNA, 22 bp, Homo sapiens
tgcttaaaaacagtatggtagt

SEQ ID NO: 7804790 - DNA, 22 bp, Homo sapiens
tgcttatttaggtagatattaa

SEQ ID NO: 7804791 - DNA, 22 bp, Homo sapiens
tgcttattctttccacaattca

SEQ ID NO: 7804792 - DNA, 22 bp, Homo sapiens
tgtcatatgttgatgaaagaga

SEQ ID NO: 7804793 - DNA, 22 bp, Homo sapiens
tgtcctgggtcaaccaggtcga

SEQ ID NO: 7804794 - DNA, 22 bp, Homo sapiens
tgtatgcaccattgtattacct

SEQ ID NO: 7804795 - DNA, 17 bp, Homo sapiens
tgtatgcatatgctttt

SEQ ID NO: 7804796 - DNA, 22 bp, Homo sapiens
tgtatgcataaaattatttaca

SEQ ID NO: 7804797 - DNA, 22 bp, Homo sapiens
tgtattttctgaagataatcaa

SEQ ID NO: 7804798 - DNA, 22 bp, Homo sapiens
tgtattttgagtccaatctcct

SEQ ID NO: 7804799 - DNA, 22 bp, Homo sapiens
tgtattttgtgaggatcactct

SEQ ID NO: 7804800 - DNA, 22 bp, Homo sapiens
tgtaattttctcaagtttctac

SEQ ID NO: 7804801 - DNA, 22 bp, Homo sapiens
tgtaaattgaaggaaatttgtg

SEQ ID NO: 7804802 - DNA, 23 bp, Homo sapiens
tgtaaattttgtagtcacatttt

SEQ ID NO: 7804803 - DNA, 22 bp, Homo sapiens
tggtaaagtgtactgaatatga

SEQ ID NO: 7804804 - DNA, 22 bp, Homo sapiens
tgggtgccaacctctggtggcc

SEQ ID NO: 7804805 - DNA, 20 bp, Homo sapiens
tgggtgcctgccacggggcc

SEQ ID NO: 7804806 - DNA, 22 bp, Homo sapiens
tgggggtgccctatgaggaagc

SEQ ID NO: 7804807 - DNA, 20 bp, Homo sapiens
tgggctctgcttcctggagt

SEQ ID NO: 7804808 - DNA, 22 bp, Homo sapiens
tgggcagggtctctgttatcag

SEQ ID NO: 7804809 - DNA, 22 bp, Homo sapiens
tgggcaggggccctgcttccgt

SEQ ID NO: 7804810 - DNA, 22 bp, Homo sapiens
tgggcagggatctcttttgcaa

SEQ ID NO: 7804811 - DNA, 22 bp, Homo sapiens
tgggcagggagctggaaccaca

SEQ ID NO: 7804812 - DNA, 22 bp, Homo sapiens
tgggaggccgaggcaggtggat

SEQ ID NO: 7804813 - DNA, 22 bp, Homo sapiens
tgggaggcccaggcctggcagg

SEQ ID NO: 7804814 - DNA, 22 bp, Homo sapiens
tgtctttaaaattaaacacatc

SEQ ID NO: 7804815 - DNA, 22 bp, Homo sapiens
tgtctggctcattttctgcagt

SEQ ID NO: 7804816 - DNA, 22 bp, Homo sapiens
tgtgattactgaatagaaaata

SEQ ID NO: 7804817 - DNA, 22 bp, Homo sapiens
tgtgctcttgtctgtgactaac

SEQ ID NO: 7804818 - DNA, 22 bp, Homo sapiens
tgtgctctgaagagtgcatgtc

SEQ ID NO: 7804819 - DNA, 18 bp, Homo sapiens
tgtgcaatattaaccacc

SEQ ID NO: 7804820 - DNA, 22 bp, Homo sapiens
ttaaaatttccccaccatgtat

SEQ ID NO: 7804821 - DNA, 22 bp, Homo sapiens
tgtgtattaccattttacagct

SEQ ID NO: 7804822 - DNA, 22 bp, Homo sapiens
ttcattcaggtgtatttatggg

SEQ ID NO: 7804823 - DNA, 22 bp, Homo sapiens
ttcattcttttacatgtgaata

SEQ ID NO: 7804824 - DNA, 22 bp, Homo sapiens
ttcattctttgaatctgaggta

SEQ ID NO: 7804825 - DNA, 19 bp, Homo sapiens
ttcattctttctacttacc

SEQ ID NO: 7804826 - DNA, 22 bp, Homo sapiens
ttcattcttgtctttgtatagt

SEQ ID NO: 7804827 - DNA, 22 bp, Homo sapiens
ttatttctactattttgcctga

SEQ ID NO: 7804828 - DNA, 22 bp, Homo sapiens
ttatttcttgtctatgtagcca

SEQ ID NO: 7804829 - DNA, 22 bp, Homo sapiens
ttacatttcccccttggaggct

SEQ ID NO: 7804830 - DNA, 22 bp, Homo sapiens
ttacattttagttaacctgtga

SEQ ID NO: 7804831 - DNA, 22 bp, Homo sapiens
ttacatttggctatgtcctcta

SEQ ID NO: 7804832 - DNA, 22 bp, Homo sapiens
ttacacaaaaataagatatggc

SEQ ID NO: 7804833 - DNA, 22 bp, Homo sapiens
ttacaattgagtctattgtatg

SEQ ID NO: 7804834 - DNA, 22 bp, Homo sapiens
ttaattaattagttaagcatgt

SEQ ID NO: 7804835 - DNA, 22 bp, Homo sapiens
ttaattaagagatactgcagta

SEQ ID NO: 7804836 - DNA, 21 bp, Homo sapiens
ttacaaagctacagatgttgc

SEQ ID NO: 7804837 - DNA, 22 bp, Homo sapiens
ttacaacttgcagaggatgttg

SEQ ID NO: 7804838 - DNA, 22 bp, Homo sapiens
ttacaacagacacatattctaa

SEQ ID NO: 7804839 - DNA, 22 bp, Homo sapiens
ttaataaagtatgaattggaaa

SEQ ID NO: 7804840 - DNA, 22 bp, Homo sapiens
ttagatttacaagcactgttta

SEQ ID NO: 7804841 - DNA, 22 bp, Homo sapiens
ttagcaggaagagttggctgga

SEQ ID NO: 7804842 - DNA, 22 bp, Homo sapiens
ttagaacatagcaacagaatta

SEQ ID NO: 7804843 - DNA, 22 bp, Homo sapiens
ttacattttgcacagatgtccc

SEQ ID NO: 7804844 - DNA, 22 bp, Homo sapiens
acaggtagatacatacttctaa

SEQ ID NO: 7804845 - DNA, 22 bp, Homo sapiens
acaggtaggttaaaatgtgtca

SEQ ID NO: 7804846 - DNA, 22 bp, Homo sapiens
acattctgtatcatctgtctca

SEQ ID NO: 7804847 - DNA, 22 bp, Homo sapiens
aaggtttccagtgatattgtgg

SEQ ID NO: 7804848 - DNA, 22 bp, Homo sapiens
aatatgcatgtatacatgtgta

SEQ ID NO: 7804849 - DNA, 21 bp, Homo sapiens
agaaaatggcgttttagattt

SEQ ID NO: 7804850 - DNA, 22 bp, Homo sapiens
actgagaagctcgcagtgatgc

SEQ ID NO: 7804851 - DNA, 21 bp, Homo sapiens
aagttttatgttgccatttgt

SEQ ID NO: 7804852 - DNA, 22 bp, Homo sapiens
aagttttaacaagtacttacta

SEQ ID NO: 7804853 - DNA, 19 bp, Homo sapiens
accttctgggaaacattcc

SEQ ID NO: 7804854 - DNA, 22 bp, Homo sapiens
agccttagaggaaaacattagt

SEQ ID NO: 7804855 - DNA, 22 bp, Homo sapiens
agcaggtgaattcctggatgtg

SEQ ID NO: 7804856 - DNA, 22 bp, Homo sapiens
agaatcagtgctggctattagc

SEQ ID NO: 7804857 - DNA, 22 bp, Homo sapiens
aatgctgtatatcttagctaat

SEQ ID NO: 7804858 - DNA, 19 bp, Homo sapiens
aatggacaggcaatagtct

SEQ ID NO: 7804859 - DNA, 20 bp, Homo sapiens
agaatctgacccagagagac

SEQ ID NO: 7804860 - DNA, 22 bp, Homo sapiens
agaatctgaaggcacctctggt

SEQ ID NO: 7804861 - DNA, 22 bp, Homo sapiens
agaatctggtagaaccaaggat

SEQ ID NO: 7804862 - DNA, 23 bp, Homo sapiens
agaatttcaaagtccagcacatt

SEQ ID NO: 7804863 - DNA, 22 bp, Homo sapiens
agaatttcaaaaggaagccagc

SEQ ID NO: 7804864 - DNA, 22 bp, Homo sapiens
aatgtataaagtgttaataact

SEQ ID NO: 7804865 - DNA, 22 bp, Homo sapiens
agagatcaaagcttgccaagta

SEQ ID NO: 7804866 - DNA, 22 bp, Homo sapiens
acaaaaaccgtggattcagcat

SEQ ID NO: 7804867 - DNA, 22 bp, Homo sapiens
agaggccaagccagactgtgca

SEQ ID NO: 7804868 - DNA, 21 bp, Homo sapiens
aattttgaaggaagattaagg

SEQ ID NO: 7804869 - DNA, 22 bp, Homo sapiens
aagcaaattggatgtctgtgag

SEQ ID NO: 7804870 - DNA, 22 bp, Homo sapiens
aagaatgagctcaaagatctta

SEQ ID NO: 7804871 - DNA, 22 bp, Homo sapiens
aagaatgttcttgtagtcatga

SEQ ID NO: 7804872 - DNA, 20 bp, Homo sapiens
aagagctacttagcctttcc

SEQ ID NO: 7804873 - DNA, 22 bp, Homo sapiens
aacacaaagaagctgcaggatc

SEQ ID NO: 7804874 - DNA, 22 bp, Homo sapiens
aacaaatgtgttttgtaattaa

SEQ ID NO: 7804875 - DNA, 22 bp, Homo sapiens
aacagtcttggaagtcttgtta

SEQ ID NO: 7804876 - DNA, 22 bp, Homo sapiens
aacagtctgggagttccttata

SEQ ID NO: 7804877 - DNA, 22 bp, Homo sapiens
aacagtctactgaatatctgcg

SEQ ID NO: 7804878 - DNA, 22 bp, Homo sapiens
aacatttcattggaagctatgt

SEQ ID NO: 7804879 - DNA, 22 bp, Homo sapiens
aacatttcataacttgactttt

SEQ ID NO: 7804880 - DNA, 22 bp, Homo sapiens
aacatttctgagaatatcagtt

SEQ ID NO: 7804881 - DNA, 22 bp, Homo sapiens
aacatgcaatgtctgaaaatcc

SEQ ID NO: 7804882 - DNA, 22 bp, Homo sapiens
aacatttcttctgaaactgagt

SEQ ID NO: 7804883 - DNA, 22 bp, Homo sapiens
aactatgttaataagtttcatt

SEQ ID NO: 7804884 - DNA, 23 bp, Homo sapiens
aactgagataatgtatgtaaagc

SEQ ID NO: 7804885 - DNA, 22 bp, Homo sapiens
aactcagatatgatagcaggag

SEQ ID NO: 7804886 - DNA, 22 bp, Homo sapiens
aaacaactcggcaactgctttt

SEQ ID NO: 7804887 - DNA, 22 bp, Homo sapiens
aaacaagagcttacatggctgc

SEQ ID NO: 7804888 - DNA, 22 bp, Homo sapiens
aaaaatgcttggacttaataaa

SEQ ID NO: 7804889 - DNA, 22 bp, Homo sapiens
aaaaatgtcattatggaactga

SEQ ID NO: 7804890 - DNA, 22 bp, Homo sapiens
aaaagtattttggatctcagat

SEQ ID NO: 7804891 - DNA, 22 bp, Homo sapiens
aaaagtattttgagcactttat

SEQ ID NO: 7804892 - DNA, 22 bp, Homo sapiens
aaagagctttagaaatctcaga

SEQ ID NO: 7804893 - DNA, 22 bp, Homo sapiens
aaagaagatggagacctgacta

SEQ ID NO: 7804894 - DNA, 20 bp, Homo sapiens
aaatgctgagaagtccttaa

SEQ ID NO: 7804895 - DNA, 18 bp, Homo sapiens
aaatgctaggctacatga

SEQ ID NO: 7804896 - DNA, 22 bp, Homo sapiens
aaatcagttctccctttcttca

SEQ ID NO: 7804897 - DNA, 22 bp, Homo sapiens
aaaggcatggatagtgaattca

SEQ ID NO: 7804898 - DNA, 22 bp, Homo sapiens
aaagcaatgcccgttcattatc

SEQ ID NO: 7804899 - DNA, 22 bp, Homo sapiens
aaagatgtcagtttgaaataac

SEQ ID NO: 7804900 - DNA, 17 bp, Homo sapiens
aagacaagacaaatgca

SEQ ID NO: 7804901 - DNA, 22 bp, Homo sapiens
aagacaagccttgtttttctgc

SEQ ID NO: 7804902 - DNA, 22 bp, Homo sapiens
acaacaaaatcactagtcttcc

SEQ ID NO: 7804903 - DNA, 22 bp, Homo sapiens
aagacaatcctggacagtcagc

SEQ ID NO: 7804904 - DNA, 22 bp, Homo sapiens
aagacaatgcattactaagaag

SEQ ID NO: 7804905 - DNA, 22 bp, Homo sapiens
acaagaaaggtaggattcaggt

SEQ ID NO: 7804906 - DNA, 22 bp, Homo sapiens
aatgtctttaaagtgcaataga

SEQ ID NO: 7804907 - DNA, 22 bp, Homo sapiens
aatgtcaacacaagagaaatgc

SEQ ID NO: 7804908 - DNA, 22 bp, Homo sapiens
aatgtattctgggaaaatgtta

SEQ ID NO: 7804909 - DNA, 22 bp, Homo sapiens
aatgttattacacttgtgaaat

SEQ ID NO: 7804910 - DNA, 22 bp, Homo sapiens
aactttctagagatgagttcgg

SEQ ID NO: 7804911 - DNA, 19 bp, Homo sapiens
aagatttggtcattgataa

SEQ ID NO: 7804912 - DNA, 22 bp, Homo sapiens
aagagtggagctggaaagtggg

SEQ ID NO: 7804913 - DNA, 22 bp, Homo sapiens
aagagtttaattttgtctagac

SEQ ID NO: 7804914 - DNA, 22 bp, Homo sapiens
aagagtaaattcaggactttaa

SEQ ID NO: 7804915 - DNA, 22 bp, Homo sapiens
acactagagagcaggcattccc

SEQ ID NO: 7804916 - DNA, 22 bp, Homo sapiens
aagacatttatttgaatcaatt

SEQ ID NO: 7804917 - DNA, 22 bp, Homo sapiens
aactcatttgcatttttcctgt

SEQ ID NO: 7804918 - DNA, 22 bp, Homo sapiens
aacattgccatggttaatttta

SEQ ID NO: 7804919 - DNA, 22 bp, Homo sapiens
aacattctttagctcttcctgc

SEQ ID NO: 7804920 - DNA, 22 bp, Homo sapiens
aacatttcagcacctgattcct

SEQ ID NO: 7804921 - DNA, 21 bp, Homo sapiens
aagtcaatacagataagtctt

SEQ ID NO: 7804922 - DNA, 22 bp, Homo sapiens
aagtcaagtgttattattgtag

SEQ ID NO: 7804923 - DNA, 22 bp, Homo sapiens
aacagtttgcctgaaatgtatt

SEQ ID NO: 7804924 - DNA, 22 bp, Homo sapiens
aacaatcaagtttctaaatgac

SEQ ID NO: 7804925 - DNA, 22 bp, Homo sapiens
aacaaatgtaaaatgcagatgc

SEQ ID NO: 7804926 - DNA, 22 bp, Homo sapiens
aaatttcaagcaaagtagctat

SEQ ID NO: 7804927 - DNA, 22 bp, Homo sapiens
aacaagcagatgcaatgcactt

SEQ ID NO: 7804928 - DNA, 22 bp, Homo sapiens
aagctgtagaggcagtacattt

SEQ ID NO: 7804929 - DNA, 22 bp, Homo sapiens
aaggagaaggcatcattcaagt

SEQ ID NO: 7804930 - DNA, 22 bp, Homo sapiens
aaggactgaataattctctttc

SEQ ID NO: 7804931 - DNA, 22 bp, Homo sapiens
aaattataggtgccaccttgga

SEQ ID NO: 7804932 - DNA, 22 bp, Homo sapiens
aaatgttttgctcccatgtggt

SEQ ID NO: 7804933 - DNA, 22 bp, Homo sapiens
attggtagttttgtatttctct

SEQ ID NO: 7804934 - DNA, 22 bp, Homo sapiens
caaacattttgagtggtttctg

SEQ ID NO: 7804935 - DNA, 22 bp, Homo sapiens
caaagcaagggctgaagactcc

SEQ ID NO: 7804936 - DNA, 22 bp, Homo sapiens
caaagcaaggctcagtttgaac

SEQ ID NO: 7804937 - DNA, 22 bp, Homo sapiens
agcaacaggcataatgtgttga

SEQ ID NO: 7804938 - DNA, 22 bp, Homo sapiens
agcaacagccctgtttcattag

SEQ ID NO: 7804939 - DNA, 22 bp, Homo sapiens
agcaaatgggtttatatttgac

SEQ ID NO: 7804940 - DNA, 22 bp, Homo sapiens
attttaaccctcttatatatac

SEQ ID NO: 7804941 - DNA, 23 bp, Homo sapiens
agaggccagcctttggagacacc

SEQ ID NO: 7804942 - DNA, 22 bp, Homo sapiens
agaggccagcagtgcctatctg

SEQ ID NO: 7804943 - DNA, 22 bp, Homo sapiens
agaggccagaaagtatgccacc

SEQ ID NO: 7804944 - DNA, 22 bp, Homo sapiens
agaggccaccagaggtggtgcc

SEQ ID NO: 7804945 - DNA, 22 bp, Homo sapiens
agaggccaccactgtcagggac

SEQ ID NO: 7804946 - DNA, 22 bp, Homo sapiens
agaggggagtcctaatctgatt

SEQ ID NO: 7804947 - DNA, 23 bp, Homo sapiens
agaggggagcatctgctggctga

SEQ ID NO: 7804948 - DNA, 22 bp, Homo sapiens
agagtgctagcctgagggaggt

SEQ ID NO: 7804949 - DNA, 19 bp, Homo sapiens
agagtattgaatttgccct

SEQ ID NO: 7804950 - DNA, 22 bp, Homo sapiens
agagtattttgattatcctgga

SEQ ID NO: 7804951 - DNA, 22 bp, Homo sapiens
agaggtggagctcttggcatca

SEQ ID NO: 7804952 - DNA, 22 bp, Homo sapiens
atgatagctaccgtttatgctg

SEQ ID NO: 7804953 - DNA, 21 bp, Homo sapiens
atgccaagtcttaatgagggc

SEQ ID NO: 7804954 - DNA, 22 bp, Homo sapiens
agactgtaattgacatgtcagc

SEQ ID NO: 7804955 - DNA, 22 bp, Homo sapiens
atgaagcttgaggtgagagctg

SEQ ID NO: 7804956 - DNA, 22 bp, Homo sapiens
agagattgctagctggctttaa

SEQ ID NO: 7804957 - DNA, 22 bp, Homo sapiens
agagaaggtcactaaggaccca

SEQ ID NO: 7804958 - DNA, 22 bp, Homo sapiens
agacttaggtgagatgtttgta

SEQ ID NO: 7804959 - DNA, 22 bp, Homo sapiens
agcaggtgtcggcgagggtctt

SEQ ID NO: 7804960 - DNA, 22 bp, Homo sapiens
agcaggtgttggctgggccatc

SEQ ID NO: 7804961 - DNA, 22 bp, Homo sapiens
agcagggaggcccagggcactg

SEQ ID NO: 7804962 - DNA, 18 bp, Homo sapiens
cagagctcctggatgcag

SEQ ID NO: 7804963 - DNA, 22 bp, Homo sapiens
cagagaaagggtgaattccttc

SEQ ID NO: 7804964 - DNA, 22 bp, Homo sapiens
agccagttctctagtgatattt

SEQ ID NO: 7804965 - DNA, 22 bp, Homo sapiens
cagcaaatactactagttttta

SEQ ID NO: 7804966 - DNA, 22 bp, Homo sapiens
agctaagagtggaagctcatct

SEQ ID NO: 7804967 - DNA, 22 bp, Homo sapiens
agctaatggaacagagatgtca

SEQ ID NO: 7804968 - DNA, 22 bp, Homo sapiens
agctaagtggaaaatgcagtta

SEQ ID NO: 7804969 - DNA, 22 bp, Homo sapiens
agctaatgaacttagacctgac

SEQ ID NO: 7804970 - DNA, 22 bp, Homo sapiens
agctaggaaattgaggctgaga

SEQ ID NO: 7804971 - DNA, 20 bp, Homo sapiens
acatgaaaggaaacaggaaa

SEQ ID NO: 7804972 - DNA, 22 bp, Homo sapiens
agctgcaggattatggaatgga

SEQ ID NO: 7804973 - DNA, 22 bp, Homo sapiens
ataatttttgtttgatgtccaa

SEQ ID NO: 7804974 - DNA, 22 bp, Homo sapiens
atacaaaaattagccgggagta

SEQ ID NO: 7804975 - DNA, 22 bp, Homo sapiens
atacaaaatatatactggagac

SEQ ID NO: 7804976 - DNA, 22 bp, Homo sapiens
atacatcacctatatattcaca

SEQ ID NO: 7804977 - DNA, 22 bp, Homo sapiens
acttccttgtcaggtgcatcat

SEQ ID NO: 7804978 - DNA, 22 bp, Homo sapiens
acttccttgtactgactccatt

SEQ ID NO: 7804979 - DNA, 22 bp, Homo sapiens
agaagccaagaacagacagtgc

SEQ ID NO: 7804980 - DNA, 22 bp, Homo sapiens
agaagccacaggaaagcagctt

SEQ ID NO: 7804981 - DNA, 22 bp, Homo sapiens
agaaatctgactgctgtgcaca

SEQ ID NO: 7804982 - DNA, 22 bp, Homo sapiens
acttttcttatcagaaaggcca

SEQ ID NO: 7804983 - DNA, 21 bp, Homo sapiens
agaaaaacacgatataagccc

SEQ ID NO: 7804984 - DNA, 22 bp, Homo sapiens
agaaatcaggaacagtaaggag

SEQ ID NO: 7804985 - DNA, 22 bp, Homo sapiens
agttaactcattttataatgcc

SEQ ID NO: 7804986 - DNA, 22 bp, Homo sapiens
agtggcagtggggcagggccct

SEQ ID NO: 7804987 - DNA, 22 bp, Homo sapiens
agtctttatttagagttaggac

SEQ ID NO: 7804988 - DNA, 22 bp, Homo sapiens
agtctacaatcttaaatgaact

SEQ ID NO: 7804989 - DNA, 22 bp, Homo sapiens
aggtattgaccacctccttgat

SEQ ID NO: 7804990 - DNA, 22 bp, Homo sapiens
ctagaattgcattctatgaata

SEQ ID NO: 7804991 - DNA, 22 bp, Homo sapiens
atctgtggatatgaccttcctg

SEQ ID NO: 7804992 - DNA, 22 bp, Homo sapiens
atctggtgacacgaggagctgg

SEQ ID NO: 7804993 - DNA, 22 bp, Homo sapiens
atctggtgctaacaaatgtgga

SEQ ID NO: 7804994 - DNA, 22 bp, Homo sapiens
atcatacatgtaactaagtaaa

SEQ ID NO: 7804995 - DNA, 22 bp, Homo sapiens
cttaatgaatgctgctgtattt

SEQ ID NO: 7804996 - DNA, 22 bp, Homo sapiens
cttagattttcaatgtgaacta

SEQ ID NO: 7804997 - DNA, 22 bp, Homo sapiens
cttcaatttttggtatgatgga

SEQ ID NO: 7804998 - DNA, 20 bp, Homo sapiens
ctgggtggcaagcaaggggg

SEQ ID NO: 7804999 - DNA, 22 bp, Homo sapiens
ctggtccctgagtagttatgca

SEQ ID NO: 7805000 - DNA, 22 bp, Homo sapiens
ctggtccccagactgggcttag

SEQ ID NO: 7805001 - DNA, 22 bp, Homo sapiens
ctggtccctgcagtgtgctggg

SEQ ID NO: 7805002 - DNA, 17 bp, Homo sapiens
ctggtcccaccaagccc

SEQ ID NO: 7805003 - DNA, 22 bp, Homo sapiens
ctggtcccagcagagctctgag

SEQ ID NO: 7805004 - DNA, 22 bp, Homo sapiens
ctggtcccatcctggcttcatg

SEQ ID NO: 7805005 - DNA, 22 bp, Homo sapiens
ctggtcccagctctgccaccaa

SEQ ID NO: 7805006 - DNA, 22 bp, Homo sapiens
ctgggtggctgtccagccagcc

SEQ ID NO: 7805007 - DNA, 20 bp, Homo sapiens
ctgggaggtcttccaaatca

SEQ ID NO: 7805008 - DNA, 22 bp, Homo sapiens
ctgggaggggtagccaatccta

SEQ ID NO: 7805009 - DNA, 22 bp, Homo sapiens
atcacacagagcattaggggcc

SEQ ID NO: 7805010 - DNA, 22 bp, Homo sapiens
ctgtctcagcaggaagtcatca

SEQ ID NO: 7805011 - DNA, 22 bp, Homo sapiens
ataaaagaagttttggtacttg

SEQ ID NO: 7805012 - DNA, 17 bp, Homo sapiens
agttttgatataatggc

SEQ ID NO: 7805013 - DNA, 22 bp, Homo sapiens
ataaaaactgacccatcctttg

SEQ ID NO: 7805014 - DNA, 22 bp, Homo sapiens
atacatgtcatcatatgtttgt

SEQ ID NO: 7805015 - DNA, 22 bp, Homo sapiens
atacatgtgtccctgatttatt

SEQ ID NO: 7805016 - DNA, 22 bp, Homo sapiens
ctggcctcatagccaagctgtg

SEQ ID NO: 7805017 - DNA, 23 bp, Homo sapiens
ctggcctccgacactggccaaga

SEQ ID NO: 7805018 - DNA, 22 bp, Homo sapiens
ctggcctctgtgttcaccatag

SEQ ID NO: 7805019 - DNA, 22 bp, Homo sapiens
agggctggagccacagctggga

SEQ ID NO: 7805020 - DNA, 22 bp, Homo sapiens
ccatttaacacagagttttcca

SEQ ID NO: 7805021 - DNA, 22 bp, Homo sapiens
ccagaacacagtggaagaatat

SEQ ID NO: 7805022 - DNA, 22 bp, Homo sapiens
aggaagaggtgtgcaatggtgt

SEQ ID NO: 7805023 - DNA, 22 bp, Homo sapiens
cagggacatgactggtctctgt

SEQ ID NO: 7805024 - DNA, 22 bp, Homo sapiens
agctttctggttacagtcttca

SEQ ID NO: 7805025 - DNA, 22 bp, Homo sapiens
agctttctagactctgtggtca

SEQ ID NO: 7805026 - DNA, 21 bp, Homo sapiens
agctgaaaagttgtttacaag

SEQ ID NO: 7805027 - DNA, 22 bp, Homo sapiens
ccaaaataacagcccaattcac

SEQ ID NO: 7805028 - DNA, 22 bp, Homo sapiens
ccaaaatattagtgcttaagta

SEQ ID NO: 7805029 - DNA, 22 bp, Homo sapiens
ccaaacaaatccccattcttag

SEQ ID NO: 7805030 - DNA, 21 bp, Homo sapiens
ccaaagaactgccatttgtca

SEQ ID NO: 7805031 - DNA, 22 bp, Homo sapiens
aggaattcaagaccagctgggc

SEQ ID NO: 7805032 - DNA, 22 bp, Homo sapiens
atttaaatgcttaagagggttt

SEQ ID NO: 7805033 - DNA, 22 bp, Homo sapiens
gcaggtggatcacctgaggtca

SEQ ID NO: 7805034 - DNA, 22 bp, Homo sapiens
gcagggtgaaggtcacatagaa

SEQ ID NO: 7805035 - DNA, 22 bp, Homo sapiens
gcagggaggaagagatgcttcc

SEQ ID NO: 7805036 - DNA, 22 bp, Homo sapiens
gcacagggagacagccgtggcc

SEQ ID NO: 7805037 - DNA, 22 bp, Homo sapiens
gcacagggagcaggtctctggt

SEQ ID NO: 7805038 - DNA, 22 bp, Homo sapiens
gcacagggccctgtgcgtaggt

SEQ ID NO: 7805039 - DNA, 22 bp, Homo sapiens
gcacagggaggctggcctggcc

SEQ ID NO: 7805040 - DNA, 22 bp, Homo sapiens
gatttctgggctttatttcaga

SEQ ID NO: 7805041 - DNA, 20 bp, Homo sapiens
gcaaaataggctctgttggt

SEQ ID NO: 7805042 - DNA, 22 bp, Homo sapiens
gcaacagcccaggttctgtgtg

SEQ ID NO: 7805043 - DNA, 22 bp, Homo sapiens
gcaacagcattctcattgacat

SEQ ID NO: 7805044 - DNA, 22 bp, Homo sapiens
gcaaacaagctgcctgaagatt

SEQ ID NO: 7805045 - DNA, 22 bp, Homo sapiens
atttgcatttacatagcataga

SEQ ID NO: 7805046 - DNA, 22 bp, Homo sapiens
atttgcatttacatagcataga

SEQ ID NO: 7805047 - DNA, 21 bp, Homo sapiens
atttgcattaaaatattacgc

SEQ ID NO: 7805048 - DNA, 22 bp, Homo sapiens
atttgcaattactcatgtcatt

SEQ ID NO: 7805049 - DNA, 22 bp, Homo sapiens
atttgcaaagtcgtatctgtga

SEQ ID NO: 7805050 - DNA, 22 bp, Homo sapiens
attttgaaaccaagttatttcc

SEQ ID NO: 7805051 - DNA, 22 bp, Homo sapiens
atttacataatagactttaggt

SEQ ID NO: 7805052 - DNA, 22 bp, Homo sapiens
atttaccagctgtgcactgata

SEQ ID NO: 7805053 - DNA, 22 bp, Homo sapiens
gctcaaagaatattcagaatga

SEQ ID NO: 7805054 - DNA, 22 bp, Homo sapiens
atgtacaaaatgttttgaaatg

SEQ ID NO: 7805055 - DNA, 22 bp, Homo sapiens
gagcagggcttgtcctcctcat

SEQ ID NO: 7805056 - DNA, 22 bp, Homo sapiens
atgtttatgttgggctatattt

SEQ ID NO: 7805057 - DNA, 22 bp, Homo sapiens
atgtttcaccagcaaattacct

SEQ ID NO: 7805058 - DNA, 22 bp, Homo sapiens
atgtttcatgactgagcaaaat

SEQ ID NO: 7805059 - DNA, 22 bp, Homo sapiens
gagtccagttagtgaggctggg

SEQ ID NO: 7805060 - DNA, 22 bp, Homo sapiens
atgcaatgttacagaatgtact

SEQ ID NO: 7805061 - DNA, 22 bp, Homo sapiens
atgcaaatgctagagaatgttg

SEQ ID NO: 7805062 - DNA, 22 bp, Homo sapiens
gaaatgattttagtttatcatg

SEQ ID NO: 7805063 - DNA, 22 bp, Homo sapiens
gaaatgatgtctgtgctgccac

SEQ ID NO: 7805064 - DNA, 22 bp, Homo sapiens
gaaaactaacggaaaagttagg

SEQ ID NO: 7805065 - DNA, 22 bp, Homo sapiens
gacagggaggaaagagactgct

SEQ ID NO: 7805066 - DNA, 22 bp, Homo sapiens
gacagggaggagcagagcttct

SEQ ID NO: 7805067 - DNA, 22 bp, Homo sapiens
gacagggccaaaccggctgatc

SEQ ID NO: 7805068 - DNA, 22 bp, Homo sapiens
gacagggcgcccagcctgtttc

SEQ ID NO: 7805069 - DNA, 22 bp, Homo sapiens
atgcttaacttcctagtctata

SEQ ID NO: 7805070 - DNA, 22 bp, Homo sapiens
atgctttcttctttcctgtaag

SEQ ID NO: 7805071 - DNA, 22 bp, Homo sapiens
atgcatatatacatacacagtc

SEQ ID NO: 7805072 - DNA, 22 bp, Homo sapiens
atgcatataaggcacatgtatt

SEQ ID NO: 7805073 - DNA, 22 bp, Homo sapiens
gaatcatggctgtgtcttcagc

SEQ ID NO: 7805074 - DNA, 22 bp, Homo sapiens
gacaggaaatatgggggttgtt

SEQ ID NO: 7805075 - DNA, 22 bp, Homo sapiens
gacaggaaaggggtctgttttc

SEQ ID NO: 7805076 - DNA, 22 bp, Homo sapiens
gacagggacgaggcttcaggca

SEQ ID NO: 7805077 - DNA, 22 bp, Homo sapiens
ggagagctgaagcatggacagg

SEQ ID NO: 7805078 - DNA, 18 bp, Homo sapiens
ggagagtgacagagtcgt

SEQ ID NO: 7805079 - DNA, 22 bp, Homo sapiens
ggagcagccacgtctcagggca

SEQ ID NO: 7805080 - DNA, 22 bp, Homo sapiens
ggagcagccgcgtctcagggca

SEQ ID NO: 7805081 - DNA, 22 bp, Homo sapiens
caagtgcacacacatcctgtgc

SEQ ID NO: 7805082 - DNA, 22 bp, Homo sapiens
gctgggagccgtacctgtcacg

SEQ ID NO: 7805083 - DNA, 22 bp, Homo sapiens
cacatttctctacctcacacaa

SEQ ID NO: 7805084 - DNA, 22 bp, Homo sapiens
ggcaggtgtgagatcgaggcca

SEQ ID NO: 7805085 - DNA, 22 bp, Homo sapiens
ggcttggcctgataaatgcatg

SEQ ID NO: 7805086 - DNA, 22 bp, Homo sapiens
cagaagaggactgggtagctca

SEQ ID NO: 7805087 - DNA, 22 bp, Homo sapiens
cagaagagtagctgaacaagtt

SEQ ID NO: 7805088 - DNA, 22 bp, Homo sapiens
tacctcattacatctgcaatga

SEQ ID NO: 7805089 - DNA, 22 bp, Homo sapiens
tacctcatgctgtacagcacgt

SEQ ID NO: 7805090 - DNA, 22 bp, Homo sapiens
caggctgatagggtccaaagtt

SEQ ID NO: 7805091 - DNA, 22 bp, Homo sapiens
cagggatgctgcttaggcagtt

SEQ ID NO: 7805092 - DNA, 22 bp, Homo sapiens
cagggatgctgttaaacatcct

SEQ ID NO: 7805093 - DNA, 22 bp, Homo sapiens
cagggatgaccagagggatgtg

SEQ ID NO: 7805094 - DNA, 22 bp, Homo sapiens
tacaatagggcttttgtttatg

SEQ ID NO: 7805095 - DNA, 22 bp, Homo sapiens
tagtacagttccatcaaagcag

SEQ ID NO: 7805096 - DNA, 22 bp, Homo sapiens
tagtacagtggcattcaaactt

SEQ ID NO: 7805097 - DNA, 22 bp, Homo sapiens
tagttttagcagcaatgggatg

SEQ ID NO: 7805098 - DNA, 22 bp, Homo sapiens
tatataatttgtaaaagcacct

SEQ ID NO: 7805099 - DNA, 22 bp, Homo sapiens
tatgatgactctagataaagtc

SEQ ID NO: 7805100 - DNA, 22 bp, Homo sapiens
tatattgtagctgatgacaaat

SEQ ID NO: 7805101 - DNA, 22 bp, Homo sapiens
tcacatgtcagtcttaaacaga

SEQ ID NO: 7805102 - DNA, 22 bp, Homo sapiens
cagtcttagccttccctcaccc

SEQ ID NO: 7805103 - DNA, 22 bp, Homo sapiens
tcaaatgcttctactcctaaga

SEQ ID NO: 7805104 - DNA, 22 bp, Homo sapiens
cagtgaaatcacaactttagtt

SEQ ID NO: 7805105 - DNA, 22 bp, Homo sapiens
catttcatagttgtcacaataa

SEQ ID NO: 7805106 - DNA, 22 bp, Homo sapiens
catttcactattcactaaaagg

SEQ ID NO: 7805107 - DNA, 21 bp, Homo sapiens
catttcatgattatagaaatg

SEQ ID NO: 7805108 - DNA, 22 bp, Homo sapiens
catttcattcctttgaaagtgg

SEQ ID NO: 7805109 - DNA, 20 bp, Homo sapiens
catttcattgtgtcttcact

SEQ ID NO: 7805110 - DNA, 22 bp, Homo sapiens
ccaagagccatcctggtcaaca

SEQ ID NO: 7805111 - DNA, 20 bp, Homo sapiens
ccaagagcatgcatgaggaa

SEQ ID NO: 7805112 - DNA, 21 bp, Homo sapiens
ccaagagcaatgctaaggaga

SEQ ID NO: 7805113 - DNA, 22 bp, Homo sapiens
tccaagaagcttacaatctaat

SEQ ID NO: 7805114 - DNA, 22 bp, Homo sapiens
catgctatttatacataagtct

SEQ ID NO: 7805115 - DNA, 22 bp, Homo sapiens
cattaattgtatttttcaaagt

SEQ ID NO: 7805116 - DNA, 22 bp, Homo sapiens
tgagtcctaaagctgtgccctt

SEQ ID NO: 7805117 - DNA, 22 bp, Homo sapiens
tgagtccaccttagtatatggg

SEQ ID NO: 7805118 - DNA, 17 bp, Homo sapiens
tgaggccatggcaccat

SEQ ID NO: 7805119 - DNA, 22 bp, Homo sapiens
tgaggccatggaactagcttgg

SEQ ID NO: 7805120 - DNA, 22 bp, Homo sapiens
tgaggccatggtcttcccagtc

SEQ ID NO: 7805121 - DNA, 22 bp, Homo sapiens
tgaggccaggcaaaggcgatct

SEQ ID NO: 7805122 - DNA, 22 bp, Homo sapiens
tgaggccagggattccatcatt

SEQ ID NO: 7805123 - DNA, 22 bp, Homo sapiens
tgaggccatgcccgtgccggcc

SEQ ID NO: 7805124 - DNA, 22 bp, Homo sapiens
tgaggccagtctcatcacaggc

SEQ ID NO: 7805125 - DNA, 22 bp, Homo sapiens
tcttttctgccagctgagccct

SEQ ID NO: 7805126 - DNA, 22 bp, Homo sapiens
tcttaattctgtgtcttcacta

SEQ ID NO: 7805127 - DNA, 22 bp, Homo sapiens
tctgttcatttgcctcggctct

SEQ ID NO: 7805128 - DNA, 22 bp, Homo sapiens
tggggagcacggtagggaaatg

SEQ ID NO: 7805129 - DNA, 22 bp, Homo sapiens
tgggcaggagagaagctaaaga

SEQ ID NO: 7805130 - DNA, 22 bp, Homo sapiens
tgctcaggaaataatgtctgtg

SEQ ID NO: 7805131 - DNA, 22 bp, Homo sapiens
tggaggagaactccctggctac

SEQ ID NO: 7805132 - DNA, 22 bp, Homo sapiens
tggaggaatcagggcttaggct

SEQ ID NO: 7805133 - DNA, 22 bp, Homo sapiens
ccctcctcaactctggcttcca

SEQ ID NO: 7805134 - DNA, 22 bp, Homo sapiens
tggagaattctatgttgagggg

SEQ ID NO: 7805135 - DNA, 22 bp, Homo sapiens
tggcagggaatacagatgttta

SEQ ID NO: 7805136 - DNA, 22 bp, Homo sapiens
ccctttaaggtctgattttcag

SEQ ID NO: 7805137 - DNA, 22 bp, Homo sapiens
tggcaggctgagttggcctggt

SEQ ID NO: 7805138 - DNA, 22 bp, Homo sapiens
tgttttcctcctggtttctgcc

SEQ ID NO: 7805139 - DNA, 22 bp, Homo sapiens
ttaaggaaacatttttccatag

SEQ ID NO: 7805140 - DNA, 22 bp, Homo sapiens
ttaaaatgcagattatgactca

SEQ ID NO: 7805141 - DNA, 22 bp, Homo sapiens
cctttaaatggatgttcaactg

SEQ ID NO: 7805142 - DNA, 22 bp, Homo sapiens
ttcctctgaaatggcttggaaa

SEQ ID NO: 7805143 - DNA, 22 bp, Homo sapiens
ttcagtttccacttacatttaa

SEQ ID NO: 7805144 - DNA, 22 bp, Homo sapiens
cggctgggttcggctgcaggcc

SEQ ID NO: 7805145 - DNA, 22 bp, Homo sapiens
cggctggtgtcgggcacagcaa

SEQ ID NO: 7805146 - DNA, 22 bp, Homo sapiens
ctaaattatcatgagaattatg

SEQ ID NO: 7805147 - DNA, 22 bp, Homo sapiens
ttctatttttgtggaactgtag

SEQ ID NO: 7805148 - DNA, 20 bp, Homo sapiens
ttctccaaaggagacactag

SEQ ID NO: 7805149 - DNA, 20 bp, Homo sapiens
ttctccaaaggagacactag

SEQ ID NO: 7805150 - DNA, 21 bp, Homo sapiens
ttcttcatgatgattaatggc

SEQ ID NO: 7805151 - DNA, 22 bp, Homo sapiens
ttcttcatgggttcttttagga

SEQ ID NO: 7805152 - DNA, 22 bp, Homo sapiens
ttcttcattcccttacttccga

SEQ ID NO: 7805153 - DNA, 22 bp, Homo sapiens
ttctgaaatttcaactttacta

SEQ ID NO: 7805154 - DNA, 22 bp, Homo sapiens
ctataaatctacccagcattgg

SEQ ID NO: 7805155 - DNA, 22 bp, Homo sapiens
ttctcttttgtgatgtgagatg

SEQ ID NO: 7805156 - DNA, 22 bp, Homo sapiens
ttttctctccaggtggggtgat

SEQ ID NO: 7805157 - DNA, 22 bp, Homo sapiens
tttttctctaagtagtcccaaa

SEQ ID NO: 7805158 - DNA, 22 bp, Homo sapiens
ttttctctacaaaataaccagc

SEQ ID NO: 7805159 - DNA, 22 bp, Homo sapiens
ttttctctatattgtctgtgaa

SEQ ID NO: 7805160 - DNA, 22 bp, Homo sapiens
ctgcagtctacctggattttta

SEQ ID NO: 7805161 - DNA, 22 bp, Homo sapiens
ctgctctgaagccaggattctg

SEQ ID NO: 7805162 - DNA, 22 bp, Homo sapiens
ctcctcagctgggaggagtccc

SEQ ID NO: 7805163 - DNA, 22 bp, Homo sapiens
tttcttctgtttgtagttacac

SEQ ID NO: 7805164 - DNA, 22 bp, Homo sapiens
ctctgctgttcttatgtgtcct

SEQ ID NO: 7805165 - DNA, 22 bp, Homo sapiens
ctctgctggtagctcattccat

SEQ ID NO: 7805166 - DNA, 22 bp, Homo sapiens
ctctgctggtgaccactgggcc

SEQ ID NO: 7805167 - DNA, 22 bp, Homo sapiens
ctctgctgcccaggcctgctag

SEQ ID NO: 7805168 - DNA, 20 bp, Homo sapiens
ctctgctgcccgccggctgc

SEQ ID NO: 7805169 - DNA, 22 bp, Homo sapiens
ctctgctgcttgccagtcattg

SEQ ID NO: 7805170 - DNA, 22 bp, Homo sapiens
ctctgctgctttgccagtggaa

SEQ ID NO: 7805171 - DNA, 22 bp, Homo sapiens
ctctatttatggcatctttatg

SEQ ID NO: 7805172 - DNA, 22 bp, Homo sapiens
gaggagagatggtagattgggt

SEQ ID NO: 7805173 - DNA, 22 bp, Homo sapiens
gaggagaggctggacgcggtga

SEQ ID NO: 7805174 - DNA, 22 bp, Homo sapiens
gaggggctgccctggtgtcagg

SEQ ID NO: 7805175 - DNA, 22 bp, Homo sapiens
gacatttaaattgcaggcagcc

SEQ ID NO: 7805176 - DNA, 22 bp, Homo sapiens
gacatttactgaatactgatta

SEQ ID NO: 7805177 - DNA, 22 bp, Homo sapiens
gacatttagaagttagattcaa

SEQ ID NO: 7805178 - DNA, 18 bp, Homo sapiens
gaaaggagagacagtagg

SEQ ID NO: 7805179 - DNA, 22 bp, Homo sapiens
ctgtattttttaagaatatctc

SEQ ID NO: 7805180 - DNA, 22 bp, Homo sapiens
ctgtatatggcttactttatat

SEQ ID NO: 7805181 - DNA, 22 bp, Homo sapiens
ctggtgcaaaagtaattgtggt

SEQ ID NO: 7805182 - DNA, 22 bp, Homo sapiens
ctgtaattttccagccaatatg

SEQ ID NO: 7805183 - DNA, 22 bp, Homo sapiens
ctggtgccctgtgtggcaggag

SEQ ID NO: 7805184 - DNA, 22 bp, Homo sapiens
ctgcttatggagatgagtaaga

SEQ ID NO: 7805185 - DNA, 21 bp, Homo sapiens
cttttctctccgcaggacatt

SEQ ID NO: 7805186 - DNA, 22 bp, Homo sapiens
cttttcttgtattggatgcccc

SEQ ID NO: 7805187 - DNA, 22 bp, Homo sapiens
gaaaatacttcagtgttctggc

SEQ ID NO: 7805188 - DNA, 22 bp, Homo sapiens
gaaaatgtttcctgttatttgc

SEQ ID NO: 7805189 - DNA, 22 bp, Homo sapiens
gaaaatgttagcttcatagtca

SEQ ID NO: 7805190 - DNA, 22 bp, Homo sapiens
gaaaattattgaaaatggctct

SEQ ID NO: 7805191 - DNA, 22 bp, Homo sapiens
ctttaaataatacaaggtccag

SEQ ID NO: 7805192 - DNA, 22 bp, Homo sapiens
ctttctcttcagcacccagccc

SEQ ID NO: 7805193 - DNA, 22 bp, Homo sapiens
cttaaattcttaatgccctcat

SEQ ID NO: 7805194 - DNA, 22 bp, Homo sapiens
cttaaattttcatctacaagaa

SEQ ID NO: 7805195 - DNA, 22 bp, Homo sapiens
cttaaattggatgagttaagtt

SEQ ID NO: 7805196 - DNA, 23 bp, Homo sapiens
ggctttgctctgggttctagggt

SEQ ID NO: 7805197 - DNA, 22 bp, Homo sapiens
ggctttgccctggactgaggca

SEQ ID NO: 7805198 - DNA, 22 bp, Homo sapiens
ggctttgcattttgatggaggt

SEQ ID NO: 7805199 - DNA, 22 bp, Homo sapiens
ggctgtgcctctggcagcacat

SEQ ID NO: 7805200 - DNA, 22 bp, Homo sapiens
ggcagtggtgggaggctcgctc

SEQ ID NO: 7805201 - DNA, 22 bp, Homo sapiens
ggtgcatgtgagaaagactggg

SEQ ID NO: 7805202 - DNA, 22 bp, Homo sapiens
ggtgcatggaaagagtaagtaa

SEQ ID NO: 7805203 - DNA, 22 bp, Homo sapiens
gggcctctcccttctcacgcat

SEQ ID NO: 7805204 - DNA, 22 bp, Homo sapiens
gtgcaaattccactggaaagct

SEQ ID NO: 7805205 - DNA, 22 bp, Homo sapiens
gtcctcaggcttgagtgtttat

SEQ ID NO: 7805206 - DNA, 22 bp, Homo sapiens
gtcattctctggtgtggttgtt

SEQ ID NO: 7805207 - DNA, 22 bp, Homo sapiens
gtcattcttaacaactcagtag

SEQ ID NO: 7805208 - DNA, 22 bp, Homo sapiens
gtaaatgagtcaaatgggggaa

SEQ ID NO: 7805209 - DNA, 22 bp, Homo sapiens
gtagctctgtttaaagttcttt

SEQ ID NO: 7805210 - DNA, 22 bp, Homo sapiens
gcagggctaggtcttctagggc

SEQ ID NO: 7805211 - DNA, 22 bp, Homo sapiens
gcaaatgcactgcatttagatt

SEQ ID NO: 7805212 - DNA, 22 bp, Homo sapiens
gcaaatgctaaagtgtagagac

SEQ ID NO: 7805213 - DNA, 22 bp, Homo sapiens
gcaagagacttttatgtctgcc

SEQ ID NO: 7805214 - DNA, 22 bp, Homo sapiens
gcaagcaagcaggtagagctga

SEQ ID NO: 7805215 - DNA, 22 bp, Homo sapiens
gcaagcaaaatgggagattccc

SEQ ID NO: 7805216 - DNA, 22 bp, Homo sapiens
gcaagcaaattatttataggca

SEQ ID NO: 7805217 - DNA, 18 bp, Homo sapiens
gcagtctctctggtcttc

SEQ ID NO: 7805218 - DNA, 22 bp, Homo sapiens
gcatttcatgtagattgagaac

SEQ ID NO: 7805219 - DNA, 22 bp, Homo sapiens
gcatttcctgtgcttggcatat

SEQ ID NO: 7805220 - DNA, 22 bp, Homo sapiens
gcataaatgttctttcagattt

SEQ ID NO: 7805221 - DNA, 22 bp, Homo sapiens
ggaaagggagttttgcttatga

SEQ ID NO: 7805222 - DNA, 22 bp, Homo sapiens
ggaaagggcagaggccttggag

SEQ ID NO: 7805223 - DNA, 22 bp, Homo sapiens
ggaaaggggcctggatcttttg

SEQ ID NO: 7805224 - DNA, 22 bp, Homo sapiens
ggaaatatcttgtactatgtga

SEQ ID NO: 7805225 - DNA, 21 bp, Homo sapiens
ggaacattgttaatagtctct

SEQ ID NO: 7805226 - DNA, 22 bp, Homo sapiens
ggacctgaacataaaacgaggc

SEQ ID NO: 7805227 - DNA, 22 bp, Homo sapiens
ggagagctggtatatgaagaca

SEQ ID NO: 7805228 - DNA, 22 bp, Homo sapiens
gctgggaggatctctccctgtc

SEQ ID NO: 7805229 - DNA, 20 bp, Homo sapiens
gcttcatttgcaagtctagt

SEQ ID NO: 7805230 - DNA, 22 bp, Homo sapiens
gctcacatcatagtaagctcat

SEQ ID NO: 7805231 - DNA, 22 bp, Homo sapiens
gctcaatgctcaatgctgcaaa

SEQ ID NO: 7805232 - DNA, 22 bp, Homo sapiens
gcggggggaggaacatcttgca

SEQ ID NO: 7805233 - DNA, 22 bp, Homo sapiens
taagaaactgtcacagtactat

SEQ ID NO: 7805234 - DNA, 22 bp, Homo sapiens
gttcatttttactttgatctac

SEQ ID NO: 7805235 - DNA, 22 bp, Homo sapiens
gttataaaggtgataatggtca

SEQ ID NO: 7805236 - DNA, 22 bp, Homo sapiens
gttcattttactgtaaatagca

SEQ ID NO: 7805237 - DNA, 22 bp, Homo sapiens
gttataaaatgcacagttgttt

SEQ ID NO: 7805238 - DNA, 22 bp, Homo sapiens
gtgttacatattctaaaatgct

SEQ ID NO: 7805239 - DNA, 22 bp, Homo sapiens
tacccagagggagagcaactat

SEQ ID NO: 7805240 - DNA, 22 bp, Homo sapiens
tactaagtgtttggcagtatca

SEQ ID NO: 7805241 - DNA, 22 bp, Homo sapiens
tactaagtagcagaactaagaa

SEQ ID NO: 7805242 - DNA, 22 bp, Homo sapiens
tactaagtggggcattgttata

SEQ ID NO: 7805243 - DNA, 22 bp, Homo sapiens
tactgagtggcaaaggcaagaa

SEQ ID NO: 7805244 - DNA, 22 bp, Homo sapiens
taagcaatgagataatcatggg

SEQ ID NO: 7805245 - DNA, 22 bp, Homo sapiens
taagttaaccctgttaatagat

SEQ ID NO: 7805246 - DNA, 22 bp, Homo sapiens
taatgactgccgtctctcttca

SEQ ID NO: 7805247 - DNA, 22 bp, Homo sapiens
taatgagatcatatcttctgag

SEQ ID NO: 7805248 - DNA, 22 bp, Homo sapiens
taatgcatgtaatgggctgata

SEQ ID NO: 7805249 - DNA, 22 bp, Homo sapiens
taatgatgcagttactgtctca

SEQ ID NO: 7805250 - DNA, 22 bp, Homo sapiens
taatgatgctagatttatctgg

SEQ ID NO: 7805251 - DNA, 22 bp, Homo sapiens
taatgatgtttcctatcttcca

SEQ ID NO: 7805252 - DNA, 22 bp, Homo sapiens
taattttatgacagtgtatttt

SEQ ID NO: 7805253 - DNA, 23 bp, Homo sapiens
taattttagccttacaggaccct

SEQ ID NO: 7805254 - DNA, 22 bp, Homo sapiens
taattttacttcctgagcacct

SEQ ID NO: 7805255 - DNA, 22 bp, Homo sapiens
taattttaatagtatgtggcat

SEQ ID NO: 7805256 - DNA, 22 bp, Homo sapiens
taattttaactgtgctgtttgg

SEQ ID NO: 7805257 - DNA, 22 bp, Homo sapiens
tacacattacataatactatct

SEQ ID NO: 7805258 - DNA, 17 bp, Homo sapiens
tatctgtgttcctggct

SEQ ID NO: 7805259 - DNA, 22 bp, Homo sapiens
tatacatgttttacataagtga

SEQ ID NO: 7805260 - DNA, 22 bp, Homo sapiens
tatttcagcacatgggataggt

SEQ ID NO: 7805261 - DNA, 22 bp, Homo sapiens
tagccatgttgttaaaagacaa

SEQ ID NO: 7805262 - DNA, 22 bp, Homo sapiens
tagtatagattgaagcagatca

SEQ ID NO: 7805263 - DNA, 22 bp, Homo sapiens
tagtacagtttactttcagcgc

SEQ ID NO: 7805264 - DNA, 22 bp, Homo sapiens
tagagctactggcagcctcttc

SEQ ID NO: 7805265 - DNA, 22 bp, Homo sapiens
tagagctatttagagcatttta

SEQ ID NO: 7805266 - DNA, 22 bp, Homo sapiens
tagagcattagaaattagtgta

SEQ ID NO: 7805267 - DNA, 20 bp, Homo sapiens
tagaatctactatttggccc

SEQ ID NO: 7805268 - DNA, 22 bp, Homo sapiens
tagcaagaggaaacaaggggcc

SEQ ID NO: 7805269 - DNA, 22 bp, Homo sapiens
tagattttgcatttctaacaag

SEQ ID NO: 7805270 - DNA, 22 bp, Homo sapiens
tccctgaggaaggggtgtggtg

SEQ ID NO: 7805271 - DNA, 22 bp, Homo sapiens
tccctgggccacagctgtgagc

SEQ ID NO: 7805272 - DNA, 22 bp, Homo sapiens
tcctcctctatcagacagtgcc

SEQ ID NO: 7805273 - DNA, 18 bp, Homo sapiens
tcatggctttagtccctc

SEQ ID NO: 7805274 - DNA, 22 bp, Homo sapiens
tcatctaagagtcttacattta

SEQ ID NO: 7805275 - DNA, 22 bp, Homo sapiens
tcatctctagacaggaggctgg

SEQ ID NO: 7805276 - DNA, 22 bp, Homo sapiens
tcataaaagtactcatgttcat

SEQ ID NO: 7805277 - DNA, 21 bp, Homo sapiens
tcatatttctcttgctattgt

SEQ ID NO: 7805278 - DNA, 22 bp, Homo sapiens
tcaattctgcctctaaatattt

SEQ ID NO: 7805279 - DNA, 22 bp, Homo sapiens
tcaattctgcatacatttcact

SEQ ID NO: 7805280 - DNA, 20 bp, Homo sapiens
tcaaaataggtgtgggcgga

SEQ ID NO: 7805281 - DNA, 22 bp, Homo sapiens
tcaaaagacacaggaggctagt

SEQ ID NO: 7805282 - DNA, 18 bp, Homo sapiens
tcaaaatatttctgtgga

SEQ ID NO: 7805283 - DNA, 22 bp, Homo sapiens
tttgaacaggagtatctatagt

SEQ ID NO: 7805284 - DNA, 22 bp, Homo sapiens
tttgaaattggctcattggttt

SEQ ID NO: 7805285 - DNA, 22 bp, Homo sapiens
tttgaacatgctgcatgataat

SEQ ID NO: 7805286 - DNA, 22 bp, Homo sapiens
tttgacatctaagaattcttac

SEQ ID NO: 7805287 - DNA, 22 bp, Homo sapiens
tttgaaatgtatcagtataggt

SEQ ID NO: 7805288 - DNA, 22 bp, Homo sapiens
tttgaaattaagatattgtcca

SEQ ID NO: 7805289 - DNA, 22 bp, Homo sapiens
tttgaaatatgaggcattatga

SEQ ID NO: 7805290 - DNA, 22 bp, Homo sapiens
tttgaaatatgtgatgagagag

SEQ ID NO: 7805291 - DNA, 22 bp, Homo sapiens
tttgaaatatgaggcattatga

SEQ ID NO: 7805292 - DNA, 22 bp, Homo sapiens
tttctagacatttctatgtaca

SEQ ID NO: 7805293 - DNA, 22 bp, Homo sapiens
tttctagagttcatcatggtaa

SEQ ID NO: 7805294 - DNA, 22 bp, Homo sapiens
tttgcatgggaggtagtaatca

SEQ ID NO: 7805295 - DNA, 22 bp, Homo sapiens
tttgcattatctcacttatata

SEQ ID NO: 7805296 - DNA, 22 bp, Homo sapiens
tttgcttaaaagcggagcaaga

SEQ ID NO: 7805297 - DNA, 22 bp, Homo sapiens
tttgcattctagaaaaatttct

SEQ ID NO: 7805298 - DNA, 19 bp, Homo sapiens
ttttcccaccctttagaat

SEQ ID NO: 7805299 - DNA, 22 bp, Homo sapiens
tttgtctgccttgctggactgt

SEQ ID NO: 7805300 - DNA, 22 bp, Homo sapiens
ttgagagtggcttgttgactgc

SEQ ID NO: 7805301 - DNA, 22 bp, Homo sapiens
ttgaaaatatcacaggagcagc

SEQ ID NO: 7805302 - DNA, 22 bp, Homo sapiens
ttcttcttaatgtcctgggaac

SEQ ID NO: 7805303 - DNA, 22 bp, Homo sapiens
ttcttcttgaaactttaggttg

SEQ ID NO: 7805304 - DNA, 22 bp, Homo sapiens
ttctttctcaacatgaatgttt

SEQ ID NO: 7805305 - DNA, 20 bp, Homo sapiens
ttctctttgggtccagagaa

SEQ ID NO: 7805306 - DNA, 22 bp, Homo sapiens
ttattttaccttcctctgagct

SEQ ID NO: 7805307 - DNA, 22 bp, Homo sapiens
ttcatattatgatttgaaatgc

SEQ ID NO: 7805308 - DNA, 22 bp, Homo sapiens
ttcatacaatgggatattatga

SEQ ID NO: 7805309 - DNA, 22 bp, Homo sapiens
ttcagaatgctatttctgaaat

SEQ ID NO: 7805310 - DNA, 22 bp, Homo sapiens
ttcagaatgtgaccttatttgg

SEQ ID NO: 7805311 - DNA, 22 bp, Homo sapiens
ttgggctcctgttgatcctgtc

SEQ ID NO: 7805312 - DNA, 22 bp, Homo sapiens
ttgtatcagtgcctataaaatg

SEQ ID NO: 7805313 - DNA, 22 bp, Homo sapiens
ttgctaaaaatggaattatagg

SEQ ID NO: 7805314 - DNA, 22 bp, Homo sapiens
ttgaggtcttgagtactgggga

SEQ ID NO: 7805315 - DNA, 22 bp, Homo sapiens
ttgccaagtgttttaaaatatt

SEQ ID NO: 7805316 - DNA, 22 bp, Homo sapiens
ttgcattttggttgtaaatatg

SEQ ID NO: 7805317 - DNA, 22 bp, Homo sapiens
tttcccaagtgaagtgaagcca

SEQ ID NO: 7805318 - DNA, 22 bp, Homo sapiens
tttcccaagtgtaaacatggca

SEQ ID NO: 7805319 - DNA, 22 bp, Homo sapiens
tttcccaatgagtccttgagca

SEQ ID NO: 7805320 - DNA, 22 bp, Homo sapiens
tttcccaattgagaggttctgt

SEQ ID NO: 7805321 - DNA, 22 bp, Homo sapiens
tttcccaagaaaaataattgga

SEQ ID NO: 7805322 - DNA, 22 bp, Homo sapiens
tttcccaagaccatagatggaa

SEQ ID NO: 7805323 - DNA, 22 bp, Homo sapiens
tttcccaacagtctctctcaaa

SEQ ID NO: 7805324 - DNA, 22 bp, Homo sapiens
tttcccaaagcctggggtgagt

SEQ ID NO: 7805325 - DNA, 22 bp, Homo sapiens
tttccaaataaggtcacactca

SEQ ID NO: 7805326 - DNA, 22 bp, Homo sapiens
tttccaaataaggtcacattct

SEQ ID NO: 7805327 - DNA, 22 bp, Homo sapiens
tttccagatgctaggttgaaag

SEQ ID NO: 7805328 - DNA, 22 bp, Homo sapiens
tttcatagtcaagtgtgtatga

SEQ ID NO: 7805329 - DNA, 22 bp, Homo sapiens
tttcacaactgcttatttgaga

SEQ ID NO: 7805330 - DNA, 22 bp, Homo sapiens
tttaggaatgtggtttttgagc

SEQ ID NO: 7805331 - DNA, 22 bp, Homo sapiens
tttagccaactatatgactagt

SEQ ID NO: 7805332 - DNA, 22 bp, Homo sapiens
tttatcttctgcagttctggct

SEQ ID NO: 7805333 - DNA, 23 bp, Homo sapiens
tttaacatttgaacatgtggcca

SEQ ID NO: 7805334 - DNA, 22 bp, Homo sapiens
aatgtgtttagttaatgagttg

SEQ ID NO: 7805335 - DNA, 22 bp, Homo sapiens
aatgtcatagcatttcttcaat

SEQ ID NO: 7805336 - DNA, 22 bp, Homo sapiens
aattatatgttaatcttcaatt

SEQ ID NO: 7805337 - DNA, 22 bp, Homo sapiens
aatgttattgtcctttccaaaa

SEQ ID NO: 7805338 - DNA, 22 bp, Homo sapiens
aatgttatttctgcatagtagt

SEQ ID NO: 7805339 - DNA, 22 bp, Homo sapiens
aatgttgtacctatgctgagag

SEQ ID NO: 7805340 - DNA, 22 bp, Homo sapiens
aatgttgtgtttcagttcaaga

SEQ ID NO: 7805341 - DNA, 22 bp, Homo sapiens
acaaatgtggacatggataatg

SEQ ID NO: 7805342 - DNA, 22 bp, Homo sapiens
acaaatgtctacattgagaata

SEQ ID NO: 7805343 - DNA, 22 bp, Homo sapiens
acaatgttttgaaacatctagg

SEQ ID NO: 7805344 - DNA, 22 bp, Homo sapiens
aatttgtgttagtccacgttca

SEQ ID NO: 7805345 - DNA, 22 bp, Homo sapiens
aatttgtggccacattgtggaa

SEQ ID NO: 7805346 - DNA, 22 bp, Homo sapiens
aattttatctctaagcaggctt

SEQ ID NO: 7805347 - DNA, 22 bp, Homo sapiens
acaaaatagagttctcccctgg

SEQ ID NO: 7805348 - DNA, 22 bp, Homo sapiens
agaggccagtggctgtgctgtc

SEQ ID NO: 7805349 - DNA, 22 bp, Homo sapiens
agaggccatctgctctgtgggg

SEQ ID NO: 7805350 - DNA, 20 bp, Homo sapiens
acaaaataggtactgggtag

SEQ ID NO: 7805351 - DNA, 22 bp, Homo sapiens
acaaatgccatatataaattct

SEQ ID NO: 7805352 - DNA, 22 bp, Homo sapiens
acaaatgccatgtgacctacca

SEQ ID NO: 7805353 - DNA, 22 bp, Homo sapiens
acaaatgcagcataaagtgaac

SEQ ID NO: 7805354 - DNA, 22 bp, Homo sapiens
acagcaaaagacaagaacttaa

SEQ ID NO: 7805355 - DNA, 22 bp, Homo sapiens
agctatgtccctatgaattctg

SEQ ID NO: 7805356 - DNA, 22 bp, Homo sapiens
agctatgtttgacagaaagtga

SEQ ID NO: 7805357 - DNA, 22 bp, Homo sapiens
agctaggataagcagagactgg

SEQ ID NO: 7805358 - DNA, 22 bp, Homo sapiens
agccattttggtaatgataaca

SEQ ID NO: 7805359 - DNA, 22 bp, Homo sapiens
agccacagtcaacctgtccata

SEQ ID NO: 7805360 - DNA, 21 bp, Homo sapiens
agcaccctcccttctggaggg

SEQ ID NO: 7805361 - DNA, 22 bp, Homo sapiens
acaatttggacatgtgcaggat

SEQ ID NO: 7805362 - DNA, 22 bp, Homo sapiens
acaatttgtgtcttttgcttat

SEQ ID NO: 7805363 - DNA, 22 bp, Homo sapiens
acacattataggcaatcaaaag

SEQ ID NO: 7805364 - DNA, 22 bp, Homo sapiens
aaggctgaggctggagaattac

SEQ ID NO: 7805365 - DNA, 22 bp, Homo sapiens
aagtcaatcaagggtgtaggca

SEQ ID NO: 7805366 - DNA, 22 bp, Homo sapiens
aagtcaattagtaaacttggaa

SEQ ID NO: 7805367 - DNA, 22 bp, Homo sapiens
aagtcaatttatgttctcagac

SEQ ID NO: 7805368 - DNA, 22 bp, Homo sapiens
aagtgcttggctaatggttatg

SEQ ID NO: 7805369 - DNA, 22 bp, Homo sapiens
aagtgcttggattgcaggtatg

SEQ ID NO: 7805370 - DNA, 22 bp, Homo sapiens
aagtttcaaatgttgattatgc

SEQ ID NO: 7805371 - DNA, 22 bp, Homo sapiens
aagtttcatgacttggttatta

SEQ ID NO: 7805372 - DNA, 22 bp, Homo sapiens
aataatgttgacgatagtctta

SEQ ID NO: 7805373 - DNA, 22 bp, Homo sapiens
aatcctggcatgtgccttggga

SEQ ID NO: 7805374 - DNA, 22 bp, Homo sapiens
aatcaaaacctacagaggtaat

SEQ ID NO: 7805375 - DNA, 22 bp, Homo sapiens
aatcctggaatacaagagtgaa

SEQ ID NO: 7805376 - DNA, 22 bp, Homo sapiens
aaatgtattgcataggatattt

SEQ ID NO: 7805377 - DNA, 18 bp, Homo sapiens
aaatggcagaatggatag

SEQ ID NO: 7805378 - DNA, 22 bp, Homo sapiens
aaatgcaggtagtatttatttt

SEQ ID NO: 7805379 - DNA, 22 bp, Homo sapiens
aaatgcatatcaaagacttgaa

SEQ ID NO: 7805380 - DNA, 22 bp, Homo sapiens
aaatgcatcagctcataagaga

SEQ ID NO: 7805381 - DNA, 22 bp, Homo sapiens
aaatgcatgagaaagtattctg

SEQ ID NO: 7805382 - DNA, 22 bp, Homo sapiens
aaatgcacaggttttaaatcct

SEQ ID NO: 7805383 - DNA, 22 bp, Homo sapiens
aaatgcaggaaattatgctttt

SEQ ID NO: 7805384 - DNA, 22 bp, Homo sapiens
aaatagattgctgaggcattac

SEQ ID NO: 7805385 - DNA, 22 bp, Homo sapiens
aaatcagatcttacacaattgt

SEQ ID NO: 7805386 - DNA, 22 bp, Homo sapiens
aaagtgtggcacaagtcacatc

SEQ ID NO: 7805387 - DNA, 22 bp, Homo sapiens
aaaggtttatttaatcagggag

SEQ ID NO: 7805388 - DNA, 22 bp, Homo sapiens
aaaggtttattgattctgctct

SEQ ID NO: 7805389 - DNA, 22 bp, Homo sapiens
aaagtcaaaatgctctcctgtc

SEQ ID NO: 7805390 - DNA, 22 bp, Homo sapiens
aaagtatcaagggaagcatttt

SEQ ID NO: 7805391 - DNA, 22 bp, Homo sapiens
aaagtcaatgatttctcctgga

SEQ ID NO: 7805392 - DNA, 22 bp, Homo sapiens
aaattttagactcctgggtcta

SEQ ID NO: 7805393 - DNA, 22 bp, Homo sapiens
aaattttagtaaggaagttgag

SEQ ID NO: 7805394 - DNA, 22 bp, Homo sapiens
aaagcttatttgtatgcatgtt

SEQ ID NO: 7805395 - DNA, 23 bp, Homo sapiens
aaaatcttctgcctatgaagaaa

SEQ ID NO: 7805396 - DNA, 22 bp, Homo sapiens
aaaagtatggtggtccttttta

SEQ ID NO: 7805397 - DNA, 22 bp, Homo sapiens
aaaagtattggccaccatttct

SEQ ID NO: 7805398 - DNA, 22 bp, Homo sapiens
aaaatcagtacactttattttg

SEQ ID NO: 7805399 - DNA, 22 bp, Homo sapiens
aaaattttgccctatccttcat

SEQ ID NO: 7805400 - DNA, 22 bp, Homo sapiens
aaacaagagtcttgctccacct

SEQ ID NO: 7805401 - DNA, 22 bp, Homo sapiens
aaacaatgtacacatgaatgtt

SEQ ID NO: 7805402 - DNA, 22 bp, Homo sapiens
aaacaatgtacatttataatgc

SEQ ID NO: 7805403 - DNA, 22 bp, Homo sapiens
aaatgcagatccctgaatctca

SEQ ID NO: 7805404 - DNA, 22 bp, Homo sapiens
aaatgcactgaacacatgttgt

SEQ ID NO: 7805405 - DNA, 22 bp, Homo sapiens
aaatgcagcctagctcagtttt

SEQ ID NO: 7805406 - DNA, 21 bp, Homo sapiens
aaagagcttttgtgctagtta

SEQ ID NO: 7805407 - DNA, 21 bp, Homo sapiens
aaagagcttttgtgctagtta

SEQ ID NO: 7805408 - DNA, 22 bp, Homo sapiens
aagccaagttggaagactgaat

SEQ ID NO: 7805409 - DNA, 22 bp, Homo sapiens
aagagctgattaagtcatgagg

SEQ ID NO: 7805410 - DNA, 22 bp, Homo sapiens
acaaggctaatttggaagatac

SEQ ID NO: 7805411 - DNA, 22 bp, Homo sapiens
acaaggctgtggggagaactga

SEQ ID NO: 7805412 - DNA, 18 bp, Homo sapiens
aagagcttcgcatataca

SEQ ID NO: 7805413 - DNA, 22 bp, Homo sapiens
aagagcttcctctttcattgct

SEQ ID NO: 7805414 - DNA, 22 bp, Homo sapiens
aagaaatgcagaaatgtgctgg

SEQ ID NO: 7805415 - DNA, 22 bp, Homo sapiens
aacaggaatgaggagaaaaggt

SEQ ID NO: 7805416 - DNA, 22 bp, Homo sapiens
aaatgtttctacttgtgagcat

SEQ ID NO: 7805417 - DNA, 22 bp, Homo sapiens
aaatgtgtttgataggaatatt

SEQ ID NO: 7805418 - DNA, 22 bp, Homo sapiens
aaatgtgtttcgaaaactggtg

SEQ ID NO: 7805419 - DNA, 22 bp, Homo sapiens
aaatgtgttcctttgctacaga

SEQ ID NO: 7805420 - DNA, 22 bp, Homo sapiens
aaatgtgtatatgaaacatgat

SEQ ID NO: 7805421 - DNA, 22 bp, Homo sapiens
aaatgtgtcagtttcattctct

SEQ ID NO: 7805422 - DNA, 22 bp, Homo sapiens
aaatgtggggctggaggcagga

SEQ ID NO: 7805423 - DNA, 21 bp, Homo sapiens
aaatgtgttccataatgcttt

SEQ ID NO: 7805424 - DNA, 22 bp, Homo sapiens
aaatgtgtgtatgtacatatat

SEQ ID NO: 7805425 - DNA, 22 bp, Homo sapiens
aaatgtgtcatattcaaagtca

SEQ ID NO: 7805426 - DNA, 22 bp, Homo sapiens
aaatgtctatctggcatattcc

SEQ ID NO: 7805427 - DNA, 22 bp, Homo sapiens
aaattttagaccaggcaaaact

SEQ ID NO: 7805428 - DNA, 22 bp, Homo sapiens
aacaaacaaacattttgtcatc

SEQ ID NO: 7805429 - DNA, 22 bp, Homo sapiens
aatagttttataggtgggatta

SEQ ID NO: 7805430 - DNA, 22 bp, Homo sapiens
aaccaacataggaatgcagaga

SEQ ID NO: 7805431 - DNA, 21 bp, Homo sapiens
aacatttcaggatccaaattg

SEQ ID NO: 7805432 - DNA, 22 bp, Homo sapiens
aataagaactccatttactcgt

SEQ ID NO: 7805433 - DNA, 22 bp, Homo sapiens
aactgcttagtgatggatgacc

SEQ ID NO: 7805434 - DNA, 22 bp, Homo sapiens
aatcataattttgtgaatgtag

SEQ ID NO: 7805435 - DNA, 22 bp, Homo sapiens
aatcatgtactgctgtggcttt

SEQ ID NO: 7805436 - DNA, 22 bp, Homo sapiens
aatcatgtccatcttaactttc

SEQ ID NO: 7805437 - DNA, 22 bp, Homo sapiens
cagcagggtatacagggaattt

SEQ ID NO: 7805438 - DNA, 22 bp, Homo sapiens
agcatataaatggacatatttg

SEQ ID NO: 7805439 - DNA, 22 bp, Homo sapiens
cagaatgtagatcatcatcaag

SEQ ID NO: 7805440 - DNA, 22 bp, Homo sapiens
cagaatgtatatgatctaaggt

SEQ ID NO: 7805441 - DNA, 22 bp, Homo sapiens
cagaatgcattgcttctgatgg

SEQ ID NO: 7805442 - DNA, 21 bp, Homo sapiens
cagaatgcattctttgaagga

SEQ ID NO: 7805443 - DNA, 22 bp, Homo sapiens
cagaatgcagaatgttcatttt

SEQ ID NO: 7805444 - DNA, 22 bp, Homo sapiens
cagaataccctatagacagaat

SEQ ID NO: 7805445 - DNA, 22 bp, Homo sapiens
caagacaatgggtaagtgtaac

SEQ ID NO: 7805446 - DNA, 22 bp, Homo sapiens
caagagctaccctgtgccatat

SEQ ID NO: 7805447 - DNA, 22 bp, Homo sapiens
caagagctagaaattggttaga

SEQ ID NO: 7805448 - DNA, 22 bp, Homo sapiens
caagcaacgactttcaagctgt

SEQ ID NO: 7805449 - DNA, 22 bp, Homo sapiens
cacagtttggtatagaagtgat

SEQ ID NO: 7805450 - DNA, 22 bp, Homo sapiens
cacacactgttaatgtaggagt

SEQ ID NO: 7805451 - DNA, 22 bp, Homo sapiens
cacacactggagcaaggagatg

SEQ ID NO: 7805452 - DNA, 22 bp, Homo sapiens
agcaggagtttgatgcttttat

SEQ ID NO: 7805453 - DNA, 22 bp, Homo sapiens
atgacaaaatgaatgcagctag

SEQ ID NO: 7805454 - DNA, 22 bp, Homo sapiens
atgaaactctaacttaacaagt

SEQ ID NO: 7805455 - DNA, 21 bp, Homo sapiens
agaagtcaattgaactgaaat

SEQ ID NO: 7805456 - DNA, 22 bp, Homo sapiens
atgggtccctggccgccctcgg

SEQ ID NO: 7805457 - DNA, 22 bp, Homo sapiens
atgtttatgcaaacatgtgagt

SEQ ID NO: 7805458 - DNA, 22 bp, Homo sapiens
agaggaggaagagctttaaaat

SEQ ID NO: 7805459 - DNA, 22 bp, Homo sapiens
attccattgtgtaaggatatcg

SEQ ID NO: 7805460 - DNA, 22 bp, Homo sapiens
attccagagaaaggcctggctg

SEQ ID NO: 7805461 - DNA, 22 bp, Homo sapiens
attccagagaggttctggaggt

SEQ ID NO: 7805462 - DNA, 18 bp, Homo sapiens
atttggcagatgatgaac

SEQ ID NO: 7805463 - DNA, 22 bp, Homo sapiens
atttggcagtataaattctggc

SEQ ID NO: 7805464 - DNA, 22 bp, Homo sapiens
atttctcttagcaagacattac

SEQ ID NO: 7805465 - DNA, 22 bp, Homo sapiens
atttgcttttactatgttaaaa

SEQ ID NO: 7805466 - DNA, 23 bp, Homo sapiens
actgctttattcatgaggctctc

SEQ ID NO: 7805467 - DNA, 22 bp, Homo sapiens
agtggcagtaacattccacaat

SEQ ID NO: 7805468 - DNA, 22 bp, Homo sapiens
agtctttaagtaatgataggca

SEQ ID NO: 7805469 - DNA, 22 bp, Homo sapiens
agtgcaattttgctttcccaat

SEQ ID NO: 7805470 - DNA, 22 bp, Homo sapiens
actcttatgggaacaaggatta

SEQ ID NO: 7805471 - DNA, 21 bp, Homo sapiens
actagcaaaagcctattatcc

SEQ ID NO: 7805472 - DNA, 22 bp, Homo sapiens
agaaaggtcacttagcctcagc

SEQ ID NO: 7805473 - DNA, 22 bp, Homo sapiens
agaaagggttctctgaggtgct

SEQ ID NO: 7805474 - DNA, 22 bp, Homo sapiens
agaaagggtcactgaaagagga

SEQ ID NO: 7805475 - DNA, 22 bp, Homo sapiens
agaaagggctattttgaggtag

SEQ ID NO: 7805476 - DNA, 22 bp, Homo sapiens
atatgcttgggactgatacagt

SEQ ID NO: 7805477 - DNA, 22 bp, Homo sapiens
atatgcttacactacaagatga

SEQ ID NO: 7805478 - DNA, 22 bp, Homo sapiens
atatgcttacagcttaaaatcc

SEQ ID NO: 7805479 - DNA, 22 bp, Homo sapiens
atatgcttatgatgtctcaagt

SEQ ID NO: 7805480 - DNA, 22 bp, Homo sapiens
actttcatgttcatttggaacc

SEQ ID NO: 7805481 - DNA, 22 bp, Homo sapiens
actttcatggtagttgtattct

SEQ ID NO: 7805482 - DNA, 22 bp, Homo sapiens
actttctatggcttattatgag

SEQ ID NO: 7805483 - DNA, 22 bp, Homo sapiens
ataaacaagactggccaacttt

SEQ ID NO: 7805484 - DNA, 22 bp, Homo sapiens
acttagaaattcagttttgtca

SEQ ID NO: 7805485 - DNA, 22 bp, Homo sapiens
acttaaagttataatttgctaa

SEQ ID NO: 7805486 - DNA, 22 bp, Homo sapiens
acttaaagtagttttactgtgg

SEQ ID NO: 7805487 - DNA, 22 bp, Homo sapiens
acatttcactgttcacagcagg

SEQ ID NO: 7805488 - DNA, 22 bp, Homo sapiens
acattgtataatgattatcaca

SEQ ID NO: 7805489 - DNA, 22 bp, Homo sapiens
acattgtagacttttcatatgt

SEQ ID NO: 7805490 - DNA, 22 bp, Homo sapiens
acatgtttaagtttaatgaaaa

SEQ ID NO: 7805491 - DNA, 22 bp, Homo sapiens
acatgcttctgtttcaagaact

SEQ ID NO: 7805492 - DNA, 21 bp, Homo sapiens
acagtttattagagtaagtgc

SEQ ID NO: 7805493 - DNA, 22 bp, Homo sapiens
acagtacaccactgtgtacagt

SEQ ID NO: 7805494 - DNA, 22 bp, Homo sapiens
acagtgtggtttgagcactggg

SEQ ID NO: 7805495 - DNA, 22 bp, Homo sapiens
acagggaagctcaggggctctg

SEQ ID NO: 7805496 - DNA, 22 bp, Homo sapiens
acagggaagctcaggggctctg

SEQ ID NO: 7805497 - DNA, 22 bp, Homo sapiens
agctgcagaggtttgtgcaaca

SEQ ID NO: 7805498 - DNA, 22 bp, Homo sapiens
caggaggacatactggctcaca

SEQ ID NO: 7805499 - DNA, 22 bp, Homo sapiens
caggaggagcattagcgtctca

SEQ ID NO: 7805500 - DNA, 22 bp, Homo sapiens
caggaggagggtacaccatcag

SEQ ID NO: 7805501 - DNA, 22 bp, Homo sapiens
caggaggattgcttgaggccag

SEQ ID NO: 7805502 - DNA, 22 bp, Homo sapiens
caggtgagctctatctagggag

SEQ ID NO: 7805503 - DNA, 20 bp, Homo sapiens
caggtgagcagatctgggtg

SEQ ID NO: 7805504 - DNA, 22 bp, Homo sapiens
cagggatggttgagaattggta

SEQ ID NO: 7805505 - DNA, 22 bp, Homo sapiens
cagggatgtctctggaagggag

SEQ ID NO: 7805506 - DNA, 22 bp, Homo sapiens
cagggatgtgatgagctgagcc

SEQ ID NO: 7805507 - DNA, 22 bp, Homo sapiens
cagggatgggatggagtcagtt

SEQ ID NO: 7805508 - DNA, 22 bp, Homo sapiens
caggtgcagctggatggaagcc

SEQ ID NO: 7805509 - DNA, 22 bp, Homo sapiens
aggacgctctcgctgaacttct

SEQ ID NO: 7805510 - DNA, 22 bp, Homo sapiens
ccaagcaaggctaattcacttg

SEQ ID NO: 7805511 - DNA, 22 bp, Homo sapiens
catgggcttgctctctgagctc

SEQ ID NO: 7805512 - DNA, 22 bp, Homo sapiens
cctgaggatgccagcatgggtg

SEQ ID NO: 7805513 - DNA, 22 bp, Homo sapiens
cctgaggagattgtggctgggg

SEQ ID NO: 7805514 - DNA, 22 bp, Homo sapiens
agggatggaagctcgtctgcaa

SEQ ID NO: 7805515 - DNA, 22 bp, Homo sapiens
agggagtccattttagaggtgg

SEQ ID NO: 7805516 - DNA, 22 bp, Homo sapiens
agggagtctagttgatgtggaa

SEQ ID NO: 7805517 - DNA, 17 bp, Homo sapiens
agggagtcagaggatcg

SEQ ID NO: 7805518 - DNA, 20 bp, Homo sapiens
agggtggcaagttagtgaca

SEQ ID NO: 7805519 - DNA, 22 bp, Homo sapiens
ctaaacaatgaacaaagcactg

SEQ ID NO: 7805520 - DNA, 22 bp, Homo sapiens
ctaaacaagggattataattga

SEQ ID NO: 7805521 - DNA, 22 bp, Homo sapiens
ctacactagagttgcaatggaa

SEQ ID NO: 7805522 - DNA, 22 bp, Homo sapiens
cctggtgccactagagaatgtc

SEQ ID NO: 7805523 - DNA, 22 bp, Homo sapiens
cctggtgcaccaagtaagggtg

SEQ ID NO: 7805524 - DNA, 22 bp, Homo sapiens
ctgaagctaggtcaaaaaaggg

SEQ ID NO: 7805525 - DNA, 22 bp, Homo sapiens
ctgagaaagtgagggttaaaca

SEQ ID NO: 7805526 - DNA, 22 bp, Homo sapiens
atagaatcatctgtgcactagt

SEQ ID NO: 7805527 - DNA, 20 bp, Homo sapiens
atagaatcacaagtcctgaa

SEQ ID NO: 7805528 - DNA, 19 bp, Homo sapiens
atagaaagggttaaagaca

SEQ ID NO: 7805529 - DNA, 22 bp, Homo sapiens
atacatgaggaggctggaaaca

SEQ ID NO: 7805530 - DNA, 22 bp, Homo sapiens
ctggaaatcactactagtcaat

SEQ ID NO: 7805531 - DNA, 22 bp, Homo sapiens
ataataaaccaggatgggtctg

SEQ ID NO: 7805532 - DNA, 22 bp, Homo sapiens
agtgttactggttcatgaatct

SEQ ID NO: 7805533 - DNA, 22 bp, Homo sapiens
atatattttgaatagcctctgt

SEQ ID NO: 7805534 - DNA, 22 bp, Homo sapiens
atatattttgcggtcacgtggc

SEQ ID NO: 7805535 - DNA, 22 bp, Homo sapiens
atatattttttgagacagagtc

SEQ ID NO: 7805536 - DNA, 22 bp, Homo sapiens
atattttcacagaacttgcaaa

SEQ ID NO: 7805537 - DNA, 22 bp, Homo sapiens
atattttcactgaaccaaagta

SEQ ID NO: 7805538 - DNA, 22 bp, Homo sapiens
ctggtggagatgcctggcccct

SEQ ID NO: 7805539 - DNA, 22 bp, Homo sapiens
atttggaatgtgtttgatcacc

SEQ ID NO: 7805540 - DNA, 22 bp, Homo sapiens
attttcctctggtttccccaga

SEQ ID NO: 7805541 - DNA, 21 bp, Homo sapiens
attttcattaattcagtgtgg

SEQ ID NO: 7805542 - DNA, 22 bp, Homo sapiens
gctcagagaagttgtgcctggc

SEQ ID NO: 7805543 - DNA, 22 bp, Homo sapiens
attttgctggtctgaattactt

SEQ ID NO: 7805544 - DNA, 22 bp, Homo sapiens
attttgaagggaattgaagttc

SEQ ID NO: 7805545 - DNA, 22 bp, Homo sapiens
attttgaatcaccttggaagaa

SEQ ID NO: 7805546 - DNA, 22 bp, Homo sapiens
caaagaatgagtgagtacataa

SEQ ID NO: 7805547 - DNA, 22 bp, Homo sapiens
caaagactgcataacacatgaa

SEQ ID NO: 7805548 - DNA, 22 bp, Homo sapiens
atttcttatgaatattgactgt

SEQ ID NO: 7805549 - DNA, 22 bp, Homo sapiens
atttcttatctgaggtctacat

SEQ ID NO: 7805550 - DNA, 22 bp, Homo sapiens
atttcccaatacgctaagtgga

SEQ ID NO: 7805551 - DNA, 22 bp, Homo sapiens
atttcccactctactacatgct

SEQ ID NO: 7805552 - DNA, 22 bp, Homo sapiens
atttcccaggactagaaatata

SEQ ID NO: 7805553 - DNA, 22 bp, Homo sapiens
attaaattggacgctgggggaa

SEQ ID NO: 7805554 - DNA, 22 bp, Homo sapiens
gattcttaagacattatgtatt

SEQ ID NO: 7805555 - DNA, 22 bp, Homo sapiens
attaaattggatctgcatagtt

SEQ ID NO: 7805556 - DNA, 22 bp, Homo sapiens
attaaattttcactaggctccc

SEQ ID NO: 7805557 - DNA, 22 bp, Homo sapiens
atgttatttctgaaagatcatt

SEQ ID NO: 7805558 - DNA, 22 bp, Homo sapiens
atgttattcaatttgaatccaa

SEQ ID NO: 7805559 - DNA, 22 bp, Homo sapiens
attctgcacatccaagaacagg

SEQ ID NO: 7805560 - DNA, 22 bp, Homo sapiens
attctggaaagctattctctct

SEQ ID NO: 7805561 - DNA, 22 bp, Homo sapiens
attctcttctgatgtcttgcca

SEQ ID NO: 7805562 - DNA, 22 bp, Homo sapiens
gagctgagttacctccagatca

SEQ ID NO: 7805563 - DNA, 22 bp, Homo sapiens
atgcttaactctgtacatagtt

SEQ ID NO: 7805564 - DNA, 22 bp, Homo sapiens
atgtgctcttattaccctgtcg

SEQ ID NO: 7805565 - DNA, 22 bp, Homo sapiens
gaggagctgggtcagggagaca

SEQ ID NO: 7805566 - DNA, 22 bp, Homo sapiens
ctttggcttttagatatccatt

SEQ ID NO: 7805567 - DNA, 19 bp, Homo sapiens
ctttgcttgtttctgtgtc

SEQ ID NO: 7805568 - DNA, 22 bp, Homo sapiens
ctttgcttctccaacctgctca

SEQ ID NO: 7805569 - DNA, 22 bp, Homo sapiens
atgagaaatttattacaagcta

SEQ ID NO: 7805570 - DNA, 22 bp, Homo sapiens
atgagaaagagttgtatctaga

SEQ ID NO: 7805571 - DNA, 22 bp, Homo sapiens
cttttgttgcccttgtcgcagg

SEQ ID NO: 7805572 - DNA, 17 bp, Homo sapiens
cttgttttccactggga

SEQ ID NO: 7805573 - DNA, 22 bp, Homo sapiens
gaagcggcatcaggaggctgcc

SEQ ID NO: 7805574 - DNA, 22 bp, Homo sapiens
atgatgtcatgaatatattagt

SEQ ID NO: 7805575 - DNA, 22 bp, Homo sapiens
gaattttagaatatgtgggctt

SEQ ID NO: 7805576 - DNA, 22 bp, Homo sapiens
gaattttaataaaggtttatca

SEQ ID NO: 7805577 - DNA, 22 bp, Homo sapiens
gaattttaagtgttcgcctctt

SEQ ID NO: 7805578 - DNA, 22 bp, Homo sapiens
gctggggagctagacctcagca

SEQ ID NO: 7805579 - DNA, 22 bp, Homo sapiens
caaggctgcaaaactacatggg

SEQ ID NO: 7805580 - DNA, 22 bp, Homo sapiens
caaggctgctggcttctgagct

SEQ ID NO: 7805581 - DNA, 22 bp, Homo sapiens
caaggctgtgcagggtccatat

SEQ ID NO: 7805582 - DNA, 22 bp, Homo sapiens
caatttcaatgaggccacaggg

SEQ ID NO: 7805583 - DNA, 22 bp, Homo sapiens
caatttcactaataatatttac

SEQ ID NO: 7805584 - DNA, 22 bp, Homo sapiens
caatttcaatacaaaatacatt

SEQ ID NO: 7805585 - DNA, 22 bp, Homo sapiens
caatttccttcatagatgactg

SEQ ID NO: 7805586 - DNA, 22 bp, Homo sapiens
caatttcattaatagatataga

SEQ ID NO: 7805587 - DNA, 22 bp, Homo sapiens
caatttcatggataaaagatgt

SEQ ID NO: 7805588 - DNA, 22 bp, Homo sapiens
cacaaatccaatttaattctgg

SEQ ID NO: 7805589 - DNA, 22 bp, Homo sapiens
ggagaagggacagactcagctt

SEQ ID NO: 7805590 - DNA, 22 bp, Homo sapiens
caaagtatgaaccagtttctct

SEQ ID NO: 7805591 - DNA, 22 bp, Homo sapiens
caacaatatgctgagtttttca

SEQ ID NO: 7805592 - DNA, 22 bp, Homo sapiens
caacaatatgccagactcaatt

SEQ ID NO: 7805593 - DNA, 22 bp, Homo sapiens
caaattttgtgtgttctctagt

SEQ ID NO: 7805594 - DNA, 22 bp, Homo sapiens
gctggggactccccaccatagc

SEQ ID NO: 7805595 - DNA, 22 bp, Homo sapiens
gctggggagaattgggttatct

SEQ ID NO: 7805596 - DNA, 22 bp, Homo sapiens
caagccatattttgaagaatga

SEQ ID NO: 7805597 - DNA, 22 bp, Homo sapiens
caagccatactgggtgaaatca

SEQ ID NO: 7805598 - DNA, 22 bp, Homo sapiens
gctgctggcgctgggcgtccgg

SEQ ID NO: 7805599 - DNA, 22 bp, Homo sapiens
gctggaagaatgagtgcctcgt

SEQ ID NO: 7805600 - DNA, 22 bp, Homo sapiens
cactcaatacaatggttggcac

SEQ ID NO: 7805601 - DNA, 21 bp, Homo sapiens
cactcaataaatgtcatatgc

SEQ ID NO: 7805602 - DNA, 22 bp, Homo sapiens
cactctgactggccctgcagga

SEQ ID NO: 7805603 - DNA, 22 bp, Homo sapiens
cagcatctgttcccaacgagat

SEQ ID NO: 7805604 - DNA, 22 bp, Homo sapiens
cagccctctgaagaggcgcttg

SEQ ID NO: 7805605 - DNA, 22 bp, Homo sapiens
gggtcccctcatcatggagact

SEQ ID NO: 7805606 - DNA, 21 bp, Homo sapiens
ggggcagagctaggccctgca

SEQ ID NO: 7805607 - DNA, 22 bp, Homo sapiens
gggcaggggtcagtggccccaa

SEQ ID NO: 7805608 - DNA, 22 bp, Homo sapiens
cagagacacttaacaggaatgg

SEQ ID NO: 7805609 - DNA, 22 bp, Homo sapiens
gggaggcagtgctggaggctgg

SEQ ID NO: 7805610 - DNA, 22 bp, Homo sapiens
cagacaaagcggaaactgttta

SEQ ID NO: 7805611 - DNA, 22 bp, Homo sapiens
cagggctagggagccctcctgg

SEQ ID NO: 7805612 - DNA, 22 bp, Homo sapiens
taggagagctgaactattgtct

SEQ ID NO: 7805613 - DNA, 22 bp, Homo sapiens
tagctattcacttgttgatgga

SEQ ID NO: 7805614 - DNA, 22 bp, Homo sapiens
tatattgtaggtgctatttgaa

SEQ ID NO: 7805615 - DNA, 22 bp, Homo sapiens
taggtaggtgcaattaaaagta

SEQ ID NO: 7805616 - DNA, 22 bp, Homo sapiens
tactcatttcaaacagcacaaa

SEQ ID NO: 7805617 - DNA, 22 bp, Homo sapiens
tactcagtcagattcaacctag

SEQ ID NO: 7805618 - DNA, 22 bp, Homo sapiens
tactcacattctgtttcttgct

SEQ ID NO: 7805619 - DNA, 20 bp, Homo sapiens
tactcacaaatggtttagca

SEQ ID NO: 7805620 - DNA, 22 bp, Homo sapiens
tactcaatctaggtggcttacc

SEQ ID NO: 7805621 - DNA, 22 bp, Homo sapiens
tactcaatgaagtagcctggtt

SEQ ID NO: 7805622 - DNA, 22 bp, Homo sapiens
tactcaatttcttatgggtttc

SEQ ID NO: 7805623 - DNA, 22 bp, Homo sapiens
tactatttttgcaacgtataca

SEQ ID NO: 7805624 - DNA, 22 bp, Homo sapiens
tactcaaactcactaagacaga

SEQ ID NO: 7805625 - DNA, 22 bp, Homo sapiens
tagcaagatgtcactccaagtt

SEQ ID NO: 7805626 - DNA, 22 bp, Homo sapiens
cagggcacagatcggggcgcac

SEQ ID NO: 7805627 - DNA, 20 bp, Homo sapiens
cagggcacactgcagcctcg

SEQ ID NO: 7805628 - DNA, 22 bp, Homo sapiens
cagggcacttaaattgcctcgt

SEQ ID NO: 7805629 - DNA, 22 bp, Homo sapiens
tagaatcaagcagtagagcaga

SEQ ID NO: 7805630 - DNA, 23 bp, Homo sapiens
tcatgagtggctgcggggctgag

SEQ ID NO: 7805631 - DNA, 22 bp, Homo sapiens
tcatgaaaatagatcagaaatt

SEQ ID NO: 7805632 - DNA, 22 bp, Homo sapiens
catgaaaaatttactgttaaca

SEQ ID NO: 7805633 - DNA, 22 bp, Homo sapiens
tcattcttgatcactagttagt

SEQ ID NO: 7805634 - DNA, 22 bp, Homo sapiens
catttgtatagtgcttagacca

SEQ ID NO: 7805635 - DNA, 22 bp, Homo sapiens
cattcattagaatagatatgta

SEQ ID NO: 7805636 - DNA, 22 bp, Homo sapiens
tctctgggacactgggtcagtt

SEQ ID NO: 7805637 - DNA, 22 bp, Homo sapiens
tcgctcaggcttgagtgtagtg

SEQ ID NO: 7805638 - DNA, 22 bp, Homo sapiens
cctcacatgaatgtaagctcca

SEQ ID NO: 7805639 - DNA, 20 bp, Homo sapiens
cctcacagggcagagagggg

SEQ ID NO: 7805640 - DNA, 22 bp, Homo sapiens
cctcacagggccaggcccctca

SEQ ID NO: 7805641 - DNA, 20 bp, Homo sapiens
tggaaggcatctgcattatt

SEQ ID NO: 7805642 - DNA, 22 bp, Homo sapiens
tgctttcagctggtaaagaaac

SEQ ID NO: 7805643 - DNA, 22 bp, Homo sapiens
tgctttcaatgaattgtatact

SEQ ID NO: 7805644 - DNA, 22 bp, Homo sapiens
cctgaatactggtgctgaaagt

SEQ ID NO: 7805645 - DNA, 22 bp, Homo sapiens
tggggtacttgtatcaaagcac

SEQ ID NO: 7805646 - DNA, 22 bp, Homo sapiens
tgtaatttcctgatgttagaac

SEQ ID NO: 7805647 - DNA, 22 bp, Homo sapiens
cctgctgttagatttcagtcac

SEQ ID NO: 7805648 - DNA, 22 bp, Homo sapiens
cctgctggtgtccaggctttgg

SEQ ID NO: 7805649 - DNA, 22 bp, Homo sapiens
tgaaagcttgttggaaatgtag

SEQ ID NO: 7805650 - DNA, 22 bp, Homo sapiens
tgagagttattctgaatttagc

SEQ ID NO: 7805651 - DNA, 23 bp, Homo sapiens
tgcctcagtggaatgtgagggtg

SEQ ID NO: 7805652 - DNA, 22 bp, Homo sapiens
tgcatattgtgaaaatgtagat

SEQ ID NO: 7805653 - DNA, 22 bp, Homo sapiens
cccacaggcaggtgcatgggct

SEQ ID NO: 7805654 - DNA, 22 bp, Homo sapiens
tttgcaaacacttaagaagaga

SEQ ID NO: 7805655 - DNA, 22 bp, Homo sapiens
tttgcaaagaaattattgctgt

SEQ ID NO: 7805656 - DNA, 22 bp, Homo sapiens
ctctgcacacaagtaatttcat

SEQ ID NO: 7805657 - DNA, 23 bp, Homo sapiens
ctctgcaccaggtggttttcagc

SEQ ID NO: 7805658 - DNA, 22 bp, Homo sapiens
tttggaataatcagatcctagt

SEQ ID NO: 7805659 - DNA, 22 bp, Homo sapiens
ctctggctatggcacggcgctc

SEQ ID NO: 7805660 - DNA, 22 bp, Homo sapiens
ctctgtgtatccaagttcaggt

SEQ ID NO: 7805661 - DNA, 21 bp, Homo sapiens
ttttgctgaatggacacgtgc

SEQ ID NO: 7805662 - DNA, 22 bp, Homo sapiens
ttttctcttccctctggacctg

SEQ ID NO: 7805663 - DNA, 17 bp, Homo sapiens
ttttctctcttggattc

SEQ ID NO: 7805664 - DNA, 22 bp, Homo sapiens
tttctcaacctcaacactattt

SEQ ID NO: 7805665 - DNA, 22 bp, Homo sapiens
tttcatgtttatggaaaatgag

SEQ ID NO: 7805666 - DNA, 22 bp, Homo sapiens
tttcatgttacatttaaaatgt

SEQ ID NO: 7805667 - DNA, 22 bp, Homo sapiens
tttcagaaatggcactgaaatc

SEQ ID NO: 7805668 - DNA, 22 bp, Homo sapiens
tttcatgttacagtgtaaaagt

SEQ ID NO: 7805669 - DNA, 22 bp, Homo sapiens
ctggagagttggaagatggact

SEQ ID NO: 7805670 - DNA, 22 bp, Homo sapiens
ctatagaaaattgtatcacacg

SEQ ID NO: 7805671 - DNA, 22 bp, Homo sapiens
ctagagaaaatgttaatacagt

SEQ ID NO: 7805672 - DNA, 23 bp, Homo sapiens
ttctggaagatttacttgagaca

SEQ ID NO: 7805673 - DNA, 22 bp, Homo sapiens
ttggaaggcagcatttgtccat

SEQ ID NO: 7805674 - DNA, 22 bp, Homo sapiens
ttggatccatctcaggcatagg

SEQ ID NO: 7805675 - DNA, 22 bp, Homo sapiens
ttggaagggaacaccatttgac

SEQ ID NO: 7805676 - DNA, 23 bp, Homo sapiens
ttggaagggaagagcatttgaga

SEQ ID NO: 7805677 - DNA, 22 bp, Homo sapiens
ttggaagggatattggcatatg

SEQ ID NO: 7805678 - DNA, 22 bp, Homo sapiens
ttatatttctggtagccttcag

SEQ ID NO: 7805679 - DNA, 22 bp, Homo sapiens
ccttagcaactgtcatagagca

SEQ ID NO: 7805680 - DNA, 22 bp, Homo sapiens
ttaaatttctacgtgatccagg

SEQ ID NO: 7805681 - DNA, 22 bp, Homo sapiens
ttaaattttagaaacagactct

SEQ ID NO: 7805682 - DNA, 22 bp, Homo sapiens
ttatttattgtgtacctactgt

SEQ ID NO: 7805683 - DNA, 22 bp, Homo sapiens
ttattgagtatctgcttggtgt

SEQ ID NO: 7805684 - DNA, 19 bp, Homo sapiens
gaatgtttgtattcagcgc

SEQ ID NO: 7805685 - DNA, 22 bp, Homo sapiens
gaatgcttggaacctgaagttc

SEQ ID NO: 7805686 - DNA, 22 bp, Homo sapiens
gaatgctttgggaattcagaat

SEQ ID NO: 7805687 - DNA, 21 bp, Homo sapiens
gacaaacatttcatagcttta

SEQ ID NO: 7805688 - DNA, 22 bp, Homo sapiens
gaattttattactagtcaactg

SEQ ID NO: 7805689 - DNA, 20 bp, Homo sapiens
gaattttatgaacactacca

SEQ ID NO: 7805690 - DNA, 22 bp, Homo sapiens
gacaaatgagacatcaattccc

SEQ ID NO: 7805691 - DNA, 22 bp, Homo sapiens
gagcaaatggagcttgtctact

SEQ ID NO: 7805692 - DNA, 22 bp, Homo sapiens
gagaaagggaacttacagagtg

SEQ ID NO: 7805693 - DNA, 22 bp, Homo sapiens
gaggagagaagctaacggtgct

SEQ ID NO: 7805694 - DNA, 22 bp, Homo sapiens
gagctcattgtggatggatggg

SEQ ID NO: 7805695 - DNA, 22 bp, Homo sapiens
gagtaaggctgctgatggagtg

SEQ ID NO: 7805696 - DNA, 22 bp, Homo sapiens
gagggtgggctcctatctgggt

SEQ ID NO: 7805697 - DNA, 22 bp, Homo sapiens
gagggccagcagcctcagcatg

SEQ ID NO: 7805698 - DNA, 22 bp, Homo sapiens
ctggttcccagcaggagtgtag

SEQ ID NO: 7805699 - DNA, 22 bp, Homo sapiens
ctgggtggaaagtgctgagaat

SEQ ID NO: 7805700 - DNA, 22 bp, Homo sapiens
ctggtgtccagcatgtgtggaa

SEQ ID NO: 7805701 - DNA, 23 bp, Homo sapiens
gaaatgtttcttgattaatccta

SEQ ID NO: 7805702 - DNA, 22 bp, Homo sapiens
gaagaagacatggaacaatagt

SEQ ID NO: 7805703 - DNA, 22 bp, Homo sapiens
gaaaaatgagctgatgtcaggg

SEQ ID NO: 7805704 - DNA, 22 bp, Homo sapiens
gaaaaatgagctgatgtcaggg

SEQ ID NO: 7805705 - DNA, 22 bp, Homo sapiens
cttttgttctacagctggggaa

SEQ ID NO: 7805706 - DNA, 23 bp, Homo sapiens
ctttggcactttacaataaactc

SEQ ID NO: 7805707 - DNA, 22 bp, Homo sapiens
ctttttctgatgttccatgatt

SEQ ID NO: 7805708 - DNA, 22 bp, Homo sapiens
ctttttcttctaggtgtgcctg

SEQ ID NO: 7805709 - DNA, 20 bp, Homo sapiens
ctttttctccagctctgagc

SEQ ID NO: 7805710 - DNA, 22 bp, Homo sapiens
ctttggagaagaatgcatcctt

SEQ ID NO: 7805711 - DNA, 22 bp, Homo sapiens
ctttggaagtgatagatatgat

SEQ ID NO: 7805712 - DNA, 22 bp, Homo sapiens
ctttggaagtgaccacaatcct

SEQ ID NO: 7805713 - DNA, 22 bp, Homo sapiens
ctttggaaggaacaggattctc

SEQ ID NO: 7805714 - DNA, 22 bp, Homo sapiens
ctttggaaggaagacctttcag

SEQ ID NO: 7805715 - DNA, 22 bp, Homo sapiens
ctttggaagccaggcagttcac

SEQ ID NO: 7805716 - DNA, 22 bp, Homo sapiens
cttcacagtaaatccagaagaa

SEQ ID NO: 7805717 - DNA, 20 bp, Homo sapiens
cttcttcagcctatgcttca

SEQ ID NO: 7805718 - DNA, 22 bp, Homo sapiens
ctttctctgtgtggtaaagggc

SEQ ID NO: 7805719 - DNA, 22 bp, Homo sapiens
ctttctctgtggtgaggagggt

SEQ ID NO: 7805720 - DNA, 22 bp, Homo sapiens
ctttctctggaggggagtggtt

SEQ ID NO: 7805721 - DNA, 22 bp, Homo sapiens
ctttctcttacccaaggatctg

SEQ ID NO: 7805722 - DNA, 22 bp, Homo sapiens
ctttctctgtgtttcacatgct

SEQ ID NO: 7805723 - DNA, 22 bp, Homo sapiens
gctgctgggtccctctgtgcca

SEQ ID NO: 7805724 - DNA, 19 bp, Homo sapiens
gctgctggctctggctgga

SEQ ID NO: 7805725 - DNA, 22 bp, Homo sapiens
gctgctgggaatgaacagtgtt

SEQ ID NO: 7805726 - DNA, 22 bp, Homo sapiens
gctgctggaagcatgcgatgaa

SEQ ID NO: 7805727 - DNA, 22 bp, Homo sapiens
ggaggaggcggcagaagttcct

SEQ ID NO: 7805728 - DNA, 22 bp, Homo sapiens
ggaaaaatgacacatatctcaa

SEQ ID NO: 7805729 - DNA, 22 bp, Homo sapiens
ggacagggctcttggcactcct

SEQ ID NO: 7805730 - DNA, 23 bp, Homo sapiens
ggacagggccctgccctatggcc

SEQ ID NO: 7805731 - DNA, 22 bp, Homo sapiens
gctggtcccaatgtgtttcctt

SEQ ID NO: 7805732 - DNA, 22 bp, Homo sapiens
gctggtccacatcctggtacgt

SEQ ID NO: 7805733 - DNA, 22 bp, Homo sapiens
gcttaaagttgtaaattagaga

SEQ ID NO: 7805734 - DNA, 22 bp, Homo sapiens
gcttttttgctattgaagtggt

SEQ ID NO: 7805735 - DNA, 22 bp, Homo sapiens
gcttttttgggatgcctgcctt

SEQ ID NO: 7805736 - DNA, 22 bp, Homo sapiens
gcagggtgtgtctcatacagtt

SEQ ID NO: 7805737 - DNA, 22 bp, Homo sapiens
gcagagtgagccgaggctgctc

SEQ ID NO: 7805738 - DNA, 22 bp, Homo sapiens
gcagagtgaagggagaggtgtg

SEQ ID NO: 7805739 - DNA, 22 bp, Homo sapiens
gcatttaaatttgaacttcaga

SEQ ID NO: 7805740 - DNA, 22 bp, Homo sapiens
gcattcttcacagtattcctcc

SEQ ID NO: 7805741 - DNA, 22 bp, Homo sapiens
gcattcttggtggagtgctaaa

SEQ ID NO: 7805742 - DNA, 20 bp, Homo sapiens
gggcagagccagccagtccc

SEQ ID NO: 7805743 - DNA, 21 bp, Homo sapiens
gggcagaggggcctcctgggt

SEQ ID NO: 7805744 - DNA, 22 bp, Homo sapiens
gggcagaggctctggcccatcc

SEQ ID NO: 7805745 - DNA, 22 bp, Homo sapiens
gggaagcagacggcggggaaat

SEQ ID NO: 7805746 - DNA, 18 bp, Homo sapiens
ggctgtgcgtggaggctg

SEQ ID NO: 7805747 - DNA, 22 bp, Homo sapiens
ggtgagaggcagtgctgtggaa

SEQ ID NO: 7805748 - DNA, 22 bp, Homo sapiens
ggtccctgaagaggcctggggt

SEQ ID NO: 7805749 - DNA, 22 bp, Homo sapiens
ggtccctgcccacctgggagct

SEQ ID NO: 7805750 - DNA, 22 bp, Homo sapiens
ggggaggccagtggaccgtccc

SEQ ID NO: 7805751 - DNA, 22 bp, Homo sapiens
gtatttttaggtaaggaaagta

SEQ ID NO: 7805752 - DNA, 22 bp, Homo sapiens
gtgccagaggcagtgaggagtt

SEQ ID NO: 7805753 - DNA, 22 bp, Homo sapiens
tcccaaatataatgcaagagac

SEQ ID NO: 7805754 - DNA, 22 bp, Homo sapiens
tcctgccctcgggggtgttcca

SEQ ID NO: 7805755 - DNA, 22 bp, Homo sapiens
tcatacattcagcagatatttg

SEQ ID NO: 7805756 - DNA, 22 bp, Homo sapiens
tcatctgttgattttaagtctt

SEQ ID NO: 7805757 - DNA, 22 bp, Homo sapiens
tcatttaattggttttgctcgt

SEQ ID NO: 7805758 - DNA, 22 bp, Homo sapiens
tcatttacagactgtgtgggtg

SEQ ID NO: 7805759 - DNA, 22 bp, Homo sapiens
tcatttctgttgtgcatcactg

SEQ ID NO: 7805760 - DNA, 22 bp, Homo sapiens
tcatttcagccatttttaaatg

SEQ ID NO: 7805761 - DNA, 22 bp, Homo sapiens
tcaacactaaagaataatcttt

SEQ ID NO: 7805762 - DNA, 21 bp, Homo sapiens
tcagaattacccctggatctg

SEQ ID NO: 7805763 - DNA, 22 bp, Homo sapiens
tcagaattttctggaatggagc

SEQ ID NO: 7805764 - DNA, 22 bp, Homo sapiens
tcagcatcaggttgtctgaatt

SEQ ID NO: 7805765 - DNA, 19 bp, Homo sapiens
tcagcatcaatttggtcct

SEQ ID NO: 7805766 - DNA, 22 bp, Homo sapiens
taaatgcaagggaaaggcaaga

SEQ ID NO: 7805767 - DNA, 22 bp, Homo sapiens
taaatgcaagtgctcctgggag

SEQ ID NO: 7805768 - DNA, 22 bp, Homo sapiens
taaatgatttatgtatgtgaaa

SEQ ID NO: 7805769 - DNA, 22 bp, Homo sapiens
taaatgcaaagcttggcgctta

SEQ ID NO: 7805770 - DNA, 20 bp, Homo sapiens
taaatgcatctgttcaactg

SEQ ID NO: 7805771 - DNA, 22 bp, Homo sapiens
taaatgcagttagtacttgcca

SEQ ID NO: 7805772 - DNA, 20 bp, Homo sapiens
taaatgcatgaatgtaaggc

SEQ ID NO: 7805773 - DNA, 18 bp, Homo sapiens
taaatgcatgttaataac

SEQ ID NO: 7805774 - DNA, 22 bp, Homo sapiens
taaatgcagtacaaattgttct

SEQ ID NO: 7805775 - DNA, 22 bp, Homo sapiens
taaatgcagcagtttctgttct

SEQ ID NO: 7805776 - DNA, 22 bp, Homo sapiens
taaatgcagattcctgagccta

SEQ ID NO: 7805777 - DNA, 22 bp, Homo sapiens
taaatgcaatgtgctttaccag

SEQ ID NO: 7805778 - DNA, 22 bp, Homo sapiens
taagacaaatactatttcaaga

SEQ ID NO: 7805779 - DNA, 22 bp, Homo sapiens
gtttattatacaacaaaagcta

SEQ ID NO: 7805780 - DNA, 22 bp, Homo sapiens
gttaaattcgatgatggataaa

SEQ ID NO: 7805781 - DNA, 22 bp, Homo sapiens
gttaaatgcagattctgactca

SEQ ID NO: 7805782 - DNA, 22 bp, Homo sapiens
gttcttcagtcacatcacagaa

SEQ ID NO: 7805783 - DNA, 22 bp, Homo sapiens
gttcttcaggctgtgctctaga

SEQ ID NO: 7805784 - DNA, 22 bp, Homo sapiens
tacaagaaactacatgaatgca

SEQ ID NO: 7805785 - DNA, 22 bp, Homo sapiens
taatagtttcataatgtgcttc

SEQ ID NO: 7805786 - DNA, 22 bp, Homo sapiens
taagctgtgggagattggcata

SEQ ID NO: 7805787 - DNA, 22 bp, Homo sapiens
taagccatacatttcagactct

SEQ ID NO: 7805788 - DNA, 22 bp, Homo sapiens
taatttatgatgcaaagaaaag

SEQ ID NO: 7805789 - DNA, 22 bp, Homo sapiens
tacagtctctgataactgtcag

SEQ ID NO: 7805790 - DNA, 21 bp, Homo sapiens
tacagtctcccctgttgtcca

SEQ ID NO: 7805791 - DNA, 22 bp, Homo sapiens
tacatgcttctatatgtgaagt

SEQ ID NO: 7805792 - DNA, 20 bp, Homo sapiens
taccaacagcaggaagcata

SEQ ID NO: 7805793 - DNA, 22 bp, Homo sapiens
tacagttaaaaagttcaatggt

SEQ ID NO: 7805794 - DNA, 22 bp, Homo sapiens
taccatttgagagagaacataa

SEQ ID NO: 7805795 - DNA, 22 bp, Homo sapiens
taccatttcagtaaaaacttag

SEQ ID NO: 7805796 - DNA, 22 bp, Homo sapiens
tatcatttaacagaatcattgc

SEQ ID NO: 7805797 - DNA, 22 bp, Homo sapiens
tataaagtgtgaactgtgagta

SEQ ID NO: 7805798 - DNA, 22 bp, Homo sapiens
tatcattttactgtgacatttt

SEQ ID NO: 7805799 - DNA, 22 bp, Homo sapiens
tatgtatagagtcttttaaatt

SEQ ID NO: 7805800 - DNA, 22 bp, Homo sapiens
tcaaagagctattcagttgtgg

SEQ ID NO: 7805801 - DNA, 22 bp, Homo sapiens
tatttgcaacataaaactctga

SEQ ID NO: 7805802 - DNA, 22 bp, Homo sapiens
tatttgcaggcttttgtcatgg

SEQ ID NO: 7805803 - DNA, 23 bp, Homo sapiens
tatttgctactggtaattctgga

SEQ ID NO: 7805804 - DNA, 23 bp, Homo sapiens
tattttccaaatgatgactacat

SEQ ID NO: 7805805 - DNA, 22 bp, Homo sapiens
tagcaaataaaacagtattgaa

SEQ ID NO: 7805806 - DNA, 22 bp, Homo sapiens
tagcaaaggatgactatgtacc

SEQ ID NO: 7805807 - DNA, 22 bp, Homo sapiens
tagcaaatgtgttatgctatgc

SEQ ID NO: 7805808 - DNA, 22 bp, Homo sapiens
tagcaagaaaacacaagaatta

SEQ ID NO: 7805809 - DNA, 22 bp, Homo sapiens
tagagtcctgtgtgctctgtgg

SEQ ID NO: 7805810 - DNA, 22 bp, Homo sapiens
tagagtccttcattctgtgcag

SEQ ID NO: 7805811 - DNA, 22 bp, Homo sapiens
tagtgcttattactgtgctgtc

SEQ ID NO: 7805812 - DNA, 22 bp, Homo sapiens
tagtgcttaacacaaagtgatt

SEQ ID NO: 7805813 - DNA, 22 bp, Homo sapiens
ttttaatactgctattgtagga

SEQ ID NO: 7805814 - DNA, 22 bp, Homo sapiens
ttttaagaaatgtatgactgtc

SEQ ID NO: 7805815 - DNA, 22 bp, Homo sapiens
tttgtaaaaggaggaagcatgg

SEQ ID NO: 7805816 - DNA, 22 bp, Homo sapiens
ttttccaaagtaccatgtccct

SEQ ID NO: 7805817 - DNA, 22 bp, Homo sapiens
ttttccaaattagaagtagaga

SEQ ID NO: 7805818 - DNA, 22 bp, Homo sapiens
ttttcattgttcctcgagcatt

SEQ ID NO: 7805819 - DNA, 22 bp, Homo sapiens
ttttctgacctatctacattta

SEQ ID NO: 7805820 - DNA, 22 bp, Homo sapiens
tttgacaaataggggaataagg

SEQ ID NO: 7805821 - DNA, 22 bp, Homo sapiens
tttgacaaaggaaaaatgcaca

SEQ ID NO: 7805822 - DNA, 22 bp, Homo sapiens
tttgaagactactgggagtgaa

SEQ ID NO: 7805823 - DNA, 22 bp, Homo sapiens
tttgaaagggttatgagactga

SEQ ID NO: 7805824 - DNA, 22 bp, Homo sapiens
tttgataatacacaagagaaag

SEQ ID NO: 7805825 - DNA, 22 bp, Homo sapiens
ttcaaacagttgcacaacttat

SEQ ID NO: 7805826 - DNA, 22 bp, Homo sapiens
ttcaaacagatgactctgctct

SEQ ID NO: 7805827 - DNA, 22 bp, Homo sapiens
ttattgacttgtttgtcctggt

SEQ ID NO: 7805828 - DNA, 22 bp, Homo sapiens
ttattctttaaacatatatgtt

SEQ ID NO: 7805829 - DNA, 22 bp, Homo sapiens
ttaggaaacgctgctattgact

SEQ ID NO: 7805830 - DNA, 17 bp, Homo sapiens
ttatactcgtaggtgga

SEQ ID NO: 7805831 - DNA, 22 bp, Homo sapiens
ttcatttttaccgcgtgtcaaa

SEQ ID NO: 7805832 - DNA, 22 bp, Homo sapiens
ttcattgtagcttgactaatta

SEQ ID NO: 7805833 - DNA, 22 bp, Homo sapiens
ttcatttaatcagaatctctaa

SEQ ID NO: 7805834 - DNA, 22 bp, Homo sapiens
ttcagttttgcttttaatcatg

SEQ ID NO: 7805835 - DNA, 22 bp, Homo sapiens
ttcttatattgggtcatggata

SEQ ID NO: 7805836 - DNA, 22 bp, Homo sapiens
ttctggaagtgttagaatctgg

SEQ ID NO: 7805837 - DNA, 19 bp, Homo sapiens
ttgaaattgtttgatatgg

SEQ ID NO: 7805838 - DNA, 22 bp, Homo sapiens
ttgaaattgggtgtggctgtca

SEQ ID NO: 7805839 - DNA, 22 bp, Homo sapiens
ttgaaatggcagcagctgacct

SEQ ID NO: 7805840 - DNA, 20 bp, Homo sapiens
ttgaaattggatggtagcta

SEQ ID NO: 7805841 - DNA, 22 bp, Homo sapiens
ttgaacaatttggtatacaaac

SEQ ID NO: 7805842 - DNA, 22 bp, Homo sapiens
ttcttattcttgaaatgtggga

SEQ ID NO: 7805843 - DNA, 23 bp, Homo sapiens
ttcttatttactttggaatctcc

SEQ ID NO: 7805844 - DNA, 22 bp, Homo sapiens
ttcttcaaagatgtctgttgga

SEQ ID NO: 7805845 - DNA, 22 bp, Homo sapiens
ttcttcaaagtccttattcctt

SEQ ID NO: 7805846 - DNA, 21 bp, Homo sapiens
ttcctggggacttccgtggga

SEQ ID NO: 7805847 - DNA, 22 bp, Homo sapiens
ttcctgggtggtcctggtagag

SEQ ID NO: 7805848 - DNA, 22 bp, Homo sapiens
ttccttggtagagagaatattt

SEQ ID NO: 7805849 - DNA, 22 bp, Homo sapiens
ttctccaagtagaagctaagtt

SEQ ID NO: 7805850 - DNA, 22 bp, Homo sapiens
ttctccaacacaagcatgatgt

SEQ ID NO: 7805851 - DNA, 22 bp, Homo sapiens
ttctctgcagctcctggctggg

SEQ ID NO: 7805852 - DNA, 21 bp, Homo sapiens
ttggaacaagcagcagtttgc

SEQ ID NO: 7805853 - DNA, 22 bp, Homo sapiens
ttgcttatttgattaaatgtct

SEQ ID NO: 7805854 - DNA, 22 bp, Homo sapiens
ttggaaagcaagctggacatac

SEQ ID NO: 7805855 - DNA, 22 bp, Homo sapiens
tttaccaaagtactctgaggca

SEQ ID NO: 7805856 - DNA, 22 bp, Homo sapiens
tttagagaccctctgctatttt

SEQ ID NO: 7805857 - DNA, 22 bp, Homo sapiens
tttagagagaaataaatgagat

SEQ ID NO: 7805858 - DNA, 23 bp, Homo sapiens
tttatattcctaatgtcttgagc

SEQ ID NO: 7805859 - DNA, 22 bp, Homo sapiens
tttatcatcttgtttttaaagc

SEQ ID NO: 7805860 - DNA, 22 bp, Homo sapiens
tttaagattcagtaaggcaaac

SEQ ID NO: 7805861 - DNA, 22 bp, Homo sapiens
tttaagatggtattttataaag

SEQ ID NO: 7805862 - DNA, 22 bp, Homo sapiens
tttaagcacagggataaagtta

SEQ ID NO: 7805863 - DNA, 22 bp, Homo sapiens
tttcatgtgttgaatgtgtaca

SEQ ID NO: 7805864 - DNA, 22 bp, Homo sapiens
tttcatgtggcgatgtctctgg

SEQ ID NO: 7805865 - DNA, 22 bp, Homo sapiens
tttcatgtgcaattagcaatat

SEQ ID NO: 7805866 - DNA, 22 bp, Homo sapiens
tttcatgtctgaattctttagt

SEQ ID NO: 7805867 - DNA, 22 bp, Homo sapiens
tttcagagaactgagtccttgc

SEQ ID NO: 7805868 - DNA, 22 bp, Homo sapiens
tttcagagatgtctagcctatt

SEQ ID NO: 7805869 - DNA, 22 bp, Homo sapiens
tttcagagcctttatctctcta

SEQ ID NO: 7805870 - DNA, 22 bp, Homo sapiens
tttcacacaacgtgaatatact

SEQ ID NO: 7805871 - DNA, 22 bp, Homo sapiens
tttcaacagctctcaaatgatc

SEQ ID NO: 7805872 - DNA, 22 bp, Homo sapiens
tttcaacatataccataatgcc

SEQ ID NO: 7805873 - DNA, 22 bp, Homo sapiens
aatgcacaaaaattgtatgtaa

SEQ ID NO: 7805874 - DNA, 22 bp, Homo sapiens
aatgcattttattatatgtgac

SEQ ID NO: 7805875 - DNA, 18 bp, Homo sapiens
aatgcatttatggagatg

SEQ ID NO: 7805876 - DNA, 22 bp, Homo sapiens
aatgcacaaaggtgtctattgc

SEQ ID NO: 7805877 - DNA, 22 bp, Homo sapiens
aatgcattgttgatttggagtg

SEQ ID NO: 7805878 - DNA, 22 bp, Homo sapiens
aatagcttttgtatgatgaaat

SEQ ID NO: 7805879 - DNA, 22 bp, Homo sapiens
aatagtaaaagatacagctaat

SEQ ID NO: 7805880 - DNA, 22 bp, Homo sapiens
aatagcatgtaagtttaaaaga

SEQ ID NO: 7805881 - DNA, 22 bp, Homo sapiens
agaaagctggagtcaagcagag

SEQ ID NO: 7805882 - DNA, 22 bp, Homo sapiens
agaaaggcagggatgaggattg

SEQ ID NO: 7805883 - DNA, 22 bp, Homo sapiens
aatctacatgcaatatttttag

SEQ ID NO: 7805884 - DNA, 20 bp, Homo sapiens
aatcctgggacagaggcagg

SEQ ID NO: 7805885 - DNA, 22 bp, Homo sapiens
aatcctggcctagctgggctca

SEQ ID NO: 7805886 - DNA, 22 bp, Homo sapiens
agaaagggaccagttcttttga

SEQ ID NO: 7805887 - DNA, 22 bp, Homo sapiens
agaaagggaactggcaaagcca

SEQ ID NO: 7805888 - DNA, 22 bp, Homo sapiens
agaaagggatgaggtagctgct

SEQ ID NO: 7805889 - DNA, 22 bp, Homo sapiens
agaaagggagcgtggatcaatt

SEQ ID NO: 7805890 - DNA, 22 bp, Homo sapiens
agaaagggagagccagcacacg

SEQ ID NO: 7805891 - DNA, 22 bp, Homo sapiens
aagtgggtcagggacagatctt

SEQ ID NO: 7805892 - DNA, 22 bp, Homo sapiens
aagtgtttacttaaagtcatgg

SEQ ID NO: 7805893 - DNA, 22 bp, Homo sapiens
aaggcattacctaagtttggga

SEQ ID NO: 7805894 - DNA, 22 bp, Homo sapiens
aaggaatcacttctttaaatga

SEQ ID NO: 7805895 - DNA, 22 bp, Homo sapiens
acatttcagtgagctattgaag

SEQ ID NO: 7805896 - DNA, 22 bp, Homo sapiens
acatttcagcgtgcatgacatg

SEQ ID NO: 7805897 - DNA, 22 bp, Homo sapiens
acatttcagatgtaatgtgatg

SEQ ID NO: 7805898 - DNA, 22 bp, Homo sapiens
agagaagggcctgtatgtaatc

SEQ ID NO: 7805899 - DNA, 22 bp, Homo sapiens
aatgtataaccataggaaattt

SEQ ID NO: 7805900 - DNA, 22 bp, Homo sapiens
aatgtatgtgattattcctcta

SEQ ID NO: 7805901 - DNA, 23 bp, Homo sapiens
aatgtatgttagtatcttagaga

SEQ ID NO: 7805902 - DNA, 22 bp, Homo sapiens
aatgtatgacagttctagtggt

SEQ ID NO: 7805903 - DNA, 23 bp, Homo sapiens
aattacaaccaagaactggaagg

SEQ ID NO: 7805904 - DNA, 22 bp, Homo sapiens
aatttccagatcagatgactca

SEQ ID NO: 7805905 - DNA, 22 bp, Homo sapiens
acaacagtaggaaaacatgtct

SEQ ID NO: 7805906 - DNA, 22 bp, Homo sapiens
agagtgtgaagaaagtgcaatg

SEQ ID NO: 7805907 - DNA, 22 bp, Homo sapiens
agagtgggttataggcagactt

SEQ ID NO: 7805908 - DNA, 22 bp, Homo sapiens
acaacattcttaaatacactga

SEQ ID NO: 7805909 - DNA, 22 bp, Homo sapiens
acacacaactcattgtgtaata

SEQ ID NO: 7805910 - DNA, 22 bp, Homo sapiens
agccaatgcgtaaaaagatcta

SEQ ID NO: 7805911 - DNA, 22 bp, Homo sapiens
acaatgtaggctgaaaaagctt

SEQ ID NO: 7805912 - DNA, 22 bp, Homo sapiens
aagagtttccagttgtggctca

SEQ ID NO: 7805913 - DNA, 22 bp, Homo sapiens
acacagagccagggaatacagt

SEQ ID NO: 7805914 - DNA, 22 bp, Homo sapiens
aatctggtctaagtgaggatag

SEQ ID NO: 7805915 - DNA, 22 bp, Homo sapiens
aatgcacatatatttccttatt

SEQ ID NO: 7805916 - DNA, 22 bp, Homo sapiens
aatgcttattattaatagaatg

SEQ ID NO: 7805917 - DNA, 22 bp, Homo sapiens
aatgcagtttcatttgtagaat

SEQ ID NO: 7805918 - DNA, 19 bp, Homo sapiens
aatgcttaggacagtgcct

SEQ ID NO: 7805919 - DNA, 22 bp, Homo sapiens
aactttaaggctataaattatg

SEQ ID NO: 7805920 - DNA, 22 bp, Homo sapiens
aataatgtacatacatatttcg

SEQ ID NO: 7805921 - DNA, 22 bp, Homo sapiens
aataatgtctgctattttaaaa

SEQ ID NO: 7805922 - DNA, 22 bp, Homo sapiens
aacagtttatgataaattctta

SEQ ID NO: 7805923 - DNA, 23 bp, Homo sapiens
aatatctgcagctcctggggagg

SEQ ID NO: 7805924 - DNA, 22 bp, Homo sapiens
aatatttctgtagctatgttct

SEQ ID NO: 7805925 - DNA, 22 bp, Homo sapiens
aaatggatggaattgacattta

SEQ ID NO: 7805926 - DNA, 22 bp, Homo sapiens
aaaagccaaggtcctcttcaga

SEQ ID NO: 7805927 - DNA, 22 bp, Homo sapiens
aaaaatgtgaccacagggtgtt

SEQ ID NO: 7805928 - DNA, 22 bp, Homo sapiens
aaaaatgttatctactgtccga

SEQ ID NO: 7805929 - DNA, 22 bp, Homo sapiens
aaaaatttatggttcttctctg

SEQ ID NO: 7805930 - DNA, 22 bp, Homo sapiens
aaaacattgaattgcacactat

SEQ ID NO: 7805931 - DNA, 22 bp, Homo sapiens
aaaacattttactgccatctca

SEQ ID NO: 7805932 - DNA, 22 bp, Homo sapiens
aaaagtgtccagattatgaaga

SEQ ID NO: 7805933 - DNA, 22 bp, Homo sapiens
aaaagtttaagactcattctag

SEQ ID NO: 7805934 - DNA, 22 bp, Homo sapiens
aaaatgatatcctgacttttat

SEQ ID NO: 7805935 - DNA, 22 bp, Homo sapiens
aaaatgatgctgtaatttggca

SEQ ID NO: 7805936 - DNA, 20 bp, Homo sapiens
aaaatgatgggcagggcagg

SEQ ID NO: 7805937 - DNA, 22 bp, Homo sapiens
aaaatgcaaacctacctacata

SEQ ID NO: 7805938 - DNA, 18 bp, Homo sapiens
aaaatgcaggcgacatgg

SEQ ID NO: 7805939 - DNA, 22 bp, Homo sapiens
aaaatgcatgagaatgtgctcg

SEQ ID NO: 7805940 - DNA, 22 bp, Homo sapiens
aaagcaatggatgagaatctgt

SEQ ID NO: 7805941 - DNA, 22 bp, Homo sapiens
aaatgtctgagacttctgaact

SEQ ID NO: 7805942 - DNA, 22 bp, Homo sapiens
aaatggtgttgtatttagtctc

SEQ ID NO: 7805943 - DNA, 22 bp, Homo sapiens
aaatgtctgagacttctgaact

SEQ ID NO: 7805944 - DNA, 22 bp, Homo sapiens
aaatgtctgtatgagaaagaga

SEQ ID NO: 7805945 - DNA, 22 bp, Homo sapiens
aaatgtctttgagtatttctgc

SEQ ID NO: 7805946 - DNA, 22 bp, Homo sapiens
aaatgtctttcaatagagaaat

SEQ ID NO: 7805947 - DNA, 22 bp, Homo sapiens
aaatgtctttatctcatgtaac

SEQ ID NO: 7805948 - DNA, 22 bp, Homo sapiens
aaaattgtcgaacagtagtaac

SEQ ID NO: 7805949 - DNA, 22 bp, Homo sapiens
aaaattttcagcttgacttgat

SEQ ID NO: 7805950 - DNA, 22 bp, Homo sapiens
aaaattttactggtgtttcctt

SEQ ID NO: 7805951 - DNA, 22 bp, Homo sapiens
aaagtacagccacatccaagta

SEQ ID NO: 7805952 - DNA, 22 bp, Homo sapiens
aaagtacaaggaaaggatctga

SEQ ID NO: 7805953 - DNA, 22 bp, Homo sapiens
aaatcagacacagtgaaagtta

SEQ ID NO: 7805954 - DNA, 22 bp, Homo sapiens
aaatcagacacagtgaaagtta

SEQ ID NO: 7805955 - DNA, 22 bp, Homo sapiens
aaatcagagaatatatttagaa

SEQ ID NO: 7805956 - DNA, 22 bp, Homo sapiens
aaatgatgattaaaatgaggta

SEQ ID NO: 7805957 - DNA, 22 bp, Homo sapiens
aaatcagaaaatatggagagga

SEQ ID NO: 7805958 - DNA, 22 bp, Homo sapiens
aaatgcaagttcatattttgtt

SEQ ID NO: 7805959 - DNA, 23 bp, Homo sapiens
aaatgatgtgtgttgtcccattc

SEQ ID NO: 7805960 - DNA, 22 bp, Homo sapiens
aaatgatgtggagtgaaattgt

SEQ ID NO: 7805961 - DNA, 22 bp, Homo sapiens
aaatgatggtactcatgtttag

SEQ ID NO: 7805962 - DNA, 22 bp, Homo sapiens
aaatgatggaaatgaggctgaa

SEQ ID NO: 7805963 - DNA, 20 bp, Homo sapiens
aaatgatgggaataatctat

SEQ ID NO: 7805964 - DNA, 22 bp, Homo sapiens
aaatgatgctcacagattagtg

SEQ ID NO: 7805965 - DNA, 22 bp, Homo sapiens
aaatgatgctacagttttccca

SEQ ID NO: 7805966 - DNA, 22 bp, Homo sapiens
aaatgatgttataagaccagga

SEQ ID NO: 7805967 - DNA, 22 bp, Homo sapiens
aaatgcaaggattttgttaggc

SEQ ID NO: 7805968 - DNA, 22 bp, Homo sapiens
aaatgctgtaactgatattctg

SEQ ID NO: 7805969 - DNA, 22 bp, Homo sapiens
aaatgctgcagctagtgtgttt

SEQ ID NO: 7805970 - DNA, 22 bp, Homo sapiens
aagagagacaataggtagcatt

SEQ ID NO: 7805971 - DNA, 22 bp, Homo sapiens
aagagtttccatgctctgtgct

SEQ ID NO: 7805972 - DNA, 22 bp, Homo sapiens
aagagtttttaatgggtactgg

SEQ ID NO: 7805973 - DNA, 22 bp, Homo sapiens
aagagtttttggagtgtgagtt

SEQ ID NO: 7805974 - DNA, 22 bp, Homo sapiens
aaaggcatgattaattctgtgt

SEQ ID NO: 7805975 - DNA, 18 bp, Homo sapiens
aaaggctgaatatagaag

SEQ ID NO: 7805976 - DNA, 22 bp, Homo sapiens
aaaggcttctttgctccatgtc

SEQ ID NO: 7805977 - DNA, 22 bp, Homo sapiens
aaaggcttgtccagtaagggga

SEQ ID NO: 7805978 - DNA, 22 bp, Homo sapiens
aaaggcttcagtgagtgggtat

SEQ ID NO: 7805979 - DNA, 22 bp, Homo sapiens
aaaggctggggactgaggaagg

SEQ ID NO: 7805980 - DNA, 22 bp, Homo sapiens
aacatgaaacccaaacagaata

SEQ ID NO: 7805981 - DNA, 17 bp, Homo sapiens
atgtatattaactctga

SEQ ID NO: 7805982 - DNA, 22 bp, Homo sapiens
atgtgcaaagggacttgcacat

SEQ ID NO: 7805983 - DNA, 22 bp, Homo sapiens
attaaggaagcctattctctcc

SEQ ID NO: 7805984 - DNA, 22 bp, Homo sapiens
agagctatatacagattattga

SEQ ID NO: 7805985 - DNA, 21 bp, Homo sapiens
atgactgtggcacttaggagg

SEQ ID NO: 7805986 - DNA, 22 bp, Homo sapiens
atgcaaatgtcaccacttctaa

SEQ ID NO: 7805987 - DNA, 22 bp, Homo sapiens
atgcaaattaacatatagtaga

SEQ ID NO: 7805988 - DNA, 22 bp, Homo sapiens
atgctgattttatagaataaag

SEQ ID NO: 7805989 - DNA, 22 bp, Homo sapiens
atgctgataactttcagtgaca

SEQ ID NO: 7805990 - DNA, 22 bp, Homo sapiens
atgccaggagatggagcagagt

SEQ ID NO: 7805991 - DNA, 22 bp, Homo sapiens
atgccattgtatattcattgat

SEQ ID NO: 7805992 - DNA, 22 bp, Homo sapiens
agattgggtttgcttctgtgcc

SEQ ID NO: 7805993 - DNA, 22 bp, Homo sapiens
agattgggattagagatctgta

SEQ ID NO: 7805994 - DNA, 22 bp, Homo sapiens
attttgctttatgtaaatatgt

SEQ ID NO: 7805995 - DNA, 22 bp, Homo sapiens
agatttcaatggatattgcaag

SEQ ID NO: 7805996 - DNA, 22 bp, Homo sapiens
agatgactaacatagtattgct

SEQ ID NO: 7805997 - DNA, 22 bp, Homo sapiens
caaagttttagtaaacatatat

SEQ ID NO: 7805998 - DNA, 22 bp, Homo sapiens
agcaatgaccagtgatcttgta

SEQ ID NO: 7805999 - DNA, 22 bp, Homo sapiens
agcaatgactttgaaatcatga

SEQ ID NO: 7806000 - DNA, 22 bp, Homo sapiens
caaacatttgacttctctcagg

SEQ ID NO: 7806001 - DNA, 22 bp, Homo sapiens
caaacattgggggcttcaacac

SEQ ID NO: 7806002 - DNA, 22 bp, Homo sapiens
caaacattgcactttctgctat

SEQ ID NO: 7806003 - DNA, 22 bp, Homo sapiens
caaacattttctacttccagga

SEQ ID NO: 7806004 - DNA, 22 bp, Homo sapiens
caaacatttgttggaacccctg

SEQ ID NO: 7806005 - DNA, 20 bp, Homo sapiens
agcaaggctggagcttatgg

SEQ ID NO: 7806006 - DNA, 22 bp, Homo sapiens
attttttgttaactcaggatag

SEQ ID NO: 7806007 - DNA, 22 bp, Homo sapiens
agcaagatgcattatttcttat

SEQ ID NO: 7806008 - DNA, 22 bp, Homo sapiens
attttgttgaggtaattgtcaa

SEQ ID NO: 7806009 - DNA, 21 bp, Homo sapiens
attttgtacatagaatttgtc

SEQ ID NO: 7806010 - DNA, 22 bp, Homo sapiens
attctctgctgcactgataaca

SEQ ID NO: 7806011 - DNA, 22 bp, Homo sapiens
attctctggaagaagataaaaa

SEQ ID NO: 7806012 - DNA, 22 bp, Homo sapiens
attctctgggttccagtaaatg

SEQ ID NO: 7806013 - DNA, 22 bp, Homo sapiens
attcttctgcctactttcatcc

SEQ ID NO: 7806014 - DNA, 21 bp, Homo sapiens
attctctgtgatgggattagg

SEQ ID NO: 7806015 - DNA, 20 bp, Homo sapiens
cagagccagggttttgtttt

SEQ ID NO: 7806016 - DNA, 22 bp, Homo sapiens
agccctcttcccagatgcctca

SEQ ID NO: 7806017 - DNA, 22 bp, Homo sapiens
agccctctctttagagatctga

SEQ ID NO: 7806018 - DNA, 20 bp, Homo sapiens
agccctcttccagatgaagg

SEQ ID NO: 7806019 - DNA, 22 bp, Homo sapiens
caattttactcttcctcttcca

SEQ ID NO: 7806020 - DNA, 18 bp, Homo sapiens
caattttacccagtccct

SEQ ID NO: 7806021 - DNA, 22 bp, Homo sapiens
caattttattggtccaaataca

SEQ ID NO: 7806022 - DNA, 22 bp, Homo sapiens
agcaggtggatttagacgggag

SEQ ID NO: 7806023 - DNA, 22 bp, Homo sapiens
agcaggtggccacgaggaggag

SEQ ID NO: 7806024 - DNA, 22 bp, Homo sapiens
acatctctgggtcctccatgca

SEQ ID NO: 7806025 - DNA, 22 bp, Homo sapiens
acatatatgtaaagtactttgt

SEQ ID NO: 7806026 - DNA, 22 bp, Homo sapiens
acagtgaatccaaattcctacc

SEQ ID NO: 7806027 - DNA, 22 bp, Homo sapiens
aggacaggtgtagtgggctctg

SEQ ID NO: 7806028 - DNA, 22 bp, Homo sapiens
aggactggtgtgtgatcagcat

SEQ ID NO: 7806029 - DNA, 23 bp, Homo sapiens
acagggcattgctggcctcgagg

SEQ ID NO: 7806030 - DNA, 21 bp, Homo sapiens
acagggcatgcagctggctgt

SEQ ID NO: 7806031 - DNA, 22 bp, Homo sapiens
acatgtctacacattctgcaat

SEQ ID NO: 7806032 - DNA, 22 bp, Homo sapiens
acatgtcttttaaagtctaata

SEQ ID NO: 7806033 - DNA, 22 bp, Homo sapiens
accagacactgtgaagacaggc

SEQ ID NO: 7806034 - DNA, 22 bp, Homo sapiens
aggtggagacccagagaaggcg

SEQ ID NO: 7806035 - DNA, 22 bp, Homo sapiens
ataaggacacccttctctttac

SEQ ID NO: 7806036 - DNA, 22 bp, Homo sapiens
ataaattttcttgctgtactta

SEQ ID NO: 7806037 - DNA, 22 bp, Homo sapiens
agaaaactgggaggagagcttc

SEQ ID NO: 7806038 - DNA, 22 bp, Homo sapiens
agaaaacttgtcacagctctca

SEQ ID NO: 7806039 - DNA, 22 bp, Homo sapiens
agaaaagggcaggagggataca

SEQ ID NO: 7806040 - DNA, 22 bp, Homo sapiens
agaaatatgctgattagatgaa

SEQ ID NO: 7806041 - DNA, 22 bp, Homo sapiens
atcaagcagtgaaaaatgctag

SEQ ID NO: 7806042 - DNA, 22 bp, Homo sapiens
agaaatgttcttcatttgccat

SEQ ID NO: 7806043 - DNA, 22 bp, Homo sapiens
agaaatgtggatcgttttaaaa

SEQ ID NO: 7806044 - DNA, 22 bp, Homo sapiens
agaaatgtattctgtatgtttt

SEQ ID NO: 7806045 - DNA, 22 bp, Homo sapiens
agaaatgtcaggaaagaagtcc

SEQ ID NO: 7806046 - DNA, 22 bp, Homo sapiens
aggctgcagaggtgctgccaga

SEQ ID NO: 7806047 - DNA, 22 bp, Homo sapiens
agggaccaggggtagctgagat

SEQ ID NO: 7806048 - DNA, 22 bp, Homo sapiens
agggaccagcgtgagtctgagg

SEQ ID NO: 7806049 - DNA, 21 bp, Homo sapiens
agggagctttaggtagaagtt

SEQ ID NO: 7806050 - DNA, 22 bp, Homo sapiens
aggggaatgggtagactgttga

SEQ ID NO: 7806051 - DNA, 22 bp, Homo sapiens
cctcttaattgtactccttcag

SEQ ID NO: 7806052 - DNA, 22 bp, Homo sapiens
agcttagaagtgtgctgagagg

SEQ ID NO: 7806053 - DNA, 22 bp, Homo sapiens
aggaagagcattcacatggtag

SEQ ID NO: 7806054 - DNA, 22 bp, Homo sapiens
aggaagagctggaccagaggac

SEQ ID NO: 7806055 - DNA, 22 bp, Homo sapiens
agctttctgtcacctgtgcttg

SEQ ID NO: 7806056 - DNA, 22 bp, Homo sapiens
agctttcttgattttgcctgta

SEQ ID NO: 7806057 - DNA, 22 bp, Homo sapiens
agctttgcctgctgacattctg

SEQ ID NO: 7806058 - DNA, 22 bp, Homo sapiens
catttctgtcacgttcttttat

SEQ ID NO: 7806059 - DNA, 22 bp, Homo sapiens
ccaatgaaaggtcaattctata

SEQ ID NO: 7806060 - DNA, 22 bp, Homo sapiens
catttctgttctcttcctgtac

SEQ ID NO: 7806061 - DNA, 22 bp, Homo sapiens
catttcaatgccttcaacatag

SEQ ID NO: 7806062 - DNA, 22 bp, Homo sapiens
catacagttttccctagatgtg

SEQ ID NO: 7806063 - DNA, 22 bp, Homo sapiens
catacataccactgctgtcttt

SEQ ID NO: 7806064 - DNA, 22 bp, Homo sapiens
catacaaatgtgtccaggctct

SEQ ID NO: 7806065 - DNA, 22 bp, Homo sapiens
ctagggtcaggggcctgcgtcg

SEQ ID NO: 7806066 - DNA, 22 bp, Homo sapiens
ctacatttttcaccgagcctct

SEQ ID NO: 7806067 - DNA, 22 bp, Homo sapiens
ctacattttaataagctgctta

SEQ ID NO: 7806068 - DNA, 22 bp, Homo sapiens
ctacattttgtgattatgaaat

SEQ ID NO: 7806069 - DNA, 22 bp, Homo sapiens
ctacatttgttctatagctttt

SEQ ID NO: 7806070 - DNA, 22 bp, Homo sapiens
ctacatttcccagctgccttcc

SEQ ID NO: 7806071 - DNA, 22 bp, Homo sapiens
ctacatttgttcaaataagctg

SEQ ID NO: 7806072 - DNA, 22 bp, Homo sapiens
ctacatttggagagtataggaa

SEQ ID NO: 7806073 - DNA, 22 bp, Homo sapiens
ctaagcaagaatgagtgcaaca

SEQ ID NO: 7806074 - DNA, 22 bp, Homo sapiens
aggtaggatagataggaagacc

SEQ ID NO: 7806075 - DNA, 22 bp, Homo sapiens
cctgggcttgcatctgtgctgg

SEQ ID NO: 7806076 - DNA, 22 bp, Homo sapiens
cctggtgctgctatcaggggta

SEQ ID NO: 7806077 - DNA, 22 bp, Homo sapiens
agttaactctgaaaagacattt

SEQ ID NO: 7806078 - DNA, 22 bp, Homo sapiens
ctgaattctgccttgaggcctt

SEQ ID NO: 7806079 - DNA, 22 bp, Homo sapiens
ctctggctttgctcatgcatcc

SEQ ID NO: 7806080 - DNA, 22 bp, Homo sapiens
ctctggcttgttaatgcatatt

SEQ ID NO: 7806081 - DNA, 22 bp, Homo sapiens
ctctggctttaaggatgccaca

SEQ ID NO: 7806082 - DNA, 22 bp, Homo sapiens
ctctggcttgttaatgcatatt

SEQ ID NO: 7806083 - DNA, 22 bp, Homo sapiens
ctctgcgccaccctcgcctgct

SEQ ID NO: 7806084 - DNA, 22 bp, Homo sapiens
ctctgctgagccagagtcccca

SEQ ID NO: 7806085 - DNA, 22 bp, Homo sapiens
ctctgctcagatgatttatcaa

SEQ ID NO: 7806086 - DNA, 22 bp, Homo sapiens
ctctgctgatatagcttttcaa

SEQ ID NO: 7806087 - DNA, 21 bp, Homo sapiens
ctctgctgagtcctaggattc

SEQ ID NO: 7806088 - DNA, 22 bp, Homo sapiens
ctcattctttcacagtctgtgg

SEQ ID NO: 7806089 - DNA, 23 bp, Homo sapiens
agtcttcattgtatttccagacc

SEQ ID NO: 7806090 - DNA, 22 bp, Homo sapiens
ctcctggctttcccagaccagg

SEQ ID NO: 7806091 - DNA, 22 bp, Homo sapiens
ctcctgggaaatgaaggggcag

SEQ ID NO: 7806092 - DNA, 22 bp, Homo sapiens
ctcctgggaatttagttgtgag

SEQ ID NO: 7806093 - DNA, 22 bp, Homo sapiens
ctcctggggccatggaaggaac

SEQ ID NO: 7806094 - DNA, 22 bp, Homo sapiens
ctccctctcaccggagccctgg

SEQ ID NO: 7806095 - DNA, 22 bp, Homo sapiens
ctcctcactttccagactgggc

SEQ ID NO: 7806096 - DNA, 22 bp, Homo sapiens
ctcctacagtgtttgagtccag

SEQ ID NO: 7806097 - DNA, 22 bp, Homo sapiens
ataaatgattcagcaggaaata

SEQ ID NO: 7806098 - DNA, 22 bp, Homo sapiens
atacagtagggaccatgtctga

SEQ ID NO: 7806099 - DNA, 22 bp, Homo sapiens
atagcactggtttttcttggtt

SEQ ID NO: 7806100 - DNA, 22 bp, Homo sapiens
ctggctggccatgtagagatga

SEQ ID NO: 7806101 - DNA, 22 bp, Homo sapiens
ctggctggccatgcagcgccag

SEQ ID NO: 7806102 - DNA, 22 bp, Homo sapiens
ctggctccatcactgggtgatg

SEQ ID NO: 7806103 - DNA, 22 bp, Homo sapiens
atactacattattagagcctgg

SEQ ID NO: 7806104 - DNA, 22 bp, Homo sapiens
atactcaaggttaatgattgaa

SEQ ID NO: 7806105 - DNA, 20 bp, Homo sapiens
atcagacttttaggaacata

SEQ ID NO: 7806106 - DNA, 22 bp, Homo sapiens
atcctgggctgcaccctcagcc

SEQ ID NO: 7806107 - DNA, 22 bp, Homo sapiens
cttcctaggaagtcagacttcc

SEQ ID NO: 7806108 - DNA, 22 bp, Homo sapiens
cttcccaagactgtattgcaag

SEQ ID NO: 7806109 - DNA, 22 bp, Homo sapiens
cttcccaagctttagttatttt

SEQ ID NO: 7806110 - DNA, 22 bp, Homo sapiens
atctgagtctctgacagcatgt

SEQ ID NO: 7806111 - DNA, 19 bp, Homo sapiens
atctgaggcctcatctggg

SEQ ID NO: 7806112 - DNA, 22 bp, Homo sapiens
atcagaatagtgggggacagtc

SEQ ID NO: 7806113 - DNA, 22 bp, Homo sapiens
atcaaaatgctccagtgatggt

SEQ ID NO: 7806114 - DNA, 22 bp, Homo sapiens
atattgggatgtttggaaatgc

SEQ ID NO: 7806115 - DNA, 22 bp, Homo sapiens
ctggctggccggaggcatccct

SEQ ID NO: 7806116 - DNA, 22 bp, Homo sapiens
atattacataaacatgagtgaa

SEQ ID NO: 7806117 - DNA, 22 bp, Homo sapiens
gaaatttattatctacatcatt

SEQ ID NO: 7806118 - DNA, 22 bp, Homo sapiens
atgatgctgtttatcatatact

SEQ ID NO: 7806119 - DNA, 22 bp, Homo sapiens
gaaacattggtctgccccttat

SEQ ID NO: 7806120 - DNA, 22 bp, Homo sapiens
gaaacattcatatgagaaacct

SEQ ID NO: 7806121 - DNA, 22 bp, Homo sapiens
ctttctcttgagcaagagctgt

SEQ ID NO: 7806122 - DNA, 22 bp, Homo sapiens
atgaaattaatcaacacataca

SEQ ID NO: 7806123 - DNA, 22 bp, Homo sapiens
cttctttaatgtatacaaaaga

SEQ ID NO: 7806124 - DNA, 22 bp, Homo sapiens
atctggctattgacatgttata

SEQ ID NO: 7806125 - DNA, 22 bp, Homo sapiens
gacatttattagaaaactatca

SEQ ID NO: 7806126 - DNA, 22 bp, Homo sapiens
gacatttatgaaggagatatgc

SEQ ID NO: 7806127 - DNA, 22 bp, Homo sapiens
atgctatgtaactggcagatag

SEQ ID NO: 7806128 - DNA, 22 bp, Homo sapiens
atgctattccagaatgtaaatt

SEQ ID NO: 7806129 - DNA, 22 bp, Homo sapiens
gaatcagactgacctgagttca

SEQ ID NO: 7806130 - DNA, 19 bp, Homo sapiens
gaattttaggacttcagca

SEQ ID NO: 7806131 - DNA, 22 bp, Homo sapiens
gaattttatcttattacttgca

SEQ ID NO: 7806132 - DNA, 22 bp, Homo sapiens
gaatcagaatctctaaggtggg

SEQ ID NO: 7806133 - DNA, 22 bp, Homo sapiens
gaatacaaacttaaggctttac

SEQ ID NO: 7806134 - DNA, 22 bp, Homo sapiens
gaaggcttatgtgtgactttcg

SEQ ID NO: 7806135 - DNA, 22 bp, Homo sapiens
gaaggcttagaaacaagggagc

SEQ ID NO: 7806136 - DNA, 16 bp, Homo sapiens
gaaggcttactgcagg

SEQ ID NO: 7806137 - DNA, 22 bp, Homo sapiens
atgggaagctgacctgcatgga

SEQ ID NO: 7806138 - DNA, 22 bp, Homo sapiens
atggaggatgtgcagcatgggc

SEQ ID NO: 7806139 - DNA, 23 bp, Homo sapiens
gagagcaatgagatgtaaacact

SEQ ID NO: 7806140 - DNA, 23 bp, Homo sapiens
gagagcaatgagatgtaaacact

SEQ ID NO: 7806141 - DNA, 22 bp, Homo sapiens
atgttggctggattttagattt

SEQ ID NO: 7806142 - DNA, 22 bp, Homo sapiens
atttctgccaaagtggggacct

SEQ ID NO: 7806143 - DNA, 22 bp, Homo sapiens
atttctgttgcttataaattac

SEQ ID NO: 7806144 - DNA, 22 bp, Homo sapiens
atttcatgtttcatctacctaa

SEQ ID NO: 7806145 - DNA, 22 bp, Homo sapiens
atttcatgttgatctttcgagg

SEQ ID NO: 7806146 - DNA, 22 bp, Homo sapiens
atttggaaatgcatctcttgag

SEQ ID NO: 7806147 - DNA, 22 bp, Homo sapiens
gcctattttattatgcatgtaa

SEQ ID NO: 7806148 - DNA, 22 bp, Homo sapiens
atttggaaatgtaagaatgcaa

SEQ ID NO: 7806149 - DNA, 22 bp, Homo sapiens
atttggaacttataataagttt

SEQ ID NO: 7806150 - DNA, 22 bp, Homo sapiens
atttggaatagctgtagaaata

SEQ ID NO: 7806151 - DNA, 22 bp, Homo sapiens
atttggaagtttggagtgaagg

SEQ ID NO: 7806152 - DNA, 22 bp, Homo sapiens
atttttctctcacacttaccag

SEQ ID NO: 7806153 - DNA, 22 bp, Homo sapiens
atttttgccctgcagtacataa

SEQ ID NO: 7806154 - DNA, 19 bp, Homo sapiens
atttttcttcctctgtgca

SEQ ID NO: 7806155 - DNA, 22 bp, Homo sapiens
attttgctttatgtaaatatgt

SEQ ID NO: 7806156 - DNA, 22 bp, Homo sapiens
caaacaatttgcatttccttag

SEQ ID NO: 7806157 - DNA, 22 bp, Homo sapiens
caaaatgttctggcacctttaa

SEQ ID NO: 7806158 - DNA, 22 bp, Homo sapiens
caaaatgatgtgattttattgt

SEQ ID NO: 7806159 - DNA, 22 bp, Homo sapiens
caaacattcagatgcaatggta

SEQ ID NO: 7806160 - DNA, 22 bp, Homo sapiens
caaatgcatgagaaataagagg

SEQ ID NO: 7806161 - DNA, 22 bp, Homo sapiens
caaatgcatagtttataagaag

SEQ ID NO: 7806162 - DNA, 22 bp, Homo sapiens
caaatgatacctattactaggc

SEQ ID NO: 7806163 - DNA, 22 bp, Homo sapiens
cacaggaaggccttctcacaat

SEQ ID NO: 7806164 - DNA, 22 bp, Homo sapiens
cacaggaatcagcattaatggc

SEQ ID NO: 7806165 - DNA, 22 bp, Homo sapiens
gctttgcacagtgctgtgttaa

SEQ ID NO: 7806166 - DNA, 22 bp, Homo sapiens
gctttgcctccaaagaaaaagt

SEQ ID NO: 7806167 - DNA, 22 bp, Homo sapiens
caatgtcaaggagaccaaaacg

SEQ ID NO: 7806168 - DNA, 22 bp, Homo sapiens
caagtcaactcaaattgttatc

SEQ ID NO: 7806169 - DNA, 22 bp, Homo sapiens
caaatgtgtaaggaagtgttag

SEQ ID NO: 7806170 - DNA, 22 bp, Homo sapiens
caagcatactgtgagagtttta

SEQ ID NO: 7806171 - DNA, 22 bp, Homo sapiens
ggcagggagagcatgctgataa

SEQ ID NO: 7806172 - DNA, 22 bp, Homo sapiens
ggcttaaaaggaaaatgagagt

SEQ ID NO: 7806173 - DNA, 22 bp, Homo sapiens
ggcttaaaactttgaaagtgtt

SEQ ID NO: 7806174 - DNA, 22 bp, Homo sapiens
ggcttaaagaattaacagagat

SEQ ID NO: 7806175 - DNA, 22 bp, Homo sapiens
ggcttaaagttttctagaataa

SEQ ID NO: 7806176 - DNA, 22 bp, Homo sapiens
ggctggtgttacagtcggcagc

SEQ ID NO: 7806177 - DNA, 22 bp, Homo sapiens
gtctgtgcagttactagctggt

SEQ ID NO: 7806178 - DNA, 22 bp, Homo sapiens
cagagtcccagatgcccctcct

SEQ ID NO: 7806179 - DNA, 22 bp, Homo sapiens
cagagtcctgcaccagctccag

SEQ ID NO: 7806180 - DNA, 22 bp, Homo sapiens
cagcaagatggtgaatgagacg

SEQ ID NO: 7806181 - DNA, 22 bp, Homo sapiens
tctggtcactgtccaattctat

SEQ ID NO: 7806182 - DNA, 22 bp, Homo sapiens
tctggtgtcagtattctttgaa

SEQ ID NO: 7806183 - DNA, 20 bp, Homo sapiens
tctggtgccccttcctgaga

SEQ ID NO: 7806184 - DNA, 22 bp, Homo sapiens
tcttcacatggagaagcaactc

SEQ ID NO: 7806185 - DNA, 22 bp, Homo sapiens
tcttcactgatgtctctcaaat

SEQ ID NO: 7806186 - DNA, 22 bp, Homo sapiens
tcttcccattagtaatgaagtg

SEQ ID NO: 7806187 - DNA, 22 bp, Homo sapiens
tgagaatcagctgcacagaggt

SEQ ID NO: 7806188 - DNA, 22 bp, Homo sapiens
tgacaagctttacagaattgaa

SEQ ID NO: 7806189 - DNA, 22 bp, Homo sapiens
ccccacagccgccagcagggag

SEQ ID NO: 7806190 - DNA, 22 bp, Homo sapiens
ccctcctctccctaagagtcac

SEQ ID NO: 7806191 - DNA, 22 bp, Homo sapiens
cctagcaataaagatatcattt

SEQ ID NO: 7806192 - DNA, 22 bp, Homo sapiens
tggcaggtacccattggctgta

SEQ ID NO: 7806193 - DNA, 22 bp, Homo sapiens
cctcatgagttcttctgcccat

SEQ ID NO: 7806194 - DNA, 22 bp, Homo sapiens
cctcatgttgctcgcatctgca

SEQ ID NO: 7806195 - DNA, 19 bp, Homo sapiens
cctctgctccagtttcctt

SEQ ID NO: 7806196 - DNA, 22 bp, Homo sapiens
tacaaaaaattgatactgacga

SEQ ID NO: 7806197 - DNA, 22 bp, Homo sapiens
caggcattagagaattgtgata

SEQ ID NO: 7806198 - DNA, 22 bp, Homo sapiens
cagggacagagactgcaccttg

SEQ ID NO: 7806199 - DNA, 22 bp, Homo sapiens
tattttaaagtgaagggtcttg

SEQ ID NO: 7806200 - DNA, 19 bp, Homo sapiens
tcaaaacacaaatggttga

SEQ ID NO: 7806201 - DNA, 23 bp, Homo sapiens
tcaagcaataattggtaatagtg

SEQ ID NO: 7806202 - DNA, 22 bp, Homo sapiens
tcaacaaatacttaaagcagag

SEQ ID NO: 7806203 - DNA, 22 bp, Homo sapiens
caggtggagctgactgagggca

SEQ ID NO: 7806204 - DNA, 22 bp, Homo sapiens
cagggagccccaattccatgcc

SEQ ID NO: 7806205 - DNA, 22 bp, Homo sapiens
cattcttatatttactcattca

SEQ ID NO: 7806206 - DNA, 22 bp, Homo sapiens
cattctgagatatgggctgaag

SEQ ID NO: 7806207 - DNA, 22 bp, Homo sapiens
cattagcattacttcaaagagt

SEQ ID NO: 7806208 - DNA, 22 bp, Homo sapiens
catagaaaagagtaggtaatgt

SEQ ID NO: 7806209 - DNA, 22 bp, Homo sapiens
catagaaactgagacaaggatt

SEQ ID NO: 7806210 - DNA, 22 bp, Homo sapiens
cataatcagatgtgtacataag

SEQ ID NO: 7806211 - DNA, 22 bp, Homo sapiens
cataattactgatatgctgatt

SEQ ID NO: 7806212 - DNA, 22 bp, Homo sapiens
catgcatgccgggctgacagag

SEQ ID NO: 7806213 - DNA, 22 bp, Homo sapiens
ctaaatctagtctttactgatt

SEQ ID NO: 7806214 - DNA, 22 bp, Homo sapiens
ctaaatctcatcatgtacctcc

SEQ ID NO: 7806215 - DNA, 22 bp, Homo sapiens
ctaaatgacttccagtggttat

SEQ ID NO: 7806216 - DNA, 22 bp, Homo sapiens
ctacatttacacagttaggctt

SEQ ID NO: 7806217 - DNA, 22 bp, Homo sapiens
ctacatttcatccagggagagc

SEQ ID NO: 7806218 - DNA, 22 bp, Homo sapiens
ttcctgggctttcccctctggt

SEQ ID NO: 7806219 - DNA, 20 bp, Homo sapiens
ttcagagtcagcaaatgcag

SEQ ID NO: 7806220 - DNA, 22 bp, Homo sapiens
ttcaaattaccacatttgctta

SEQ ID NO: 7806221 - DNA, 22 bp, Homo sapiens
ttcacacacagcttcctattgt

SEQ ID NO: 7806222 - DNA, 22 bp, Homo sapiens
cctttctacagatgcctcttgc

SEQ ID NO: 7806223 - DNA, 22 bp, Homo sapiens
ttactaagagaagtaaatattt

SEQ ID NO: 7806224 - DNA, 21 bp, Homo sapiens
ttacttttgcaccaacctaat

SEQ ID NO: 7806225 - DNA, 22 bp, Homo sapiens
ttacttttgcaccaaactaata

SEQ ID NO: 7806226 - DNA, 21 bp, Homo sapiens
ttacttttgcagcaacctaat

SEQ ID NO: 7806227 - DNA, 23 bp, Homo sapiens
ttacttttgcaccaacctaatat

SEQ ID NO: 7806228 - DNA, 22 bp, Homo sapiens
ttagaagtgggcctatagtcct

SEQ ID NO: 7806229 - DNA, 22 bp, Homo sapiens
ttagaatttctgctcactttga

SEQ ID NO: 7806230 - DNA, 22 bp, Homo sapiens
ttaaagctggcgttacagtttg

SEQ ID NO: 7806231 - DNA, 22 bp, Homo sapiens
ttaaagctgtagagttacttgc

SEQ ID NO: 7806232 - DNA, 22 bp, Homo sapiens
tgttcattcgctattgtctatg

SEQ ID NO: 7806233 - DNA, 22 bp, Homo sapiens
tgtgtattaatgtttgtatatg

SEQ ID NO: 7806234 - DNA, 22 bp, Homo sapiens
ctctctgctgtatccttaggct

SEQ ID NO: 7806235 - DNA, 22 bp, Homo sapiens
tttcacagtagaaatcattatg

SEQ ID NO: 7806236 - DNA, 17 bp, Homo sapiens
ctcctggcagcctcagg

SEQ ID NO: 7806237 - DNA, 22 bp, Homo sapiens
ctccacagcccctccagtggca

SEQ ID NO: 7806238 - DNA, 22 bp, Homo sapiens
ctcatttactcatctgcaaaac

SEQ ID NO: 7806239 - DNA, 22 bp, Homo sapiens
ctcatttacctttgcaatcaag

SEQ ID NO: 7806240 - DNA, 22 bp, Homo sapiens
ctcatttaacagattaaaaagt

SEQ ID NO: 7806241 - DNA, 22 bp, Homo sapiens
ctcatttatttctcccaaaaca

SEQ ID NO: 7806242 - DNA, 22 bp, Homo sapiens
ctctgcccagtgcccacaggag

SEQ ID NO: 7806243 - DNA, 22 bp, Homo sapiens
tttgcaaataaataagtgctcg

SEQ ID NO: 7806244 - DNA, 22 bp, Homo sapiens
tttgctctctcaggctcctggg

SEQ ID NO: 7806245 - DNA, 22 bp, Homo sapiens
tttgccaggtaagtactatgct

SEQ ID NO: 7806246 - DNA, 22 bp, Homo sapiens
tttgccagtattttattgatga

SEQ ID NO: 7806247 - DNA, 22 bp, Homo sapiens
tttgctattgtgaatagtgcca

SEQ ID NO: 7806248 - DNA, 22 bp, Homo sapiens
tttgctaaaaggccattgattt

SEQ ID NO: 7806249 - DNA, 22 bp, Homo sapiens
tttgggaatctttgtgcatgac

SEQ ID NO: 7806250 - DNA, 22 bp, Homo sapiens
tttgtacacaggatgttataat

SEQ ID NO: 7806251 - DNA, 22 bp, Homo sapiens
tttgtacatataaatcttgtat

SEQ ID NO: 7806252 - DNA, 22 bp, Homo sapiens
ctggcaggaagaggaaaggtca

SEQ ID NO: 7806253 - DNA, 22 bp, Homo sapiens
ctgcatccatgttgctgcaaag

SEQ ID NO: 7806254 - DNA, 22 bp, Homo sapiens
ctggcaggcactcatgaaataa

SEQ ID NO: 7806255 - DNA, 22 bp, Homo sapiens
ctggctggagaaatgaaattct

SEQ ID NO: 7806256 - DNA, 22 bp, Homo sapiens
ctggctggaagttagagaactt

SEQ ID NO: 7806257 - DNA, 22 bp, Homo sapiens
ctgggaggcggagcttgcagtg

SEQ ID NO: 7806258 - DNA, 22 bp, Homo sapiens
ctgggaggcactattcaggagg

SEQ ID NO: 7806259 - DNA, 22 bp, Homo sapiens
ctggctttctgcaaatctccat

SEQ ID NO: 7806260 - DNA, 22 bp, Homo sapiens
ctggctttccttgtctgcatcc

SEQ ID NO: 7806261 - DNA, 22 bp, Homo sapiens
ctgggaggattcattgaggtga

SEQ ID NO: 7806262 - DNA, 22 bp, Homo sapiens
ctgggaggcaccgcgtcgtgct

SEQ ID NO: 7806263 - DNA, 22 bp, Homo sapiens
ctggcttttggaaacaggctca

SEQ ID NO: 7806264 - DNA, 22 bp, Homo sapiens
ctggctttggtcatgtgatcat

SEQ ID NO: 7806265 - DNA, 22 bp, Homo sapiens
ctgggtgctgtgggctcagagg

SEQ ID NO: 7806266 - DNA, 22 bp, Homo sapiens
ctgttgaaaatttctcagatgg

SEQ ID NO: 7806267 - DNA, 22 bp, Homo sapiens
cttcctgggtctggagactgga

SEQ ID NO: 7806268 - DNA, 22 bp, Homo sapiens
cttcctggatgagcaggctgat

SEQ ID NO: 7806269 - DNA, 22 bp, Homo sapiens
cttatatttgtcaactttacaa

SEQ ID NO: 7806270 - DNA, 22 bp, Homo sapiens
cttcagccctgagtgccagcag

SEQ ID NO: 7806271 - DNA, 22 bp, Homo sapiens
gagcttaaaacatagccagact

SEQ ID NO: 7806272 - DNA, 22 bp, Homo sapiens
gagcttaaatggctaaatataa

SEQ ID NO: 7806273 - DNA, 22 bp, Homo sapiens
gagagggagccagccaggaacc

SEQ ID NO: 7806274 - DNA, 22 bp, Homo sapiens
gagaatctccagatgaagtcct

SEQ ID NO: 7806275 - DNA, 22 bp, Homo sapiens
gagaagggcttgggagtcaaca

SEQ ID NO: 7806276 - DNA, 22 bp, Homo sapiens
gagatggagtctttttctgtca

SEQ ID NO: 7806277 - DNA, 22 bp, Homo sapiens
gacaagcaggctcctgaagaaa

SEQ ID NO: 7806278 - DNA, 22 bp, Homo sapiens
gacaaggcagaaagcttaaagg

SEQ ID NO: 7806279 - DNA, 21 bp, Homo sapiens
gacaggggaagaagcaaggag

SEQ ID NO: 7806280 - DNA, 21 bp, Homo sapiens
gacaggtgattcagagcaggg

SEQ ID NO: 7806281 - DNA, 22 bp, Homo sapiens
gacctagattaacattctgtga

SEQ ID NO: 7806282 - DNA, 22 bp, Homo sapiens
ctttcatttgataagaatgcca

SEQ ID NO: 7806283 - DNA, 22 bp, Homo sapiens
ctttcattcttagatattagtg

SEQ ID NO: 7806284 - DNA, 22 bp, Homo sapiens
gaaatgcataatcttagtagat

SEQ ID NO: 7806285 - DNA, 22 bp, Homo sapiens
gaaatgcatggatcttggcaga

SEQ ID NO: 7806286 - DNA, 22 bp, Homo sapiens
gaaatgcaaattctctctcgct

SEQ ID NO: 7806287 - DNA, 22 bp, Homo sapiens
gaaatgcagattctgattctgt

SEQ ID NO: 7806288 - DNA, 22 bp, Homo sapiens
gaaatgcaggcttggattcagc

SEQ ID NO: 7806289 - DNA, 22 bp, Homo sapiens
gaaatgcagaacctgagaccat

SEQ ID NO: 7806290 - DNA, 22 bp, Homo sapiens
gaagatgttatggagagctcag

SEQ ID NO: 7806291 - DNA, 22 bp, Homo sapiens
gaagccaggggcctgacaggca

SEQ ID NO: 7806292 - DNA, 22 bp, Homo sapiens
gaagatttttcttaatgctccg

SEQ ID NO: 7806293 - DNA, 22 bp, Homo sapiens
gaagagctatgtccagggagca

SEQ ID NO: 7806294 - DNA, 22 bp, Homo sapiens
gaagagctatgtccagggagca

SEQ ID NO: 7806295 - DNA, 22 bp, Homo sapiens
gaagagctgcacactggggact

SEQ ID NO: 7806296 - DNA, 22 bp, Homo sapiens
gaagagctgtgattcaggctta

SEQ ID NO: 7806297 - DNA, 22 bp, Homo sapiens
gaagagcttagacagaatcaaa

SEQ ID NO: 7806298 - DNA, 22 bp, Homo sapiens
gaagagctgtcagaaaagctaa

SEQ ID NO: 7806299 - DNA, 22 bp, Homo sapiens
gaagagctgtgattcaggctta

SEQ ID NO: 7806300 - DNA, 22 bp, Homo sapiens
gaagagctgctcagaacatgat

SEQ ID NO: 7806301 - DNA, 22 bp, Homo sapiens
gaagagctgtcagaaaagctaa

SEQ ID NO: 7806302 - DNA, 22 bp, Homo sapiens
ggctgggcaaacaagactcttc

SEQ ID NO: 7806303 - DNA, 22 bp, Homo sapiens
ggctgggctccgggagcatgcg

SEQ ID NO: 7806304 - DNA, 22 bp, Homo sapiens
ggctgggcaggtctgcacaggg

SEQ ID NO: 7806305 - DNA, 22 bp, Homo sapiens
gggaggaaagagaagtggtcca

SEQ ID NO: 7806306 - DNA, 22 bp, Homo sapiens
gggaggaaggcttgggtgagta

SEQ ID NO: 7806307 - DNA, 22 bp, Homo sapiens
ggagtaggccccgggagagagt

SEQ ID NO: 7806308 - DNA, 19 bp, Homo sapiens
ggcaagcacaaaagctttg

SEQ ID NO: 7806309 - DNA, 22 bp, Homo sapiens
ggcctcagggtcactctgtaga

SEQ ID NO: 7806310 - DNA, 20 bp, Homo sapiens
ggcctcagtgtccttgtttg

SEQ ID NO: 7806311 - DNA, 22 bp, Homo sapiens
ggcctcttctgctcatactttc

SEQ ID NO: 7806312 - DNA, 22 bp, Homo sapiens
gggtggcatctctctgagctgt

SEQ ID NO: 7806313 - DNA, 22 bp, Homo sapiens
gtgaaatatttaacgtccaggt

SEQ ID NO: 7806314 - DNA, 22 bp, Homo sapiens
gtacatttaggattcattgaaa

SEQ ID NO: 7806315 - DNA, 22 bp, Homo sapiens
gtacatttcagtttccttaaga

SEQ ID NO: 7806316 - DNA, 22 bp, Homo sapiens
gtacatttatttttgcagcata

SEQ ID NO: 7806317 - DNA, 22 bp, Homo sapiens
gtacatttcatttaaatgatgt

SEQ ID NO: 7806318 - DNA, 22 bp, Homo sapiens
gtacattttgaggttaaaacaa

SEQ ID NO: 7806319 - DNA, 20 bp, Homo sapiens
gtacattttcaggaggggat

SEQ ID NO: 7806320 - DNA, 22 bp, Homo sapiens
gtacatttctcccaacactaaa

SEQ ID NO: 7806321 - DNA, 22 bp, Homo sapiens
gtacattttactttgtttgaat

SEQ ID NO: 7806322 - DNA, 22 bp, Homo sapiens
gtacatttctcttgttcttatt

SEQ ID NO: 7806323 - DNA, 22 bp, Homo sapiens
gtccctgacacccgggtggagg

SEQ ID NO: 7806324 - DNA, 22 bp, Homo sapiens
gtcccctcagccacccatgggg

SEQ ID NO: 7806325 - DNA, 22 bp, Homo sapiens
gtcccctcaaaattcatatgtt

SEQ ID NO: 7806326 - DNA, 22 bp, Homo sapiens
gcatggccatggcactatggac

SEQ ID NO: 7806327 - DNA, 22 bp, Homo sapiens
gcatggcctccagccaacagca

SEQ ID NO: 7806328 - DNA, 22 bp, Homo sapiens
gcatggccaggaaaggtagaaa

SEQ ID NO: 7806329 - DNA, 22 bp, Homo sapiens
gcatgcatgtgtgcagacagtc

SEQ ID NO: 7806330 - DNA, 22 bp, Homo sapiens
gcagggctgtggacactttggt

SEQ ID NO: 7806331 - DNA, 22 bp, Homo sapiens
gcaggcagatcacctgtcagga

SEQ ID NO: 7806332 - DNA, 22 bp, Homo sapiens
gcagagcaggaaggaagtcagg

SEQ ID NO: 7806333 - DNA, 22 bp, Homo sapiens
gctcagagggaacaaggggctg

SEQ ID NO: 7806334 - DNA, 22 bp, Homo sapiens
gccttggctgatgtgcgaatga

SEQ ID NO: 7806335 - DNA, 22 bp, Homo sapiens
gctggggagggcgtcaaggcca

SEQ ID NO: 7806336 - DNA, 22 bp, Homo sapiens
gctgtgctatatctctgagtgt

SEQ ID NO: 7806337 - DNA, 17 bp, Homo sapiens
gctttggaaagccttcc

SEQ ID NO: 7806338 - DNA, 22 bp, Homo sapiens
gctttggagggcaagagctgtt

SEQ ID NO: 7806339 - DNA, 22 bp, Homo sapiens
gctttggagcctgtgttctgcc

SEQ ID NO: 7806340 - DNA, 22 bp, Homo sapiens
gctttggaatgtgctgttatag

SEQ ID NO: 7806341 - DNA, 22 bp, Homo sapiens
ggaatcagcaaggaggctcacc

SEQ ID NO: 7806342 - DNA, 22 bp, Homo sapiens
ggaatcagagcagaggctgtta

SEQ ID NO: 7806343 - DNA, 22 bp, Homo sapiens
ggaagattcagttatctcatga

SEQ ID NO: 7806344 - DNA, 22 bp, Homo sapiens
ggaattctgtagctcttcctct

SEQ ID NO: 7806345 - DNA, 22 bp, Homo sapiens
ggaattctgcatgttcagttgg

SEQ ID NO: 7806346 - DNA, 22 bp, Homo sapiens
ggacagtgaatctggaggtata

SEQ ID NO: 7806347 - DNA, 19 bp, Homo sapiens
ggaccaggtcctgggcagc

SEQ ID NO: 7806348 - DNA, 22 bp, Homo sapiens
tccagcagccacacctctggac

SEQ ID NO: 7806349 - DNA, 23 bp, Homo sapiens
tccagcagagccttccaggaggg

SEQ ID NO: 7806350 - DNA, 22 bp, Homo sapiens
tccagcagtccatgtgagacac

SEQ ID NO: 7806351 - DNA, 22 bp, Homo sapiens
tcattattctctttaatgttct

SEQ ID NO: 7806352 - DNA, 22 bp, Homo sapiens
tcattattttggactggagtgt

SEQ ID NO: 7806353 - DNA, 22 bp, Homo sapiens
tcatgcttattgcatatttgga

SEQ ID NO: 7806354 - DNA, 22 bp, Homo sapiens
tcatatttaggcctttaattca

SEQ ID NO: 7806355 - DNA, 22 bp, Homo sapiens
tcaatttcaacagctgataaga

SEQ ID NO: 7806356 - DNA, 22 bp, Homo sapiens
tatttctgtcagccagatatgg

SEQ ID NO: 7806357 - DNA, 20 bp, Homo sapiens
tatttctgggcaaccattta

SEQ ID NO: 7806358 - DNA, 22 bp, Homo sapiens
tatttctgggagttcagaaatt

SEQ ID NO: 7806359 - DNA, 22 bp, Homo sapiens
tcacaaaggatgatgaattctg

SEQ ID NO: 7806360 - DNA, 22 bp, Homo sapiens
tcacaaggttcactataaattg

SEQ ID NO: 7806361 - DNA, 22 bp, Homo sapiens
tcagagcatgtgggctgcagtt

SEQ ID NO: 7806362 - DNA, 22 bp, Homo sapiens
tcagacctctgaccttgccaaa

SEQ ID NO: 7806363 - DNA, 22 bp, Homo sapiens
tcactttagaggaaacattgag

SEQ ID NO: 7806364 - DNA, 22 bp, Homo sapiens
taaattatgtcacatgactctg

SEQ ID NO: 7806365 - DNA, 22 bp, Homo sapiens
taaattatgttccatgtccttt

SEQ ID NO: 7806366 - DNA, 22 bp, Homo sapiens
taaacaattcctctctaggcat

SEQ ID NO: 7806367 - DNA, 22 bp, Homo sapiens
taaaatgtgtttctgtatggtt

SEQ ID NO: 7806368 - DNA, 22 bp, Homo sapiens
taaaatgcacagcagttgaaag

SEQ ID NO: 7806369 - DNA, 22 bp, Homo sapiens
taaaatggtaactttcatttgc

SEQ ID NO: 7806370 - DNA, 22 bp, Homo sapiens
taaaatgccagaccagttcacg

SEQ ID NO: 7806371 - DNA, 19 bp, Homo sapiens
taaaatgtctgtggtcagt

SEQ ID NO: 7806372 - DNA, 18 bp, Homo sapiens
gttttgaattgtcttaca

SEQ ID NO: 7806373 - DNA, 22 bp, Homo sapiens
gttttctttgaatgcttctaga

SEQ ID NO: 7806374 - DNA, 22 bp, Homo sapiens
gttgagtgggttaggatgctga

SEQ ID NO: 7806375 - DNA, 18 bp, Homo sapiens
gtttcatgcatgtgaaac

SEQ ID NO: 7806376 - DNA, 22 bp, Homo sapiens
gtttcatggagagctgaatatt

SEQ ID NO: 7806377 - DNA, 22 bp, Homo sapiens
gtgctctgtgtattaggatgtc

SEQ ID NO: 7806378 - DNA, 22 bp, Homo sapiens
gtgctgaaatggacctcaggaa

SEQ ID NO: 7806379 - DNA, 22 bp, Homo sapiens
tacaacagtaatcaaggttttt

SEQ ID NO: 7806380 - DNA, 22 bp, Homo sapiens
tacaacagacctagatgaatga

SEQ ID NO: 7806381 - DNA, 22 bp, Homo sapiens
tacaacaggaatttcaactttg

SEQ ID NO: 7806382 - DNA, 22 bp, Homo sapiens
tacagcaatgcctgaaatagta

SEQ ID NO: 7806383 - DNA, 22 bp, Homo sapiens
tacagagtatttttaatatggt

SEQ ID NO: 7806384 - DNA, 22 bp, Homo sapiens
tacattctactttttcactccc

SEQ ID NO: 7806385 - DNA, 22 bp, Homo sapiens
tacatttcctgtcagagatata

SEQ ID NO: 7806386 - DNA, 22 bp, Homo sapiens
tacatcattttggagatgagca

SEQ ID NO: 7806387 - DNA, 22 bp, Homo sapiens
taattataacagttacatctta

SEQ ID NO: 7806388 - DNA, 22 bp, Homo sapiens
taaggtaactgcttttggctga

SEQ ID NO: 7806389 - DNA, 22 bp, Homo sapiens
tattcttactctcgactgcatt

SEQ ID NO: 7806390 - DNA, 22 bp, Homo sapiens
tattcttaattgctgagctgaa

SEQ ID NO: 7806391 - DNA, 22 bp, Homo sapiens
tatagctaaggtcagactgttt

SEQ ID NO: 7806392 - DNA, 22 bp, Homo sapiens
tatccaaagtggcatattatag

SEQ ID NO: 7806393 - DNA, 22 bp, Homo sapiens
tataatttatcatgtcacagtt

SEQ ID NO: 7806394 - DNA, 22 bp, Homo sapiens
tataaatgccaggactttagat

SEQ ID NO: 7806395 - DNA, 22 bp, Homo sapiens
tagaaaggaagctacttagggg

SEQ ID NO: 7806396 - DNA, 22 bp, Homo sapiens
tagaaaggagcattttagacta

SEQ ID NO: 7806397 - DNA, 22 bp, Homo sapiens
tagaaaggcaagcgtgaaatat

SEQ ID NO: 7806398 - DNA, 22 bp, Homo sapiens
tagaaaggatattgagatgaat

SEQ ID NO: 7806399 - DNA, 22 bp, Homo sapiens
tagaaagtactaaatttaactg

SEQ ID NO: 7806400 - DNA, 22 bp, Homo sapiens
tagaaacatatgtttgagacat

SEQ ID NO: 7806401 - DNA, 22 bp, Homo sapiens
tagaaacattcagttgcagtcc

SEQ ID NO: 7806402 - DNA, 22 bp, Homo sapiens
tagaaacaagtttctctttggg

SEQ ID NO: 7806403 - DNA, 22 bp, Homo sapiens
tagaaacaatgacatgcttgta

SEQ ID NO: 7806404 - DNA, 22 bp, Homo sapiens
tagcagaggaaaagagaacatt

SEQ ID NO: 7806405 - DNA, 22 bp, Homo sapiens
tagcagagcagggatcagagcc

SEQ ID NO: 7806406 - DNA, 20 bp, Homo sapiens
ttcagtctcctgcttccttc

SEQ ID NO: 7806407 - DNA, 22 bp, Homo sapiens
ttcaatttagtgatgttgttgg

SEQ ID NO: 7806408 - DNA, 22 bp, Homo sapiens
ttcaatttcataatatctagct

SEQ ID NO: 7806409 - DNA, 22 bp, Homo sapiens
ttcctagaatggttagaaaata

SEQ ID NO: 7806410 - DNA, 22 bp, Homo sapiens
ttctagcttgagtgaataaagg

SEQ ID NO: 7806411 - DNA, 22 bp, Homo sapiens
ttcttctttcctataattaatt

SEQ ID NO: 7806412 - DNA, 20 bp, Homo sapiens
ttctgcttgcaaatatcaag

SEQ ID NO: 7806413 - DNA, 22 bp, Homo sapiens
ttctgcttttagctaaactata

SEQ ID NO: 7806414 - DNA, 22 bp, Homo sapiens
ttctgcctggcaggaggactgt

SEQ ID NO: 7806415 - DNA, 17 bp, Homo sapiens
ttctgctgtcgtcctct

SEQ ID NO: 7806416 - DNA, 22 bp, Homo sapiens
ttctgctgtagttgcatctgtt

SEQ ID NO: 7806417 - DNA, 22 bp, Homo sapiens
ttctgctgttgtgacgttagtt

SEQ ID NO: 7806418 - DNA, 21 bp, Homo sapiens
ttctgctgtgccatgcctctg

SEQ ID NO: 7806419 - DNA, 22 bp, Homo sapiens
ttctgctgaaaacagccatgta

SEQ ID NO: 7806420 - DNA, 22 bp, Homo sapiens
ttgcaaagagtcatgtaagtca

SEQ ID NO: 7806421 - DNA, 22 bp, Homo sapiens
ttctttatcctatttgtaggtg

SEQ ID NO: 7806422 - DNA, 22 bp, Homo sapiens
ttctttatgttaatgaatctat

SEQ ID NO: 7806423 - DNA, 22 bp, Homo sapiens
ttgaattagactttgctacagg

SEQ ID NO: 7806424 - DNA, 22 bp, Homo sapiens
tgttatttatctgagcatttat

SEQ ID NO: 7806425 - DNA, 22 bp, Homo sapiens
tgttatctcagactgagttact

SEQ ID NO: 7806426 - DNA, 22 bp, Homo sapiens
tgtgtttctgagaatcccacct

SEQ ID NO: 7806427 - DNA, 22 bp, Homo sapiens
tgtggagactatagccataaca

SEQ ID NO: 7806428 - DNA, 21 bp, Homo sapiens
tcccctcacttgtcttctgag

SEQ ID NO: 7806429 - DNA, 22 bp, Homo sapiens
tgtggaggattctgatgccagc

SEQ ID NO: 7806430 - DNA, 20 bp, Homo sapiens
ttagaaagagcgtgataaga

SEQ ID NO: 7806431 - DNA, 22 bp, Homo sapiens
ttactttagaaatagtcatcaa

SEQ ID NO: 7806432 - DNA, 22 bp, Homo sapiens
ttacattttggggtaaggataa

SEQ ID NO: 7806433 - DNA, 22 bp, Homo sapiens
ttaattttctcatctgtgaaat

SEQ ID NO: 7806434 - DNA, 22 bp, Homo sapiens
ttaaatgatgcatatcatttag

SEQ ID NO: 7806435 - DNA, 22 bp, Homo sapiens
ttaaatgaggctgatgtagatt

SEQ ID NO: 7806436 - DNA, 22 bp, Homo sapiens
ttaaatgagatgttcagatatt

SEQ ID NO: 7806437 - DNA, 22 bp, Homo sapiens
ttaaatgacttttattattctc

SEQ ID NO: 7806438 - DNA, 22 bp, Homo sapiens
ttaaatgacgggactgggtttt

SEQ ID NO: 7806439 - DNA, 22 bp, Homo sapiens
ttaacattgtccttagcagatt

SEQ ID NO: 7806440 - DNA, 22 bp, Homo sapiens
ttaactattattagcatctttg

SEQ ID NO: 7806441 - DNA, 22 bp, Homo sapiens
tttctgcatgcatttaattaaa

SEQ ID NO: 7806442 - DNA, 18 bp, Homo sapiens
tttctgaatgtctatttc

SEQ ID NO: 7806443 - DNA, 22 bp, Homo sapiens
tttctgaataactctatgatat

SEQ ID NO: 7806444 - DNA, 22 bp, Homo sapiens
tttctgaagggcagcagactct

SEQ ID NO: 7806445 - DNA, 22 bp, Homo sapiens
tttctgaaggttaaggaattag

SEQ ID NO: 7806446 - DNA, 23 bp, Homo sapiens
tttctgaagttgagatggacttt

SEQ ID NO: 7806447 - DNA, 22 bp, Homo sapiens
tttctgaagtcttctaacagat

SEQ ID NO: 7806448 - DNA, 22 bp, Homo sapiens
tttctgctttctatccttgtca

SEQ ID NO: 7806449 - DNA, 22 bp, Homo sapiens
tttctgctgtgctttcttgcgt

SEQ ID NO: 7806450 - DNA, 22 bp, Homo sapiens
tttctgcttaggactctgtgga

SEQ ID NO: 7806451 - DNA, 20 bp, Homo sapiens
tttctgtagctcagtattca

SEQ ID NO: 7806452 - DNA, 22 bp, Homo sapiens
tttctgaagatacagctttgct

SEQ ID NO: 7806453 - DNA, 22 bp, Homo sapiens
tttctgaacttggtactggagc

SEQ ID NO: 7806454 - DNA, 21 bp, Homo sapiens
tttctgaaggcaacatctatc

SEQ ID NO: 7806455 - DNA, 22 bp, Homo sapiens
tttctgaaaactgaagtagtgc

SEQ ID NO: 7806456 - DNA, 22 bp, Homo sapiens
tttctgaaacatggtctttgta

SEQ ID NO: 7806457 - DNA, 22 bp, Homo sapiens
tttctgaacaaagccattatca

SEQ ID NO: 7806458 - DNA, 22 bp, Homo sapiens
tttcttcatagaccttgtcttg

SEQ ID NO: 7806459 - DNA, 22 bp, Homo sapiens
tttcttatggggtagtccttta

SEQ ID NO: 7806460 - DNA, 22 bp, Homo sapiens
tttctattggcgtcactgttgt

SEQ ID NO: 7806461 - DNA, 22 bp, Homo sapiens
tttctattgtaagtctcctata

SEQ ID NO: 7806462 - DNA, 22 bp, Homo sapiens
tttctaatctgattctcctacc

SEQ ID NO: 7806463 - DNA, 22 bp, Homo sapiens
tttcattgtcatctatcttaga

SEQ ID NO: 7806464 - DNA, 22 bp, Homo sapiens
tttcatttcatagaattgtgtt

SEQ ID NO: 7806465 - DNA, 22 bp, Homo sapiens
tttccaaaatgaatctaatgca

SEQ ID NO: 7806466 - DNA, 22 bp, Homo sapiens
tttccaaaggtggcaggaacaa

SEQ ID NO: 7806467 - DNA, 22 bp, Homo sapiens
tttccaaagttgccataagctt

SEQ ID NO: 7806468 - DNA, 22 bp, Homo sapiens
tttcagagttgtcttcttgacc

SEQ ID NO: 7806469 - DNA, 22 bp, Homo sapiens
tttcagagttggggaaaagcag

SEQ ID NO: 7806470 - DNA, 22 bp, Homo sapiens
tttcagagctgagatgccacag

SEQ ID NO: 7806471 - DNA, 22 bp, Homo sapiens
tttcagaggaaatctcattgag

SEQ ID NO: 7806472 - DNA, 22 bp, Homo sapiens
tttcagaggtgcttggaatgct

SEQ ID NO: 7806473 - DNA, 22 bp, Homo sapiens
tttcagaggtatgctgcttatc

SEQ ID NO: 7806474 - DNA, 22 bp, Homo sapiens
tttcagagtcagctcctctcta

SEQ ID NO: 7806475 - DNA, 20 bp, Homo sapiens
tttcagagtgtctttccatt

SEQ ID NO: 7806476 - DNA, 22 bp, Homo sapiens
tttattattctgttctctctac

SEQ ID NO: 7806477 - DNA, 22 bp, Homo sapiens
tttactaagcccagttatatgc

SEQ ID NO: 7806478 - DNA, 22 bp, Homo sapiens
tttacaacctcatattctgatg

SEQ ID NO: 7806479 - DNA, 22 bp, Homo sapiens
tttaattttcctcttcctggag

SEQ ID NO: 7806480 - DNA, 22 bp, Homo sapiens
ttttgcaaagtacattatcagg

SEQ ID NO: 7806481 - DNA, 22 bp, Homo sapiens
ttttgatatcatgatgaacaga

SEQ ID NO: 7806482 - DNA, 22 bp, Homo sapiens
tttgtagagaatgttaagcact

SEQ ID NO: 7806483 - DNA, 22 bp, Homo sapiens
tttgatttactggatattctca

SEQ ID NO: 7806484 - DNA, 22 bp, Homo sapiens
tttgcacacacaataacaaatg

SEQ ID NO: 7806485 - DNA, 22 bp, Homo sapiens
tttggcaatatctgaattatag

SEQ ID NO: 7806486 - DNA, 22 bp, Homo sapiens
tttggcagagtgtgggcatttg

SEQ ID NO: 7806487 - DNA, 22 bp, Homo sapiens
tttggcaaaactgtgtctatct

SEQ ID NO: 7806488 - DNA, 22 bp, Homo sapiens
tttggaagtaaatgagtgtttt

SEQ ID NO: 7806489 - DNA, 22 bp, Homo sapiens
tttggaaggtgaggcatgaagg

SEQ ID NO: 7806490 - DNA, 22 bp, Homo sapiens
cagagtcctgcaccagctccag

SEQ ID NO: 7806491 - DNA, 22 bp, Homo sapiens
cagagtcccagatgcccctcct

SEQ ID NO: 7806492 - DNA, 22 bp, Homo sapiens
gggcagcataacaatcactgaa

SEQ ID NO: 7806493 - DNA, 22 bp, Homo sapiens
gggcagcagttgccctaatcaa

SEQ ID NO: 7806494 - DNA, 22 bp, Homo sapiens
gggcagcagcaggaggtctctg

SEQ ID NO: 7806495 - DNA, 22 bp, Homo sapiens
gggcagcagccactcatttagc

SEQ ID NO: 7806496 - DNA, 22 bp, Homo sapiens
gggcagcagagccctgccgagt

SEQ ID NO: 7806497 - DNA, 22 bp, Homo sapiens
gggcagcatgtcactagcatgg

SEQ ID NO: 7806498 - DNA, 22 bp, Homo sapiens
gggcagcatttgaaaaacagat

SEQ ID NO: 7806499 - DNA, 22 bp, Homo sapiens
gggcagcattctgtgggcaggt

SEQ ID NO: 7806500 - DNA, 22 bp, Homo sapiens
gtctgtgcagttactagctggt

SEQ ID NO: 7806501 - DNA, 22 bp, Homo sapiens
gtctgtgtgcacagagctttgg

SEQ ID NO: 7806502 - DNA, 19 bp, Homo sapiens
gtctgtgtatttgttgctg

SEQ ID NO: 7806503 - DNA, 22 bp, Homo sapiens
cagccaggggctggcgtgttga

SEQ ID NO: 7806504 - DNA, 22 bp, Homo sapiens
cagccaggtatgggcgtgcggg

SEQ ID NO: 7806505 - DNA, 22 bp, Homo sapiens
cagccagggagcaaagagttga

SEQ ID NO: 7806506 - DNA, 22 bp, Homo sapiens
cagccaggcctggtgaccaaag

SEQ ID NO: 7806507 - DNA, 22 bp, Homo sapiens
gtgctgtgtgatccatgctggc

SEQ ID NO: 7806508 - DNA, 22 bp, Homo sapiens
ggctggtgttacagtcggcagc

SEQ ID NO: 7806509 - DNA, 22 bp, Homo sapiens
ggctgccataacagagtaccac

SEQ ID NO: 7806510 - DNA, 22 bp, Homo sapiens
ggcctctctccttggcttgcag

SEQ ID NO: 7806511 - DNA, 22 bp, Homo sapiens
ggcctctctccctggcttgcag

SEQ ID NO: 7806512 - DNA, 22 bp, Homo sapiens
ggcagggagagcatgctgataa

SEQ ID NO: 7806513 - DNA, 22 bp, Homo sapiens
ggcaggcatggggtctgccatt

SEQ ID NO: 7806514 - DNA, 22 bp, Homo sapiens
cacatatacctcttcttgagtt

SEQ ID NO: 7806515 - DNA, 23 bp, Homo sapiens
cacatatagcagccactaaggtc

SEQ ID NO: 7806516 - DNA, 22 bp, Homo sapiens
cacatataacctagacaaggcc

SEQ ID NO: 7806517 - DNA, 22 bp, Homo sapiens
cacatataccagccgcggtacg

SEQ ID NO: 7806518 - DNA, 22 bp, Homo sapiens
cacatacaatggtgttatttgg

SEQ ID NO: 7806519 - DNA, 22 bp, Homo sapiens
cacatacaaggcacactggagg

SEQ ID NO: 7806520 - DNA, 19 bp, Homo sapiens
cacatacagaaaagagtaa

SEQ ID NO: 7806521 - DNA, 22 bp, Homo sapiens
cacatacatacgtatgtataca

SEQ ID NO: 7806522 - DNA, 22 bp, Homo sapiens
cacatacatgcacacctaaata

SEQ ID NO: 7806523 - DNA, 22 bp, Homo sapiens
cacatacattcatgttactcta

SEQ ID NO: 7806524 - DNA, 22 bp, Homo sapiens
cacatacttgtgtgtacatatg

SEQ ID NO: 7806525 - DNA, 22 bp, Homo sapiens
ggccactgacctacatctgggg

SEQ ID NO: 7806526 - DNA, 22 bp, Homo sapiens
ggccactgcctccgccatggct

SEQ ID NO: 7806527 - DNA, 22 bp, Homo sapiens
ggccactgctgctctggtggag

SEQ ID NO: 7806528 - DNA, 22 bp, Homo sapiens
gctttgcctccaaagaaaaagt

SEQ ID NO: 7806529 - DNA, 22 bp, Homo sapiens
gctttgcacagtgctgtgttaa

SEQ ID NO: 7806530 - DNA, 22 bp, Homo sapiens
ggaaggggagctaaatctactg

SEQ ID NO: 7806531 - DNA, 22 bp, Homo sapiens
ggaaggggagctggaaagggta

SEQ ID NO: 7806532 - DNA, 22 bp, Homo sapiens
ggaaggggccttgagcaaactg

SEQ ID NO: 7806533 - DNA, 22 bp, Homo sapiens
caaatgatacctattactaggc

SEQ ID NO: 7806534 - DNA, 22 bp, Homo sapiens
caaatgcatagtttataagaag

SEQ ID NO: 7806535 - DNA, 22 bp, Homo sapiens
caaatgcatgagaaataagagg

SEQ ID NO: 7806536 - DNA, 22 bp, Homo sapiens
caaaatgatgtgattttattgt

SEQ ID NO: 7806537 - DNA, 22 bp, Homo sapiens
attttgctttatgtaaatatgt

SEQ ID NO: 7806538 - DNA, 22 bp, Homo sapiens
attttacttcatttgaaatgcc

SEQ ID NO: 7806539 - DNA, 19 bp, Homo sapiens
atttttcttcctctgtgca

SEQ ID NO: 7806540 - DNA, 22 bp, Homo sapiens
atttttgccctgcagtacataa

SEQ ID NO: 7806541 - DNA, 22 bp, Homo sapiens
atttttctctcacacttaccag

SEQ ID NO: 7806542 - DNA, 22 bp, Homo sapiens
atttggaagtttggagtgaagg

SEQ ID NO: 7806543 - DNA, 22 bp, Homo sapiens
atttggaatagctgtagaaata

SEQ ID NO: 7806544 - DNA, 22 bp, Homo sapiens
atttggaacttataataagttt

SEQ ID NO: 7806545 - DNA, 22 bp, Homo sapiens
atttggaaatgtaagaatgcaa

SEQ ID NO: 7806546 - DNA, 22 bp, Homo sapiens
gcctattttattatgcatgtaa

SEQ ID NO: 7806547 - DNA, 22 bp, Homo sapiens
atttggaaatgcatctcttgag

SEQ ID NO: 7806548 - DNA, 22 bp, Homo sapiens
gccaggtgcacctgccctggcc

SEQ ID NO: 7806549 - DNA, 22 bp, Homo sapiens
gccaggctggaaagaacagaca

SEQ ID NO: 7806550 - DNA, 22 bp, Homo sapiens
atttctgccaaagtggggacct

SEQ ID NO: 7806551 - DNA, 22 bp, Homo sapiens
gcccacctaacctgctcacctt

SEQ ID NO: 7806552 - DNA, 22 bp, Homo sapiens
attagtattcagtttataacac

SEQ ID NO: 7806553 - DNA, 22 bp, Homo sapiens
attactgttggcaaagtcttat

SEQ ID NO: 7806554 - DNA, 22 bp, Homo sapiens
attacatgagagaatgtaaata

SEQ ID NO: 7806555 - DNA, 23 bp, Homo sapiens
attacatgagcaaatatagctat

SEQ ID NO: 7806556 - DNA, 22 bp, Homo sapiens
attactatgatttgatcattac

SEQ ID NO: 7806557 - DNA, 22 bp, Homo sapiens
attcacatgtgcttcttatcac

SEQ ID NO: 7806558 - DNA, 22 bp, Homo sapiens
attcacattgagcttcactgtg

SEQ ID NO: 7806559 - DNA, 22 bp, Homo sapiens
attcacattttatttcactgga

SEQ ID NO: 7806560 - DNA, 22 bp, Homo sapiens
attcactgtggtgactgatata

SEQ ID NO: 7806561 - DNA, 22 bp, Homo sapiens
gcagcgagtgcggctgccacag

SEQ ID NO: 7806562 - DNA, 22 bp, Homo sapiens
gcagctggaagtgacactctgt

SEQ ID NO: 7806563 - DNA, 22 bp, Homo sapiens
atgttggctggattttagattt

SEQ ID NO: 7806564 - DNA, 22 bp, Homo sapiens
gataatattagaagatacaaat

SEQ ID NO: 7806565 - DNA, 22 bp, Homo sapiens
gataattataggctaagccact

SEQ ID NO: 7806566 - DNA, 22 bp, Homo sapiens
gatacacaagtggaaggagacg

SEQ ID NO: 7806567 - DNA, 22 bp, Homo sapiens
gatacacaaaagtctagtgagg

SEQ ID NO: 7806568 - DNA, 22 bp, Homo sapiens
gaggcagcggctcacagagaaa

SEQ ID NO: 7806569 - DNA, 23 bp, Homo sapiens
gagagcaatgagatgtaaacact

SEQ ID NO: 7806570 - DNA, 22 bp, Homo sapiens
atggaggatgtgcagcatgggc

SEQ ID NO: 7806571 - DNA, 22 bp, Homo sapiens
gagatggccagtgccaggacaa

SEQ ID NO: 7806572 - DNA, 17 bp, Homo sapiens
gagatggcattggcagc

SEQ ID NO: 7806573 - DNA, 22 bp, Homo sapiens
gagatggcaggtgtgtgggaca

SEQ ID NO: 7806574 - DNA, 21 bp, Homo sapiens
gagatggcccagtagcgggcc

SEQ ID NO: 7806575 - DNA, 22 bp, Homo sapiens
gagatggctctcagatctttga

SEQ ID NO: 7806576 - DNA, 20 bp, Homo sapiens
gagatggctaagtgctgaac

SEQ ID NO: 7806577 - DNA, 22 bp, Homo sapiens
gagatggccctggcatgtagct

SEQ ID NO: 7806578 - DNA, 22 bp, Homo sapiens
gagatggcttgctctcacgtgg

SEQ ID NO: 7806579 - DNA, 23 bp, Homo sapiens
gagatggctggttgtcctctgaa

SEQ ID NO: 7806580 - DNA, 22 bp, Homo sapiens
gagatggtagcctcagaagagt

SEQ ID NO: 7806581 - DNA, 20 bp, Homo sapiens
atgggctggttaggaagtgt

SEQ ID NO: 7806582 - DNA, 22 bp, Homo sapiens
gaggcagcattcgcatagacag

SEQ ID NO: 7806583 - DNA, 22 bp, Homo sapiens
gaggcagccagaggttctcatt

SEQ ID NO: 7806584 - DNA, 22 bp, Homo sapiens
gaggcagcctcagtggacctcg

SEQ ID NO: 7806585 - DNA, 22 bp, Homo sapiens
gaataatattgactttgcaggc

SEQ ID NO: 7806586 - DNA, 22 bp, Homo sapiens
gaatatttttaaagggactaat

SEQ ID NO: 7806587 - DNA, 22 bp, Homo sapiens
gaatattttcagtacagatggt

SEQ ID NO: 7806588 - DNA, 22 bp, Homo sapiens
gaatcagactgacctgagttca

SEQ ID NO: 7806589 - DNA, 22 bp, Homo sapiens
ctttctcttgagcaagagctgt

SEQ ID NO: 7806590 - DNA, 22 bp, Homo sapiens
atgatgctgtttatcatatact

SEQ ID NO: 7806591 - DNA, 22 bp, Homo sapiens
atattacataaacatgagtgaa

SEQ ID NO: 7806592 - DNA, 22 bp, Homo sapiens
atattacataaacatgagtgaa

SEQ ID NO: 7806593 - DNA, 22 bp, Homo sapiens
atatgctatgttgaataatttg

SEQ ID NO: 7806594 - DNA, 22 bp, Homo sapiens
atatgctattgctgtaatttaa

SEQ ID NO: 7806595 - DNA, 22 bp, Homo sapiens
atatgctacaaataaactttta

SEQ ID NO: 7806596 - DNA, 22 bp, Homo sapiens
atatgctatgtatgtaaatgag

SEQ ID NO: 7806597 - DNA, 22 bp, Homo sapiens
atatgcgtactatatactgtgt

SEQ ID NO: 7806598 - DNA, 22 bp, Homo sapiens
atatgcatgtacgtgtgcacaa

SEQ ID NO: 7806599 - DNA, 22 bp, Homo sapiens
atatgcatatgtcaaaacttat

SEQ ID NO: 7806600 - DNA, 22 bp, Homo sapiens
atatgcatttacctggcatata

SEQ ID NO: 7806601 - DNA, 20 bp, Homo sapiens
atatgcatgtgttttcactt

SEQ ID NO: 7806602 - DNA, 22 bp, Homo sapiens
atattatagacagagtcttctg

SEQ ID NO: 7806603 - DNA, 22 bp, Homo sapiens
ctggctggccggaggcatccct

SEQ ID NO: 7806604 - DNA, 22 bp, Homo sapiens
atatgcacatacatacataggt

SEQ ID NO: 7806605 - DNA, 22 bp, Homo sapiens
atatgcataatacaaagagtat

SEQ ID NO: 7806606 - DNA, 22 bp, Homo sapiens
atatgcatatacacacatgcgt

SEQ ID NO: 7806607 - DNA, 20 bp, Homo sapiens
ctgggctcaagtgagcctcc

SEQ ID NO: 7806608 - DNA, 22 bp, Homo sapiens
atattgggatgtttggaaatgc

SEQ ID NO: 7806609 - DNA, 22 bp, Homo sapiens
atattgtactagggttacatgt

SEQ ID NO: 7806610 - DNA, 22 bp, Homo sapiens
atattcttgtgattataaagta

SEQ ID NO: 7806611 - DNA, 22 bp, Homo sapiens
atcagaataattagatttcaga

SEQ ID NO: 7806612 - DNA, 19 bp, Homo sapiens
atctgaggcctcatctggg

SEQ ID NO: 7806613 - DNA, 22 bp, Homo sapiens
atctgagtctctgacagcatgt

SEQ ID NO: 7806614 - DNA, 22 bp, Homo sapiens
cttcctaggaagtcagacttcc

SEQ ID NO: 7806615 - DNA, 22 bp, Homo sapiens
cttagatacagtagaaagactc

SEQ ID NO: 7806616 - DNA, 22 bp, Homo sapiens
atcctgggctgcaccctcagcc

SEQ ID NO: 7806617 - DNA, 22 bp, Homo sapiens
ctgtgtgtcctcggacgagttt

SEQ ID NO: 7806618 - DNA, 22 bp, Homo sapiens
ctgtgtgtcatttgtcaatcct

SEQ ID NO: 7806619 - DNA, 22 bp, Homo sapiens
atactacattattagagcctgg

SEQ ID NO: 7806620 - DNA, 22 bp, Homo sapiens
atactacacattgactatattt

SEQ ID NO: 7806621 - DNA, 22 bp, Homo sapiens
atactacaatcataattgtaca

SEQ ID NO: 7806622 - DNA, 22 bp, Homo sapiens
atactacaaggtatgtgctaaa

SEQ ID NO: 7806623 - DNA, 22 bp, Homo sapiens
ctggccccaggcagcctgctgg

SEQ ID NO: 7806624 - DNA, 22 bp, Homo sapiens
ctggccccatctggagtctgag

SEQ ID NO: 7806625 - DNA, 22 bp, Homo sapiens
ctggctccatcactgggtgatg

SEQ ID NO: 7806626 - DNA, 22 bp, Homo sapiens
ctggctggccatgcagcgccag

SEQ ID NO: 7806627 - DNA, 22 bp, Homo sapiens
ctggctggccatgtagagatga

SEQ ID NO: 7806628 - DNA, 22 bp, Homo sapiens
atagcactggtttttcttggtt

SEQ ID NO: 7806629 - DNA, 22 bp, Homo sapiens
atacatacatgtacacataaat

SEQ ID NO: 7806630 - DNA, 22 bp, Homo sapiens
atacatacgtacatacgtatgt

SEQ ID NO: 7806631 - DNA, 22 bp, Homo sapiens
atacatacatgtatgcacatac

SEQ ID NO: 7806632 - DNA, 22 bp, Homo sapiens
atacatgttcgtgtacatgttc

SEQ ID NO: 7806633 - DNA, 22 bp, Homo sapiens
atacatatatggtacttcctgg

SEQ ID NO: 7806634 - DNA, 22 bp, Homo sapiens
ataaatgattcagcaggaaata

SEQ ID NO: 7806635 - DNA, 21 bp, Homo sapiens
ataagcatgctgattacattt

SEQ ID NO: 7806636 - DNA, 22 bp, Homo sapiens
ctcctacagtgtttgagtccag

SEQ ID NO: 7806637 - DNA, 22 bp, Homo sapiens
ctcctcactttccagactgggc

SEQ ID NO: 7806638 - DNA, 22 bp, Homo sapiens
ctccctctcaccggagccctgg

SEQ ID NO: 7806639 - DNA, 22 bp, Homo sapiens
ctcctggggccatggaaggaac

SEQ ID NO: 7806640 - DNA, 22 bp, Homo sapiens
ctcctgggaatttagttgtgag

SEQ ID NO: 7806641 - DNA, 22 bp, Homo sapiens
ctcctgggaaatgaaggggcag

SEQ ID NO: 7806642 - DNA, 23 bp, Homo sapiens
agtcttcattgtatttccagacc

SEQ ID NO: 7806643 - DNA, 22 bp, Homo sapiens
ctccagctcgcgagctctgctc

SEQ ID NO: 7806644 - DNA, 22 bp, Homo sapiens
agtcctgatgctctggcaggag

SEQ ID NO: 7806645 - DNA, 21 bp, Homo sapiens
ctctgctgagtcctaggattc

SEQ ID NO: 7806646 - DNA, 22 bp, Homo sapiens
ctctgctgatatagcttttcaa

SEQ ID NO: 7806647 - DNA, 22 bp, Homo sapiens
ctctgctcagatgatttatcaa

SEQ ID NO: 7806648 - DNA, 22 bp, Homo sapiens
ctctgctgagccagagtcccca

SEQ ID NO: 7806649 - DNA, 22 bp, Homo sapiens
ctctgcgccaccctcgcctgct

SEQ ID NO: 7806650 - DNA, 22 bp, Homo sapiens
ctctggcttgttaatgcatatt

SEQ ID NO: 7806651 - DNA, 22 bp, Homo sapiens
ctctggctttaaggatgccaca

SEQ ID NO: 7806652 - DNA, 22 bp, Homo sapiens
ctgaattctgccttgaggcctt

SEQ ID NO: 7806653 - DNA, 22 bp, Homo sapiens
agtgtctgcctgggaggagcat

SEQ ID NO: 7806654 - DNA, 22 bp, Homo sapiens
agtgtctgctttgagtcaggtg

SEQ ID NO: 7806655 - DNA, 22 bp, Homo sapiens
agtgtctgcttatcagttcttg

SEQ ID NO: 7806656 - DNA, 22 bp, Homo sapiens
agttaactctgaaaagacattt

SEQ ID NO: 7806657 - DNA, 22 bp, Homo sapiens
cctggtgctgctatcaggggta

SEQ ID NO: 7806658 - DNA, 22 bp, Homo sapiens
cctgggcttgcatctgtgctgg

SEQ ID NO: 7806659 - DNA, 22 bp, Homo sapiens
aggtggggaggagtgtctcttt

SEQ ID NO: 7806660 - DNA, 21 bp, Homo sapiens
aggtggggctgcacctctgct

SEQ ID NO: 7806661 - DNA, 22 bp, Homo sapiens
agtacacagtagactttctcat

SEQ ID NO: 7806662 - DNA, 22 bp, Homo sapiens
agtacacagaattctacttgtt

SEQ ID NO: 7806663 - DNA, 22 bp, Homo sapiens
cgcaggcaagagagtacagtta

SEQ ID NO: 7806664 - DNA, 17 bp, Homo sapiens
cctgtgtttgctccttc

SEQ ID NO: 7806665 - DNA, 19 bp, Homo sapiens
cctgtgttgggagtgtgag

SEQ ID NO: 7806666 - DNA, 22 bp, Homo sapiens
cctgtgttctaatccatctcag

SEQ ID NO: 7806667 - DNA, 22 bp, Homo sapiens
cctgtgtttagatatgatgctg

SEQ ID NO: 7806668 - DNA, 22 bp, Homo sapiens
ctagggtcaggggcctgcgtcg

SEQ ID NO: 7806669 - DNA, 22 bp, Homo sapiens
catacaatcaagttctttatta

SEQ ID NO: 7806670 - DNA, 22 bp, Homo sapiens
catacataccactgctgtcttt

SEQ ID NO: 7806671 - DNA, 22 bp, Homo sapiens
catacataccactgctgtcttt

SEQ ID NO: 7806672 - DNA, 22 bp, Homo sapiens
catctcttcattagcattattg

SEQ ID NO: 7806673 - DNA, 22 bp, Homo sapiens
cataacatgtacatataaatgc

SEQ ID NO: 7806674 - DNA, 22 bp, Homo sapiens
cataatatactacattgatgaa

SEQ ID NO: 7806675 - DNA, 22 bp, Homo sapiens
cataatatactacattgatgaa

SEQ ID NO: 7806676 - DNA, 19 bp, Homo sapiens
cataatacagtggatctga

SEQ ID NO: 7806677 - DNA, 22 bp, Homo sapiens
cagtgtgtggattgcccttgca

SEQ ID NO: 7806678 - DNA, 22 bp, Homo sapiens
cagtgtttagcacagtgcttgg

SEQ ID NO: 7806679 - DNA, 22 bp, Homo sapiens
cagtccaggcctggaggagcca

SEQ ID NO: 7806680 - DNA, 22 bp, Homo sapiens
aggcaaggtgctacagacagtg

SEQ ID NO: 7806681 - DNA, 22 bp, Homo sapiens
agctttgcctgctgacattctg

SEQ ID NO: 7806682 - DNA, 22 bp, Homo sapiens
agctttcttgattttgcctgta

SEQ ID NO: 7806683 - DNA, 22 bp, Homo sapiens
agctttctgtcacctgtgcttg

SEQ ID NO: 7806684 - DNA, 22 bp, Homo sapiens
aggaagagcccgggtgacataa

SEQ ID NO: 7806685 - DNA, 22 bp, Homo sapiens
aggaagagctggaccagaggac

SEQ ID NO: 7806686 - DNA, 22 bp, Homo sapiens
caggcagcgtcctgcttcctgt

SEQ ID NO: 7806687 - DNA, 22 bp, Homo sapiens
caggcagcctgcggtctgcaca

SEQ ID NO: 7806688 - DNA, 22 bp, Homo sapiens
caggcagggagctggaaaggat

SEQ ID NO: 7806689 - DNA, 22 bp, Homo sapiens
caggcaggtcagtgaagaagga

SEQ ID NO: 7806690 - DNA, 22 bp, Homo sapiens
cagctggtaggtagcagatttg

SEQ ID NO: 7806691 - DNA, 22 bp, Homo sapiens
aggggaatgggtagactgttga

SEQ ID NO: 7806692 - DNA, 18 bp, Homo sapiens
aggggcagcttgtgtgga

SEQ ID NO: 7806693 - DNA, 22 bp, Homo sapiens
agggcctgtctgtagaactgaa

SEQ ID NO: 7806694 - DNA, 22 bp, Homo sapiens
agggaccagcgtgagtctgagg

SEQ ID NO: 7806695 - DNA, 22 bp, Homo sapiens
agggaccaggggtagctgagat

SEQ ID NO: 7806696 - DNA, 22 bp, Homo sapiens
cccaggaacctaccagctcgag

SEQ ID NO: 7806697 - DNA, 22 bp, Homo sapiens
cccaggaagtggaggttgcagt

SEQ ID NO: 7806698 - DNA, 22 bp, Homo sapiens
aggctgcagaggtgctgccaga

SEQ ID NO: 7806699 - DNA, 22 bp, Homo sapiens
cccactccctgcacgcctgccg

SEQ ID NO: 7806700 - DNA, 22 bp, Homo sapiens
aggctcagaggtgagcatctgc

SEQ ID NO: 7806701 - DNA, 22 bp, Homo sapiens
ccagccaggctggctgtggagg

SEQ ID NO: 7806702 - DNA, 22 bp, Homo sapiens
agaaatatgctgattagatgaa

SEQ ID NO: 7806703 - DNA, 22 bp, Homo sapiens
agaaatatgctgattagatgaa

SEQ ID NO: 7806704 - DNA, 22 bp, Homo sapiens
agaaagttttgtgctatatatg

SEQ ID NO: 7806705 - DNA, 22 bp, Homo sapiens
atattaaatggattttgggagc

SEQ ID NO: 7806706 - DNA, 19 bp, Homo sapiens
atatagcattattcaattt

SEQ ID NO: 7806707 - DNA, 22 bp, Homo sapiens
agaaaagggcaggagggataca

SEQ ID NO: 7806708 - DNA, 22 bp, Homo sapiens
atagttcacagccatgcagtgg

SEQ ID NO: 7806709 - DNA, 22 bp, Homo sapiens
atagttatttctgtcactgtca

SEQ ID NO: 7806710 - DNA, 22 bp, Homo sapiens
ataaattttcttgctgtactta

SEQ ID NO: 7806711 - DNA, 22 bp, Homo sapiens
agttgacatccagagacattct

SEQ ID NO: 7806712 - DNA, 22 bp, Homo sapiens
atacaagttgtgataatgtaaa

SEQ ID NO: 7806713 - DNA, 19 bp, Homo sapiens
atacacgtgtatacataca

SEQ ID NO: 7806714 - DNA, 22 bp, Homo sapiens
atacacgtgtgtgtacatgcac

SEQ ID NO: 7806715 - DNA, 22 bp, Homo sapiens
atacactactaagcacagattg

SEQ ID NO: 7806716 - DNA, 22 bp, Homo sapiens
atacacacatatgtgagttttg

SEQ ID NO: 7806717 - DNA, 22 bp, Homo sapiens
aggtggggttcagtctcagccg

SEQ ID NO: 7806718 - DNA, 22 bp, Homo sapiens
agggtgcagtcacaggaaatgt

SEQ ID NO: 7806719 - DNA, 22 bp, Homo sapiens
agggtgcatgtttgcaagagtg

SEQ ID NO: 7806720 - DNA, 22 bp, Homo sapiens
agggtgcaggtgtggagtctag

SEQ ID NO: 7806721 - DNA, 22 bp, Homo sapiens
agggtgcagaaggagcctagga

SEQ ID NO: 7806722 - DNA, 22 bp, Homo sapiens
agggtgcaaaagcaaggacagt

SEQ ID NO: 7806723 - DNA, 17 bp, Homo sapiens
agtgaggagattggaag

SEQ ID NO: 7806724 - DNA, 22 bp, Homo sapiens
agtgaggataccaatgtgtaga

SEQ ID NO: 7806725 - DNA, 22 bp, Homo sapiens
agtggcagacacaatgtgggca

SEQ ID NO: 7806726 - DNA, 21 bp, Homo sapiens
agttacatgtatagataaagt

SEQ ID NO: 7806727 - DNA, 20 bp, Homo sapiens
agtgtctggtgcagggcctc

SEQ ID NO: 7806728 - DNA, 17 bp, Homo sapiens
agtgtgtaacttgtgta

SEQ ID NO: 7806729 - DNA, 22 bp, Homo sapiens
agtgtgtagcacatggtaagca

SEQ ID NO: 7806730 - DNA, 17 bp, Homo sapiens
agtgtgtgaaatggtgg

SEQ ID NO: 7806731 - DNA, 22 bp, Homo sapiens
acatgtatgctttatgaagtag

SEQ ID NO: 7806732 - DNA, 22 bp, Homo sapiens
acatgtatacaatgtgtaatga

SEQ ID NO: 7806733 - DNA, 22 bp, Homo sapiens
aggcagtgtgtagctggaagag

SEQ ID NO: 7806734 - DNA, 22 bp, Homo sapiens
aggggcagttccaagttttgtg

SEQ ID NO: 7806735 - DNA, 21 bp, Homo sapiens
acagggcatgcagctggctgt

SEQ ID NO: 7806736 - DNA, 23 bp, Homo sapiens
acagggcattgctggcctcgagg

SEQ ID NO: 7806737 - DNA, 22 bp, Homo sapiens
aggaaaggtagcgtgccagcag

SEQ ID NO: 7806738 - DNA, 22 bp, Homo sapiens
aggaaaggtgagagcggccgcg

SEQ ID NO: 7806739 - DNA, 22 bp, Homo sapiens
aggactggtgtgtgatcagcat

SEQ ID NO: 7806740 - DNA, 22 bp, Homo sapiens
aggacaggtgtagtgggctctg

SEQ ID NO: 7806741 - DNA, 22 bp, Homo sapiens
acagcagtttagaggacagcca

SEQ ID NO: 7806742 - DNA, 22 bp, Homo sapiens
acatatatgtgcacatgtgcag

SEQ ID NO: 7806743 - DNA, 22 bp, Homo sapiens
acatatatgcgtgggctcatgg

SEQ ID NO: 7806744 - DNA, 22 bp, Homo sapiens
acatatatgtaaagtactttgt

SEQ ID NO: 7806745 - DNA, 22 bp, Homo sapiens
acatatatgctgggactgtgac

SEQ ID NO: 7806746 - DNA, 22 bp, Homo sapiens
acatctctgggtcctccatgca

SEQ ID NO: 7806747 - DNA, 22 bp, Homo sapiens
aggcagcaatgaatgaaatgga

SEQ ID NO: 7806748 - DNA, 22 bp, Homo sapiens
aggcagcaaatgtctggaacag

SEQ ID NO: 7806749 - DNA, 22 bp, Homo sapiens
aggcagcaaagaaatgatgctg

SEQ ID NO: 7806750 - DNA, 22 bp, Homo sapiens
agcaggtggccacgaggaggag

SEQ ID NO: 7806751 - DNA, 22 bp, Homo sapiens
agcaggtggccacgaggaggag

SEQ ID NO: 7806752 - DNA, 22 bp, Homo sapiens
agcaggtggatttagacgggag

SEQ ID NO: 7806753 - DNA, 18 bp, Homo sapiens
agcaggcgttgcctggga

SEQ ID NO: 7806754 - DNA, 22 bp, Homo sapiens
caaggaagacccacgcagatat

SEQ ID NO: 7806755 - DNA, 22 bp, Homo sapiens
caagctgggtgcgggcagtata

SEQ ID NO: 7806756 - DNA, 22 bp, Homo sapiens
caattacatttattgagcattc

SEQ ID NO: 7806757 - DNA, 20 bp, Homo sapiens
agccctcttccagatgaagg

SEQ ID NO: 7806758 - DNA, 22 bp, Homo sapiens
agccctctctttagagatctga

SEQ ID NO: 7806759 - DNA, 22 bp, Homo sapiens
agccctcttcccagatgcctca

SEQ ID NO: 7806760 - DNA, 18 bp, Homo sapiens
cagagtgggccaagagac

SEQ ID NO: 7806761 - DNA, 20 bp, Homo sapiens
cagagccagggttttgtttt

SEQ ID NO: 7806762 - DNA, 22 bp, Homo sapiens
agccagggaggtggaggttgca

SEQ ID NO: 7806763 - DNA, 22 bp, Homo sapiens
cagctgggtgatcttgggcagg

SEQ ID NO: 7806764 - DNA, 21 bp, Homo sapiens
attctctgtgatgggattagg

SEQ ID NO: 7806765 - DNA, 22 bp, Homo sapiens
attctctgggttccagtaaatg

SEQ ID NO: 7806766 - DNA, 22 bp, Homo sapiens
attctctggaagaagataaaaa

SEQ ID NO: 7806767 - DNA, 22 bp, Homo sapiens
attctctgctgcactgataaca

SEQ ID NO: 7806768 - DNA, 22 bp, Homo sapiens
agataattatttacttcaaagt

SEQ ID NO: 7806769 - DNA, 22 bp, Homo sapiens
attgtgtggtgaatgatcagct

SEQ ID NO: 7806770 - DNA, 22 bp, Homo sapiens
attgtgtatgttaattctgtaa

SEQ ID NO: 7806771 - DNA, 22 bp, Homo sapiens
attgtgtagtagtattctgttt

SEQ ID NO: 7806772 - DNA, 22 bp, Homo sapiens
attgttaaaaaggtggaaatgc

SEQ ID NO: 7806773 - DNA, 22 bp, Homo sapiens
attgaaaataaggccagaaaca

SEQ ID NO: 7806774 - DNA, 22 bp, Homo sapiens
agcaagatgcattatttcttat

SEQ ID NO: 7806775 - DNA, 22 bp, Homo sapiens
attttttgttaactcaggatag

SEQ ID NO: 7806776 - DNA, 20 bp, Homo sapiens
agcaaggctggagcttatgg

SEQ ID NO: 7806777 - DNA, 22 bp, Homo sapiens
agatgactaacatagtattgct

SEQ ID NO: 7806778 - DNA, 22 bp, Homo sapiens
agattgggattagagatctgta

SEQ ID NO: 7806779 - DNA, 22 bp, Homo sapiens
agattgggtttgcttctgtgcc

SEQ ID NO: 7806780 - DNA, 22 bp, Homo sapiens
atgccattgtatattcattgat

SEQ ID NO: 7806781 - DNA, 22 bp, Homo sapiens
atgccaggagatggagcagagt

SEQ ID NO: 7806782 - DNA, 22 bp, Homo sapiens
atgctgataactttcagtgaca

SEQ ID NO: 7806783 - DNA, 22 bp, Homo sapiens
atgctgattttatagaataaag

SEQ ID NO: 7806784 - DNA, 22 bp, Homo sapiens
atgcaaattaacatatagtaga

SEQ ID NO: 7806785 - DNA, 22 bp, Homo sapiens
atgcaaatgtcaccacttctaa

SEQ ID NO: 7806786 - DNA, 21 bp, Homo sapiens
atgactgtggcacttaggagg

SEQ ID NO: 7806787 - DNA, 22 bp, Homo sapiens
agagctatatacagattattga

SEQ ID NO: 7806788 - DNA, 21 bp, Homo sapiens
atgttcactgggtcaattaga

SEQ ID NO: 7806789 - DNA, 22 bp, Homo sapiens
agagatgggaaggcagacttca

SEQ ID NO: 7806790 - DNA, 22 bp, Homo sapiens
aaaggctggggactgaggaagg

SEQ ID NO: 7806791 - DNA, 22 bp, Homo sapiens
aaaggcttcagtgagtgggtat

SEQ ID NO: 7806792 - DNA, 22 bp, Homo sapiens
aaaggcttgtccagtaagggga

SEQ ID NO: 7806793 - DNA, 18 bp, Homo sapiens
aaaggctgaatatagaag

SEQ ID NO: 7806794 - DNA, 22 bp, Homo sapiens
aaaggcatgattaattctgtgt

SEQ ID NO: 7806795 - DNA, 22 bp, Homo sapiens
aaatatgagagtaggagtttgg

SEQ ID NO: 7806796 - DNA, 22 bp, Homo sapiens
aaatgctgcagctagtgtgttt

SEQ ID NO: 7806797 - DNA, 22 bp, Homo sapiens
aaatgctgtaactgatattctg

SEQ ID NO: 7806798 - DNA, 22 bp, Homo sapiens
aaatgcaaggattttgttaggc

SEQ ID NO: 7806799 - DNA, 22 bp, Homo sapiens
aaatgatgttataagaccagga

SEQ ID NO: 7806800 - DNA, 22 bp, Homo sapiens
aaatgatgctacagttttccca

SEQ ID NO: 7806801 - DNA, 22 bp, Homo sapiens
aaatgatgctcacagattagtg

SEQ ID NO: 7806802 - DNA, 20 bp, Homo sapiens
aaatgatgggaataatctat

SEQ ID NO: 7806803 - DNA, 22 bp, Homo sapiens
aaatgatggaaatgaggctgaa

SEQ ID NO: 7806804 - DNA, 22 bp, Homo sapiens
aaatgatggtactcatgtttag

SEQ ID NO: 7806805 - DNA, 22 bp, Homo sapiens
aaatgatgtggagtgaaattgt

SEQ ID NO: 7806806 - DNA, 23 bp, Homo sapiens
aaatgatgtgtgttgtcccattc

SEQ ID NO: 7806807 - DNA, 22 bp, Homo sapiens
aaatgcaagttcatattttgtt

SEQ ID NO: 7806808 - DNA, 22 bp, Homo sapiens
aaatatttgtctgaggcggttg

SEQ ID NO: 7806809 - DNA, 22 bp, Homo sapiens
aaatgatgattaaaatgaggta

SEQ ID NO: 7806810 - DNA, 22 bp, Homo sapiens
aaatcagagaatatatttagaa

SEQ ID NO: 7806811 - DNA, 22 bp, Homo sapiens
aaatcagacacagtgaaagtta

SEQ ID NO: 7806812 - DNA, 22 bp, Homo sapiens
aaagtacaaggaaaggatctga

SEQ ID NO: 7806813 - DNA, 22 bp, Homo sapiens
aaagacagatggcaaggatgat

SEQ ID NO: 7806814 - DNA, 22 bp, Homo sapiens
aaatgtctgagacttctgaact

SEQ ID NO: 7806815 - DNA, 22 bp, Homo sapiens
aaatggtgttgtatttagtctc

SEQ ID NO: 7806816 - DNA, 22 bp, Homo sapiens
aaacttcatggataatataaag

SEQ ID NO: 7806817 - DNA, 22 bp, Homo sapiens
aaagcagccggttccctggtct

SEQ ID NO: 7806818 - DNA, 22 bp, Homo sapiens
aaagcagccacagagagagcgt

SEQ ID NO: 7806819 - DNA, 22 bp, Homo sapiens
aaagcagcagcacgtggaagag

SEQ ID NO: 7806820 - DNA, 22 bp, Homo sapiens
aaagcagctttcggccctcggg

SEQ ID NO: 7806821 - DNA, 22 bp, Homo sapiens
aaaatgcatgagaatgtgctcg

SEQ ID NO: 7806822 - DNA, 22 bp, Homo sapiens
aaaatgcatgagaatgtgctcg

SEQ ID NO: 7806823 - DNA, 18 bp, Homo sapiens
aaaatgcaggcgacatgg

SEQ ID NO: 7806824 - DNA, 22 bp, Homo sapiens
aaaatgtaaagcttgagtgtag

SEQ ID NO: 7806825 - DNA, 22 bp, Homo sapiens
aaaatgcaaacctacctacata

SEQ ID NO: 7806826 - DNA, 20 bp, Homo sapiens
aaaatgatgggcagggcagg

SEQ ID NO: 7806827 - DNA, 22 bp, Homo sapiens
aaaatgatgctgtaatttggca

SEQ ID NO: 7806828 - DNA, 22 bp, Homo sapiens
aaaatgatatcctgacttttat

SEQ ID NO: 7806829 - DNA, 22 bp, Homo sapiens
aaatggatggaattgacattta

SEQ ID NO: 7806830 - DNA, 22 bp, Homo sapiens
aagtccaggtcctcattccatc

SEQ ID NO: 7806831 - DNA, 22 bp, Homo sapiens
aagggctgcaatccaaaacact

SEQ ID NO: 7806832 - DNA, 22 bp, Homo sapiens
aatattgagaaccagcatgttt

SEQ ID NO: 7806833 - DNA, 22 bp, Homo sapiens
aatattgtttcaagatcacaga

SEQ ID NO: 7806834 - DNA, 23 bp, Homo sapiens
aatatctgcagctcctggggagg

SEQ ID NO: 7806835 - DNA, 22 bp, Homo sapiens
aacagtttatgataaattctta

SEQ ID NO: 7806836 - DNA, 22 bp, Homo sapiens
aataatgtacatacatatttcg

SEQ ID NO: 7806837 - DNA, 22 bp, Homo sapiens
aataatgtaggatgataaatga

SEQ ID NO: 7806838 - DNA, 22 bp, Homo sapiens
aataagaattgccagatttgaa

SEQ ID NO: 7806839 - DNA, 22 bp, Homo sapiens
aatgcagtttcatttgtagaat

SEQ ID NO: 7806840 - DNA, 22 bp, Homo sapiens
aatgcacatatatttccttatt

SEQ ID NO: 7806841 - DNA, 22 bp, Homo sapiens
aatctggtctaagtgaggatag

SEQ ID NO: 7806842 - DNA, 22 bp, Homo sapiens
aatctcttcccagtaaaaatgg

SEQ ID NO: 7806843 - DNA, 22 bp, Homo sapiens
aagataatattcattaactaga

SEQ ID NO: 7806844 - DNA, 22 bp, Homo sapiens
aagaatatagattttttgaagt

SEQ ID NO: 7806845 - DNA, 22 bp, Homo sapiens
aagaatatctgttttatttagg

SEQ ID NO: 7806846 - DNA, 20 bp, Homo sapiens
acacatatagcagcataaac

SEQ ID NO: 7806847 - DNA, 22 bp, Homo sapiens
acacttgtggcctttctagtaa

SEQ ID NO: 7806848 - DNA, 21 bp, Homo sapiens
agcaggtgtaaaggaggaaat

SEQ ID NO: 7806849 - DNA, 22 bp, Homo sapiens
agcaggtggtaggcagtcagca

SEQ ID NO: 7806850 - DNA, 22 bp, Homo sapiens
agcagggaatagcggaaagaat

SEQ ID NO: 7806851 - DNA, 21 bp, Homo sapiens
agctgaggtaaggcaagagag

SEQ ID NO: 7806852 - DNA, 22 bp, Homo sapiens
acagcagtgcacagagaaccct

SEQ ID NO: 7806853 - DNA, 22 bp, Homo sapiens
acagataattagcataaatgct

SEQ ID NO: 7806854 - DNA, 22 bp, Homo sapiens
agagtgggttataggcagactt

SEQ ID NO: 7806855 - DNA, 22 bp, Homo sapiens
agagtgtgaagaaagtgcaatg

SEQ ID NO: 7806856 - DNA, 22 bp, Homo sapiens
agagttaagtgaaatgtaataa

SEQ ID NO: 7806857 - DNA, 22 bp, Homo sapiens
aatttgattttcttaaaccata

SEQ ID NO: 7806858 - DNA, 22 bp, Homo sapiens
aatttccagatcagatgactca

SEQ ID NO: 7806859 - DNA, 22 bp, Homo sapiens
aatgtatgacagttctagtggt

SEQ ID NO: 7806860 - DNA, 23 bp, Homo sapiens
aatgtatgttagtatcttagaga

SEQ ID NO: 7806861 - DNA, 22 bp, Homo sapiens
aatgtatgtgattattcctcta

SEQ ID NO: 7806862 - DNA, 22 bp, Homo sapiens
agagaagggcctgtatgtaatc

SEQ ID NO: 7806863 - DNA, 22 bp, Homo sapiens
aaggggtcaagcggcagctaca

SEQ ID NO: 7806864 - DNA, 22 bp, Homo sapiens
aagtataagctattcttcatga

SEQ ID NO: 7806865 - DNA, 22 bp, Homo sapiens
aaggacagaaacagattgctgg

SEQ ID NO: 7806866 - DNA, 22 bp, Homo sapiens
aaggcattacctaagtttggga

SEQ ID NO: 7806867 - DNA, 22 bp, Homo sapiens
acatgcatggacatgtatatat

SEQ ID NO: 7806868 - DNA, 22 bp, Homo sapiens
acatgcatggctgcttaaatta

SEQ ID NO: 7806869 - DNA, 22 bp, Homo sapiens
acatgcatatacttaaatatgt

SEQ ID NO: 7806870 - DNA, 22 bp, Homo sapiens
agaaagggagagccagcacacg

SEQ ID NO: 7806871 - DNA, 22 bp, Homo sapiens
agaaagggagcgtggatcaatt

SEQ ID NO: 7806872 - DNA, 22 bp, Homo sapiens
agaaagggatgaggtagctgct

SEQ ID NO: 7806873 - DNA, 22 bp, Homo sapiens
agaaagggaactggcaaagcca

SEQ ID NO: 7806874 - DNA, 22 bp, Homo sapiens
agaaagggaccagttcttttga

SEQ ID NO: 7806875 - DNA, 22 bp, Homo sapiens
agaaagggaactggcaaagcca

SEQ ID NO: 7806876 - DNA, 22 bp, Homo sapiens
aatcctggcctagctgggctca

SEQ ID NO: 7806877 - DNA, 20 bp, Homo sapiens
aatcctgggacagaggcagg

SEQ ID NO: 7806878 - DNA, 22 bp, Homo sapiens
agaaaggcagggatgaggattg

SEQ ID NO: 7806879 - DNA, 22 bp, Homo sapiens
aatagcatgtaagtttaaaaga

SEQ ID NO: 7806880 - DNA, 22 bp, Homo sapiens
aatagcttttgtatgatgaaat

SEQ ID NO: 7806881 - DNA, 22 bp, Homo sapiens
aatagcttttgtatgatgaaat

SEQ ID NO: 7806882 - DNA, 22 bp, Homo sapiens
aatagcttatgggatagatgtt

SEQ ID NO: 7806883 - DNA, 22 bp, Homo sapiens
aatgcattgttgatttggagtg

SEQ ID NO: 7806884 - DNA, 22 bp, Homo sapiens
aatgcacaaaggtgtctattgc

SEQ ID NO: 7806885 - DNA, 18 bp, Homo sapiens
aatgcatttatggagatg

SEQ ID NO: 7806886 - DNA, 22 bp, Homo sapiens
aatgcattttattatatgtgac

SEQ ID NO: 7806887 - DNA, 22 bp, Homo sapiens
aatgcacaaaaattgtatgtaa

SEQ ID NO: 7806888 - DNA, 22 bp, Homo sapiens
tagaaaggatattgagatgaat

SEQ ID NO: 7806889 - DNA, 22 bp, Homo sapiens
tagaaaggcaagcgtgaaatat

SEQ ID NO: 7806890 - DNA, 22 bp, Homo sapiens
tagaaaggaagctacttagggg

SEQ ID NO: 7806891 - DNA, 22 bp, Homo sapiens
tataaatgccaggactttagat

SEQ ID NO: 7806892 - DNA, 22 bp, Homo sapiens
tatacaatgagtacattctggg

SEQ ID NO: 7806893 - DNA, 22 bp, Homo sapiens
tatacacaaacaaggggttaag

SEQ ID NO: 7806894 - DNA, 22 bp, Homo sapiens
tatacaatggctgaatcatcca

SEQ ID NO: 7806895 - DNA, 22 bp, Homo sapiens
tatacacaaggtgtgcatttgt

SEQ ID NO: 7806896 - DNA, 22 bp, Homo sapiens
tatacacacctccaaagcagga

SEQ ID NO: 7806897 - DNA, 22 bp, Homo sapiens
tatacacacatgctccggcctt

SEQ ID NO: 7806898 - DNA, 23 bp, Homo sapiens
tatacacatgtggcagtatagtg

SEQ ID NO: 7806899 - DNA, 22 bp, Homo sapiens
tatacacatcctccaaagatag

SEQ ID NO: 7806900 - DNA, 22 bp, Homo sapiens
tatacacatatcttctaggcct

SEQ ID NO: 7806901 - DNA, 17 bp, Homo sapiens
tatacacagacagactg

SEQ ID NO: 7806902 - DNA, 22 bp, Homo sapiens
tatacacaggaatctgtgaaaa

SEQ ID NO: 7806903 - DNA, 22 bp, Homo sapiens
tatacacatatacgtttgtgtg

SEQ ID NO: 7806904 - DNA, 22 bp, Homo sapiens
tatacacatttttacctatagt

SEQ ID NO: 7806905 - DNA, 22 bp, Homo sapiens
tatacacatgtgtgtattcata

SEQ ID NO: 7806906 - DNA, 22 bp, Homo sapiens
tatacacattacagtttcagga

SEQ ID NO: 7806907 - DNA, 22 bp, Homo sapiens
tatatattcttaagtagtgtag

SEQ ID NO: 7806908 - DNA, 22 bp, Homo sapiens
tatagctaaggtcagactgttt

SEQ ID NO: 7806909 - DNA, 22 bp, Homo sapiens
tatagcatttatcatctctgaa

SEQ ID NO: 7806910 - DNA, 22 bp, Homo sapiens
tatagcatggctatattgttgc

SEQ ID NO: 7806911 - DNA, 22 bp, Homo sapiens
tattcttaattgctgagctgaa

SEQ ID NO: 7806912 - DNA, 21 bp, Homo sapiens
tatttattaatttgtaaggct

SEQ ID NO: 7806913 - DNA, 22 bp, Homo sapiens
tatttaatttgctcattgtgat

SEQ ID NO: 7806914 - DNA, 22 bp, Homo sapiens
tattacatccacttttattgca

SEQ ID NO: 7806915 - DNA, 20 bp, Homo sapiens
tattacacacaatgagcagt

SEQ ID NO: 7806916 - DNA, 19 bp, Homo sapiens
tatgtgtgcatttgtgcat

SEQ ID NO: 7806917 - DNA, 22 bp, Homo sapiens
tatgtgtgctttttccatgcat

SEQ ID NO: 7806918 - DNA, 22 bp, Homo sapiens
tatgtgtgcatgtatacattaa

SEQ ID NO: 7806919 - DNA, 22 bp, Homo sapiens
tatgtctggaagtgtacttgtc

SEQ ID NO: 7806920 - DNA, 22 bp, Homo sapiens
taaggtaactgcttttggctga

SEQ ID NO: 7806921 - DNA, 22 bp, Homo sapiens
taattataacagttacatctta

SEQ ID NO: 7806922 - DNA, 22 bp, Homo sapiens
taattacaggtccaaaacaatc

SEQ ID NO: 7806923 - DNA, 22 bp, Homo sapiens
taattacaaagcaagcacaggg

SEQ ID NO: 7806924 - DNA, 22 bp, Homo sapiens
tacaaagtaatgtataatatcg

SEQ ID NO: 7806925 - DNA, 22 bp, Homo sapiens
tacatatactgagtgatttgct

SEQ ID NO: 7806926 - DNA, 22 bp, Homo sapiens
tacatatagacagttactctag

SEQ ID NO: 7806927 - DNA, 22 bp, Homo sapiens
tacattctactttttcactccc

SEQ ID NO: 7806928 - DNA, 22 bp, Homo sapiens
tacatacattacctcatttagt

SEQ ID NO: 7806929 - DNA, 22 bp, Homo sapiens
tacatacatgtatgtgtgtatt

SEQ ID NO: 7806930 - DNA, 22 bp, Homo sapiens
tacatagaatatttcacttaaa

SEQ ID NO: 7806931 - DNA, 22 bp, Homo sapiens
gtgctgaaatggacctcaggaa

SEQ ID NO: 7806932 - DNA, 22 bp, Homo sapiens
gtgctctgtgtattaggatgtc

SEQ ID NO: 7806933 - DNA, 22 bp, Homo sapiens
gttgcagatgtggaactcgtgc

SEQ ID NO: 7806934 - DNA, 22 bp, Homo sapiens
gttgagtgggttaggatgctga

SEQ ID NO: 7806935 - DNA, 22 bp, Homo sapiens
gttttctttgaatgcttctaga

SEQ ID NO: 7806936 - DNA, 22 bp, Homo sapiens
gttttgaatactactagaactt

SEQ ID NO: 7806937 - DNA, 22 bp, Homo sapiens
taaaatgccagaccagttcacg

SEQ ID NO: 7806938 - DNA, 22 bp, Homo sapiens
taaaatgcacagcagttgaaag

SEQ ID NO: 7806939 - DNA, 22 bp, Homo sapiens
taaattatgtcacatgactctg

SEQ ID NO: 7806940 - DNA, 22 bp, Homo sapiens
taaagtataagcattggagtat

SEQ ID NO: 7806941 - DNA, 22 bp, Homo sapiens
taaagtatccagttattcttct

SEQ ID NO: 7806942 - DNA, 22 bp, Homo sapiens
taaattgttttctagaagttgt

SEQ ID NO: 7806943 - DNA, 22 bp, Homo sapiens
taactcttccaacactccttcc

SEQ ID NO: 7806944 - DNA, 22 bp, Homo sapiens
tcacccaggatattgaagtcag

SEQ ID NO: 7806945 - DNA, 22 bp, Homo sapiens
tcagacctctgaccttgccaaa

SEQ ID NO: 7806946 - DNA, 22 bp, Homo sapiens
tcagagcatgtgggctgcagtt

SEQ ID NO: 7806947 - DNA, 22 bp, Homo sapiens
tcacaaggttcactataaattg

SEQ ID NO: 7806948 - DNA, 22 bp, Homo sapiens
tcacaggcttgtgaacattgca

SEQ ID NO: 7806949 - DNA, 22 bp, Homo sapiens
tcaattttatgaaacaaagtga

SEQ ID NO: 7806950 - DNA, 22 bp, Homo sapiens
tcatataccagagagtttatat

SEQ ID NO: 7806951 - DNA, 22 bp, Homo sapiens
tcatatacctgcatgtgcatgt

SEQ ID NO: 7806952 - DNA, 22 bp, Homo sapiens
tcatatactgccttgtagatta

SEQ ID NO: 7806953 - DNA, 22 bp, Homo sapiens
tcatatattttggcagtgatca

SEQ ID NO: 7806954 - DNA, 21 bp, Homo sapiens
tcatatattccagctgcagct

SEQ ID NO: 7806955 - DNA, 22 bp, Homo sapiens
tcatatgcatatgaaatttttg

SEQ ID NO: 7806956 - DNA, 22 bp, Homo sapiens
tcagtgttattagatgaggttt

SEQ ID NO: 7806957 - DNA, 22 bp, Homo sapiens
tcattattttggactggagtgt

SEQ ID NO: 7806958 - DNA, 22 bp, Homo sapiens
tcattatagagttgtattttag

SEQ ID NO: 7806959 - DNA, 21 bp, Homo sapiens
tcagtgtatttaagaatgttg

SEQ ID NO: 7806960 - DNA, 22 bp, Homo sapiens
tcagtgtaagttatgtagatgt

SEQ ID NO: 7806961 - DNA, 21 bp, Homo sapiens
tcaggaagagccagttcatgc

SEQ ID NO: 7806962 - DNA, 22 bp, Homo sapiens
tcaggaaggagctggcctgcca

SEQ ID NO: 7806963 - DNA, 22 bp, Homo sapiens
tccagcagtccatgtgagacac

SEQ ID NO: 7806964 - DNA, 23 bp, Homo sapiens
tccagcagagccttccaggaggg

SEQ ID NO: 7806965 - DNA, 22 bp, Homo sapiens
tccagcagccacacctctggac

SEQ ID NO: 7806966 - DNA, 22 bp, Homo sapiens
tcccatatatgtttatattgga

SEQ ID NO: 7806967 - DNA, 20 bp, Homo sapiens
tcccagtcagccagagtgag

SEQ ID NO: 7806968 - DNA, 19 bp, Homo sapiens
ggaccaggtcctgggcagc

SEQ ID NO: 7806969 - DNA, 22 bp, Homo sapiens
ggacagtgaatctggaggtata

SEQ ID NO: 7806970 - DNA, 19 bp, Homo sapiens
ggagactcagcccatgcct

SEQ ID NO: 7806971 - DNA, 22 bp, Homo sapiens
ggagactcgggttctagccttg

SEQ ID NO: 7806972 - DNA, 22 bp, Homo sapiens
ggagactctcattgtcaagctt

SEQ ID NO: 7806973 - DNA, 22 bp, Homo sapiens
ggagactcaccccgcattctag

SEQ ID NO: 7806974 - DNA, 22 bp, Homo sapiens
ggaattctgcatgttcagttgg

SEQ ID NO: 7806975 - DNA, 22 bp, Homo sapiens
ggaattctgtagctcttcctct

SEQ ID NO: 7806976 - DNA, 22 bp, Homo sapiens
ggaagagggaaccacgactgta

SEQ ID NO: 7806977 - DNA, 22 bp, Homo sapiens
ggaagaggctggtagtgcccgt

SEQ ID NO: 7806978 - DNA, 22 bp, Homo sapiens
ggaatcagagcagaggctgtta

SEQ ID NO: 7806979 - DNA, 22 bp, Homo sapiens
ggaatcagcaaggaggctcacc

SEQ ID NO: 7806980 - DNA, 22 bp, Homo sapiens
gctttggaatgtgctgttatag

SEQ ID NO: 7806981 - DNA, 22 bp, Homo sapiens
gctttggagcctgtgttctgcc

SEQ ID NO: 7806982 - DNA, 22 bp, Homo sapiens
gctttggagggcaagagctgtt

SEQ ID NO: 7806983 - DNA, 22 bp, Homo sapiens
ggaagaggaggagccaggcttt

SEQ ID NO: 7806984 - DNA, 22 bp, Homo sapiens
ggaagaggctctcattgagggc

SEQ ID NO: 7806985 - DNA, 22 bp, Homo sapiens
ggaagaggctgaggccatgctg

SEQ ID NO: 7806986 - DNA, 22 bp, Homo sapiens
ggaagaggctgagccaggtccc

SEQ ID NO: 7806987 - DNA, 17 bp, Homo sapiens
gctttggaaagccttcc

SEQ ID NO: 7806988 - DNA, 22 bp, Homo sapiens
gctgtgctatatctctgagtgt

SEQ ID NO: 7806989 - DNA, 22 bp, Homo sapiens
gctggggagggcgtcaaggcca

SEQ ID NO: 7806990 - DNA, 22 bp, Homo sapiens
gctggggaggcagcagagaaca

SEQ ID NO: 7806991 - DNA, 22 bp, Homo sapiens
gccttggctgatgtgcgaatga

SEQ ID NO: 7806992 - DNA, 22 bp, Homo sapiens
gcctctggtccctcatgctgtg

SEQ ID NO: 7806993 - DNA, 22 bp, Homo sapiens
gcgtattttagtctatgtgcat

SEQ ID NO: 7806994 - DNA, 22 bp, Homo sapiens
gcgtggggcagcccagggcttc

SEQ ID NO: 7806995 - DNA, 22 bp, Homo sapiens
gctcagagggaacaaggggctg

SEQ ID NO: 7806996 - DNA, 22 bp, Homo sapiens
gcagagcaggaaggaagtcagg

SEQ ID NO: 7806997 - DNA, 22 bp, Homo sapiens
gcagatggagacgaggttccgc

SEQ ID NO: 7806998 - DNA, 22 bp, Homo sapiens
gcagatggactgtatgacctga

SEQ ID NO: 7806999 - DNA, 22 bp, Homo sapiens
gcagatggaaagtgcttgaggg

SEQ ID NO: 7807000 - DNA, 22 bp, Homo sapiens
gcagaggtctagcaccaagaat

SEQ ID NO: 7807001 - DNA, 22 bp, Homo sapiens
gcagagaacccagcagattggc

SEQ ID NO: 7807002 - DNA, 22 bp, Homo sapiens
gcaaataaatgctcactgctgt

SEQ ID NO: 7807003 - DNA, 22 bp, Homo sapiens
gcaaagcaaatgcctgaaggcg

SEQ ID NO: 7807004 - DNA, 22 bp, Homo sapiens
gcaggcagatcacctgtcagga

SEQ ID NO: 7807005 - DNA, 22 bp, Homo sapiens
gcagggctgtggacactttggt

SEQ ID NO: 7807006 - DNA, 22 bp, Homo sapiens
gcaggaagggaaaggttgactc

SEQ ID NO: 7807007 - DNA, 22 bp, Homo sapiens
gcagatggtgggggaggagtac

SEQ ID NO: 7807008 - DNA, 22 bp, Homo sapiens
gcagatggatgtggacggcgcc

SEQ ID NO: 7807009 - DNA, 22 bp, Homo sapiens
gcagatggatcacctgaggtcg

SEQ ID NO: 7807010 - DNA, 18 bp, Homo sapiens
gcagatggagattcaggg

SEQ ID NO: 7807011 - DNA, 22 bp, Homo sapiens
gcagatggagataaatggaact

SEQ ID NO: 7807012 - DNA, 22 bp, Homo sapiens
gcagatggcagcccaggctggg

SEQ ID NO: 7807013 - DNA, 22 bp, Homo sapiens
gcagatggcgcagtggaagttc

SEQ ID NO: 7807014 - DNA, 23 bp, Homo sapiens
gcagatggccccagagtgctgcc

SEQ ID NO: 7807015 - DNA, 22 bp, Homo sapiens
gcagatggtgccatgtcttgtg

SEQ ID NO: 7807016 - DNA, 22 bp, Homo sapiens
gcagatggtggaggcaagaggc

SEQ ID NO: 7807017 - DNA, 22 bp, Homo sapiens
gcagatggtggggcaggaaaat

SEQ ID NO: 7807018 - DNA, 15 bp, Homo sapiens
gcagatgggggtgat

SEQ ID NO: 7807019 - DNA, 21 bp, Homo sapiens
gcagatgggagtcatcaggct

SEQ ID NO: 7807020 - DNA, 22 bp, Homo sapiens
gcagatggctgagcctgcagat

SEQ ID NO: 7807021 - DNA, 22 bp, Homo sapiens
gcagatggctcagacactgggg

SEQ ID NO: 7807022 - DNA, 22 bp, Homo sapiens
gcagatgggagccccaggggag

SEQ ID NO: 7807023 - DNA, 21 bp, Homo sapiens
gcagatgggaagagacgaggc

SEQ ID NO: 7807024 - DNA, 22 bp, Homo sapiens
gcatggccaggaaaggtagaaa

SEQ ID NO: 7807025 - DNA, 22 bp, Homo sapiens
gcatggcctccagccaacagca

SEQ ID NO: 7807026 - DNA, 22 bp, Homo sapiens
gcatggccatggcactatggac

SEQ ID NO: 7807027 - DNA, 22 bp, Homo sapiens
gcagtggcagctgagggggtat

SEQ ID NO: 7807028 - DNA, 22 bp, Homo sapiens
gcagtgggagcttaggcagtgc

SEQ ID NO: 7807029 - DNA, 22 bp, Homo sapiens
gccaggcagcagcgaggatggt

SEQ ID NO: 7807030 - DNA, 22 bp, Homo sapiens
gcctcccttggtgtctcccggg

SEQ ID NO: 7807031 - DNA, 17 bp, Homo sapiens
gccctggagccaggcta

SEQ ID NO: 7807032 - DNA, 22 bp, Homo sapiens
gccctggatgtacaggcatgtt

SEQ ID NO: 7807033 - DNA, 22 bp, Homo sapiens
gccctggatggcaggagccatc

SEQ ID NO: 7807034 - DNA, 22 bp, Homo sapiens
gccctggcctggcgcgttgtca

SEQ ID NO: 7807035 - DNA, 22 bp, Homo sapiens
gtcccctcaaaattcatatgtt

SEQ ID NO: 7807036 - DNA, 22 bp, Homo sapiens
gtcccctcagccacccatgggg

SEQ ID NO: 7807037 - DNA, 22 bp, Homo sapiens
gtccctgacacccgggtggagg

SEQ ID NO: 7807038 - DNA, 22 bp, Homo sapiens
gtcatttttcactgcatataga

SEQ ID NO: 7807039 - DNA, 23 bp, Homo sapiens
gtatttcagcattctcagttaaa

SEQ ID NO: 7807040 - DNA, 22 bp, Homo sapiens
ggttttggaagtataaagatgt

SEQ ID NO: 7807041 - DNA, 22 bp, Homo sapiens
gtattgtatttatttatgtgac

SEQ ID NO: 7807042 - DNA, 22 bp, Homo sapiens
gtattgtattgggatgagctct

SEQ ID NO: 7807043 - DNA, 22 bp, Homo sapiens
gtgaaatatttaacgtccaggt

SEQ ID NO: 7807044 - DNA, 23 bp, Homo sapiens
gtgagcagcccactaggaatgcc

SEQ ID NO: 7807045 - DNA, 22 bp, Homo sapiens
gtgagcagctcagggtggtctc

SEQ ID NO: 7807046 - DNA, 22 bp, Homo sapiens
gtgactgtgagtcgctgtgaca

SEQ ID NO: 7807047 - DNA, 22 bp, Homo sapiens
gtgactgtgaactgtttctgat

SEQ ID NO: 7807048 - DNA, 22 bp, Homo sapiens
gggtggcatctctctgagctgt

SEQ ID NO: 7807049 - DNA, 22 bp, Homo sapiens
gggtggcaggattggcaggagt

SEQ ID NO: 7807050 - DNA, 22 bp, Homo sapiens
gggtggcacaggtgcagagggt

SEQ ID NO: 7807051 - DNA, 22 bp, Homo sapiens
gggtggcagctgttgccaaggt

SEQ ID NO: 7807052 - DNA, 22 bp, Homo sapiens
ggtgtgtggttttgatacagtc

SEQ ID NO: 7807053 - DNA, 22 bp, Homo sapiens
ggtgtggtttgaagggagatgg

SEQ ID NO: 7807054 - DNA, 18 bp, Homo sapiens
ggtgtgtaacgtgttttc

SEQ ID NO: 7807055 - DNA, 22 bp, Homo sapiens
ggggctggctcactaagagact

SEQ ID NO: 7807056 - DNA, 22 bp, Homo sapiens
ggcctcttctgctcatactttc

SEQ ID NO: 7807057 - DNA, 20 bp, Homo sapiens
ggcctcagtgtccttgtttg

SEQ ID NO: 7807058 - DNA, 22 bp, Homo sapiens
ggcctcagggtcactctgtaga

SEQ ID NO: 7807059 - DNA, 22 bp, Homo sapiens
ggccaggtggctgtcctggcgt

SEQ ID NO: 7807060 - DNA, 22 bp, Homo sapiens
ggcaggtggcactgctgctccc

SEQ ID NO: 7807061 - DNA, 22 bp, Homo sapiens
ggcaggtggacgtgctaaagct

SEQ ID NO: 7807062 - DNA, 22 bp, Homo sapiens
ggcaagcataacctgtacagcc

SEQ ID NO: 7807063 - DNA, 22 bp, Homo sapiens
ggcaagagttgaagctccagga

SEQ ID NO: 7807064 - DNA, 22 bp, Homo sapiens
ggcaagaaggcttcaggtagct

SEQ ID NO: 7807065 - DNA, 22 bp, Homo sapiens
ggcaaagccttccagctgttac

SEQ ID NO: 7807066 - DNA, 22 bp, Homo sapiens
ggcacagctcaggtcccagctc

SEQ ID NO: 7807067 - DNA, 22 bp, Homo sapiens
ggcacagcgactaccatcgaaa

SEQ ID NO: 7807068 - DNA, 22 bp, Homo sapiens
ggcacagcaggagctatgtgaa

SEQ ID NO: 7807069 - DNA, 22 bp, Homo sapiens
gggaggaaggcttgggtgagta

SEQ ID NO: 7807070 - DNA, 22 bp, Homo sapiens
gggaggaaagagaagtggtcca

SEQ ID NO: 7807071 - DNA, 19 bp, Homo sapiens
gggcaaagtgatcgtcctg

SEQ ID NO: 7807072 - DNA, 22 bp, Homo sapiens
gggcaaaggcagaaagcggtgt

SEQ ID NO: 7807073 - DNA, 22 bp, Homo sapiens
gggagagaattattgccagacc

SEQ ID NO: 7807074 - DNA, 22 bp, Homo sapiens
ggcttggcctgataaatgcatg

SEQ ID NO: 7807075 - DNA, 22 bp, Homo sapiens
ggctgggcaggtctgcacaggg

SEQ ID NO: 7807076 - DNA, 22 bp, Homo sapiens
ggctgggctccgggagcatgcg

SEQ ID NO: 7807077 - DNA, 22 bp, Homo sapiens
ggctgggcaaacaagactcttc

SEQ ID NO: 7807078 - DNA, 22 bp, Homo sapiens
ggcgggaagttcttgcccactt

SEQ ID NO: 7807079 - DNA, 22 bp, Homo sapiens
gaagagctgtcagaaaagctaa

SEQ ID NO: 7807080 - DNA, 22 bp, Homo sapiens
gaagagctgtgattcaggctta

SEQ ID NO: 7807081 - DNA, 22 bp, Homo sapiens
gaagagctgcacactggggact

SEQ ID NO: 7807082 - DNA, 22 bp, Homo sapiens
gaagagctatgtccagggagca

SEQ ID NO: 7807083 - DNA, 22 bp, Homo sapiens
gaaatgcagaacctgagaccat

SEQ ID NO: 7807084 - DNA, 22 bp, Homo sapiens
gaaatgcaggcttggattcagc

SEQ ID NO: 7807085 - DNA, 22 bp, Homo sapiens
gaaatgcagattctgattctgt

SEQ ID NO: 7807086 - DNA, 22 bp, Homo sapiens
gaaatgcaaattctctctcgct

SEQ ID NO: 7807087 - DNA, 22 bp, Homo sapiens
gaaatgcatggatcttggcaga

SEQ ID NO: 7807088 - DNA, 22 bp, Homo sapiens
gaaatgcataatcttagtagat

SEQ ID NO: 7807089 - DNA, 22 bp, Homo sapiens
gaacagcagcttcctgggaatt

SEQ ID NO: 7807090 - DNA, 17 bp, Homo sapiens
gaacagcagaggggaca

SEQ ID NO: 7807091 - DNA, 22 bp, Homo sapiens
ctttcattcttagatattagtg

SEQ ID NO: 7807092 - DNA, 22 bp, Homo sapiens
ctttcaatgtgcctgccttggg

SEQ ID NO: 7807093 - DNA, 22 bp, Homo sapiens
ctttcaatgtcatctgtgaatg

SEQ ID NO: 7807094 - DNA, 22 bp, Homo sapiens
gacctagattaacattctgtga

SEQ ID NO: 7807095 - DNA, 21 bp, Homo sapiens
gacaggtgattcagagcaggg

SEQ ID NO: 7807096 - DNA, 21 bp, Homo sapiens
gacaggggaagaagcaaggag

SEQ ID NO: 7807097 - DNA, 22 bp, Homo sapiens
gagatggagtctttttctgtca

SEQ ID NO: 7807098 - DNA, 22 bp, Homo sapiens
gagcagcaggtggggctggctt

SEQ ID NO: 7807099 - DNA, 22 bp, Homo sapiens
gagaatctccagatgaagtcct

SEQ ID NO: 7807100 - DNA, 22 bp, Homo sapiens
gagagggagccagccaggaacc

SEQ ID NO: 7807101 - DNA, 22 bp, Homo sapiens
gagatcggtaaagagcatgcac

SEQ ID NO: 7807102 - DNA, 22 bp, Homo sapiens
gagcttaaatggctaaatataa

SEQ ID NO: 7807103 - DNA, 22 bp, Homo sapiens
cttcagccctgagtgccagcag

SEQ ID NO: 7807104 - DNA, 22 bp, Homo sapiens
cttatttgcccatgtttcttta

SEQ ID NO: 7807105 - DNA, 22 bp, Homo sapiens
cttcctggatgagcaggctgat

SEQ ID NO: 7807106 - DNA, 22 bp, Homo sapiens
cttcctgggtctggagactgga

SEQ ID NO: 7807107 - DNA, 22 bp, Homo sapiens
ctgttgaaaatttctcagatgg

SEQ ID NO: 7807108 - DNA, 22 bp, Homo sapiens
ctgtgtctcgttaaagcattgg

SEQ ID NO: 7807109 - DNA, 22 bp, Homo sapiens
ctgtgtcttcctctgcccaggc

SEQ ID NO: 7807110 - DNA, 22 bp, Homo sapiens
ctgtgtctaatcttatacatca

SEQ ID NO: 7807111 - DNA, 22 bp, Homo sapiens
ctgggtgctgtgggctcagagg

SEQ ID NO: 7807112 - DNA, 22 bp, Homo sapiens
ctggctttggtcatgtgatcat

SEQ ID NO: 7807113 - DNA, 22 bp, Homo sapiens
ctggcttttggaaacaggctca

SEQ ID NO: 7807114 - DNA, 22 bp, Homo sapiens
ctgggaggcaccgcgtcgtgct

SEQ ID NO: 7807115 - DNA, 22 bp, Homo sapiens
ctgggaggattcattgaggtga

SEQ ID NO: 7807116 - DNA, 22 bp, Homo sapiens
ctggctttccttgtctgcatcc

SEQ ID NO: 7807117 - DNA, 22 bp, Homo sapiens
ctggctttctgcaaatctccat

SEQ ID NO: 7807118 - DNA, 22 bp, Homo sapiens
ctgggaggcactattcaggagg

SEQ ID NO: 7807119 - DNA, 22 bp, Homo sapiens
ctgggaggcggagcttgcagtg

SEQ ID NO: 7807120 - DNA, 22 bp, Homo sapiens
ctggctggaagttagagaactt

SEQ ID NO: 7807121 - DNA, 22 bp, Homo sapiens
ctggctggagaaatgaaattct

SEQ ID NO: 7807122 - DNA, 22 bp, Homo sapiens
ctggcaggcactcatgaaataa

SEQ ID NO: 7807123 - DNA, 22 bp, Homo sapiens
ctgcatccatgttgctgcaaag

SEQ ID NO: 7807124 - DNA, 22 bp, Homo sapiens
ctgccaagtaatgcctgggctc

SEQ ID NO: 7807125 - DNA, 22 bp, Homo sapiens
ctggcaggaagaggaaaggtca

SEQ ID NO: 7807126 - DNA, 22 bp, Homo sapiens
ttttagattgggaaatgtaaag

SEQ ID NO: 7807127 - DNA, 20 bp, Homo sapiens
ctcttcaaatattttattct

SEQ ID NO: 7807128 - DNA, 22 bp, Homo sapiens
ctcttcatgtgtttaattttta

SEQ ID NO: 7807129 - DNA, 22 bp, Homo sapiens
tttgggaatctttgtgcatgac

SEQ ID NO: 7807130 - DNA, 22 bp, Homo sapiens
tttgctaaaaggccattgattt

SEQ ID NO: 7807131 - DNA, 22 bp, Homo sapiens
tttgctattgtgaatagtgcca

SEQ ID NO: 7807132 - DNA, 22 bp, Homo sapiens
tttgccagtattttattgatga

SEQ ID NO: 7807133 - DNA, 22 bp, Homo sapiens
tttgccaggtaagtactatgct

SEQ ID NO: 7807134 - DNA, 22 bp, Homo sapiens
tttgctctctcaggctcctggg

SEQ ID NO: 7807135 - DNA, 22 bp, Homo sapiens
tttgcaaataaataagtgctcg

SEQ ID NO: 7807136 - DNA, 22 bp, Homo sapiens
ctctgcccagtgcccacaggag

SEQ ID NO: 7807137 - DNA, 22 bp, Homo sapiens
ctccacagcccctccagtggca

SEQ ID NO: 7807138 - DNA, 22 bp, Homo sapiens
ttgtacaacgttttaaatttga

SEQ ID NO: 7807139 - DNA, 22 bp, Homo sapiens
ctccagtgcgtcttagtaaacc

SEQ ID NO: 7807140 - DNA, 23 bp, Homo sapiens
ttgtatttttagtagagacaggg

SEQ ID NO: 7807141 - DNA, 22 bp, Homo sapiens
tttcacatagaaagtgatttac

SEQ ID NO: 7807142 - DNA, 22 bp, Homo sapiens
tttcacataaatggagtaaaga

SEQ ID NO: 7807143 - DNA, 22 bp, Homo sapiens
ctctctgctgtatccttaggct

SEQ ID NO: 7807144 - DNA, 22 bp, Homo sapiens
tgtgtattaatgtttgtatatg

SEQ ID NO: 7807145 - DNA, 22 bp, Homo sapiens
tgtgtatgtgtatacactatat

SEQ ID NO: 7807146 - DNA, 20 bp, Homo sapiens
tgtgtatgtgcacatgcgaa

SEQ ID NO: 7807147 - DNA, 22 bp, Homo sapiens
tgtgtatgttttgaggttgcta

SEQ ID NO: 7807148 - DNA, 22 bp, Homo sapiens
tgtgtatgtctgtatgcacaca

SEQ ID NO: 7807149 - DNA, 22 bp, Homo sapiens
tgtgtatgtaagcatgtgcata

SEQ ID NO: 7807150 - DNA, 23 bp, Homo sapiens
tgtgtatgtatctatgcataggt

SEQ ID NO: 7807151 - DNA, 21 bp, Homo sapiens
tgtgtatgtccaatgccctac

SEQ ID NO: 7807152 - DNA, 22 bp, Homo sapiens
tgtgtatgcatacacacataga

SEQ ID NO: 7807153 - DNA, 22 bp, Homo sapiens
tgtgtatatgtaaatatagttg

SEQ ID NO: 7807154 - DNA, 22 bp, Homo sapiens
tgtgtataaacaagagtctgtg

SEQ ID NO: 7807155 - DNA, 20 bp, Homo sapiens
tgtgtataaatatatgtttc

SEQ ID NO: 7807156 - DNA, 22 bp, Homo sapiens
tgtgtatagatgcatgcatata

SEQ ID NO: 7807157 - DNA, 22 bp, Homo sapiens
tgtgtatagcagtttccagtct

SEQ ID NO: 7807158 - DNA, 21 bp, Homo sapiens
tgggggagaattggttgcttt

SEQ ID NO: 7807159 - DNA, 22 bp, Homo sapiens
tgggggacaccagtctctctct

SEQ ID NO: 7807160 - DNA, 22 bp, Homo sapiens
tggggcagggatgggaaactat

SEQ ID NO: 7807161 - DNA, 22 bp, Homo sapiens
tgttcattcgctattgtctatg

SEQ ID NO: 7807162 - DNA, 22 bp, Homo sapiens
cctggtggagaggggcggagcg

SEQ ID NO: 7807163 - DNA, 22 bp, Homo sapiens
cctggtggcttctgggtggacg

SEQ ID NO: 7807164 - DNA, 22 bp, Homo sapiens
ttaaagctgtagagttacttgc

SEQ ID NO: 7807165 - DNA, 22 bp, Homo sapiens
ttaaagctggcgttacagtttg

SEQ ID NO: 7807166 - DNA, 22 bp, Homo sapiens
ttaaagtttgcctatgtgttgt

SEQ ID NO: 7807167 - DNA, 22 bp, Homo sapiens
ttagaagtgggcctatagtcct

SEQ ID NO: 7807168 - DNA, 22 bp, Homo sapiens
ttactaagagaagtaaatattt

SEQ ID NO: 7807169 - DNA, 22 bp, Homo sapiens
ttcacacagcaactgtatgaat

SEQ ID NO: 7807170 - DNA, 22 bp, Homo sapiens
cgcccctcagcgacccaccagc

SEQ ID NO: 7807171 - DNA, 22 bp, Homo sapiens
cgccccctcggccacctgcggg

SEQ ID NO: 7807172 - DNA, 22 bp, Homo sapiens
cgccctccacacagcccctggc

SEQ ID NO: 7807173 - DNA, 22 bp, Homo sapiens
cggtcctggcacttgcggctcc

SEQ ID NO: 7807174 - DNA, 22 bp, Homo sapiens
cggtcctgtacttgatgagata

SEQ ID NO: 7807175 - DNA, 22 bp, Homo sapiens
ttcctgggctttcccctctggt

SEQ ID NO: 7807176 - DNA, 22 bp, Homo sapiens
ctaaatgacttccagtggttat

SEQ ID NO: 7807177 - DNA, 22 bp, Homo sapiens
ctaaatctcatcatgtacctcc

SEQ ID NO: 7807178 - DNA, 22 bp, Homo sapiens
ctaaatctagtctttactgatt

SEQ ID NO: 7807179 - DNA, 22 bp, Homo sapiens
ctatgtgtcttgaaacaagact

SEQ ID NO: 7807180 - DNA, 22 bp, Homo sapiens
ctatatatatcatcttccagtt

SEQ ID NO: 7807181 - DNA, 22 bp, Homo sapiens
ctatatacttttcacagatgtt

SEQ ID NO: 7807182 - DNA, 22 bp, Homo sapiens
cataattactgatatgctgatt

SEQ ID NO: 7807183 - DNA, 22 bp, Homo sapiens
cataattagagaattcatgtta

SEQ ID NO: 7807184 - DNA, 22 bp, Homo sapiens
cataattaggcagttgatcatt

SEQ ID NO: 7807185 - DNA, 22 bp, Homo sapiens
cataatcagatgtgtacataag

SEQ ID NO: 7807186 - DNA, 22 bp, Homo sapiens
cataatatctccgattacttgc

SEQ ID NO: 7807187 - DNA, 22 bp, Homo sapiens
cattacatttcaaaatgtttcc

SEQ ID NO: 7807188 - DNA, 22 bp, Homo sapiens
cattctgagatatgggctgaag

SEQ ID NO: 7807189 - DNA, 22 bp, Homo sapiens
cattctgaccctatgatttaag

SEQ ID NO: 7807190 - DNA, 22 bp, Homo sapiens
cattcttacacaatattttaat

SEQ ID NO: 7807191 - DNA, 22 bp, Homo sapiens
tcccaccaggtgaccatttcat

SEQ ID NO: 7807192 - DNA, 22 bp, Homo sapiens
catgggaggcctgctgctggtg

SEQ ID NO: 7807193 - DNA, 23 bp, Homo sapiens
catgggagtgagaatgccagctc

SEQ ID NO: 7807194 - DNA, 22 bp, Homo sapiens
cattgtccctcaatgtctatga

SEQ ID NO: 7807195 - DNA, 22 bp, Homo sapiens
cattgtcctttggctttgcaaa

SEQ ID NO: 7807196 - DNA, 22 bp, Homo sapiens
ccaaggcacactctgcaaggtt

SEQ ID NO: 7807197 - DNA, 22 bp, Homo sapiens
ccaaggcaacgttggtgtcagg

SEQ ID NO: 7807198 - DNA, 22 bp, Homo sapiens
cagggagccccaattccatgcc

SEQ ID NO: 7807199 - DNA, 22 bp, Homo sapiens
cagggagcaggctctgtccatc

SEQ ID NO: 7807200 - DNA, 22 bp, Homo sapiens
caggtggagctgactgagggca

SEQ ID NO: 7807201 - DNA, 22 bp, Homo sapiens
tattaaatgttatttgggttgt

SEQ ID NO: 7807202 - DNA, 22 bp, Homo sapiens
caggtcagaggtagatgagatg

SEQ ID NO: 7807203 - DNA, 22 bp, Homo sapiens
caggtaggcagccggtctctgg

SEQ ID NO: 7807204 - DNA, 22 bp, Homo sapiens
tattttaaagtgaagggtcttg

SEQ ID NO: 7807205 - DNA, 22 bp, Homo sapiens
cagtcaggggtgggatcaaggc

SEQ ID NO: 7807206 - DNA, 22 bp, Homo sapiens
cagggacagagactgcaccttg

SEQ ID NO: 7807207 - DNA, 22 bp, Homo sapiens
cagggaagagccgatgctgcag

SEQ ID NO: 7807208 - DNA, 22 bp, Homo sapiens
tacattgttttttcttgccatc

SEQ ID NO: 7807209 - DNA, 22 bp, Homo sapiens
tacattgtgatgtttcaataca

SEQ ID NO: 7807210 - DNA, 22 bp, Homo sapiens
tactttattgtaaatgctgatg

SEQ ID NO: 7807211 - DNA, 22 bp, Homo sapiens
tacattgtacttacaaatagtg

SEQ ID NO: 7807212 - DNA, 22 bp, Homo sapiens
caggcattagagaattgtgata

SEQ ID NO: 7807213 - DNA, 19 bp, Homo sapiens
caggccagtgtcagggggc

SEQ ID NO: 7807214 - DNA, 22 bp, Homo sapiens
taatatttctaccctgctgcct

SEQ ID NO: 7807215 - DNA, 22 bp, Homo sapiens
taatatttctaccctgctgcct

SEQ ID NO: 7807216 - DNA, 22 bp, Homo sapiens
taataattggcaatgttgagca

SEQ ID NO: 7807217 - DNA, 23 bp, Homo sapiens
cagctcagcacataggaggtact

SEQ ID NO: 7807218 - DNA, 19 bp, Homo sapiens
taagtatgtactatcttgc

SEQ ID NO: 7807219 - DNA, 19 bp, Homo sapiens
cctctgctccagtttcctt

SEQ ID NO: 7807220 - DNA, 22 bp, Homo sapiens
cctcatgttgctcgcatctgca

SEQ ID NO: 7807221 - DNA, 22 bp, Homo sapiens
cctcatgagttcttctgcccat

SEQ ID NO: 7807222 - DNA, 22 bp, Homo sapiens
tggcaggtacccattggctgta

SEQ ID NO: 7807223 - DNA, 22 bp, Homo sapiens
cctagcaataaagatatcattt

SEQ ID NO: 7807224 - DNA, 22 bp, Homo sapiens
tggagcaggccggaagtggctt

SEQ ID NO: 7807225 - DNA, 22 bp, Homo sapiens
ccctcctctccctaagagtcac

SEQ ID NO: 7807226 - DNA, 22 bp, Homo sapiens
tgctgtgtaaaaggtgattgaa

SEQ ID NO: 7807227 - DNA, 22 bp, Homo sapiens
ccccacagccgccagcagggag

SEQ ID NO: 7807228 - DNA, 22 bp, Homo sapiens
tgagaatcagctgcacagaggt

SEQ ID NO: 7807229 - DNA, 22 bp, Homo sapiens
tgcaaatagcctatatttatag

SEQ ID NO: 7807230 - DNA, 22 bp, Homo sapiens
tcttcactgatgtctctcaaat

SEQ ID NO: 7807231 - DNA, 22 bp, Homo sapiens
tcttcacatggagaagcaactc

SEQ ID NO: 7807232 - DNA, 22 bp, Homo sapiens
tctttgaaacaccctaaccttt

SEQ ID NO: 7807233 - DNA, 22 bp, Homo sapiens
tctttcaatgagcattctttcc

SEQ ID NO: 7807234 - DNA, 22 bp, Homo sapiens
tctttcaatccattcatatgtc

SEQ ID NO: 7807235 - DNA, 20 bp, Homo sapiens
tctggtgccccttcctgaga

SEQ ID NO: 7807236 - DNA, 22 bp, Homo sapiens
tctggtgtcagtattctttgaa

SEQ ID NO: 7807237 - DNA, 22 bp, Homo sapiens
tctggtcactgtccaattctat

SEQ ID NO: 7807238 - DNA, 22 bp, Homo sapiens
tttggaaggtgaggcatgaagg

SEQ ID NO: 7807239 - DNA, 22 bp, Homo sapiens
tttggaagtaaatgagtgtttt

SEQ ID NO: 7807240 - DNA, 22 bp, Homo sapiens
tttggcaaaactgtgtctatct

SEQ ID NO: 7807241 - DNA, 22 bp, Homo sapiens
tttggcagagtgtgggcatttg

SEQ ID NO: 7807242 - DNA, 22 bp, Homo sapiens
tttggcaatatctgaattatag

SEQ ID NO: 7807243 - DNA, 22 bp, Homo sapiens
tttattattctgttctctctac

SEQ ID NO: 7807244 - DNA, 22 bp, Homo sapiens
tttatataacagagactgctat

SEQ ID NO: 7807245 - DNA, 22 bp, Homo sapiens
ttggtcttgagtggcttgttaa

SEQ ID NO: 7807246 - DNA, 22 bp, Homo sapiens
ttggtgggagaagactctggtt

SEQ ID NO: 7807247 - DNA, 22 bp, Homo sapiens
ttggtgggttaatgagtgactg

SEQ ID NO: 7807248 - DNA, 22 bp, Homo sapiens
ttggtgggcacaggggagaagt

SEQ ID NO: 7807249 - DNA, 22 bp, Homo sapiens
ttggtgggagagatgagggttg

SEQ ID NO: 7807250 - DNA, 22 bp, Homo sapiens
ttgtgtttctggccaagatgga

SEQ ID NO: 7807251 - DNA, 22 bp, Homo sapiens
ttgtgtttctgtgatatgtaaa

SEQ ID NO: 7807252 - DNA, 22 bp, Homo sapiens
ttgtgtttgatgctgacacgca

SEQ ID NO: 7807253 - DNA, 22 bp, Homo sapiens
ttgtgtgtttgtagaaaatcca

SEQ ID NO: 7807254 - DNA, 22 bp, Homo sapiens
ttgtgtgtgtaactttatgaga

SEQ ID NO: 7807255 - DNA, 19 bp, Homo sapiens
ttgtgtgtcagtcagagtt

SEQ ID NO: 7807256 - DNA, 22 bp, Homo sapiens
ttgtgtgtcttcttcactgccc

SEQ ID NO: 7807257 - DNA, 22 bp, Homo sapiens
ttgtgtgtgagccttcaccaca

SEQ ID NO: 7807258 - DNA, 22 bp, Homo sapiens
tttcatttcatagaattgtgtt

SEQ ID NO: 7807259 - DNA, 22 bp, Homo sapiens
tttctacattcaaaaactacca

SEQ ID NO: 7807260 - DNA, 22 bp, Homo sapiens
tttcttcatagaccttgtcttg

SEQ ID NO: 7807261 - DNA, 22 bp, Homo sapiens
tttctttatcatagcatctttg

SEQ ID NO: 7807262 - DNA, 22 bp, Homo sapiens
tttctgcttaggactctgtgga

SEQ ID NO: 7807263 - DNA, 22 bp, Homo sapiens
tttctgctgtgctttcttgcgt

SEQ ID NO: 7807264 - DNA, 22 bp, Homo sapiens
tttctgctttctatccttgtca

SEQ ID NO: 7807265 - DNA, 22 bp, Homo sapiens
ttaactattattagcatctttg

SEQ ID NO: 7807266 - DNA, 22 bp, Homo sapiens
ttaaatgacgggactgggtttt

SEQ ID NO: 7807267 - DNA, 22 bp, Homo sapiens
ttaaatgacttttattattctc

SEQ ID NO: 7807268 - DNA, 22 bp, Homo sapiens
ttaaatgacttttattattctc

SEQ ID NO: 7807269 - DNA, 22 bp, Homo sapiens
ttaaatgagatgttcagatatt

SEQ ID NO: 7807270 - DNA, 22 bp, Homo sapiens
ttaaatgaggctgatgtagatt

SEQ ID NO: 7807271 - DNA, 22 bp, Homo sapiens
ttaaatgatgcatatcatttag

SEQ ID NO: 7807272 - DNA, 22 bp, Homo sapiens
ttaaatgtcaatagattgcttg

SEQ ID NO: 7807273 - DNA, 22 bp, Homo sapiens
ttaaattagtcaagcttctctg

SEQ ID NO: 7807274 - DNA, 22 bp, Homo sapiens
ttaaatgtgcctaaacctgtaa

SEQ ID NO: 7807275 - DNA, 22 bp, Homo sapiens
ttacacatgaaggtccaatgtt

SEQ ID NO: 7807276 - DNA, 22 bp, Homo sapiens
ttacacattgcagatcaaaatg

SEQ ID NO: 7807277 - DNA, 22 bp, Homo sapiens
ttacatattgtctattgttcaa

SEQ ID NO: 7807278 - DNA, 22 bp, Homo sapiens
ttactgtagcttgacatatgtc

SEQ ID NO: 7807279 - DNA, 22 bp, Homo sapiens
ttactttagaaatagtcatcaa

SEQ ID NO: 7807280 - DNA, 20 bp, Homo sapiens
ttagaaagagcgtgataaga

SEQ ID NO: 7807281 - DNA, 22 bp, Homo sapiens
tgtggaggattctgatgccagc

SEQ ID NO: 7807282 - DNA, 21 bp, Homo sapiens
tcccctcacttgtcttctgag

SEQ ID NO: 7807283 - DNA, 22 bp, Homo sapiens
tgtggagactatagccataaca

SEQ ID NO: 7807284 - DNA, 22 bp, Homo sapiens
tgtgtaaaagattagtttacta

SEQ ID NO: 7807285 - DNA, 21 bp, Homo sapiens
tgtgtaaagttgaaatcctgt

SEQ ID NO: 7807286 - DNA, 22 bp, Homo sapiens
tgtgtacaaactaacaacatat

SEQ ID NO: 7807287 - DNA, 22 bp, Homo sapiens
tgtggggaggctgcagtgctgc

SEQ ID NO: 7807288 - DNA, 22 bp, Homo sapiens
tgtgtctttggcgatgtctgga

SEQ ID NO: 7807289 - DNA, 22 bp, Homo sapiens
tgtgtttcagaaccttctttca

SEQ ID NO: 7807290 - DNA, 22 bp, Homo sapiens
tgtgtttgaggcatgttgcaga

SEQ ID NO: 7807291 - DNA, 22 bp, Homo sapiens
tgtgtttagagagcacattcag

SEQ ID NO: 7807292 - DNA, 22 bp, Homo sapiens
tgtgttttccagaatggtgttt

SEQ ID NO: 7807293 - DNA, 22 bp, Homo sapiens
tgtgttttgaactcatctactg

SEQ ID NO: 7807294 - DNA, 21 bp, Homo sapiens
tgtgttttaatgatattctgt

SEQ ID NO: 7807295 - DNA, 22 bp, Homo sapiens
tgtgttttacaaattctcttaa

SEQ ID NO: 7807296 - DNA, 22 bp, Homo sapiens
tgtgtttgttagactaatgtta

SEQ ID NO: 7807297 - DNA, 22 bp, Homo sapiens
tgttatctcagactgagttact

SEQ ID NO: 7807298 - DNA, 22 bp, Homo sapiens
tgttcagaacaaaggtaaatga

SEQ ID NO: 7807299 - DNA, 22 bp, Homo sapiens
tgtttcatgaaacatgtttagg

SEQ ID NO: 7807300 - DNA, 22 bp, Homo sapiens
ttgaattagactttgctacagg

SEQ ID NO: 7807301 - DNA, 22 bp, Homo sapiens
ttctttatcctatttgtaggtg

SEQ ID NO: 7807302 - DNA, 22 bp, Homo sapiens
ttctgctgaaaacagccatgta

SEQ ID NO: 7807303 - DNA, 21 bp, Homo sapiens
ttctgctgtgccatgcctctg

SEQ ID NO: 7807304 - DNA, 22 bp, Homo sapiens
ttctgctgttgtgacgttagtt

SEQ ID NO: 7807305 - DNA, 22 bp, Homo sapiens
ttctgctgtagttgcatctgtt

SEQ ID NO: 7807306 - DNA, 17 bp, Homo sapiens
ttctgctgtcgtcctct

SEQ ID NO: 7807307 - DNA, 22 bp, Homo sapiens
ttctgcctggcaggaggactgt

SEQ ID NO: 7807308 - DNA, 22 bp, Homo sapiens
ttctgagaaatgggttcacata

SEQ ID NO: 7807309 - DNA, 22 bp, Homo sapiens
ttcttacagccctattactaaa

SEQ ID NO: 7807310 - DNA, 22 bp, Homo sapiens
ttctttaaaatagtgagaaaga

SEQ ID NO: 7807311 - DNA, 22 bp, Homo sapiens
ttctagcttgagtgaataaagg

SEQ ID NO: 7807312 - DNA, 22 bp, Homo sapiens
ttcctagaatggttagaaaata

SEQ ID NO: 7807313 - DNA, 22 bp, Homo sapiens
ttcaactttaggcaaagaaaac

SEQ ID NO: 7807314 - DNA, 20 bp, Homo sapiens
ttcagtctcctgcttccttc

SEQ ID NO: 7807315 - DNA, 22 bp, Homo sapiens
ggctggcacccttggggatagg

SEQ ID NO: 7807316 - DNA, 22 bp, Homo sapiens
ggctggcaagtcagtgctgatg

SEQ ID NO: 7807317 - DNA, 22 bp, Homo sapiens
gggaggcagtgctggaggctgg

SEQ ID NO: 7807318 - DNA, 21 bp, Homo sapiens
gggagctggaaactgggtgac

SEQ ID NO: 7807319 - DNA, 22 bp, Homo sapiens
cagacacacaagcaatctaagt

SEQ ID NO: 7807320 - DNA, 22 bp, Homo sapiens
gggcaggggtcagtggccccaa

SEQ ID NO: 7807321 - DNA, 21 bp, Homo sapiens
ggggcagagctaggccctgca

SEQ ID NO: 7807322 - DNA, 22 bp, Homo sapiens
ggggcagatggaacagagcaca

SEQ ID NO: 7807323 - DNA, 19 bp, Homo sapiens
ggggcctgtgatggtcaca

SEQ ID NO: 7807324 - DNA, 22 bp, Homo sapiens
gggtacagagagatgaggtaac

SEQ ID NO: 7807325 - DNA, 22 bp, Homo sapiens
gggtaaatctcttttcatggct

SEQ ID NO: 7807326 - DNA, 22 bp, Homo sapiens
gggtcccctcatcatggagact

SEQ ID NO: 7807327 - DNA, 18 bp, Homo sapiens
gggtcctgtgggagacag

SEQ ID NO: 7807328 - DNA, 18 bp, Homo sapiens
gggtcctgttcttggaag

SEQ ID NO: 7807329 - DNA, 22 bp, Homo sapiens
gggtcctgcgtgggcccaggac

SEQ ID NO: 7807330 - DNA, 21 bp, Homo sapiens
gggtcctgggatgggatccag

SEQ ID NO: 7807331 - DNA, 22 bp, Homo sapiens
gggtacagttcttccagtgtca

SEQ ID NO: 7807332 - DNA, 22 bp, Homo sapiens
gggtagcatgtgtcagagtttg

SEQ ID NO: 7807333 - DNA, 20 bp, Homo sapiens
cagatggcacgtcagggcat

SEQ ID NO: 7807334 - DNA, 22 bp, Homo sapiens
cagatggcacagatttagagtg

SEQ ID NO: 7807335 - DNA, 18 bp, Homo sapiens
ggtcctgaatgcctgcta

SEQ ID NO: 7807336 - DNA, 22 bp, Homo sapiens
ggtcctgcattgccagcaagct

SEQ ID NO: 7807337 - DNA, 22 bp, Homo sapiens
cagccctctgaagaggcgcttg

SEQ ID NO: 7807338 - DNA, 23 bp, Homo sapiens
gtgagcagcaccatgaggctaga

SEQ ID NO: 7807339 - DNA, 22 bp, Homo sapiens
gtcctgtgcaccgtgggatgtt

SEQ ID NO: 7807340 - DNA, 22 bp, Homo sapiens
cagcatctgttcccaacgagat

SEQ ID NO: 7807341 - DNA, 22 bp, Homo sapiens
cagcatctctgcctgcctgcaa

SEQ ID NO: 7807342 - DNA, 22 bp, Homo sapiens
cagcatctcacttcccagaagg

SEQ ID NO: 7807343 - DNA, 22 bp, Homo sapiens
gtacacataggttactgattaa

SEQ ID NO: 7807344 - DNA, 23 bp, Homo sapiens
gtacacatagtgtagttatattt

SEQ ID NO: 7807345 - DNA, 22 bp, Homo sapiens
gtacacatatattaaaaattgt

SEQ ID NO: 7807346 - DNA, 22 bp, Homo sapiens
gtacacatatttccaagggtaa

SEQ ID NO: 7807347 - DNA, 22 bp, Homo sapiens
cactctgactggccctgcagga

SEQ ID NO: 7807348 - DNA, 16 bp, Homo sapiens
cacatatatttatatg

SEQ ID NO: 7807349 - DNA, 22 bp, Homo sapiens
cacatatatgaaatgaggaatt

SEQ ID NO: 7807350 - DNA, 22 bp, Homo sapiens
cacatatatgggcccctgaggg

SEQ ID NO: 7807351 - DNA, 22 bp, Homo sapiens
gctggaagaatgagtgcctcgt

SEQ ID NO: 7807352 - DNA, 22 bp, Homo sapiens
gctgctggcgctgggcgtccgg

SEQ ID NO: 7807353 - DNA, 22 bp, Homo sapiens
gctggggagaattgggttatct

SEQ ID NO: 7807354 - DNA, 22 bp, Homo sapiens
gctggggactccccaccatagc

SEQ ID NO: 7807355 - DNA, 22 bp, Homo sapiens
gctgggctcaccaggccactag

SEQ ID NO: 7807356 - DNA, 22 bp, Homo sapiens
caagcgtggctgctctgatgga

SEQ ID NO: 7807357 - DNA, 22 bp, Homo sapiens
cacaaatccaatttaattctgg

SEQ ID NO: 7807358 - DNA, 22 bp, Homo sapiens
caaggctgtgcagggtccatat

SEQ ID NO: 7807359 - DNA, 22 bp, Homo sapiens
caaggctgctggcttctgagct

SEQ ID NO: 7807360 - DNA, 22 bp, Homo sapiens
caaggctgcaaaactacatggg

SEQ ID NO: 7807361 - DNA, 22 bp, Homo sapiens
gctggggagctagacctcagca

SEQ ID NO: 7807362 - DNA, 22 bp, Homo sapiens
atgatgtcatgaatatattagt

SEQ ID NO: 7807363 - DNA, 22 bp, Homo sapiens
gaagcggcatcaggaggctgcc

SEQ ID NO: 7807364 - DNA, 22 bp, Homo sapiens
gaaggaggcgttagccctagga

SEQ ID NO: 7807365 - DNA, 17 bp, Homo sapiens
cttgttttccactggga

SEQ ID NO: 7807366 - DNA, 22 bp, Homo sapiens
cttttgttgcccttgtcgcagg

SEQ ID NO: 7807367 - DNA, 22 bp, Homo sapiens
ctttgcttctccaacctgctca

SEQ ID NO: 7807368 - DNA, 19 bp, Homo sapiens
ctttgcttgtttctgtgtc

SEQ ID NO: 7807369 - DNA, 22 bp, Homo sapiens
atgtatgtatgctgtgcttgca

SEQ ID NO: 7807370 - DNA, 22 bp, Homo sapiens
atgtatgtatgtacttttgtat

SEQ ID NO: 7807371 - DNA, 22 bp, Homo sapiens
atgtatgtgagctttgagatca

SEQ ID NO: 7807372 - DNA, 22 bp, Homo sapiens
atgtgctcttattaccctgtcg

SEQ ID NO: 7807373 - DNA, 22 bp, Homo sapiens
atgctgtggtagacagcattcc

SEQ ID NO: 7807374 - DNA, 22 bp, Homo sapiens
atgctgtgctggctaaccatgg

SEQ ID NO: 7807375 - DNA, 22 bp, Homo sapiens
gagctgagttacctccagatca

SEQ ID NO: 7807376 - DNA, 22 bp, Homo sapiens
atgggagttttctctgatgctc

SEQ ID NO: 7807377 - DNA, 22 bp, Homo sapiens
attctcttctgatgtcttgcca

SEQ ID NO: 7807378 - DNA, 22 bp, Homo sapiens
gcagctgttcagctggccagat

SEQ ID NO: 7807379 - DNA, 23 bp, Homo sapiens
gcagcttgtggtttagtagaggg

SEQ ID NO: 7807380 - DNA, 22 bp, Homo sapiens
attctggaaagctattctctct

SEQ ID NO: 7807381 - DNA, 22 bp, Homo sapiens
attaaattttcactaggctccc

SEQ ID NO: 7807382 - DNA, 22 bp, Homo sapiens
attaaattggatctgcatagtt

SEQ ID NO: 7807383 - DNA, 22 bp, Homo sapiens
attaaattggacgctgggggaa

SEQ ID NO: 7807384 - DNA, 22 bp, Homo sapiens
gattcccatcctcagcagcagc

SEQ ID NO: 7807385 - DNA, 22 bp, Homo sapiens
gatgtctttagggcaaaatatt

SEQ ID NO: 7807386 - DNA, 22 bp, Homo sapiens
atttcttatctgaggtctacat

SEQ ID NO: 7807387 - DNA, 22 bp, Homo sapiens
gcccaggagttgaatgcagcag

SEQ ID NO: 7807388 - DNA, 22 bp, Homo sapiens
gccagctggagactggcagggg

SEQ ID NO: 7807389 - DNA, 22 bp, Homo sapiens
caaagactgcataacacatgaa

SEQ ID NO: 7807390 - DNA, 22 bp, Homo sapiens
attttgctggtctgaattactt

SEQ ID NO: 7807391 - DNA, 22 bp, Homo sapiens
gctcagagaagttgtgcctggc

SEQ ID NO: 7807392 - DNA, 22 bp, Homo sapiens
atttggaatgtgtttgatcacc

SEQ ID NO: 7807393 - DNA, 22 bp, Homo sapiens
atttgtaaagtgcttaaaagta

SEQ ID NO: 7807394 - DNA, 22 bp, Homo sapiens
atttgtcacacatagtttatcc

SEQ ID NO: 7807395 - DNA, 22 bp, Homo sapiens
atttgtcaataagatgaacata

SEQ ID NO: 7807396 - DNA, 22 bp, Homo sapiens
atttgtatcaatctcaatatat

SEQ ID NO: 7807397 - DNA, 22 bp, Homo sapiens
ctggtggagatgcctggcccct

SEQ ID NO: 7807398 - DNA, 22 bp, Homo sapiens
ctggtgggaagatggaaaacat

SEQ ID NO: 7807399 - DNA, 22 bp, Homo sapiens
ctggtgggagataattgaatca

SEQ ID NO: 7807400 - DNA, 22 bp, Homo sapiens
ctggtgggaggcaaggtggaag

SEQ ID NO: 7807401 - DNA, 22 bp, Homo sapiens
ctggtgggagcagcaggcagct

SEQ ID NO: 7807402 - DNA, 22 bp, Homo sapiens
ctggggcagagcccagcaattt

SEQ ID NO: 7807403 - DNA, 22 bp, Homo sapiens
atatttgtttggcagagttcag

SEQ ID NO: 7807404 - DNA, 22 bp, Homo sapiens
atatttgttgagttcttatgat

SEQ ID NO: 7807405 - DNA, 22 bp, Homo sapiens
atatttgttagagtctatgtgt

SEQ ID NO: 7807406 - DNA, 22 bp, Homo sapiens
atatttgttagagtctatgtgt

SEQ ID NO: 7807407 - DNA, 22 bp, Homo sapiens
ctgtatttcccacattctctat

SEQ ID NO: 7807408 - DNA, 22 bp, Homo sapiens
ctgtatgttccgttttgtcact

SEQ ID NO: 7807409 - DNA, 22 bp, Homo sapiens
atatcacaaacaagtctgtact

SEQ ID NO: 7807410 - DNA, 23 bp, Homo sapiens
atatcacacccagtacagtctcc

SEQ ID NO: 7807411 - DNA, 22 bp, Homo sapiens
atatcacagtagttgtttagtt

SEQ ID NO: 7807412 - DNA, 22 bp, Homo sapiens
atatcataaatcggtgcatgaa

SEQ ID NO: 7807413 - DNA, 22 bp, Homo sapiens
atatattttgcggtcacgtggc

SEQ ID NO: 7807414 - DNA, 22 bp, Homo sapiens
atctccaggttgtgcctgcgtc

SEQ ID NO: 7807415 - DNA, 22 bp, Homo sapiens
atctccaggattttcacactca

SEQ ID NO: 7807416 - DNA, 22 bp, Homo sapiens
atctccagcaatggggagctct

SEQ ID NO: 7807417 - DNA, 22 bp, Homo sapiens
atctccagaggagtcatggtct

SEQ ID NO: 7807418 - DNA, 22 bp, Homo sapiens
ctgtgtgtgaacacagcccagc

SEQ ID NO: 7807419 - DNA, 22 bp, Homo sapiens
ctgtgtccccctcagccaggtg

SEQ ID NO: 7807420 - DNA, 22 bp, Homo sapiens
ctgtgtatctctgtgggacaga

SEQ ID NO: 7807421 - DNA, 22 bp, Homo sapiens
ctgtgtatgactccagagggta

SEQ ID NO: 7807422 - DNA, 22 bp, Homo sapiens
ctgtgtattgaaaaagggttaa

SEQ ID NO: 7807423 - DNA, 22 bp, Homo sapiens
agtttatttttgataagtcttg

SEQ ID NO: 7807424 - DNA, 22 bp, Homo sapiens
agtttcacatagctcagtgctc

SEQ ID NO: 7807425 - DNA, 22 bp, Homo sapiens
agtttcttattcttagttatgt

SEQ ID NO: 7807426 - DNA, 22 bp, Homo sapiens
ctgcccgcaccatccccgggct

SEQ ID NO: 7807427 - DNA, 19 bp, Homo sapiens
ctggaaagttggcagtgag

SEQ ID NO: 7807428 - DNA, 20 bp, Homo sapiens
ataatttaccctgcaccact

SEQ ID NO: 7807429 - DNA, 22 bp, Homo sapiens
ataattaatttcagtaatctcc

SEQ ID NO: 7807430 - DNA, 16 bp, Homo sapiens
ataattactgctactt

SEQ ID NO: 7807431 - DNA, 20 bp, Homo sapiens
atagaatcacaagtcctgaa

SEQ ID NO: 7807432 - DNA, 22 bp, Homo sapiens
atagaatcatctgtgcactagt

SEQ ID NO: 7807433 - DNA, 22 bp, Homo sapiens
atagacacagatctatatatgt

SEQ ID NO: 7807434 - DNA, 22 bp, Homo sapiens
ctgagaaagtgagggttaaaca

SEQ ID NO: 7807435 - DNA, 21 bp, Homo sapiens
agtgtgttcttggcattacct

SEQ ID NO: 7807436 - DNA, 22 bp, Homo sapiens
agtgtgttgtaggctcaaatgg

SEQ ID NO: 7807437 - DNA, 22 bp, Homo sapiens
agtgtgtgtttgggcggtttat

SEQ ID NO: 7807438 - DNA, 21 bp, Homo sapiens
agtgtgtgataggcaggaaga

SEQ ID NO: 7807439 - DNA, 21 bp, Homo sapiens
agtgtgtgtggaatgagaata

SEQ ID NO: 7807440 - DNA, 21 bp, Homo sapiens
agtgtgtgtggaatgagaata

SEQ ID NO: 7807441 - DNA, 22 bp, Homo sapiens
agtgtgtgctgttccccggagg

SEQ ID NO: 7807442 - DNA, 22 bp, Homo sapiens
agtgtgtgctgttccccggagg

SEQ ID NO: 7807443 - DNA, 18 bp, Homo sapiens
agtgtgtgccctttcagg

SEQ ID NO: 7807444 - DNA, 22 bp, Homo sapiens
agtggggaggtccaggccaccc

SEQ ID NO: 7807445 - DNA, 23 bp, Homo sapiens
agtggggaatcaacagattcttt

SEQ ID NO: 7807446 - DNA, 22 bp, Homo sapiens
agtggggacaatgagagcaggt

SEQ ID NO: 7807447 - DNA, 22 bp, Homo sapiens
agtgtctgccagctgccaggtg

SEQ ID NO: 7807448 - DNA, 22 bp, Homo sapiens
agtgcagcaacaaactgccctc

SEQ ID NO: 7807449 - DNA, 22 bp, Homo sapiens
agtgcagctccctcacctgctt

SEQ ID NO: 7807450 - DNA, 22 bp, Homo sapiens
agtgcagctgggactgtagggt

SEQ ID NO: 7807451 - DNA, 22 bp, Homo sapiens
agtgcagcttataaagcatcaa

SEQ ID NO: 7807452 - DNA, 22 bp, Homo sapiens
agtccaaagcagatgagggcca

SEQ ID NO: 7807453 - DNA, 22 bp, Homo sapiens
agtctgcctttccaatcccgtg

SEQ ID NO: 7807454 - DNA, 23 bp, Homo sapiens
agtctgtgctgaagaagttacaa

SEQ ID NO: 7807455 - DNA, 22 bp, Homo sapiens
cctggtgcaccaagtaagggtg

SEQ ID NO: 7807456 - DNA, 22 bp, Homo sapiens
cctggtgccactagagaatgtc

SEQ ID NO: 7807457 - DNA, 22 bp, Homo sapiens
agtaatcaaattaagctaattg

SEQ ID NO: 7807458 - DNA, 22 bp, Homo sapiens
agtcagagcaaactggacagac

SEQ ID NO: 7807459 - DNA, 23 bp, Homo sapiens
agtcagagagtgtgagacaactg

SEQ ID NO: 7807460 - DNA, 22 bp, Homo sapiens
cggtcaggtgcagcgttggcac

SEQ ID NO: 7807461 - DNA, 20 bp, Homo sapiens
agggtggcaagttagtgaca

SEQ ID NO: 7807462 - DNA, 22 bp, Homo sapiens
aggtataagaagattatttata

SEQ ID NO: 7807463 - DNA, 19 bp, Homo sapiens
aggtctgcagctgcagttt

SEQ ID NO: 7807464 - DNA, 17 bp, Homo sapiens
agggagtcagaggatcg

SEQ ID NO: 7807465 - DNA, 22 bp, Homo sapiens
agggagtctagttgatgtggaa

SEQ ID NO: 7807466 - DNA, 22 bp, Homo sapiens
agggagtccattttagaggtgg

SEQ ID NO: 7807467 - DNA, 22 bp, Homo sapiens
agggaggagtcctcaaagtcat

SEQ ID NO: 7807468 - DNA, 22 bp, Homo sapiens
agggatggaagctcgtctgcaa

SEQ ID NO: 7807469 - DNA, 22 bp, Homo sapiens
cctgaggagattgtggctgggg

SEQ ID NO: 7807470 - DNA, 22 bp, Homo sapiens
cctgaggatgccagcatgggtg

SEQ ID NO: 7807471 - DNA, 22 bp, Homo sapiens
aggggacacggcttctccaggg

SEQ ID NO: 7807472 - DNA, 22 bp, Homo sapiens
cctcctgcggcgtccgcgctct

SEQ ID NO: 7807473 - DNA, 22 bp, Homo sapiens
catgggcttgctctctgagctc

SEQ ID NO: 7807474 - DNA, 22 bp, Homo sapiens
catggggagacacctagggaaa

SEQ ID NO: 7807475 - DNA, 22 bp, Homo sapiens
catgtatagacactcatacagt

SEQ ID NO: 7807476 - DNA, 22 bp, Homo sapiens
catgtatacagtagaatactat

SEQ ID NO: 7807477 - DNA, 22 bp, Homo sapiens
aggcagcagggccactggctga

SEQ ID NO: 7807478 - DNA, 18 bp, Homo sapiens
catttgttattgtgtgtg

SEQ ID NO: 7807479 - DNA, 22 bp, Homo sapiens
cattaaattccttgttctcaaa

SEQ ID NO: 7807480 - DNA, 22 bp, Homo sapiens
cattaaatcttccagacctcac

SEQ ID NO: 7807481 - DNA, 22 bp, Homo sapiens
cattaaatatcaacctagacta

SEQ ID NO: 7807482 - DNA, 22 bp, Homo sapiens
caggtgcagctggatggaagcc

SEQ ID NO: 7807483 - DNA, 22 bp, Homo sapiens
catatttagtgtttggagatcg

SEQ ID NO: 7807484 - DNA, 22 bp, Homo sapiens
catataaatacaacatgtgtta

SEQ ID NO: 7807485 - DNA, 22 bp, Homo sapiens
cagggatgggatggagtcagtt

SEQ ID NO: 7807486 - DNA, 22 bp, Homo sapiens
caggctggacattagatacata

SEQ ID NO: 7807487 - DNA, 22 bp, Homo sapiens
cagggatgtgatgagctgagcc

SEQ ID NO: 7807488 - DNA, 22 bp, Homo sapiens
cagggatgtctctggaagggag

SEQ ID NO: 7807489 - DNA, 22 bp, Homo sapiens
cagggatggttgagaattggta

SEQ ID NO: 7807490 - DNA, 20 bp, Homo sapiens
caggtgagcagatctgggtg

SEQ ID NO: 7807491 - DNA, 22 bp, Homo sapiens
caggtgagctctatctagggag

SEQ ID NO: 7807492 - DNA, 22 bp, Homo sapiens
caggaggattgcttgaggccag

SEQ ID NO: 7807493 - DNA, 22 bp, Homo sapiens
caggaggagggtacaccatcag

SEQ ID NO: 7807494 - DNA, 22 bp, Homo sapiens
caggaggagcattagcgtctca

SEQ ID NO: 7807495 - DNA, 22 bp, Homo sapiens
caggaggacatactggctcaca

SEQ ID NO: 7807496 - DNA, 22 bp, Homo sapiens
agctgcagaggtttgtgcaaca

SEQ ID NO: 7807497 - DNA, 22 bp, Homo sapiens
caggaaggcccacctgtcctgt

SEQ ID NO: 7807498 - DNA, 22 bp, Homo sapiens
acagggaagctcaggggctctg

SEQ ID NO: 7807499 - DNA, 22 bp, Homo sapiens
acagggaagctcaggggctctg

SEQ ID NO: 7807500 - DNA, 22 bp, Homo sapiens
aggaagagcatctttgggtctg

SEQ ID NO: 7807501 - DNA, 22 bp, Homo sapiens
acagctgggaactcacacagca

SEQ ID NO: 7807502 - DNA, 18 bp, Homo sapiens
agctggtggggagacagc

SEQ ID NO: 7807503 - DNA, 22 bp, Homo sapiens
acagtgtggtttgagcactggg

SEQ ID NO: 7807504 - DNA, 22 bp, Homo sapiens
acagtcaggccgagatgggcct

SEQ ID NO: 7807505 - DNA, 22 bp, Homo sapiens
aggagcagaatttaatgtgcag

SEQ ID NO: 7807506 - DNA, 21 bp, Homo sapiens
acagtttattagagtaagtgc

SEQ ID NO: 7807507 - DNA, 22 bp, Homo sapiens
acatatattttcacacatggtt

SEQ ID NO: 7807508 - DNA, 22 bp, Homo sapiens
acatagatggggtgtcatgtca

SEQ ID NO: 7807509 - DNA, 22 bp, Homo sapiens
acatgcatacaagcacatgtag

SEQ ID NO: 7807510 - DNA, 22 bp, Homo sapiens
aggcctctgttccccatgtttt

SEQ ID NO: 7807511 - DNA, 22 bp, Homo sapiens
aggcctcttcagggagcatgga

SEQ ID NO: 7807512 - DNA, 21 bp, Homo sapiens
aggcctcttcatggccatgat

SEQ ID NO: 7807513 - DNA, 22 bp, Homo sapiens
acatttgagatgccttttaggt

SEQ ID NO: 7807514 - DNA, 22 bp, Homo sapiens
acatttgaaaaagttgatggag

SEQ ID NO: 7807515 - DNA, 22 bp, Homo sapiens
agggcagcaatgcagctgctgc

SEQ ID NO: 7807516 - DNA, 21 bp, Homo sapiens
acttaaattccttgatattta

SEQ ID NO: 7807517 - DNA, 23 bp, Homo sapiens
acttaaatggttctttatctcag

SEQ ID NO: 7807518 - DNA, 22 bp, Homo sapiens
acttagaaattcagttttgtca

SEQ ID NO: 7807519 - DNA, 22 bp, Homo sapiens
atacaggtggaactaaataaat

SEQ ID NO: 7807520 - DNA, 22 bp, Homo sapiens
atacaggtaggggacatacatc

SEQ ID NO: 7807521 - DNA, 22 bp, Homo sapiens
atacatgttgtaccatatgttt

SEQ ID NO: 7807522 - DNA, 22 bp, Homo sapiens
atacatgttgtaccatatgttt

SEQ ID NO: 7807523 - DNA, 22 bp, Homo sapiens
atactgtgtaaaatttgaacct

SEQ ID NO: 7807524 - DNA, 22 bp, Homo sapiens
actttctatggcttattatgag

SEQ ID NO: 7807525 - DNA, 22 bp, Homo sapiens
actttcatggtagttgtattct

SEQ ID NO: 7807526 - DNA, 22 bp, Homo sapiens
atatgcttacagcttaaaatcc

SEQ ID NO: 7807527 - DNA, 22 bp, Homo sapiens
atatttcagctttacttaggaa

SEQ ID NO: 7807528 - DNA, 22 bp, Homo sapiens
atatttataaggcaggcaagta

SEQ ID NO: 7807529 - DNA, 22 bp, Homo sapiens
agaaagggctattttgaggtag

SEQ ID NO: 7807530 - DNA, 22 bp, Homo sapiens
agaaagggtcactgaaagagga

SEQ ID NO: 7807531 - DNA, 22 bp, Homo sapiens
agaaagggttctctgaggtgct

SEQ ID NO: 7807532 - DNA, 21 bp, Homo sapiens
actagcaaaagcctattatcc

SEQ ID NO: 7807533 - DNA, 22 bp, Homo sapiens
agtatttgatcagatgatagta

SEQ ID NO: 7807534 - DNA, 22 bp, Homo sapiens
agtatatagtggcgctgtatgc

SEQ ID NO: 7807535 - DNA, 22 bp, Homo sapiens
aggtcctgtttcttccctgggg

SEQ ID NO: 7807536 - DNA, 22 bp, Homo sapiens
aggtcctgtgtccaggggcctg

SEQ ID NO: 7807537 - DNA, 22 bp, Homo sapiens
aggtggcatgcctgagacataa

SEQ ID NO: 7807538 - DNA, 22 bp, Homo sapiens
actcttatgggaacaaggatta

SEQ ID NO: 7807539 - DNA, 22 bp, Homo sapiens
actcttcaccgctactgaaata

SEQ ID NO: 7807540 - DNA, 22 bp, Homo sapiens
agtctttaatgatcatgtattt

SEQ ID NO: 7807541 - DNA, 22 bp, Homo sapiens
agtggcagtaacattccacaat

SEQ ID NO: 7807542 - DNA, 22 bp, Homo sapiens
agtggcagtggctgggcagagc

SEQ ID NO: 7807543 - DNA, 22 bp, Homo sapiens
agtgtacatcagaacatatcaa

SEQ ID NO: 7807544 - DNA, 22 bp, Homo sapiens
agtgtacatgtttacagcatct

SEQ ID NO: 7807545 - DNA, 22 bp, Homo sapiens
agtgtatacttttagtagaatt

SEQ ID NO: 7807546 - DNA, 21 bp, Homo sapiens
agtgtgtgataggcaggaaga

SEQ ID NO: 7807547 - DNA, 22 bp, Homo sapiens
atttctcttagcaagacattac

SEQ ID NO: 7807548 - DNA, 21 bp, Homo sapiens
agatagttgggcatgcagctg

SEQ ID NO: 7807549 - DNA, 22 bp, Homo sapiens
atttggcagtataaattctggc

SEQ ID NO: 7807550 - DNA, 18 bp, Homo sapiens
atttggcagatgatgaac

SEQ ID NO: 7807551 - DNA, 22 bp, Homo sapiens
atttcacagctgtcagtgttac

SEQ ID NO: 7807552 - DNA, 22 bp, Homo sapiens
agatacatcatttataccttca

SEQ ID NO: 7807553 - DNA, 22 bp, Homo sapiens
attccagagaggttctggaggt

SEQ ID NO: 7807554 - DNA, 22 bp, Homo sapiens
attccagagaaaggcctggctg

SEQ ID NO: 7807555 - DNA, 22 bp, Homo sapiens
attccattgtgtaaggatatcg

SEQ ID NO: 7807556 - DNA, 22 bp, Homo sapiens
atgtgtatatttattgtagttt

SEQ ID NO: 7807557 - DNA, 22 bp, Homo sapiens
atgtgtatatttggtgtcaata

SEQ ID NO: 7807558 - DNA, 22 bp, Homo sapiens
atgtgtatacttgtgcttactc

SEQ ID NO: 7807559 - DNA, 22 bp, Homo sapiens
atgggtccctggccgccctcgg

SEQ ID NO: 7807560 - DNA, 22 bp, Homo sapiens
agagcagcctgtgatgatgcac

SEQ ID NO: 7807561 - DNA, 22 bp, Homo sapiens
atgtgtaaaaggcatgttttat

SEQ ID NO: 7807562 - DNA, 22 bp, Homo sapiens
atgtgtaatgtggtattttaat

SEQ ID NO: 7807563 - DNA, 22 bp, Homo sapiens
agagacagggttttgtcgtgtt

SEQ ID NO: 7807564 - DNA, 20 bp, Homo sapiens
agagaccctgtagcttgcag

SEQ ID NO: 7807565 - DNA, 22 bp, Homo sapiens
agaccacagtcaggctcctggt

SEQ ID NO: 7807566 - DNA, 22 bp, Homo sapiens
atgaaatttgaccaattattta

SEQ ID NO: 7807567 - DNA, 22 bp, Homo sapiens
atgaaagtagggtaaaatcaca

SEQ ID NO: 7807568 - DNA, 22 bp, Homo sapiens
agcagctgccactggaatagga

SEQ ID NO: 7807569 - DNA, 22 bp, Homo sapiens
cacagtttggtatagaagtgat

SEQ ID NO: 7807570 - DNA, 22 bp, Homo sapiens
caagagctagaaattggttaga

SEQ ID NO: 7807571 - DNA, 22 bp, Homo sapiens
caagagctaccctgtgccatat

SEQ ID NO: 7807572 - DNA, 22 bp, Homo sapiens
agcagcaggctagggaactgct

SEQ ID NO: 7807573 - DNA, 22 bp, Homo sapiens
agcagcagggacaaaggaacag

SEQ ID NO: 7807574 - DNA, 22 bp, Homo sapiens
agcagcaggcttaaggaaaagt

SEQ ID NO: 7807575 - DNA, 22 bp, Homo sapiens
agcacagcttcaccgagcccat

SEQ ID NO: 7807576 - DNA, 22 bp, Homo sapiens
cagaatgcagaatgttcatttt

SEQ ID NO: 7807577 - DNA, 21 bp, Homo sapiens
cagaatgcattctttgaagga

SEQ ID NO: 7807578 - DNA, 22 bp, Homo sapiens
cagaatgcattgcttctgatgg

SEQ ID NO: 7807579 - DNA, 22 bp, Homo sapiens
cagaatgggaaggactgcagtt

SEQ ID NO: 7807580 - DNA, 22 bp, Homo sapiens
agcatatacaaactcatataca

SEQ ID NO: 7807581 - DNA, 22 bp, Homo sapiens
agcatataaatggacatatttg

SEQ ID NO: 7807582 - DNA, 22 bp, Homo sapiens
cagcagggtatacagggaattt

SEQ ID NO: 7807583 - DNA, 22 bp, Homo sapiens
cagcagtgtggaagctgagggg

SEQ ID NO: 7807584 - DNA, 22 bp, Homo sapiens
cagcagtgtgcaggtgtgctgg

SEQ ID NO: 7807585 - DNA, 22 bp, Homo sapiens
cagctcagtctggagagatgca

SEQ ID NO: 7807586 - DNA, 22 bp, Homo sapiens
agctcaggcaactctgggcccc

SEQ ID NO: 7807587 - DNA, 22 bp, Homo sapiens
cagcgtctcgttgtgggcctcg

SEQ ID NO: 7807588 - DNA, 22 bp, Homo sapiens
aatcatgtccatcttaactttc

SEQ ID NO: 7807589 - DNA, 22 bp, Homo sapiens
aatcatgtactgctgtggcttt

SEQ ID NO: 7807590 - DNA, 22 bp, Homo sapiens
aatcataattttgtgaatgtag

SEQ ID NO: 7807591 - DNA, 20 bp, Homo sapiens
aatataattctctgaattta

SEQ ID NO: 7807592 - DNA, 22 bp, Homo sapiens
aatataatgctgttttatgcca

SEQ ID NO: 7807593 - DNA, 22 bp, Homo sapiens
aactgttctacccttcatttca

SEQ ID NO: 7807594 - DNA, 22 bp, Homo sapiens
aactgttcttgtgtttgctatg

SEQ ID NO: 7807595 - DNA, 22 bp, Homo sapiens
aactgttccttaggaattattt

SEQ ID NO: 7807596 - DNA, 22 bp, Homo sapiens
aatagttttataggtgggatta

SEQ ID NO: 7807597 - DNA, 22 bp, Homo sapiens
aacaggcaggagaattctgcct

SEQ ID NO: 7807598 - DNA, 22 bp, Homo sapiens
aacaggcaatttaggactcttt

SEQ ID NO: 7807599 - DNA, 22 bp, Homo sapiens
aaattctttcatggctaataag

SEQ ID NO: 7807600 - DNA, 21 bp, Homo sapiens
aaatgtgttccataatgcttt

SEQ ID NO: 7807601 - DNA, 22 bp, Homo sapiens
aaatgtgttcctttgctacaga

SEQ ID NO: 7807602 - DNA, 22 bp, Homo sapiens
aaatgtggggctggaggcagga

SEQ ID NO: 7807603 - DNA, 22 bp, Homo sapiens
aaatgtgtttctttgtgaatgg

SEQ ID NO: 7807604 - DNA, 22 bp, Homo sapiens
aaatgttctaaattacatgtga

SEQ ID NO: 7807605 - DNA, 22 bp, Homo sapiens
aaattcctctgatcataagaat

SEQ ID NO: 7807606 - DNA, 22 bp, Homo sapiens
aacttcatgtaatttaaaacag

SEQ ID NO: 7807607 - DNA, 22 bp, Homo sapiens
aattgttgagcataaattatcg

SEQ ID NO: 7807608 - DNA, 22 bp, Homo sapiens
aagacagctcaggacagattca

SEQ ID NO: 7807609 - DNA, 22 bp, Homo sapiens
aagaataaattaagatacttag

SEQ ID NO: 7807610 - DNA, 22 bp, Homo sapiens
aagagcttcctctttcattgct

SEQ ID NO: 7807611 - DNA, 18 bp, Homo sapiens
aagagcttcgcatataca

SEQ ID NO: 7807612 - DNA, 22 bp, Homo sapiens
acaaggctgtggggagaactga

SEQ ID NO: 7807613 - DNA, 22 bp, Homo sapiens
acaaggctaatttggaagatac

SEQ ID NO: 7807614 - DNA, 22 bp, Homo sapiens
aagagctgattaagtcatgagg

SEQ ID NO: 7807615 - DNA, 22 bp, Homo sapiens
aagccaagttggaagactgaat

SEQ ID NO: 7807616 - DNA, 22 bp, Homo sapiens
aagcacaggatcttgaggagcg

SEQ ID NO: 7807617 - DNA, 21 bp, Homo sapiens
aaagagcttttgtgctagtta

SEQ ID NO: 7807618 - DNA, 22 bp, Homo sapiens
aaatgcagcctagctcagtttt

SEQ ID NO: 7807619 - DNA, 22 bp, Homo sapiens
aaatgcactgaacacatgttgt

SEQ ID NO: 7807620 - DNA, 22 bp, Homo sapiens
aaatgcagatccctgaatctca

SEQ ID NO: 7807621 - DNA, 22 bp, Homo sapiens
aaattactttacactttcatct

SEQ ID NO: 7807622 - DNA, 22 bp, Homo sapiens
aaactcttcatatacatatgct

SEQ ID NO: 7807623 - DNA, 22 bp, Homo sapiens
aaaatcagtacactttattttg

SEQ ID NO: 7807624 - DNA, 22 bp, Homo sapiens
aaaagtatagggtttggagtca

SEQ ID NO: 7807625 - DNA, 22 bp, Homo sapiens
aaagcttatttgtatgcatgtt

SEQ ID NO: 7807626 - DNA, 22 bp, Homo sapiens
aaattttctctctaagacttaa

SEQ ID NO: 7807627 - DNA, 22 bp, Homo sapiens
aaagataatgtttccttattct

SEQ ID NO: 7807628 - DNA, 22 bp, Homo sapiens
aaagtatatatgcactttagaa

SEQ ID NO: 7807629 - DNA, 22 bp, Homo sapiens
aaagtatatttacttactgtga

SEQ ID NO: 7807630 - DNA, 22 bp, Homo sapiens
aactaaaagtgtgtctcttgta

SEQ ID NO: 7807631 - DNA, 19 bp, Homo sapiens
aaagtgttttcttttctgt

SEQ ID NO: 7807632 - DNA, 22 bp, Homo sapiens
aaataactttctgtgtatagtc

SEQ ID NO: 7807633 - DNA, 22 bp, Homo sapiens
aaatcagatcttacacaattgt

SEQ ID NO: 7807634 - DNA, 22 bp, Homo sapiens
aaatagattgctgaggcattac

SEQ ID NO: 7807635 - DNA, 22 bp, Homo sapiens
aaatgcaggaaattatgctttt

SEQ ID NO: 7807636 - DNA, 22 bp, Homo sapiens
aaatgcacaggttttaaatcct

SEQ ID NO: 7807637 - DNA, 22 bp, Homo sapiens
aaatgcatgagaaagtattctg

SEQ ID NO: 7807638 - DNA, 22 bp, Homo sapiens
aaatgcatcagctcataagaga

SEQ ID NO: 7807639 - DNA, 22 bp, Homo sapiens
aaatgcatatcaaagacttgaa

SEQ ID NO: 7807640 - DNA, 22 bp, Homo sapiens
aaatgcaggtagtatttatttt

SEQ ID NO: 7807641 - DNA, 22 bp, Homo sapiens
aatcctggaatacaagagtgaa

SEQ ID NO: 7807642 - DNA, 23 bp, Homo sapiens
aatatatgtgtttttctgcttca

SEQ ID NO: 7807643 - DNA, 22 bp, Homo sapiens
aatatatgagggagctatttga

SEQ ID NO: 7807644 - DNA, 22 bp, Homo sapiens
aatatatgactccactgcatga

SEQ ID NO: 7807645 - DNA, 22 bp, Homo sapiens
aatcctggcatgtgccttggga

SEQ ID NO: 7807646 - DNA, 22 bp, Homo sapiens
aataatgtttatttgtattctc

SEQ ID NO: 7807647 - DNA, 22 bp, Homo sapiens
aataatgttgacgatagtctta

SEQ ID NO: 7807648 - DNA, 22 bp, Homo sapiens
aataatgttatgtcattcttct

SEQ ID NO: 7807649 - DNA, 19 bp, Homo sapiens
aataatgttcatgagattg

SEQ ID NO: 7807650 - DNA, 22 bp, Homo sapiens
aataattgtcaactatgctaca

SEQ ID NO: 7807651 - DNA, 22 bp, Homo sapiens
aagtactagaaatagcagtgcc

SEQ ID NO: 7807652 - DNA, 22 bp, Homo sapiens
aaggctgaggctggagaattac

SEQ ID NO: 7807653 - DNA, 22 bp, Homo sapiens
aaggaaaggatgagcatgcatt

SEQ ID NO: 7807654 - DNA, 22 bp, Homo sapiens
aaggcagcttcaccacagcatt

SEQ ID NO: 7807655 - DNA, 22 bp, Homo sapiens
aaggcagctcagctcatggcag

SEQ ID NO: 7807656 - DNA, 22 bp, Homo sapiens
aaggcagcctctgccagccggg

SEQ ID NO: 7807657 - DNA, 22 bp, Homo sapiens
agcagtggtgtgaggagggctc

SEQ ID NO: 7807658 - DNA, 22 bp, Homo sapiens
agcagtggctggatggtgtgct

SEQ ID NO: 7807659 - DNA, 22 bp, Homo sapiens
acaatttgtgtcttttgcttat

SEQ ID NO: 7807660 - DNA, 22 bp, Homo sapiens
acaatttggacatgtgcaggat

SEQ ID NO: 7807661 - DNA, 21 bp, Homo sapiens
agcaccctcccttctggaggg

SEQ ID NO: 7807662 - DNA, 23 bp, Homo sapiens
acacatatattcagatacagatg

SEQ ID NO: 7807663 - DNA, 22 bp, Homo sapiens
acacatatatttgcatatacac

SEQ ID NO: 7807664 - DNA, 22 bp, Homo sapiens
acacatatctaagatagatgac

SEQ ID NO: 7807665 - DNA, 22 bp, Homo sapiens
acacatatgccattacagcaaa

SEQ ID NO: 7807666 - DNA, 22 bp, Homo sapiens
acacatatggttgctgcagtga

SEQ ID NO: 7807667 - DNA, 22 bp, Homo sapiens
acacatatgtatgcatcatgtg

SEQ ID NO: 7807668 - DNA, 22 bp, Homo sapiens
agccattttggtaatgataaca

SEQ ID NO: 7807669 - DNA, 22 bp, Homo sapiens
agccccctccctagtgactgga

SEQ ID NO: 7807670 - DNA, 15 bp, Homo sapiens
agccccctcagagga

SEQ ID NO: 7807671 - DNA, 22 bp, Homo sapiens
agctatgtttgacagaaagtga

SEQ ID NO: 7807672 - DNA, 22 bp, Homo sapiens
agctatgtccctatgaattctg

SEQ ID NO: 7807673 - DNA, 22 bp, Homo sapiens
acaaatgcagcataaagtgaac

SEQ ID NO: 7807674 - DNA, 22 bp, Homo sapiens
acaaatgccatgtgacctacca

SEQ ID NO: 7807675 - DNA, 22 bp, Homo sapiens
acaaatgccatatataaattct

SEQ ID NO: 7807676 - DNA, 22 bp, Homo sapiens
agaggccatctgctctgtgggg

SEQ ID NO: 7807677 - DNA, 22 bp, Homo sapiens
agaggccagtggctgtgctgtc

SEQ ID NO: 7807678 - DNA, 22 bp, Homo sapiens
aatttgtggccacattgtggaa

SEQ ID NO: 7807679 - DNA, 22 bp, Homo sapiens
aatttgtgttagtccacgttca

SEQ ID NO: 7807680 - DNA, 22 bp, Homo sapiens
aatgttgtacctatgctgagag

SEQ ID NO: 7807681 - DNA, 22 bp, Homo sapiens
aattatatgttaatcttcaatt

SEQ ID NO: 7807682 - DNA, 23 bp, Homo sapiens
agaaggtgggcctgctgagttat

SEQ ID NO: 7807683 - DNA, 22 bp, Homo sapiens
tagtttcatatgcaaaatagta

SEQ ID NO: 7807684 - DNA, 23 bp, Homo sapiens
tagttattttctctgtaatttgc

SEQ ID NO: 7807685 - DNA, 22 bp, Homo sapiens
tagctggggctttcattcttgc

SEQ ID NO: 7807686 - DNA, 22 bp, Homo sapiens
tagagtccttcattctgtgcag

SEQ ID NO: 7807687 - DNA, 22 bp, Homo sapiens
tagagtcctgtgtgctctgtgg

SEQ ID NO: 7807688 - DNA, 22 bp, Homo sapiens
tagcaagaaaacacaagaatta

SEQ ID NO: 7807689 - DNA, 22 bp, Homo sapiens
tagcaaaatgtggatgtagttg

SEQ ID NO: 7807690 - DNA, 22 bp, Homo sapiens
tatttgatgaaggtaaagtctt

SEQ ID NO: 7807691 - DNA, 22 bp, Homo sapiens
tatttgatggttctaaaacagc

SEQ ID NO: 7807692 - DNA, 22 bp, Homo sapiens
tatttgatagagataaatgata

SEQ ID NO: 7807693 - DNA, 22 bp, Homo sapiens
tatttaataaaactatggcatg

SEQ ID NO: 7807694 - DNA, 22 bp, Homo sapiens
tattgtccatgtgtctgttagc

SEQ ID NO: 7807695 - DNA, 22 bp, Homo sapiens
tatgtatataggtgtgtgtctc

SEQ ID NO: 7807696 - DNA, 18 bp, Homo sapiens
tatgtataacatagttca

SEQ ID NO: 7807697 - DNA, 22 bp, Homo sapiens
tatgtataaatgcatgtgtgga

SEQ ID NO: 7807698 - DNA, 22 bp, Homo sapiens
tatgtataatcacagagtgtca

SEQ ID NO: 7807699 - DNA, 18 bp, Homo sapiens
tatgtagtatatgtgtat

SEQ ID NO: 7807700 - DNA, 23 bp, Homo sapiens
tatgtatgtatgtttgtatggaa

SEQ ID NO: 7807701 - DNA, 22 bp, Homo sapiens
tatgtatccgtgtgtgtacaga

SEQ ID NO: 7807702 - DNA, 22 bp, Homo sapiens
tatgtatatgtgtgttgacaac

SEQ ID NO: 7807703 - DNA, 22 bp, Homo sapiens
tatgtatatggtagaagtatgt

SEQ ID NO: 7807704 - DNA, 22 bp, Homo sapiens
tatgtatatatgttgggtagaa

SEQ ID NO: 7807705 - DNA, 22 bp, Homo sapiens
tattaattcttgccaattctcc

SEQ ID NO: 7807706 - DNA, 22 bp, Homo sapiens
tattaacattttatgaaaataa

SEQ ID NO: 7807707 - DNA, 22 bp, Homo sapiens
tattaaattatggatttaggag

SEQ ID NO: 7807708 - DNA, 22 bp, Homo sapiens
tatgtactcatcaactattgaa

SEQ ID NO: 7807709 - DNA, 22 bp, Homo sapiens
tatcattttactgtgacatttt

SEQ ID NO: 7807710 - DNA, 22 bp, Homo sapiens
tatgaattctgttcattgatga

SEQ ID NO: 7807711 - DNA, 18 bp, Homo sapiens
tataaacacacttaggtt

SEQ ID NO: 7807712 - DNA, 22 bp, Homo sapiens
tatcacatacttctcatccagg

SEQ ID NO: 7807713 - DNA, 22 bp, Homo sapiens
tactagtttttaggaaaagtga

SEQ ID NO: 7807714 - DNA, 22 bp, Homo sapiens
tactgtgtggtgagctgtctcc

SEQ ID NO: 7807715 - DNA, 22 bp, Homo sapiens
tactgtgttgtgctgaaaggga

SEQ ID NO: 7807716 - DNA, 22 bp, Homo sapiens
tactgtgtgattccatttacgt

SEQ ID NO: 7807717 - DNA, 22 bp, Homo sapiens
tactgtgtcttaggatgtggaa

SEQ ID NO: 7807718 - DNA, 22 bp, Homo sapiens
tactgtgtgaccctgggtaggt

SEQ ID NO: 7807719 - DNA, 21 bp, Homo sapiens
tacagtctcccctgttgtcca

SEQ ID NO: 7807720 - DNA, 22 bp, Homo sapiens
tacagtctctgataactgtcag

SEQ ID NO: 7807721 - DNA, 20 bp, Homo sapiens
tacagtgtatgtatttaggc

SEQ ID NO: 7807722 - DNA, 22 bp, Homo sapiens
taatttatgatgcaaagaaaag

SEQ ID NO: 7807723 - DNA, 22 bp, Homo sapiens
taagctgtgggagattggcata

SEQ ID NO: 7807724 - DNA, 22 bp, Homo sapiens
taatagtttcataatgtgcttc

SEQ ID NO: 7807725 - DNA, 22 bp, Homo sapiens
taatataccaaactgtaatttt

SEQ ID NO: 7807726 - DNA, 22 bp, Homo sapiens
taatatacttcccatagtttga

SEQ ID NO: 7807727 - DNA, 22 bp, Homo sapiens
tacacagttttgctcccatgat

SEQ ID NO: 7807728 - DNA, 22 bp, Homo sapiens
tacacatacattgcttacaagg

SEQ ID NO: 7807729 - DNA, 22 bp, Homo sapiens
tacacatacaccaatgtggtca

SEQ ID NO: 7807730 - DNA, 22 bp, Homo sapiens
gttcttcaggctgtgctctaga

SEQ ID NO: 7807731 - DNA, 22 bp, Homo sapiens
gttcttcagtcacatcacagaa

SEQ ID NO: 7807732 - DNA, 22 bp, Homo sapiens
gttaaatgcagattctgactca

SEQ ID NO: 7807733 - DNA, 22 bp, Homo sapiens
gttaaatgcactattgaaagct

SEQ ID NO: 7807734 - DNA, 22 bp, Homo sapiens
gttaaattcgatgatggataaa

SEQ ID NO: 7807735 - DNA, 22 bp, Homo sapiens
gtgtttgacttaggtacattaa

SEQ ID NO: 7807736 - DNA, 22 bp, Homo sapiens
gtgttctgggatgattgtagtg

SEQ ID NO: 7807737 - DNA, 22 bp, Homo sapiens
gtgttgtggagcttgtcagggg

SEQ ID NO: 7807738 - DNA, 22 bp, Homo sapiens
gtttattatacaacaaaagcta

SEQ ID NO: 7807739 - DNA, 21 bp, Homo sapiens
taagcatatcagatagactct

SEQ ID NO: 7807740 - DNA, 22 bp, Homo sapiens
taaatgtttagtcttatttggg

SEQ ID NO: 7807741 - DNA, 22 bp, Homo sapiens
taaatgcaatgtgctttaccag

SEQ ID NO: 7807742 - DNA, 22 bp, Homo sapiens
taaatgcagattcctgagccta

SEQ ID NO: 7807743 - DNA, 22 bp, Homo sapiens
taaatgcagcagtttctgttct

SEQ ID NO: 7807744 - DNA, 22 bp, Homo sapiens
taaatgcagcagtttctgttct

SEQ ID NO: 7807745 - DNA, 22 bp, Homo sapiens
taaatgcagtacaaattgttct

SEQ ID NO: 7807746 - DNA, 18 bp, Homo sapiens
taaatgcatgttaataac

SEQ ID NO: 7807747 - DNA, 20 bp, Homo sapiens
taaatgcatgaatgtaaggc

SEQ ID NO: 7807748 - DNA, 22 bp, Homo sapiens
taaatgcagttagtacttgcca

SEQ ID NO: 7807749 - DNA, 20 bp, Homo sapiens
taaatgcatctgttcaactg

SEQ ID NO: 7807750 - DNA, 22 bp, Homo sapiens
taaatgcaaagcttggcgctta

SEQ ID NO: 7807751 - DNA, 22 bp, Homo sapiens
taaatgatttatgtatgtgaaa

SEQ ID NO: 7807752 - DNA, 22 bp, Homo sapiens
taaatgcaagtgctcctgggag

SEQ ID NO: 7807753 - DNA, 22 bp, Homo sapiens
taaatgcaagggaaaggcaaga

SEQ ID NO: 7807754 - DNA, 19 bp, Homo sapiens
tcagcatcaatttggtcct

SEQ ID NO: 7807755 - DNA, 22 bp, Homo sapiens
tcagcatcaggttgtctgaatt

SEQ ID NO: 7807756 - DNA, 22 bp, Homo sapiens
tcagatggtcattcactagggt

SEQ ID NO: 7807757 - DNA, 22 bp, Homo sapiens
tcagatggttccatcatttttc

SEQ ID NO: 7807758 - DNA, 22 bp, Homo sapiens
tcagatggtactaatttaagga

SEQ ID NO: 7807759 - DNA, 22 bp, Homo sapiens
tcagatgggttttgaaggatgt

SEQ ID NO: 7807760 - DNA, 20 bp, Homo sapiens
tcagatgggagtgagccatc

SEQ ID NO: 7807761 - DNA, 22 bp, Homo sapiens
tcagatggattcattacatgac

SEQ ID NO: 7807762 - DNA, 22 bp, Homo sapiens
tcagatggaggcaatgttacct

SEQ ID NO: 7807763 - DNA, 22 bp, Homo sapiens
tcagatggaaaggttactgtcc

SEQ ID NO: 7807764 - DNA, 22 bp, Homo sapiens
tcagatggaatgatgccactgc

SEQ ID NO: 7807765 - DNA, 22 bp, Homo sapiens
tcagatggatttatactatttc

SEQ ID NO: 7807766 - DNA, 22 bp, Homo sapiens
tcagatggcacacagagcctgc

SEQ ID NO: 7807767 - DNA, 22 bp, Homo sapiens
tcagatggcataggttggaatt

SEQ ID NO: 7807768 - DNA, 18 bp, Homo sapiens
tcacatacttaggccctc

SEQ ID NO: 7807769 - DNA, 22 bp, Homo sapiens
tcacataaattatacaatttca

SEQ ID NO: 7807770 - DNA, 22 bp, Homo sapiens
tcatttgtggaagtgattgtgg

SEQ ID NO: 7807771 - DNA, 22 bp, Homo sapiens
tcatttgtgtgagtgatttgac

SEQ ID NO: 7807772 - DNA, 22 bp, Homo sapiens
tccaatggggcctctctgtcag

SEQ ID NO: 7807773 - DNA, 22 bp, Homo sapiens
tcatctgttgattttaagtctt

SEQ ID NO: 7807774 - DNA, 22 bp, Homo sapiens
tcagtgttttaactgtctttta

SEQ ID NO: 7807775 - DNA, 22 bp, Homo sapiens
tcctgccctcgggggtgttcca

SEQ ID NO: 7807776 - DNA, 20 bp, Homo sapiens
tcctgagcctccaccatgtc

SEQ ID NO: 7807777 - DNA, 22 bp, Homo sapiens
tcctgaagaacgaagtcatgta

SEQ ID NO: 7807778 - DNA, 22 bp, Homo sapiens
tcccaaatataatgcaagagac

SEQ ID NO: 7807779 - DNA, 22 bp, Homo sapiens
tcccaaaggtccgagcgggaat

SEQ ID NO: 7807780 - DNA, 22 bp, Homo sapiens
gtgccagaggcagtgaggagtt

SEQ ID NO: 7807781 - DNA, 22 bp, Homo sapiens
gtgcccagctccacctcacaga

SEQ ID NO: 7807782 - DNA, 22 bp, Homo sapiens
gtgctgccggcatagcagtgaa

SEQ ID NO: 7807783 - DNA, 22 bp, Homo sapiens
gtctccagtgttcaggtgactg

SEQ ID NO: 7807784 - DNA, 22 bp, Homo sapiens
gtctccagggctgctggcgcct

SEQ ID NO: 7807785 - DNA, 22 bp, Homo sapiens
gtctcccaatccgggacagcct

SEQ ID NO: 7807786 - DNA, 22 bp, Homo sapiens
gtctccagaattcttgggaggg

SEQ ID NO: 7807787 - DNA, 22 bp, Homo sapiens
gtctttcatggatattcagttt

SEQ ID NO: 7807788 - DNA, 22 bp, Homo sapiens
gtgaggactggtaaggactgca

SEQ ID NO: 7807789 - DNA, 22 bp, Homo sapiens
gtgaggactagtgggtttgtgc

SEQ ID NO: 7807790 - DNA, 22 bp, Homo sapiens
gtgagctgttggagtggcagag

SEQ ID NO: 7807791 - DNA, 22 bp, Homo sapiens
gtatacatagatgatgaacaag

SEQ ID NO: 7807792 - DNA, 22 bp, Homo sapiens
gtatacatagatgatgaacaag

SEQ ID NO: 7807793 - DNA, 22 bp, Homo sapiens
gtagtgtgtaggcactgtgctc

SEQ ID NO: 7807794 - DNA, 22 bp, Homo sapiens
gtagtattttctgtgatgtagg

SEQ ID NO: 7807795 - DNA, 22 bp, Homo sapiens
gtcagagatggcatgaaagatt

SEQ ID NO: 7807796 - DNA, 22 bp, Homo sapiens
ggggaggccagtggaccgtccc

SEQ ID NO: 7807797 - DNA, 22 bp, Homo sapiens
ggggccagcttcgcgtgctctt

SEQ ID NO: 7807798 - DNA, 22 bp, Homo sapiens
ggggccaggtccagcttccaaa

SEQ ID NO: 7807799 - DNA, 22 bp, Homo sapiens
ggtccctgcccacctgggagct

SEQ ID NO: 7807800 - DNA, 22 bp, Homo sapiens
ggtccctgaagaggcctggggt

SEQ ID NO: 7807801 - DNA, 22 bp, Homo sapiens
ggtgagaggcagtgctgtggaa

SEQ ID NO: 7807802 - DNA, 19 bp, Homo sapiens
ggtggcagaacgtgggtcc

SEQ ID NO: 7807803 - DNA, 22 bp, Homo sapiens
ggtggagtaattcgcagaggtt

SEQ ID NO: 7807804 - DNA, 22 bp, Homo sapiens
ggtggggagtcaggcattcttg

SEQ ID NO: 7807805 - DNA, 18 bp, Homo sapiens
ggctgtgcgtggaggctg

SEQ ID NO: 7807806 - DNA, 22 bp, Homo sapiens
gggaagcagacggcggggaaat

SEQ ID NO: 7807807 - DNA, 22 bp, Homo sapiens
gggaagagtaactagcccatgt

SEQ ID NO: 7807808 - DNA, 22 bp, Homo sapiens
ggctgccacgtcgagggtccaa

SEQ ID NO: 7807809 - DNA, 22 bp, Homo sapiens
ggctgccaggagaagctcagtg

SEQ ID NO: 7807810 - DNA, 22 bp, Homo sapiens
ggctggcagaggggagtctgtg

SEQ ID NO: 7807811 - DNA, 22 bp, Homo sapiens
gggcagaggctctggcccatcc

SEQ ID NO: 7807812 - DNA, 21 bp, Homo sapiens
gggcagaggggcctcctgggt

SEQ ID NO: 7807813 - DNA, 20 bp, Homo sapiens
gggcagagccagccagtccc

SEQ ID NO: 7807814 - DNA, 22 bp, Homo sapiens
gggcagagagctggaactcctt

SEQ ID NO: 7807815 - DNA, 16 bp, Homo sapiens
gggagtgaaggagggt

SEQ ID NO: 7807816 - DNA, 22 bp, Homo sapiens
ggcctctctggcatggctgccc

SEQ ID NO: 7807817 - DNA, 22 bp, Homo sapiens
ggcccatgcatcctgtgcagcc

SEQ ID NO: 7807818 - DNA, 22 bp, Homo sapiens
ggcagatggagaagcagcaggt

SEQ ID NO: 7807819 - DNA, 22 bp, Homo sapiens
gccaggctccccggatccctgg

SEQ ID NO: 7807820 - DNA, 22 bp, Homo sapiens
gcctccctgtttcctgctccaa

SEQ ID NO: 7807821 - DNA, 22 bp, Homo sapiens
gcccgcgccagcctctccatct

SEQ ID NO: 7807822 - DNA, 22 bp, Homo sapiens
gcagagtgaagggagaggtgtg

SEQ ID NO: 7807823 - DNA, 22 bp, Homo sapiens
gcagagtgagccgaggctgctc

SEQ ID NO: 7807824 - DNA, 22 bp, Homo sapiens
gcacagcagccgaaatgccctt

SEQ ID NO: 7807825 - DNA, 22 bp, Homo sapiens
gcaatactgagattattgtact

SEQ ID NO: 7807826 - DNA, 22 bp, Homo sapiens
gcagggtgtgtctcatacagtt

SEQ ID NO: 7807827 - DNA, 22 bp, Homo sapiens
gcaggccaggctaggggctgtc

SEQ ID NO: 7807828 - DNA, 22 bp, Homo sapiens
gcagctgggacactgaggccag

SEQ ID NO: 7807829 - DNA, 21 bp, Homo sapiens
gcagctggtctcagagcttgc

SEQ ID NO: 7807830 - DNA, 22 bp, Homo sapiens
gcttttttgggatgcctgcctt

SEQ ID NO: 7807831 - DNA, 22 bp, Homo sapiens
gcttttttgctattgaagtggt

SEQ ID NO: 7807832 - DNA, 22 bp, Homo sapiens
gctgtgtttgacagtagcagac

SEQ ID NO: 7807833 - DNA, 22 bp, Homo sapiens
gctgtgttggtgaagctgtagc

SEQ ID NO: 7807834 - DNA, 22 bp, Homo sapiens
gctgtgttcattttgcatatgt

SEQ ID NO: 7807835 - DNA, 22 bp, Homo sapiens
gctgtgttgggaatcatgtggg

SEQ ID NO: 7807836 - DNA, 22 bp, Homo sapiens
gctgtgtgctcacgtagtggaa

SEQ ID NO: 7807837 - DNA, 22 bp, Homo sapiens
gctggtccacatcctggtacgt

SEQ ID NO: 7807838 - DNA, 22 bp, Homo sapiens
gctggtcccaatgtgtttcctt

SEQ ID NO: 7807839 - DNA, 19 bp, Homo sapiens
gctgtattaaagatacatg

SEQ ID NO: 7807840 - DNA, 22 bp, Homo sapiens
gctgtatgagttcatgtgtaga

SEQ ID NO: 7807841 - DNA, 23 bp, Homo sapiens
ggacagggccctgccctatggcc

SEQ ID NO: 7807842 - DNA, 22 bp, Homo sapiens
ggacagggctcttggcactcct

SEQ ID NO: 7807843 - DNA, 22 bp, Homo sapiens
ggaaaaatgacacatatctcaa

SEQ ID NO: 7807844 - DNA, 22 bp, Homo sapiens
gctgctggaagcatgcgatgaa

SEQ ID NO: 7807845 - DNA, 22 bp, Homo sapiens
gctgctgggaatgaacagtgtt

SEQ ID NO: 7807846 - DNA, 19 bp, Homo sapiens
gctgctggctctggctgga

SEQ ID NO: 7807847 - DNA, 22 bp, Homo sapiens
gctgctgggggaacagttaaaa

SEQ ID NO: 7807848 - DNA, 22 bp, Homo sapiens
gctgctgggtccctctgtgcca

SEQ ID NO: 7807849 - DNA, 22 bp, Homo sapiens
gctgctggtcctcagagctcat

SEQ ID NO: 7807850 - DNA, 22 bp, Homo sapiens
gctctctgcagcctccttggag

SEQ ID NO: 7807851 - DNA, 22 bp, Homo sapiens
gctccccttggtcctcctggga

SEQ ID NO: 7807852 - DNA, 20 bp, Homo sapiens
gctccccttctctgggcctc

SEQ ID NO: 7807853 - DNA, 22 bp, Homo sapiens
gctctctggctagtccatcggg

SEQ ID NO: 7807854 - DNA, 22 bp, Homo sapiens
gctctctggaggccatggacag

SEQ ID NO: 7807855 - DNA, 22 bp, Homo sapiens
gctctctggttccagtcaggaa

SEQ ID NO: 7807856 - DNA, 22 bp, Homo sapiens
gctctctgcctttctcaatgac

SEQ ID NO: 7807857 - DNA, 22 bp, Homo sapiens
ctttctctgtgtttcacatgct

SEQ ID NO: 7807858 - DNA, 22 bp, Homo sapiens
ctttctcttacccaaggatctg

SEQ ID NO: 7807859 - DNA, 22 bp, Homo sapiens
ctttctctggaggggagtggtt

SEQ ID NO: 7807860 - DNA, 22 bp, Homo sapiens
ctttctctgtggtgaggagggt

SEQ ID NO: 7807861 - DNA, 22 bp, Homo sapiens
ctttctctgtgtggtaaagggc

SEQ ID NO: 7807862 - DNA, 20 bp, Homo sapiens
cttcttcagcctatgcttca

SEQ ID NO: 7807863 - DNA, 22 bp, Homo sapiens
cttcacagtaaatccagaagaa

SEQ ID NO: 7807864 - DNA, 22 bp, Homo sapiens
ctgttaaagatagttaagcttc

SEQ ID NO: 7807865 - DNA, 22 bp, Homo sapiens
ctttggaagccaggcagttcac

SEQ ID NO: 7807866 - DNA, 22 bp, Homo sapiens
ctttggaaggaagacctttcag

SEQ ID NO: 7807867 - DNA, 22 bp, Homo sapiens
ctttggaaggaacaggattctc

SEQ ID NO: 7807868 - DNA, 22 bp, Homo sapiens
ctttggaagtgaccacaatcct

SEQ ID NO: 7807869 - DNA, 22 bp, Homo sapiens
ctttggaagtgatagatatgat

SEQ ID NO: 7807870 - DNA, 22 bp, Homo sapiens
ctttggagaagaatgcatcctt

SEQ ID NO: 7807871 - DNA, 20 bp, Homo sapiens
ctttttctccagctctgagc

SEQ ID NO: 7807872 - DNA, 22 bp, Homo sapiens
ctttttcttctaggtgtgcctg

SEQ ID NO: 7807873 - DNA, 22 bp, Homo sapiens
ctttttctgatgttccatgatt

SEQ ID NO: 7807874 - DNA, 23 bp, Homo sapiens
ctttggcactttacaataaactc

SEQ ID NO: 7807875 - DNA, 22 bp, Homo sapiens
cttttgttctacagctggggaa

SEQ ID NO: 7807876 - DNA, 22 bp, Homo sapiens
gaaaaatgagctgatgtcaggg

SEQ ID NO: 7807877 - DNA, 22 bp, Homo sapiens
gaaatattgtactggagatgtt

SEQ ID NO: 7807878 - DNA, 22 bp, Homo sapiens
ctggtgtccagcatgtgtggaa

SEQ ID NO: 7807879 - DNA, 22 bp, Homo sapiens
ctggtgggtagagggcatcagg

SEQ ID NO: 7807880 - DNA, 22 bp, Homo sapiens
ctggtggggagtcctggtctcc

SEQ ID NO: 7807881 - DNA, 22 bp, Homo sapiens
ctgggtggaaagtgctgagaat

SEQ ID NO: 7807882 - DNA, 22 bp, Homo sapiens
ctggttcccagcaggagtgtag

SEQ ID NO: 7807883 - DNA, 22 bp, Homo sapiens
ctgtgtgtgctacaggcttcca

SEQ ID NO: 7807884 - DNA, 22 bp, Homo sapiens
ctgtgtgtgtctgcagcatact

SEQ ID NO: 7807885 - DNA, 23 bp, Homo sapiens
ctgtgtgtgccgagggtggccac

SEQ ID NO: 7807886 - DNA, 22 bp, Homo sapiens
ctgtgtgtgagaagcaggttga

SEQ ID NO: 7807887 - DNA, 22 bp, Homo sapiens
ctgtgtttctcttgacccaagt

SEQ ID NO: 7807888 - DNA, 22 bp, Homo sapiens
ctgtgtttctaagtaaaggagc

SEQ ID NO: 7807889 - DNA, 22 bp, Homo sapiens
ctgtgtgtttatatcatttcct

SEQ ID NO: 7807890 - DNA, 22 bp, Homo sapiens
ctgtgtttttggtctgatctat

SEQ ID NO: 7807891 - DNA, 22 bp, Homo sapiens
ctgtgttttgattaaaaagcaa

SEQ ID NO: 7807892 - DNA, 22 bp, Homo sapiens
ctgtgtttgctatgcaaagaca

SEQ ID NO: 7807893 - DNA, 22 bp, Homo sapiens
ctgtgtttggacaacttttcag

SEQ ID NO: 7807894 - DNA, 22 bp, Homo sapiens
gagggccagcagcctcagcatg

SEQ ID NO: 7807895 - DNA, 22 bp, Homo sapiens
gagggtgggctcctatctgggt

SEQ ID NO: 7807896 - DNA, 22 bp, Homo sapiens
gaggtcttagaagaaaaatcat

SEQ ID NO: 7807897 - DNA, 22 bp, Homo sapiens
gagaaagggaacttacagagtg

SEQ ID NO: 7807898 - DNA, 22 bp, Homo sapiens
gagcaagactacaggcagatga

SEQ ID NO: 7807899 - DNA, 22 bp, Homo sapiens
gacaaatgagacatcaattccc

SEQ ID NO: 7807900 - DNA, 22 bp, Homo sapiens
gacatacagaatctgcagactt

SEQ ID NO: 7807901 - DNA, 22 bp, Homo sapiens
gacatacagcatggtctatgaa

SEQ ID NO: 7807902 - DNA, 22 bp, Homo sapiens
gacatacagccctctccctggt

SEQ ID NO: 7807903 - DNA, 22 bp, Homo sapiens
gacatatactatggatggttct

SEQ ID NO: 7807904 - DNA, 22 bp, Homo sapiens
ttattgagtatctgcttggtgt

SEQ ID NO: 7807905 - DNA, 22 bp, Homo sapiens
cgagcagaagcctggtggtctg

SEQ ID NO: 7807906 - DNA, 16 bp, Homo sapiens
cgcctccctccctcgc

SEQ ID NO: 7807907 - DNA, 22 bp, Homo sapiens
ttaagatgatgtttcttgttgt

SEQ ID NO: 7807908 - DNA, 22 bp, Homo sapiens
ttaaattttagaaacagactct

SEQ ID NO: 7807909 - DNA, 22 bp, Homo sapiens
ttaaattgtcatttgagcaatg

SEQ ID NO: 7807910 - DNA, 22 bp, Homo sapiens
ccttagcaactgtcatagagca

SEQ ID NO: 7807911 - DNA, 22 bp, Homo sapiens
ttggaagggatattggcatatg

SEQ ID NO: 7807912 - DNA, 23 bp, Homo sapiens
ttggaagggaagagcatttgaga

SEQ ID NO: 7807913 - DNA, 22 bp, Homo sapiens
ttggaagggaacaccatttgac

SEQ ID NO: 7807914 - DNA, 22 bp, Homo sapiens
ttggatccatctcaggcatagg

SEQ ID NO: 7807915 - DNA, 22 bp, Homo sapiens
ttggaaggcagcatttgtccat

SEQ ID NO: 7807916 - DNA, 22 bp, Homo sapiens
ttgcccagagtcacccagctca

SEQ ID NO: 7807917 - DNA, 23 bp, Homo sapiens
ttctggaagatttacttgagaca

SEQ ID NO: 7807918 - DNA, 22 bp, Homo sapiens
ctagagaacaacattcatatgg

SEQ ID NO: 7807919 - DNA, 22 bp, Homo sapiens
cgtgtgtgtacctgcgcattta

SEQ ID NO: 7807920 - DNA, 22 bp, Homo sapiens
cgtgtgttgaaagatgtacatc

SEQ ID NO: 7807921 - DNA, 22 bp, Homo sapiens
ctatagaaaattgtatcacacg

SEQ ID NO: 7807922 - DNA, 22 bp, Homo sapiens
ctggagagttggaagatggact

SEQ ID NO: 7807923 - DNA, 19 bp, Homo sapiens
ctgctgggtgctgagggag

SEQ ID NO: 7807924 - DNA, 22 bp, Homo sapiens
ctgctgggtctatgcaagtgga

SEQ ID NO: 7807925 - DNA, 22 bp, Homo sapiens
ctgctctgttcccccatcatct

SEQ ID NO: 7807926 - DNA, 20 bp, Homo sapiens
ctgcccagccactgagggat

SEQ ID NO: 7807927 - DNA, 22 bp, Homo sapiens
ctgcccaggggagtgctgtcgg

SEQ ID NO: 7807928 - DNA, 17 bp, Homo sapiens
ctgaggggagtgctgtg

SEQ ID NO: 7807929 - DNA, 22 bp, Homo sapiens
tttcatgttacatttaaaatgt

SEQ ID NO: 7807930 - DNA, 17 bp, Homo sapiens
ttttctctcttggattc

SEQ ID NO: 7807931 - DNA, 22 bp, Homo sapiens
ttttctcttccctctggacctg

SEQ ID NO: 7807932 - DNA, 21 bp, Homo sapiens
ttttgctgaatggacacgtgc

SEQ ID NO: 7807933 - DNA, 22 bp, Homo sapiens
ctctgtgtatccaagttcaggt

SEQ ID NO: 7807934 - DNA, 22 bp, Homo sapiens
ctctgtgtgctggtggggtcct

SEQ ID NO: 7807935 - DNA, 22 bp, Homo sapiens
ctctgtgtggtatgattgtcat

SEQ ID NO: 7807936 - DNA, 22 bp, Homo sapiens
ctctgtgtggtcctctgtattg

SEQ ID NO: 7807937 - DNA, 22 bp, Homo sapiens
ctctgtgcgggccatggtcagg

SEQ ID NO: 7807938 - DNA, 22 bp, Homo sapiens
ctctggctatggcacggcgctc

SEQ ID NO: 7807939 - DNA, 22 bp, Homo sapiens
tttggaataatcagatcctagt

SEQ ID NO: 7807940 - DNA, 23 bp, Homo sapiens
ctctgcaccaggtggttttcagc

SEQ ID NO: 7807941 - DNA, 22 bp, Homo sapiens
ctctgcacacaagtaatttcat

SEQ ID NO: 7807942 - DNA, 20 bp, Homo sapiens
tttgactaggtaagtgcttt

SEQ ID NO: 7807943 - DNA, 22 bp, Homo sapiens
cccacaggcaggtgcatgggct

SEQ ID NO: 7807944 - DNA, 22 bp, Homo sapiens
ccatggccgccgctgctcagga

SEQ ID NO: 7807945 - DNA, 22 bp, Homo sapiens
tgatgactgccattctattact

SEQ ID NO: 7807946 - DNA, 18 bp, Homo sapiens
tgaggcagtcagtgatgg

SEQ ID NO: 7807947 - DNA, 22 bp, Homo sapiens
tgatacataaaccatcattttg

SEQ ID NO: 7807948 - DNA, 22 bp, Homo sapiens
tgcatattgtgaaaatgtagat

SEQ ID NO: 7807949 - DNA, 23 bp, Homo sapiens
tgcctcagtggaatgtgagggtg

SEQ ID NO: 7807950 - DNA, 22 bp, Homo sapiens
cccaggaattggaggctgcagt

SEQ ID NO: 7807951 - DNA, 22 bp, Homo sapiens
tgagagttattctgaatttagc

SEQ ID NO: 7807952 - DNA, 22 bp, Homo sapiens
tgagcagaaaagaatgctgagc

SEQ ID NO: 7807953 - DNA, 20 bp, Homo sapiens
tgaagaggaagaggacggcc

SEQ ID NO: 7807954 - DNA, 22 bp, Homo sapiens
tctttcaaagctgtagtagatt

SEQ ID NO: 7807955 - DNA, 22 bp, Homo sapiens
tctttcaaagcaaaatgaggct

SEQ ID NO: 7807956 - DNA, 22 bp, Homo sapiens
ccaggctagaaactgaggcaca

SEQ ID NO: 7807957 - DNA, 22 bp, Homo sapiens
cctgctggtgtccaggctttgg

SEQ ID NO: 7807958 - DNA, 22 bp, Homo sapiens
cctgctgttagatttcagtcac

SEQ ID NO: 7807959 - DNA, 21 bp, Homo sapiens
tgtaagtttcatctgaattgg

SEQ ID NO: 7807960 - DNA, 22 bp, Homo sapiens
tgtaatatatataactgtgtgc

SEQ ID NO: 7807961 - DNA, 22 bp, Homo sapiens
tgtaatataagcattaatagtt

SEQ ID NO: 7807962 - DNA, 22 bp, Homo sapiens
tggggtacttgtatcaaagcac

SEQ ID NO: 7807963 - DNA, 22 bp, Homo sapiens
tgggagcaggtgtgctagggaa

SEQ ID NO: 7807964 - DNA, 20 bp, Homo sapiens
tggaaggcatctgcattatt

SEQ ID NO: 7807965 - DNA, 22 bp, Homo sapiens
cccgtcccttttgcccgctggt

SEQ ID NO: 7807966 - DNA, 22 bp, Homo sapiens
cctcacagggccaggcccctca

SEQ ID NO: 7807967 - DNA, 20 bp, Homo sapiens
cctcacagggcagagagggg

SEQ ID NO: 7807968 - DNA, 22 bp, Homo sapiens
ccgtcccctctgaccttgctga

SEQ ID NO: 7807969 - DNA, 22 bp, Homo sapiens
ccgtccccagccacctgctgat

SEQ ID NO: 7807970 - DNA, 22 bp, Homo sapiens
tcgctcaggcttgagtgtagtg

SEQ ID NO: 7807971 - DNA, 22 bp, Homo sapiens
tcgcgccctcctcaccaacgtg

SEQ ID NO: 7807972 - DNA, 22 bp, Homo sapiens
tcgcgcccccaagcgtcattgg

SEQ ID NO: 7807973 - DNA, 23 bp, Homo sapiens
tcggtgggcgtggaggccgaggc

SEQ ID NO: 7807974 - DNA, 22 bp, Homo sapiens
tctccgatcacaggttttcaat

SEQ ID NO: 7807975 - DNA, 22 bp, Homo sapiens
tctctgggacactgggtcagtt

SEQ ID NO: 7807976 - DNA, 22 bp, Homo sapiens
cattcattagaatagatatgta

SEQ ID NO: 7807977 - DNA, 22 bp, Homo sapiens
catttgtaggatgcttcttgtt

SEQ ID NO: 7807978 - DNA, 22 bp, Homo sapiens
tcatttatgtctttgccatcca

SEQ ID NO: 7807979 - DNA, 23 bp, Homo sapiens
tcatgagtggctgcggggctgag

SEQ ID NO: 7807980 - DNA, 22 bp, Homo sapiens
catgtgtgtctccaccagctgc

SEQ ID NO: 7807981 - DNA, 22 bp, Homo sapiens
catgtgtgtgagggaaacatgt

SEQ ID NO: 7807982 - DNA, 22 bp, Homo sapiens
catgtgtgtccatgtgactaag

SEQ ID NO: 7807983 - DNA, 22 bp, Homo sapiens
tagaatcaagcagtagagcaga

SEQ ID NO: 7807984 - DNA, 22 bp, Homo sapiens
caggctggtcccagagcattgc

SEQ ID NO: 7807985 - DNA, 22 bp, Homo sapiens
cagggcacttaaattgcctcgt

SEQ ID NO: 7807986 - DNA, 20 bp, Homo sapiens
cagggcacactgcagcctcg

SEQ ID NO: 7807987 - DNA, 22 bp, Homo sapiens
cagggcacagatcggggcgcac

SEQ ID NO: 7807988 - DNA, 22 bp, Homo sapiens
tagcaagatgtcactccaagtt

SEQ ID NO: 7807989 - DNA, 22 bp, Homo sapiens
tagctacaaatctgataagtgg

SEQ ID NO: 7807990 - DNA, 22 bp, Homo sapiens
tactcagtcagattcaacctag

SEQ ID NO: 7807991 - DNA, 22 bp, Homo sapiens
caggctggagtgcaatgacgcc

SEQ ID NO: 7807992 - DNA, 22 bp, Homo sapiens
tatcatttaacagaatcattgc

SEQ ID NO: 7807993 - DNA, 22 bp, Homo sapiens
tagctattcacttgttgatgga

SEQ ID NO: 7807994 - DNA, 22 bp, Homo sapiens
cagggctagggagccctcctgg

SEQ ID NO: 7807995 - DNA, 22 bp, Homo sapiens
cagtgggaagggcagaggcttt

SEQ ID NO: 7807996 - DNA, 21 bp, Homo sapiens
cagtagtgcgtcgcagaggac

SEQ ID NO: 7807997 - DNA, 22 bp, Homo sapiens
tttcactcagctctcattgtct

SEQ ID NO: 7807998 - DNA, 17 bp, Homo sapiens
ttgtgtgtagttctgat

SEQ ID NO: 7807999 - DNA, 22 bp, Homo sapiens
ttgtgtgtagactcagccattg

SEQ ID NO: 7808000 - DNA, 22 bp, Homo sapiens
tttaaatgttcatgatactgaa

SEQ ID NO: 7808001 - DNA, 22 bp, Homo sapiens
tttatatagagatttgtgcatg

SEQ ID NO: 7808002 - DNA, 22 bp, Homo sapiens
ttggaaagcaagctggacatac

SEQ ID NO: 7808003 - DNA, 21 bp, Homo sapiens
ttggaacaagcagcagtttgc

SEQ ID NO: 7808004 - DNA, 22 bp, Homo sapiens
ttgtgtatttcctgaaggtaag

SEQ ID NO: 7808005 - DNA, 22 bp, Homo sapiens
ttgtgtattttttgatactaac

SEQ ID NO: 7808006 - DNA, 22 bp, Homo sapiens
ttgtccattgtgacaagtgtgg

SEQ ID NO: 7808007 - DNA, 22 bp, Homo sapiens
ttgtcccattgcgaatgtgagt

SEQ ID NO: 7808008 - DNA, 22 bp, Homo sapiens
ttgtccctgcccctgcttgctt

SEQ ID NO: 7808009 - DNA, 22 bp, Homo sapiens
ttgtcccttcagtaagagtgga

SEQ ID NO: 7808010 - DNA, 22 bp, Homo sapiens
ttgtcatatttataaaatgtaa

SEQ ID NO: 7808011 - DNA, 22 bp, Homo sapiens
ttgtcactagtgaagaatcagg

SEQ ID NO: 7808012 - DNA, 22 bp, Homo sapiens
ttgtaaatgaccttttctaatt

SEQ ID NO: 7808013 - DNA, 22 bp, Homo sapiens
ttgtaaatagtagtaagatgcc

SEQ ID NO: 7808014 - DNA, 21 bp, Homo sapiens
ttgtaaatggctttttccttc

SEQ ID NO: 7808015 - DNA, 22 bp, Homo sapiens
ttctctgcagctcctggctggg

SEQ ID NO: 7808016 - DNA, 22 bp, Homo sapiens
ttctccaacacaagcatgatgt

SEQ ID NO: 7808017 - DNA, 22 bp, Homo sapiens
ttctccagagggctctgcagga

SEQ ID NO: 7808018 - DNA, 22 bp, Homo sapiens
ttctctaagagttatatgaatt

SEQ ID NO: 7808019 - DNA, 22 bp, Homo sapiens
ttctccagaccctcctgcagac

SEQ ID NO: 7808020 - DNA, 22 bp, Homo sapiens
ttccttggtagagagaatattt

SEQ ID NO: 7808021 - DNA, 22 bp, Homo sapiens
ttcctgggtggtcctggtagag

SEQ ID NO: 7808022 - DNA, 21 bp, Homo sapiens
ttcctggggacttccgtggga

SEQ ID NO: 7808023 - DNA, 22 bp, Homo sapiens
ttcttcaaagtccttattcctt

SEQ ID NO: 7808024 - DNA, 22 bp, Homo sapiens
ttcttcaaagatgtctgttgga

SEQ ID NO: 7808025 - DNA, 22 bp, Homo sapiens
ttctggaagtgttagaatctgg

SEQ ID NO: 7808026 - DNA, 22 bp, Homo sapiens
ttcattgtagcttgactaatta

SEQ ID NO: 7808027 - DNA, 22 bp, Homo sapiens
ttcatacaatgggatattatga

SEQ ID NO: 7808028 - DNA, 22 bp, Homo sapiens
ttcatttttaccgcgtgtcaaa

SEQ ID NO: 7808029 - DNA, 17 bp, Homo sapiens
ttatactcgtaggtgga

SEQ ID NO: 7808030 - DNA, 22 bp, Homo sapiens
ttatatactgtggtagtactgt

SEQ ID NO: 7808031 - DNA, 22 bp, Homo sapiens
ttaggaaacgctgctattgact

SEQ ID NO: 7808032 - DNA, 22 bp, Homo sapiens
ttatatatcttgatttgttcca

SEQ ID NO: 7808033 - DNA, 22 bp, Homo sapiens
ttatatatatgtagaggtcacg

SEQ ID NO: 7808034 - DNA, 22 bp, Homo sapiens
tttgaaagggttatgagactga

SEQ ID NO: 7808035 - DNA, 22 bp, Homo sapiens
tttgtgtgtatatgtatataga

SEQ ID NO: 7808036 - DNA, 22 bp, Homo sapiens
tttgtaagaactataaattgct

SEQ ID NO: 7808037 - DNA, 22 bp, Homo sapiens
tttgtaagcaagttaacatttt

SEQ ID NO: 7808038 - DNA, 22 bp, Homo sapiens
tttgttaattcttatgttagag

SEQ ID NO: 7808039 - DNA, 22 bp, Homo sapiens
tttgttaaggagtattgcttct

SEQ ID NO: 7808040 - DNA, 22 bp, Homo sapiens
tttgttaaaatgcagattctgt

SEQ ID NO: 7808041 - DNA, 22 bp, Homo sapiens
tttgttaagatgctgttctgct

SEQ ID NO: 7808042 - DNA, 22 bp, Homo sapiens
ttttaaagagatgctgtgcata

SEQ ID NO: 7808043 - DNA, 22 bp, Homo sapiens
cagaagagtagctgaacaagtt

SEQ ID NO: 7808044 - DNA, 22 bp, Homo sapiens
cagaagaggactgggtagctca

SEQ ID NO: 7808045 - DNA, 22 bp, Homo sapiens
ggcaggtgtgagatcgaggcca

SEQ ID NO: 7808046 - DNA, 22 bp, Homo sapiens
ggcaggtgccttctgtgctagc

SEQ ID NO: 7808047 - DNA, 22 bp, Homo sapiens
ggagtgactcacagctgggaca

SEQ ID NO: 7808048 - DNA, 21 bp, Homo sapiens
ggccagctcggaaggtcccat

SEQ ID NO: 7808049 - DNA, 22 bp, Homo sapiens
ggcgcccccttcaaacagagca

SEQ ID NO: 7808050 - DNA, 22 bp, Homo sapiens
gctgggagccgtacctgtcacg

SEQ ID NO: 7808051 - DNA, 22 bp, Homo sapiens
caagtgcacacacatcctgtgc

SEQ ID NO: 7808052 - DNA, 20 bp, Homo sapiens
caagtgtagaaactaataag

SEQ ID NO: 7808053 - DNA, 22 bp, Homo sapiens
gctggtggcagagacatcaggt

SEQ ID NO: 7808054 - DNA, 22 bp, Homo sapiens
gcttccagatcccatgctctta

SEQ ID NO: 7808055 - DNA, 22 bp, Homo sapiens
ggagcagccgcgtctcagggca

SEQ ID NO: 7808056 - DNA, 22 bp, Homo sapiens
ggagcagccacgtctcagggca

SEQ ID NO: 7808057 - DNA, 22 bp, Homo sapiens
cacagcattaactgggacagct

SEQ ID NO: 7808058 - DNA, 21 bp, Homo sapiens
cacagcagggttcctgggctc

SEQ ID NO: 7808059 - DNA, 18 bp, Homo sapiens
ggagagtgacagagtcgt

SEQ ID NO: 7808060 - DNA, 22 bp, Homo sapiens
ggacagcattcctagttccaaa

SEQ ID NO: 7808061 - DNA, 22 bp, Homo sapiens
ggaaggggtcacctcctgatga

SEQ ID NO: 7808062 - DNA, 22 bp, Homo sapiens
ggtggcagtagcactgggcctg

SEQ ID NO: 7808063 - DNA, 22 bp, Homo sapiens
cagatggcaacagctctgtgac

SEQ ID NO: 7808064 - DNA, 22 bp, Homo sapiens
ggtggctggttttataagaggt

SEQ ID NO: 7808065 - DNA, 22 bp, Homo sapiens
ggtggcagtgcttgcgggtcta

SEQ ID NO: 7808066 - DNA, 22 bp, Homo sapiens
ggtgggaaggggccagtgtgcg

SEQ ID NO: 7808067 - DNA, 22 bp, Homo sapiens
cagataatccaagtagttttca

SEQ ID NO: 7808068 - DNA, 22 bp, Homo sapiens
ggggtagggtgattgtgaagta

SEQ ID NO: 7808069 - DNA, 22 bp, Homo sapiens
gggggcagaatgtactcttgtc

SEQ ID NO: 7808070 - DNA, 22 bp, Homo sapiens
cagaggcagaggtcatctctgg

SEQ ID NO: 7808071 - DNA, 22 bp, Homo sapiens
cagcagtggctgcaggcagctg

SEQ ID NO: 7808072 - DNA, 22 bp, Homo sapiens
gtcctgaatgccttcatagtcc

SEQ ID NO: 7808073 - DNA, 22 bp, Homo sapiens
cagcagtggaactacccaggga

SEQ ID NO: 7808074 - DNA, 22 bp, Homo sapiens
cagcagtgcttcagtgtgagat

SEQ ID NO: 7808075 - DNA, 22 bp, Homo sapiens
cagcagtggccatctgtgtggt

SEQ ID NO: 7808076 - DNA, 20 bp, Homo sapiens
cagcagtggatgagagtttt

SEQ ID NO: 7808077 - DNA, 22 bp, Homo sapiens
cagcagtgatgtgtgagggttc

SEQ ID NO: 7808078 - DNA, 22 bp, Homo sapiens
cagcaggtcccactgagggccc

SEQ ID NO: 7808079 - DNA, 22 bp, Homo sapiens
cagcaggtcctgggcgtggcct

SEQ ID NO: 7808080 - DNA, 22 bp, Homo sapiens
cagctcctgcagctggctccca

SEQ ID NO: 7808081 - DNA, 22 bp, Homo sapiens
gacagggacgaggcttcaggca

SEQ ID NO: 7808082 - DNA, 22 bp, Homo sapiens
atgcccaatgtcacaatttttg

SEQ ID NO: 7808083 - DNA, 22 bp, Homo sapiens
gaatcatggctgtgtcttcagc

SEQ ID NO: 7808084 - DNA, 22 bp, Homo sapiens
gacagggcgcccagcctgtttc

SEQ ID NO: 7808085 - DNA, 22 bp, Homo sapiens
gacagggccaaaccggctgatc

SEQ ID NO: 7808086 - DNA, 22 bp, Homo sapiens
gacagggaggagcagagcttct

SEQ ID NO: 7808087 - DNA, 22 bp, Homo sapiens
gacagggaggaaagagactgct

SEQ ID NO: 7808088 - DNA, 22 bp, Homo sapiens
gaaatgatgtctgtgctgccac

SEQ ID NO: 7808089 - DNA, 22 bp, Homo sapiens
gaaatgattttagtttatcatg

SEQ ID NO: 7808090 - DNA, 22 bp, Homo sapiens
atgcaaatgctagagaatgttg

SEQ ID NO: 7808091 - DNA, 22 bp, Homo sapiens
gagtccagttagtgaggctggg

SEQ ID NO: 7808092 - DNA, 22 bp, Homo sapiens
atgtttcaggcgaactaacatg

SEQ ID NO: 7808093 - DNA, 22 bp, Homo sapiens
atgtttcagttctaaagttaga

SEQ ID NO: 7808094 - DNA, 22 bp, Homo sapiens
atgtttcaggaaatcagctaga

SEQ ID NO: 7808095 - DNA, 22 bp, Homo sapiens
atgtttcaccagcaaattacct

SEQ ID NO: 7808096 - DNA, 22 bp, Homo sapiens
atgtttcaccagttttataaga

SEQ ID NO: 7808097 - DNA, 22 bp, Homo sapiens
atgtttcaagagaaaaagagac

SEQ ID NO: 7808098 - DNA, 22 bp, Homo sapiens
atgtttcaataatgctgtgagt

SEQ ID NO: 7808099 - DNA, 22 bp, Homo sapiens
gagcagggcttgtcctcctcat

SEQ ID NO: 7808100 - DNA, 22 bp, Homo sapiens
gagcagctgagctggaatgaga

SEQ ID NO: 7808101 - DNA, 18 bp, Homo sapiens
gagctctgcctcccagtc

SEQ ID NO: 7808102 - DNA, 22 bp, Homo sapiens
gagctctgccatggctcccacc

SEQ ID NO: 7808103 - DNA, 22 bp, Homo sapiens
gagcacagggaatagacagata

SEQ ID NO: 7808104 - DNA, 22 bp, Homo sapiens
gctaagaaaaattcatgtatat

SEQ ID NO: 7808105 - DNA, 22 bp, Homo sapiens
gctgaggaaaggctggaaggga

SEQ ID NO: 7808106 - DNA, 22 bp, Homo sapiens
gctgaggacatcatggaaggaa

SEQ ID NO: 7808107 - DNA, 22 bp, Homo sapiens
gctgaggaagtcaggtggccca

SEQ ID NO: 7808108 - DNA, 22 bp, Homo sapiens
gcccaggagttgaagggctgac

SEQ ID NO: 7808109 - DNA, 21 bp, Homo sapiens
gccccctggactcctcatcca

SEQ ID NO: 7808110 - DNA, 22 bp, Homo sapiens
gcccaggaggtggaggtgcagt

SEQ ID NO: 7808111 - DNA, 22 bp, Homo sapiens
atttgcaaagtcgtatctgtga

SEQ ID NO: 7808112 - DNA, 22 bp, Homo sapiens
atttgcaattactcatgtcatt

SEQ ID NO: 7808113 - DNA, 22 bp, Homo sapiens
atttgatttgtagatagtgtag

SEQ ID NO: 7808114 - DNA, 22 bp, Homo sapiens
atttgcatttacatagcataga

SEQ ID NO: 7808115 - DNA, 22 bp, Homo sapiens
gcacagggaggctggcctggcc

SEQ ID NO: 7808116 - DNA, 22 bp, Homo sapiens
gcacagggccctgtgcgtaggt

SEQ ID NO: 7808117 - DNA, 22 bp, Homo sapiens
gcacagggagcaggtctctggt

SEQ ID NO: 7808118 - DNA, 22 bp, Homo sapiens
gcacagggagacagccgtggcc

SEQ ID NO: 7808119 - DNA, 19 bp, Homo sapiens
gcagccaggtgctctacct

SEQ ID NO: 7808120 - DNA, 22 bp, Homo sapiens
gcagggaggaagagatgcttcc

SEQ ID NO: 7808121 - DNA, 22 bp, Homo sapiens
gcagggtgaaggtcacatagaa

SEQ ID NO: 7808122 - DNA, 22 bp, Homo sapiens
gcaggtggatcacctgaggtca

SEQ ID NO: 7808123 - DNA, 22 bp, Homo sapiens
attgtaaaagtattctaagatt

SEQ ID NO: 7808124 - DNA, 22 bp, Homo sapiens
gccactggcatctagttggtag

SEQ ID NO: 7808125 - DNA, 22 bp, Homo sapiens
aggaattcaagaccagctgggc

SEQ ID NO: 7808126 - DNA, 22 bp, Homo sapiens
cagtgaggagtccagggcagag

SEQ ID NO: 7808127 - DNA, 22 bp, Homo sapiens
cagtgcaggaagtgagatgcct

SEQ ID NO: 7808128 - DNA, 23 bp, Homo sapiens
aggcaggcagttcagctgttgtt

SEQ ID NO: 7808129 - DNA, 22 bp, Homo sapiens
catgtgtggtctgtggctatct

SEQ ID NO: 7808130 - DNA, 22 bp, Homo sapiens
catgtgtggagggcatgcatgg

SEQ ID NO: 7808131 - DNA, 22 bp, Homo sapiens
catgtgtgcaccaaccctatgt

SEQ ID NO: 7808132 - DNA, 22 bp, Homo sapiens
caggaagaaagaggtgaggtgt

SEQ ID NO: 7808133 - DNA, 22 bp, Homo sapiens
caggaagaagggtggtgagtcc

SEQ ID NO: 7808134 - DNA, 22 bp, Homo sapiens
caggaagaccagggctgtggct

SEQ ID NO: 7808135 - DNA, 22 bp, Homo sapiens
agctggtgaacctgaggcacag

SEQ ID NO: 7808136 - DNA, 22 bp, Homo sapiens
agctgggttcagaggcacatgg

SEQ ID NO: 7808137 - DNA, 22 bp, Homo sapiens
agctttctagactctgtggtca

SEQ ID NO: 7808138 - DNA, 22 bp, Homo sapiens
agcttctccatctgcccagaga

SEQ ID NO: 7808139 - DNA, 22 bp, Homo sapiens
agctttctggttacagtcttca

SEQ ID NO: 7808140 - DNA, 22 bp, Homo sapiens
cagggacatgactggtctctgt

SEQ ID NO: 7808141 - DNA, 22 bp, Homo sapiens
aggaagagtgttacctatgggt

SEQ ID NO: 7808142 - DNA, 22 bp, Homo sapiens
aggaagaggtagctgtcaaggg

SEQ ID NO: 7808143 - DNA, 22 bp, Homo sapiens
aggaagagggtggcagataatc

SEQ ID NO: 7808144 - DNA, 22 bp, Homo sapiens
aggaagggttctttctgtttat

SEQ ID NO: 7808145 - DNA, 22 bp, Homo sapiens
aggaagggtgtcatgagccctt

SEQ ID NO: 7808146 - DNA, 22 bp, Homo sapiens
aggaaggggagaagttaaagct

SEQ ID NO: 7808147 - DNA, 22 bp, Homo sapiens
aggaagggttctttgtgaaaga

SEQ ID NO: 7808148 - DNA, 22 bp, Homo sapiens
ccagaaaggtaaacactggatt

SEQ ID NO: 7808149 - DNA, 22 bp, Homo sapiens
aggcaggctgctatggagtaga

SEQ ID NO: 7808150 - DNA, 22 bp, Homo sapiens
ccagctggcccagctgtgctcc

SEQ ID NO: 7808151 - DNA, 22 bp, Homo sapiens
aggcctctgggcctgcgggttt

SEQ ID NO: 7808152 - DNA, 22 bp, Homo sapiens
aggcctctggaggtggcagtgt

SEQ ID NO: 7808153 - DNA, 22 bp, Homo sapiens
ccagctggaacggcagcccagc

SEQ ID NO: 7808154 - DNA, 22 bp, Homo sapiens
ccaggctctgcgctggacatgg

SEQ ID NO: 7808155 - DNA, 22 bp, Homo sapiens
agggctggagccacagctggga

SEQ ID NO: 7808156 - DNA, 19 bp, Homo sapiens
agggcctgcagctcaagct

SEQ ID NO: 7808157 - DNA, 22 bp, Homo sapiens
cctgagagcattccacactgaa

SEQ ID NO: 7808158 - DNA, 23 bp, Homo sapiens
aggggcagcaagttttggtgtta

SEQ ID NO: 7808159 - DNA, 22 bp, Homo sapiens
cccagtcatcctgcaggtgaaa

SEQ ID NO: 7808160 - DNA, 22 bp, Homo sapiens
cccaggcttttctcttgcccca

SEQ ID NO: 7808161 - DNA, 22 bp, Homo sapiens
ccctgcccatcggggcggcctg

SEQ ID NO: 7808162 - DNA, 21 bp, Homo sapiens
ccccagcaccttgccagcctg

SEQ ID NO: 7808163 - DNA, 22 bp, Homo sapiens
ctggcctctgtgttcaccatag

SEQ ID NO: 7808164 - DNA, 23 bp, Homo sapiens
atataaacaccagatagattgta

SEQ ID NO: 7808165 - DNA, 22 bp, Homo sapiens
atatacaggtggtatgtgtaaa

SEQ ID NO: 7808166 - DNA, 22 bp, Homo sapiens
atatacactcaccatggtattt

SEQ ID NO: 7808167 - DNA, 22 bp, Homo sapiens
atatacactccactgatacagg

SEQ ID NO: 7808168 - DNA, 22 bp, Homo sapiens
atatacacatttgcttatgtgt

SEQ ID NO: 7808169 - DNA, 19 bp, Homo sapiens
atatacatactgtgtgcat

SEQ ID NO: 7808170 - DNA, 22 bp, Homo sapiens
atatactgatagctgcacttct

SEQ ID NO: 7808171 - DNA, 22 bp, Homo sapiens
atatactgaggagactttatat

SEQ ID NO: 7808172 - DNA, 23 bp, Homo sapiens
ctggcctccgacactggccaaga

SEQ ID NO: 7808173 - DNA, 22 bp, Homo sapiens
ctggcctcatagccaagctgtg

SEQ ID NO: 7808174 - DNA, 22 bp, Homo sapiens
atacatgtgtccctgatttatt

SEQ ID NO: 7808175 - DNA, 22 bp, Homo sapiens
atacatgtgggtctaaacatat

SEQ ID NO: 7808176 - DNA, 22 bp, Homo sapiens
atacatgtgggtctaaacatat

SEQ ID NO: 7808177 - DNA, 19 bp, Homo sapiens
atacatgcatttacatgct

SEQ ID NO: 7808178 - DNA, 22 bp, Homo sapiens
atacatgtaactgcattgtaat

SEQ ID NO: 7808179 - DNA, 22 bp, Homo sapiens
atacacattactttctgtctga

SEQ ID NO: 7808180 - DNA, 22 bp, Homo sapiens
atacacatgtgtatgtgcatgc

SEQ ID NO: 7808181 - DNA, 22 bp, Homo sapiens
ataaaagaagttttggtacttg

SEQ ID NO: 7808182 - DNA, 22 bp, Homo sapiens
ataaaagatcccttctgagctc

SEQ ID NO: 7808183 - DNA, 22 bp, Homo sapiens
ataaagcatactttgtatgact

SEQ ID NO: 7808184 - DNA, 22 bp, Homo sapiens
atacacatgcacacatgtgtgt

SEQ ID NO: 7808185 - DNA, 22 bp, Homo sapiens
atacacatatgtgtgtatatgt

SEQ ID NO: 7808186 - DNA, 21 bp, Homo sapiens
atacacatacacataaatgtg

SEQ ID NO: 7808187 - DNA, 22 bp, Homo sapiens
atacacatatatacacgtttaa

SEQ ID NO: 7808188 - DNA, 22 bp, Homo sapiens
atacacatatcaggtgtataca

SEQ ID NO: 7808189 - DNA, 22 bp, Homo sapiens
atacaagttctcatgtgtatct

SEQ ID NO: 7808190 - DNA, 22 bp, Homo sapiens
ctgtctcagcaggaagtcatca

SEQ ID NO: 7808191 - DNA, 22 bp, Homo sapiens
ctgtaaatggaactatgtagta

SEQ ID NO: 7808192 - DNA, 22 bp, Homo sapiens
ctgggaggggtagccaatccta

SEQ ID NO: 7808193 - DNA, 20 bp, Homo sapiens
ctgggaggtcttccaaatca

SEQ ID NO: 7808194 - DNA, 22 bp, Homo sapiens
atattattctagctcttgtgtg

SEQ ID NO: 7808195 - DNA, 22 bp, Homo sapiens
ctgggtggctgtccagccagcc

SEQ ID NO: 7808196 - DNA, 22 bp, Homo sapiens
ctggtcccagctctgccaccaa

SEQ ID NO: 7808197 - DNA, 22 bp, Homo sapiens
ctggtcccatcctggcttcatg

SEQ ID NO: 7808198 - DNA, 22 bp, Homo sapiens
ctggtcccagcagagctctgag

SEQ ID NO: 7808199 - DNA, 17 bp, Homo sapiens
ctggtcccaccaagccc

SEQ ID NO: 7808200 - DNA, 22 bp, Homo sapiens
ctggtccctgcagtgtgctggg

SEQ ID NO: 7808201 - DNA, 22 bp, Homo sapiens
ctggtccccagactgggcttag

SEQ ID NO: 7808202 - DNA, 22 bp, Homo sapiens
ctggtccctgagtagttatgca

SEQ ID NO: 7808203 - DNA, 20 bp, Homo sapiens
ctgggtggcaagcaaggggg

SEQ ID NO: 7808204 - DNA, 22 bp, Homo sapiens
cttcaatttttggtatgatgga

SEQ ID NO: 7808205 - DNA, 22 bp, Homo sapiens
cttagattttcaatgtgaacta

SEQ ID NO: 7808206 - DNA, 22 bp, Homo sapiens
cttaatgaatgctgctgtattt

SEQ ID NO: 7808207 - DNA, 19 bp, Homo sapiens
atcatacatgttacactct

SEQ ID NO: 7808208 - DNA, 22 bp, Homo sapiens
atcatacagcctttgttagtgt

SEQ ID NO: 7808209 - DNA, 22 bp, Homo sapiens
atctggtgctaacaaatgtgga

SEQ ID NO: 7808210 - DNA, 22 bp, Homo sapiens
atctggtgacacgaggagctgg

SEQ ID NO: 7808211 - DNA, 22 bp, Homo sapiens
atctgtggatatgaccttcctg

SEQ ID NO: 7808212 - DNA, 22 bp, Homo sapiens
atctgtgtgttgagttctcagc

SEQ ID NO: 7808213 - DNA, 22 bp, Homo sapiens
ctagaattgcattctatgaata

SEQ ID NO: 7808214 - DNA, 22 bp, Homo sapiens
agtcagcactcctgaggatcac

SEQ ID NO: 7808215 - DNA, 22 bp, Homo sapiens
aggtattgaccacctccttgat

SEQ ID NO: 7808216 - DNA, 21 bp, Homo sapiens
aggtcagcccagctctggaag

SEQ ID NO: 7808217 - DNA, 20 bp, Homo sapiens
aggtcctggttctctgggat

SEQ ID NO: 7808218 - DNA, 22 bp, Homo sapiens
aggtcctggtgaccatggagtt

SEQ ID NO: 7808219 - DNA, 22 bp, Homo sapiens
agtctacaatcttaaatgaact

SEQ ID NO: 7808220 - DNA, 22 bp, Homo sapiens
ctcacatatgctgggatttccg

SEQ ID NO: 7808221 - DNA, 22 bp, Homo sapiens
agtggcagtggggcagggccct

SEQ ID NO: 7808222 - DNA, 22 bp, Homo sapiens
agttaactcattttataatgcc

SEQ ID NO: 7808223 - DNA, 22 bp, Homo sapiens
ctgagcagccccaccagccatt

SEQ ID NO: 7808224 - DNA, 22 bp, Homo sapiens
agttaaatgtcagtagcttaac

SEQ ID NO: 7808225 - DNA, 22 bp, Homo sapiens
agtgtttgtaaactacagatct

SEQ ID NO: 7808226 - DNA, 22 bp, Homo sapiens
agtgtttggggtgattgtaacc

SEQ ID NO: 7808227 - DNA, 22 bp, Homo sapiens
agtgtttgagacacatttcact

SEQ ID NO: 7808228 - DNA, 20 bp, Homo sapiens
agtgtctgggcctcaggccc

SEQ ID NO: 7808229 - DNA, 22 bp, Homo sapiens
acttttcttatcagaaaggcca

SEQ ID NO: 7808230 - DNA, 22 bp, Homo sapiens
acttccttgtactgactccatt

SEQ ID NO: 7808231 - DNA, 22 bp, Homo sapiens
acttccttgtcaggtgcatcat

SEQ ID NO: 7808232 - DNA, 22 bp, Homo sapiens
atacatatccacaggagataaa

SEQ ID NO: 7808233 - DNA, 22 bp, Homo sapiens
atacaaaatatatactggagac

SEQ ID NO: 7808234 - DNA, 22 bp, Homo sapiens
atacaaaaattagccgggagta

SEQ ID NO: 7808235 - DNA, 22 bp, Homo sapiens
atagatacttataacaattgtg

SEQ ID NO: 7808236 - DNA, 22 bp, Homo sapiens
atacatcatttcccatcaatcg

SEQ ID NO: 7808237 - DNA, 22 bp, Homo sapiens
agtataattagatatcaaaagt

SEQ ID NO: 7808238 - DNA, 22 bp, Homo sapiens
agtatacaaataaatgtgtaat

SEQ ID NO: 7808239 - DNA, 22 bp, Homo sapiens
agtatacagtaatgacatatct

SEQ ID NO: 7808240 - DNA, 22 bp, Homo sapiens
aggtggggaaaccagcgatccc

SEQ ID NO: 7808241 - DNA, 22 bp, Homo sapiens
agctgcaggattatggaatgga

SEQ ID NO: 7808242 - DNA, 22 bp, Homo sapiens
acatacacaagcgtacatgaac

SEQ ID NO: 7808243 - DNA, 22 bp, Homo sapiens
acatacacatgaatatattttt

SEQ ID NO: 7808244 - DNA, 22 bp, Homo sapiens
acatacacacatactttctcct

SEQ ID NO: 7808245 - DNA, 23 bp, Homo sapiens
acatacataagcaccacattttg

SEQ ID NO: 7808246 - DNA, 22 bp, Homo sapiens
acatacatcaagtatcacaaga

SEQ ID NO: 7808247 - DNA, 22 bp, Homo sapiens
acatacatatgacaactttcct

SEQ ID NO: 7808248 - DNA, 22 bp, Homo sapiens
agctaatgaacttagacctgac

SEQ ID NO: 7808249 - DNA, 22 bp, Homo sapiens
agctaagtggaaaatgcagtta

SEQ ID NO: 7808250 - DNA, 22 bp, Homo sapiens
agctaatggaacagagatgtca

SEQ ID NO: 7808251 - DNA, 22 bp, Homo sapiens
agctaagagtggaagctcatct

SEQ ID NO: 7808252 - DNA, 22 bp, Homo sapiens
cagatggctgccttcttgctgt

SEQ ID NO: 7808253 - DNA, 22 bp, Homo sapiens
agccagttctctagtgatattt

SEQ ID NO: 7808254 - DNA, 22 bp, Homo sapiens
agccagtgggattagagcctct

SEQ ID NO: 7808255 - DNA, 22 bp, Homo sapiens
cagatggcatttcctttctggc

SEQ ID NO: 7808256 - DNA, 19 bp, Homo sapiens
cagatggccacctacttgc

SEQ ID NO: 7808257 - DNA, 22 bp, Homo sapiens
cagatggcagggcagctctgca

SEQ ID NO: 7808258 - DNA, 22 bp, Homo sapiens
cagatggctgccaagatgggct

SEQ ID NO: 7808259 - DNA, 22 bp, Homo sapiens
cagatggccagaggcagctgca

SEQ ID NO: 7808260 - DNA, 22 bp, Homo sapiens
agcagggaggcccagggcactg

SEQ ID NO: 7808261 - DNA, 21 bp, Homo sapiens
agcagctgggcaacatggagg

SEQ ID NO: 7808262 - DNA, 22 bp, Homo sapiens
agcaggtgttggctgggccatc

SEQ ID NO: 7808263 - DNA, 22 bp, Homo sapiens
agcaggtgttggctgggccatc

SEQ ID NO: 7808264 - DNA, 22 bp, Homo sapiens
agcaggtgtcggcgagggtctt

SEQ ID NO: 7808265 - DNA, 22 bp, Homo sapiens
cactgtgtcagagtatgatgat

SEQ ID NO: 7808266 - DNA, 22 bp, Homo sapiens
caaaggcatgtgagtatatgtg

SEQ ID NO: 7808267 - DNA, 17 bp, Homo sapiens
agcagctggcacaggag

SEQ ID NO: 7808268 - DNA, 19 bp, Homo sapiens
agcagcgtttaaaaaatgc

SEQ ID NO: 7808269 - DNA, 21 bp, Homo sapiens
agcagcagatctggtgagggc

SEQ ID NO: 7808270 - DNA, 22 bp, Homo sapiens
agcagcagaggtcagaaaggta

SEQ ID NO: 7808271 - DNA, 22 bp, Homo sapiens
agacttaggtgagatgtttgta

SEQ ID NO: 7808272 - DNA, 22 bp, Homo sapiens
agagcagagggctctgggacaa

SEQ ID NO: 7808273 - DNA, 22 bp, Homo sapiens
agagcagagtggctgtagcttg

SEQ ID NO: 7808274 - DNA, 22 bp, Homo sapiens
agagcagatggagctggaagag

SEQ ID NO: 7808275 - DNA, 22 bp, Homo sapiens
agagcagatggccagggggcct

SEQ ID NO: 7808276 - DNA, 22 bp, Homo sapiens
atgaagcttgaggtgagagctg

SEQ ID NO: 7808277 - DNA, 22 bp, Homo sapiens
agaatattcatctgtattctta

SEQ ID NO: 7808278 - DNA, 21 bp, Homo sapiens
atgccaagtcttaatgagggc

SEQ ID NO: 7808279 - DNA, 22 bp, Homo sapiens
atgatagctaccgtttatgctg

SEQ ID NO: 7808280 - DNA, 20 bp, Homo sapiens
atgatagtcagaaaactagc

SEQ ID NO: 7808281 - DNA, 22 bp, Homo sapiens
atgatatacttcctagaacagt

SEQ ID NO: 7808282 - DNA, 22 bp, Homo sapiens
atgcatatgtacttgcatatgt

SEQ ID NO: 7808283 - DNA, 21 bp, Homo sapiens
atgcatattttaagttgtgtc

SEQ ID NO: 7808284 - DNA, 22 bp, Homo sapiens
agaggtggagctcttggcatca

SEQ ID NO: 7808285 - DNA, 22 bp, Homo sapiens
agagtattttgattatcctgga

SEQ ID NO: 7808286 - DNA, 19 bp, Homo sapiens
agagtattgaatttgccct

SEQ ID NO: 7808287 - DNA, 22 bp, Homo sapiens
agagtgctagcctgagggaggt

SEQ ID NO: 7808288 - DNA, 22 bp, Homo sapiens
agagtgagggggcactgagacg

SEQ ID NO: 7808289 - DNA, 23 bp, Homo sapiens
agaggggagcatctgctggctga

SEQ ID NO: 7808290 - DNA, 22 bp, Homo sapiens
agaggggagtcctaatctgatt

SEQ ID NO: 7808291 - DNA, 22 bp, Homo sapiens
agaggccaccactgtcagggac

SEQ ID NO: 7808292 - DNA, 22 bp, Homo sapiens
agaggccaccagaggtggtgcc

SEQ ID NO: 7808293 - DNA, 22 bp, Homo sapiens
agaggccagaaagtatgccacc

SEQ ID NO: 7808294 - DNA, 22 bp, Homo sapiens
agaggccagcagtgcctatctg

SEQ ID NO: 7808295 - DNA, 23 bp, Homo sapiens
agaggccagcctttggagacacc

SEQ ID NO: 7808296 - DNA, 22 bp, Homo sapiens
attacacagcggttactactag

SEQ ID NO: 7808297 - DNA, 22 bp, Homo sapiens
attacacttgttcatcatcacc

SEQ ID NO: 7808298 - DNA, 22 bp, Homo sapiens
attttaaccctcttatatatac

SEQ ID NO: 7808299 - DNA, 22 bp, Homo sapiens
attttcaaaacatctgctgtgt

SEQ ID NO: 7808300 - DNA, 22 bp, Homo sapiens
agcaaatattttgttgaagtgc

SEQ ID NO: 7808301 - DNA, 22 bp, Homo sapiens
agatattaccagcagtctatgc

SEQ ID NO: 7808302 - DNA, 22 bp, Homo sapiens
aaatttaaaaagcagcattgca

SEQ ID NO: 7808303 - DNA, 21 bp, Homo sapiens
aaggggcaaacccaggacacc

SEQ ID NO: 7808304 - DNA, 22 bp, Homo sapiens
aacagtttgcctgaaatgtatt

SEQ ID NO: 7808305 - DNA, 22 bp, Homo sapiens
aagtcaagtgttattattgtag

SEQ ID NO: 7808306 - DNA, 22 bp, Homo sapiens
aatcacatgtgctcaattttaa

SEQ ID NO: 7808307 - DNA, 22 bp, Homo sapiens
aacattctttagctcttcctgc

SEQ ID NO: 7808308 - DNA, 22 bp, Homo sapiens
aatcacattacagcatatctgt

SEQ ID NO: 7808309 - DNA, 20 bp, Homo sapiens
aagaggtgataacaggtgag

SEQ ID NO: 7808310 - DNA, 22 bp, Homo sapiens
aagaggtgccaggggttttgta

SEQ ID NO: 7808311 - DNA, 23 bp, Homo sapiens
acacgtgtgtgtacatagatagt

SEQ ID NO: 7808312 - DNA, 22 bp, Homo sapiens
aagagtaaattcaggactttaa

SEQ ID NO: 7808313 - DNA, 22 bp, Homo sapiens
aagagtggagctggaaagtggg

SEQ ID NO: 7808314 - DNA, 22 bp, Homo sapiens
aactttctagagatgagttcgg

SEQ ID NO: 7808315 - DNA, 22 bp, Homo sapiens
aagacaatttgatactagttgc

SEQ ID NO: 7808316 - DNA, 22 bp, Homo sapiens
aaagatgtcagtttgaaataac

SEQ ID NO: 7808317 - DNA, 22 bp, Homo sapiens
aaaggcatggatagtgaattca

SEQ ID NO: 7808318 - DNA, 22 bp, Homo sapiens
aaatcagttctccctttcttca

SEQ ID NO: 7808319 - DNA, 18 bp, Homo sapiens
aaatgctaggctacatga

SEQ ID NO: 7808320 - DNA, 20 bp, Homo sapiens
aaatgctgagaagtccttaa

SEQ ID NO: 7808321 - DNA, 22 bp, Homo sapiens
aaatatgtatggagttcatgaa

SEQ ID NO: 7808322 - DNA, 22 bp, Homo sapiens
aaagagctttagaaatctcaga

SEQ ID NO: 7808323 - DNA, 20 bp, Homo sapiens
aaacttgatggcatagaata

SEQ ID NO: 7808324 - DNA, 22 bp, Homo sapiens
aaacttgacagtgagacagttt

SEQ ID NO: 7808325 - DNA, 22 bp, Homo sapiens
aaacttgacagtagacagatta

SEQ ID NO: 7808326 - DNA, 23 bp, Homo sapiens
aaacttgttaatgaggcaacagg

SEQ ID NO: 7808327 - DNA, 22 bp, Homo sapiens
aaacttgttctcatgttgcaga

SEQ ID NO: 7808328 - DNA, 22 bp, Homo sapiens
aaaaatgcttggacttaataaa

SEQ ID NO: 7808329 - DNA, 22 bp, Homo sapiens
aaaaagacagaggatgaggcag

SEQ ID NO: 7808330 - DNA, 22 bp, Homo sapiens
aacatgcaatgtctgaaaatcc

SEQ ID NO: 7808331 - DNA, 22 bp, Homo sapiens
aacagtctactgaatatctgcg

SEQ ID NO: 7808332 - DNA, 22 bp, Homo sapiens
aacagtctgggagttccttata

SEQ ID NO: 7808333 - DNA, 22 bp, Homo sapiens
aacagtcttggaagtcttgtta

SEQ ID NO: 7808334 - DNA, 20 bp, Homo sapiens
aagagctacttagcctttcc

SEQ ID NO: 7808335 - DNA, 22 bp, Homo sapiens
aagaatgttagtttctgataca

SEQ ID NO: 7808336 - DNA, 22 bp, Homo sapiens
aagaatgagctcaaagatctta

SEQ ID NO: 7808337 - DNA, 22 bp, Homo sapiens
aagaatgtcgttggtattttaa

SEQ ID NO: 7808338 - DNA, 22 bp, Homo sapiens
aagaatgtggcatttatttata

SEQ ID NO: 7808339 - DNA, 22 bp, Homo sapiens
aactttgtcttttatgcttaca

SEQ ID NO: 7808340 - DNA, 22 bp, Homo sapiens
aaatatgaatgataagagttat

SEQ ID NO: 7808341 - DNA, 22 bp, Homo sapiens
aaatatcttaggagtatatgag

SEQ ID NO: 7808342 - DNA, 22 bp, Homo sapiens
agaggccaagccagactgtgca

SEQ ID NO: 7808343 - DNA, 22 bp, Homo sapiens
agagcagcgtttgtggaacact

SEQ ID NO: 7808344 - DNA, 22 bp, Homo sapiens
agactctggagtcagctaggat

SEQ ID NO: 7808345 - DNA, 19 bp, Homo sapiens
agaattgttttatgtcttc

SEQ ID NO: 7808346 - DNA, 22 bp, Homo sapiens
agaatctggtagaaccaaggat

SEQ ID NO: 7808347 - DNA, 22 bp, Homo sapiens
agaatctgaaggcacctctggt

SEQ ID NO: 7808348 - DNA, 20 bp, Homo sapiens
agaatctgacccagagagac

SEQ ID NO: 7808349 - DNA, 22 bp, Homo sapiens
aatgctgtatatcttagctaat

SEQ ID NO: 7808350 - DNA, 22 bp, Homo sapiens
agaatcagtgctggctattagc

SEQ ID NO: 7808351 - DNA, 22 bp, Homo sapiens
agcaggtgaattcctggatgtg

SEQ ID NO: 7808352 - DNA, 22 bp, Homo sapiens
agcagcagattcagcaggaatg

SEQ ID NO: 7808353 - DNA, 22 bp, Homo sapiens
agccttagaggaaaacattagt

SEQ ID NO: 7808354 - DNA, 22 bp, Homo sapiens
agctcaggtctcaggaggtgtc

SEQ ID NO: 7808355 - DNA, 22 bp, Homo sapiens
aatatgcatgtatacatgtgta

SEQ ID NO: 7808356 - DNA, 22 bp, Homo sapiens
aatatgtctctgtggttaagta

SEQ ID NO: 7808357 - DNA, 18 bp, Homo sapiens
aatatgtctagttacagc

SEQ ID NO: 7808358 - DNA, 22 bp, Homo sapiens
aatattatacagtcaacctctt

SEQ ID NO: 7808359 - DNA, 22 bp, Homo sapiens
aatattatcaaaagctttttca

SEQ ID NO: 7808360 - DNA, 22 bp, Homo sapiens
aatcttcacagagaaaattagg

SEQ ID NO: 7808361 - DNA, 22 bp, Homo sapiens
aatatcttctaaggatagaact

SEQ ID NO: 7808362 - DNA, 22 bp, Homo sapiens
aatacttgaatttcatgtcagg

SEQ ID NO: 7808363 - DNA, 22 bp, Homo sapiens
aatacttgtcagatgaataaga

SEQ ID NO: 7808364 - DNA, 22 bp, Homo sapiens
acattctgtatcatctgtctca

SEQ ID NO: 7808365 - DNA, 22 bp, Homo sapiens
acataatacctaggacagtttg

SEQ ID NO: 7808366 - DNA, 22 bp, Homo sapiens
acatacattgcctcattggtaa

SEQ ID NO: 7808367 - DNA, 22 bp, Homo sapiens
acatactatgaatacatgtgtc

SEQ ID NO: 7808368 - DNA, 18 bp, Homo sapiens
acatacattctgtctgca

SEQ ID NO: 7808369 - DNA, 22 bp, Homo sapiens
acagtgtatgatatttcacagt

SEQ ID NO: 7808370 - DNA, 22 bp, Homo sapiens
acagtgtactaggtacatgttc

SEQ ID NO: 7808371 - DNA, 20 bp, Homo sapiens
acagtgtaatattcacattc

SEQ ID NO: 7808372 - DNA, 22 bp, Homo sapiens
tcaaaagacacaggaggctagt

SEQ ID NO: 7808373 - DNA, 22 bp, Homo sapiens
tcacatcatggagaattatggg

SEQ ID NO: 7808374 - DNA, 22 bp, Homo sapiens
tcacacatgagtaaatacaggg

SEQ ID NO: 7808375 - DNA, 22 bp, Homo sapiens
tcacatcttggattacaatttt

SEQ ID NO: 7808376 - DNA, 22 bp, Homo sapiens
tcatctctagacaggaggctgg

SEQ ID NO: 7808377 - DNA, 22 bp, Homo sapiens
tcatgtgtctgccagtgtttat

SEQ ID NO: 7808378 - DNA, 22 bp, Homo sapiens
tcatgtgtgtttcatgtatgga

SEQ ID NO: 7808379 - DNA, 20 bp, Homo sapiens
tcatgttgggccatcagaat

SEQ ID NO: 7808380 - DNA, 22 bp, Homo sapiens
tccagtcctagaaactggagag

SEQ ID NO: 7808381 - DNA, 22 bp, Homo sapiens
tcctcctctatcagacagtgcc

SEQ ID NO: 7808382 - DNA, 22 bp, Homo sapiens
tccctgggccacagctgtgagc

SEQ ID NO: 7808383 - DNA, 22 bp, Homo sapiens
tccctgaggaaggggtgtggtg

SEQ ID NO: 7808384 - DNA, 22 bp, Homo sapiens
tagatggctttctgaggtattt

SEQ ID NO: 7808385 - DNA, 22 bp, Homo sapiens
tagatggcaccttctgtgtgtc

SEQ ID NO: 7808386 - DNA, 18 bp, Homo sapiens
tagatggcagtctgcaga

SEQ ID NO: 7808387 - DNA, 22 bp, Homo sapiens
tagatggcgtccatggccgcag

SEQ ID NO: 7808388 - DNA, 22 bp, Homo sapiens
tagatggctggtgttctgagct

SEQ ID NO: 7808389 - DNA, 22 bp, Homo sapiens
tagcaagaggaaacaaggggcc

SEQ ID NO: 7808390 - DNA, 20 bp, Homo sapiens
tagaatctactatttggccc

SEQ ID NO: 7808391 - DNA, 22 bp, Homo sapiens
tactttctaagacatacaactt

SEQ ID NO: 7808392 - DNA, 22 bp, Homo sapiens
tagagcattagaaattagtgta

SEQ ID NO: 7808393 - DNA, 22 bp, Homo sapiens
tagagctatttagagcatttta

SEQ ID NO: 7808394 - DNA, 22 bp, Homo sapiens
tagagctactggcagcctcttc

SEQ ID NO: 7808395 - DNA, 22 bp, Homo sapiens
tagtatagattgaagcagatca

SEQ ID NO: 7808396 - DNA, 23 bp, Homo sapiens
tagtgtatatcaacatttgtccc

SEQ ID NO: 7808397 - DNA, 22 bp, Homo sapiens
tagtatttataatcatgcttaa

SEQ ID NO: 7808398 - DNA, 22 bp, Homo sapiens
tagccatgttgttaaaagacaa

SEQ ID NO: 7808399 - DNA, 22 bp, Homo sapiens
tatttcacctaaaagtgtcaaa

SEQ ID NO: 7808400 - DNA, 22 bp, Homo sapiens
tatttcacagcagctcatttaa

SEQ ID NO: 7808401 - DNA, 22 bp, Homo sapiens
tatttgttgcgggaattgctat

SEQ ID NO: 7808402 - DNA, 22 bp, Homo sapiens
tatttcagggagaataaatttg

SEQ ID NO: 7808403 - DNA, 22 bp, Homo sapiens
tatttctaagctgtaagtctga

SEQ ID NO: 7808404 - DNA, 22 bp, Homo sapiens
tatttgtatttcatgcagtaaa

SEQ ID NO: 7808405 - DNA, 22 bp, Homo sapiens
tatttgtatgtgtgtacatata

SEQ ID NO: 7808406 - DNA, 22 bp, Homo sapiens
tatgtgtgtttcagtggaaatg

SEQ ID NO: 7808407 - DNA, 17 bp, Homo sapiens
tatgtgtgtttgcagca

SEQ ID NO: 7808408 - DNA, 22 bp, Homo sapiens
tatgctgtattctgtatgttag

SEQ ID NO: 7808409 - DNA, 22 bp, Homo sapiens
tatgcttattgtctcatccact

SEQ ID NO: 7808410 - DNA, 19 bp, Homo sapiens
tatgtgtgtgtatttacat

SEQ ID NO: 7808411 - DNA, 22 bp, Homo sapiens
tatgctaaatatgttcacattg

SEQ ID NO: 7808412 - DNA, 22 bp, Homo sapiens
tatgctaattgttagtcacatg

SEQ ID NO: 7808413 - DNA, 21 bp, Homo sapiens
tataccacagccatcaaatat

SEQ ID NO: 7808414 - DNA, 20 bp, Homo sapiens
tatactaacatatatctgtt

SEQ ID NO: 7808415 - DNA, 22 bp, Homo sapiens
tatatgcaatgaggtgggagta

SEQ ID NO: 7808416 - DNA, 22 bp, Homo sapiens
tatatgcagattttcatcatcg

SEQ ID NO: 7808417 - DNA, 22 bp, Homo sapiens
tatatgcagtgtgtcattcaag

SEQ ID NO: 7808418 - DNA, 22 bp, Homo sapiens
tatatgcaattttttagtgcaa

SEQ ID NO: 7808419 - DNA, 17 bp, Homo sapiens
tatatgtatgcctctcc

SEQ ID NO: 7808420 - DNA, 22 bp, Homo sapiens
tatatgtagattgtaccaatgt

SEQ ID NO: 7808421 - DNA, 22 bp, Homo sapiens
tatattatcataaaaccattca

SEQ ID NO: 7808422 - DNA, 17 bp, Homo sapiens
tatctgtgttcctggct

SEQ ID NO: 7808423 - DNA, 22 bp, Homo sapiens
tatatttaattagttgctggat

SEQ ID NO: 7808424 - DNA, 22 bp, Homo sapiens
tatgcagtgtacgatgtttagt

SEQ ID NO: 7808425 - DNA, 22 bp, Homo sapiens
tatgcatatagatgcacacaca

SEQ ID NO: 7808426 - DNA, 22 bp, Homo sapiens
tacacatgtttggcaagtatgt

SEQ ID NO: 7808427 - DNA, 22 bp, Homo sapiens
tacacatgtatttatgtgtaca

SEQ ID NO: 7808428 - DNA, 22 bp, Homo sapiens
tacacatatgtgtgtatatgtg

SEQ ID NO: 7808429 - DNA, 20 bp, Homo sapiens
taatttgatatctataagtt

SEQ ID NO: 7808430 - DNA, 22 bp, Homo sapiens
taattttccactctgtttatct

SEQ ID NO: 7808431 - DNA, 22 bp, Homo sapiens
taatttttccacgtacactggg

SEQ ID NO: 7808432 - DNA, 22 bp, Homo sapiens
taatttttccacgtacactggg

SEQ ID NO: 7808433 - DNA, 22 bp, Homo sapiens
taatgatgtttcctatcttcca

SEQ ID NO: 7808434 - DNA, 22 bp, Homo sapiens
taatgatgctagatttatctgg

SEQ ID NO: 7808435 - DNA, 22 bp, Homo sapiens
taatgatgcagttactgtctca

SEQ ID NO: 7808436 - DNA, 22 bp, Homo sapiens
taatgcatgtaatgggctgata

SEQ ID NO: 7808437 - DNA, 22 bp, Homo sapiens
taatgactgccgtctctcttca

SEQ ID NO: 7808438 - DNA, 22 bp, Homo sapiens
taagttaaccctgttaatagat

SEQ ID NO: 7808439 - DNA, 22 bp, Homo sapiens
tactgagtggcaaaggcaagaa

SEQ ID NO: 7808440 - DNA, 22 bp, Homo sapiens
tactaagtggggcattgttata

SEQ ID NO: 7808441 - DNA, 22 bp, Homo sapiens
tactaagtagcagaactaagaa

SEQ ID NO: 7808442 - DNA, 22 bp, Homo sapiens
tactaagtgtttggcagtatca

SEQ ID NO: 7808443 - DNA, 22 bp, Homo sapiens
tacatacacaaatgctgaatgg

SEQ ID NO: 7808444 - DNA, 22 bp, Homo sapiens
tacatacagagatgctagttaa

SEQ ID NO: 7808445 - DNA, 22 bp, Homo sapiens
tacatacagccaagtatgaagt

SEQ ID NO: 7808446 - DNA, 22 bp, Homo sapiens
tacatacacaaatatactgttt

SEQ ID NO: 7808447 - DNA, 22 bp, Homo sapiens
tacatacaagcattcaatttta

SEQ ID NO: 7808448 - DNA, 22 bp, Homo sapiens
tacatacagtggatgctttagg

SEQ ID NO: 7808449 - DNA, 22 bp, Homo sapiens
tacatacatattcatacaggtg

SEQ ID NO: 7808450 - DNA, 22 bp, Homo sapiens
tacatacatggtggaatggtta

SEQ ID NO: 7808451 - DNA, 22 bp, Homo sapiens
tacatacaagatgtgtttaaaa

SEQ ID NO: 7808452 - DNA, 22 bp, Homo sapiens
gtgttacatattctaaaatgct

SEQ ID NO: 7808453 - DNA, 22 bp, Homo sapiens
gtgttaaatgcaatcacatgca

SEQ ID NO: 7808454 - DNA, 22 bp, Homo sapiens
gtgttaaacatgttcacagcat

SEQ ID NO: 7808455 - DNA, 22 bp, Homo sapiens
gtgttaaaaatcccatgatatg

SEQ ID NO: 7808456 - DNA, 22 bp, Homo sapiens
gtgtgtgttcaataaatttaag

SEQ ID NO: 7808457 - DNA, 22 bp, Homo sapiens
gtgtgtttcagaagccaggtgt

SEQ ID NO: 7808458 - DNA, 22 bp, Homo sapiens
gtgtgtttcaccctgacaccaa

SEQ ID NO: 7808459 - DNA, 22 bp, Homo sapiens
gtgtgtttagcattagcagggg

SEQ ID NO: 7808460 - DNA, 22 bp, Homo sapiens
gtgtgtgtgcctgcacacacac

SEQ ID NO: 7808461 - DNA, 22 bp, Homo sapiens
gtgtgtgtgtaaaaatccagag

SEQ ID NO: 7808462 - DNA, 22 bp, Homo sapiens
gtgtgtgtatctgcctatcaca

SEQ ID NO: 7808463 - DNA, 22 bp, Homo sapiens
gtgtgtgtctccgcggccgtag

SEQ ID NO: 7808464 - DNA, 22 bp, Homo sapiens
gtgtgtgtgcatctcttttatt

SEQ ID NO: 7808465 - DNA, 22 bp, Homo sapiens
gtgtgtgtgcatataacatata

SEQ ID NO: 7808466 - DNA, 22 bp, Homo sapiens
gttcattttactgtaaatagca

SEQ ID NO: 7808467 - DNA, 22 bp, Homo sapiens
gttcattttactgtaaatagca

SEQ ID NO: 7808468 - DNA, 22 bp, Homo sapiens
gttcatttttactttgatctac

SEQ ID NO: 7808469 - DNA, 22 bp, Homo sapiens
gttcatttttactttgatctac

SEQ ID NO: 7808470 - DNA, 21 bp, Homo sapiens
taaataataagttgctgagat

SEQ ID NO: 7808471 - DNA, 22 bp, Homo sapiens
gcggggggaggaacatcttgca

SEQ ID NO: 7808472 - DNA, 16 bp, Homo sapiens
gcgcctcctcggcctc

SEQ ID NO: 7808473 - DNA, 22 bp, Homo sapiens
gcgggccaccttggagagcgct

SEQ ID NO: 7808474 - DNA, 22 bp, Homo sapiens
gcggggacagaaggcggttctc

SEQ ID NO: 7808475 - DNA, 22 bp, Homo sapiens
gctgatgagagagacaaatgct

SEQ ID NO: 7808476 - DNA, 20 bp, Homo sapiens
gcttcatttgcaagtctagt

SEQ ID NO: 7808477 - DNA, 22 bp, Homo sapiens
gctgggaggatctctccctgtc

SEQ ID NO: 7808478 - DNA, 22 bp, Homo sapiens
ggagagagatgccgccttgctc

SEQ ID NO: 7808479 - DNA, 22 bp, Homo sapiens
ggacctgaacataaaacgaggc

SEQ ID NO: 7808480 - DNA, 22 bp, Homo sapiens
ggaaatatcttgtactatgtga

SEQ ID NO: 7808481 - DNA, 22 bp, Homo sapiens
ggaaaggggcctggatcttttg

SEQ ID NO: 7808482 - DNA, 22 bp, Homo sapiens
ggaaagggcagaggccttggag

SEQ ID NO: 7808483 - DNA, 22 bp, Homo sapiens
ggaaagggcagaggccttggag

SEQ ID NO: 7808484 - DNA, 22 bp, Homo sapiens
ggaaagggagttttgcttatga

SEQ ID NO: 7808485 - DNA, 22 bp, Homo sapiens
gcataaatgttctttcagattt

SEQ ID NO: 7808486 - DNA, 18 bp, Homo sapiens
gcataatgtgtatattga

SEQ ID NO: 7808487 - DNA, 22 bp, Homo sapiens
gcatttcctgtgcttggcatat

SEQ ID NO: 7808488 - DNA, 22 bp, Homo sapiens
gcatttcatgtagattgagaac

SEQ ID NO: 7808489 - DNA, 18 bp, Homo sapiens
gcagtctctctggtcttc

SEQ ID NO: 7808490 - DNA, 22 bp, Homo sapiens
gccaggaatggagaggtggcct

SEQ ID NO: 7808491 - DNA, 22 bp, Homo sapiens
gcccagagttcaaggctgcagt

SEQ ID NO: 7808492 - DNA, 23 bp, Homo sapiens
gcccatggagtctggatctggcc

SEQ ID NO: 7808493 - DNA, 22 bp, Homo sapiens
gcaagagacttttatgtctgcc

SEQ ID NO: 7808494 - DNA, 22 bp, Homo sapiens
gcaaatgctaaagtgtagagac

SEQ ID NO: 7808495 - DNA, 22 bp, Homo sapiens
gcaaatgcactgcatttagatt

SEQ ID NO: 7808496 - DNA, 22 bp, Homo sapiens
gcacagccttgccctgtgccct

SEQ ID NO: 7808497 - DNA, 23 bp, Homo sapiens
gcactgggctctcagcaaggtgt

SEQ ID NO: 7808498 - DNA, 22 bp, Homo sapiens
gcagggctaggtcttctagggc

SEQ ID NO: 7808499 - DNA, 22 bp, Homo sapiens
gcaggctgagagtccaagaagg

SEQ ID NO: 7808500 - DNA, 22 bp, Homo sapiens
gcagctggatttcaagagggag

SEQ ID NO: 7808501 - DNA, 22 bp, Homo sapiens
gcagcagtactcaatatcctgg

SEQ ID NO: 7808502 - DNA, 20 bp, Homo sapiens
gcagcagtgcaagtcctctt

SEQ ID NO: 7808503 - DNA, 22 bp, Homo sapiens
gcagcagtggtctgtagaagga

SEQ ID NO: 7808504 - DNA, 22 bp, Homo sapiens
gtagctctgtttaaagttcttt

SEQ ID NO: 7808505 - DNA, 22 bp, Homo sapiens
gtaaatgagtcaaatgggggaa

SEQ ID NO: 7808506 - DNA, 22 bp, Homo sapiens
gtaaatgtgctaaaatgtgtcg

SEQ ID NO: 7808507 - DNA, 22 bp, Homo sapiens
ggtgggcagctcttggcaggca

SEQ ID NO: 7808508 - DNA, 19 bp, Homo sapiens
gtaatatgtgctgagtcct

SEQ ID NO: 7808509 - DNA, 22 bp, Homo sapiens
gtaatattcagctattgagttg

SEQ ID NO: 7808510 - DNA, 22 bp, Homo sapiens
gtaatattcagctattgagttg

SEQ ID NO: 7808511 - DNA, 22 bp, Homo sapiens
gtcctcaggcttgagtgtttat

SEQ ID NO: 7808512 - DNA, 22 bp, Homo sapiens
gtctcccatcgtttgtgaggaa

SEQ ID NO: 7808513 - DNA, 22 bp, Homo sapiens
gtgcaaattccactggaaagct

SEQ ID NO: 7808514 - DNA, 22 bp, Homo sapiens
gtgcccaggggccagctgccgg

SEQ ID NO: 7808515 - DNA, 22 bp, Homo sapiens
gtgctgggtgctgcagacaggt

SEQ ID NO: 7808516 - DNA, 22 bp, Homo sapiens
gtcttcattcaacaaatattca

SEQ ID NO: 7808517 - DNA, 22 bp, Homo sapiens
gggcctctcccttctcacgcat

SEQ ID NO: 7808518 - DNA, 22 bp, Homo sapiens
gggcctctgtgcagaggggcct

SEQ ID NO: 7808519 - DNA, 22 bp, Homo sapiens
gggggaagactgggctagtgat

SEQ ID NO: 7808520 - DNA, 21 bp, Homo sapiens
gggggaagaggagttgctagt

SEQ ID NO: 7808521 - DNA, 22 bp, Homo sapiens
ggtgcatggaaagagtaagtaa

SEQ ID NO: 7808522 - DNA, 22 bp, Homo sapiens
ggtgcatgtgagaaagactggg

SEQ ID NO: 7808523 - DNA, 22 bp, Homo sapiens
ggtcccaatctaatcacatgag

SEQ ID NO: 7808524 - DNA, 22 bp, Homo sapiens
ggtgcccacctgtcttcctgga

SEQ ID NO: 7808525 - DNA, 21 bp, Homo sapiens
ggtgggcacaggagagcagag

SEQ ID NO: 7808526 - DNA, 22 bp, Homo sapiens
ggtagcagggctgtgagtcaga

SEQ ID NO: 7808527 - DNA, 22 bp, Homo sapiens
ggcagtggtgggaggctcgctc

SEQ ID NO: 7808528 - DNA, 22 bp, Homo sapiens
ggagcagagcatttcacagcct

SEQ ID NO: 7808529 - DNA, 22 bp, Homo sapiens
ggagcagagctgggcttggctg

SEQ ID NO: 7808530 - DNA, 17 bp, Homo sapiens
ggagcagatccaccatt

SEQ ID NO: 7808531 - DNA, 22 bp, Homo sapiens
ggcagccatgcacgctgcctgg

SEQ ID NO: 7808532 - DNA, 22 bp, Homo sapiens
ggcagcaggagccatctggtag

SEQ ID NO: 7808533 - DNA, 22 bp, Homo sapiens
ggctgtgcctctggcagcacat

SEQ ID NO: 7808534 - DNA, 22 bp, Homo sapiens
ggctttgcattttgatggaggt

SEQ ID NO: 7808535 - DNA, 22 bp, Homo sapiens
ggctttgccctggactgaggca

SEQ ID NO: 7808536 - DNA, 23 bp, Homo sapiens
ggctttgctctgggttctagggt

SEQ ID NO: 7808537 - DNA, 22 bp, Homo sapiens
gggaagggagctgggtatttag

SEQ ID NO: 7808538 - DNA, 22 bp, Homo sapiens
cttaaattggatgagttaagtt

SEQ ID NO: 7808539 - DNA, 22 bp, Homo sapiens
cttaaattttcatctacaagaa

SEQ ID NO: 7808540 - DNA, 22 bp, Homo sapiens
cttaaattcttaatgccctcat

SEQ ID NO: 7808541 - DNA, 22 bp, Homo sapiens
cttagaaataatggtttcagtt

SEQ ID NO: 7808542 - DNA, 22 bp, Homo sapiens
ctgtgcttgtgttcattgttaa

SEQ ID NO: 7808543 - DNA, 22 bp, Homo sapiens
ctttctcttcagcacccagccc

SEQ ID NO: 7808544 - DNA, 22 bp, Homo sapiens
cttttcttgtattggatgcccc

SEQ ID NO: 7808545 - DNA, 21 bp, Homo sapiens
cttttctctccgcaggacatt

SEQ ID NO: 7808546 - DNA, 22 bp, Homo sapiens
ctggtgccctgtgtggcaggag

SEQ ID NO: 7808547 - DNA, 22 bp, Homo sapiens
ctgtaattttccagccaatatg

SEQ ID NO: 7808548 - DNA, 22 bp, Homo sapiens
ctggtgcaaaagtaattgtggt

SEQ ID NO: 7808549 - DNA, 22 bp, Homo sapiens
ctggtccttgctacccagcaag

SEQ ID NO: 7808550 - DNA, 22 bp, Homo sapiens
ctggggaccgagcaagctctgg

SEQ ID NO: 7808551 - DNA, 22 bp, Homo sapiens
ctggggaaggcggtgactgcgc

SEQ ID NO: 7808552 - DNA, 20 bp, Homo sapiens
ctggggacagcaatggctgt

SEQ ID NO: 7808553 - DNA, 22 bp, Homo sapiens
ctggggaacaatttgccacact

SEQ ID NO: 7808554 - DNA, 21 bp, Homo sapiens
ctgggctttctctcaaagaca

SEQ ID NO: 7808555 - DNA, 22 bp, Homo sapiens
ctgtatttgtcctctatttatt

SEQ ID NO: 7808556 - DNA, 22 bp, Homo sapiens
ctgtattttcatgcctacgtac

SEQ ID NO: 7808557 - DNA, 22 bp, Homo sapiens
ctgtgcttagccatcacattca

SEQ ID NO: 7808558 - DNA, 18 bp, Homo sapiens
gaaaggagagacagtagg

SEQ ID NO: 7808559 - DNA, 22 bp, Homo sapiens
gaaggccacaagagaagttaag

SEQ ID NO: 7808560 - DNA, 22 bp, Homo sapiens
gaagggggaaaatgacaacaga

SEQ ID NO: 7808561 - DNA, 22 bp, Homo sapiens
gaagggtgtgatttgcctgaga

SEQ ID NO: 7808562 - DNA, 22 bp, Homo sapiens
gaatatttgtaattactgttga

SEQ ID NO: 7808563 - DNA, 22 bp, Homo sapiens
gaatatttgtaattactgttga

SEQ ID NO: 7808564 - DNA, 22 bp, Homo sapiens
gaatattttcagtacagatggt

SEQ ID NO: 7808565 - DNA, 22 bp, Homo sapiens
gacagaggagaagatgctgtgg

SEQ ID NO: 7808566 - DNA, 22 bp, Homo sapiens
gacagcagacaaaccatgtttt

SEQ ID NO: 7808567 - DNA, 22 bp, Homo sapiens
gagaaagacgtaggctgggagg

SEQ ID NO: 7808568 - DNA, 22 bp, Homo sapiens
gagaaagatgaagagtggcgtt

SEQ ID NO: 7808569 - DNA, 22 bp, Homo sapiens
gagaaagatgtaggctgggagg

SEQ ID NO: 7808570 - DNA, 22 bp, Homo sapiens
gaggggctgccctggtgtcagg

SEQ ID NO: 7808571 - DNA, 22 bp, Homo sapiens
gagggctgtgaaggagcgggtt

SEQ ID NO: 7808572 - DNA, 22 bp, Homo sapiens
gagcagtggttgaacagaggca

SEQ ID NO: 7808573 - DNA, 22 bp, Homo sapiens
gagcagtggtcacagggaggga

SEQ ID NO: 7808574 - DNA, 22 bp, Homo sapiens
gagcagtgggaaggaacagggt

SEQ ID NO: 7808575 - DNA, 22 bp, Homo sapiens
gagcagtgatgggaggacgtca

SEQ ID NO: 7808576 - DNA, 22 bp, Homo sapiens
gagcagtgagtgaatgttgcct

SEQ ID NO: 7808577 - DNA, 20 bp, Homo sapiens
gagcagtgagccagggaaag

SEQ ID NO: 7808578 - DNA, 22 bp, Homo sapiens
gaggaagaagcaaaccagctaa

SEQ ID NO: 7808579 - DNA, 22 bp, Homo sapiens
ctctgctgctttgccagtggaa

SEQ ID NO: 7808580 - DNA, 22 bp, Homo sapiens
ctctgctgcttgccagtcattg

SEQ ID NO: 7808581 - DNA, 20 bp, Homo sapiens
ctctgctgcccgccggctgc

SEQ ID NO: 7808582 - DNA, 22 bp, Homo sapiens
ctctgctgcccaggcctgctag

SEQ ID NO: 7808583 - DNA, 22 bp, Homo sapiens
ctctgctggtgaccactgggcc

SEQ ID NO: 7808584 - DNA, 22 bp, Homo sapiens
ctctgctggtagctcattccat

SEQ ID NO: 7808585 - DNA, 22 bp, Homo sapiens
ctctgctgtctcagatgggcca

SEQ ID NO: 7808586 - DNA, 22 bp, Homo sapiens
ctctgctgttcttatgtgtcct

SEQ ID NO: 7808587 - DNA, 22 bp, Homo sapiens
ctcctcagctgggaggagtccc

SEQ ID NO: 7808588 - DNA, 22 bp, Homo sapiens
ctccctgcttgtttcccttcag

SEQ ID NO: 7808589 - DNA, 22 bp, Homo sapiens
ctgctctgaagccaggattctg

SEQ ID NO: 7808590 - DNA, 22 bp, Homo sapiens
ctgctccaggatttcaggccag

SEQ ID NO: 7808591 - DNA, 22 bp, Homo sapiens
ctgcagtctacctggattttta

SEQ ID NO: 7808592 - DNA, 22 bp, Homo sapiens
ctgcctctggcctcaggcccag

SEQ ID NO: 7808593 - DNA, 22 bp, Homo sapiens
ttttctctatattgtctgtgaa

SEQ ID NO: 7808594 - DNA, 22 bp, Homo sapiens
ttttctctacaaaataaccagc

SEQ ID NO: 7808595 - DNA, 22 bp, Homo sapiens
tttttctctaagtagtcccaaa

SEQ ID NO: 7808596 - DNA, 22 bp, Homo sapiens
ttttctctccaggtggggtgat

SEQ ID NO: 7808597 - DNA, 19 bp, Homo sapiens
tttttacaagtaggtgtga

SEQ ID NO: 7808598 - DNA, 22 bp, Homo sapiens
ttctcttttgtgatgtgagatg

SEQ ID NO: 7808599 - DNA, 22 bp, Homo sapiens
ctataaatctacccagcattgg

SEQ ID NO: 7808600 - DNA, 22 bp, Homo sapiens
ttcttcattcccttacttccga

SEQ ID NO: 7808601 - DNA, 22 bp, Homo sapiens
ttcttcatgggttcttttagga

SEQ ID NO: 7808602 - DNA, 21 bp, Homo sapiens
ttcttcatgatgattaatggc

SEQ ID NO: 7808603 - DNA, 22 bp, Homo sapiens
ttcttcatctgtaagataagca

SEQ ID NO: 7808604 - DNA, 22 bp, Homo sapiens
ttgcaaaaccatcctaagtaaa

SEQ ID NO: 7808605 - DNA, 22 bp, Homo sapiens
ttgcaaaagcaattgcagtttt

SEQ ID NO: 7808606 - DNA, 20 bp, Homo sapiens
ttctccaaaggagacactag

SEQ ID NO: 7808607 - DNA, 22 bp, Homo sapiens
ttctcatagagacatgattata

SEQ ID NO: 7808608 - DNA, 22 bp, Homo sapiens
ctaaattatcatgagaattatg

SEQ ID NO: 7808609 - DNA, 22 bp, Homo sapiens
cggctggtgtcgggcacagcaa

SEQ ID NO: 7808610 - DNA, 22 bp, Homo sapiens
cggctgggttcggctgcaggcc

SEQ ID NO: 7808611 - DNA, 22 bp, Homo sapiens
ttcctctgaaatggcttggaaa

SEQ ID NO: 7808612 - DNA, 22 bp, Homo sapiens
ttacaatgagacgttcttatct

SEQ ID NO: 7808613 - DNA, 22 bp, Homo sapiens
cgagcagaatggagggtgccga

SEQ ID NO: 7808614 - DNA, 22 bp, Homo sapiens
ttatgtatgaatatagtagaag

SEQ ID NO: 7808615 - DNA, 22 bp, Homo sapiens
ttatgtatggatggctgaaagt

SEQ ID NO: 7808616 - DNA, 22 bp, Homo sapiens
ttaaaatgcagattatgactca

SEQ ID NO: 7808617 - DNA, 22 bp, Homo sapiens
ttaaaatgcagattatgactca

SEQ ID NO: 7808618 - DNA, 22 bp, Homo sapiens
ttaaaatgaatattgattagca

SEQ ID NO: 7808619 - DNA, 22 bp, Homo sapiens
ttaatatgctgcttcttgaaaa

SEQ ID NO: 7808620 - DNA, 22 bp, Homo sapiens
tggcaggctgagttggcctggt

SEQ ID NO: 7808621 - DNA, 22 bp, Homo sapiens
ccctggcttaaaaacctcatat

SEQ ID NO: 7808622 - DNA, 22 bp, Homo sapiens
tggcagggaatacagatgttta

SEQ ID NO: 7808623 - DNA, 22 bp, Homo sapiens
tggcagaattttaaagacagat

SEQ ID NO: 7808624 - DNA, 22 bp, Homo sapiens
tggcagaatttctagcagattc

SEQ ID NO: 7808625 - DNA, 22 bp, Homo sapiens
tggagaattctatgttgagggg

SEQ ID NO: 7808626 - DNA, 22 bp, Homo sapiens
ccctcctcaactctggcttcca

SEQ ID NO: 7808627 - DNA, 22 bp, Homo sapiens
tggaggaatcagggcttaggct

SEQ ID NO: 7808628 - DNA, 22 bp, Homo sapiens
tggaggagaactccctggctac

SEQ ID NO: 7808629 - DNA, 22 bp, Homo sapiens
tgctcaggaaataatgtctgtg

SEQ ID NO: 7808630 - DNA, 22 bp, Homo sapiens
tgctgggggtagctctgcgtag

SEQ ID NO: 7808631 - DNA, 22 bp, Homo sapiens
ccctcccggcgtgctgggctcg

SEQ ID NO: 7808632 - DNA, 22 bp, Homo sapiens
tgggcaggagagaagctaaaga

SEQ ID NO: 7808633 - DNA, 22 bp, Homo sapiens
tggggagcacggtagggaaatg

SEQ ID NO: 7808634 - DNA, 17 bp, Homo sapiens
cctcccacaccgccctg

SEQ ID NO: 7808635 - DNA, 22 bp, Homo sapiens
tggcagtggtgtctgcacaggc

SEQ ID NO: 7808636 - DNA, 22 bp, Homo sapiens
tctgttcatttgcctcggctct

SEQ ID NO: 7808637 - DNA, 22 bp, Homo sapiens
tctgggccctgagatgttcttc

SEQ ID NO: 7808638 - DNA, 22 bp, Homo sapiens
tctgggcttttgcactggccat

SEQ ID NO: 7808639 - DNA, 22 bp, Homo sapiens
ccaggcagatgggccggcttca

SEQ ID NO: 7808640 - DNA, 22 bp, Homo sapiens
ccaggcaggcgatggtgcagtg

SEQ ID NO: 7808641 - DNA, 22 bp, Homo sapiens
tcttttctgccagctgagccct

SEQ ID NO: 7808642 - DNA, 22 bp, Homo sapiens
tcttgcatgatattctgtattt

SEQ ID NO: 7808643 - DNA, 22 bp, Homo sapiens
tgaggccagtctcatcacaggc

SEQ ID NO: 7808644 - DNA, 22 bp, Homo sapiens
tgaggccatgcccgtgccggcc

SEQ ID NO: 7808645 - DNA, 22 bp, Homo sapiens
tgaggccagggattccatcatt

SEQ ID NO: 7808646 - DNA, 22 bp, Homo sapiens
tgaggccaggcaaaggcgatct

SEQ ID NO: 7808647 - DNA, 22 bp, Homo sapiens
tgaggccatggtcttcccagtc

SEQ ID NO: 7808648 - DNA, 22 bp, Homo sapiens
tgaggccatggaactagcttgg

SEQ ID NO: 7808649 - DNA, 17 bp, Homo sapiens
tgaggccatggcaccat

SEQ ID NO: 7808650 - DNA, 22 bp, Homo sapiens
tgagtccaccttagtatatggg

SEQ ID NO: 7808651 - DNA, 22 bp, Homo sapiens
tgagtcctaaagctgtgccctt

SEQ ID NO: 7808652 - DNA, 22 bp, Homo sapiens
ccagtcagccaagctgcagcgg

SEQ ID NO: 7808653 - DNA, 22 bp, Homo sapiens
ccagtcagggcaggagcctggt

SEQ ID NO: 7808654 - DNA, 22 bp, Homo sapiens
ccagtcagagcagcgctcgcat

SEQ ID NO: 7808655 - DNA, 22 bp, Homo sapiens
ccagtcagtcagttgctggcat

SEQ ID NO: 7808656 - DNA, 22 bp, Homo sapiens
ccaggtggccctgccctactct

SEQ ID NO: 7808657 - DNA, 22 bp, Homo sapiens
ccagtctgaggcctggtgaggg

SEQ ID NO: 7808658 - DNA, 22 bp, Homo sapiens
tgatacacagatttacatcaat

SEQ ID NO: 7808659 - DNA, 22 bp, Homo sapiens
tgcaatatgttgcattgtatgg

SEQ ID NO: 7808660 - DNA, 22 bp, Homo sapiens
catgtgtatgcattcatacata

SEQ ID NO: 7808661 - DNA, 22 bp, Homo sapiens
catgtgtagtgaaataagcagt

SEQ ID NO: 7808662 - DNA, 20 bp, Homo sapiens
catggtggaggagcagggcc

SEQ ID NO: 7808663 - DNA, 22 bp, Homo sapiens
cagtgtataaactttaacatag

SEQ ID NO: 7808664 - DNA, 22 bp, Homo sapiens
tcataatacaaagagttctgca

SEQ ID NO: 7808665 - DNA, 22 bp, Homo sapiens
tcatacacattcttattacttt

SEQ ID NO: 7808666 - DNA, 20 bp, Homo sapiens
tcatacacatgagcatgcag

SEQ ID NO: 7808667 - DNA, 22 bp, Homo sapiens
tcatacacaagagcatgtaaca

SEQ ID NO: 7808668 - DNA, 22 bp, Homo sapiens
catcatatatttctacaagtgc

SEQ ID NO: 7808669 - DNA, 21 bp, Homo sapiens
ccaagagcaatgctaaggaga

SEQ ID NO: 7808670 - DNA, 20 bp, Homo sapiens
ccaagagcatgcatgaggaa

SEQ ID NO: 7808671 - DNA, 22 bp, Homo sapiens
ccaagagccatcctggtcaaca

SEQ ID NO: 7808672 - DNA, 22 bp, Homo sapiens
cattttcagcacccatctgaaa

SEQ ID NO: 7808673 - DNA, 22 bp, Homo sapiens
tcaaatgcttctactcctaaga

SEQ ID NO: 7808674 - DNA, 22 bp, Homo sapiens
tatattgtagctgatgacaaat

SEQ ID NO: 7808675 - DNA, 22 bp, Homo sapiens
tatgatgactctagataaagtc

SEQ ID NO: 7808676 - DNA, 22 bp, Homo sapiens
tatataatttgtaaaagcacct

SEQ ID NO: 7808677 - DNA, 22 bp, Homo sapiens
tatataatttgtaaaagcacct

SEQ ID NO: 7808678 - DNA, 22 bp, Homo sapiens
tatatacaaggtaggtttaggt

SEQ ID NO: 7808679 - DNA, 22 bp, Homo sapiens
tatatactatgcgattcctgcc

SEQ ID NO: 7808680 - DNA, 22 bp, Homo sapiens
cagggatgaccagagggatgtg

SEQ ID NO: 7808681 - DNA, 22 bp, Homo sapiens
cagggatgctgttaaacatcct

SEQ ID NO: 7808682 - DNA, 22 bp, Homo sapiens
cagggatgctgcttaggcagtt

SEQ ID NO: 7808683 - DNA, 22 bp, Homo sapiens
caggctgatagggtccaaagtt

SEQ ID NO: 7808684 - DNA, 22 bp, Homo sapiens
tttaaattatagttaatgtctg

SEQ ID NO: 7808685 - DNA, 22 bp, Homo sapiens
tttatcttctgcagttctggct

SEQ ID NO: 7808686 - DNA, 22 bp, Homo sapiens
tttagccaactatatgactagt

SEQ ID NO: 7808687 - DNA, 22 bp, Homo sapiens
tttaggaatgtggtttttgagc

SEQ ID NO: 7808688 - DNA, 22 bp, Homo sapiens
tttcaatcaccataaagcaact

SEQ ID NO: 7808689 - DNA, 22 bp, Homo sapiens
tttcacatttgttttaagaagt

SEQ ID NO: 7808690 - DNA, 22 bp, Homo sapiens
tttcacatcagaggtagattag

SEQ ID NO: 7808691 - DNA, 22 bp, Homo sapiens
tttcacatatggttgttgattg

SEQ ID NO: 7808692 - DNA, 22 bp, Homo sapiens
tttcacatgtgctgttgtcaat

SEQ ID NO: 7808693 - DNA, 22 bp, Homo sapiens
tttcacatcatgggatggaagc

SEQ ID NO: 7808694 - DNA, 22 bp, Homo sapiens
tttccagatgctaggttgaaag

SEQ ID NO: 7808695 - DNA, 22 bp, Homo sapiens
tttccatattctgcgtctgcca

SEQ ID NO: 7808696 - DNA, 22 bp, Homo sapiens
tttcgtttgcttatataataga

SEQ ID NO: 7808697 - DNA, 22 bp, Homo sapiens
ttgccaagtgttttaaaatatt

SEQ ID NO: 7808698 - DNA, 22 bp, Homo sapiens
ttgaggtcttgagtactgggga

SEQ ID NO: 7808699 - DNA, 22 bp, Homo sapiens
ttgtatgtttctgtgcacatga

SEQ ID NO: 7808700 - DNA, 22 bp, Homo sapiens
ttgtgctcctgtgagaatctag

SEQ ID NO: 7808701 - DNA, 22 bp, Homo sapiens
ttgtgctcctatgagaatctaa

SEQ ID NO: 7808702 - DNA, 22 bp, Homo sapiens
ttgtgctctgtgttatttaagg

SEQ ID NO: 7808703 - DNA, 22 bp, Homo sapiens
ttgggctcctgttgatcctgtc

SEQ ID NO: 7808704 - DNA, 23 bp, Homo sapiens
ttggggacaaacatgctactttc

SEQ ID NO: 7808705 - DNA, 22 bp, Homo sapiens
ttattttaccttcctctgagct

SEQ ID NO: 7808706 - DNA, 22 bp, Homo sapiens
ttatttatatctctgcagttta

SEQ ID NO: 7808707 - DNA, 22 bp, Homo sapiens
ttatacactgcagaaccagcat

SEQ ID NO: 7808708 - DNA, 22 bp, Homo sapiens
ttatacacgtttatggagctac

SEQ ID NO: 7808709 - DNA, 22 bp, Homo sapiens
ttatgtgtataattacaggaag

SEQ ID NO: 7808710 - DNA, 22 bp, Homo sapiens
ttatgtgtgtacatgcatatgt

SEQ ID NO: 7808711 - DNA, 20 bp, Homo sapiens
ttatgtgtacctgtgctccc

SEQ ID NO: 7808712 - DNA, 22 bp, Homo sapiens
ttatgcatatagcagatacgag

SEQ ID NO: 7808713 - DNA, 20 bp, Homo sapiens
ttctctttgggtccagagaa

SEQ ID NO: 7808714 - DNA, 22 bp, Homo sapiens
ttctgattgctgatgaggccca

SEQ ID NO: 7808715 - DNA, 22 bp, Homo sapiens
ttctccagctcatcagggaggg

SEQ ID NO: 7808716 - DNA, 22 bp, Homo sapiens
ttctccaggcttgggccaggtc

SEQ ID NO: 7808717 - DNA, 22 bp, Homo sapiens
ttctccagaggtggctagagtt

SEQ ID NO: 7808718 - DNA, 22 bp, Homo sapiens
ttcttcttaatgtcctgggaac

SEQ ID NO: 7808719 - DNA, 22 bp, Homo sapiens
ttgagagtggcttgttgactgc

SEQ ID NO: 7808720 - DNA, 22 bp, Homo sapiens
ttgagaaataagcatgtctaga

SEQ ID NO: 7808721 - DNA, 22 bp, Homo sapiens
tttgtctgccttgctggactgt

SEQ ID NO: 7808722 - DNA, 22 bp, Homo sapiens
tttgcttaaaagcggagcaaga

SEQ ID NO: 7808723 - DNA, 22 bp, Homo sapiens
tttgtcatttccctgattaaag

SEQ ID NO: 7808724 - DNA, 22 bp, Homo sapiens
tttgtcatcagttattaatatg

SEQ ID NO: 7808725 - DNA, 22 bp, Homo sapiens
tttgaaatatgaggcattatga

SEQ ID NO: 7808726 - DNA, 22 bp, Homo sapiens
tttgaaatgtatcagtataggt

SEQ ID NO: 7808727 - DNA, 22 bp, Homo sapiens
tttctattgatctaataaacat

SEQ ID NO: 7808728 - DNA, 22 bp, Homo sapiens
atgtctttgccatagttcatat

SEQ ID NO: 7808729 - DNA, 22 bp, Homo sapiens
atgtctttattaatatcatgcc

SEQ ID NO: 7808730 - DNA, 22 bp, Homo sapiens
atgtgtatgatacctttgctga

SEQ ID NO: 7808731 - DNA, 22 bp, Homo sapiens
atgtgtatgtcttattcaaaga

SEQ ID NO: 7808732 - DNA, 22 bp, Homo sapiens
atgtgtatgcatgcactaagat

SEQ ID NO: 7808733 - DNA, 22 bp, Homo sapiens
atgtgtattaccctttcattcc

SEQ ID NO: 7808734 - DNA, 22 bp, Homo sapiens
atgtgtatgtgtatacacacag

SEQ ID NO: 7808735 - DNA, 22 bp, Homo sapiens
atgtgtattacctcgattgtga

SEQ ID NO: 7808736 - DNA, 22 bp, Homo sapiens
atgtgtatttatttggggctta

SEQ ID NO: 7808737 - DNA, 22 bp, Homo sapiens
atgtgtattgagcacctactgc

SEQ ID NO: 7808738 - DNA, 22 bp, Homo sapiens
atgtgtatttccatcgatcagc

SEQ ID NO: 7808739 - DNA, 22 bp, Homo sapiens
atgtgtattagttagtttaatg

SEQ ID NO: 7808740 - DNA, 22 bp, Homo sapiens
atgtgtattttgtactattggg

SEQ ID NO: 7808741 - DNA, 22 bp, Homo sapiens
atgtgtgtatatatagtcattt

SEQ ID NO: 7808742 - DNA, 22 bp, Homo sapiens
atgtgtgtgcatttctctccct

SEQ ID NO: 7808743 - DNA, 22 bp, Homo sapiens
atgtgtgtgatgggcgccgcca

SEQ ID NO: 7808744 - DNA, 22 bp, Homo sapiens
atgtgtgtatgtgcctatatct

SEQ ID NO: 7808745 - DNA, 20 bp, Homo sapiens
atggaggaagggcaagagaa

SEQ ID NO: 7808746 - DNA, 22 bp, Homo sapiens
gagaaagggataatttgaagag

SEQ ID NO: 7808747 - DNA, 22 bp, Homo sapiens
gagaaatgcatgcatgtcatca

SEQ ID NO: 7808748 - DNA, 22 bp, Homo sapiens
cttggcagatccaaaaatgaca

SEQ ID NO: 7808749 - DNA, 22 bp, Homo sapiens
atctagattaggtataagagct

SEQ ID NO: 7808750 - DNA, 22 bp, Homo sapiens
cttgcctttgtcttcaaaggct

SEQ ID NO: 7808751 - DNA, 18 bp, Homo sapiens
cttgttcttctcttggcg

SEQ ID NO: 7808752 - DNA, 22 bp, Homo sapiens
atctttttgacatggtgatggt

SEQ ID NO: 7808753 - DNA, 22 bp, Homo sapiens
atgaaatgtctggatctttttc

SEQ ID NO: 7808754 - DNA, 22 bp, Homo sapiens
atgcatatgccgtagaataagt

SEQ ID NO: 7808755 - DNA, 22 bp, Homo sapiens
atgcaaataaacagtctagttg

SEQ ID NO: 7808756 - DNA, 22 bp, Homo sapiens
atgagtgttgctcattgcagaa

SEQ ID NO: 7808757 - DNA, 22 bp, Homo sapiens
gcgagtgccgagagggcagggc

SEQ ID NO: 7808758 - DNA, 22 bp, Homo sapiens
atttccttcggacagtttgggt

SEQ ID NO: 7808759 - DNA, 22 bp, Homo sapiens
atttccttcccagatttggttc

SEQ ID NO: 7808760 - DNA, 22 bp, Homo sapiens
atttattggatgcttacttggg

SEQ ID NO: 7808761 - DNA, 20 bp, Homo sapiens
attagagctacatggctaca

SEQ ID NO: 7808762 - DNA, 22 bp, Homo sapiens
attaatatacactgttagcatg

SEQ ID NO: 7808763 - DNA, 22 bp, Homo sapiens
attaatatgagaaagtggcaga

SEQ ID NO: 7808764 - DNA, 22 bp, Homo sapiens
attaaattagcaaactgtgaaa

SEQ ID NO: 7808765 - DNA, 22 bp, Homo sapiens
attaaattaagtggctaattta

SEQ ID NO: 7808766 - DNA, 22 bp, Homo sapiens
attaaatgttggacgtatacat

SEQ ID NO: 7808767 - DNA, 22 bp, Homo sapiens
attaaatgttggacgtatacat

SEQ ID NO: 7808768 - DNA, 22 bp, Homo sapiens
attaaatgttggcatattttgt

SEQ ID NO: 7808769 - DNA, 22 bp, Homo sapiens
attaaatgatggcatgtcttat

SEQ ID NO: 7808770 - DNA, 22 bp, Homo sapiens
attaaatgatggcatgtcttat

SEQ ID NO: 7808771 - DNA, 22 bp, Homo sapiens
attaaatggtggtcattcattt

SEQ ID NO: 7808772 - DNA, 22 bp, Homo sapiens
attaaatgttccttaaattata

SEQ ID NO: 7808773 - DNA, 22 bp, Homo sapiens
atgtgtgtgtttaatcctcaaa

SEQ ID NO: 7808774 - DNA, 22 bp, Homo sapiens
atgtgtgtgtatatacacacat

SEQ ID NO: 7808775 - DNA, 22 bp, Homo sapiens
atgtgtgtgtgcgcgcgcagga

SEQ ID NO: 7808776 - DNA, 22 bp, Homo sapiens
atgtgtttataattactcaatc

SEQ ID NO: 7808777 - DNA, 22 bp, Homo sapiens
atgtgtttggttatatggtatt

SEQ ID NO: 7808778 - DNA, 22 bp, Homo sapiens
atgtgtttgtcctgcagaaata

SEQ ID NO: 7808779 - DNA, 22 bp, Homo sapiens
atgtgtttgtacctttaaatat

SEQ ID NO: 7808780 - DNA, 22 bp, Homo sapiens
atgtgttttggtaatttctgct

SEQ ID NO: 7808781 - DNA, 22 bp, Homo sapiens
atgtgttttggtggatcattca

SEQ ID NO: 7808782 - DNA, 22 bp, Homo sapiens
atgtgtttttattctggcatgt

SEQ ID NO: 7808783 - DNA, 22 bp, Homo sapiens
attctatagacagaaggtcaat

SEQ ID NO: 7808784 - DNA, 22 bp, Homo sapiens
attcttcactgtttcagaatga

SEQ ID NO: 7808785 - DNA, 22 bp, Homo sapiens
attcttcactgtttcagaatga

SEQ ID NO: 7808786 - DNA, 22 bp, Homo sapiens
attcttcaccatggataatttg

SEQ ID NO: 7808787 - DNA, 22 bp, Homo sapiens
attcttcaccatggataatttg

SEQ ID NO: 7808788 - DNA, 22 bp, Homo sapiens
attcttcacaaatatatagaag

SEQ ID NO: 7808789 - DNA, 22 bp, Homo sapiens
attcttcacaaatatatagaag

SEQ ID NO: 7808790 - DNA, 22 bp, Homo sapiens
attcttcaaagagtgtcaaagt

SEQ ID NO: 7808791 - DNA, 22 bp, Homo sapiens
attcttcagatcagcagggcct

SEQ ID NO: 7808792 - DNA, 22 bp, Homo sapiens
gggaggtgaaaggtcatgtgtg

SEQ ID NO: 7808793 - DNA, 19 bp, Homo sapiens
gggagcaggaaagctgtgg

SEQ ID NO: 7808794 - DNA, 22 bp, Homo sapiens
cagaggtgttggtgaatggaga

SEQ ID NO: 7808795 - DNA, 22 bp, Homo sapiens
cagcagagctgtgtgggaaggg

SEQ ID NO: 7808796 - DNA, 22 bp, Homo sapiens
gtatgcatgcatgtgtatgtac

SEQ ID NO: 7808797 - DNA, 22 bp, Homo sapiens
gtatgcatttggcatattgtcc

SEQ ID NO: 7808798 - DNA, 22 bp, Homo sapiens
gtatgcataattgtgtattcat

SEQ ID NO: 7808799 - DNA, 22 bp, Homo sapiens
gtatttctagaaaatgcagatt

SEQ ID NO: 7808800 - DNA, 22 bp, Homo sapiens
cacagggaggcagccatgctcc

SEQ ID NO: 7808801 - DNA, 22 bp, Homo sapiens
cacagcttcagtttctgacttg

SEQ ID NO: 7808802 - DNA, 22 bp, Homo sapiens
cacagcttctccccgctgcggc

SEQ ID NO: 7808803 - DNA, 22 bp, Homo sapiens
ggcagcagttacaaatgtgcag

SEQ ID NO: 7808804 - DNA, 22 bp, Homo sapiens
cacagtgtagactaataataga

SEQ ID NO: 7808805 - DNA, 22 bp, Homo sapiens
cacagtgtagttaatgtgacat

SEQ ID NO: 7808806 - DNA, 22 bp, Homo sapiens
gctgctggagagcgagactgtt

SEQ ID NO: 7808807 - DNA, 22 bp, Homo sapiens
gctgctggcactggagtgagcc

SEQ ID NO: 7808808 - DNA, 22 bp, Homo sapiens
caagagctcaccggagagcatt

SEQ ID NO: 7808809 - DNA, 22 bp, Homo sapiens
caagatggagaagcagcaaggg

SEQ ID NO: 7808810 - DNA, 22 bp, Homo sapiens
caagaggctaaactgggctatt

SEQ ID NO: 7808811 - DNA, 22 bp, Homo sapiens
gctgcagtgagccaagatcgtg

SEQ ID NO: 7808812 - DNA, 22 bp, Homo sapiens
caacatataatatttgagttct

SEQ ID NO: 7808813 - DNA, 22 bp, Homo sapiens
caacatatataaggatttacta

SEQ ID NO: 7808814 - DNA, 22 bp, Homo sapiens
caaagtaattacggttttggcc

SEQ ID NO: 7808815 - DNA, 22 bp, Homo sapiens
caaagtatattggattgaatgg

SEQ ID NO: 7808816 - DNA, 22 bp, Homo sapiens
gctgtgcttttggtagatccca

SEQ ID NO: 7808817 - DNA, 22 bp, Homo sapiens
gctgtgctgattcattccctgc

SEQ ID NO: 7808818 - DNA, 22 bp, Homo sapiens
gctgtggagtacagagctggtt

SEQ ID NO: 7808819 - DNA, 22 bp, Homo sapiens
caaggcagctattgtctccata

SEQ ID NO: 7808820 - DNA, 22 bp, Homo sapiens
gcttctcctcccgctcccaggc

SEQ ID NO: 7808821 - DNA, 15 bp, Homo sapiens
gcttctccagatgac

SEQ ID NO: 7808822 - DNA, 22 bp, Homo sapiens
gcttctccctacagatgtcagt

SEQ ID NO: 7808823 - DNA, 22 bp, Homo sapiens
ctcagagtccccacatctgggt

SEQ ID NO: 7808824 - DNA, 22 bp, Homo sapiens
ctcagagttctcctgggaggtg

SEQ ID NO: 7808825 - DNA, 22 bp, Homo sapiens
agtatcatgttggaattaatca

SEQ ID NO: 7808826 - DNA, 21 bp, Homo sapiens
agtatcataatgaatagttct

SEQ ID NO: 7808827 - DNA, 22 bp, Homo sapiens
agtggctgtttataggtgggta

SEQ ID NO: 7808828 - DNA, 22 bp, Homo sapiens
agtggtgccgggtgggttttgc

SEQ ID NO: 7808829 - DNA, 22 bp, Homo sapiens
cctgctctgccaagtcctcttt

SEQ ID NO: 7808830 - DNA, 22 bp, Homo sapiens
cctgccctaatccagagactag

SEQ ID NO: 7808831 - DNA, 22 bp, Homo sapiens
cctctgccacctcccacgaggc

SEQ ID NO: 7808832 - DNA, 22 bp, Homo sapiens
aggtgcctgtcgtctctggtta

SEQ ID NO: 7808833 - DNA, 22 bp, Homo sapiens
aggtgctggcgccccaggagac

SEQ ID NO: 7808834 - DNA, 22 bp, Homo sapiens
aggtgctgtttgtcagcagttt

SEQ ID NO: 7808835 - DNA, 19 bp, Homo sapiens
cggcccctcctctcgcgcc

SEQ ID NO: 7808836 - DNA, 22 bp, Homo sapiens
aggtggggtgagctgcagacta

SEQ ID NO: 7808837 - DNA, 22 bp, Homo sapiens
atatttgtcaattcactgttca

SEQ ID NO: 7808838 - DNA, 22 bp, Homo sapiens
ctgtctttggtcctgtctgtta

SEQ ID NO: 7808839 - DNA, 22 bp, Homo sapiens
atatatactttgacacattctg

SEQ ID NO: 7808840 - DNA, 22 bp, Homo sapiens
atatatatcgagttcatgtctc

SEQ ID NO: 7808841 - DNA, 19 bp, Homo sapiens
ctgggaggtgttcagagaa

SEQ ID NO: 7808842 - DNA, 22 bp, Homo sapiens
atatatatgctgatggctgcca

SEQ ID NO: 7808843 - DNA, 22 bp, Homo sapiens
atatatacaactagattaaaag

SEQ ID NO: 7808844 - DNA, 22 bp, Homo sapiens
atatgtggcattatttctgagg

SEQ ID NO: 7808845 - DNA, 22 bp, Homo sapiens
atatgtgtaaatgcatttgttt

SEQ ID NO: 7808846 - DNA, 22 bp, Homo sapiens
atatgtcataattgtgtctgta

SEQ ID NO: 7808847 - DNA, 20 bp, Homo sapiens
atatgtgtacgtgtatacat

SEQ ID NO: 7808848 - DNA, 22 bp, Homo sapiens
atatgtgtatggatttctatct

SEQ ID NO: 7808849 - DNA, 22 bp, Homo sapiens
atatgtgtcgtgctactgccca

SEQ ID NO: 7808850 - DNA, 22 bp, Homo sapiens
atatgtgtgcacatatgtattt

SEQ ID NO: 7808851 - DNA, 22 bp, Homo sapiens
atatgtattttaacgtgtaagg

SEQ ID NO: 7808852 - DNA, 22 bp, Homo sapiens
atatgtatgtacgcacatattc

SEQ ID NO: 7808853 - DNA, 22 bp, Homo sapiens
atatgtatgtacgcacatattc

SEQ ID NO: 7808854 - DNA, 22 bp, Homo sapiens
atatttgcaggaaactagtttt

SEQ ID NO: 7808855 - DNA, 22 bp, Homo sapiens
atatttgtagtgggtaagaagt

SEQ ID NO: 7808856 - DNA, 22 bp, Homo sapiens
atatgttgagcaagcatgatta

SEQ ID NO: 7808857 - DNA, 22 bp, Homo sapiens
atatgatgtgctatgtcactag

SEQ ID NO: 7808858 - DNA, 22 bp, Homo sapiens
atatgacagaatgtgtgtgtat

SEQ ID NO: 7808859 - DNA, 22 bp, Homo sapiens
atatgacagcggattcacatat

SEQ ID NO: 7808860 - DNA, 22 bp, Homo sapiens
atatatattgcccaggctggtt

SEQ ID NO: 7808861 - DNA, 22 bp, Homo sapiens
atatatgcatgtgtacttatgt

SEQ ID NO: 7808862 - DNA, 22 bp, Homo sapiens
ctgctctggtctcttcatgttt

SEQ ID NO: 7808863 - DNA, 22 bp, Homo sapiens
ctgctctggctgtgtacttcag

SEQ ID NO: 7808864 - DNA, 22 bp, Homo sapiens
ctgctctggcgtactcggcatc

SEQ ID NO: 7808865 - DNA, 22 bp, Homo sapiens
ctgctctgctgatcagtgtctc

SEQ ID NO: 7808866 - DNA, 22 bp, Homo sapiens
ctgcccagaagccagatgggca

SEQ ID NO: 7808867 - DNA, 22 bp, Homo sapiens
ataatatttgcattactgtgat

SEQ ID NO: 7808868 - DNA, 22 bp, Homo sapiens
ataatatttgcattactgtgat

SEQ ID NO: 7808869 - DNA, 22 bp, Homo sapiens
ataatattgagtcaggacctga

SEQ ID NO: 7808870 - DNA, 22 bp, Homo sapiens
ataatattgagtcaggacctga

SEQ ID NO: 7808871 - DNA, 22 bp, Homo sapiens
ataatagcattaggtttatgca

SEQ ID NO: 7808872 - DNA, 22 bp, Homo sapiens
ataatatttggataggacagta

SEQ ID NO: 7808873 - DNA, 22 bp, Homo sapiens
atacttatgataaataattgct

SEQ ID NO: 7808874 - DNA, 22 bp, Homo sapiens
atactttctgaccaattaattg

SEQ ID NO: 7808875 - DNA, 22 bp, Homo sapiens
atacagatgcttgctcgtgact

SEQ ID NO: 7808876 - DNA, 22 bp, Homo sapiens
ataaaagtctgcttatttgggc

SEQ ID NO: 7808877 - DNA, 22 bp, Homo sapiens
ataaaagttcaagagagtacag

SEQ ID NO: 7808878 - DNA, 21 bp, Homo sapiens
agctgcagccatgtacatggc

SEQ ID NO: 7808879 - DNA, 17 bp, Homo sapiens
agcttgtttttgaaagc

SEQ ID NO: 7808880 - DNA, 22 bp, Homo sapiens
aggacagcccttgagagcacat

SEQ ID NO: 7808881 - DNA, 21 bp, Homo sapiens
aggacaggaactggctgaata

SEQ ID NO: 7808882 - DNA, 22 bp, Homo sapiens
aggacagcagttggtgaggttc

SEQ ID NO: 7808883 - DNA, 22 bp, Homo sapiens
aggacagcatatgggaaccagt

SEQ ID NO: 7808884 - DNA, 22 bp, Homo sapiens
aggacagcagccattggcagtc

SEQ ID NO: 7808885 - DNA, 19 bp, Homo sapiens
aggaaggaacctgagtctg

SEQ ID NO: 7808886 - DNA, 22 bp, Homo sapiens
cattcaaacattaatttattca

SEQ ID NO: 7808887 - DNA, 19 bp, Homo sapiens
aggcagcacccagtccttg

SEQ ID NO: 7808888 - DNA, 19 bp, Homo sapiens
aggcagaggcttggctagc

SEQ ID NO: 7808889 - DNA, 22 bp, Homo sapiens
catggccttgagtgactgcact

SEQ ID NO: 7808890 - DNA, 22 bp, Homo sapiens
catggcctcaaaggactgcaga

SEQ ID NO: 7808891 - DNA, 22 bp, Homo sapiens
catggcctctctcctggaatgg

SEQ ID NO: 7808892 - DNA, 22 bp, Homo sapiens
aggcagcagtcatgaggaaaga

SEQ ID NO: 7808893 - DNA, 19 bp, Homo sapiens
aggcagcattctggggctt

SEQ ID NO: 7808894 - DNA, 22 bp, Homo sapiens
aggcagcagcttgctggttgcc

SEQ ID NO: 7808895 - DNA, 22 bp, Homo sapiens
aggcagcagaggttgaggaaag

SEQ ID NO: 7808896 - DNA, 18 bp, Homo sapiens
aggcagcagcatcttctc

SEQ ID NO: 7808897 - DNA, 22 bp, Homo sapiens
aggcattttgttcaagatgaca

SEQ ID NO: 7808898 - DNA, 22 bp, Homo sapiens
aggcatttaaagatgtaagact

SEQ ID NO: 7808899 - DNA, 22 bp, Homo sapiens
ccactgctcggcctcaaagaag

SEQ ID NO: 7808900 - DNA, 22 bp, Homo sapiens
aggcagtgagaaatagcaagat

SEQ ID NO: 7808901 - DNA, 22 bp, Homo sapiens
aggcctctctccttggcttgta

SEQ ID NO: 7808902 - DNA, 21 bp, Homo sapiens
ccagtctgtaaaatggggaca

SEQ ID NO: 7808903 - DNA, 22 bp, Homo sapiens
ccagtctggcaggagggggaac

SEQ ID NO: 7808904 - DNA, 22 bp, Homo sapiens
ccagttagttaaaggcgcagta

SEQ ID NO: 7808905 - DNA, 22 bp, Homo sapiens
agggaggaaggatgttccaaag

SEQ ID NO: 7808906 - DNA, 22 bp, Homo sapiens
agggaggagaatggactccttc

SEQ ID NO: 7808907 - DNA, 22 bp, Homo sapiens
agggcagcagctcctcctagct

SEQ ID NO: 7808908 - DNA, 22 bp, Homo sapiens
agggcagcctgagtgctggccc

SEQ ID NO: 7808909 - DNA, 22 bp, Homo sapiens
agggcagcccttctgggagggc

SEQ ID NO: 7808910 - DNA, 22 bp, Homo sapiens
ccccatcctattcatgtttctg

SEQ ID NO: 7808911 - DNA, 22 bp, Homo sapiens
agccttgggcaatttggacact

SEQ ID NO: 7808912 - DNA, 17 bp, Homo sapiens
cagaaggaagcatggca

SEQ ID NO: 7808913 - DNA, 18 bp, Homo sapiens
agccaggtggaatggaac

SEQ ID NO: 7808914 - DNA, 22 bp, Homo sapiens
agcccaggaggtggaggttgca

SEQ ID NO: 7808915 - DNA, 22 bp, Homo sapiens
agcccaggagtttgaggctgtg

SEQ ID NO: 7808916 - DNA, 21 bp, Homo sapiens
agcaggtgctgttggaggaaa

SEQ ID NO: 7808917 - DNA, 22 bp, Homo sapiens
agcaggtgatgtgagtctggaa

SEQ ID NO: 7808918 - DNA, 18 bp, Homo sapiens
agcagctgtcagaatgcc

SEQ ID NO: 7808919 - DNA, 18 bp, Homo sapiens
agcagctgtgccacactg

SEQ ID NO: 7808920 - DNA, 22 bp, Homo sapiens
agcagctgttagaaacaggaag

SEQ ID NO: 7808921 - DNA, 22 bp, Homo sapiens
agcagctgtggggacaagggta

SEQ ID NO: 7808922 - DNA, 23 bp, Homo sapiens
agcagctgtggtttaccttagta

SEQ ID NO: 7808923 - DNA, 22 bp, Homo sapiens
attttctcacaatgcagaagga

SEQ ID NO: 7808924 - DNA, 22 bp, Homo sapiens
caaatgatagagccgattatca

SEQ ID NO: 7808925 - DNA, 22 bp, Homo sapiens
caaatgatactgtttttagtct

SEQ ID NO: 7808926 - DNA, 22 bp, Homo sapiens
agcacagcctctggtttctgac

SEQ ID NO: 7808927 - DNA, 22 bp, Homo sapiens
caaatgcaggtcagcaggtgtc

SEQ ID NO: 7808928 - DNA, 22 bp, Homo sapiens
caaatgcaaaatataaccctgt

SEQ ID NO: 7808929 - DNA, 22 bp, Homo sapiens
caaatgatgcatggctagtgag

SEQ ID NO: 7808930 - DNA, 22 bp, Homo sapiens
caaatgcagattcaggagttct

SEQ ID NO: 7808931 - DNA, 22 bp, Homo sapiens
caaatgcatagaaagatgaaac

SEQ ID NO: 7808932 - DNA, 22 bp, Homo sapiens
caaatgcaggtcataacctgag

SEQ ID NO: 7808933 - DNA, 22 bp, Homo sapiens
caaatgcagtccctttgttgct

SEQ ID NO: 7808934 - DNA, 22 bp, Homo sapiens
agcagaagaaagccacatgact

SEQ ID NO: 7808935 - DNA, 22 bp, Homo sapiens
caaggcagtccctactccctgc

SEQ ID NO: 7808936 - DNA, 22 bp, Homo sapiens
agcagcagaaagttgatggcag

SEQ ID NO: 7808937 - DNA, 22 bp, Homo sapiens
caactgggataaagagctaaag

SEQ ID NO: 7808938 - DNA, 22 bp, Homo sapiens
atggctggtctcccatggaaaa

SEQ ID NO: 7808939 - DNA, 21 bp, Homo sapiens
atggctggtggctcagcctcc

SEQ ID NO: 7808940 - DNA, 22 bp, Homo sapiens
atgggaggaagagaagatgtct

SEQ ID NO: 7808941 - DNA, 22 bp, Homo sapiens
atgggaggcagacactaagttc

SEQ ID NO: 7808942 - DNA, 22 bp, Homo sapiens
atgggaggcaaagatcgcagaa

SEQ ID NO: 7808943 - DNA, 22 bp, Homo sapiens
atgtctgtttatccttcaagat

SEQ ID NO: 7808944 - DNA, 22 bp, Homo sapiens
atgtctgtgtgatcttggataa

SEQ ID NO: 7808945 - DNA, 22 bp, Homo sapiens
atgtctgtggcattatatgttt

SEQ ID NO: 7808946 - DNA, 22 bp, Homo sapiens
atgtctgtggcattatatgttt

SEQ ID NO: 7808947 - DNA, 22 bp, Homo sapiens
atgtacatactgcattttcaaa

SEQ ID NO: 7808948 - DNA, 22 bp, Homo sapiens
atgtgtatgagtgtgcttcttt

SEQ ID NO: 7808949 - DNA, 22 bp, Homo sapiens
atgtgtatctaaggtgttctat

SEQ ID NO: 7808950 - DNA, 22 bp, Homo sapiens
atgtgtatccatctgtctattt

SEQ ID NO: 7808951 - DNA, 22 bp, Homo sapiens
atgtgtgtaaacaagtataatt

SEQ ID NO: 7808952 - DNA, 22 bp, Homo sapiens
atgtgtgtacacacgtgactct

SEQ ID NO: 7808953 - DNA, 22 bp, Homo sapiens
attctctgtttccaagatgaaa

SEQ ID NO: 7808954 - DNA, 22 bp, Homo sapiens
agatgaaaatacgtgactttaa

SEQ ID NO: 7808955 - DNA, 22 bp, Homo sapiens
agagtgggacacgggcgctgtc

SEQ ID NO: 7808956 - DNA, 22 bp, Homo sapiens
agagtggcttgctcagctagca

SEQ ID NO: 7808957 - DNA, 23 bp, Homo sapiens
attcttcattatcttctagaaaa

SEQ ID NO: 7808958 - DNA, 22 bp, Homo sapiens
attcttcatggctgtgagtcct

SEQ ID NO: 7808959 - DNA, 22 bp, Homo sapiens
attcttcatttactgttacttg

SEQ ID NO: 7808960 - DNA, 22 bp, Homo sapiens
attcttcatacctactgaggtt

SEQ ID NO: 7808961 - DNA, 22 bp, Homo sapiens
agagggtggtgaggcctggttc

SEQ ID NO: 7808962 - DNA, 23 bp, Homo sapiens
agagtggcctactcacactcatt

SEQ ID NO: 7808963 - DNA, 22 bp, Homo sapiens
aggcaggctggtctgaagagtg

SEQ ID NO: 7808964 - DNA, 22 bp, Homo sapiens
agggcctggtgacctgggtcct

SEQ ID NO: 7808965 - DNA, 22 bp, Homo sapiens
aggcagcattcaggggtgatga

SEQ ID NO: 7808966 - DNA, 22 bp, Homo sapiens
aggcagcaattgaaatcattgt

SEQ ID NO: 7808967 - DNA, 22 bp, Homo sapiens
aggcagcagtgataagatagga

SEQ ID NO: 7808968 - DNA, 22 bp, Homo sapiens
aggcagcatccagaggagaatg

SEQ ID NO: 7808969 - DNA, 22 bp, Homo sapiens
acagggcaacctctgggagact

SEQ ID NO: 7808970 - DNA, 22 bp, Homo sapiens
acagggattttccaggctaccc

SEQ ID NO: 7808971 - DNA, 22 bp, Homo sapiens
acagggattatgactgacagcc

SEQ ID NO: 7808972 - DNA, 18 bp, Homo sapiens
acagggagggcgctgggg

SEQ ID NO: 7808973 - DNA, 22 bp, Homo sapiens
aggaagggctgtttctccaaga

SEQ ID NO: 7808974 - DNA, 23 bp, Homo sapiens
acagcttcctactttgctgctgc

SEQ ID NO: 7808975 - DNA, 22 bp, Homo sapiens
acgtgtgtatgagtgtacatat

SEQ ID NO: 7808976 - DNA, 22 bp, Homo sapiens
acctgtgttttccctcagtttc

SEQ ID NO: 7808977 - DNA, 20 bp, Homo sapiens
agggtggggacgttctgact

SEQ ID NO: 7808978 - DNA, 22 bp, Homo sapiens
agtctgggagggatgccagtgt

SEQ ID NO: 7808979 - DNA, 22 bp, Homo sapiens
actgtgtattcctatatagtaa

SEQ ID NO: 7808980 - DNA, 22 bp, Homo sapiens
actgtgtatgatatgtactggg

SEQ ID NO: 7808981 - DNA, 22 bp, Homo sapiens
agtttacagatgctacaggagc

SEQ ID NO: 7808982 - DNA, 22 bp, Homo sapiens
actgttaacggtatgatgctcg

SEQ ID NO: 7808983 - DNA, 22 bp, Homo sapiens
actgtgtttctgaaacaagagg

SEQ ID NO: 7808984 - DNA, 22 bp, Homo sapiens
actgtgtttggcaatagggcct

SEQ ID NO: 7808985 - DNA, 22 bp, Homo sapiens
actgtgttttcctgctgaggca

SEQ ID NO: 7808986 - DNA, 22 bp, Homo sapiens
actgtgttcaattaaaaagctt

SEQ ID NO: 7808987 - DNA, 22 bp, Homo sapiens
actgtgttaaatacagagatgg

SEQ ID NO: 7808988 - DNA, 22 bp, Homo sapiens
actgtgttgtctcaacctgacc

SEQ ID NO: 7808989 - DNA, 22 bp, Homo sapiens
actgtgtttcacctgagtatgg

SEQ ID NO: 7808990 - DNA, 22 bp, Homo sapiens
actgtgttcacacttacaaatg

SEQ ID NO: 7808991 - DNA, 22 bp, Homo sapiens
actgtgttcctctttggtatcc

SEQ ID NO: 7808992 - DNA, 22 bp, Homo sapiens
actgtgttgccttcccccagcc

SEQ ID NO: 7808993 - DNA, 22 bp, Homo sapiens
actgtgtgaaacatcaatgtgt

SEQ ID NO: 7808994 - DNA, 22 bp, Homo sapiens
actgtgtattctaatgactaaa

SEQ ID NO: 7808995 - DNA, 22 bp, Homo sapiens
actgtgtggaaatttgtgaggg

SEQ ID NO: 7808996 - DNA, 19 bp, Homo sapiens
actgtgtggaagtgtgatt

SEQ ID NO: 7808997 - DNA, 22 bp, Homo sapiens
acttcacaaagagatcatctaa

SEQ ID NO: 7808998 - DNA, 22 bp, Homo sapiens
acttcacacagcaaatttatct

SEQ ID NO: 7808999 - DNA, 22 bp, Homo sapiens
acttcattgtaatattatagca

SEQ ID NO: 7809000 - DNA, 22 bp, Homo sapiens
atagtttaaggaactatgcgat

SEQ ID NO: 7809001 - DNA, 22 bp, Homo sapiens
atagtttacaaaaatgatgcat

SEQ ID NO: 7809002 - DNA, 22 bp, Homo sapiens
atataattgttctgaagtgttt

SEQ ID NO: 7809003 - DNA, 22 bp, Homo sapiens
atatacacatctttttaaatat

SEQ ID NO: 7809004 - DNA, 22 bp, Homo sapiens
atatacacagagcttatggtga

SEQ ID NO: 7809005 - DNA, 22 bp, Homo sapiens
atatacacatgtgtatacattt

SEQ ID NO: 7809006 - DNA, 22 bp, Homo sapiens
agaaaataaattgatggtggaa

SEQ ID NO: 7809007 - DNA, 22 bp, Homo sapiens
aaaagtaattgcaattttgtag

SEQ ID NO: 7809008 - DNA, 22 bp, Homo sapiens
aaagagctgagacctggtggag

SEQ ID NO: 7809009 - DNA, 22 bp, Homo sapiens
aaagagctgatagcatctgttt

SEQ ID NO: 7809010 - DNA, 22 bp, Homo sapiens
aaagagctcggaaagtgttgaa

SEQ ID NO: 7809011 - DNA, 22 bp, Homo sapiens
aaagagctaacattgccgagat

SEQ ID NO: 7809012 - DNA, 17 bp, Homo sapiens
aaagagcttggagtgtt

SEQ ID NO: 7809013 - DNA, 22 bp, Homo sapiens
aaactgtaaatactagtaagtg

SEQ ID NO: 7809014 - DNA, 22 bp, Homo sapiens
aaagacttgggtgaagtaattt

SEQ ID NO: 7809015 - DNA, 22 bp, Homo sapiens
aaagaaatagatggcatttaaa

SEQ ID NO: 7809016 - DNA, 21 bp, Homo sapiens
aaagaaatctcccattggtag

SEQ ID NO: 7809017 - DNA, 22 bp, Homo sapiens
aaatgcatgtagaataatagag

SEQ ID NO: 7809018 - DNA, 22 bp, Homo sapiens
aaatgcatggtaaatgattgcc

SEQ ID NO: 7809019 - DNA, 22 bp, Homo sapiens
aaatgcatggtaaatgattgcc

SEQ ID NO: 7809020 - DNA, 22 bp, Homo sapiens
aagcagcatagctcccttagtt

SEQ ID NO: 7809021 - DNA, 22 bp, Homo sapiens
aagactgatgtccagtcccatg

SEQ ID NO: 7809022 - DNA, 22 bp, Homo sapiens
aagactgaatttgcatagttgg

SEQ ID NO: 7809023 - DNA, 22 bp, Homo sapiens
aacatataaactcttaagttca

SEQ ID NO: 7809024 - DNA, 22 bp, Homo sapiens
aacatataaactcttaagttca

SEQ ID NO: 7809025 - DNA, 22 bp, Homo sapiens
aacatacttgtactatgcatat

SEQ ID NO: 7809026 - DNA, 22 bp, Homo sapiens
aacatacagtgagcagtggact

SEQ ID NO: 7809027 - DNA, 22 bp, Homo sapiens
aacatacatatttcagtgtcca

SEQ ID NO: 7809028 - DNA, 22 bp, Homo sapiens
aaagattatggcattgaaatac

SEQ ID NO: 7809029 - DNA, 22 bp, Homo sapiens
aaaggcataggatgtggaatcg

SEQ ID NO: 7809030 - DNA, 19 bp, Homo sapiens
aaaggcagtgggtggcgtg

SEQ ID NO: 7809031 - DNA, 22 bp, Homo sapiens
aaaggcagtgggtatgtggatc

SEQ ID NO: 7809032 - DNA, 22 bp, Homo sapiens
aaaggcaggactgcagcatagg

SEQ ID NO: 7809033 - DNA, 22 bp, Homo sapiens
aaatttgtcaacttcatatgtt

SEQ ID NO: 7809034 - DNA, 22 bp, Homo sapiens
aaatttgttcaatgtctatttg

SEQ ID NO: 7809035 - DNA, 22 bp, Homo sapiens
aaatgcattctgttttcactag

SEQ ID NO: 7809036 - DNA, 22 bp, Homo sapiens
aaatgcatgtatgtaatatgct

SEQ ID NO: 7809037 - DNA, 22 bp, Homo sapiens
aaatgcatgtatgtaatatgct

SEQ ID NO: 7809038 - DNA, 22 bp, Homo sapiens
aaatgcatgtgctatagatgtg

SEQ ID NO: 7809039 - DNA, 22 bp, Homo sapiens
aaatgcattggtttctacttgt

SEQ ID NO: 7809040 - DNA, 22 bp, Homo sapiens
aaatgcatttcactaatgtttc

SEQ ID NO: 7809041 - DNA, 22 bp, Homo sapiens
aaatgcatttcactaatgtttc

SEQ ID NO: 7809042 - DNA, 22 bp, Homo sapiens
aaggcagcatgaatccctgtac

SEQ ID NO: 7809043 - DNA, 22 bp, Homo sapiens
aaggcagcaactaatggatctc

SEQ ID NO: 7809044 - DNA, 22 bp, Homo sapiens
aaggcagcaagaattccaggtt

SEQ ID NO: 7809045 - DNA, 22 bp, Homo sapiens
aatagactttctttttagaaca

SEQ ID NO: 7809046 - DNA, 19 bp, Homo sapiens
aactagaaaggttttgaga

SEQ ID NO: 7809047 - DNA, 22 bp, Homo sapiens
aatggcctggagggaatacaga

SEQ ID NO: 7809048 - DNA, 22 bp, Homo sapiens
aagatgatagatctgtcaatgt

SEQ ID NO: 7809049 - DNA, 22 bp, Homo sapiens
aagatgatgcagactttgatgt

SEQ ID NO: 7809050 - DNA, 22 bp, Homo sapiens
aagatgataggacttgcttaag

SEQ ID NO: 7809051 - DNA, 22 bp, Homo sapiens
aagatggcttagagtcctggtg

SEQ ID NO: 7809052 - DNA, 22 bp, Homo sapiens
aagatggctgcagcaattccaa

SEQ ID NO: 7809053 - DNA, 22 bp, Homo sapiens
aagatggcatctcctatagatg

SEQ ID NO: 7809054 - DNA, 22 bp, Homo sapiens
aagatggcaggaatcataagct

SEQ ID NO: 7809055 - DNA, 22 bp, Homo sapiens
aagatgtatcagttaagtcttc

SEQ ID NO: 7809056 - DNA, 22 bp, Homo sapiens
aagacttgaccaggttgaaggc

SEQ ID NO: 7809057 - DNA, 22 bp, Homo sapiens
aattttaatcagtggtgctgag

SEQ ID NO: 7809058 - DNA, 22 bp, Homo sapiens
aattttaagcatatgactggtt

SEQ ID NO: 7809059 - DNA, 22 bp, Homo sapiens
aatttgttacacagcaatataa

SEQ ID NO: 7809060 - DNA, 22 bp, Homo sapiens
aactttctgtctgagctgcaga

SEQ ID NO: 7809061 - DNA, 22 bp, Homo sapiens
aatttcactgtggagcacattt

SEQ ID NO: 7809062 - DNA, 22 bp, Homo sapiens
aatgatgtgagtttttattctc

SEQ ID NO: 7809063 - DNA, 22 bp, Homo sapiens
aatcagcaggcttctaaatttt

SEQ ID NO: 7809064 - DNA, 22 bp, Homo sapiens
aatcagcaaatgcttactcagg

SEQ ID NO: 7809065 - DNA, 21 bp, Homo sapiens
aatcagaggcttcctagttgg

SEQ ID NO: 7809066 - DNA, 22 bp, Homo sapiens
aatcagagccctctgagcttca

SEQ ID NO: 7809067 - DNA, 22 bp, Homo sapiens
aagtctaaacacatatttaaaa

SEQ ID NO: 7809068 - DNA, 22 bp, Homo sapiens
acatatgaggtgttattctatg

SEQ ID NO: 7809069 - DNA, 22 bp, Homo sapiens
acatatgagtactatacagtgc

SEQ ID NO: 7809070 - DNA, 22 bp, Homo sapiens
acagggcagcaactttgtgcct

SEQ ID NO: 7809071 - DNA, 22 bp, Homo sapiens
acagggcagaaatgttgcatct

SEQ ID NO: 7809072 - DNA, 22 bp, Homo sapiens
aagctatgggggagtttcaacc

SEQ ID NO: 7809073 - DNA, 22 bp, Homo sapiens
aagctatgttcctgcactgctc

SEQ ID NO: 7809074 - DNA, 22 bp, Homo sapiens
aagccaagagttaactatttgt

SEQ ID NO: 7809075 - DNA, 22 bp, Homo sapiens
aagctatgagctaggcatctct

SEQ ID NO: 7809076 - DNA, 22 bp, Homo sapiens
aagctaagtggaagtcttatca

SEQ ID NO: 7809077 - DNA, 22 bp, Homo sapiens
aagctaagtggaagtcttatca

SEQ ID NO: 7809078 - DNA, 22 bp, Homo sapiens
aagctaagggtgtttaagcagg

SEQ ID NO: 7809079 - DNA, 22 bp, Homo sapiens
agaggctgtgcagagggagtgc

SEQ ID NO: 7809080 - DNA, 22 bp, Homo sapiens
acaaagtaggaagattagctga

SEQ ID NO: 7809081 - DNA, 22 bp, Homo sapiens
acaaagtaagggctaatgagca

SEQ ID NO: 7809082 - DNA, 22 bp, Homo sapiens
agataagtcttccatatttcta

SEQ ID NO: 7809083 - DNA, 22 bp, Homo sapiens
aattaaattggtttagagagga

SEQ ID NO: 7809084 - DNA, 23 bp, Homo sapiens
aattaaattgctagatccagggc

SEQ ID NO: 7809085 - DNA, 22 bp, Homo sapiens
aattaaatgacaggggaagatg

SEQ ID NO: 7809086 - DNA, 22 bp, Homo sapiens
aattaacagagggcttattact

SEQ ID NO: 7809087 - DNA, 22 bp, Homo sapiens
acactataagacagatacagca

SEQ ID NO: 7809088 - DNA, 22 bp, Homo sapiens
agcagatggtgtcatgggatgg

SEQ ID NO: 7809089 - DNA, 22 bp, Homo sapiens
agcagatgaatcccagataaag

SEQ ID NO: 7809090 - DNA, 19 bp, Homo sapiens
agccagggtgagaaggagc

SEQ ID NO: 7809091 - DNA, 22 bp, Homo sapiens
acagatggtagcattatgttgg

SEQ ID NO: 7809092 - DNA, 22 bp, Homo sapiens
acagatggtgagccgctgatgt

SEQ ID NO: 7809093 - DNA, 22 bp, Homo sapiens
acagatggttattgtcatttct

SEQ ID NO: 7809094 - DNA, 21 bp, Homo sapiens
acagatgggatgagcacactg

SEQ ID NO: 7809095 - DNA, 22 bp, Homo sapiens
acagatggggcacaaagccaca

SEQ ID NO: 7809096 - DNA, 22 bp, Homo sapiens
acagatggtactaaacccatat

SEQ ID NO: 7809097 - DNA, 20 bp, Homo sapiens
acagatggcagttattacat

SEQ ID NO: 7809098 - DNA, 22 bp, Homo sapiens
acagatggccatattactatat

SEQ ID NO: 7809099 - DNA, 22 bp, Homo sapiens
acagatggcacctttttgctgt

SEQ ID NO: 7809100 - DNA, 22 bp, Homo sapiens
acagatggcactttttaggact

SEQ ID NO: 7809101 - DNA, 22 bp, Homo sapiens
acagatggaatgtgttatggga

SEQ ID NO: 7809102 - DNA, 22 bp, Homo sapiens
acagatggagctactaggtaaa

SEQ ID NO: 7809103 - DNA, 19 bp, Homo sapiens
acagatggaggaatctggg

SEQ ID NO: 7809104 - DNA, 22 bp, Homo sapiens
acagatggaggttattatgaac

SEQ ID NO: 7809105 - DNA, 22 bp, Homo sapiens
agcctctcagagtgctgggatt

SEQ ID NO: 7809106 - DNA, 22 bp, Homo sapiens
agcctctctttctggtggctaa

SEQ ID NO: 7809107 - DNA, 22 bp, Homo sapiens
taaatcagtagatatggtatag

SEQ ID NO: 7809108 - DNA, 22 bp, Homo sapiens
taaatcagtttctcttattggt

SEQ ID NO: 7809109 - DNA, 22 bp, Homo sapiens
taaatcagtaaggcatattctc

SEQ ID NO: 7809110 - DNA, 22 bp, Homo sapiens
taaatcagggagtcatctgcga

SEQ ID NO: 7809111 - DNA, 22 bp, Homo sapiens
taaatacttttactccactgat

SEQ ID NO: 7809112 - DNA, 22 bp, Homo sapiens
taaatgataataatgctagtgt

SEQ ID NO: 7809113 - DNA, 22 bp, Homo sapiens
taaatgagatttgttcttttgt

SEQ ID NO: 7809114 - DNA, 22 bp, Homo sapiens
taaagctatgcttaatttatca

SEQ ID NO: 7809115 - DNA, 22 bp, Homo sapiens
taaagctattatagttatgttt

SEQ ID NO: 7809116 - DNA, 22 bp, Homo sapiens
taaagctattgctgtttattgt

SEQ ID NO: 7809117 - DNA, 21 bp, Homo sapiens
taaagctagaaccttagcttt

SEQ ID NO: 7809118 - DNA, 22 bp, Homo sapiens
gtttttctaggaccatgtgatt

SEQ ID NO: 7809119 - DNA, 22 bp, Homo sapiens
gtggtcaggggctgaggtgccc

SEQ ID NO: 7809120 - DNA, 22 bp, Homo sapiens
gtgggggctggctcgtcctgtg

SEQ ID NO: 7809121 - DNA, 22 bp, Homo sapiens
gtgggggacccaggtgctgtcc

SEQ ID NO: 7809122 - DNA, 22 bp, Homo sapiens
gtgggcagagcaagggaactca

SEQ ID NO: 7809123 - DNA, 22 bp, Homo sapiens
gtgtgtacatatttttaatggg

SEQ ID NO: 7809124 - DNA, 22 bp, Homo sapiens
gtgtgtatgtagaactatgtat

SEQ ID NO: 7809125 - DNA, 22 bp, Homo sapiens
gtgtgtattattgcatacacat

SEQ ID NO: 7809126 - DNA, 22 bp, Homo sapiens
gtgtgtatttaaaggatagttg

SEQ ID NO: 7809127 - DNA, 21 bp, Homo sapiens
gtgtgagtagcatgtgtctca

SEQ ID NO: 7809128 - DNA, 22 bp, Homo sapiens
gtatgtatacattgtggaatgg

SEQ ID NO: 7809129 - DNA, 22 bp, Homo sapiens
gtatatatgtgtgaacatgtat

SEQ ID NO: 7809130 - DNA, 22 bp, Homo sapiens
gtatatatcggcactattttaa

SEQ ID NO: 7809131 - DNA, 20 bp, Homo sapiens
gtatataaccatagtgacta

SEQ ID NO: 7809132 - DNA, 22 bp, Homo sapiens
gggtggggcccaggaaatctat

SEQ ID NO: 7809133 - DNA, 22 bp, Homo sapiens
gggtggggtgtatcggatccta

SEQ ID NO: 7809134 - DNA, 22 bp, Homo sapiens
gggtggggttcaggaatcttca

SEQ ID NO: 7809135 - DNA, 22 bp, Homo sapiens
ggtggcagttacaggggcaaat

SEQ ID NO: 7809136 - DNA, 22 bp, Homo sapiens
gtctgggcaagggagatggcgc

SEQ ID NO: 7809137 - DNA, 22 bp, Homo sapiens
gtcggccacgcaggtgcggtag

SEQ ID NO: 7809138 - DNA, 22 bp, Homo sapiens
gtatgtgtgcaaatgtaaatat

SEQ ID NO: 7809139 - DNA, 22 bp, Homo sapiens
gtggaaaagaaagtcttccttg

SEQ ID NO: 7809140 - DNA, 22 bp, Homo sapiens
gtgcgtatgcatgtgaatacgt

SEQ ID NO: 7809141 - DNA, 22 bp, Homo sapiens
gtggaggaaaagaagttgggtg

SEQ ID NO: 7809142 - DNA, 22 bp, Homo sapiens
gtggcagggcaatgctccctct

SEQ ID NO: 7809143 - DNA, 22 bp, Homo sapiens
gtggcatgacagtgaatgggca

SEQ ID NO: 7809144 - DNA, 22 bp, Homo sapiens
gtggccaggacattgccaggca

SEQ ID NO: 7809145 - DNA, 22 bp, Homo sapiens
gtggccagccagggtgctgatg

SEQ ID NO: 7809146 - DNA, 22 bp, Homo sapiens
ggcagagactgggttggcagag

SEQ ID NO: 7809147 - DNA, 22 bp, Homo sapiens
ggcagacctctccagccccaca

SEQ ID NO: 7809148 - DNA, 22 bp, Homo sapiens
ggcacagcacagtggacccagg

SEQ ID NO: 7809149 - DNA, 22 bp, Homo sapiens
ggcacagcacagagcacatgta

SEQ ID NO: 7809150 - DNA, 22 bp, Homo sapiens
ggcaggtgaggcatgtgcctgg

SEQ ID NO: 7809151 - DNA, 22 bp, Homo sapiens
ggcaggcattagagattcccag

SEQ ID NO: 7809152 - DNA, 22 bp, Homo sapiens
ggaggtgggattaggacctaaa

SEQ ID NO: 7809153 - DNA, 22 bp, Homo sapiens
ggagggtggcagcgtcctgggc

SEQ ID NO: 7809154 - DNA, 21 bp, Homo sapiens
ggaaggggtcctcccaacagt

SEQ ID NO: 7809155 - DNA, 19 bp, Homo sapiens
ggaaggtgacagtggtgaa

SEQ ID NO: 7809156 - DNA, 22 bp, Homo sapiens
gcttccttccttacattggtgg

SEQ ID NO: 7809157 - DNA, 22 bp, Homo sapiens
gcttcatttctctctgtagacc

SEQ ID NO: 7809158 - DNA, 22 bp, Homo sapiens
ggagctattactgtaacgaaca

SEQ ID NO: 7809159 - DNA, 22 bp, Homo sapiens
ggaggcagaatagagtgtgggt

SEQ ID NO: 7809160 - DNA, 22 bp, Homo sapiens
ggcccctcagcatctgagtcag

SEQ ID NO: 7809161 - DNA, 22 bp, Homo sapiens
ggcccacttgaaatggagctca

SEQ ID NO: 7809162 - DNA, 20 bp, Homo sapiens
ggccatgggttgcctgaggt

SEQ ID NO: 7809163 - DNA, 22 bp, Homo sapiens
ggccagaggccatcctcctgct

SEQ ID NO: 7809164 - DNA, 22 bp, Homo sapiens
ggcaggtgctctgtgggcctgg

SEQ ID NO: 7809165 - DNA, 22 bp, Homo sapiens
gggaacagcatatctgaagggt

SEQ ID NO: 7809166 - DNA, 22 bp, Homo sapiens
gggaagagaccgtaccctggcc

SEQ ID NO: 7809167 - DNA, 22 bp, Homo sapiens
ggctgagttgagaggattactt

SEQ ID NO: 7809168 - DNA, 21 bp, Homo sapiens
gggatctgaggcaagtctcct

SEQ ID NO: 7809169 - DNA, 22 bp, Homo sapiens
gggatggctcaaaggagtcagg

SEQ ID NO: 7809170 - DNA, 22 bp, Homo sapiens
gggcagaggggcgcttccctct

SEQ ID NO: 7809171 - DNA, 22 bp, Homo sapiens
gggcagcagaattggacagaaa

SEQ ID NO: 7809172 - DNA, 21 bp, Homo sapiens
gggcagcacgtcattcctgtg

SEQ ID NO: 7809173 - DNA, 20 bp, Homo sapiens
gggcagcaagacatttgaca

SEQ ID NO: 7809174 - DNA, 22 bp, Homo sapiens
gggcagcaaatctgagtctggt

SEQ ID NO: 7809175 - DNA, 18 bp, Homo sapiens
gggcagcacagcagcctc

SEQ ID NO: 7809176 - DNA, 22 bp, Homo sapiens
gggcagcacagacagtgaaggc

SEQ ID NO: 7809177 - DNA, 22 bp, Homo sapiens
gggtgaataggggaaggctatt

SEQ ID NO: 7809178 - DNA, 22 bp, Homo sapiens
ggggggtgacaagtagaggttg

SEQ ID NO: 7809179 - DNA, 22 bp, Homo sapiens
gggctgcttttaagggtctcag

SEQ ID NO: 7809180 - DNA, 22 bp, Homo sapiens
gccttagcatcttaaagctgtg

SEQ ID NO: 7809181 - DNA, 22 bp, Homo sapiens
gctggagctgagttccctgggc

SEQ ID NO: 7809182 - DNA, 22 bp, Homo sapiens
gctggagatagaatggccactg

SEQ ID NO: 7809183 - DNA, 20 bp, Homo sapiens
gctgaggattcctggcccct

SEQ ID NO: 7809184 - DNA, 22 bp, Homo sapiens
gctgaggaggtgtggttaggtg

SEQ ID NO: 7809185 - DNA, 22 bp, Homo sapiens
gcctgggaagactaagtgggag

SEQ ID NO: 7809186 - DNA, 21 bp, Homo sapiens
gcctgtgtaaattgagtttcc

SEQ ID NO: 7809187 - DNA, 22 bp, Homo sapiens
gccctctggcacagagatgcag

SEQ ID NO: 7809188 - DNA, 22 bp, Homo sapiens
gccggggctggggagagacatg

SEQ ID NO: 7809189 - DNA, 22 bp, Homo sapiens
gcccaggaggagaggctgcagt

SEQ ID NO: 7809190 - DNA, 22 bp, Homo sapiens
gatgccctgcatgagtcctgct

SEQ ID NO: 7809191 - DNA, 22 bp, Homo sapiens
gatgggaggaacctgggtccct

SEQ ID NO: 7809192 - DNA, 22 bp, Homo sapiens
gatggcctgggtccccttccgg

SEQ ID NO: 7809193 - DNA, 22 bp, Homo sapiens
gatggggatgagaagtgagcag

SEQ ID NO: 7809194 - DNA, 22 bp, Homo sapiens
gatgtgtgctgcatagtatatt

SEQ ID NO: 7809195 - DNA, 22 bp, Homo sapiens
gatgtgtgtttatacatatatt

SEQ ID NO: 7809196 - DNA, 21 bp, Homo sapiens
gattaaatttaagctacatgc

SEQ ID NO: 7809197 - DNA, 22 bp, Homo sapiens
gattgtgtctcactgtgatgct

SEQ ID NO: 7809198 - DNA, 22 bp, Homo sapiens
gcagagcattggagggaccctg

SEQ ID NO: 7809199 - DNA, 22 bp, Homo sapiens
gcagagcagtgcttgcccagcg

SEQ ID NO: 7809200 - DNA, 22 bp, Homo sapiens
gcacccctgcgtgccttccctt

SEQ ID NO: 7809201 - DNA, 22 bp, Homo sapiens
gcaggtggcagaggtgggatct

SEQ ID NO: 7809202 - DNA, 22 bp, Homo sapiens
gcaggtggaagcagcagactca

SEQ ID NO: 7809203 - DNA, 19 bp, Homo sapiens
gcaggtggatgtggtcagc

SEQ ID NO: 7809204 - DNA, 22 bp, Homo sapiens
gcaggtggtccccgtggagtgg

SEQ ID NO: 7809205 - DNA, 22 bp, Homo sapiens
gccaatggctcatgagcaggac

SEQ ID NO: 7809206 - DNA, 22 bp, Homo sapiens
gccacagcagggccctctcagg

SEQ ID NO: 7809207 - DNA, 22 bp, Homo sapiens
gccacagcggggccgctagagc

SEQ ID NO: 7809208 - DNA, 21 bp, Homo sapiens
gcaggggatagaaatggtctg

SEQ ID NO: 7809209 - DNA, 22 bp, Homo sapiens
gcagcgtggggacaggagctca

SEQ ID NO: 7809210 - DNA, 22 bp, Homo sapiens
gatatacagagcattctttgat

SEQ ID NO: 7809211 - DNA, 22 bp, Homo sapiens
gatatacaatccacagttgatt

SEQ ID NO: 7809212 - DNA, 22 bp, Homo sapiens
gatactgtgtcattctcacatg

SEQ ID NO: 7809213 - DNA, 22 bp, Homo sapiens
gataatatctggtttattcacc

SEQ ID NO: 7809214 - DNA, 22 bp, Homo sapiens
gatacacacccttgataggact

SEQ ID NO: 7809215 - DNA, 20 bp, Homo sapiens
gatacacagcacagagggcc

SEQ ID NO: 7809216 - DNA, 22 bp, Homo sapiens
gatacacatgcatgtgcatgta

SEQ ID NO: 7809217 - DNA, 15 bp, Homo sapiens
gatacacatgactgg

SEQ ID NO: 7809218 - DNA, 22 bp, Homo sapiens
gatacacagggctaagatggat

SEQ ID NO: 7809219 - DNA, 20 bp, Homo sapiens
gatacacagcttcactgttg

SEQ ID NO: 7809220 - DNA, 22 bp, Homo sapiens
gatacacattttagctttgtct

SEQ ID NO: 7809221 - DNA, 22 bp, Homo sapiens
gatatacataggtttctatgca

SEQ ID NO: 7809222 - DNA, 22 bp, Homo sapiens
gatctggtacaggcctgcagcc

SEQ ID NO: 7809223 - DNA, 22 bp, Homo sapiens
gatgaaattgttttgatacttt

SEQ ID NO: 7809224 - DNA, 22 bp, Homo sapiens
gatgacttatgtttacaaatgt

SEQ ID NO: 7809225 - DNA, 22 bp, Homo sapiens
gatgacttatgtttacaaatgt

SEQ ID NO: 7809226 - DNA, 22 bp, Homo sapiens
gataaaatatgtggcctttagt

SEQ ID NO: 7809227 - DNA, 22 bp, Homo sapiens
gataaaattcttattttacccg

SEQ ID NO: 7809228 - DNA, 22 bp, Homo sapiens
gagtgtgttctttatgctgtga

SEQ ID NO: 7809229 - DNA, 22 bp, Homo sapiens
gagtcctgttgtcccagatggg

SEQ ID NO: 7809230 - DNA, 22 bp, Homo sapiens
gagctgggaagatagcttgagc

SEQ ID NO: 7809231 - DNA, 22 bp, Homo sapiens
gagctgggagttatagcatgtt

SEQ ID NO: 7809232 - DNA, 22 bp, Homo sapiens
gaggaagagagctctgccttgt

SEQ ID NO: 7809233 - DNA, 22 bp, Homo sapiens
gaggaagagcatggccagtttc

SEQ ID NO: 7809234 - DNA, 23 bp, Homo sapiens
gagctgggatacaggcttactgc

SEQ ID NO: 7809235 - DNA, 22 bp, Homo sapiens
gaggcagcaataaaaagaattt

SEQ ID NO: 7809236 - DNA, 22 bp, Homo sapiens
gaggcagctcttctgaatgggg

SEQ ID NO: 7809237 - DNA, 22 bp, Homo sapiens
gaggcagcaggctgaggaggat

SEQ ID NO: 7809238 - DNA, 22 bp, Homo sapiens
gaggcagctgaagcttcaaaga

SEQ ID NO: 7809239 - DNA, 22 bp, Homo sapiens
gaggcagctgaaggagtgacag

SEQ ID NO: 7809240 - DNA, 23 bp, Homo sapiens
gacttgtccctggcaattcatcc

SEQ ID NO: 7809241 - DNA, 22 bp, Homo sapiens
gacttctgagctatccagctgt

SEQ ID NO: 7809242 - DNA, 22 bp, Homo sapiens
gaaggctgatgacagattctgc

SEQ ID NO: 7809243 - DNA, 22 bp, Homo sapiens
ctttgtttatatttctcctcga

SEQ ID NO: 7809244 - DNA, 22 bp, Homo sapiens
ctttgttaggggctcagggtgg

SEQ ID NO: 7809245 - DNA, 22 bp, Homo sapiens
gaacgggtgcagccatgggccc

SEQ ID NO: 7809246 - DNA, 22 bp, Homo sapiens
gaacagacttggaggagtgatc

SEQ ID NO: 7809247 - DNA, 22 bp, Homo sapiens
cttggctgcttttgtgcacatt

SEQ ID NO: 7809248 - DNA, 22 bp, Homo sapiens
cttggctgaactccaggatgca

SEQ ID NO: 7809249 - DNA, 22 bp, Homo sapiens
ctttatctgtgtcctcttgcct

SEQ ID NO: 7809250 - DNA, 22 bp, Homo sapiens
ctttagatttctatgtatcact

SEQ ID NO: 7809251 - DNA, 22 bp, Homo sapiens
ctggctgggcagacagaatgct

SEQ ID NO: 7809252 - DNA, 22 bp, Homo sapiens
ctggctggggtaccagttgaac

SEQ ID NO: 7809253 - DNA, 22 bp, Homo sapiens
ctggctggggccttagataaga

SEQ ID NO: 7809254 - DNA, 22 bp, Homo sapiens
ctggctggttggggagaagaca

SEQ ID NO: 7809255 - DNA, 22 bp, Homo sapiens
tttagaatgtgactgtatttga

SEQ ID NO: 7809256 - DNA, 22 bp, Homo sapiens
tttaaatttagaagaaacactg

SEQ ID NO: 7809257 - DNA, 22 bp, Homo sapiens
tttaaatttagaagaaacactg

SEQ ID NO: 7809258 - DNA, 22 bp, Homo sapiens
tttaaattctgtctgccgctta

SEQ ID NO: 7809259 - DNA, 22 bp, Homo sapiens
tttaaatttgtgtttagagggt

SEQ ID NO: 7809260 - DNA, 22 bp, Homo sapiens
ctcctgggagctgtggcagagc

SEQ ID NO: 7809261 - DNA, 22 bp, Homo sapiens
ctcctgggagcagggatggatg

SEQ ID NO: 7809262 - DNA, 22 bp, Homo sapiens
ctcctgggctgggaactcagcc

SEQ ID NO: 7809263 - DNA, 22 bp, Homo sapiens
ctctccagccaggggcttcctg

SEQ ID NO: 7809264 - DNA, 22 bp, Homo sapiens
ttggaaaaattgcctgatgtct

SEQ ID NO: 7809265 - DNA, 22 bp, Homo sapiens
ttgatattagagtatttgtttg

SEQ ID NO: 7809266 - DNA, 22 bp, Homo sapiens
ttgggaggtaatggagccaagt

SEQ ID NO: 7809267 - DNA, 22 bp, Homo sapiens
ttgggaggtcataaatctgttc

SEQ ID NO: 7809268 - DNA, 22 bp, Homo sapiens
ctcataatgtgactgtatttga

SEQ ID NO: 7809269 - DNA, 22 bp, Homo sapiens
ttgtatttgattgtcatatcgt

SEQ ID NO: 7809270 - DNA, 22 bp, Homo sapiens
ttgtgtacacgcctttaaatga

SEQ ID NO: 7809271 - DNA, 22 bp, Homo sapiens
ttgtattttgttatgctactgc

SEQ ID NO: 7809272 - DNA, 22 bp, Homo sapiens
ctccagtctagtagagcctgct

SEQ ID NO: 7809273 - DNA, 22 bp, Homo sapiens
ctccagtcatagtctgtcttgt

SEQ ID NO: 7809274 - DNA, 22 bp, Homo sapiens
tttaaaaaactagtctgagtct

SEQ ID NO: 7809275 - DNA, 22 bp, Homo sapiens
cggctgggtagaggtgccgggt

SEQ ID NO: 7809276 - DNA, 22 bp, Homo sapiens
ttcacataaatagatcacatca

SEQ ID NO: 7809277 - DNA, 22 bp, Homo sapiens
ttcacataatctgcagcaagcg

SEQ ID NO: 7809278 - DNA, 22 bp, Homo sapiens
ttcacataggagcatggttttt

SEQ ID NO: 7809279 - DNA, 22 bp, Homo sapiens
ttcacatataatgtctttaaaa

SEQ ID NO: 7809280 - DNA, 22 bp, Homo sapiens
ttgagaaaatagttcgaatgtt

SEQ ID NO: 7809281 - DNA, 19 bp, Homo sapiens
ctcagcacttttacacagg

SEQ ID NO: 7809282 - DNA, 23 bp, Homo sapiens
ttcttggccccagtgacttctac

SEQ ID NO: 7809283 - DNA, 22 bp, Homo sapiens
ttcttggccaccagatctcact

SEQ ID NO: 7809284 - DNA, 22 bp, Homo sapiens
ttcttggctgttcatggtcagg

SEQ ID NO: 7809285 - DNA, 21 bp, Homo sapiens
ttcttggcaggtgtatcataa

SEQ ID NO: 7809286 - DNA, 22 bp, Homo sapiens
ttcttggcatcatgaaaaatta

SEQ ID NO: 7809287 - DNA, 22 bp, Homo sapiens
ttccttttcttaaacatatgtg

SEQ ID NO: 7809288 - DNA, 22 bp, Homo sapiens
ctctggctgcggggcgcgtgga

SEQ ID NO: 7809289 - DNA, 22 bp, Homo sapiens
ctctggctgtttgcagctcaag

SEQ ID NO: 7809290 - DNA, 19 bp, Homo sapiens
ctctggcttccaaagcatc

SEQ ID NO: 7809291 - DNA, 22 bp, Homo sapiens
ctgcctcacattggctgtgtga

SEQ ID NO: 7809292 - DNA, 22 bp, Homo sapiens
ctgagtccttgggcttagagtg

SEQ ID NO: 7809293 - DNA, 22 bp, Homo sapiens
ctggcaggtatctaaagttgtc

SEQ ID NO: 7809294 - DNA, 22 bp, Homo sapiens
ctggctctatctccaaggctgg

SEQ ID NO: 7809295 - DNA, 22 bp, Homo sapiens
ctggctccctcgctgaggtgct

SEQ ID NO: 7809296 - DNA, 22 bp, Homo sapiens
ctggctccctggacatggggcc

SEQ ID NO: 7809297 - DNA, 22 bp, Homo sapiens
ctggaggagcaatatggttagg

SEQ ID NO: 7809298 - DNA, 22 bp, Homo sapiens
ctggagtcagcaaggacgaggc

SEQ ID NO: 7809299 - DNA, 18 bp, Homo sapiens
ctggagtcacagtgggga

SEQ ID NO: 7809300 - DNA, 22 bp, Homo sapiens
ctggaaagatttacacggggaa

SEQ ID NO: 7809301 - DNA, 22 bp, Homo sapiens
ctggaaagagatggcagggttt

SEQ ID NO: 7809302 - DNA, 22 bp, Homo sapiens
tggctgaggtaactatgaataa

SEQ ID NO: 7809303 - DNA, 21 bp, Homo sapiens
cctctgtagttaagtttccta

SEQ ID NO: 7809304 - DNA, 22 bp, Homo sapiens
cctctgtaagccttagtctaga

SEQ ID NO: 7809305 - DNA, 22 bp, Homo sapiens
cctctcagcgattcctcttgga

SEQ ID NO: 7809306 - DNA, 22 bp, Homo sapiens
tggcaagaatattggaccagaa

SEQ ID NO: 7809307 - DNA, 20 bp, Homo sapiens
ccctggcctgtttcatgccc

SEQ ID NO: 7809308 - DNA, 22 bp, Homo sapiens
ccctggcctccaggcagtcctg

SEQ ID NO: 7809309 - DNA, 22 bp, Homo sapiens
cctatgactctgattctttaga

SEQ ID NO: 7809310 - DNA, 22 bp, Homo sapiens
cctatacaggcttctttacatg

SEQ ID NO: 7809311 - DNA, 22 bp, Homo sapiens
tggcagcacaaggtggcccatg

SEQ ID NO: 7809312 - DNA, 22 bp, Homo sapiens
tggcagcaaaaccagaatcaga

SEQ ID NO: 7809313 - DNA, 22 bp, Homo sapiens
tggcagcaatagaaatataatc

SEQ ID NO: 7809314 - DNA, 22 bp, Homo sapiens
tgctgagacagtggataggggc

SEQ ID NO: 7809315 - DNA, 22 bp, Homo sapiens
tgctccagtgagctggccatcc

SEQ ID NO: 7809316 - DNA, 22 bp, Homo sapiens
cccccaccgtgttcctgctcgg

SEQ ID NO: 7809317 - DNA, 22 bp, Homo sapiens
ccccctgcgcccggcacgtcat

SEQ ID NO: 7809318 - DNA, 22 bp, Homo sapiens
ccccgcgcgttgtcccgcaggt

SEQ ID NO: 7809319 - DNA, 22 bp, Homo sapiens
tgccaagattatcgaagtctta

SEQ ID NO: 7809320 - DNA, 22 bp, Homo sapiens
cccaggaaaagcagtgccagca

SEQ ID NO: 7809321 - DNA, 22 bp, Homo sapiens
cccaggaaagagactgctgggt

SEQ ID NO: 7809322 - DNA, 20 bp, Homo sapiens
cctggctgcattcaggacgg

SEQ ID NO: 7809323 - DNA, 22 bp, Homo sapiens
tgtgaggagaggcccagctccc

SEQ ID NO: 7809324 - DNA, 20 bp, Homo sapiens
tgtgaggagcatggccgctg

SEQ ID NO: 7809325 - DNA, 22 bp, Homo sapiens
tgtgaggaacccggaatgtggg

SEQ ID NO: 7809326 - DNA, 22 bp, Homo sapiens
tgtctttatatatttggaaaat

SEQ ID NO: 7809327 - DNA, 22 bp, Homo sapiens
tgtctttggaatatttagctga

SEQ ID NO: 7809328 - DNA, 22 bp, Homo sapiens
cctgggtccctgagagatgatt

SEQ ID NO: 7809329 - DNA, 22 bp, Homo sapiens
cctgggtctgtattggtaggta

SEQ ID NO: 7809330 - DNA, 22 bp, Homo sapiens
cctgggctttgctggcaaggcc

SEQ ID NO: 7809331 - DNA, 22 bp, Homo sapiens
tgtgtgtaaggaagctttatgg

SEQ ID NO: 7809332 - DNA, 22 bp, Homo sapiens
tgtgtgtaatgtttctctcttc

SEQ ID NO: 7809333 - DNA, 22 bp, Homo sapiens
tgtgtgtataataatgtctgca

SEQ ID NO: 7809334 - DNA, 22 bp, Homo sapiens
tgtgtgtcactgaaagaaatct

SEQ ID NO: 7809335 - DNA, 22 bp, Homo sapiens
tgtgtgtcagagtctccatggt

SEQ ID NO: 7809336 - DNA, 22 bp, Homo sapiens
tgtgtgtatatgcatttatcta

SEQ ID NO: 7809337 - DNA, 22 bp, Homo sapiens
tgtgtgtatgtttacttttcct

SEQ ID NO: 7809338 - DNA, 19 bp, Homo sapiens
tgtgtgtatttcagttctt

SEQ ID NO: 7809339 - DNA, 22 bp, Homo sapiens
tgtgtgtccttgacctcagtgg

SEQ ID NO: 7809340 - DNA, 22 bp, Homo sapiens
tgtgtgtctgcacatgtataat

SEQ ID NO: 7809341 - DNA, 22 bp, Homo sapiens
tgtggggatcttctagcttttc

SEQ ID NO: 7809342 - DNA, 22 bp, Homo sapiens
tgtgtctgtcctcggttgatgc

SEQ ID NO: 7809343 - DNA, 22 bp, Homo sapiens
tgtctatgtatacatgtgtata

SEQ ID NO: 7809344 - DNA, 22 bp, Homo sapiens
tgtcctggaaaaatggagagtt

SEQ ID NO: 7809345 - DNA, 22 bp, Homo sapiens
cctggctcctgcctctgcaggg

SEQ ID NO: 7809346 - DNA, 22 bp, Homo sapiens
cctggctcgctgacctcagggg

SEQ ID NO: 7809347 - DNA, 22 bp, Homo sapiens
tgtcatgtttcatgtttgtagg

SEQ ID NO: 7809348 - DNA, 22 bp, Homo sapiens
tgtatgtttctaaatgattgct

SEQ ID NO: 7809349 - DNA, 22 bp, Homo sapiens
tgtatgtatgtatgtatttggg

SEQ ID NO: 7809350 - DNA, 22 bp, Homo sapiens
tgtatgtattttgctaggctga

SEQ ID NO: 7809351 - DNA, 17 bp, Homo sapiens
tgtatgtggatacacta

SEQ ID NO: 7809352 - DNA, 22 bp, Homo sapiens
tgtatgtggctacttttcttgc

SEQ ID NO: 7809353 - DNA, 22 bp, Homo sapiens
tgtatgtgtatgtacatatgca

SEQ ID NO: 7809354 - DNA, 22 bp, Homo sapiens
tgtatgtgtggatagatgtata

SEQ ID NO: 7809355 - DNA, 22 bp, Homo sapiens
tgtataaaccatggacagcttt

SEQ ID NO: 7809356 - DNA, 22 bp, Homo sapiens
tgtaaacatatgtatgtatgta

SEQ ID NO: 7809357 - DNA, 22 bp, Homo sapiens
cctctgtgcctcgtgtcctctg

SEQ ID NO: 7809358 - DNA, 22 bp, Homo sapiens
cctctgtgctttgtccagcctc

SEQ ID NO: 7809359 - DNA, 23 bp, Homo sapiens
tggtccctgagagctggggaggg

SEQ ID NO: 7809360 - DNA, 22 bp, Homo sapiens
tggtccctaggaaagcagtgtt

SEQ ID NO: 7809361 - DNA, 22 bp, Homo sapiens
gttcttcagcattagaagtcat

SEQ ID NO: 7809362 - DNA, 22 bp, Homo sapiens
gttcttcaggctgagcagagag

SEQ ID NO: 7809363 - DNA, 22 bp, Homo sapiens
gttcttcaccaaggtcagaggc

SEQ ID NO: 7809364 - DNA, 22 bp, Homo sapiens
gtttacatattttaattggtga

SEQ ID NO: 7809365 - DNA, 22 bp, Homo sapiens
caggaagattgtggaggtggtt

SEQ ID NO: 7809366 - DNA, 22 bp, Homo sapiens
gtgttttattggtgcagtcaga

SEQ ID NO: 7809367 - DNA, 22 bp, Homo sapiens
gtgtgtgtatatatacacacac

SEQ ID NO: 7809368 - DNA, 22 bp, Homo sapiens
gtgttttagtgctgctgagctg

SEQ ID NO: 7809369 - DNA, 22 bp, Homo sapiens
gtgtgtgtactctgtatataaa

SEQ ID NO: 7809370 - DNA, 22 bp, Homo sapiens
gtgggcaggccctaggcgattt

SEQ ID NO: 7809371 - DNA, 22 bp, Homo sapiens
gtgtatctgttaagtataaaaa

SEQ ID NO: 7809372 - DNA, 22 bp, Homo sapiens
gtgtataatgctgtttgtacat

SEQ ID NO: 7809373 - DNA, 22 bp, Homo sapiens
gtgtactgcaaatgctgctgcc

SEQ ID NO: 7809374 - DNA, 22 bp, Homo sapiens
gtgtatgttctacttaatatta

SEQ ID NO: 7809375 - DNA, 19 bp, Homo sapiens
gtgtatgtaagttgtgagg

SEQ ID NO: 7809376 - DNA, 22 bp, Homo sapiens
gtgtctttattcctctatgttt

SEQ ID NO: 7809377 - DNA, 17 bp, Homo sapiens
gtgtctttgctgttgtg

SEQ ID NO: 7809378 - DNA, 22 bp, Homo sapiens
gtggggcatgcacgctgctcct

SEQ ID NO: 7809379 - DNA, 22 bp, Homo sapiens
tacaaatgcctgacacacagat

SEQ ID NO: 7809380 - DNA, 22 bp, Homo sapiens
tacaaatgagttgtatgaacca

SEQ ID NO: 7809381 - DNA, 22 bp, Homo sapiens
tacaaatgggttaaaatatagt

SEQ ID NO: 7809382 - DNA, 22 bp, Homo sapiens
tacaagttgcagaaagttgttt

SEQ ID NO: 7809383 - DNA, 22 bp, Homo sapiens
tacaagtatgttttaaaatgtt

SEQ ID NO: 7809384 - DNA, 22 bp, Homo sapiens
caggcagctctaatggaaagtg

SEQ ID NO: 7809385 - DNA, 22 bp, Homo sapiens
caggcagcatcagtctgctgta

SEQ ID NO: 7809386 - DNA, 22 bp, Homo sapiens
caggcagcagccactctggtat

SEQ ID NO: 7809387 - DNA, 22 bp, Homo sapiens
caggcagcaggagccctgctcg

SEQ ID NO: 7809388 - DNA, 22 bp, Homo sapiens
taattgtcctcggtccaaatga

SEQ ID NO: 7809389 - DNA, 22 bp, Homo sapiens
taattgtcatcgtagtaaacat

SEQ ID NO: 7809390 - DNA, 22 bp, Homo sapiens
taattgtcttagtctgtgcagg

SEQ ID NO: 7809391 - DNA, 22 bp, Homo sapiens
taacaacttgcttttatcttag

SEQ ID NO: 7809392 - DNA, 22 bp, Homo sapiens
caggaggaaagttccactcaac

SEQ ID NO: 7809393 - DNA, 22 bp, Homo sapiens
taaaatgatctctcatgttctt

SEQ ID NO: 7809394 - DNA, 22 bp, Homo sapiens
gtttggtgacacatagtttgat

SEQ ID NO: 7809395 - DNA, 22 bp, Homo sapiens
ccaaatgctccactgactttgg

SEQ ID NO: 7809396 - DNA, 22 bp, Homo sapiens
ccacaaattaggttttgcttgt

SEQ ID NO: 7809397 - DNA, 22 bp, Homo sapiens
catttattagttagttcgatgt

SEQ ID NO: 7809398 - DNA, 22 bp, Homo sapiens
ccagatggtttgcatgggaggg

SEQ ID NO: 7809399 - DNA, 22 bp, Homo sapiens
ccagatggtgcctgtcagaagg

SEQ ID NO: 7809400 - DNA, 22 bp, Homo sapiens
ccagatgggttacttcaagcaa

SEQ ID NO: 7809401 - DNA, 22 bp, Homo sapiens
ccagatggtatagtagggagag

SEQ ID NO: 7809402 - DNA, 22 bp, Homo sapiens
ccagatggtccagagtctagcc

SEQ ID NO: 7809403 - DNA, 20 bp, Homo sapiens
ccagatggtccctgtgaaaa

SEQ ID NO: 7809404 - DNA, 22 bp, Homo sapiens
ccagatggaaatgatgttctca

SEQ ID NO: 7809405 - DNA, 22 bp, Homo sapiens
ccagatgggaagaagcatgact

SEQ ID NO: 7809406 - DNA, 18 bp, Homo sapiens
ccagatggccagtctgct

SEQ ID NO: 7809407 - DNA, 22 bp, Homo sapiens
ccagatgggctttagcaaatga

SEQ ID NO: 7809408 - DNA, 22 bp, Homo sapiens
ccagatgggccaggggtttgtt

SEQ ID NO: 7809409 - DNA, 22 bp, Homo sapiens
tctctctgtgacagctttgctg

SEQ ID NO: 7809410 - DNA, 22 bp, Homo sapiens
tctgcctcgctaacagcagcca

SEQ ID NO: 7809411 - DNA, 19 bp, Homo sapiens
tctgcctctggtcaggctc

SEQ ID NO: 7809412 - DNA, 22 bp, Homo sapiens
ccagctggtgacatccccaacc

SEQ ID NO: 7809413 - DNA, 22 bp, Homo sapiens
ccagctggtctgtgctcatgtt

SEQ ID NO: 7809414 - DNA, 22 bp, Homo sapiens
catagacattcagcactcacta

SEQ ID NO: 7809415 - DNA, 22 bp, Homo sapiens
catataatgtttgaagatgtgg

SEQ ID NO: 7809416 - DNA, 22 bp, Homo sapiens
catatacacttccacctctgtg

SEQ ID NO: 7809417 - DNA, 22 bp, Homo sapiens
tcaggaagtgctgaggctgctt

SEQ ID NO: 7809418 - DNA, 20 bp, Homo sapiens
catatatacctagaagtgga

SEQ ID NO: 7809419 - DNA, 22 bp, Homo sapiens
catatactgcatacatatgtgt

SEQ ID NO: 7809420 - DNA, 22 bp, Homo sapiens
catatatgtagatgtatgtgaa

SEQ ID NO: 7809421 - DNA, 22 bp, Homo sapiens
catatcatttgcttataaatct

SEQ ID NO: 7809422 - DNA, 22 bp, Homo sapiens
catgtacatgcctactatcaat

SEQ ID NO: 7809423 - DNA, 22 bp, Homo sapiens
tcattttcacacataaatagca

SEQ ID NO: 7809424 - DNA, 22 bp, Homo sapiens
catctttagttattgaatatag

SEQ ID NO: 7809425 - DNA, 22 bp, Homo sapiens
tcagtttcacagtctgtgcaga

SEQ ID NO: 7809426 - DNA, 22 bp, Homo sapiens
tattggaatttagttagagaat

SEQ ID NO: 7809427 - DNA, 22 bp, Homo sapiens
cagtgcagaacacatggaaaat

SEQ ID NO: 7809428 - DNA, 22 bp, Homo sapiens
tcactcagaaatagaatgaacc

SEQ ID NO: 7809429 - DNA, 22 bp, Homo sapiens
cagtgctgggcagaggagagcg

SEQ ID NO: 7809430 - DNA, 22 bp, Homo sapiens
tataatattccttgttgtaggt

SEQ ID NO: 7809431 - DNA, 22 bp, Homo sapiens
tattaaatatatctgttagttg

SEQ ID NO: 7809432 - DNA, 22 bp, Homo sapiens
tatgtgtcccttggtgtagcaa

SEQ ID NO: 7809433 - DNA, 19 bp, Homo sapiens
tatgtgtatatgtatctgt

SEQ ID NO: 7809434 - DNA, 22 bp, Homo sapiens
tatgtgtatgtacatacataca

SEQ ID NO: 7809435 - DNA, 22 bp, Homo sapiens
tatgtgtatttagttctataca

SEQ ID NO: 7809436 - DNA, 22 bp, Homo sapiens
tatgtgtatttagttctataca

SEQ ID NO: 7809437 - DNA, 22 bp, Homo sapiens
tatgtgtaagctgtttatcttt

SEQ ID NO: 7809438 - DNA, 22 bp, Homo sapiens
tatgtgtactcgttaaatattt

SEQ ID NO: 7809439 - DNA, 22 bp, Homo sapiens
tatgtgtatatctgtatgtgca

SEQ ID NO: 7809440 - DNA, 22 bp, Homo sapiens
tatgtgtatacctatacatgtg

SEQ ID NO: 7809441 - DNA, 22 bp, Homo sapiens
tatgtgtactcgttaaatattt

SEQ ID NO: 7809442 - DNA, 22 bp, Homo sapiens
tatgtgctttgcactgtgctat

SEQ ID NO: 7809443 - DNA, 22 bp, Homo sapiens
tatgtactaactttcattctag

SEQ ID NO: 7809444 - DNA, 22 bp, Homo sapiens
ttagcaggaagagttggctgga

SEQ ID NO: 7809445 - DNA, 22 bp, Homo sapiens
ttaattaagagatactgcagta

SEQ ID NO: 7809446 - DNA, 22 bp, Homo sapiens
ttaattaattagttaagcatgt

SEQ ID NO: 7809447 - DNA, 22 bp, Homo sapiens
ttcactgcagcccatgaaggga

SEQ ID NO: 7809448 - DNA, 22 bp, Homo sapiens
tgtgtattaccattttacagct

SEQ ID NO: 7809449 - DNA, 22 bp, Homo sapiens
tgtgtatttctggaacagacta

SEQ ID NO: 7809450 - DNA, 22 bp, Homo sapiens
tgtgtattctgaggtaggtata

SEQ ID NO: 7809451 - DNA, 22 bp, Homo sapiens
tgtgtggattcatctcaaagag

SEQ ID NO: 7809452 - DNA, 22 bp, Homo sapiens
tgtgtgtgactcatactagaac

SEQ ID NO: 7809453 - DNA, 22 bp, Homo sapiens
tgtgtgtgacaacctagttcag

SEQ ID NO: 7809454 - DNA, 22 bp, Homo sapiens
tgtgtgtgcacatgcatataca

SEQ ID NO: 7809455 - DNA, 22 bp, Homo sapiens
tgtgtgtgagtcctggctttcc

SEQ ID NO: 7809456 - DNA, 22 bp, Homo sapiens
tgtgtgtgactcatactagaac

SEQ ID NO: 7809457 - DNA, 22 bp, Homo sapiens
tgtgtgtgttcctcctcagcta

SEQ ID NO: 7809458 - DNA, 22 bp, Homo sapiens
tgtgtgtgtcctcatttgcaga

SEQ ID NO: 7809459 - DNA, 22 bp, Homo sapiens
tgtgtgtgtgcgcgcacgcata

SEQ ID NO: 7809460 - DNA, 20 bp, Homo sapiens
tgtgtgtgtacttctaaata

SEQ ID NO: 7809461 - DNA, 22 bp, Homo sapiens
tgtgtgtgtaaaagcatttata

SEQ ID NO: 7809462 - DNA, 22 bp, Homo sapiens
tgtgtgtggggaggcagcagat

SEQ ID NO: 7809463 - DNA, 22 bp, Homo sapiens
tgtgtgtgggcggaacggcccc

SEQ ID NO: 7809464 - DNA, 22 bp, Homo sapiens
tgtgtgtgggcggaacggcccc

SEQ ID NO: 7809465 - DNA, 22 bp, Homo sapiens
tgtgtgtgcaggagagcaggtg

SEQ ID NO: 7809466 - DNA, 21 bp, Homo sapiens
tgtgtgtgcaggcacacacac

SEQ ID NO: 7809467 - DNA, 22 bp, Homo sapiens
tgtgtgtgtttataaatctaaa

SEQ ID NO: 7809468 - DNA, 22 bp, Homo sapiens
tgtgtgtgtttctgctcataca

SEQ ID NO: 7809469 - DNA, 22 bp, Homo sapiens
tgtgtgttcagagatagatata

SEQ ID NO: 7809470 - DNA, 22 bp, Homo sapiens
tgtgtgttattttcagccatta

SEQ ID NO: 7809471 - DNA, 22 bp, Homo sapiens
tgtgttaagtatttgatacact

SEQ ID NO: 7809472 - DNA, 22 bp, Homo sapiens
tgtgttaacactgcatgataat

SEQ ID NO: 7809473 - DNA, 22 bp, Homo sapiens
tgtgtacacacagatatataca

SEQ ID NO: 7809474 - DNA, 22 bp, Homo sapiens
tgtgtacacgagaggttatata

SEQ ID NO: 7809475 - DNA, 22 bp, Homo sapiens
tgtgtacatatacacaaataca

SEQ ID NO: 7809476 - DNA, 22 bp, Homo sapiens
tgtgtacacaagtatatataca

SEQ ID NO: 7809477 - DNA, 22 bp, Homo sapiens
tgtgtacaagcctgagtacaga

SEQ ID NO: 7809478 - DNA, 22 bp, Homo sapiens
tgtggggactgagtggaggctt

SEQ ID NO: 7809479 - DNA, 22 bp, Homo sapiens
ttaaaatgcagattctgattca

SEQ ID NO: 7809480 - DNA, 22 bp, Homo sapiens
tgtttgcttacttgtatgctgc

SEQ ID NO: 7809481 - DNA, 22 bp, Homo sapiens
tgttcttaacttttgtgtatat

SEQ ID NO: 7809482 - DNA, 22 bp, Homo sapiens
tgttctgttttatggtagggaa

SEQ ID NO: 7809483 - DNA, 22 bp, Homo sapiens
tgttaaatgtattatgtgttct

SEQ ID NO: 7809484 - DNA, 17 bp, Homo sapiens
tgtgcatagaataatga

SEQ ID NO: 7809485 - DNA, 22 bp, Homo sapiens
tgtgctctgaagagtgcatgtc

SEQ ID NO: 7809486 - DNA, 22 bp, Homo sapiens
tgtgctcttgtctgtgactaac

SEQ ID NO: 7809487 - DNA, 22 bp, Homo sapiens
tgtgattactgaatagaaaata

SEQ ID NO: 7809488 - DNA, 22 bp, Homo sapiens
tgtgaaatgctattgtgacaaa

SEQ ID NO: 7809489 - DNA, 22 bp, Homo sapiens
tgtctggctcattttctgcagt

SEQ ID NO: 7809490 - DNA, 22 bp, Homo sapiens
tgtctttggggctgtacctgtt

SEQ ID NO: 7809491 - DNA, 19 bp, Homo sapiens
tgtctttggtctgagtttc

SEQ ID NO: 7809492 - DNA, 23 bp, Homo sapiens
tgtctttgttaggactgtgttta

SEQ ID NO: 7809493 - DNA, 22 bp, Homo sapiens
tgtctgagcgagaaagtagtgt

SEQ ID NO: 7809494 - DNA, 22 bp, Homo sapiens
tgggaggcccaggcctggcagg

SEQ ID NO: 7809495 - DNA, 22 bp, Homo sapiens
tgggaggccgaggcaggtggat

SEQ ID NO: 7809496 - DNA, 22 bp, Homo sapiens
tgggagtagatgaggagtgggc

SEQ ID NO: 7809497 - DNA, 22 bp, Homo sapiens
tgggatgaggcctctgttgtga

SEQ ID NO: 7809498 - DNA, 22 bp, Homo sapiens
tgggagtgaggcagagtctatc

SEQ ID NO: 7809499 - DNA, 22 bp, Homo sapiens
tgggcacatagttttatggtca

SEQ ID NO: 7809500 - DNA, 22 bp, Homo sapiens
tgggcagggagctggaaccaca

SEQ ID NO: 7809501 - DNA, 22 bp, Homo sapiens
tgggcagggatctcttttgcaa

SEQ ID NO: 7809502 - DNA, 22 bp, Homo sapiens
tgggcaggggccctgcttccgt

SEQ ID NO: 7809503 - DNA, 22 bp, Homo sapiens
tgggcagggtctctgttatcag

SEQ ID NO: 7809504 - DNA, 22 bp, Homo sapiens
tgggccagcactgggtgctcat

SEQ ID NO: 7809505 - DNA, 22 bp, Homo sapiens
tgggccagctgaagtgccgccc

SEQ ID NO: 7809506 - DNA, 20 bp, Homo sapiens
tgggctctgcttcctggagt

SEQ ID NO: 7809507 - DNA, 21 bp, Homo sapiens
tgggcctgtccctcttggagg

SEQ ID NO: 7809508 - DNA, 22 bp, Homo sapiens
tgggcctgactcacctgcctcc

SEQ ID NO: 7809509 - DNA, 22 bp, Homo sapiens
tgggggtgccctatgaggaagc

SEQ ID NO: 7809510 - DNA, 22 bp, Homo sapiens
tggggggatacttgctactggc

SEQ ID NO: 7809511 - DNA, 20 bp, Homo sapiens
tgggtgcctgccacggggcc

SEQ ID NO: 7809512 - DNA, 22 bp, Homo sapiens
tgggtgccaacctctggtggcc

SEQ ID NO: 7809513 - DNA, 22 bp, Homo sapiens
tgggtgcatgtgagcacgtgca

SEQ ID NO: 7809514 - DNA, 22 bp, Homo sapiens
tgggtgcaggtcttgtgccagg

SEQ ID NO: 7809515 - DNA, 22 bp, Homo sapiens
tgggtgcaggatgagtgctggc

SEQ ID NO: 7809516 - DNA, 22 bp, Homo sapiens
tgggtgtgcccagatggtgtcc

SEQ ID NO: 7809517 - DNA, 22 bp, Homo sapiens
tggtaaagtgtactgaatatga

SEQ ID NO: 7809518 - DNA, 22 bp, Homo sapiens
tggtatgtaataagtgttctaa

SEQ ID NO: 7809519 - DNA, 22 bp, Homo sapiens
tggggaagggcaccctggagac

SEQ ID NO: 7809520 - DNA, 22 bp, Homo sapiens
tggggacagggctcagcaattt

SEQ ID NO: 7809521 - DNA, 22 bp, Homo sapiens
tgggggcagccaggctgtcaag

SEQ ID NO: 7809522 - DNA, 22 bp, Homo sapiens
tgtaaattgtcacctaaatgct

SEQ ID NO: 7809523 - DNA, 23 bp, Homo sapiens
tggtggggtcttggagacagcac

SEQ ID NO: 7809524 - DNA, 22 bp, Homo sapiens
tgtaaacaaatgcattcttgct

SEQ ID NO: 7809525 - DNA, 18 bp, Homo sapiens
tgtaaacactttcattct

SEQ ID NO: 7809526 - DNA, 22 bp, Homo sapiens
tggtgcagatagtggtgtagta

SEQ ID NO: 7809527 - DNA, 22 bp, Homo sapiens
tggtgcaggagttggcagggac

SEQ ID NO: 7809528 - DNA, 22 bp, Homo sapiens
tggtgcagtcattggcccaggg

SEQ ID NO: 7809529 - DNA, 16 bp, Homo sapiens
tggtggggaggacagc

SEQ ID NO: 7809530 - DNA, 22 bp, Homo sapiens
tggtgggagtccgctgtgctgc

SEQ ID NO: 7809531 - DNA, 22 bp, Homo sapiens
tggtggggctttccttctgctt

SEQ ID NO: 7809532 - DNA, 22 bp, Homo sapiens
tggtggggattccctccctggc

SEQ ID NO: 7809533 - DNA, 22 bp, Homo sapiens
tggtgggggaggctgtctagca

SEQ ID NO: 7809534 - DNA, 22 bp, Homo sapiens
tggtcctggggatctgcagtga

SEQ ID NO: 7809535 - DNA, 20 bp, Homo sapiens
tggtcctgtcccacccactc

SEQ ID NO: 7809536 - DNA, 22 bp, Homo sapiens
tggtcctgtctcaaggagcctt

SEQ ID NO: 7809537 - DNA, 22 bp, Homo sapiens
tggtcctggccttgaccccagg

SEQ ID NO: 7809538 - DNA, 22 bp, Homo sapiens
tggtcctgccccgtgcacagag

SEQ ID NO: 7809539 - DNA, 22 bp, Homo sapiens
tgtatttgagttatgaaagaga

SEQ ID NO: 7809540 - DNA, 22 bp, Homo sapiens
tgtatttgaaacagtgcatggg

SEQ ID NO: 7809541 - DNA, 22 bp, Homo sapiens
tgtatttggtgtatttaatgag

SEQ ID NO: 7809542 - DNA, 22 bp, Homo sapiens
tgtatgtaaagtttgtaataga

SEQ ID NO: 7809543 - DNA, 22 bp, Homo sapiens
tgtatgtaaagaaggatatttt

SEQ ID NO: 7809544 - DNA, 22 bp, Homo sapiens
tgtatgctttccttctttctgg

SEQ ID NO: 7809545 - DNA, 22 bp, Homo sapiens
tgtatgtatacacatagatacg

SEQ ID NO: 7809546 - DNA, 22 bp, Homo sapiens
tgtatgtatacactgatcatca

SEQ ID NO: 7809547 - DNA, 22 bp, Homo sapiens
tgtattgttataatttgtatgt

SEQ ID NO: 7809548 - DNA, 22 bp, Homo sapiens
tgtatttaattgtatcatcaca

SEQ ID NO: 7809549 - DNA, 22 bp, Homo sapiens
tgtcacatatataatgttcaat

SEQ ID NO: 7809550 - DNA, 22 bp, Homo sapiens
tgtcacatgaagccaacatagc

SEQ ID NO: 7809551 - DNA, 22 bp, Homo sapiens
tgtcacatgacacaaatatcta

SEQ ID NO: 7809552 - DNA, 20 bp, Homo sapiens
tgtatattttctggtgtaaa

SEQ ID NO: 7809553 - DNA, 22 bp, Homo sapiens
tgtatatgtgcacatgtgcttc

SEQ ID NO: 7809554 - DNA, 22 bp, Homo sapiens
tgtatatgagtctgagtgtaca

SEQ ID NO: 7809555 - DNA, 22 bp, Homo sapiens
tgtatacatttggtgcatattt

SEQ ID NO: 7809556 - DNA, 22 bp, Homo sapiens
tgtatacatttaactagataga

SEQ ID NO: 7809557 - DNA, 21 bp, Homo sapiens
tgtatacacacatatatgtac

SEQ ID NO: 7809558 - DNA, 22 bp, Homo sapiens
tgtcctgggtcaaccaggtcga

SEQ ID NO: 7809559 - DNA, 22 bp, Homo sapiens
tgtccccaaggttcagcccaca

SEQ ID NO: 7809560 - DNA, 22 bp, Homo sapiens
tgtcatttcctgaatgctgagt

SEQ ID NO: 7809561 - DNA, 19 bp, Homo sapiens
tgcttcatttcttttatgt

SEQ ID NO: 7809562 - DNA, 22 bp, Homo sapiens
tgctgggttacctaagcctaaa

SEQ ID NO: 7809563 - DNA, 22 bp, Homo sapiens
tgctgtattacttttacaaact

SEQ ID NO: 7809564 - DNA, 23 bp, Homo sapiens
tgctgggtatcagaatcactgag

SEQ ID NO: 7809565 - DNA, 22 bp, Homo sapiens
tgctggctatttaaagaagaaa

SEQ ID NO: 7809566 - DNA, 23 bp, Homo sapiens
tgctggctgtgttattgccaaca

SEQ ID NO: 7809567 - DNA, 23 bp, Homo sapiens
tgctggagtttactcaggccagc

SEQ ID NO: 7809568 - DNA, 22 bp, Homo sapiens
tgctggagtaacaagacactca

SEQ ID NO: 7809569 - DNA, 22 bp, Homo sapiens
tgcctgtggaaaggctggtgct

SEQ ID NO: 7809570 - DNA, 22 bp, Homo sapiens
tgctatttaacttttatgtgta

SEQ ID NO: 7809571 - DNA, 22 bp, Homo sapiens
tgctatgtaaagctctgggttt

SEQ ID NO: 7809572 - DNA, 22 bp, Homo sapiens
tgctatttgggggctacatgat

SEQ ID NO: 7809573 - DNA, 20 bp, Homo sapiens
tgcgtgtgtatttattttct

SEQ ID NO: 7809574 - DNA, 22 bp, Homo sapiens
tgctcagtagcagtgtgctgct

SEQ ID NO: 7809575 - DNA, 22 bp, Homo sapiens
tgctgaggaaagaggataaaag

SEQ ID NO: 7809576 - DNA, 22 bp, Homo sapiens
tgctgaggtttctgactatgga

SEQ ID NO: 7809577 - DNA, 22 bp, Homo sapiens
tgctccaggctgctgaagatct

SEQ ID NO: 7809578 - DNA, 22 bp, Homo sapiens
tgctccagctggagatgggggc

SEQ ID NO: 7809579 - DNA, 22 bp, Homo sapiens
tggaagcactactttaatgcat

SEQ ID NO: 7809580 - DNA, 22 bp, Homo sapiens
tggaagaggtggaagtggcttc

SEQ ID NO: 7809581 - DNA, 22 bp, Homo sapiens
tggaagagaaaggagtggatct

SEQ ID NO: 7809582 - DNA, 22 bp, Homo sapiens
tggaagagaaaggagtggatct

SEQ ID NO: 7809583 - DNA, 22 bp, Homo sapiens
tggaagagcaggcagacaatgc

SEQ ID NO: 7809584 - DNA, 22 bp, Homo sapiens
tggactcttggaccttctctaa

SEQ ID NO: 7809585 - DNA, 22 bp, Homo sapiens
tggactctgaactggcactgac

SEQ ID NO: 7809586 - DNA, 22 bp, Homo sapiens
tggacaggatctgagactgaga

SEQ ID NO: 7809587 - DNA, 22 bp, Homo sapiens
tggaaagagatgttgtttctga

SEQ ID NO: 7809588 - DNA, 22 bp, Homo sapiens
tgctttgcactgactccttcct

SEQ ID NO: 7809589 - DNA, 22 bp, Homo sapiens
tgctttgcaaataatagaatgt

SEQ ID NO: 7809590 - DNA, 22 bp, Homo sapiens
tgcttgtgacagaactgtgtcc

SEQ ID NO: 7809591 - DNA, 22 bp, Homo sapiens
tggaggtggcatctgacagctg

SEQ ID NO: 7809592 - DNA, 22 bp, Homo sapiens
tggagtccccgagaggcctgca

SEQ ID NO: 7809593 - DNA, 18 bp, Homo sapiens
tggaggaaaaatctcatg

SEQ ID NO: 7809594 - DNA, 22 bp, Homo sapiens
tggagcagaggaagaaggcttt

SEQ ID NO: 7809595 - DNA, 22 bp, Homo sapiens
tggagcagcattcatccagcag

SEQ ID NO: 7809596 - DNA, 21 bp, Homo sapiens
tggagctgaatttttggcatc

SEQ ID NO: 7809597 - DNA, 22 bp, Homo sapiens
tggcatttagagaaatgaagga

SEQ ID NO: 7809598 - DNA, 22 bp, Homo sapiens
tggcatgtggcagctggttcag

SEQ ID NO: 7809599 - DNA, 23 bp, Homo sapiens
tggccaggtagaggaggtagtga

SEQ ID NO: 7809600 - DNA, 22 bp, Homo sapiens
tggcagggtcttgctgtgttgc

SEQ ID NO: 7809601 - DNA, 22 bp, Homo sapiens
tggccatgaaggaggcagcaga

SEQ ID NO: 7809602 - DNA, 22 bp, Homo sapiens
tggccctgcacccagagcagtt

SEQ ID NO: 7809603 - DNA, 22 bp, Homo sapiens
tggcaggggaggtgcttgctta

SEQ ID NO: 7809604 - DNA, 22 bp, Homo sapiens
tggcagcagacaaaaggccatt

SEQ ID NO: 7809605 - DNA, 23 bp, Homo sapiens
tggcagcagatcttaaagtgacc

SEQ ID NO: 7809606 - DNA, 22 bp, Homo sapiens
tggcagcagcaaatggcatatc

SEQ ID NO: 7809607 - DNA, 22 bp, Homo sapiens
tggcagcagccatggaaggccc

SEQ ID NO: 7809608 - DNA, 18 bp, Homo sapiens
tggcagcaggaagccatt

SEQ ID NO: 7809609 - DNA, 22 bp, Homo sapiens
tggcagcagtggaggtagaaag

SEQ ID NO: 7809610 - DNA, 22 bp, Homo sapiens
tggcaacatgtcgaagtgctgt

SEQ ID NO: 7809611 - DNA, 22 bp, Homo sapiens
tggcaataaagaccaacaggtt

SEQ ID NO: 7809612 - DNA, 22 bp, Homo sapiens
tggcaaagctagacattccctc

SEQ ID NO: 7809613 - DNA, 22 bp, Homo sapiens
tggcaaaggcgctcacatgcct

SEQ ID NO: 7809614 - DNA, 22 bp, Homo sapiens
tggcaaagactgcaaggacttt

SEQ ID NO: 7809615 - DNA, 22 bp, Homo sapiens
tggctggggccacagttttcct

SEQ ID NO: 7809616 - DNA, 22 bp, Homo sapiens
tgggagcagctttgcgagggag

SEQ ID NO: 7809617 - DNA, 22 bp, Homo sapiens
tgggagcactctttgggaagca

SEQ ID NO: 7809618 - DNA, 22 bp, Homo sapiens
tgggagcagccaacatggcctt

SEQ ID NO: 7809619 - DNA, 22 bp, Homo sapiens
tgggagcaagctggtgctggag

SEQ ID NO: 7809620 - DNA, 22 bp, Homo sapiens
tgggagcaccctgaggagcttc

SEQ ID NO: 7809621 - DNA, 22 bp, Homo sapiens
tgggagcaccttgagggcagaa

SEQ ID NO: 7809622 - DNA, 22 bp, Homo sapiens
tgggaggaagtgctaatgggag

SEQ ID NO: 7809623 - DNA, 22 bp, Homo sapiens
tgggaggaatgtcactgagcca

SEQ ID NO: 7809624 - DNA, 22 bp, Homo sapiens
tgggaggacttgtgggcttcat

SEQ ID NO: 7809625 - DNA, 22 bp, Homo sapiens
tgggaggagccctctgggaagg

SEQ ID NO: 7809626 - DNA, 22 bp, Homo sapiens
tgggaggatctcttgaggccag

SEQ ID NO: 7809627 - DNA, 22 bp, Homo sapiens
tgggaagaggcgggaggctgtt

SEQ ID NO: 7809628 - DNA, 21 bp, Homo sapiens
tggctgagtggatgcatgaat

SEQ ID NO: 7809629 - DNA, 22 bp, Homo sapiens
tggctgagtttcatgcatcatg

SEQ ID NO: 7809630 - DNA, 22 bp, Homo sapiens
tggctgaaagcctggcctgcca

SEQ ID NO: 7809631 - DNA, 22 bp, Homo sapiens
tgaaatatcattttcatctccc

SEQ ID NO: 7809632 - DNA, 22 bp, Homo sapiens
tgaaatatccagcccagcagga

SEQ ID NO: 7809633 - DNA, 22 bp, Homo sapiens
tgaaatatgctcccattcactt

SEQ ID NO: 7809634 - DNA, 22 bp, Homo sapiens
tgaaatatgctcccattcactt

SEQ ID NO: 7809635 - DNA, 23 bp, Homo sapiens
tgaaatattcttttgcatgagct

SEQ ID NO: 7809636 - DNA, 22 bp, Homo sapiens
tgaaatgtctgaaagccaatct

SEQ ID NO: 7809637 - DNA, 22 bp, Homo sapiens
tctttttttcctgtgcagagct

SEQ ID NO: 7809638 - DNA, 22 bp, Homo sapiens
tctttggaaggagcagtttttg

SEQ ID NO: 7809639 - DNA, 22 bp, Homo sapiens
tctttggaattctctgcagccc

SEQ ID NO: 7809640 - DNA, 22 bp, Homo sapiens
tctttggaatgctagcattcta

SEQ ID NO: 7809641 - DNA, 22 bp, Homo sapiens
tctttggactttccaatttgtt

SEQ ID NO: 7809642 - DNA, 22 bp, Homo sapiens
tctttggagtgttatcagtaat

SEQ ID NO: 7809643 - DNA, 22 bp, Homo sapiens
tctttggatatcgctagaccgt

SEQ ID NO: 7809644 - DNA, 22 bp, Homo sapiens
tctttggattaaaatatttgta

SEQ ID NO: 7809645 - DNA, 22 bp, Homo sapiens
tcttttctccagacctgggatc

SEQ ID NO: 7809646 - DNA, 22 bp, Homo sapiens
tgacctctgtcctgcagtctgg

SEQ ID NO: 7809647 - DNA, 22 bp, Homo sapiens
tgacttgtattttaaataattg

SEQ ID NO: 7809648 - DNA, 22 bp, Homo sapiens
tgaaggaggaatgtggcctcca

SEQ ID NO: 7809649 - DNA, 22 bp, Homo sapiens
tgaagccattactgtgttaggg

SEQ ID NO: 7809650 - DNA, 22 bp, Homo sapiens
tgaaggcctccccgagcattag

SEQ ID NO: 7809651 - DNA, 22 bp, Homo sapiens
tgaaggggttcagcatgggggt

SEQ ID NO: 7809652 - DNA, 22 bp, Homo sapiens
tgaagggggagatatatgtgtg

SEQ ID NO: 7809653 - DNA, 20 bp, Homo sapiens
tgaattctgggtttatctgc

SEQ ID NO: 7809654 - DNA, 22 bp, Homo sapiens
tgaatctttttggaaataaaga

SEQ ID NO: 7809655 - DNA, 22 bp, Homo sapiens
tgagatgtaaggtatgcttact

SEQ ID NO: 7809656 - DNA, 22 bp, Homo sapiens
tgagatgtaaggtatgcttact

SEQ ID NO: 7809657 - DNA, 19 bp, Homo sapiens
tgagaaattccacaggatg

SEQ ID NO: 7809658 - DNA, 22 bp, Homo sapiens
tgagaaattacttcagtgatgg

SEQ ID NO: 7809659 - DNA, 22 bp, Homo sapiens
tgagaaatattgcacagtgagg

SEQ ID NO: 7809660 - DNA, 22 bp, Homo sapiens
tgagccttccttgtcatatcat

SEQ ID NO: 7809661 - DNA, 22 bp, Homo sapiens
tgagcagatggaggcttctgca

SEQ ID NO: 7809662 - DNA, 22 bp, Homo sapiens
tgagcagaggccagcacctggg

SEQ ID NO: 7809663 - DNA, 22 bp, Homo sapiens
tgaggccaggatcccaggctct

SEQ ID NO: 7809664 - DNA, 22 bp, Homo sapiens
tgaggccaatgaccctgggcag

SEQ ID NO: 7809665 - DNA, 22 bp, Homo sapiens
tgaggccacagtatcagaacag

SEQ ID NO: 7809666 - DNA, 22 bp, Homo sapiens
tgaggccacttccccacagccc

SEQ ID NO: 7809667 - DNA, 18 bp, Homo sapiens
tgaggccagagtgggcat

SEQ ID NO: 7809668 - DNA, 22 bp, Homo sapiens
tgaggccaggacccccagcagg

SEQ ID NO: 7809669 - DNA, 22 bp, Homo sapiens
tgaggccaaaatgactcaaatg

SEQ ID NO: 7809670 - DNA, 22 bp, Homo sapiens
tgaggccaagcctcctctgcca

SEQ ID NO: 7809671 - DNA, 22 bp, Homo sapiens
tgaggccaagaaaagctgggtg

SEQ ID NO: 7809672 - DNA, 19 bp, Homo sapiens
tgaggccaaggtcacagat

SEQ ID NO: 7809673 - DNA, 22 bp, Homo sapiens
tgagtcttctgcctaaagaagt

SEQ ID NO: 7809674 - DNA, 23 bp, Homo sapiens
tgagggacatggtggcttctgag

SEQ ID NO: 7809675 - DNA, 22 bp, Homo sapiens
tgcaatttggcttccattttct

SEQ ID NO: 7809676 - DNA, 22 bp, Homo sapiens
tgcaagagacagacatgactca

SEQ ID NO: 7809677 - DNA, 22 bp, Homo sapiens
tgcaagagcagaaagaactgag

SEQ ID NO: 7809678 - DNA, 22 bp, Homo sapiens
tgcaagagcccagggccaggaa

SEQ ID NO: 7809679 - DNA, 22 bp, Homo sapiens
tgcaagaggtaaaatgaaagga

SEQ ID NO: 7809680 - DNA, 22 bp, Homo sapiens
tgcaagagctgtggcaaaagca

SEQ ID NO: 7809681 - DNA, 22 bp, Homo sapiens
tgcaagaggaattctagaagca

SEQ ID NO: 7809682 - DNA, 22 bp, Homo sapiens
tgcaagaggagactgtactcag

SEQ ID NO: 7809683 - DNA, 22 bp, Homo sapiens
tgcaaggggtttatgcagatga

SEQ ID NO: 7809684 - DNA, 22 bp, Homo sapiens
tgcaagggtgtttgagctgccc

SEQ ID NO: 7809685 - DNA, 23 bp, Homo sapiens
tgattacaagggccaaagaaagg

SEQ ID NO: 7809686 - DNA, 22 bp, Homo sapiens
tgattaaattaattaagatgag

SEQ ID NO: 7809687 - DNA, 22 bp, Homo sapiens
tgattctttgaccaaaaaattg

SEQ ID NO: 7809688 - DNA, 22 bp, Homo sapiens
tgagtgcctaccaagtgctgga

SEQ ID NO: 7809689 - DNA, 22 bp, Homo sapiens
tgagtgcctttgattgggcatg

SEQ ID NO: 7809690 - DNA, 22 bp, Homo sapiens
tgagtgtgtattatgtatcagg

SEQ ID NO: 7809691 - DNA, 22 bp, Homo sapiens
tgagtgtggggaatgtcatgag

SEQ ID NO: 7809692 - DNA, 22 bp, Homo sapiens
tgagtgtgctaggtgtctcggt

SEQ ID NO: 7809693 - DNA, 22 bp, Homo sapiens
tgcagcttatctctttggcagt

SEQ ID NO: 7809694 - DNA, 22 bp, Homo sapiens
tgcagcagggcccaggcacaga

SEQ ID NO: 7809695 - DNA, 22 bp, Homo sapiens
tgcagaaaccaattcaagtaag

SEQ ID NO: 7809696 - DNA, 22 bp, Homo sapiens
tgcagaaataaagatattatca

SEQ ID NO: 7809697 - DNA, 22 bp, Homo sapiens
tgcagatgcctgggctgcacca

SEQ ID NO: 7809698 - DNA, 22 bp, Homo sapiens
tgcagatgagagggagttttta

SEQ ID NO: 7809699 - DNA, 22 bp, Homo sapiens
tgcagatgaatgctgagacact

SEQ ID NO: 7809700 - DNA, 22 bp, Homo sapiens
tgcatgtggacccctggtgcct

SEQ ID NO: 7809701 - DNA, 22 bp, Homo sapiens
tgcagttttggccattgaaggc

SEQ ID NO: 7809702 - DNA, 22 bp, Homo sapiens
tgcagttttatcacatatatag

SEQ ID NO: 7809703 - DNA, 19 bp, Homo sapiens
tgcataaattatatacttt

SEQ ID NO: 7809704 - DNA, 22 bp, Homo sapiens
tgcataaagtgccatagtatta

SEQ ID NO: 7809705 - DNA, 22 bp, Homo sapiens
tgcataattcatccttctggga

SEQ ID NO: 7809706 - DNA, 22 bp, Homo sapiens
tgcataatgctggacttttcaa

SEQ ID NO: 7809707 - DNA, 21 bp, Homo sapiens
tgcattcttgtgtaaggtagt

SEQ ID NO: 7809708 - DNA, 22 bp, Homo sapiens
tgcattctgaacgtaaatgtga

SEQ ID NO: 7809709 - DNA, 22 bp, Homo sapiens
tgcattctgacttagttaatat

SEQ ID NO: 7809710 - DNA, 22 bp, Homo sapiens
tgccatttttgagtggggcctc

SEQ ID NO: 7809711 - DNA, 22 bp, Homo sapiens
tgccattttgagatgttaatga

SEQ ID NO: 7809712 - DNA, 22 bp, Homo sapiens
tgccatttctcacatatgtatg

SEQ ID NO: 7809713 - DNA, 22 bp, Homo sapiens
tgccatttactgagattagaag

SEQ ID NO: 7809714 - DNA, 20 bp, Homo sapiens
tgcccagcaagagtgcagtt

SEQ ID NO: 7809715 - DNA, 22 bp, Homo sapiens
tgcccagcagggagctacctgg

SEQ ID NO: 7809716 - DNA, 22 bp, Homo sapiens
tgcccaggctggagtgcagagg

SEQ ID NO: 7809717 - DNA, 22 bp, Homo sapiens
tgcccaggctggagtgcagtgg

SEQ ID NO: 7809718 - DNA, 22 bp, Homo sapiens
tgcccagggtggagtgcagtgg

SEQ ID NO: 7809719 - DNA, 22 bp, Homo sapiens
tgcccagggtggagtgcagcgg

SEQ ID NO: 7809720 - DNA, 22 bp, Homo sapiens
tgcccaggtttgagtgcccaag

SEQ ID NO: 7809721 - DNA, 22 bp, Homo sapiens
tgcccatggaccaagcaagggg

SEQ ID NO: 7809722 - DNA, 22 bp, Homo sapiens
tgccccctggtggccagagccg

SEQ ID NO: 7809723 - DNA, 22 bp, Homo sapiens
tgcccccttttcttgttacact

SEQ ID NO: 7809724 - DNA, 22 bp, Homo sapiens
tgcctcaggcacctggcaggtt

SEQ ID NO: 7809725 - DNA, 22 bp, Homo sapiens
tgccgcaagtactgctgcctgt

SEQ ID NO: 7809726 - DNA, 22 bp, Homo sapiens
tcctgggtccatggcagccgaa

SEQ ID NO: 7809727 - DNA, 22 bp, Homo sapiens
tcctgggtggtggtaggagcag

SEQ ID NO: 7809728 - DNA, 22 bp, Homo sapiens
tcctgggtagagacctgatgaa

SEQ ID NO: 7809729 - DNA, 22 bp, Homo sapiens
tcctgggatgcataaaatatgt

SEQ ID NO: 7809730 - DNA, 22 bp, Homo sapiens
tcctgggcaaagaggggcagtg

SEQ ID NO: 7809731 - DNA, 22 bp, Homo sapiens
tctattttatactcaaatcttc

SEQ ID NO: 7809732 - DNA, 21 bp, Homo sapiens
tctacatatcaatatgtaatt

SEQ ID NO: 7809733 - DNA, 22 bp, Homo sapiens
tcgtctgtgaaattgggataag

SEQ ID NO: 7809734 - DNA, 21 bp, Homo sapiens
tctctggaattagaccatgtt

SEQ ID NO: 7809735 - DNA, 22 bp, Homo sapiens
tctctggcagacacctccctga

SEQ ID NO: 7809736 - DNA, 21 bp, Homo sapiens
tctctgggccctcctgtgggg

SEQ ID NO: 7809737 - DNA, 22 bp, Homo sapiens
tctctgggaaatggagaatttt

SEQ ID NO: 7809738 - DNA, 19 bp, Homo sapiens
tctctggcttgtctgcctg

SEQ ID NO: 7809739 - DNA, 22 bp, Homo sapiens
tctctgggctcaggagcccggc

SEQ ID NO: 7809740 - DNA, 22 bp, Homo sapiens
tctctggggatggacctgggag

SEQ ID NO: 7809741 - DNA, 22 bp, Homo sapiens
tctctctgccaactcacagcca

SEQ ID NO: 7809742 - DNA, 22 bp, Homo sapiens
tctcttccttgacctattgtaa

SEQ ID NO: 7809743 - DNA, 22 bp, Homo sapiens
tctcttcacatgcttgctccaa

SEQ ID NO: 7809744 - DNA, 22 bp, Homo sapiens
tctctgtctttgttgtcttcac

SEQ ID NO: 7809745 - DNA, 22 bp, Homo sapiens
tctctgggtttttgtcctgtac

SEQ ID NO: 7809746 - DNA, 23 bp, Homo sapiens
tctctggttaggggagattggtg

SEQ ID NO: 7809747 - DNA, 22 bp, Homo sapiens
tctccacaagctgatgctagga

SEQ ID NO: 7809748 - DNA, 22 bp, Homo sapiens
tctcagcagggccatcctgagc

SEQ ID NO: 7809749 - DNA, 22 bp, Homo sapiens
tcttggctggtcatttaaaatc

SEQ ID NO: 7809750 - DNA, 20 bp, Homo sapiens
tctttagatttatcttatgt

SEQ ID NO: 7809751 - DNA, 22 bp, Homo sapiens
tctttcaatgtgaaaccatgta

SEQ ID NO: 7809752 - DNA, 22 bp, Homo sapiens
tctttgaatcctttacatctga

SEQ ID NO: 7809753 - DNA, 22 bp, Homo sapiens
tcttcaaatgctagtaatatca

SEQ ID NO: 7809754 - DNA, 22 bp, Homo sapiens
tcttatttgcaactggctcaga

SEQ ID NO: 7809755 - DNA, 22 bp, Homo sapiens
tcttatgataatatcactacca

SEQ ID NO: 7809756 - DNA, 22 bp, Homo sapiens
tcttcatatataaagtggaata

SEQ ID NO: 7809757 - DNA, 22 bp, Homo sapiens
tcttcattttatagcatctgtg

SEQ ID NO: 7809758 - DNA, 22 bp, Homo sapiens
tctgggtgaccctgggcaaggc

SEQ ID NO: 7809759 - DNA, 22 bp, Homo sapiens
tctgggtgtagggcctggcaac

SEQ ID NO: 7809760 - DNA, 22 bp, Homo sapiens
tctgggttattatgatggctac

SEQ ID NO: 7809761 - DNA, 22 bp, Homo sapiens
tctgggcttggattggctctgc

SEQ ID NO: 7809762 - DNA, 22 bp, Homo sapiens
tctgtcaatatatgtgctgcag

SEQ ID NO: 7809763 - DNA, 22 bp, Homo sapiens
tctgtcaaggcaactgcatttt

SEQ ID NO: 7809764 - DNA, 22 bp, Homo sapiens
tctgtcaaggcaactgcatttt

SEQ ID NO: 7809765 - DNA, 22 bp, Homo sapiens
tctgtgtctgttacttcactgc

SEQ ID NO: 7809766 - DNA, 22 bp, Homo sapiens
tctgtgctttccctgccttctt

SEQ ID NO: 7809767 - DNA, 22 bp, Homo sapiens
tctgtgctgtctcagagaaagc

SEQ ID NO: 7809768 - DNA, 22 bp, Homo sapiens
tctgtgctaggcagcctggccc

SEQ ID NO: 7809769 - DNA, 22 bp, Homo sapiens
tctgtgctcaagttctgcctct

SEQ ID NO: 7809770 - DNA, 22 bp, Homo sapiens
tctgttaacctggtcttggctt

SEQ ID NO: 7809771 - DNA, 22 bp, Homo sapiens
tctgttaacaggagagaatgat

SEQ ID NO: 7809772 - DNA, 18 bp, Homo sapiens
tctgtgttctgtcattgc

SEQ ID NO: 7809773 - DNA, 22 bp, Homo sapiens
tctgtgttgagaaggatcatga

SEQ ID NO: 7809774 - DNA, 22 bp, Homo sapiens
tctgtgttgataattttggaga

SEQ ID NO: 7809775 - DNA, 22 bp, Homo sapiens
tctgtgtttaaaagatatgtcc

SEQ ID NO: 7809776 - DNA, 20 bp, Homo sapiens
tctgtgtttcagctgcttga

SEQ ID NO: 7809777 - DNA, 22 bp, Homo sapiens
tctgtgtttgccatccttgctc

SEQ ID NO: 7809778 - DNA, 22 bp, Homo sapiens
tctgtgttttgtgcctactgct

SEQ ID NO: 7809779 - DNA, 22 bp, Homo sapiens
tctgtgttttaaacagtagaaa

SEQ ID NO: 7809780 - DNA, 22 bp, Homo sapiens
tctgtgtggtagtttcagtgaa

SEQ ID NO: 7809781 - DNA, 22 bp, Homo sapiens
tctgcaagctaaggaagcatct

SEQ ID NO: 7809782 - DNA, 22 bp, Homo sapiens
tctgcaagcgtcacatgattct

SEQ ID NO: 7809783 - DNA, 22 bp, Homo sapiens
tctgacctgaatgaaacagatg

SEQ ID NO: 7809784 - DNA, 19 bp, Homo sapiens
tctgagctgatatgacatt

SEQ ID NO: 7809785 - DNA, 22 bp, Homo sapiens
tctgcaagtagatgacagtgag

SEQ ID NO: 7809786 - DNA, 22 bp, Homo sapiens
tctgccctgcagggagcagtaa

SEQ ID NO: 7809787 - DNA, 22 bp, Homo sapiens
tctgcccacagtccaatagttg

SEQ ID NO: 7809788 - DNA, 21 bp, Homo sapiens
tctgccctccaggagctcata

SEQ ID NO: 7809789 - DNA, 22 bp, Homo sapiens
tctgcccagtttgtgctcaggt

SEQ ID NO: 7809790 - DNA, 19 bp, Homo sapiens
tctgcccagttgtctgccc

SEQ ID NO: 7809791 - DNA, 21 bp, Homo sapiens
tctggccctaggttgggcctc

SEQ ID NO: 7809792 - DNA, 21 bp, Homo sapiens
tctgggcccatgctgcctcac

SEQ ID NO: 7809793 - DNA, 22 bp, Homo sapiens
tctgggctgaaatgaaggcctt

SEQ ID NO: 7809794 - DNA, 22 bp, Homo sapiens
tctgctgagtcagacctctggg

SEQ ID NO: 7809795 - DNA, 22 bp, Homo sapiens
tctgctctccatacttccgcac

SEQ ID NO: 7809796 - DNA, 17 bp, Homo sapiens
tctgctctgccaatcca

SEQ ID NO: 7809797 - DNA, 18 bp, Homo sapiens
acacaggctgacagcacc

SEQ ID NO: 7809798 - DNA, 22 bp, Homo sapiens
aacctggccccagattccccat

SEQ ID NO: 7809799 - DNA, 22 bp, Homo sapiens
aacctggccctaatcccagtag

SEQ ID NO: 7809800 - DNA, 22 bp, Homo sapiens
actgcaacctccgcctgccagg

SEQ ID NO: 7809801 - DNA, 22 bp, Homo sapiens
acctggctggttgtgattccca

SEQ ID NO: 7809802 - DNA, 23 bp, Homo sapiens
acctggctgctcaacctgcaggg

SEQ ID NO: 7809803 - DNA, 23 bp, Homo sapiens
agccacagccagagctatctcca

SEQ ID NO: 7809804 - DNA, 22 bp, Homo sapiens
agccacagcctgacttaactgt

SEQ ID NO: 7809805 - DNA, 22 bp, Homo sapiens
ccccatgaagtagggtctctga

SEQ ID NO: 7809806 - DNA, 20 bp, Homo sapiens
aggctctgccattgtccctg

SEQ ID NO: 7809807 - DNA, 20 bp, Homo sapiens
aggctctgcctgcaggccca

SEQ ID NO: 7809808 - DNA, 19 bp, Homo sapiens
aggctctgagctcctggag

SEQ ID NO: 7809809 - DNA, 22 bp, Homo sapiens
aggctctgagtagagctgccag

SEQ ID NO: 7809810 - DNA, 22 bp, Homo sapiens
aggctctgatgcaagcccaggg

SEQ ID NO: 7809811 - DNA, 22 bp, Homo sapiens
aggctctgcagtccatcccgtg

SEQ ID NO: 7809812 - DNA, 22 bp, Homo sapiens
cgggttcacgccattctcctgc

SEQ ID NO: 7809813 - DNA, 22 bp, Homo sapiens
ggatgttctggggttctcttgt

SEQ ID NO: 7809814 - DNA, 22 bp, Homo sapiens
gcgcaccacctccaggtggccg

SEQ ID NO: 7809815 - DNA, 22 bp, Homo sapiens
tctgcctctttcaggcctggca

SEQ ID NO: 7809816 - DNA, 22 bp, Homo sapiens
tctgcgccctgtcgcctgctcc

SEQ ID NO: 7809817 - DNA, 19 bp, Homo sapiens
tctgcctctggtcaggctc

SEQ ID NO: 7809818 - DNA, 22 bp, Homo sapiens
tctgcctcgctaacagcagcca

SEQ ID NO: 7809819 - DNA, 22 bp, Homo sapiens
tctgcctcctgcttgtcccgac

SEQ ID NO: 7809820 - DNA, 19 bp, Homo sapiens
tctctctgtacattagata

SEQ ID NO: 7809821 - DNA, 22 bp, Homo sapiens
gttggccaggctggtctcaaac

SEQ ID NO: 7809822 - DNA, 22 bp, Homo sapiens
gttggccaggctggtctcaatc

SEQ ID NO: 7809823 - DNA, 22 bp, Homo sapiens
gttggccatcgctatgacaaga

SEQ ID NO: 7809824 - DNA, 22 bp, Homo sapiens
gttggccagagatgctgatata

SEQ ID NO: 7809825 - DNA, 22 bp, Homo sapiens
gttggccagcacagcttgcaag

SEQ ID NO: 7809826 - DNA, 22 bp, Homo sapiens
ccctggctcaggcagctttgtt

SEQ ID NO: 7809827 - DNA, 22 bp, Homo sapiens
ctggagtagccggacgggtctg

SEQ ID NO: 7809828 - DNA, 22 bp, Homo sapiens
ctggctctatctccaaggctgg

SEQ ID NO: 7809829 - DNA, 22 bp, Homo sapiens
ctggctctgaccgcgctggcct

SEQ ID NO: 7809830 - DNA, 22 bp, Homo sapiens
ctggctctctgatttcacattc

SEQ ID NO: 7809831 - DNA, 22 bp, Homo sapiens
ctggctctattccctaaggatg

SEQ ID NO: 7809832 - DNA, 22 bp, Homo sapiens
ctggctctgtgggacctggcct

SEQ ID NO: 7809833 - DNA, 22 bp, Homo sapiens
ctggctctgtggcttccttcat

SEQ ID NO: 7809834 - DNA, 22 bp, Homo sapiens
ctggctctgtcaccctttctcc

SEQ ID NO: 7809835 - DNA, 23 bp, Homo sapiens
ctggctctgtaggtggcatcctt

SEQ ID NO: 7809836 - DNA, 22 bp, Homo sapiens
ctggctctgagcccacctccag

SEQ ID NO: 7809837 - DNA, 19 bp, Homo sapiens
ctggccacacctgctggtt

SEQ ID NO: 7809838 - DNA, 22 bp, Homo sapiens
ctggccacccatgcctccctga

SEQ ID NO: 7809839 - DNA, 22 bp, Homo sapiens
ctgcctcagccttctgggtgac

SEQ ID NO: 7809840 - DNA, 22 bp, Homo sapiens
ctgcctcagcgttgtggcccta

SEQ ID NO: 7809841 - DNA, 22 bp, Homo sapiens
ctgcctcatgctgcctgcagcc

SEQ ID NO: 7809842 - DNA, 22 bp, Homo sapiens
ctgccatctgagggtccagcct

SEQ ID NO: 7809843 - DNA, 22 bp, Homo sapiens
ttggccagagaccagagcaggg

SEQ ID NO: 7809844 - DNA, 22 bp, Homo sapiens
gacttaagtggtgtgataagtg

SEQ ID NO: 7809845 - DNA, 23 bp, Homo sapiens
ggctcctggattcaaatcctgcc

SEQ ID NO: 7809846 - DNA, 22 bp, Homo sapiens
ggaggaagcacacggcttgtat

SEQ ID NO: 7809847 - DNA, 22 bp, Homo sapiens
ggagaaggaatattggagtagg

SEQ ID NO: 7809848 - DNA, 22 bp, Homo sapiens
gtggccaccctcggcacacaca

SEQ ID NO: 7809849 - DNA, 22 bp, Homo sapiens
tctggaccctgggctgtgattt

SEQ ID NO: 7809850 - DNA, 21 bp, Homo sapiens
tctgcccacactggccactgc

SEQ ID NO: 7809851 - DNA, 22 bp, Homo sapiens
tctgcaacagtgccctgtaaat

SEQ ID NO: 7809852 - DNA, 22 bp, Homo sapiens
tctcgctctgtcgcccaggctg

SEQ ID NO: 7809853 - DNA, 21 bp, Homo sapiens
tctctggaattagaccatgtt

SEQ ID NO: 7809854 - DNA, 22 bp, Homo sapiens
tctctggaagcgcagatctgtt

SEQ ID NO: 7809855 - DNA, 22 bp, Homo sapiens
tcctggctgccgtcgtcctgcg

SEQ ID NO: 7809856 - DNA, 22 bp, Homo sapiens
tcctggctgagttcccaagtcg

SEQ ID NO: 7809857 - DNA, 22 bp, Homo sapiens
tcctggcttccactcctctgtt

SEQ ID NO: 7809858 - DNA, 22 bp, Homo sapiens
tcctggcttctgtctccttatt

SEQ ID NO: 7809859 - DNA, 22 bp, Homo sapiens
tcctggcttcctgctcttgtca

SEQ ID NO: 7809860 - DNA, 22 bp, Homo sapiens
tcctggcttaggtttccagaac

SEQ ID NO: 7809861 - DNA, 21 bp, Homo sapiens
tcctggctttatgctacctct

SEQ ID NO: 7809862 - DNA, 17 bp, Homo sapiens
tcctggctctgccactg

SEQ ID NO: 7809863 - DNA, 22 bp, Homo sapiens
tcctggctctgctgcctcctag

SEQ ID NO: 7809864 - DNA, 22 bp, Homo sapiens
tcctggctctaagtcctgagtg

SEQ ID NO: 7809865 - DNA, 22 bp, Homo sapiens
tcctggctcctggagacctgct

SEQ ID NO: 7809866 - DNA, 22 bp, Homo sapiens
tgcctaggctggagtgtagtgg

SEQ ID NO: 7809867 - DNA, 22 bp, Homo sapiens
tgccacaggcaatccctgcacg

SEQ ID NO: 7809868 - DNA, 23 bp, Homo sapiens
tgacctcatgatccgcccacctc

SEQ ID NO: 7809869 - DNA, 23 bp, Homo sapiens
tggctctgagaggttcagatgct

SEQ ID NO: 7809870 - DNA, 22 bp, Homo sapiens
tggctctgagctgcaaagctgc

SEQ ID NO: 7809871 - DNA, 21 bp, Homo sapiens
tggctctgagcctcatggctg

SEQ ID NO: 7809872 - DNA, 17 bp, Homo sapiens
tggctctgaggctgaat

SEQ ID NO: 7809873 - DNA, 21 bp, Homo sapiens
tggctctgctcagagcagtcc

SEQ ID NO: 7809874 - DNA, 22 bp, Homo sapiens
tggctctgctgaacctagtgca

SEQ ID NO: 7809875 - DNA, 18 bp, Homo sapiens
tggctctggacttgctcc

SEQ ID NO: 7809876 - DNA, 22 bp, Homo sapiens
tggctctggagctcctgggccc

SEQ ID NO: 7809877 - DNA, 22 bp, Homo sapiens
tggctctgccacctttccctaa

SEQ ID NO: 7809878 - DNA, 18 bp, Homo sapiens
tggctctgccactcaccg

SEQ ID NO: 7809879 - DNA, 22 bp, Homo sapiens
tggctctgatcagatgtccagt

SEQ ID NO: 7809880 - DNA, 22 bp, Homo sapiens
tggctctgcacctcagtgtacc

SEQ ID NO: 7809881 - DNA, 18 bp, Homo sapiens
tggctctgcagccagatg

SEQ ID NO: 7809882 - DNA, 19 bp, Homo sapiens
tggctctgtttctctggag

SEQ ID NO: 7809883 - DNA, 22 bp, Homo sapiens
tggctctgttcgccatcaggag

SEQ ID NO: 7809884 - DNA, 22 bp, Homo sapiens
tggctctgttgtgctgagccag

SEQ ID NO: 7809885 - DNA, 22 bp, Homo sapiens
tggctctggagctggcggctga

SEQ ID NO: 7809886 - DNA, 22 bp, Homo sapiens
tggctctggggacagtaagtcc

SEQ ID NO: 7809887 - DNA, 22 bp, Homo sapiens
tggctctgggcaccgtgtccac

SEQ ID NO: 7809888 - DNA, 22 bp, Homo sapiens
tggctctgggaatgggaagatg

SEQ ID NO: 7809889 - DNA, 22 bp, Homo sapiens
tggctctgtgcttctagtatct

SEQ ID NO: 7809890 - DNA, 23 bp, Homo sapiens
tggctctgtggatccctcaggag

SEQ ID NO: 7809891 - DNA, 22 bp, Homo sapiens
tgggactcactcttttggccag

SEQ ID NO: 7809892 - DNA, 22 bp, Homo sapiens
tggcaggagagcgtcagatcag

SEQ ID NO: 7809893 - DNA, 22 bp, Homo sapiens
tggcaggaggttttctccagga

SEQ ID NO: 7809894 - DNA, 18 bp, Homo sapiens
tggcaggaaatgcacttt

SEQ ID NO: 7809895 - DNA, 22 bp, Homo sapiens
tggcaggaaccaggaggctctc

SEQ ID NO: 7809896 - DNA, 22 bp, Homo sapiens
tggccacagcctctgccagttc

SEQ ID NO: 7809897 - DNA, 19 bp, Homo sapiens
tggaacctgtgccagggct

SEQ ID NO: 7809898 - DNA, 23 bp, Homo sapiens
tggtggttgatctggggcacagc

SEQ ID NO: 7809899 - DNA, 22 bp, Homo sapiens
acaggctgagcgtccatcttca

SEQ ID NO: 7809900 - DNA, 22 bp, Homo sapiens
acctggcttcaaccatcatttg

SEQ ID NO: 7809901 - DNA, 22 bp, Homo sapiens
acctggctgttctcatttctag

SEQ ID NO: 7809902 - DNA, 22 bp, Homo sapiens
accacaggaattgctctgtggt

SEQ ID NO: 7809903 - DNA, 22 bp, Homo sapiens
actgcctcttggtgctgagaga

SEQ ID NO: 7809904 - DNA, 19 bp, Homo sapiens
ctggctcttgggtggagga

SEQ ID NO: 7809905 - DNA, 22 bp, Homo sapiens
ctggctcttggctagggagagt

SEQ ID NO: 7809906 - DNA, 22 bp, Homo sapiens
ctggctctttcctagctaggct

SEQ ID NO: 7809907 - DNA, 22 bp, Homo sapiens
cccatcggcaaggtaggtgatt

SEQ ID NO: 7809908 - DNA, 22 bp, Homo sapiens
gcctggctcctaagagcacaac

SEQ ID NO: 7809909 - DNA, 22 bp, Homo sapiens
gcctggctccctctgcagctcc

SEQ ID NO: 7809910 - DNA, 22 bp, Homo sapiens
gcctggctctgagtttctctcc

SEQ ID NO: 7809911 - DNA, 22 bp, Homo sapiens
gcgccccatctacagtactttt

SEQ ID NO: 7809912 - DNA, 22 bp, Homo sapiens
gcctggctcctaaggactggct

SEQ ID NO: 7809913 - DNA, 22 bp, Homo sapiens
atcttcccaggctggggagagg

SEQ ID NO: 7809914 - DNA, 22 bp, Homo sapiens
gtctctgtcttaggccaggcct

SEQ ID NO: 7809915 - DNA, 22 bp, Homo sapiens
cactgcctccccaggctccaca

SEQ ID NO: 7809916 - DNA, 22 bp, Homo sapiens
tcctggctcaggcccctggtgc

SEQ ID NO: 7809917 - DNA, 22 bp, Homo sapiens
tcctggctagttttgctgaaat

SEQ ID NO: 7809918 - DNA, 22 bp, Homo sapiens
ccaccaggcactcacagggaag

SEQ ID NO: 7809919 - DNA, 22 bp, Homo sapiens
tcctggctccactgagcaggcc

SEQ ID NO: 7809920 - DNA, 22 bp, Homo sapiens
tcctggctaatgctgctgatgg

SEQ ID NO: 7809921 - DNA, 22 bp, Homo sapiens
ccacaggctgctgcaggtcccg

SEQ ID NO: 7809922 - DNA, 22 bp, Homo sapiens
cctgcctcccagaggtcctcta

SEQ ID NO: 7809923 - DNA, 23 bp, Homo sapiens
cctgcctccccatcagttataca

SEQ ID NO: 7809924 - DNA, 22 bp, Homo sapiens
cctgcctcatcaacttgtcgtg

SEQ ID NO: 7809925 - DNA, 22 bp, Homo sapiens
cctgcctcaggactctgcatat

SEQ ID NO: 7809926 - DNA, 22 bp, Homo sapiens
ccctggctgcttgtagtctggc

SEQ ID NO: 7809927 - DNA, 22 bp, Homo sapiens
ccctggctgcgtgatggatgaa

SEQ ID NO: 7809928 - DNA, 22 bp, Homo sapiens
ccctggctggaaattaagtagt

SEQ ID NO: 7809929 - DNA, 19 bp, Homo sapiens
ttccaccatcactctgttt

SEQ ID NO: 7809930 - DNA, 22 bp, Homo sapiens
ggcctcacccatcggtgccttt

SEQ ID NO: 7809931 - DNA, 22 bp, Homo sapiens
gtgcctcagcaccgcctgcagc

SEQ ID NO: 7809932 - DNA, 22 bp, Homo sapiens
gcacaggccatgggaggacagc

SEQ ID NO: 7809933 - DNA, 22 bp, Homo sapiens
gccaggttgctgacgacgatct

SEQ ID NO: 7809934 - DNA, 22 bp, Homo sapiens
gcccacaggtcctacctctttc

SEQ ID NO: 7809935 - DNA, 22 bp, Homo sapiens
gcctggctacccactgaaatat

SEQ ID NO: 7809936 - DNA, 22 bp, Homo sapiens
gcctggctaattttggtatttt

SEQ ID NO: 7809937 - DNA, 22 bp, Homo sapiens
gcctggctgctcagccactcac

SEQ ID NO: 7809938 - DNA, 22 bp, Homo sapiens
gcctggctagttagtgtcaggt

SEQ ID NO: 7809939 - DNA, 21 bp, Homo sapiens
gcctggcttcacaggcactga

SEQ ID NO: 7809940 - DNA, 22 bp, Homo sapiens
gcctggcttcccttggagcatt

SEQ ID NO: 7809941 - DNA, 22 bp, Homo sapiens
gcctggcttgccagccctggcg

SEQ ID NO: 7809942 - DNA, 22 bp, Homo sapiens
gcctggcttttgcctcatgttc

SEQ ID NO: 7809943 - DNA, 22 bp, Homo sapiens
gcctggctgggctgaatgctta

SEQ ID NO: 7809944 - DNA, 22 bp, Homo sapiens
gcctggctggtagagggggctc

SEQ ID NO: 7809945 - DNA, 19 bp, Homo sapiens
gcctggctgggatgagccc

SEQ ID NO: 7809946 - DNA, 22 bp, Homo sapiens
gcctggctgtctggcaaggttc

SEQ ID NO: 7809947 - DNA, 22 bp, Homo sapiens
tactgcgccttcaccaagcggc

SEQ ID NO: 7809948 - DNA, 22 bp, Homo sapiens
tagtatagattgaagcagatca

SEQ ID NO: 7809949 - DNA, 22 bp, Homo sapiens
tccacagggatgttgagttctt

SEQ ID NO: 7809950 - DNA, 22 bp, Homo sapiens
tccacaggctgaggcccttctg

SEQ ID NO: 7809951 - DNA, 18 bp, Homo sapiens
tccaccagtcaatctgtc

SEQ ID NO: 7809952 - DNA, 22 bp, Homo sapiens
tccaccagccaggcccaggctg

SEQ ID NO: 7809953 - DNA, 22 bp, Homo sapiens
tccaccaggctccatgttcagt

SEQ ID NO: 7809954 - DNA, 22 bp, Homo sapiens
tccaccagggtttcatctccct

SEQ ID NO: 7809955 - DNA, 22 bp, Homo sapiens
tccaccagagccttcccatgct

SEQ ID NO: 7809956 - DNA, 22 bp, Homo sapiens
tccaccagagccctctttgcgg

SEQ ID NO: 7809957 - DNA, 22 bp, Homo sapiens
tccaccagcagcctgtcagcct

SEQ ID NO: 7809958 - DNA, 22 bp, Homo sapiens
agccacagtcaacctgtccata

SEQ ID NO: 7809959 - DNA, 22 bp, Homo sapiens
acacaggcatagccatacatgt

SEQ ID NO: 7809960 - DNA, 22 bp, Homo sapiens
aaggcttctttgcaggctttag

SEQ ID NO: 7809961 - DNA, 22 bp, Homo sapiens
agcctctgctggccctggcact

SEQ ID NO: 7809962 - DNA, 23 bp, Homo sapiens
cactgccttcagttgcttcacct

SEQ ID NO: 7809963 - DNA, 22 bp, Homo sapiens
cactgctacctctgcctcccgg

SEQ ID NO: 7809964 - DNA, 22 bp, Homo sapiens
acaggcaggagctccccattcc

SEQ ID NO: 7809965 - DNA, 22 bp, Homo sapiens
ccgcccacactaaatatgagcg

SEQ ID NO: 7809966 - DNA, 22 bp, Homo sapiens
aggctctgtgatccacaatgag

SEQ ID NO: 7809967 - DNA, 22 bp, Homo sapiens
aggctctgtgcagcctgcatct

SEQ ID NO: 7809968 - DNA, 22 bp, Homo sapiens
aggctctgtgcatcctccccaa

SEQ ID NO: 7809969 - DNA, 22 bp, Homo sapiens
aggtctgggcaccactggctgc

SEQ ID NO: 7809970 - DNA, 22 bp, Homo sapiens
atggctctgagaacctgagcta

SEQ ID NO: 7809971 - DNA, 20 bp, Homo sapiens
atggctctgattctgagccc

SEQ ID NO: 7809972 - DNA, 22 bp, Homo sapiens
atggctctctccttactgctgc

SEQ ID NO: 7809973 - DNA, 19 bp, Homo sapiens
atggctctgggatcactgc

SEQ ID NO: 7809974 - DNA, 22 bp, Homo sapiens
atggctcttgaattgatactct

SEQ ID NO: 7809975 - DNA, 22 bp, Homo sapiens
atggctctatctagaattctgg

SEQ ID NO: 7809976 - DNA, 20 bp, Homo sapiens
cacctggctgactgtctcca

SEQ ID NO: 7809977 - DNA, 22 bp, Homo sapiens
cacctggctgtgaagcctgggt

SEQ ID NO: 7809978 - DNA, 22 bp, Homo sapiens
cacctggctggaagtgctccgg

SEQ ID NO: 7809979 - DNA, 23 bp, Homo sapiens
cacctggcttgagttggtgggtc

SEQ ID NO: 7809980 - DNA, 22 bp, Homo sapiens
cacctggcagctgttggccacg

SEQ ID NO: 7809981 - DNA, 20 bp, Homo sapiens
cagtccactggagttcctac

SEQ ID NO: 7809982 - DNA, 22 bp, Homo sapiens
tccacaggtcctctttgcaaag

SEQ ID NO: 7809983 - DNA, 22 bp, Homo sapiens
tggcctcaatctgtcctccagc

SEQ ID NO: 7809984 - DNA, 22 bp, Homo sapiens
tggctctgaccaggtagaggag

SEQ ID NO: 7809985 - DNA, 21 bp, Homo sapiens
tggctctgaaagagtgctgca

SEQ ID NO: 7809986 - DNA, 22 bp, Homo sapiens
ccagggtctctgctgcctgaga

SEQ ID NO: 7809987 - DNA, 22 bp, Homo sapiens
cccacaggccctgctgccttga

SEQ ID NO: 7809988 - DNA, 22 bp, Homo sapiens
cccacaggcaggggcagagaca

SEQ ID NO: 7809989 - DNA, 22 bp, Homo sapiens
cccacagggctgctgatggcag

SEQ ID NO: 7809990 - DNA, 22 bp, Homo sapiens
cccacaggctaggggtagggca

SEQ ID NO: 7809991 - DNA, 22 bp, Homo sapiens
cccacaggtggaagcctcggaa

SEQ ID NO: 7809992 - DNA, 22 bp, Homo sapiens
cccaccagtacagatggtagat

SEQ ID NO: 7809993 - DNA, 22 bp, Homo sapiens
cccaccagccatctgagagtgt

SEQ ID NO: 7809994 - DNA, 22 bp, Homo sapiens
ctctgcactgtccggctttctt

SEQ ID NO: 7809995 - DNA, 22 bp, Homo sapiens
ctgccccagcctggggccttct

SEQ ID NO: 7809996 - DNA, 22 bp, Homo sapiens
gacctggcctgcacagccctta

SEQ ID NO: 7809997 - DNA, 23 bp, Homo sapiens
gacctggctttgaatcttgactc

SEQ ID NO: 7809998 - DNA, 23 bp, Homo sapiens
gctgcctctgttggtcttcagtt

SEQ ID NO: 7809999 - DNA, 22 bp, Homo sapiens
gctgcctctgcgactctgggcg

SEQ ID NO: 7810000 - DNA, 22 bp, Homo sapiens
gctgcctctgtagctttggacc

SEQ ID NO: 7810001 - DNA, 22 bp, Homo sapiens
gctgcctctgcacagctcactc

SEQ ID NO: 7810002 - DNA, 22 bp, Homo sapiens
gctgcctcctgagatttgggca

SEQ ID NO: 7810003 - DNA, 22 bp, Homo sapiens
gctgcctctcctgagttgacag

SEQ ID NO: 7810004 - DNA, 22 bp, Homo sapiens
gctgcctcctgaaagcgctctg

SEQ ID NO: 7810005 - DNA, 22 bp, Homo sapiens
gctgcctcccccatggctggaa

SEQ ID NO: 7810006 - DNA, 22 bp, Homo sapiens
gctgcctccgccggctccacag

SEQ ID NO: 7810007 - DNA, 22 bp, Homo sapiens
gctgcctccactggctcccagt

SEQ ID NO: 7810008 - DNA, 22 bp, Homo sapiens
gctgcctcccagagccctgcag

SEQ ID NO: 7810009 - DNA, 22 bp, Homo sapiens
ggccacagagggcgggatgctg

SEQ ID NO: 7810010 - DNA, 20 bp, Homo sapiens
ggccacagggtgctggtgga

SEQ ID NO: 7810011 - DNA, 22 bp, Homo sapiens
ggccacagggctgaacgtggac

SEQ ID NO: 7810012 - DNA, 22 bp, Homo sapiens
ggctctgccatttcctagctgc

SEQ ID NO: 7810013 - DNA, 22 bp, Homo sapiens
ggctctgccacttcttggctgt

SEQ ID NO: 7810014 - DNA, 22 bp, Homo sapiens
aggctctggagttagccaggca

SEQ ID NO: 7810015 - DNA, 22 bp, Homo sapiens
aggctctggagtgtggtgctgg

SEQ ID NO: 7810016 - DNA, 22 bp, Homo sapiens
aggctctgacgtcacacgtggc

SEQ ID NO: 7810017 - DNA, 22 bp, Homo sapiens
aggctctgacccatgggaccca

SEQ ID NO: 7810018 - DNA, 22 bp, Homo sapiens
aggctctgaaggagaacctgtt

SEQ ID NO: 7810019 - DNA, 22 bp, Homo sapiens
accacaggacccatgagtcagt

SEQ ID NO: 7810020 - DNA, 22 bp, Homo sapiens
aggctctggcaacagctggtgt

SEQ ID NO: 7810021 - DNA, 22 bp, Homo sapiens
ccagccagtatattccaaagcc

SEQ ID NO: 7810022 - DNA, 19 bp, Homo sapiens
aggctctgtaggagagggc

SEQ ID NO: 7810023 - DNA, 22 bp, Homo sapiens
aggctctgcttttctggatata

SEQ ID NO: 7810024 - DNA, 22 bp, Homo sapiens
aggctctgtcaggcggagcagc

SEQ ID NO: 7810025 - DNA, 22 bp, Homo sapiens
ctaggtgatccactgctctctt

SEQ ID NO: 7810026 - DNA, 22 bp, Homo sapiens
ctctgcgccaccctcgcctgct

SEQ ID NO: 7810027 - DNA, 22 bp, Homo sapiens
gcccacagtgtagcaggtactc

SEQ ID NO: 7810028 - DNA, 22 bp, Homo sapiens
gccacaggtcggctagagggtc

SEQ ID NO: 7810029 - DNA, 22 bp, Homo sapiens
gccacaggtaggaacctacctc

SEQ ID NO: 7810030 - DNA, 21 bp, Homo sapiens
ccagggtccagctgccatggt

SEQ ID NO: 7810031 - DNA, 18 bp, Homo sapiens
cccggctaatttttggta

SEQ ID NO: 7810032 - DNA, 22 bp, Homo sapiens
cccagggttgcctgcctctgct

SEQ ID NO: 7810033 - DNA, 19 bp, Homo sapiens
cccagggtttcctctctcc

SEQ ID NO: 7810034 - DNA, 22 bp, Homo sapiens
cccagggtccggataaccctgg

SEQ ID NO: 7810035 - DNA, 22 bp, Homo sapiens
cccagggtccctgctctctgtg

SEQ ID NO: 7810036 - DNA, 22 bp, Homo sapiens
cccagggtagctgagctggcag

SEQ ID NO: 7810037 - DNA, 22 bp, Homo sapiens
tggctctgagacacaggctctc

SEQ ID NO: 7810038 - DNA, 21 bp, Homo sapiens
tggctctgggtaggagagtgc

SEQ ID NO: 7810039 - DNA, 22 bp, Homo sapiens
tggctctgtcaaactgcacaca

SEQ ID NO: 7810040 - DNA, 17 bp, Homo sapiens
tggctctgtcctcagct

SEQ ID NO: 7810041 - DNA, 22 bp, Homo sapiens
tcctggctccagcagctcttcc

SEQ ID NO: 7810042 - DNA, 22 bp, Homo sapiens
ctggccactgattcctcccctg

SEQ ID NO: 7810043 - DNA, 22 bp, Homo sapiens
ctggccactgcacctcttcctt

SEQ ID NO: 7810044 - DNA, 21 bp, Homo sapiens
ctggccactgcacctcttcct

SEQ ID NO: 7810045 - DNA, 22 bp, Homo sapiens
ctggctcttgcgactcagcttg

SEQ ID NO: 7810046 - DNA, 22 bp, Homo sapiens
ggctctgctgcacccttggctc

SEQ ID NO: 7810047 - DNA, 22 bp, Homo sapiens
gccaccagtgggggcctgggca

SEQ ID NO: 7810048 - DNA, 22 bp, Homo sapiens
gccaccaggttctgggttaagc

SEQ ID NO: 7810049 - DNA, 22 bp, Homo sapiens
gccacaggcttaggagggaggt

SEQ ID NO: 7810050 - DNA, 22 bp, Homo sapiens
gcacaggctccggaggagagct

SEQ ID NO: 7810051 - DNA, 22 bp, Homo sapiens
gctgcctcaggcacctcctggc

SEQ ID NO: 7810052 - DNA, 22 bp, Homo sapiens
gctgcctccaatctgtgccccg

SEQ ID NO: 7810053 - DNA, 22 bp, Homo sapiens
gctgcctcactccagcccaata

SEQ ID NO: 7810054 - DNA, 22 bp, Homo sapiens
tcacaggcttgtgaacattgca

SEQ ID NO: 7810055 - DNA, 22 bp, Homo sapiens
tcacaggctctccaccatgagg

SEQ ID NO: 7810056 - DNA, 22 bp, Homo sapiens
tcacaggcccaaaccacgctta

SEQ ID NO: 7810057 - DNA, 19 bp, Homo sapiens
tcacaggcatctccccaga

SEQ ID NO: 7810058 - DNA, 22 bp, Homo sapiens
tgtggccagccacaggcatggt

SEQ ID NO: 7810059 - DNA, 22 bp, Homo sapiens
gccacaggtaggaacctacctc

SEQ ID NO: 7810060 - DNA, 22 bp, Homo sapiens
gccacaggtaggaacctacctc

SEQ ID NO: 7810061 - DNA, 22 bp, Homo sapiens
gccacaggtactatgggagaga

SEQ ID NO: 7810062 - DNA, 22 bp, Homo sapiens
gccacaggtactatgggagaga

SEQ ID NO: 7810063 - DNA, 22 bp, Homo sapiens
gccacaggtcggctagagggtc

SEQ ID NO: 7810064 - DNA, 22 bp, Homo sapiens
gccacaggtcggctagagggtc

SEQ ID NO: 7810065 - DNA, 22 bp, Homo sapiens
gccacaggtaggaacctacctc

SEQ ID NO: 7810066 - DNA, 22 bp, Homo sapiens
gccacaggtcggctagagggtc

SEQ ID NO: 7810067 - DNA, 22 bp, Homo sapiens
gccacaggtactatgggagaga

SEQ ID NO: 7810068 - DNA, 22 bp, Homo sapiens
gccacaggtactatgggagaga

SEQ ID NO: 7810069 - DNA, 22 bp, Homo sapiens
gccacaggtactatgggagaga

SEQ ID NO: 7810070 - DNA, 22 bp, Homo sapiens
gccacagggcgagcggaggcca

SEQ ID NO: 7810071 - DNA, 22 bp, Homo sapiens
gccacaggtactatgggagaga

SEQ ID NO: 7810072 - DNA, 22 bp, Homo sapiens
gccacaggtgggctctgggaaa

SEQ ID NO: 7810073 - DNA, 22 bp, Homo sapiens
gccacagtcactgctgcagggg

SEQ ID NO: 7810074 - DNA, 22 bp, Homo sapiens
gccacagtcactgctgcagggg

SEQ ID NO: 7810075 - DNA, 22 bp, Homo sapiens
gccacagtcactgctgcagggg

SEQ ID NO: 7810076 - DNA, 22 bp, Homo sapiens
gccacaggtgggctctgggaaa

SEQ ID NO: 7810077 - DNA, 22 bp, Homo sapiens
gccacaggtgggctctgggaaa

SEQ ID NO: 7810078 - DNA, 22 bp, Homo sapiens
gccacaggtggaattaagaaat

SEQ ID NO: 7810079 - DNA, 19 bp, Homo sapiens
gccaggcctggacctgcag

SEQ ID NO: 7810080 - DNA, 19 bp, Homo sapiens
gccaggcctggacctgcag

SEQ ID NO: 7810081 - DNA, 19 bp, Homo sapiens
gccaggcctggacctgcag

SEQ ID NO: 7810082 - DNA, 22 bp, Homo sapiens
gccaggcgggtctcaaactcct

SEQ ID NO: 7810083 - DNA, 22 bp, Homo sapiens
gccaggctgctggctgctgtcc

SEQ ID NO: 7810084 - DNA, 22 bp, Homo sapiens
gccaggctggaaagaacagaca

SEQ ID NO: 7810085 - DNA, 22 bp, Homo sapiens
gccaggctggaaagaacagaca

SEQ ID NO: 7810086 - DNA, 22 bp, Homo sapiens
gccaggctggaaagaacagaca

SEQ ID NO: 7810087 - DNA, 22 bp, Homo sapiens
gccaggctgctggctgctgtcc

SEQ ID NO: 7810088 - DNA, 22 bp, Homo sapiens
gccaggctggaaagaacagaca

SEQ ID NO: 7810089 - DNA, 22 bp, Homo sapiens
gccaggctggaaagaacagaca

SEQ ID NO: 7810090 - DNA, 22 bp, Homo sapiens
gccaggctggccagcaccttct

SEQ ID NO: 7810091 - DNA, 22 bp, Homo sapiens
gccaggctggcaaaaggaaacc

SEQ ID NO: 7810092 - DNA, 22 bp, Homo sapiens
gccaggctggcaaaaggaaacc

SEQ ID NO: 7810093 - DNA, 22 bp, Homo sapiens
gccaggctggcaaaaggaaacc

SEQ ID NO: 7810094 - DNA, 22 bp, Homo sapiens
gccaggctggccagcaccttct

SEQ ID NO: 7810095 - DNA, 22 bp, Homo sapiens
gccaggctggggggagatgtct

SEQ ID NO: 7810096 - DNA, 22 bp, Homo sapiens
gccaggctggggggagatgtct

SEQ ID NO: 7810097 - DNA, 22 bp, Homo sapiens
gccaggctggtcttgaactcct

SEQ ID NO: 7810098 - DNA, 22 bp, Homo sapiens
gccaggctggggggagatgtct

SEQ ID NO: 7810099 - DNA, 22 bp, Homo sapiens
gccaggctggggggagatgtct

SEQ ID NO: 7810100 - DNA, 22 bp, Homo sapiens
gccaggctggccagcaccttct

SEQ ID NO: 7810101 - DNA, 22 bp, Homo sapiens
gccaggctggccagcaccttct

SEQ ID NO: 7810102 - DNA, 22 bp, Homo sapiens
gccaggctggtgcaaggatatt

SEQ ID NO: 7810103 - DNA, 22 bp, Homo sapiens
gccaggctggtgcaaggatatt

SEQ ID NO: 7810104 - DNA, 22 bp, Homo sapiens
gccaggctggtcttgaactcct

SEQ ID NO: 7810105 - DNA, 22 bp, Homo sapiens
gccaggctggtcttgaactcct

SEQ ID NO: 7810106 - DNA, 22 bp, Homo sapiens
gccaggctggtcttgaactcct

SEQ ID NO: 7810107 - DNA, 22 bp, Homo sapiens
gccaggtgcatattagaagcat

SEQ ID NO: 7810108 - DNA, 22 bp, Homo sapiens
gccaggtgcatggctgagtctc

SEQ ID NO: 7810109 - DNA, 22 bp, Homo sapiens
gccaggtgcatggctgagtctc

SEQ ID NO: 7810110 - DNA, 22 bp, Homo sapiens
gccaggtgcatattagaagcat

SEQ ID NO: 7810111 - DNA, 22 bp, Homo sapiens
gccaggtgcatggctgagtctc

SEQ ID NO: 7810112 - DNA, 22 bp, Homo sapiens
gccaggtggaggttgcagtgag

SEQ ID NO: 7810113 - DNA, 22 bp, Homo sapiens
gccaggtggaggttgcagtgag

SEQ ID NO: 7810114 - DNA, 22 bp, Homo sapiens
gccaggtggaggttgcagtgag

SEQ ID NO: 7810115 - DNA, 22 bp, Homo sapiens
gccaggtggaggttgcagtgag

SEQ ID NO: 7810116 - DNA, 22 bp, Homo sapiens
gccaggtgctatccctgcgctg

SEQ ID NO: 7810117 - DNA, 22 bp, Homo sapiens
gccaggtgctatccctgcgctg

SEQ ID NO: 7810118 - DNA, 22 bp, Homo sapiens
gccaggtgcatggctgagtctc

SEQ ID NO: 7810119 - DNA, 22 bp, Homo sapiens
gccaggtgcatggctgagtctc

SEQ ID NO: 7810120 - DNA, 19 bp, Homo sapiens
gccaggtcttgggtccagg

SEQ ID NO: 7810121 - DNA, 19 bp, Homo sapiens
gccaggtcttgggtccagg

SEQ ID NO: 7810122 - DNA, 19 bp, Homo sapiens
gccaggtcttgggtccagg

SEQ ID NO: 7810123 - DNA, 22 bp, Homo sapiens
gccaggtgagaggactgaggct

SEQ ID NO: 7810124 - DNA, 22 bp, Homo sapiens
gccaggtgagaggactgaggct

SEQ ID NO: 7810125 - DNA, 22 bp, Homo sapiens
gccaggtctgggtagcagagga

SEQ ID NO: 7810126 - DNA, 22 bp, Homo sapiens
gccaggctggtgcaaggatatt

SEQ ID NO: 7810127 - DNA, 22 bp, Homo sapiens
gccaggctggtgcaaggatatt

SEQ ID NO: 7810128 - DNA, 22 bp, Homo sapiens
gccaggtgagaggactgaggct

SEQ ID NO: 7810129 - DNA, 22 bp, Homo sapiens
gccaggtgagaggactgaggct

SEQ ID NO: 7810130 - DNA, 22 bp, Homo sapiens
gccaggtgagaggactgaggct

SEQ ID NO: 7810131 - DNA, 22 bp, Homo sapiens
gccaggtgcacctgccctggcc

SEQ ID NO: 7810132 - DNA, 22 bp, Homo sapiens
gccaggtgcacctgccctggcc

SEQ ID NO: 7810133 - DNA, 22 bp, Homo sapiens
gccaggtgcacctgccctggcc

SEQ ID NO: 7810134 - DNA, 22 bp, Homo sapiens
gccaggtgatttcaaagtcctt

SEQ ID NO: 7810135 - DNA, 22 bp, Homo sapiens
atttcatgttgatctttcgagg

SEQ ID NO: 7810136 - DNA, 22 bp, Homo sapiens
atttcatgttgatctttcgagg

SEQ ID NO: 7810137 - DNA, 22 bp, Homo sapiens
atttcatgtttcatctacctaa

SEQ ID NO: 7810138 - DNA, 22 bp, Homo sapiens
atttcatgtttcatctacctaa

SEQ ID NO: 7810139 - DNA, 22 bp, Homo sapiens
gccaggtggctgagcagctgca

SEQ ID NO: 7810140 - DNA, 22 bp, Homo sapiens
atttcatgttaactgaacagaa

SEQ ID NO: 7810141 - DNA, 22 bp, Homo sapiens
atttcatgttaactgaacagaa

SEQ ID NO: 7810142 - DNA, 22 bp, Homo sapiens
gccaggtggctgagcagctgca

SEQ ID NO: 7810143 - DNA, 22 bp, Homo sapiens
gccaggtggaggttgcagtgag

SEQ ID NO: 7810144 - DNA, 22 bp, Homo sapiens
gccaggtggctgagcagctgca

SEQ ID NO: 7810145 - DNA, 22 bp, Homo sapiens
gccaggtggaggttgcagtgag

SEQ ID NO: 7810146 - DNA, 22 bp, Homo sapiens
atttccagtactattttctgct

SEQ ID NO: 7810147 - DNA, 22 bp, Homo sapiens
atttccagtcctaatgatctgg

SEQ ID NO: 7810148 - DNA, 22 bp, Homo sapiens
atttccagtgcactgaatagaa

SEQ ID NO: 7810149 - DNA, 22 bp, Homo sapiens
atttccagtgcactgaatagaa

SEQ ID NO: 7810150 - DNA, 22 bp, Homo sapiens
atttccagtacccagaacagag

SEQ ID NO: 7810151 - DNA, 22 bp, Homo sapiens
atttccagtactattttctgct

SEQ ID NO: 7810152 - DNA, 22 bp, Homo sapiens
atttccagtacccagaacagag

SEQ ID NO: 7810153 - DNA, 22 bp, Homo sapiens
gcccacagtgtagcaggtactc

SEQ ID NO: 7810154 - DNA, 22 bp, Homo sapiens
gcccacagtgtagcaggtactc

SEQ ID NO: 7810155 - DNA, 21 bp, Homo sapiens
gcccacagtgaggaggatccc

SEQ ID NO: 7810156 - DNA, 22 bp, Homo sapiens
gcccacagtgtagcaggtactc

SEQ ID NO: 7810157 - DNA, 22 bp, Homo sapiens
gcccacagtgtagcaggtactc

SEQ ID NO: 7810158 - DNA, 22 bp, Homo sapiens
gcccacagttaatgggggctct

SEQ ID NO: 7810159 - DNA, 22 bp, Homo sapiens
gcccacagtctatcagtttgcg

SEQ ID NO: 7810160 - DNA, 21 bp, Homo sapiens
gcccacagtgaggaggatccc

SEQ ID NO: 7810161 - DNA, 21 bp, Homo sapiens
gcccacagtgaggaggatccc

SEQ ID NO: 7810162 - DNA, 21 bp, Homo sapiens
gcccacagtgaggaggatccc

SEQ ID NO: 7810163 - DNA, 17 bp, Homo sapiens
gcccacccttaggagct

SEQ ID NO: 7810164 - DNA, 17 bp, Homo sapiens
gcccacccttaggagct

SEQ ID NO: 7810165 - DNA, 17 bp, Homo sapiens
gcccacccttaggagct

SEQ ID NO: 7810166 - DNA, 17 bp, Homo sapiens
gcccacccttaggagct

SEQ ID NO: 7810167 - DNA, 17 bp, Homo sapiens
gcccacccttaggagct

SEQ ID NO: 7810168 - DNA, 23 bp, Homo sapiens
gcccaccctcagcgtcctcacgg

SEQ ID NO: 7810169 - DNA, 23 bp, Homo sapiens
gcccaccctcagcgtcctcacgg

SEQ ID NO: 7810170 - DNA, 23 bp, Homo sapiens
gcccaccctcagcgtcctcacgg

SEQ ID NO: 7810171 - DNA, 23 bp, Homo sapiens
gcccaccctcagcgtcctcacgg

SEQ ID NO: 7810172 - DNA, 23 bp, Homo sapiens
gcccacattggtgcatgaatgtt

SEQ ID NO: 7810173 - DNA, 22 bp, Homo sapiens
gcccacatttttggcttagagg

SEQ ID NO: 7810174 - DNA, 22 bp, Homo sapiens
gcccacatttttggcttagagg

SEQ ID NO: 7810175 - DNA, 22 bp, Homo sapiens
gcccacagttagtttgcatggc

SEQ ID NO: 7810176 - DNA, 22 bp, Homo sapiens
atttccagtgcactgaatagaa

SEQ ID NO: 7810177 - DNA, 22 bp, Homo sapiens
atttccatgaaggcagatttta

SEQ ID NO: 7810178 - DNA, 22 bp, Homo sapiens
atttccatagagcgtctcacag

SEQ ID NO: 7810179 - DNA, 22 bp, Homo sapiens
atttccatgaattcccactcat

SEQ ID NO: 7810180 - DNA, 22 bp, Homo sapiens
atttccatgccttagcttaagg

SEQ ID NO: 7810181 - DNA, 22 bp, Homo sapiens
atttccatgccttagcttaagg

SEQ ID NO: 7810182 - DNA, 22 bp, Homo sapiens
atttccatgtccaaaaattagt

SEQ ID NO: 7810183 - DNA, 22 bp, Homo sapiens
atttcccaatacgctaagtgga

SEQ ID NO: 7810184 - DNA, 22 bp, Homo sapiens
gcccacagtctatcagtttgcg

SEQ ID NO: 7810185 - DNA, 22 bp, Homo sapiens
atttcccaacacattagaaaat

SEQ ID NO: 7810186 - DNA, 22 bp, Homo sapiens
atttcccaacacattagaaaat

SEQ ID NO: 7810187 - DNA, 22 bp, Homo sapiens
atttccattttcagccattact

SEQ ID NO: 7810188 - DNA, 22 bp, Homo sapiens
atttccattttcagccattact

SEQ ID NO: 7810189 - DNA, 22 bp, Homo sapiens
atttccattatcatgacaaatt

SEQ ID NO: 7810190 - DNA, 22 bp, Homo sapiens
atttccattatcatgacaaatt

SEQ ID NO: 7810191 - DNA, 22 bp, Homo sapiens
atttccatgtcggtattttata

SEQ ID NO: 7810192 - DNA, 22 bp, Homo sapiens
atttccattatcatgacaaatt

SEQ ID NO: 7810193 - DNA, 22 bp, Homo sapiens
gcccacctaacctgctcacctt

SEQ ID NO: 7810194 - DNA, 17 bp, Homo sapiens
gcccacccttaggagct

SEQ ID NO: 7810195 - DNA, 22 bp, Homo sapiens
atttctcagtgtacattatgtt

SEQ ID NO: 7810196 - DNA, 22 bp, Homo sapiens
gcccacctaacctgctcacctt

SEQ ID NO: 7810197 - DNA, 22 bp, Homo sapiens
atttctcagtgtgatcaggcct

SEQ ID NO: 7810198 - DNA, 22 bp, Homo sapiens
atttctcagtgtgatcaggcct

SEQ ID NO: 7810199 - DNA, 22 bp, Homo sapiens
atttctgatacccggtcaccct

SEQ ID NO: 7810200 - DNA, 22 bp, Homo sapiens
atttctcagttcctactgttta

SEQ ID NO: 7810201 - DNA, 22 bp, Homo sapiens
atttctgataaacgtaagctgc

SEQ ID NO: 7810202 - DNA, 22 bp, Homo sapiens
atttctgccaaagtggggacct

SEQ ID NO: 7810203 - DNA, 22 bp, Homo sapiens
atttctgctactgcaccctagt

SEQ ID NO: 7810204 - DNA, 22 bp, Homo sapiens
atttctgcatctctggagatct

SEQ ID NO: 7810205 - DNA, 22 bp, Homo sapiens
atttctgatagtaaaggtcttt

SEQ ID NO: 7810206 - DNA, 22 bp, Homo sapiens
atttctggctgttggaaagttc

SEQ ID NO: 7810207 - DNA, 22 bp, Homo sapiens
atttctggactgaaaaggaagt

SEQ ID NO: 7810208 - DNA, 22 bp, Homo sapiens
atttctgctctgacctgaaagt

SEQ ID NO: 7810209 - DNA, 22 bp, Homo sapiens
atttctgtagtccacattcttt

SEQ ID NO: 7810210 - DNA, 22 bp, Homo sapiens
atttctgtagtccacattcttt

SEQ ID NO: 7810211 - DNA, 22 bp, Homo sapiens
atttctgtagtccacattcttt

SEQ ID NO: 7810212 - DNA, 22 bp, Homo sapiens
atttctgtaacttatgaaagtt

SEQ ID NO: 7810213 - DNA, 22 bp, Homo sapiens
atttctgtaacttatgaaagtt

SEQ ID NO: 7810214 - DNA, 22 bp, Homo sapiens
atttctgtaacttatgaaagtt

SEQ ID NO: 7810215 - DNA, 22 bp, Homo sapiens
atttctgttgcttataaattac

SEQ ID NO: 7810216 - DNA, 22 bp, Homo sapiens
gccccaggttgcctgtcccagg

SEQ ID NO: 7810217 - DNA, 22 bp, Homo sapiens
gccccaggttgcctgtcccagg

SEQ ID NO: 7810218 - DNA, 22 bp, Homo sapiens
atttctgttgcttataaattac

SEQ ID NO: 7810219 - DNA, 22 bp, Homo sapiens
atttctgttgcttataaattac

SEQ ID NO: 7810220 - DNA, 22 bp, Homo sapiens
gccccaggttgcctgtcccagg

SEQ ID NO: 7810221 - DNA, 22 bp, Homo sapiens
gcccccacaggcgggctcgggt

SEQ ID NO: 7810222 - DNA, 22 bp, Homo sapiens
gccccaggttgcctgtcccagg

SEQ ID NO: 7810223 - DNA, 17 bp, Homo sapiens
gcccccagaaatctcag

SEQ ID NO: 7810224 - DNA, 17 bp, Homo sapiens
gcccccagaaatctcag

SEQ ID NO: 7810225 - DNA, 17 bp, Homo sapiens
gcccccagaaatctcag

SEQ ID NO: 7810226 - DNA, 22 bp, Homo sapiens
atttctgtggcttcattctcct

SEQ ID NO: 7810227 - DNA, 22 bp, Homo sapiens
atttctgttatacctttctcag

SEQ ID NO: 7810228 - DNA, 22 bp, Homo sapiens
atttctgtatcctgctgtcaga

SEQ ID NO: 7810229 - DNA, 22 bp, Homo sapiens
atttctgtgcagtaaatggtga

SEQ ID NO: 7810230 - DNA, 22 bp, Homo sapiens
atttctgtgcagtaaatggtga

SEQ ID NO: 7810231 - DNA, 22 bp, Homo sapiens
atttggaaatgcatctcttgag

SEQ ID NO: 7810232 - DNA, 22 bp, Homo sapiens
atttggaaatgcatctcttgag

SEQ ID NO: 7810233 - DNA, 22 bp, Homo sapiens
atttggaaatacgcgcttttgg

SEQ ID NO: 7810234 - DNA, 19 bp, Homo sapiens
atttggaaataaggtcttc

SEQ ID NO: 7810235 - DNA, 22 bp, Homo sapiens
atttggaaatacgcgcttttgg

SEQ ID NO: 7810236 - DNA, 22 bp, Homo sapiens
atttggaaacatgctgaccatg

SEQ ID NO: 7810237 - DNA, 22 bp, Homo sapiens
atttggaaacatgctgaccatg

SEQ ID NO: 7810238 - DNA, 19 bp, Homo sapiens
atttggaaataaggtcttc

SEQ ID NO: 7810239 - DNA, 22 bp, Homo sapiens
atttggaaacaattatattctt

SEQ ID NO: 7810240 - DNA, 22 bp, Homo sapiens
atttggaaacaattatattctt

SEQ ID NO: 7810241 - DNA, 22 bp, Homo sapiens
atttggaaacaaatggtttcgc

SEQ ID NO: 7810242 - DNA, 22 bp, Homo sapiens
atttggaaacaaatggtttcgc

SEQ ID NO: 7810243 - DNA, 22 bp, Homo sapiens
atttggaaacaattatattctt

SEQ ID NO: 7810244 - DNA, 22 bp, Homo sapiens
atttggaaaatctggttataga

SEQ ID NO: 7810245 - DNA, 22 bp, Homo sapiens
atttggaaaatctggttataga

SEQ ID NO: 7810246 - DNA, 22 bp, Homo sapiens
atttggaaaatctggttataga

SEQ ID NO: 7810247 - DNA, 22 bp, Homo sapiens
gccccctcaaagaggaagctct

SEQ ID NO: 7810248 - DNA, 22 bp, Homo sapiens
atttgccttttaaactcacaat

SEQ ID NO: 7810249 - DNA, 22 bp, Homo sapiens
atttgctctagctgcagtgaat

SEQ ID NO: 7810250 - DNA, 22 bp, Homo sapiens
atttggaaaagcggtaacttgc

SEQ ID NO: 7810251 - DNA, 22 bp, Homo sapiens
atttggaaaagcggtaacttgc

SEQ ID NO: 7810252 - DNA, 22 bp, Homo sapiens
atttggaaaatctggttataga

SEQ ID NO: 7810253 - DNA, 22 bp, Homo sapiens
atttggaaaagtttcttcaact

SEQ ID NO: 7810254 - DNA, 22 bp, Homo sapiens
atttggaaaagcggtaacttgc

SEQ ID NO: 7810255 - DNA, 22 bp, Homo sapiens
atttggaaaagtttcttcaact

SEQ ID NO: 7810256 - DNA, 22 bp, Homo sapiens
gcccccagctctcaagctcaaa

SEQ ID NO: 7810257 - DNA, 22 bp, Homo sapiens
gcccccagctctcaagctcaaa

SEQ ID NO: 7810258 - DNA, 22 bp, Homo sapiens
gcccccaggctctggagaacct

SEQ ID NO: 7810259 - DNA, 22 bp, Homo sapiens
gcccccaggctctggagaacct

SEQ ID NO: 7810260 - DNA, 22 bp, Homo sapiens
gcccccgtagtagatgaggcgc

SEQ ID NO: 7810261 - DNA, 22 bp, Homo sapiens
gcccccgtagtagatgaggcgc

SEQ ID NO: 7810262 - DNA, 22 bp, Homo sapiens
gcccccaggtgacttatccaca

SEQ ID NO: 7810263 - DNA, 22 bp, Homo sapiens
gcccccagacctcagtgggctg

SEQ ID NO: 7810264 - DNA, 22 bp, Homo sapiens
gcccccagagaatgaggtacga

SEQ ID NO: 7810265 - DNA, 18 bp, Homo sapiens
gcccccagatgctactga

SEQ ID NO: 7810266 - DNA, 18 bp, Homo sapiens
gcccccagatgctactga

SEQ ID NO: 7810267 - DNA, 22 bp, Homo sapiens
gcccccagctctcaagctcaaa

SEQ ID NO: 7810268 - DNA, 22 bp, Homo sapiens
gcccccagaagggccacagatt

SEQ ID NO: 7810269 - DNA, 22 bp, Homo sapiens
gcccccagaagggccacagatt

SEQ ID NO: 7810270 - DNA, 22 bp, Homo sapiens
gcccccagaagggccacagatt

SEQ ID NO: 7810271 - DNA, 22 bp, Homo sapiens
gcccccagaagggccacagatt

SEQ ID NO: 7810272 - DNA, 22 bp, Homo sapiens
gcccccagaagggccacagatt

SEQ ID NO: 7810273 - DNA, 22 bp, Homo sapiens
gcccccagaagggccacagatt

SEQ ID NO: 7810274 - DNA, 22 bp, Homo sapiens
gcccccagaagggccacagatt

SEQ ID NO: 7810275 - DNA, 22 bp, Homo sapiens
gcctattaaagagcttggagca

SEQ ID NO: 7810276 - DNA, 22 bp, Homo sapiens
gcctattatcagagctagtgat

SEQ ID NO: 7810277 - DNA, 22 bp, Homo sapiens
gcctcaaatgtggagcactatt

SEQ ID NO: 7810278 - DNA, 19 bp, Homo sapiens
gcctatgtcttcaaatcat

SEQ ID NO: 7810279 - DNA, 19 bp, Homo sapiens
gcctatgtcttcaaatcat

SEQ ID NO: 7810280 - DNA, 22 bp, Homo sapiens
gcctatggattggagaaggagc

SEQ ID NO: 7810281 - DNA, 22 bp, Homo sapiens
gcctatatgttaataggaggga

SEQ ID NO: 7810282 - DNA, 22 bp, Homo sapiens
gcctagggtgctcagggacgag

SEQ ID NO: 7810283 - DNA, 22 bp, Homo sapiens
gcctagtgcactggcagggctc

SEQ ID NO: 7810284 - DNA, 22 bp, Homo sapiens
gcctagggttggcctgagaatc

SEQ ID NO: 7810285 - DNA, 22 bp, Homo sapiens
gcctaggtaccagcagagagcc

SEQ ID NO: 7810286 - DNA, 22 bp, Homo sapiens
gcctaggtaccagcagagagcc

SEQ ID NO: 7810287 - DNA, 22 bp, Homo sapiens
gcctagggttggcctgagaatc

SEQ ID NO: 7810288 - DNA, 22 bp, Homo sapiens
gcctagggtgctcagggacgag

SEQ ID NO: 7810289 - DNA, 22 bp, Homo sapiens
gcctagggtgctcagggacgag

SEQ ID NO: 7810290 - DNA, 20 bp, Homo sapiens
gcctagggtcacttcagtga

SEQ ID NO: 7810291 - DNA, 22 bp, Homo sapiens
gcctcacatattcatggttact

SEQ ID NO: 7810292 - DNA, 22 bp, Homo sapiens
gcctcacatattcatggttact

SEQ ID NO: 7810293 - DNA, 19 bp, Homo sapiens
gcctcacaggtctcaggcc

SEQ ID NO: 7810294 - DNA, 22 bp, Homo sapiens
gcctcttgtttccttacatgga

SEQ ID NO: 7810295 - DNA, 22 bp, Homo sapiens
gcctctgcaactccgccttggt

SEQ ID NO: 7810296 - DNA, 22 bp, Homo sapiens
gcctctgatggaggccagcgct

SEQ ID NO: 7810297 - DNA, 22 bp, Homo sapiens
gcctcaagacatttttaattgc

SEQ ID NO: 7810298 - DNA, 22 bp, Homo sapiens
atttggaacaaatattagtaaa

SEQ ID NO: 7810299 - DNA, 22 bp, Homo sapiens
atttggaaatgtaagaatgcaa

SEQ ID NO: 7810300 - DNA, 22 bp, Homo sapiens
atttggaaatgtaagaatgcaa

SEQ ID NO: 7810301 - DNA, 22 bp, Homo sapiens
atttggaaatgcatctcttgag

SEQ ID NO: 7810302 - DNA, 22 bp, Homo sapiens
atttggaaatgtaagaatgcaa

SEQ ID NO: 7810303 - DNA, 22 bp, Homo sapiens
atttggaacaaatattagtaaa

SEQ ID NO: 7810304 - DNA, 22 bp, Homo sapiens
atttggaacaaatattagtaaa

SEQ ID NO: 7810305 - DNA, 22 bp, Homo sapiens
atttggaacaaatattagtaaa

SEQ ID NO: 7810306 - DNA, 22 bp, Homo sapiens
atttggaacaaatattagtaaa

SEQ ID NO: 7810307 - DNA, 22 bp, Homo sapiens
atttggaacttataataagttt

SEQ ID NO: 7810308 - DNA, 22 bp, Homo sapiens
atttggaacttataataagttt

SEQ ID NO: 7810309 - DNA, 22 bp, Homo sapiens
atttggaacttataataagttt

SEQ ID NO: 7810310 - DNA, 22 bp, Homo sapiens
atttggaacttataataagttt

SEQ ID NO: 7810311 - DNA, 22 bp, Homo sapiens
atttggaacttataataagttt

SEQ ID NO: 7810312 - DNA, 22 bp, Homo sapiens
atttggaacttataataagttt

SEQ ID NO: 7810313 - DNA, 22 bp, Homo sapiens
atttggaactgggcatgcaaac

SEQ ID NO: 7810314 - DNA, 22 bp, Homo sapiens
atttggaactgggcatgcaaac

SEQ ID NO: 7810315 - DNA, 22 bp, Homo sapiens
atttggaactgggcatgcaaac

SEQ ID NO: 7810316 - DNA, 22 bp, Homo sapiens
atttggaagaaatctgtcacag

SEQ ID NO: 7810317 - DNA, 22 bp, Homo sapiens
atttggaagaaatctgtcacag

SEQ ID NO: 7810318 - DNA, 22 bp, Homo sapiens
atttggaagaaatctgtcacag

SEQ ID NO: 7810319 - DNA, 22 bp, Homo sapiens
atttggaagaaatctgtcacag

SEQ ID NO: 7810320 - DNA, 22 bp, Homo sapiens
gcctaggagtacagaatggttt

SEQ ID NO: 7810321 - DNA, 20 bp, Homo sapiens
gcctaggggttgggaaagca

SEQ ID NO: 7810322 - DNA, 20 bp, Homo sapiens
gcctaggggttgggaaagca

SEQ ID NO: 7810323 - DNA, 20 bp, Homo sapiens
gcctaggggttgggaaagca

SEQ ID NO: 7810324 - DNA, 22 bp, Homo sapiens
gcctaggggtaagagtactggc

SEQ ID NO: 7810325 - DNA, 22 bp, Homo sapiens
gcctaggggtaagagtactggc

SEQ ID NO: 7810326 - DNA, 21 bp, Homo sapiens
gcctagggagatgggactgcc

SEQ ID NO: 7810327 - DNA, 22 bp, Homo sapiens
atttggaatagctgtagaaata

SEQ ID NO: 7810328 - DNA, 22 bp, Homo sapiens
atttggaatagctgtagaaata

SEQ ID NO: 7810329 - DNA, 22 bp, Homo sapiens
atttggaatagctgtagaaata

SEQ ID NO: 7810330 - DNA, 22 bp, Homo sapiens
atttggaatagctgtagaaata

SEQ ID NO: 7810331 - DNA, 22 bp, Homo sapiens
atttggaagtttttgtgggaat

SEQ ID NO: 7810332 - DNA, 22 bp, Homo sapiens
atttggaagtttttgtgggaat

SEQ ID NO: 7810333 - DNA, 22 bp, Homo sapiens
atttggaagtttggagtgaagg

SEQ ID NO: 7810334 - DNA, 22 bp, Homo sapiens
atttggaagtttggagtgaagg

SEQ ID NO: 7810335 - DNA, 22 bp, Homo sapiens
atttggaagtttggagtgaagg

SEQ ID NO: 7810336 - DNA, 22 bp, Homo sapiens
atttggaagtttggagtgaagg

SEQ ID NO: 7810337 - DNA, 22 bp, Homo sapiens
atttggaaggcgtttctctgta

SEQ ID NO: 7810338 - DNA, 22 bp, Homo sapiens
atttggaaggtttacaaagaga

SEQ ID NO: 7810339 - DNA, 22 bp, Homo sapiens
atttggaaggtttacaaagaga

SEQ ID NO: 7810340 - DNA, 22 bp, Homo sapiens
atttggaaggcgtttctctgta

SEQ ID NO: 7810341 - DNA, 22 bp, Homo sapiens
atttggaaggcgtttctctgta

SEQ ID NO: 7810342 - DNA, 22 bp, Homo sapiens
atttggaaggcgtttctctgta

SEQ ID NO: 7810343 - DNA, 22 bp, Homo sapiens
atttggaaggtttacaaagaga

SEQ ID NO: 7810344 - DNA, 22 bp, Homo sapiens
atttggaaggtttacaaagaga

SEQ ID NO: 7810345 - DNA, 22 bp, Homo sapiens
atttggaaggtttacaaagaga

SEQ ID NO: 7810346 - DNA, 22 bp, Homo sapiens
gcctgagattcccggagccgtg

SEQ ID NO: 7810347 - DNA, 22 bp, Homo sapiens
gcctgagattcccggagccgtg

SEQ ID NO: 7810348 - DNA, 22 bp, Homo sapiens
gcctgagattcccggagccgtg

SEQ ID NO: 7810349 - DNA, 22 bp, Homo sapiens
gcctgagattctgcatttctaa

SEQ ID NO: 7810350 - DNA, 22 bp, Homo sapiens
atttggaagcatttccaaagca

SEQ ID NO: 7810351 - DNA, 22 bp, Homo sapiens
atttggaagcatttccaaagca

SEQ ID NO: 7810352 - DNA, 22 bp, Homo sapiens
atttggaagcatttccaaagca

SEQ ID NO: 7810353 - DNA, 22 bp, Homo sapiens
atttggaagcatttccaaagca

SEQ ID NO: 7810354 - DNA, 22 bp, Homo sapiens
atttggaaggagctgcacagca

SEQ ID NO: 7810355 - DNA, 22 bp, Homo sapiens
atttggaaggagctgcacagca

SEQ ID NO: 7810356 - DNA, 22 bp, Homo sapiens
atttggaaggagctgcacagca

SEQ ID NO: 7810357 - DNA, 22 bp, Homo sapiens
atttggaaggagctgcacagca

SEQ ID NO: 7810358 - DNA, 22 bp, Homo sapiens
atttggaaggagctgcacagca

SEQ ID NO: 7810359 - DNA, 22 bp, Homo sapiens
atttggaagcttgaagattatt

SEQ ID NO: 7810360 - DNA, 22 bp, Homo sapiens
atttggaagcttgaagattatt

SEQ ID NO: 7810361 - DNA, 22 bp, Homo sapiens
atttggaagcttgaagattatt

SEQ ID NO: 7810362 - DNA, 22 bp, Homo sapiens
atttggaagcttgaagattatt

SEQ ID NO: 7810363 - DNA, 22 bp, Homo sapiens
atttggaagcttgaagattatt

SEQ ID NO: 7810364 - DNA, 22 bp, Homo sapiens
atttggaagcttgaagattatt

SEQ ID NO: 7810365 - DNA, 22 bp, Homo sapiens
gcctgaaggagtcagagagggc

SEQ ID NO: 7810366 - DNA, 22 bp, Homo sapiens
gcctgaagctggaataattgta

SEQ ID NO: 7810367 - DNA, 22 bp, Homo sapiens
gcctgaagctggaataattgta

SEQ ID NO: 7810368 - DNA, 22 bp, Homo sapiens
gcctgaaggagtcagagagggc

SEQ ID NO: 7810369 - DNA, 22 bp, Homo sapiens
gcctgaagtttcatgcctctat

SEQ ID NO: 7810370 - DNA, 21 bp, Homo sapiens
gcctgaccttactactggggt

SEQ ID NO: 7810371 - DNA, 22 bp, Homo sapiens
gcctgacttgtgtattttacat

SEQ ID NO: 7810372 - DNA, 22 bp, Homo sapiens
gcctgacctcttctgccctggg

SEQ ID NO: 7810373 - DNA, 22 bp, Homo sapiens
gcctgacctcttctgccctggg

SEQ ID NO: 7810374 - DNA, 20 bp, Homo sapiens
gcctgaatgcttaactggag

SEQ ID NO: 7810375 - DNA, 22 bp, Homo sapiens
gcctgaatctgatgaatgatct

SEQ ID NO: 7810376 - DNA, 22 bp, Homo sapiens
gcctgagaaggataggaagcga

SEQ ID NO: 7810377 - DNA, 22 bp, Homo sapiens
gcctgagaaggacacagcaggt

SEQ ID NO: 7810378 - DNA, 22 bp, Homo sapiens
gcctgagaaggataggaagcga

SEQ ID NO: 7810379 - DNA, 22 bp, Homo sapiens
gcctgagaaggataggaagcga

SEQ ID NO: 7810380 - DNA, 22 bp, Homo sapiens
gcctgagaaggacacagcaggt

SEQ ID NO: 7810381 - DNA, 22 bp, Homo sapiens
gcctgagaaggacacagcaggt

SEQ ID NO: 7810382 - DNA, 22 bp, Homo sapiens
gcctgagaaggacacagcaggt

SEQ ID NO: 7810383 - DNA, 22 bp, Homo sapiens
gcctgagatcaggagaaagcca

SEQ ID NO: 7810384 - DNA, 22 bp, Homo sapiens
gcctgagatcaggagaaagcca

SEQ ID NO: 7810385 - DNA, 22 bp, Homo sapiens
gcctgagatcaggagaaagcca

SEQ ID NO: 7810386 - DNA, 22 bp, Homo sapiens
gcctgagatcaggagaaagcca

SEQ ID NO: 7810387 - DNA, 22 bp, Homo sapiens
gcctgagagtctccagaccttg

SEQ ID NO: 7810388 - DNA, 22 bp, Homo sapiens
gcctgagagtctgcatttctaa

SEQ ID NO: 7810389 - DNA, 22 bp, Homo sapiens
gcctgagagttgaagttcagtg

SEQ ID NO: 7810390 - DNA, 22 bp, Homo sapiens
gcctgagagttgaagttcagtg

SEQ ID NO: 7810391 - DNA, 22 bp, Homo sapiens
gcctgagagttgaagttcagtg

SEQ ID NO: 7810392 - DNA, 22 bp, Homo sapiens
gcctgagagaactgaccaagag

SEQ ID NO: 7810393 - DNA, 22 bp, Homo sapiens
gcctgagagaactgaccaagag

SEQ ID NO: 7810394 - DNA, 22 bp, Homo sapiens
gcctgagagaactgaccaagag

SEQ ID NO: 7810395 - DNA, 22 bp, Homo sapiens
gcctgagacagtgtggtccaat

SEQ ID NO: 7810396 - DNA, 22 bp, Homo sapiens
gcctgagacagtgtggtccaat

SEQ ID NO: 7810397 - DNA, 22 bp, Homo sapiens
gcctgagacagtgtggtccaat

SEQ ID NO: 7810398 - DNA, 22 bp, Homo sapiens
gcctgagagaactgaccaagag

SEQ ID NO: 7810399 - DNA, 22 bp, Homo sapiens
gcctgagagacccatggggcaa

SEQ ID NO: 7810400 - DNA, 22 bp, Homo sapiens
gcctgagagtctccagaccttg

SEQ ID NO: 7810401 - DNA, 22 bp, Homo sapiens
gcctggattccttgtttctcag

SEQ ID NO: 7810402 - DNA, 22 bp, Homo sapiens
gcctggattccttgtttctcag

SEQ ID NO: 7810403 - DNA, 21 bp, Homo sapiens
gcctggcaaaaaccggccctg

SEQ ID NO: 7810404 - DNA, 21 bp, Homo sapiens
gcctggcaaaaaccggccctg

SEQ ID NO: 7810405 - DNA, 22 bp, Homo sapiens
gcctggattccttgtttctcag

SEQ ID NO: 7810406 - DNA, 22 bp, Homo sapiens
gcctggattacaaacagccaac

SEQ ID NO: 7810407 - DNA, 22 bp, Homo sapiens
gcctggattccttgtttctcag

SEQ ID NO: 7810408 - DNA, 22 bp, Homo sapiens
gcctggattccttgtttctcag

SEQ ID NO: 7810409 - DNA, 23 bp, Homo sapiens
gcctggattaaggcagtgacttc

SEQ ID NO: 7810410 - DNA, 22 bp, Homo sapiens
gcctggattacaaacagccaac

SEQ ID NO: 7810411 - DNA, 22 bp, Homo sapiens
gcctggagttgtggtgaagcca

SEQ ID NO: 7810412 - DNA, 22 bp, Homo sapiens
gcctggatcccagggagtcagg

SEQ ID NO: 7810413 - DNA, 22 bp, Homo sapiens
gcctggagttgtggtgaagcca

SEQ ID NO: 7810414 - DNA, 22 bp, Homo sapiens
gcctggagttgtggtgaagcca

SEQ ID NO: 7810415 - DNA, 22 bp, Homo sapiens
gcctggagttgtggtgaagcca

SEQ ID NO: 7810416 - DNA, 22 bp, Homo sapiens
gcctggagttgtggtgaagcca

SEQ ID NO: 7810417 - DNA, 22 bp, Homo sapiens
gcctggagttgtggtgaagcca

SEQ ID NO: 7810418 - DNA, 22 bp, Homo sapiens
gcctggaggaatgtagctgagg

SEQ ID NO: 7810419 - DNA, 20 bp, Homo sapiens
gcctggaggcaatgggaaga

SEQ ID NO: 7810420 - DNA, 22 bp, Homo sapiens
gcctggagttcagccaagtccc

SEQ ID NO: 7810421 - DNA, 22 bp, Homo sapiens
gcctggaggaatgtagctgagg

SEQ ID NO: 7810422 - DNA, 22 bp, Homo sapiens
atttggaatgtgtttgatcacc

SEQ ID NO: 7810423 - DNA, 22 bp, Homo sapiens
atttggaatggtctggcatttg

SEQ ID NO: 7810424 - DNA, 22 bp, Homo sapiens
atttggaatgtgtttgatcacc

SEQ ID NO: 7810425 - DNA, 22 bp, Homo sapiens
atttggaatggtctggcatttg

SEQ ID NO: 7810426 - DNA, 22 bp, Homo sapiens
atttggaatggtctggcatttg

SEQ ID NO: 7810427 - DNA, 22 bp, Homo sapiens
atttggaatgggagcctggcat

SEQ ID NO: 7810428 - DNA, 22 bp, Homo sapiens
atttggaatgctagtgaatgta

SEQ ID NO: 7810429 - DNA, 22 bp, Homo sapiens
atttggaatgggagcctggcat

SEQ ID NO: 7810430 - DNA, 22 bp, Homo sapiens
atttggaatgctagtgaatgta

SEQ ID NO: 7810431 - DNA, 22 bp, Homo sapiens
atttggaatgctagtgaatgta

SEQ ID NO: 7810432 - DNA, 22 bp, Homo sapiens
atttggaatgctagtgaatgta

SEQ ID NO: 7810433 - DNA, 22 bp, Homo sapiens
gcctggcaatggcctcaggaag

SEQ ID NO: 7810434 - DNA, 22 bp, Homo sapiens
gcctggcacaggaattaggagg

SEQ ID NO: 7810435 - DNA, 22 bp, Homo sapiens
gcctggcacagtagggacccaa

SEQ ID NO: 7810436 - DNA, 22 bp, Homo sapiens
gcctggcacaggaattaggagg

SEQ ID NO: 7810437 - DNA, 22 bp, Homo sapiens
gcctggcacagtagggacccaa

SEQ ID NO: 7810438 - DNA, 22 bp, Homo sapiens
gcctggcaatggcctcaggaag

SEQ ID NO: 7810439 - DNA, 22 bp, Homo sapiens
gcctggcaatggcctcaggaag

SEQ ID NO: 7810440 - DNA, 22 bp, Homo sapiens
gcctggcaatggcctcaggaag

SEQ ID NO: 7810441 - DNA, 23 bp, Homo sapiens
gcctggcaaagcactaccgagag

SEQ ID NO: 7810442 - DNA, 23 bp, Homo sapiens
gcctggcaaagcactaccgagag

SEQ ID NO: 7810443 - DNA, 22 bp, Homo sapiens
gcctggcaaggccctgttgact

SEQ ID NO: 7810444 - DNA, 22 bp, Homo sapiens
gcctggcaccacagcctttcag

SEQ ID NO: 7810445 - DNA, 22 bp, Homo sapiens
attttactactccaattaatga

SEQ ID NO: 7810446 - DNA, 22 bp, Homo sapiens
gcctggcacattgcagtggatt

SEQ ID NO: 7810447 - DNA, 22 bp, Homo sapiens
gcctggcacattgcagtggatt

SEQ ID NO: 7810448 - DNA, 22 bp, Homo sapiens
gcctggcacattgcagtggatt

SEQ ID NO: 7810449 - DNA, 22 bp, Homo sapiens
attttactactccaattaatga

SEQ ID NO: 7810450 - DNA, 22 bp, Homo sapiens
attttacttagtgtaatgtcca

SEQ ID NO: 7810451 - DNA, 22 bp, Homo sapiens
attttacttagtgtaatgtcca

SEQ ID NO: 7810452 - DNA, 22 bp, Homo sapiens
atttttctctcacacttaccag

SEQ ID NO: 7810453 - DNA, 22 bp, Homo sapiens
atttttctctcacacttaccag

SEQ ID NO: 7810454 - DNA, 22 bp, Homo sapiens
atttttctctccactccattaa

SEQ ID NO: 7810455 - DNA, 22 bp, Homo sapiens
atttttctctccactccattaa

SEQ ID NO: 7810456 - DNA, 22 bp, Homo sapiens
atttttctctccactccattaa

SEQ ID NO: 7810457 - DNA, 22 bp, Homo sapiens
atttttctctccactccattaa

SEQ ID NO: 7810458 - DNA, 22 bp, Homo sapiens
atttttctctttccactgagat

SEQ ID NO: 7810459 - DNA, 22 bp, Homo sapiens
atttttcctgggtgctttagtt

SEQ ID NO: 7810460 - DNA, 22 bp, Homo sapiens
atttttcctgggtgctttagtt

SEQ ID NO: 7810461 - DNA, 22 bp, Homo sapiens
atttttcctgggtgctttagtt

SEQ ID NO: 7810462 - DNA, 23 bp, Homo sapiens
atttttcctggaacagtcaccca

SEQ ID NO: 7810463 - DNA, 22 bp, Homo sapiens
atttttcctgctggatctgctc

SEQ ID NO: 7810464 - DNA, 23 bp, Homo sapiens
atttttcctggaacagtcaccca

SEQ ID NO: 7810465 - DNA, 22 bp, Homo sapiens
atttttccattctctgttagta

SEQ ID NO: 7810466 - DNA, 22 bp, Homo sapiens
atttttccattctctgttagta

SEQ ID NO: 7810467 - DNA, 22 bp, Homo sapiens
atttttccatgatacttatctg

SEQ ID NO: 7810468 - DNA, 22 bp, Homo sapiens
atttttccattctctgttagta

SEQ ID NO: 7810469 - DNA, 18 bp, Homo sapiens
atttttcccagatggata

SEQ ID NO: 7810470 - DNA, 18 bp, Homo sapiens
atttttcccagatggata

SEQ ID NO: 7810471 - DNA, 18 bp, Homo sapiens
atttttcccagatggata

SEQ ID NO: 7810472 - DNA, 22 bp, Homo sapiens
atttttcctgctggatctgctc

SEQ ID NO: 7810473 - DNA, 18 bp, Homo sapiens
atttttcccagatggata

SEQ ID NO: 7810474 - DNA, 22 bp, Homo sapiens
atttttcctgctggatctgctc

SEQ ID NO: 7810475 - DNA, 22 bp, Homo sapiens
atttttgccctgcagtacataa

SEQ ID NO: 7810476 - DNA, 22 bp, Homo sapiens
atttttgagctgtgaacatagc

SEQ ID NO: 7810477 - DNA, 22 bp, Homo sapiens
atttttgccctgcagtacataa

SEQ ID NO: 7810478 - DNA, 22 bp, Homo sapiens
atttttgccctgcagtacataa

SEQ ID NO: 7810479 - DNA, 22 bp, Homo sapiens
atttttggctgttgtcagaggt

SEQ ID NO: 7810480 - DNA, 22 bp, Homo sapiens
caaaagcagttctatctgagtt

SEQ ID NO: 7810481 - DNA, 22 bp, Homo sapiens
caaaagcagttctatctgagtt

SEQ ID NO: 7810482 - DNA, 22 bp, Homo sapiens
atttttgtatccccagctcctg

SEQ ID NO: 7810483 - DNA, 22 bp, Homo sapiens
atttttgtatccccagctcctg

SEQ ID NO: 7810484 - DNA, 22 bp, Homo sapiens
caaaataccacgacttgtttta

SEQ ID NO: 7810485 - DNA, 22 bp, Homo sapiens
caaaagcagttctatctgagtt

SEQ ID NO: 7810486 - DNA, 22 bp, Homo sapiens
caaaagcagttctatctgagtt

SEQ ID NO: 7810487 - DNA, 22 bp, Homo sapiens
caaaagcagttctatctgagtt

SEQ ID NO: 7810488 - DNA, 22 bp, Homo sapiens
caaaagcagttctatctgagtt

SEQ ID NO: 7810489 - DNA, 19 bp, Homo sapiens
atttttcttcctctgtgca

SEQ ID NO: 7810490 - DNA, 19 bp, Homo sapiens
atttttcttcctctgtgca

SEQ ID NO: 7810491 - DNA, 22 bp, Homo sapiens
atttttctctttccactgagat

SEQ ID NO: 7810492 - DNA, 22 bp, Homo sapiens
atttttctctttccactgagat

SEQ ID NO: 7810493 - DNA, 22 bp, Homo sapiens
atttttctctttccactgagat

SEQ ID NO: 7810494 - DNA, 22 bp, Homo sapiens
atttttctctttccactgagat

SEQ ID NO: 7810495 - DNA, 22 bp, Homo sapiens
atttttgagctgtgaacatagc

SEQ ID NO: 7810496 - DNA, 22 bp, Homo sapiens
atttttgagctgtgaacatagc

SEQ ID NO: 7810497 - DNA, 22 bp, Homo sapiens
atttttgagctgtgaacatagc

SEQ ID NO: 7810498 - DNA, 22 bp, Homo sapiens
atttttgagctgtgaacatagc

SEQ ID NO: 7810499 - DNA, 22 bp, Homo sapiens
atttttgagctgtgaacatagc

SEQ ID NO: 7810500 - DNA, 19 bp, Homo sapiens
atttttcttcctctgtgca

SEQ ID NO: 7810501 - DNA, 22 bp, Homo sapiens
attttacttagtgtaatgtcca

SEQ ID NO: 7810502 - DNA, 22 bp, Homo sapiens
attttacttcatttgaaatgcc

SEQ ID NO: 7810503 - DNA, 22 bp, Homo sapiens
attttacttcatttgaaatgcc

SEQ ID NO: 7810504 - DNA, 22 bp, Homo sapiens
attttactttgtgaatattgac

SEQ ID NO: 7810505 - DNA, 22 bp, Homo sapiens
attttactttgtgaatattgac

SEQ ID NO: 7810506 - DNA, 22 bp, Homo sapiens
attttagagaaacaaacgtagg

SEQ ID NO: 7810507 - DNA, 22 bp, Homo sapiens
attttagagaaacaaacgtagg

SEQ ID NO: 7810508 - DNA, 22 bp, Homo sapiens
attttactttgtgaatattgac

SEQ ID NO: 7810509 - DNA, 22 bp, Homo sapiens
attttgctttatgtaaatatgt

SEQ ID NO: 7810510 - DNA, 22 bp, Homo sapiens
attttgctttatgtaaatatgt

SEQ ID NO: 7810511 - DNA, 22 bp, Homo sapiens
attttagagctccaagtacagc

SEQ ID NO: 7810512 - DNA, 22 bp, Homo sapiens
attttgctgtggtacattagga

SEQ ID NO: 7810513 - DNA, 22 bp, Homo sapiens
attttagagctccaagtacagc

SEQ ID NO: 7810514 - DNA, 22 bp, Homo sapiens
attttagagctccaagtacagc

SEQ ID NO: 7810515 - DNA, 22 bp, Homo sapiens
attttagagctccaagtacagc

SEQ ID NO: 7810516 - DNA, 22 bp, Homo sapiens
attttagagaaacaaacgtagg

SEQ ID NO: 7810517 - DNA, 22 bp, Homo sapiens
attttagagaaacaaacgtagg

SEQ ID NO: 7810518 - DNA, 22 bp, Homo sapiens
attttagagaaacaaacgtagg

SEQ ID NO: 7810519 - DNA, 22 bp, Homo sapiens
atttttcagcttcattgaggca

SEQ ID NO: 7810520 - DNA, 22 bp, Homo sapiens
atttttcagcttcattgaggca

SEQ ID NO: 7810521 - DNA, 22 bp, Homo sapiens
atttttcagcttcattgaggca

SEQ ID NO: 7810522 - DNA, 22 bp, Homo sapiens
atttttaggctctaccctcaga

SEQ ID NO: 7810523 - DNA, 22 bp, Homo sapiens
atttttcaactttggaaatggc

SEQ ID NO: 7810524 - DNA, 22 bp, Homo sapiens
atttttccaattaggataaaga

SEQ ID NO: 7810525 - DNA, 22 bp, Homo sapiens
atttttccaattaggataaaga

SEQ ID NO: 7810526 - DNA, 22 bp, Homo sapiens
atttttcagcttcattgaggca

SEQ ID NO: 7810527 - DNA, 22 bp, Homo sapiens
atttttccaattaggataaaga

SEQ ID NO: 7810528 - DNA, 22 bp, Homo sapiens
atttttccatgatacttatctg

SEQ ID NO: 7810529 - DNA, 22 bp, Homo sapiens
atttttccatgatacttatctg

SEQ ID NO: 7810530 - DNA, 22 bp, Homo sapiens
atttttccatgatacttatctg

SEQ ID NO: 7810531 - DNA, 22 bp, Homo sapiens
atttttatgacaaaccatcctc

SEQ ID NO: 7810532 - DNA, 23 bp, Homo sapiens
atttttagcctctctgagctgag

SEQ ID NO: 7810533 - DNA, 22 bp, Homo sapiens
atttttaggctctaccctcaga

SEQ ID NO: 7810534 - DNA, 22 bp, Homo sapiens
atttttatgacaaaccatcctc

SEQ ID NO: 7810535 - DNA, 22 bp, Homo sapiens
atttttatgacaaaccatcctc

SEQ ID NO: 7810536 - DNA, 22 bp, Homo sapiens
atttttcaactttggaaatggc

SEQ ID NO: 7810537 - DNA, 23 bp, Homo sapiens
atttttagcctctctgagctgag

SEQ ID NO: 7810538 - DNA, 23 bp, Homo sapiens
atttttagcctctctgagctgag

SEQ ID NO: 7810539 - DNA, 22 bp, Homo sapiens
attttgtttcctttggagtaga

SEQ ID NO: 7810540 - DNA, 22 bp, Homo sapiens
attttgtttcctttggagtaga

SEQ ID NO: 7810541 - DNA, 22 bp, Homo sapiens
attttgctttatgtaaatatgt

SEQ ID NO: 7810542 - DNA, 22 bp, Homo sapiens
attttgtttcctttggagtaga

SEQ ID NO: 7810543 - DNA, 22 bp, Homo sapiens
attttgtttcctttggagtaga

SEQ ID NO: 7810544 - DNA, 22 bp, Homo sapiens
caaaatgatgtgattttattgt

SEQ ID NO: 7810545 - DNA, 22 bp, Homo sapiens
caaaatgatgtgattttattgt

SEQ ID NO: 7810546 - DNA, 22 bp, Homo sapiens
caaaatgatgtgattttattgt

SEQ ID NO: 7810547 - DNA, 22 bp, Homo sapiens
caaaatgcatctgagaccaggc

SEQ ID NO: 7810548 - DNA, 22 bp, Homo sapiens
caaaatgcatctgagaccaggc

SEQ ID NO: 7810549 - DNA, 22 bp, Homo sapiens
caaaatagatgttaacctggaa

SEQ ID NO: 7810550 - DNA, 22 bp, Homo sapiens
caaaatgatgtgattttattgt

SEQ ID NO: 7810551 - DNA, 22 bp, Homo sapiens
caaaatgatgtgattttattgt

SEQ ID NO: 7810552 - DNA, 22 bp, Homo sapiens
caaaatgatgtgattttattgt

SEQ ID NO: 7810553 - DNA, 22 bp, Homo sapiens
caaaatagatgttaacctggaa

SEQ ID NO: 7810554 - DNA, 22 bp, Homo sapiens
caaaatagatgttaacctggaa

SEQ ID NO: 7810555 - DNA, 22 bp, Homo sapiens
caaaatgttctggcacctttaa

SEQ ID NO: 7810556 - DNA, 22 bp, Homo sapiens
caaaattagaaatgcagctgtt

SEQ ID NO: 7810557 - DNA, 22 bp, Homo sapiens
caaaatgttctggcacctttaa

SEQ ID NO: 7810558 - DNA, 22 bp, Homo sapiens
caaaattagaaatgcagctgtt

SEQ ID NO: 7810559 - DNA, 22 bp, Homo sapiens
caaaattagaaatgcagctgtt

SEQ ID NO: 7810560 - DNA, 22 bp, Homo sapiens
caaaatgttctggcacctttaa

SEQ ID NO: 7810561 - DNA, 22 bp, Homo sapiens
caaaatgttctggcacctttaa

SEQ ID NO: 7810562 - DNA, 22 bp, Homo sapiens
caaaatgtgagtcccacctcaa

SEQ ID NO: 7810563 - DNA, 22 bp, Homo sapiens
caaaatgtgagtcccacctcaa

SEQ ID NO: 7810564 - DNA, 22 bp, Homo sapiens
caaacaatttgcatttccttag

SEQ ID NO: 7810565 - DNA, 22 bp, Homo sapiens
caaacatagtgaagcaatgaca

SEQ ID NO: 7810566 - DNA, 22 bp, Homo sapiens
caaacatagtgaagcaatgaca

SEQ ID NO: 7810567 - DNA, 22 bp, Homo sapiens
caaacatagtgaagcaatgaca

SEQ ID NO: 7810568 - DNA, 22 bp, Homo sapiens
caaacatctgcaccttgaccgg

SEQ ID NO: 7810569 - DNA, 22 bp, Homo sapiens
caaacaatttgcatttccttag

SEQ ID NO: 7810570 - DNA, 22 bp, Homo sapiens
caaacaatttgcatttccttag

SEQ ID NO: 7810571 - DNA, 22 bp, Homo sapiens
caaaattctgcatttctaataa

SEQ ID NO: 7810572 - DNA, 22 bp, Homo sapiens
caaaattctgcatttctaataa

SEQ ID NO: 7810573 - DNA, 22 bp, Homo sapiens
caaaattctgcatttctaataa

SEQ ID NO: 7810574 - DNA, 22 bp, Homo sapiens
caaaattctgcatttctaataa

SEQ ID NO: 7810575 - DNA, 22 bp, Homo sapiens
caaaattagggagtgagctgga

SEQ ID NO: 7810576 - DNA, 22 bp, Homo sapiens
caaaattagggagtgagctgga

SEQ ID NO: 7810577 - DNA, 22 bp, Homo sapiens
caaaattagggagtgagctgga

SEQ ID NO: 7810578 - DNA, 22 bp, Homo sapiens
caaaattagggagtgagctgga

SEQ ID NO: 7810579 - DNA, 22 bp, Homo sapiens
caaaattagaaatgcagctgtt

SEQ ID NO: 7810580 - DNA, 22 bp, Homo sapiens
caaaattagaaatgcagctgtt

SEQ ID NO: 7810581 - DNA, 22 bp, Homo sapiens
caaaattagaaatgcagctgtt

SEQ ID NO: 7810582 - DNA, 22 bp, Homo sapiens
caaacattcagatgcaatggta

SEQ ID NO: 7810583 - DNA, 22 bp, Homo sapiens
caaacattccgcttctcccagg

SEQ ID NO: 7810584 - DNA, 22 bp, Homo sapiens
caaagaggttttgagggcagct

SEQ ID NO: 7810585 - DNA, 22 bp, Homo sapiens
caaagaggttttgagggcagct

SEQ ID NO: 7810586 - DNA, 22 bp, Homo sapiens
caaagagttttttcatataatg

SEQ ID NO: 7810587 - DNA, 22 bp, Homo sapiens
caaacattcaagtacaagtctt

SEQ ID NO: 7810588 - DNA, 22 bp, Homo sapiens
caaacattcaagtacaagtctt

SEQ ID NO: 7810589 - DNA, 22 bp, Homo sapiens
caaacattcagatgcaatggta

SEQ ID NO: 7810590 - DNA, 22 bp, Homo sapiens
caaacattcaagtacaagtctt

SEQ ID NO: 7810591 - DNA, 22 bp, Homo sapiens
caaacattcaagtacaagtctt

SEQ ID NO: 7810592 - DNA, 22 bp, Homo sapiens
caaacatctgcaccttgaccgg

SEQ ID NO: 7810593 - DNA, 22 bp, Homo sapiens
caaacattcaagtacaagtctt

SEQ ID NO: 7810594 - DNA, 22 bp, Homo sapiens
caaacattcaagtacaagtctt

SEQ ID NO: 7810595 - DNA, 22 bp, Homo sapiens
caaacattcaagtacaagtctt

SEQ ID NO: 7810596 - DNA, 22 bp, Homo sapiens
caaacattcaagtacaagtctt

SEQ ID NO: 7810597 - DNA, 22 bp, Homo sapiens
caaagcaggaagaatattgaaa

SEQ ID NO: 7810598 - DNA, 22 bp, Homo sapiens
caaagcaggaagctcctgacag

SEQ ID NO: 7810599 - DNA, 22 bp, Homo sapiens
caaagcagcggattgggatagt

SEQ ID NO: 7810600 - DNA, 22 bp, Homo sapiens
caaagcagcctgcagtgtggac

SEQ ID NO: 7810601 - DNA, 22 bp, Homo sapiens
caaagcagcctgcagtgtggac

SEQ ID NO: 7810602 - DNA, 22 bp, Homo sapiens
caaagcagcggattgggatagt

SEQ ID NO: 7810603 - DNA, 22 bp, Homo sapiens
caaagcagagaactgtctcatt

SEQ ID NO: 7810604 - DNA, 22 bp, Homo sapiens
caaagcagagaactgtctcatt

SEQ ID NO: 7810605 - DNA, 22 bp, Homo sapiens
caaagcagagaactgtctcatt

SEQ ID NO: 7810606 - DNA, 22 bp, Homo sapiens
caaagcagacgcagtaagggta

SEQ ID NO: 7810607 - DNA, 22 bp, Homo sapiens
caaagagttttttcatataatg

SEQ ID NO: 7810608 - DNA, 22 bp, Homo sapiens
caaagcagagccagagcttgtc

SEQ ID NO: 7810609 - DNA, 22 bp, Homo sapiens
caaagcagagccagagcttgtc

SEQ ID NO: 7810610 - DNA, 22 bp, Homo sapiens
caaagcagagaactgtctcatt

SEQ ID NO: 7810611 - DNA, 22 bp, Homo sapiens
caaagcagttttaatcaagtag

SEQ ID NO: 7810612 - DNA, 21 bp, Homo sapiens
caaagccaggcaactctctcc

SEQ ID NO: 7810613 - DNA, 22 bp, Homo sapiens
caaagcagttttaatcaagtag

SEQ ID NO: 7810614 - DNA, 21 bp, Homo sapiens
caaagccaggcaactctctcc

SEQ ID NO: 7810615 - DNA, 21 bp, Homo sapiens
caaagccaggcaactctctcc

SEQ ID NO: 7810616 - DNA, 21 bp, Homo sapiens
caaagccaggcaactctctcc

SEQ ID NO: 7810617 - DNA, 21 bp, Homo sapiens
caaagccaggcaactctctcc

SEQ ID NO: 7810618 - DNA, 22 bp, Homo sapiens
caaagccaggctttctaatgta

SEQ ID NO: 7810619 - DNA, 22 bp, Homo sapiens
caaagccatagagtagataaga

SEQ ID NO: 7810620 - DNA, 22 bp, Homo sapiens
caaagcagtgatccttaaagga

SEQ ID NO: 7810621 - DNA, 22 bp, Homo sapiens
caaagcagtattggattcttta

SEQ ID NO: 7810622 - DNA, 18 bp, Homo sapiens
caaagcaggtgacagtgt

SEQ ID NO: 7810623 - DNA, 22 bp, Homo sapiens
caaagcagtattggattcttta

SEQ ID NO: 7810624 - DNA, 20 bp, Homo sapiens
caaagcagtaggataaaaat

SEQ ID NO: 7810625 - DNA, 20 bp, Homo sapiens
caaagcagtaggataaaaat

SEQ ID NO: 7810626 - DNA, 20 bp, Homo sapiens
caaagcagtaggataaaaat

SEQ ID NO: 7810627 - DNA, 22 bp, Homo sapiens
caaagcaggaagctcctgacag

SEQ ID NO: 7810628 - DNA, 22 bp, Homo sapiens
caaagcaggaagctcctgacag

SEQ ID NO: 7810629 - DNA, 18 bp, Homo sapiens
caaagcaggtgacagtgt

SEQ ID NO: 7810630 - DNA, 18 bp, Homo sapiens
caaagcaggtgacagtgt

SEQ ID NO: 7810631 - DNA, 18 bp, Homo sapiens
caaagcaggtgacagtgt

SEQ ID NO: 7810632 - DNA, 18 bp, Homo sapiens
caaagcaggtgacagtgt

SEQ ID NO: 7810633 - DNA, 22 bp, Homo sapiens
caaatgcatgagaaataagagg

SEQ ID NO: 7810634 - DNA, 22 bp, Homo sapiens
caaatgcatgagaaataagagg

SEQ ID NO: 7810635 - DNA, 22 bp, Homo sapiens
caaatgcatgagaaataagagg

SEQ ID NO: 7810636 - DNA, 22 bp, Homo sapiens
caaatgctaacttctttccaaa

SEQ ID NO: 7810637 - DNA, 22 bp, Homo sapiens
caaatgctaacttctttccaaa

SEQ ID NO: 7810638 - DNA, 22 bp, Homo sapiens
caaatgctactaataggcaagt

SEQ ID NO: 7810639 - DNA, 22 bp, Homo sapiens
caaatgctactaataggcaagt

SEQ ID NO: 7810640 - DNA, 22 bp, Homo sapiens
caaatgctactaataggcaagt

SEQ ID NO: 7810641 - DNA, 22 bp, Homo sapiens
caaatgctactaataggcaagt

SEQ ID NO: 7810642 - DNA, 22 bp, Homo sapiens
caaatgctactaataggcaagt

SEQ ID NO: 7810643 - DNA, 22 bp, Homo sapiens
caaatggctggcatccttctac

SEQ ID NO: 7810644 - DNA, 22 bp, Homo sapiens
caaatggcaacaagaacactgg

SEQ ID NO: 7810645 - DNA, 22 bp, Homo sapiens
caaatgctggccctgctactta

SEQ ID NO: 7810646 - DNA, 21 bp, Homo sapiens
caaatgctggctggatgagga

SEQ ID NO: 7810647 - DNA, 22 bp, Homo sapiens
caaatgctatgattttgagttt

SEQ ID NO: 7810648 - DNA, 22 bp, Homo sapiens
caaatgctatgattttgagttt

SEQ ID NO: 7810649 - DNA, 22 bp, Homo sapiens
caaatgctggccctgctactta

SEQ ID NO: 7810650 - DNA, 22 bp, Homo sapiens
caaatgctatgattttgagttt

SEQ ID NO: 7810651 - DNA, 22 bp, Homo sapiens
caaatgcatagtttataagaag

SEQ ID NO: 7810652 - DNA, 22 bp, Homo sapiens
caaatgcatagtttataagaag

SEQ ID NO: 7810653 - DNA, 22 bp, Homo sapiens
caaatgcatagtttataagaag

SEQ ID NO: 7810654 - DNA, 22 bp, Homo sapiens
caaatgcatagtttataagaag

SEQ ID NO: 7810655 - DNA, 22 bp, Homo sapiens
caaatgatacctattactaggc

SEQ ID NO: 7810656 - DNA, 22 bp, Homo sapiens
caaatgaatttccctgcaaatg

SEQ ID NO: 7810657 - DNA, 22 bp, Homo sapiens
gctgactgtccgctgctcccgg

SEQ ID NO: 7810658 - DNA, 22 bp, Homo sapiens
gctgacctttgccaggaaggca

SEQ ID NO: 7810659 - DNA, 22 bp, Homo sapiens
gctgaccttcaaatccagcgag

SEQ ID NO: 7810660 - DNA, 22 bp, Homo sapiens
gctgaccttcaaatccagcgag

SEQ ID NO: 7810661 - DNA, 22 bp, Homo sapiens
gctgactgagctggcttttcgt

SEQ ID NO: 7810662 - DNA, 22 bp, Homo sapiens
gctgactctttgacaaaatgca

SEQ ID NO: 7810663 - DNA, 22 bp, Homo sapiens
gctgacctcgtccaggcgcttc

SEQ ID NO: 7810664 - DNA, 22 bp, Homo sapiens
gctgacctgaatcattcggggt

SEQ ID NO: 7810665 - DNA, 22 bp, Homo sapiens
gctgactgctcagggccagctg

SEQ ID NO: 7810666 - DNA, 22 bp, Homo sapiens
gctgactggttcaggtcccgct

SEQ ID NO: 7810667 - DNA, 22 bp, Homo sapiens
gctgactggttgcacagagggt

SEQ ID NO: 7810668 - DNA, 22 bp, Homo sapiens
gctgactgctcagggccagctg

SEQ ID NO: 7810669 - DNA, 22 bp, Homo sapiens
gctgactgatggacacagcacc

SEQ ID NO: 7810670 - DNA, 22 bp, Homo sapiens
gctgactgatggacacagcacc

SEQ ID NO: 7810671 - DNA, 22 bp, Homo sapiens
gctgaaatgcagatccctcact

SEQ ID NO: 7810672 - DNA, 22 bp, Homo sapiens
gctgaaatgcagatccctcact

SEQ ID NO: 7810673 - DNA, 22 bp, Homo sapiens
gctgacagagtgcctggcctca

SEQ ID NO: 7810674 - DNA, 22 bp, Homo sapiens
gctgaaatgaaaacacaggtcg

SEQ ID NO: 7810675 - DNA, 22 bp, Homo sapiens
gctgaaatcccagcattcccca

SEQ ID NO: 7810676 - DNA, 22 bp, Homo sapiens
gctcttttcacagtccaaaatg

SEQ ID NO: 7810677 - DNA, 20 bp, Homo sapiens
gctctttgtaagggaatttg

SEQ ID NO: 7810678 - DNA, 22 bp, Homo sapiens
gctctttgtattttggaatcaa

SEQ ID NO: 7810679 - DNA, 23 bp, Homo sapiens
gctctttgttcatgtggatgcct

SEQ ID NO: 7810680 - DNA, 22 bp, Homo sapiens
gctgaccatgaattaagcatct

SEQ ID NO: 7810681 - DNA, 22 bp, Homo sapiens
gctgacccctacaggttgtgtt

SEQ ID NO: 7810682 - DNA, 22 bp, Homo sapiens
gctgacccctacaggttgtgtt

SEQ ID NO: 7810683 - DNA, 22 bp, Homo sapiens
gctgacagttactgctgtaaca

SEQ ID NO: 7810684 - DNA, 22 bp, Homo sapiens
gctgacagcaaggggctgccct

SEQ ID NO: 7810685 - DNA, 22 bp, Homo sapiens
gctgacagcgtttccagtgatg

SEQ ID NO: 7810686 - DNA, 22 bp, Homo sapiens
gctctttctgtccgcagggcct

SEQ ID NO: 7810687 - DNA, 22 bp, Homo sapiens
gctctttgcacagctctgccct

SEQ ID NO: 7810688 - DNA, 22 bp, Homo sapiens
gctctttggattcctttacaaa

SEQ ID NO: 7810689 - DNA, 22 bp, Homo sapiens
gctctttagcgggggccaggcc

SEQ ID NO: 7810690 - DNA, 22 bp, Homo sapiens
gctctttactgtgagggtggtc

SEQ ID NO: 7810691 - DNA, 22 bp, Homo sapiens
gctctttaattcattcatggat

SEQ ID NO: 7810692 - DNA, 22 bp, Homo sapiens
gctcttgtcaaaaattagttga

SEQ ID NO: 7810693 - DNA, 22 bp, Homo sapiens
gctcttgtcaaaaattagttga

SEQ ID NO: 7810694 - DNA, 22 bp, Homo sapiens
gctctttaattcattcatggat

SEQ ID NO: 7810695 - DNA, 22 bp, Homo sapiens
gctcttggtctcagcctctgaa

SEQ ID NO: 7810696 - DNA, 22 bp, Homo sapiens
gctcttggtctcagcctctgaa

SEQ ID NO: 7810697 - DNA, 22 bp, Homo sapiens
gctcttgtcaaaaattagttga

SEQ ID NO: 7810698 - DNA, 22 bp, Homo sapiens
gctcttgtcaaaaattagttga

SEQ ID NO: 7810699 - DNA, 22 bp, Homo sapiens
gctcttgtcaaaaattagttga

SEQ ID NO: 7810700 - DNA, 22 bp, Homo sapiens
gctcttggccaagtggaagggt

SEQ ID NO: 7810701 - DNA, 22 bp, Homo sapiens
gctcttgggggacagatggagt

SEQ ID NO: 7810702 - DNA, 22 bp, Homo sapiens
gctcttgggggacagatggagt

SEQ ID NO: 7810703 - DNA, 18 bp, Homo sapiens
gctctggttccttcaacc

SEQ ID NO: 7810704 - DNA, 22 bp, Homo sapiens
gctctggttccagttccgcacc

SEQ ID NO: 7810705 - DNA, 22 bp, Homo sapiens
gctcttggaagacaggatgtgt

SEQ ID NO: 7810706 - DNA, 18 bp, Homo sapiens
gctctggttccttcaacc

SEQ ID NO: 7810707 - DNA, 22 bp, Homo sapiens
caaatagactctagaatttatt

SEQ ID NO: 7810708 - DNA, 22 bp, Homo sapiens
caaatagactctagaatttatt

SEQ ID NO: 7810709 - DNA, 22 bp, Homo sapiens
caaatagactctagaatttatt

SEQ ID NO: 7810710 - DNA, 22 bp, Homo sapiens
caaatagactctagaatttatt

SEQ ID NO: 7810711 - DNA, 22 bp, Homo sapiens
caaatagaactcacagacaaga

SEQ ID NO: 7810712 - DNA, 22 bp, Homo sapiens
caaatagaactcacagacaaga

SEQ ID NO: 7810713 - DNA, 22 bp, Homo sapiens
caaatacttttagcctattgag

SEQ ID NO: 7810714 - DNA, 22 bp, Homo sapiens
caaatagaactcacagacaaga

SEQ ID NO: 7810715 - DNA, 22 bp, Homo sapiens
caaatagaactcacagacaaga

SEQ ID NO: 7810716 - DNA, 22 bp, Homo sapiens
caaatagaactcacagacaaga

SEQ ID NO: 7810717 - DNA, 22 bp, Homo sapiens
caaatagaactcacagacaaga

SEQ ID NO: 7810718 - DNA, 22 bp, Homo sapiens
caaatagacaagatggcaggaa

SEQ ID NO: 7810719 - DNA, 22 bp, Homo sapiens
caaatagacaagatggcaggaa

SEQ ID NO: 7810720 - DNA, 22 bp, Homo sapiens
caaatagacaagatggcaggaa

SEQ ID NO: 7810721 - DNA, 21 bp, Homo sapiens
caaatagacatggctagagga

SEQ ID NO: 7810722 - DNA, 21 bp, Homo sapiens
caaatagacatggctagagga

SEQ ID NO: 7810723 - DNA, 22 bp, Homo sapiens
caaatagaaggtactcagagaa

SEQ ID NO: 7810724 - DNA, 22 bp, Homo sapiens
caaatagaaggtactcagagaa

SEQ ID NO: 7810725 - DNA, 22 bp, Homo sapiens
caaatagaaggtactcagagaa

SEQ ID NO: 7810726 - DNA, 22 bp, Homo sapiens
caaatagaaggtactcagagaa

SEQ ID NO: 7810727 - DNA, 22 bp, Homo sapiens
caaatagaaggtactcagagaa

SEQ ID NO: 7810728 - DNA, 22 bp, Homo sapiens
caaatagaaggtactcagagaa

SEQ ID NO: 7810729 - DNA, 21 bp, Homo sapiens
caaatacttagaaacttaaga

SEQ ID NO: 7810730 - DNA, 21 bp, Homo sapiens
caaatacttagaaacttaaga

SEQ ID NO: 7810731 - DNA, 21 bp, Homo sapiens
caaatacttagaaacttaaga

SEQ ID NO: 7810732 - DNA, 21 bp, Homo sapiens
caaatacttagaaacttaaga

SEQ ID NO: 7810733 - DNA, 21 bp, Homo sapiens
caaatacttagaaacttaaga

SEQ ID NO: 7810734 - DNA, 21 bp, Homo sapiens
caaatacttagaaacttaaga

SEQ ID NO: 7810735 - DNA, 22 bp, Homo sapiens
caaatactttatatacttcaaa

SEQ ID NO: 7810736 - DNA, 22 bp, Homo sapiens
caaatactttatatacttcaaa

SEQ ID NO: 7810737 - DNA, 22 bp, Homo sapiens
caaatactttatatacttcaaa

SEQ ID NO: 7810738 - DNA, 22 bp, Homo sapiens
caaatacttttagcctattgag

SEQ ID NO: 7810739 - DNA, 22 bp, Homo sapiens
caaatactttatatacttcaaa

SEQ ID NO: 7810740 - DNA, 22 bp, Homo sapiens
caaatactttatatacttcaaa

SEQ ID NO: 7810741 - DNA, 18 bp, Homo sapiens
caaatactgttgtcttat

SEQ ID NO: 7810742 - DNA, 18 bp, Homo sapiens
caaatactgttgtcttat

SEQ ID NO: 7810743 - DNA, 18 bp, Homo sapiens
caaatactgttgtcttat

SEQ ID NO: 7810744 - DNA, 18 bp, Homo sapiens
caaatactgttgtcttat

SEQ ID NO: 7810745 - DNA, 18 bp, Homo sapiens
caaatactgttgtcttat

SEQ ID NO: 7810746 - DNA, 22 bp, Homo sapiens
caaatacttactgaacctgtgc

SEQ ID NO: 7810747 - DNA, 22 bp, Homo sapiens
caaatacttactgaacctgtgc

SEQ ID NO: 7810748 - DNA, 22 bp, Homo sapiens
caaatacttactgaacctgtgc

SEQ ID NO: 7810749 - DNA, 22 bp, Homo sapiens
caaatactgggtaagttaattt

SEQ ID NO: 7810750 - DNA, 22 bp, Homo sapiens
caaatactgtactgaacactgt

SEQ ID NO: 7810751 - DNA, 22 bp, Homo sapiens
caaatactgtactgaacactgt

SEQ ID NO: 7810752 - DNA, 22 bp, Homo sapiens
caaatactgtactgaacactgt

SEQ ID NO: 7810753 - DNA, 22 bp, Homo sapiens
caaatactacgattcttgcagt

SEQ ID NO: 7810754 - DNA, 22 bp, Homo sapiens
caaatactctggatgtgtttgt

SEQ ID NO: 7810755 - DNA, 22 bp, Homo sapiens
caaatactctggatgtgtttgt

SEQ ID NO: 7810756 - DNA, 22 bp, Homo sapiens
caaatactgagcacgcaatcaa

SEQ ID NO: 7810757 - DNA, 22 bp, Homo sapiens
caaatactctggatgtgtttgt

SEQ ID NO: 7810758 - DNA, 22 bp, Homo sapiens
caaatactctggatgtgtttgt

SEQ ID NO: 7810759 - DNA, 22 bp, Homo sapiens
caaatactgagcacgcaatcaa

SEQ ID NO: 7810760 - DNA, 22 bp, Homo sapiens
caaatactgggtaagttaattt

SEQ ID NO: 7810761 - DNA, 22 bp, Homo sapiens
caaatactgggtaagttaattt

SEQ ID NO: 7810762 - DNA, 22 bp, Homo sapiens
caaatactgagtttattttcaa

SEQ ID NO: 7810763 - DNA, 22 bp, Homo sapiens
caaatactgagtttattttcaa

SEQ ID NO: 7810764 - DNA, 22 bp, Homo sapiens
caaatactgggtaagttaattt

SEQ ID NO: 7810765 - DNA, 22 bp, Homo sapiens
caaatactgagtttattttcaa

SEQ ID NO: 7810766 - DNA, 22 bp, Homo sapiens
caaatactgagtttattttcaa

SEQ ID NO: 7810767 - DNA, 22 bp, Homo sapiens
caaatactgagtttattttcaa

SEQ ID NO: 7810768 - DNA, 22 bp, Homo sapiens
caaagctggaaaaggaggctgg

SEQ ID NO: 7810769 - DNA, 22 bp, Homo sapiens
caaagctgatactcagcaagta

SEQ ID NO: 7810770 - DNA, 22 bp, Homo sapiens
caaagctgacgaggtcagcatc

SEQ ID NO: 7810771 - DNA, 22 bp, Homo sapiens
caaagctggactgctcagttca

SEQ ID NO: 7810772 - DNA, 22 bp, Homo sapiens
caaagctgtgaattcctacaaa

SEQ ID NO: 7810773 - DNA, 22 bp, Homo sapiens
caaagctcagccctccaatgaa

SEQ ID NO: 7810774 - DNA, 22 bp, Homo sapiens
caaagctgtgaattcctacaaa

SEQ ID NO: 7810775 - DNA, 22 bp, Homo sapiens
caaagctggactgctcagttca

SEQ ID NO: 7810776 - DNA, 22 bp, Homo sapiens
caaaggaagctccttgatggcg

SEQ ID NO: 7810777 - DNA, 22 bp, Homo sapiens
caaaggaaatactaatctggaa

SEQ ID NO: 7810778 - DNA, 22 bp, Homo sapiens
caaagctgtgaattcctacaaa

SEQ ID NO: 7810779 - DNA, 22 bp, Homo sapiens
caaagcttggagaagcagctgg

SEQ ID NO: 7810780 - DNA, 22 bp, Homo sapiens
caaagcttcatctgttgttttg

SEQ ID NO: 7810781 - DNA, 22 bp, Homo sapiens
caaaggaaatactaatctggaa

SEQ ID NO: 7810782 - DNA, 22 bp, Homo sapiens
caaagcttggagaagcagctgg

SEQ ID NO: 7810783 - DNA, 22 bp, Homo sapiens
caaagctgacgaggtcagcatc

SEQ ID NO: 7810784 - DNA, 22 bp, Homo sapiens
caaagctgacgaggtcagcatc

SEQ ID NO: 7810785 - DNA, 22 bp, Homo sapiens
caaagctcgccacctctgaggg

SEQ ID NO: 7810786 - DNA, 22 bp, Homo sapiens
caaagctcagccctccaatgaa

SEQ ID NO: 7810787 - DNA, 22 bp, Homo sapiens
caaagcctctgatttcacttgt

SEQ ID NO: 7810788 - DNA, 18 bp, Homo sapiens
caaagctcacgttccatc

SEQ ID NO: 7810789 - DNA, 22 bp, Homo sapiens
caaatacaaatacgggcagctt

SEQ ID NO: 7810790 - DNA, 22 bp, Homo sapiens
caaatactaaacataagatttt

SEQ ID NO: 7810791 - DNA, 22 bp, Homo sapiens
caaatactaaacataagatttt

SEQ ID NO: 7810792 - DNA, 22 bp, Homo sapiens
caaatacaaatacgggcagctt

SEQ ID NO: 7810793 - DNA, 22 bp, Homo sapiens
caaataattactatcctcactt

SEQ ID NO: 7810794 - DNA, 22 bp, Homo sapiens
caaatacaaatacgggcagctt

SEQ ID NO: 7810795 - DNA, 22 bp, Homo sapiens
caaatacaaatacgggcagctt

SEQ ID NO: 7810796 - DNA, 22 bp, Homo sapiens
caaatactaaacataagatttt

SEQ ID NO: 7810797 - DNA, 22 bp, Homo sapiens
caaatactaaacataagatttt

SEQ ID NO: 7810798 - DNA, 22 bp, Homo sapiens
caaatactaaacataagatttt

SEQ ID NO: 7810799 - DNA, 22 bp, Homo sapiens
caaatactacgattcttgcagt

SEQ ID NO: 7810800 - DNA, 22 bp, Homo sapiens
caaatactacgattcttgcagt

SEQ ID NO: 7810801 - DNA, 22 bp, Homo sapiens
caaatactaaacataagatttt

SEQ ID NO: 7810802 - DNA, 22 bp, Homo sapiens
caaagtgctggaattacaggtg

SEQ ID NO: 7810803 - DNA, 22 bp, Homo sapiens
caaaggcaacatatacttgttt

SEQ ID NO: 7810804 - DNA, 22 bp, Homo sapiens
caaagtgctggaattacaggtg

SEQ ID NO: 7810805 - DNA, 21 bp, Homo sapiens
caaaggactgtagctcactga

SEQ ID NO: 7810806 - DNA, 22 bp, Homo sapiens
gcagctggaagtgacactctgt

SEQ ID NO: 7810807 - DNA, 22 bp, Homo sapiens
gcagctggaagtgacactctgt

SEQ ID NO: 7810808 - DNA, 22 bp, Homo sapiens
gcagctgctgtggcatcaagct

SEQ ID NO: 7810809 - DNA, 19 bp, Homo sapiens
gcagctgcttgaaaagaaa

SEQ ID NO: 7810810 - DNA, 19 bp, Homo sapiens
gcagctgcttgaaaagaaa

SEQ ID NO: 7810811 - DNA, 22 bp, Homo sapiens
gcagctgctggagggaggcagg

SEQ ID NO: 7810812 - DNA, 22 bp, Homo sapiens
gcagctgctggagggaggcagg

SEQ ID NO: 7810813 - DNA, 22 bp, Homo sapiens
gcagctgctggagggaggcagg

SEQ ID NO: 7810814 - DNA, 22 bp, Homo sapiens
gcagctgctggagggaggcagg

SEQ ID NO: 7810815 - DNA, 22 bp, Homo sapiens
gcagctgctggagggaggcagg

SEQ ID NO: 7810816 - DNA, 22 bp, Homo sapiens
gcagctgctgtggcatcaagct

SEQ ID NO: 7810817 - DNA, 22 bp, Homo sapiens
gcagctgctgtggcatcaagct

SEQ ID NO: 7810818 - DNA, 22 bp, Homo sapiens
gcagctgctgggatcatttagg

SEQ ID NO: 7810819 - DNA, 22 bp, Homo sapiens
gcagctgctgggatcatttagg

SEQ ID NO: 7810820 - DNA, 22 bp, Homo sapiens
gcagctgctgggatcatttagg

SEQ ID NO: 7810821 - DNA, 22 bp, Homo sapiens
attccttctttgagaataagca

SEQ ID NO: 7810822 - DNA, 22 bp, Homo sapiens
attccttctttgagaataagca

SEQ ID NO: 7810823 - DNA, 22 bp, Homo sapiens
gcagctggacccacacggctta

SEQ ID NO: 7810824 - DNA, 22 bp, Homo sapiens
gcagctggacccacacggctta

SEQ ID NO: 7810825 - DNA, 22 bp, Homo sapiens
gcagctggaagtgacactctgt

SEQ ID NO: 7810826 - DNA, 22 bp, Homo sapiens
gcagctggacccacacggctta

SEQ ID NO: 7810827 - DNA, 22 bp, Homo sapiens
attccttgcacatcagatagtt

SEQ ID NO: 7810828 - DNA, 22 bp, Homo sapiens
attccttgcacatcagatagtt

SEQ ID NO: 7810829 - DNA, 22 bp, Homo sapiens
attccttgcacatcagatagtt

SEQ ID NO: 7810830 - DNA, 22 bp, Homo sapiens
attccttggaacagatgcgaag

SEQ ID NO: 7810831 - DNA, 22 bp, Homo sapiens
attccttgctctcatcaacctt

SEQ ID NO: 7810832 - DNA, 22 bp, Homo sapiens
attccttgctctcatcaacctt

SEQ ID NO: 7810833 - DNA, 22 bp, Homo sapiens
gcagctgcctattcagggcttg

SEQ ID NO: 7810834 - DNA, 22 bp, Homo sapiens
gcagcgaggtgatgaaatagct

SEQ ID NO: 7810835 - DNA, 22 bp, Homo sapiens
gcagcgaggtgatgaaatagct

SEQ ID NO: 7810836 - DNA, 22 bp, Homo sapiens
gcagcgagtgcggctgccacag

SEQ ID NO: 7810837 - DNA, 22 bp, Homo sapiens
gcagcgaggtgatgaaatagct

SEQ ID NO: 7810838 - DNA, 22 bp, Homo sapiens
gcagctgcgaagaagtctatct

SEQ ID NO: 7810839 - DNA, 22 bp, Homo sapiens
gcagctgccttcagctggatgg

SEQ ID NO: 7810840 - DNA, 22 bp, Homo sapiens
gcagctgccttcagctggatgg

SEQ ID NO: 7810841 - DNA, 22 bp, Homo sapiens
gcagctgccttcagctggatgg

SEQ ID NO: 7810842 - DNA, 22 bp, Homo sapiens
gcagctgccttcagctggatgg

SEQ ID NO: 7810843 - DNA, 22 bp, Homo sapiens
gcagcgataagagaactgggac

SEQ ID NO: 7810844 - DNA, 22 bp, Homo sapiens
gcagctgccttcagctggatgg

SEQ ID NO: 7810845 - DNA, 22 bp, Homo sapiens
gcagctgccttcagctggatgg

SEQ ID NO: 7810846 - DNA, 22 bp, Homo sapiens
gcagctgcctattcagggcttg

SEQ ID NO: 7810847 - DNA, 22 bp, Homo sapiens
gcagctgccttcagctggatgg

SEQ ID NO: 7810848 - DNA, 22 bp, Homo sapiens
gcagctgcgctggtgtggggca

SEQ ID NO: 7810849 - DNA, 22 bp, Homo sapiens
gcagctgcgctggtgtggggca

SEQ ID NO: 7810850 - DNA, 22 bp, Homo sapiens
gcagctgcgaagaagtctatct

SEQ ID NO: 7810851 - DNA, 22 bp, Homo sapiens
gcagctgcgctggtgtggggca

SEQ ID NO: 7810852 - DNA, 22 bp, Homo sapiens
gcagctgcgctggtgtggggca

SEQ ID NO: 7810853 - DNA, 22 bp, Homo sapiens
gcagctgcgctggtgtggggca

SEQ ID NO: 7810854 - DNA, 22 bp, Homo sapiens
gcagctgctcacattctcacaa

SEQ ID NO: 7810855 - DNA, 22 bp, Homo sapiens
gcagctgctcacattctcacaa

SEQ ID NO: 7810856 - DNA, 22 bp, Homo sapiens
gcagctgctcccttttacagtg

SEQ ID NO: 7810857 - DNA, 22 bp, Homo sapiens
gcagctgctcacattctcacaa

SEQ ID NO: 7810858 - DNA, 22 bp, Homo sapiens
gcagctgctcacattctcacaa

SEQ ID NO: 7810859 - DNA, 22 bp, Homo sapiens
gcagctgctcacattctcacaa

SEQ ID NO: 7810860 - DNA, 22 bp, Homo sapiens
gcagctgctggagggaggcagg

SEQ ID NO: 7810861 - DNA, 22 bp, Homo sapiens
gcagctgctggaagttcctgcc

SEQ ID NO: 7810862 - DNA, 22 bp, Homo sapiens
gcagctgctggaagttcctgcc

SEQ ID NO: 7810863 - DNA, 22 bp, Homo sapiens
gcagctgctcccttttacagtg

SEQ ID NO: 7810864 - DNA, 22 bp, Homo sapiens
gcagctgctggaagttcctgcc

SEQ ID NO: 7810865 - DNA, 22 bp, Homo sapiens
gcagctgctggaagttcctgcc

SEQ ID NO: 7810866 - DNA, 22 bp, Homo sapiens
gcagctgctggaagttcctgcc

SEQ ID NO: 7810867 - DNA, 22 bp, Homo sapiens
attcttgatatagatagttaat

SEQ ID NO: 7810868 - DNA, 22 bp, Homo sapiens
attcttgatatagatagttaat

SEQ ID NO: 7810869 - DNA, 22 bp, Homo sapiens
attcttcttgagtcttggactc

SEQ ID NO: 7810870 - DNA, 22 bp, Homo sapiens
attcttgcagtatacaactact

SEQ ID NO: 7810871 - DNA, 22 bp, Homo sapiens
attcttggcaaggagatttaaa

SEQ ID NO: 7810872 - DNA, 22 bp, Homo sapiens
attcttgcttcacactcctctg

SEQ ID NO: 7810873 - DNA, 23 bp, Homo sapiens
attcttggggaaatagtatgagc

SEQ ID NO: 7810874 - DNA, 23 bp, Homo sapiens
attcttggggaaatagtatgagc

SEQ ID NO: 7810875 - DNA, 19 bp, Homo sapiens
attcttggtgcaccttgta

SEQ ID NO: 7810876 - DNA, 22 bp, Homo sapiens
attccttgtatatctacatgca

SEQ ID NO: 7810877 - DNA, 22 bp, Homo sapiens
attccttgggaattattgaatg

SEQ ID NO: 7810878 - DNA, 22 bp, Homo sapiens
attccttgggctgccttattat

SEQ ID NO: 7810879 - DNA, 22 bp, Homo sapiens
attccttgggctgccttattat

SEQ ID NO: 7810880 - DNA, 22 bp, Homo sapiens
attccttgtatatctacatgca

SEQ ID NO: 7810881 - DNA, 19 bp, Homo sapiens
attcttcagcagtgagacc

SEQ ID NO: 7810882 - DNA, 22 bp, Homo sapiens
attccttggaacagatgcgaag

SEQ ID NO: 7810883 - DNA, 22 bp, Homo sapiens
attccttggcattctggacttg

SEQ ID NO: 7810884 - DNA, 22 bp, Homo sapiens
attccttggcattctggacttg

SEQ ID NO: 7810885 - DNA, 22 bp, Homo sapiens
attccttgggaattattgaatg

SEQ ID NO: 7810886 - DNA, 22 bp, Homo sapiens
attccttgggaattattgaatg

SEQ ID NO: 7810887 - DNA, 22 bp, Homo sapiens
attctttagccagcaggtatat

SEQ ID NO: 7810888 - DNA, 22 bp, Homo sapiens
attctttagttggcttcttgcc

SEQ ID NO: 7810889 - DNA, 22 bp, Homo sapiens
attctttcatataaaggctcag

SEQ ID NO: 7810890 - DNA, 22 bp, Homo sapiens
attctttcatataaaggctcag

SEQ ID NO: 7810891 - DNA, 22 bp, Homo sapiens
attctttcaaggaatagttatt

SEQ ID NO: 7810892 - DNA, 22 bp, Homo sapiens
attctttcaaggaatagttatt

SEQ ID NO: 7810893 - DNA, 22 bp, Homo sapiens
attctttattgctgatggttat

SEQ ID NO: 7810894 - DNA, 22 bp, Homo sapiens
attctttcaaggaatagttatt

SEQ ID NO: 7810895 - DNA, 22 bp, Homo sapiens
attctttaattcaattgaagga

SEQ ID NO: 7810896 - DNA, 22 bp, Homo sapiens
attctttaattcaattgaagga

SEQ ID NO: 7810897 - DNA, 19 bp, Homo sapiens
attcttgttaagtgtcatc

SEQ ID NO: 7810898 - DNA, 22 bp, Homo sapiens
attcttgtaaattttgtgtgaa

SEQ ID NO: 7810899 - DNA, 22 bp, Homo sapiens
attcttgtttaatttgcatccc

SEQ ID NO: 7810900 - DNA, 22 bp, Homo sapiens
attctttaattcaattgaagga

SEQ ID NO: 7810901 - DNA, 22 bp, Homo sapiens
attgatttgaacaaagatatta

SEQ ID NO: 7810902 - DNA, 22 bp, Homo sapiens
attgatttagctcaagacacat

SEQ ID NO: 7810903 - DNA, 22 bp, Homo sapiens
attgattctcataggaccatct

SEQ ID NO: 7810904 - DNA, 23 bp, Homo sapiens
attgattccctcttggaagggat

SEQ ID NO: 7810905 - DNA, 22 bp, Homo sapiens
attgattctgtaagtcaacaat

SEQ ID NO: 7810906 - DNA, 22 bp, Homo sapiens
attgattctgtaagtcaacaat

SEQ ID NO: 7810907 - DNA, 22 bp, Homo sapiens
attgattgaagtaaaataacct

SEQ ID NO: 7810908 - DNA, 22 bp, Homo sapiens
attgattgaagtaaaataacct

SEQ ID NO: 7810909 - DNA, 22 bp, Homo sapiens
attgattgaagtaaaataacct

SEQ ID NO: 7810910 - DNA, 22 bp, Homo sapiens
attgatttgaacaaagatatta

SEQ ID NO: 7810911 - DNA, 22 bp, Homo sapiens
attgatttgaacaaagatatta

SEQ ID NO: 7810912 - DNA, 22 bp, Homo sapiens
attgcaaaattgtcctgtggaa

SEQ ID NO: 7810913 - DNA, 22 bp, Homo sapiens
attgcaaagaaatacatgctta

SEQ ID NO: 7810914 - DNA, 22 bp, Homo sapiens
attgcaaagaaatacatgctta

SEQ ID NO: 7810915 - DNA, 22 bp, Homo sapiens
attgcaaagaaatacatgctta

SEQ ID NO: 7810916 - DNA, 22 bp, Homo sapiens
attgcaaagcattgtgagcgca

SEQ ID NO: 7810917 - DNA, 22 bp, Homo sapiens
attgcaaagaaatacatgctta

SEQ ID NO: 7810918 - DNA, 22 bp, Homo sapiens
attgcaaagaaatacatgctta

SEQ ID NO: 7810919 - DNA, 22 bp, Homo sapiens
gcagggctgactcagccaccct

SEQ ID NO: 7810920 - DNA, 22 bp, Homo sapiens
gcagggctgactcagccaccct

SEQ ID NO: 7810921 - DNA, 22 bp, Homo sapiens
gcagggctgactcagccaccct

SEQ ID NO: 7810922 - DNA, 22 bp, Homo sapiens
gcagggctgcagagggcactgt

SEQ ID NO: 7810923 - DNA, 22 bp, Homo sapiens
gcagggctgcagagggcactgt

SEQ ID NO: 7810924 - DNA, 22 bp, Homo sapiens
gcagggctgcagagggcactgt

SEQ ID NO: 7810925 - DNA, 22 bp, Homo sapiens
gcagggctgcagagggcactgt

SEQ ID NO: 7810926 - DNA, 22 bp, Homo sapiens
gcagggctgcagagggcactgt

SEQ ID NO: 7810927 - DNA, 22 bp, Homo sapiens
gcagggctgcagagggcactgt

SEQ ID NO: 7810928 - DNA, 22 bp, Homo sapiens
gcagggctgcagagggcactgt

SEQ ID NO: 7810929 - DNA, 22 bp, Homo sapiens
gcagggctgcagagggcactgt

SEQ ID NO: 7810930 - DNA, 22 bp, Homo sapiens
gcagggctgggacttactggta

SEQ ID NO: 7810931 - DNA, 18 bp, Homo sapiens
gcagggctggacaagtca

SEQ ID NO: 7810932 - DNA, 22 bp, Homo sapiens
gcagggctgggacttactggta

SEQ ID NO: 7810933 - DNA, 22 bp, Homo sapiens
gcagggctgggacttactggta

SEQ ID NO: 7810934 - DNA, 22 bp, Homo sapiens
gcagggctgcagagggcactgt

SEQ ID NO: 7810935 - DNA, 22 bp, Homo sapiens
gcagggctgctgaaacttgttt

SEQ ID NO: 7810936 - DNA, 22 bp, Homo sapiens
gcagggctgagtcatgtgtgcc

SEQ ID NO: 7810937 - DNA, 22 bp, Homo sapiens
gcagggctgatggcttccctca

SEQ ID NO: 7810938 - DNA, 22 bp, Homo sapiens
gcagggctgagtcatgtgtgcc

SEQ ID NO: 7810939 - DNA, 22 bp, Homo sapiens
gcagggctgagtcatgtgtgcc

SEQ ID NO: 7810940 - DNA, 22 bp, Homo sapiens
gcagggctgagtcatgtgtgcc

SEQ ID NO: 7810941 - DNA, 22 bp, Homo sapiens
gcagggctgagtcatgtgtgcc

SEQ ID NO: 7810942 - DNA, 22 bp, Homo sapiens
gcagggctgagtcatgtgtgcc

SEQ ID NO: 7810943 - DNA, 22 bp, Homo sapiens
gcagggctgatggcttccctca

SEQ ID NO: 7810944 - DNA, 22 bp, Homo sapiens
gcagggctgatgttattgacga

SEQ ID NO: 7810945 - DNA, 22 bp, Homo sapiens
gcagggctgatgttattgacga

SEQ ID NO: 7810946 - DNA, 18 bp, Homo sapiens
gcagggctgcacacgcat

SEQ ID NO: 7810947 - DNA, 22 bp, Homo sapiens
gcagggctgatgttattgacga

SEQ ID NO: 7810948 - DNA, 18 bp, Homo sapiens
gcagggctgcacacgcat

SEQ ID NO: 7810949 - DNA, 22 bp, Homo sapiens
gcaggccttggcaatgagcctg

SEQ ID NO: 7810950 - DNA, 22 bp, Homo sapiens
gcaggcctttatccctgcctca

SEQ ID NO: 7810951 - DNA, 22 bp, Homo sapiens
gcaggcctgtcttgctcgccct

SEQ ID NO: 7810952 - DNA, 22 bp, Homo sapiens
gcaggcctggtttacatggtag

SEQ ID NO: 7810953 - DNA, 22 bp, Homo sapiens
gcaggccttggcaatgagcctg

SEQ ID NO: 7810954 - DNA, 22 bp, Homo sapiens
gcaggccttggcaatgagcctg

SEQ ID NO: 7810955 - DNA, 22 bp, Homo sapiens
gcaggccttggcaatgagcctg

SEQ ID NO: 7810956 - DNA, 22 bp, Homo sapiens
gcaggcctgtaatgaagggaca

SEQ ID NO: 7810957 - DNA, 22 bp, Homo sapiens
gcaggcctgtaatgaagggaca

SEQ ID NO: 7810958 - DNA, 22 bp, Homo sapiens
gcaggcctgtaatgaagggaca

SEQ ID NO: 7810959 - DNA, 22 bp, Homo sapiens
gcaggcctgtaatgaagggaca

SEQ ID NO: 7810960 - DNA, 22 bp, Homo sapiens
gcaggcctggtttacatggtag

SEQ ID NO: 7810961 - DNA, 22 bp, Homo sapiens
gcaggcctggtttacatggtag

SEQ ID NO: 7810962 - DNA, 22 bp, Homo sapiens
gcaggcctggtttacatggtag

SEQ ID NO: 7810963 - DNA, 22 bp, Homo sapiens
gcaggcctgtaatgaagggaca

SEQ ID NO: 7810964 - DNA, 22 bp, Homo sapiens
gcaggcctgtcttgctcgccct

SEQ ID NO: 7810965 - DNA, 22 bp, Homo sapiens
gcaggcctgtcttgctcgccct

SEQ ID NO: 7810966 - DNA, 22 bp, Homo sapiens
gcaggcctgcccagcaggatgg

SEQ ID NO: 7810967 - DNA, 22 bp, Homo sapiens
gcaggcctgcccagcaggatgg

SEQ ID NO: 7810968 - DNA, 22 bp, Homo sapiens
gcaggcctgcccagcaggatgg

SEQ ID NO: 7810969 - DNA, 22 bp, Homo sapiens
gcaggcctgcccagcaggatgg

SEQ ID NO: 7810970 - DNA, 22 bp, Homo sapiens
gcaggcctggtttacatggtag

SEQ ID NO: 7810971 - DNA, 22 bp, Homo sapiens
gcaggcctgggagtcatcttgt

SEQ ID NO: 7810972 - DNA, 22 bp, Homo sapiens
gcaggcctgactgtagggggca

SEQ ID NO: 7810973 - DNA, 22 bp, Homo sapiens
gcaggcctgactgtagggggca

SEQ ID NO: 7810974 - DNA, 19 bp, Homo sapiens
gcaggcctcttgggaatta

SEQ ID NO: 7810975 - DNA, 22 bp, Homo sapiens
gcaggcctgactgtagggggca

SEQ ID NO: 7810976 - DNA, 22 bp, Homo sapiens
gcaggcctgactgtagggggca

SEQ ID NO: 7810977 - DNA, 22 bp, Homo sapiens
gcaggcctgcaggtatggccgg

SEQ ID NO: 7810978 - DNA, 22 bp, Homo sapiens
gcaggcctgcaggtatggccgg

SEQ ID NO: 7810979 - DNA, 22 bp, Homo sapiens
gcaggcctgcccagcaggatgg

SEQ ID NO: 7810980 - DNA, 22 bp, Homo sapiens
attgatatattatttctaactg

SEQ ID NO: 7810981 - DNA, 22 bp, Homo sapiens
attgatatattatttctaactg

SEQ ID NO: 7810982 - DNA, 22 bp, Homo sapiens
attgataaattgcaatggggct

SEQ ID NO: 7810983 - DNA, 22 bp, Homo sapiens
gcaggcctttatccctgcctca

SEQ ID NO: 7810984 - DNA, 22 bp, Homo sapiens
gcaggcggaggttgcagtgagc

SEQ ID NO: 7810985 - DNA, 22 bp, Homo sapiens
gcaggcggaggttgcagtgagc

SEQ ID NO: 7810986 - DNA, 23 bp, Homo sapiens
attgaccagctgtctcattttca

SEQ ID NO: 7810987 - DNA, 22 bp, Homo sapiens
attgacccagtggacttgatgg

SEQ ID NO: 7810988 - DNA, 22 bp, Homo sapiens
attgacctggcagactggactg

SEQ ID NO: 7810989 - DNA, 22 bp, Homo sapiens
attgatgggaatggctaaactt

SEQ ID NO: 7810990 - DNA, 22 bp, Homo sapiens
attgatggagagatttccattg

SEQ ID NO: 7810991 - DNA, 22 bp, Homo sapiens
attgatgggtgccaatggagtg

SEQ ID NO: 7810992 - DNA, 22 bp, Homo sapiens
attgatggtgatagtgctgtgg

SEQ ID NO: 7810993 - DNA, 22 bp, Homo sapiens
attgatgtagtttcagatttca

SEQ ID NO: 7810994 - DNA, 22 bp, Homo sapiens
attgatggtgcttatagtcatg

SEQ ID NO: 7810995 - DNA, 22 bp, Homo sapiens
attgatgtgtcacaagagattt

SEQ ID NO: 7810996 - DNA, 22 bp, Homo sapiens
attgatgtgccgaaatagaggc

SEQ ID NO: 7810997 - DNA, 22 bp, Homo sapiens
attgatgtgtaatgaaggagtt

SEQ ID NO: 7810998 - DNA, 22 bp, Homo sapiens
attgatgtgtcacaagagattt

SEQ ID NO: 7810999 - DNA, 22 bp, Homo sapiens
attgatgttactattctggtct

SEQ ID NO: 7811000 - DNA, 22 bp, Homo sapiens
attgatgttactattctggtct

SEQ ID NO: 7811001 - DNA, 22 bp, Homo sapiens
attgatgttagaatctactcct

SEQ ID NO: 7811002 - DNA, 22 bp, Homo sapiens
attgatgttagaatctactcct

SEQ ID NO: 7811003 - DNA, 23 bp, Homo sapiens
attgatgacttgattacactttt

SEQ ID NO: 7811004 - DNA, 22 bp, Homo sapiens
attgatgagcattactctctaa

SEQ ID NO: 7811005 - DNA, 22 bp, Homo sapiens
attgatggaaaacaaatgatga

SEQ ID NO: 7811006 - DNA, 22 bp, Homo sapiens
attgatggagagatttccattg

SEQ ID NO: 7811007 - DNA, 22 bp, Homo sapiens
attgatggcggcctctccatat

SEQ ID NO: 7811008 - DNA, 22 bp, Homo sapiens
attgatatcagtttgctgattg

SEQ ID NO: 7811009 - DNA, 22 bp, Homo sapiens
attgatatattatttctaactg

SEQ ID NO: 7811010 - DNA, 22 bp, Homo sapiens
attgatatattatttctaactg

SEQ ID NO: 7811011 - DNA, 22 bp, Homo sapiens
attgatatcagtttgctgattg

SEQ ID NO: 7811012 - DNA, 22 bp, Homo sapiens
attgatcatgcagatgcttcac

SEQ ID NO: 7811013 - DNA, 22 bp, Homo sapiens
gcatagtaggctgtcaaaaatg

SEQ ID NO: 7811014 - DNA, 22 bp, Homo sapiens
gcataggcactttcctcctcct

SEQ ID NO: 7811015 - DNA, 22 bp, Homo sapiens
gcatagctttgatgctgcctta

SEQ ID NO: 7811016 - DNA, 22 bp, Homo sapiens
gcatagaatttagagacaaaag

SEQ ID NO: 7811017 - DNA, 22 bp, Homo sapiens
gcatatgatcacgtgtgtcggt

SEQ ID NO: 7811018 - DNA, 22 bp, Homo sapiens
gcatatgatcacgtgtgtcggt

SEQ ID NO: 7811019 - DNA, 22 bp, Homo sapiens
gcatattagtaatctttcaaca

SEQ ID NO: 7811020 - DNA, 22 bp, Homo sapiens
gcatatggtattagtggtgcta

SEQ ID NO: 7811021 - DNA, 22 bp, Homo sapiens
gcatatgatcacgtgtgtcggt

SEQ ID NO: 7811022 - DNA, 17 bp, Homo sapiens
gcatcacagataacacg

SEQ ID NO: 7811023 - DNA, 22 bp, Homo sapiens
gcatcagaatcatccggggaat

SEQ ID NO: 7811024 - DNA, 22 bp, Homo sapiens
gcatcagaatcatccggggaat

SEQ ID NO: 7811025 - DNA, 22 bp, Homo sapiens
attgtacttttattacatgtag

SEQ ID NO: 7811026 - DNA, 22 bp, Homo sapiens
attgtataacagcatgtatttt

SEQ ID NO: 7811027 - DNA, 22 bp, Homo sapiens
attgtacttttattacatgtag

SEQ ID NO: 7811028 - DNA, 17 bp, Homo sapiens
gcatcacagataacacg

SEQ ID NO: 7811029 - DNA, 19 bp, Homo sapiens
gcatcaaagctgactcctg

SEQ ID NO: 7811030 - DNA, 17 bp, Homo sapiens
gcatcacagataacacg

SEQ ID NO: 7811031 - DNA, 22 bp, Homo sapiens
gcatattttcacaagctcttgg

SEQ ID NO: 7811032 - DNA, 22 bp, Homo sapiens
attgtcattccagtcattgtta

SEQ ID NO: 7811033 - DNA, 22 bp, Homo sapiens
attgtcattccagtcattgtta

SEQ ID NO: 7811034 - DNA, 22 bp, Homo sapiens
attgtcattggcttctatgtct

SEQ ID NO: 7811035 - DNA, 22 bp, Homo sapiens
attgtcctatctcagtgccatg

SEQ ID NO: 7811036 - DNA, 22 bp, Homo sapiens
attgtctcttaaatgtggaaat

SEQ ID NO: 7811037 - DNA, 17 bp, Homo sapiens
attgtctcttcacttat

SEQ ID NO: 7811038 - DNA, 22 bp, Homo sapiens
attgtccatctccacattaatg

SEQ ID NO: 7811039 - DNA, 22 bp, Homo sapiens
attgtcgtcaatggacacatag

SEQ ID NO: 7811040 - DNA, 22 bp, Homo sapiens
attgtcagtgggatttgtcaac

SEQ ID NO: 7811041 - DNA, 22 bp, Homo sapiens
attgtcatcgatgttagccagt

SEQ ID NO: 7811042 - DNA, 22 bp, Homo sapiens
attgtcagctcgaaatgcatca

SEQ ID NO: 7811043 - DNA, 22 bp, Homo sapiens
attgtcagctcgaaatgcatca

SEQ ID NO: 7811044 - DNA, 22 bp, Homo sapiens
attgtcagagtttgagaaagta

SEQ ID NO: 7811045 - DNA, 22 bp, Homo sapiens
attgtatttgtacaagacatgt

SEQ ID NO: 7811046 - DNA, 22 bp, Homo sapiens
attgtatttgtacaagacatgt

SEQ ID NO: 7811047 - DNA, 22 bp, Homo sapiens
attgtcacttaaaagtgcatgt

SEQ ID NO: 7811048 - DNA, 16 bp, Homo sapiens
gcagtgtgtttaatag

SEQ ID NO: 7811049 - DNA, 22 bp, Homo sapiens
gcagtgtgtgtccccacactgg

SEQ ID NO: 7811050 - DNA, 22 bp, Homo sapiens
gcagtgtgtttctgagatatgg

SEQ ID NO: 7811051 - DNA, 22 bp, Homo sapiens
gcagtgttaaacaactgctgct

SEQ ID NO: 7811052 - DNA, 22 bp, Homo sapiens
gcagtgtgtttggataacacac

SEQ ID NO: 7811053 - DNA, 22 bp, Homo sapiens
gcagtgtgtggtgagggctgcc

SEQ ID NO: 7811054 - DNA, 22 bp, Homo sapiens
gcagtgtgtgtccccacactgg

SEQ ID NO: 7811055 - DNA, 22 bp, Homo sapiens
gcagtgtgtgtccccacactgg

SEQ ID NO: 7811056 - DNA, 22 bp, Homo sapiens
gcagtgtgtggtgagggctgcc

SEQ ID NO: 7811057 - DNA, 22 bp, Homo sapiens
gcagtgtgtttggataacacac

SEQ ID NO: 7811058 - DNA, 22 bp, Homo sapiens
gcagtgttaatgcgagtgttca

SEQ ID NO: 7811059 - DNA, 22 bp, Homo sapiens
gcagtgttacctcttcagtggg

SEQ ID NO: 7811060 - DNA, 22 bp, Homo sapiens
gcagtgttaaacaactgctgct

SEQ ID NO: 7811061 - DNA, 22 bp, Homo sapiens
gcagtgttacctcttcagtggg

SEQ ID NO: 7811062 - DNA, 22 bp, Homo sapiens
gcagtgttaccttgggctggtt

SEQ ID NO: 7811063 - DNA, 18 bp, Homo sapiens
gcatacagaggggaagta

SEQ ID NO: 7811064 - DNA, 22 bp, Homo sapiens
gcatacagtccttgtattcttc

SEQ ID NO: 7811065 - DNA, 22 bp, Homo sapiens
gcatagaatttagagacaaaag

SEQ ID NO: 7811066 - DNA, 22 bp, Homo sapiens
gcatagaaggttttggtatcaa

SEQ ID NO: 7811067 - DNA, 22 bp, Homo sapiens
gcatacaaaggtttacaactga

SEQ ID NO: 7811068 - DNA, 22 bp, Homo sapiens
gcagtgttacttggtttgcaga

SEQ ID NO: 7811069 - DNA, 22 bp, Homo sapiens
gcagtgttacttggagtactaa

SEQ ID NO: 7811070 - DNA, 22 bp, Homo sapiens
gcagtgttacttggagtactaa

SEQ ID NO: 7811071 - DNA, 22 bp, Homo sapiens
gcatacagagaggatgtggcat

SEQ ID NO: 7811072 - DNA, 22 bp, Homo sapiens
gcatacagagaggatgtggcat

SEQ ID NO: 7811073 - DNA, 21 bp, Homo sapiens
gcagtgcttcgagactgtggt

SEQ ID NO: 7811074 - DNA, 21 bp, Homo sapiens
gcagtgcttcgagactgtggt

SEQ ID NO: 7811075 - DNA, 20 bp, Homo sapiens
gcagtgctggtgcctctgct

SEQ ID NO: 7811076 - DNA, 22 bp, Homo sapiens
gcagggctgggatttgagccca

SEQ ID NO: 7811077 - DNA, 22 bp, Homo sapiens
gcagtgtgaccgagcttgcttc

SEQ ID NO: 7811078 - DNA, 22 bp, Homo sapiens
gcagtgtgacgctgttctccgt

SEQ ID NO: 7811079 - DNA, 22 bp, Homo sapiens
gcagtgtgaccgagcttgcttc

SEQ ID NO: 7811080 - DNA, 22 bp, Homo sapiens
gcagtgtgaccgagcttgcttc

SEQ ID NO: 7811081 - DNA, 23 bp, Homo sapiens
gcagtgtgaatccagtgtttcag

SEQ ID NO: 7811082 - DNA, 22 bp, Homo sapiens
gcagtgtgaccgagcttgcttc

SEQ ID NO: 7811083 - DNA, 22 bp, Homo sapiens
gcagtgtggcgtggggacctaa

SEQ ID NO: 7811084 - DNA, 22 bp, Homo sapiens
gcagtgtgtagagtttaggaaa

SEQ ID NO: 7811085 - DNA, 20 bp, Homo sapiens
gcagtgtgtatgaatagctg

SEQ ID NO: 7811086 - DNA, 22 bp, Homo sapiens
gcagtgtgatgcttccagccac

SEQ ID NO: 7811087 - DNA, 22 bp, Homo sapiens
gcagtgtggccccagtatcacg

SEQ ID NO: 7811088 - DNA, 22 bp, Homo sapiens
gcagtgtgcatggcttttggcc

SEQ ID NO: 7811089 - DNA, 22 bp, Homo sapiens
gcagtgtggccccagtatcacg

SEQ ID NO: 7811090 - DNA, 22 bp, Homo sapiens
gcagtgtggccccagtatcacg

SEQ ID NO: 7811091 - DNA, 22 bp, Homo sapiens
gcagtgtgtctcttggcttcct

SEQ ID NO: 7811092 - DNA, 22 bp, Homo sapiens
gcagtgtgtctggagtacatgg

SEQ ID NO: 7811093 - DNA, 22 bp, Homo sapiens
gcagtgtgtctcttggcttcct

SEQ ID NO: 7811094 - DNA, 22 bp, Homo sapiens
gcagtgtgtctcttggcttcct

SEQ ID NO: 7811095 - DNA, 20 bp, Homo sapiens
gcagtgtgtatgaatagctg

SEQ ID NO: 7811096 - DNA, 22 bp, Homo sapiens
gcagtgtgtggtgagggctgcc

SEQ ID NO: 7811097 - DNA, 22 bp, Homo sapiens
gcagtgtgtggtgagggctgcc

SEQ ID NO: 7811098 - DNA, 22 bp, Homo sapiens
gcagtgtgtctggagtacatgg

SEQ ID NO: 7811099 - DNA, 22 bp, Homo sapiens
gcagtgtgtctggagtacatgg

SEQ ID NO: 7811100 - DNA, 22 bp, Homo sapiens
gcagtgtgtggtgagggctgcc

SEQ ID NO: 7811101 - DNA, 22 bp, Homo sapiens
gcagtgtgtggtgagggctgcc

SEQ ID NO: 7811102 - DNA, 22 bp, Homo sapiens
attgtctttaaaaatatacaac

SEQ ID NO: 7811103 - DNA, 22 bp, Homo sapiens
attgtctttaaaaatatacaac

SEQ ID NO: 7811104 - DNA, 22 bp, Homo sapiens
attgtctttaaaaatatacaac

SEQ ID NO: 7811105 - DNA, 22 bp, Homo sapiens
attgtctttaaaaatatacaac

SEQ ID NO: 7811106 - DNA, 22 bp, Homo sapiens
attgtcttgtacgtttgcctgt

SEQ ID NO: 7811107 - DNA, 22 bp, Homo sapiens
attgtctttccactgagaagtt

SEQ ID NO: 7811108 - DNA, 22 bp, Homo sapiens
attgtctttaacctctgagggg

SEQ ID NO: 7811109 - DNA, 22 bp, Homo sapiens
attgtctttccactgagaagtt

SEQ ID NO: 7811110 - DNA, 22 bp, Homo sapiens
attgtctttggtgcttccagga

SEQ ID NO: 7811111 - DNA, 22 bp, Homo sapiens
attgtctttggtgcttccagga

SEQ ID NO: 7811112 - DNA, 22 bp, Homo sapiens
attgtctttggtgcttccagga

SEQ ID NO: 7811113 - DNA, 22 bp, Homo sapiens
attgtctttaaaaatatacaac

SEQ ID NO: 7811114 - DNA, 20 bp, Homo sapiens
attgtgaatactgcatatgt

SEQ ID NO: 7811115 - DNA, 20 bp, Homo sapiens
attgtgaatactgcatatgt

SEQ ID NO: 7811116 - DNA, 22 bp, Homo sapiens
attgtctttgtttaagggatac

SEQ ID NO: 7811117 - DNA, 22 bp, Homo sapiens
attgtcttggaaccaaggtctt

SEQ ID NO: 7811118 - DNA, 22 bp, Homo sapiens
attgtcttggcattcaaattag

SEQ ID NO: 7811119 - DNA, 22 bp, Homo sapiens
attgtcttggaaccaaggtctt

SEQ ID NO: 7811120 - DNA, 22 bp, Homo sapiens
attgtcttctggtcttatcttt

SEQ ID NO: 7811121 - DNA, 22 bp, Homo sapiens
attgtcttctggtcttatcttt

SEQ ID NO: 7811122 - DNA, 22 bp, Homo sapiens
attgtcttctgtcttatagttc

SEQ ID NO: 7811123 - DNA, 22 bp, Homo sapiens
attgtcttctgtcttatagttc

SEQ ID NO: 7811124 - DNA, 22 bp, Homo sapiens
attgtctgtactttaaaaatgt

SEQ ID NO: 7811125 - DNA, 22 bp, Homo sapiens
attgtcttacatactgtggagg

SEQ ID NO: 7811126 - DNA, 22 bp, Homo sapiens
attgtcttaaacaaatgtgttt

SEQ ID NO: 7811127 - DNA, 22 bp, Homo sapiens
attgtctgtactttaaaaatgt

SEQ ID NO: 7811128 - DNA, 22 bp, Homo sapiens
attgtgaatttcagttagagcc

SEQ ID NO: 7811129 - DNA, 22 bp, Homo sapiens
attgtgaatttcagttagagcc

SEQ ID NO: 7811130 - DNA, 22 bp, Homo sapiens
attgtgaattgagagtacttct

SEQ ID NO: 7811131 - DNA, 22 bp, Homo sapiens
attgtgaatagtgccgcagtaa

SEQ ID NO: 7811132 - DNA, 22 bp, Homo sapiens
attgtgaatagtgccgcagtaa

SEQ ID NO: 7811133 - DNA, 22 bp, Homo sapiens
attgtgaatagtgccgcagtaa

SEQ ID NO: 7811134 - DNA, 22 bp, Homo sapiens
attgtgaatagtgccgcagtaa

SEQ ID NO: 7811135 - DNA, 22 bp, Homo sapiens
attgtgaatagtgccgcagtaa

SEQ ID NO: 7811136 - DNA, 22 bp, Homo sapiens
attgtgaattgagagtacttct

SEQ ID NO: 7811137 - DNA, 22 bp, Homo sapiens
attgtgaattgagagtacttct

SEQ ID NO: 7811138 - DNA, 22 bp, Homo sapiens
gccaaagagctgagtacatgta

SEQ ID NO: 7811139 - DNA, 22 bp, Homo sapiens
gccaaagcccaggagacagcca

SEQ ID NO: 7811140 - DNA, 22 bp, Homo sapiens
gccaaagcagtcttgcctctgc

SEQ ID NO: 7811141 - DNA, 22 bp, Homo sapiens
gccaaagagctgagtacatgta

SEQ ID NO: 7811142 - DNA, 22 bp, Homo sapiens
gcattctatagtctacattaca

SEQ ID NO: 7811143 - DNA, 22 bp, Homo sapiens
attgtgcaaatattatctgtag

SEQ ID NO: 7811144 - DNA, 22 bp, Homo sapiens
attgtgcaatgttttacaattt

SEQ ID NO: 7811145 - DNA, 22 bp, Homo sapiens
gcattcctttataggaaaatgg

SEQ ID NO: 7811146 - DNA, 22 bp, Homo sapiens
gcattcctttataggaaaatgg

SEQ ID NO: 7811147 - DNA, 22 bp, Homo sapiens
gcattctagacagctacagaaa

SEQ ID NO: 7811148 - DNA, 22 bp, Homo sapiens
gcattctatagtctacattaca

SEQ ID NO: 7811149 - DNA, 22 bp, Homo sapiens
gccaagagtttccagctgcaag

SEQ ID NO: 7811150 - DNA, 22 bp, Homo sapiens
gccaagagaatgtgagagaaat

SEQ ID NO: 7811151 - DNA, 22 bp, Homo sapiens
gccaagagtttccagctgcaag

SEQ ID NO: 7811152 - DNA, 22 bp, Homo sapiens
gccaagcactgaggacattgtt

SEQ ID NO: 7811153 - DNA, 22 bp, Homo sapiens
gccaagcctgggaagagcccat

SEQ ID NO: 7811154 - DNA, 22 bp, Homo sapiens
gccaagagtttccagctgcaag

SEQ ID NO: 7811155 - DNA, 22 bp, Homo sapiens
gccaagcctgggaagagcccat

SEQ ID NO: 7811156 - DNA, 22 bp, Homo sapiens
gccaagcctgggaagagcccat

SEQ ID NO: 7811157 - DNA, 22 bp, Homo sapiens
gccaagcctgggaagagcccat

SEQ ID NO: 7811158 - DNA, 21 bp, Homo sapiens
gccaagaacaagacagacatg

SEQ ID NO: 7811159 - DNA, 22 bp, Homo sapiens
gccaagaaggtggggacatgca

SEQ ID NO: 7811160 - DNA, 22 bp, Homo sapiens
gccaagaaggtggggacatgca

SEQ ID NO: 7811161 - DNA, 22 bp, Homo sapiens
gccaagagaatgtgagagaaat

SEQ ID NO: 7811162 - DNA, 22 bp, Homo sapiens
gccaagagaatgtgagagaaat

SEQ ID NO: 7811163 - DNA, 22 bp, Homo sapiens
gccacagggcagatgcgcagag

SEQ ID NO: 7811164 - DNA, 22 bp, Homo sapiens
gccacagggcagatgcgcagag

SEQ ID NO: 7811165 - DNA, 22 bp, Homo sapiens
gccacagggcagatgcgcagag

SEQ ID NO: 7811166 - DNA, 22 bp, Homo sapiens
gccacagggattgttttgtgag

SEQ ID NO: 7811167 - DNA, 22 bp, Homo sapiens
gccacagggaggcgttttcagg

SEQ ID NO: 7811168 - DNA, 22 bp, Homo sapiens
gccacagggcgagcggaggcca

SEQ ID NO: 7811169 - DNA, 22 bp, Homo sapiens
gccacagggcgagcggaggcca

SEQ ID NO: 7811170 - DNA, 22 bp, Homo sapiens
gccacagggcgagcggaggcca

SEQ ID NO: 7811171 - DNA, 22 bp, Homo sapiens
gccacagggcgagcggaggcca

SEQ ID NO: 7811172 - DNA, 22 bp, Homo sapiens
gccacagggcgagcggaggcca

SEQ ID NO: 7811173 - DNA, 22 bp, Homo sapiens
gccacagggcagatgcgcagag

SEQ ID NO: 7811174 - DNA, 22 bp, Homo sapiens
gccacagggcagatgcgcagag

SEQ ID NO: 7811175 - DNA, 22 bp, Homo sapiens
gccacagggcagatgcgcagag

SEQ ID NO: 7811176 - DNA, 22 bp, Homo sapiens
gccacagggcgagcggaggcca

SEQ ID NO: 7811177 - DNA, 21 bp, Homo sapiens
gccaagaacaagacagacatg

SEQ ID NO: 7811178 - DNA, 22 bp, Homo sapiens
gccaagaaatgtgtcgggcagc

SEQ ID NO: 7811179 - DNA, 22 bp, Homo sapiens
gccaaccattggcttcttgtca

SEQ ID NO: 7811180 - DNA, 20 bp, Homo sapiens
gccaacgcgctggggctgcc

SEQ ID NO: 7811181 - DNA, 22 bp, Homo sapiens
gccaaattcctggcagaagcat

SEQ ID NO: 7811182 - DNA, 22 bp, Homo sapiens
gccaaatcttgcacactcttgt

SEQ ID NO: 7811183 - DNA, 22 bp, Homo sapiens
gccaacaggccttgctctgctc

SEQ ID NO: 7811184 - DNA, 22 bp, Homo sapiens
gccaaataagtggaatcacaca

SEQ ID NO: 7811185 - DNA, 22 bp, Homo sapiens
gccaaaggttggcctgtgagtt

SEQ ID NO: 7811186 - DNA, 22 bp, Homo sapiens
gccaaaggttggcctgtgagtt

SEQ ID NO: 7811187 - DNA, 23 bp, Homo sapiens
gccaaaggtctgttcagtggtga

SEQ ID NO: 7811188 - DNA, 22 bp, Homo sapiens
gccaaaggacctgtgggtgaca

SEQ ID NO: 7811189 - DNA, 22 bp, Homo sapiens
gccaaaggattctatggagata

SEQ ID NO: 7811190 - DNA, 16 bp, Homo sapiens
gccaaagggcaaagaa

SEQ ID NO: 7811191 - DNA, 22 bp, Homo sapiens
gccaaaggcccttctgaaggca

SEQ ID NO: 7811192 - DNA, 22 bp, Homo sapiens
gccaaaggcccttctgaaggca

SEQ ID NO: 7811193 - DNA, 22 bp, Homo sapiens
gccaaaggattctatggagata

SEQ ID NO: 7811194 - DNA, 22 bp, Homo sapiens
gccaaaggattctatggagata

SEQ ID NO: 7811195 - DNA, 22 bp, Homo sapiens
gccaaaggacctgtgggtgaca

SEQ ID NO: 7811196 - DNA, 22 bp, Homo sapiens
attcacttattctcaaagtcct

SEQ ID NO: 7811197 - DNA, 22 bp, Homo sapiens
attcactgtgggtcctttggat

SEQ ID NO: 7811198 - DNA, 22 bp, Homo sapiens
attcagaaagatatgcctggtt

SEQ ID NO: 7811199 - DNA, 22 bp, Homo sapiens
attcagaaactctgggcagaac

SEQ ID NO: 7811200 - DNA, 22 bp, Homo sapiens
attcacctttccccaaaatgag

SEQ ID NO: 7811201 - DNA, 22 bp, Homo sapiens
attcactgaatttcatgattat

SEQ ID NO: 7811202 - DNA, 22 bp, Homo sapiens
attcacggttgtgtgatgcaga

SEQ ID NO: 7811203 - DNA, 22 bp, Homo sapiens
attcacctgttagtaaaaatct

SEQ ID NO: 7811204 - DNA, 22 bp, Homo sapiens
attcaccatggaccaggggcct

SEQ ID NO: 7811205 - DNA, 22 bp, Homo sapiens
attcaccccctatttgcaatgc

SEQ ID NO: 7811206 - DNA, 22 bp, Homo sapiens
attcactgtcagcttgcatggg

SEQ ID NO: 7811207 - DNA, 22 bp, Homo sapiens
attcactggtgtcagggatcag

SEQ ID NO: 7811208 - DNA, 22 bp, Homo sapiens
attcagaaagttgtcatatttg

SEQ ID NO: 7811209 - DNA, 22 bp, Homo sapiens
attcagaaagggttgcctggtt

SEQ ID NO: 7811210 - DNA, 22 bp, Homo sapiens
attcagaaagcaagtgctgggt

SEQ ID NO: 7811211 - DNA, 21 bp, Homo sapiens
attcagaaagggaataaactc

SEQ ID NO: 7811212 - DNA, 21 bp, Homo sapiens
attcagaaagggaataaactc

SEQ ID NO: 7811213 - DNA, 22 bp, Homo sapiens
attcacattttatttcactgga

SEQ ID NO: 7811214 - DNA, 22 bp, Homo sapiens
attcacattttatttcactgga

SEQ ID NO: 7811215 - DNA, 22 bp, Homo sapiens
attcacatttagcctctgacat

SEQ ID NO: 7811216 - DNA, 22 bp, Homo sapiens
attcacattttatttcactgga

SEQ ID NO: 7811217 - DNA, 20 bp, Homo sapiens
attcaccaaatcatcccagg

SEQ ID NO: 7811218 - DNA, 22 bp, Homo sapiens
attcaccaagaatgatttcagt

SEQ ID NO: 7811219 - DNA, 22 bp, Homo sapiens
attcaccaagaatgatttcagt

SEQ ID NO: 7811220 - DNA, 22 bp, Homo sapiens
attcaccaagaatgatttcagt

SEQ ID NO: 7811221 - DNA, 22 bp, Homo sapiens
attcacccagcacagtggcagc

SEQ ID NO: 7811222 - DNA, 22 bp, Homo sapiens
attcacccacgtcttagtctgt

SEQ ID NO: 7811223 - DNA, 22 bp, Homo sapiens
attcacatttagcctctgacat

SEQ ID NO: 7811224 - DNA, 22 bp, Homo sapiens
attcacatttagcctctgacat

SEQ ID NO: 7811225 - DNA, 22 bp, Homo sapiens
attcacatttagacatcaggta

SEQ ID NO: 7811226 - DNA, 22 bp, Homo sapiens
attcacatttagacatcaggta

SEQ ID NO: 7811227 - DNA, 22 bp, Homo sapiens
attcacatttacaaagcactca

SEQ ID NO: 7811228 - DNA, 22 bp, Homo sapiens
attcacatttacaaagcactca

SEQ ID NO: 7811229 - DNA, 22 bp, Homo sapiens
attcacatttacaaagcactca

SEQ ID NO: 7811230 - DNA, 22 bp, Homo sapiens
attcacatttacaaagcactca

SEQ ID NO: 7811231 - DNA, 22 bp, Homo sapiens
attcacatttacaaagcactca

SEQ ID NO: 7811232 - DNA, 15 bp, Homo sapiens
attcacattgcttca

SEQ ID NO: 7811233 - DNA, 15 bp, Homo sapiens
attcacattgcttca

SEQ ID NO: 7811234 - DNA, 22 bp, Homo sapiens
attcacatttacaaagcactca

SEQ ID NO: 7811235 - DNA, 22 bp, Homo sapiens
attcacattgagcttcactgtg

SEQ ID NO: 7811236 - DNA, 22 bp, Homo sapiens
attcacattgagcttcactgtg

SEQ ID NO: 7811237 - DNA, 22 bp, Homo sapiens
attcacattgagcttcactgtg

SEQ ID NO: 7811238 - DNA, 22 bp, Homo sapiens
attcacattctagggccctact

SEQ ID NO: 7811239 - DNA, 22 bp, Homo sapiens
attcacattctagggccctact

SEQ ID NO: 7811240 - DNA, 22 bp, Homo sapiens
attcacatgttgaagccctaac

SEQ ID NO: 7811241 - DNA, 22 bp, Homo sapiens
attcacatgttgaagccctaac

SEQ ID NO: 7811242 - DNA, 22 bp, Homo sapiens
attcacatgtgcttcttatcac

SEQ ID NO: 7811243 - DNA, 22 bp, Homo sapiens
attcacatgtgcttcttatcac

SEQ ID NO: 7811244 - DNA, 22 bp, Homo sapiens
attcacatgtgcttcttatcac

SEQ ID NO: 7811245 - DNA, 22 bp, Homo sapiens
attcacatgcccaagcagcacc

SEQ ID NO: 7811246 - DNA, 22 bp, Homo sapiens
attcacatgtgcttcttatcac

SEQ ID NO: 7811247 - DNA, 22 bp, Homo sapiens
attcacatgtgcttcttatcac

SEQ ID NO: 7811248 - DNA, 22 bp, Homo sapiens
attcacatgcccaagcagcacc

SEQ ID NO: 7811249 - DNA, 22 bp, Homo sapiens
attcacatgcccaagcagcacc

SEQ ID NO: 7811250 - DNA, 22 bp, Homo sapiens
attcacatgatgtatgtagggc

SEQ ID NO: 7811251 - DNA, 22 bp, Homo sapiens
attcacatgcccaagcagcacc

SEQ ID NO: 7811252 - DNA, 22 bp, Homo sapiens
gcacctttctatattcagtggc

SEQ ID NO: 7811253 - DNA, 22 bp, Homo sapiens
gcaccttggctttcttggtggc

SEQ ID NO: 7811254 - DNA, 18 bp, Homo sapiens
gcaccttaccaattctac

SEQ ID NO: 7811255 - DNA, 22 bp, Homo sapiens
gcacctggtttatataatcata

SEQ ID NO: 7811256 - DNA, 22 bp, Homo sapiens
gcacggcaagacggggcctcct

SEQ ID NO: 7811257 - DNA, 19 bp, Homo sapiens
gcacgctggcttgataggg

SEQ ID NO: 7811258 - DNA, 22 bp, Homo sapiens
gcacggcctcgcccttggaacc

SEQ ID NO: 7811259 - DNA, 22 bp, Homo sapiens
gcacggctaatttttgtatttt

SEQ ID NO: 7811260 - DNA, 22 bp, Homo sapiens
gcacctttctatattcagtggc

SEQ ID NO: 7811261 - DNA, 22 bp, Homo sapiens
gcacctttggaatgaaaagttg

SEQ ID NO: 7811262 - DNA, 22 bp, Homo sapiens
gcacgaggcaccgctgttttgt

SEQ ID NO: 7811263 - DNA, 22 bp, Homo sapiens
gcacgaggcaccgctgttttgt

SEQ ID NO: 7811264 - DNA, 22 bp, Homo sapiens
attcaaggttggctcaggaatt

SEQ ID NO: 7811265 - DNA, 22 bp, Homo sapiens
attcaaggttggctcaggaatt

SEQ ID NO: 7811266 - DNA, 22 bp, Homo sapiens
attcaaggtttattcagtttag

SEQ ID NO: 7811267 - DNA, 22 bp, Homo sapiens
attcaaggtttattcagtttag

SEQ ID NO: 7811268 - DNA, 22 bp, Homo sapiens
attcaagtaaacactgaaggaa

SEQ ID NO: 7811269 - DNA, 22 bp, Homo sapiens
attcaagtacagttttcttctt

SEQ ID NO: 7811270 - DNA, 22 bp, Homo sapiens
attcaagtacagttttcttctt

SEQ ID NO: 7811271 - DNA, 22 bp, Homo sapiens
gcacctggggtacacagctaca

SEQ ID NO: 7811272 - DNA, 22 bp, Homo sapiens
attcaaggtatttaaaacataa

SEQ ID NO: 7811273 - DNA, 22 bp, Homo sapiens
attcaagaggaacaatgaagat

SEQ ID NO: 7811274 - DNA, 22 bp, Homo sapiens
gcacggctaatttttgtatttt

SEQ ID NO: 7811275 - DNA, 22 bp, Homo sapiens
gcacggctaatttttgtatttt

SEQ ID NO: 7811276 - DNA, 22 bp, Homo sapiens
gcacgtgcacacatgtgtacaa

SEQ ID NO: 7811277 - DNA, 22 bp, Homo sapiens
gcacggctaatttttgtatttt

SEQ ID NO: 7811278 - DNA, 22 bp, Homo sapiens
gcacgtgttctgtggcatgggt

SEQ ID NO: 7811279 - DNA, 22 bp, Homo sapiens
gcactaaaccaacatgtaataa

SEQ ID NO: 7811280 - DNA, 22 bp, Homo sapiens
gcactaggtaagtgggtggcaa

SEQ ID NO: 7811281 - DNA, 22 bp, Homo sapiens
gcactagatactgttcaggaaa

SEQ ID NO: 7811282 - DNA, 22 bp, Homo sapiens
gcactagattctgaagcagcag

SEQ ID NO: 7811283 - DNA, 22 bp, Homo sapiens
gcactagaatcccttcaagaag

SEQ ID NO: 7811284 - DNA, 22 bp, Homo sapiens
gcactagagcagctctcagaga

SEQ ID NO: 7811285 - DNA, 22 bp, Homo sapiens
gcactacatcttcacgtgtctt

SEQ ID NO: 7811286 - DNA, 22 bp, Homo sapiens
gcactagaagtacgccttgtaa

SEQ ID NO: 7811287 - DNA, 22 bp, Homo sapiens
gcactagagcagctctcagaga

SEQ ID NO: 7811288 - DNA, 22 bp, Homo sapiens
gcactagagcagctctcagaga

SEQ ID NO: 7811289 - DNA, 22 bp, Homo sapiens
gcactagaatcccttcaagaag

SEQ ID NO: 7811290 - DNA, 22 bp, Homo sapiens
gcactagaatcccttcaagaag

SEQ ID NO: 7811291 - DNA, 19 bp, Homo sapiens
attcacatccctgggaagg

SEQ ID NO: 7811292 - DNA, 22 bp, Homo sapiens
attcacatgatgtatgtagggc

SEQ ID NO: 7811293 - DNA, 19 bp, Homo sapiens
attcacatccctgggaagg

SEQ ID NO: 7811294 - DNA, 20 bp, Homo sapiens
attcacatataccagggagg

SEQ ID NO: 7811295 - DNA, 22 bp, Homo sapiens
attcacatgatgtatgtagggc

SEQ ID NO: 7811296 - DNA, 22 bp, Homo sapiens
attcacatgatgtatgtagggc

SEQ ID NO: 7811297 - DNA, 20 bp, Homo sapiens
attcacatataccagggagg

SEQ ID NO: 7811298 - DNA, 22 bp, Homo sapiens
attcacagtttcctcatattct

SEQ ID NO: 7811299 - DNA, 22 bp, Homo sapiens
attcacagtttcctcatattct

SEQ ID NO: 7811300 - DNA, 22 bp, Homo sapiens
gcactcaggactctcatcagta

SEQ ID NO: 7811301 - DNA, 22 bp, Homo sapiens
gcactcaggactctcatcagta

SEQ ID NO: 7811302 - DNA, 22 bp, Homo sapiens
attcacaatgatacataagcga

SEQ ID NO: 7811303 - DNA, 22 bp, Homo sapiens
attcatctgtacttcaatatct

SEQ ID NO: 7811304 - DNA, 22 bp, Homo sapiens
gcagcgaggtgatgaaatagct

SEQ ID NO: 7811305 - DNA, 22 bp, Homo sapiens
attcatctctgcatatagagtc

SEQ ID NO: 7811306 - DNA, 22 bp, Homo sapiens
attcatctctgcatatagagtc

SEQ ID NO: 7811307 - DNA, 22 bp, Homo sapiens
attcatcaactgatagccatag

SEQ ID NO: 7811308 - DNA, 22 bp, Homo sapiens
attcatcagctaatggacattt

SEQ ID NO: 7811309 - DNA, 22 bp, Homo sapiens
attcatctatgactctaatgtg

SEQ ID NO: 7811310 - DNA, 22 bp, Homo sapiens
attcataagtaaatgattacct

SEQ ID NO: 7811311 - DNA, 22 bp, Homo sapiens
attcataagtaaatgattacct

SEQ ID NO: 7811312 - DNA, 22 bp, Homo sapiens
attcatagctcagtacagactc

SEQ ID NO: 7811313 - DNA, 22 bp, Homo sapiens
attcatatcatagagttattga

SEQ ID NO: 7811314 - DNA, 22 bp, Homo sapiens
attcatatcatagagttattga

SEQ ID NO: 7811315 - DNA, 22 bp, Homo sapiens
attcatatcatagagttattga

SEQ ID NO: 7811316 - DNA, 22 bp, Homo sapiens
attcatatcatagagttattga

SEQ ID NO: 7811317 - DNA, 21 bp, Homo sapiens
attcagtttgacatctagcag

SEQ ID NO: 7811318 - DNA, 21 bp, Homo sapiens
attcagtttgacatctagcag

SEQ ID NO: 7811319 - DNA, 22 bp, Homo sapiens
attcagtttcatggcacagcta

SEQ ID NO: 7811320 - DNA, 22 bp, Homo sapiens
attcagtttcaatcattgtagt

SEQ ID NO: 7811321 - DNA, 22 bp, Homo sapiens
attcagtttcatggcacagcta

SEQ ID NO: 7811322 - DNA, 22 bp, Homo sapiens
attcagtttttattggaccagc

SEQ ID NO: 7811323 - DNA, 22 bp, Homo sapiens
attcagtttttgaagggaaatt

SEQ ID NO: 7811324 - DNA, 22 bp, Homo sapiens
attcataacggcaaatgtcacc

SEQ ID NO: 7811325 - DNA, 22 bp, Homo sapiens
attcataacggcaaatgtcacc

SEQ ID NO: 7811326 - DNA, 22 bp, Homo sapiens
attcataacggcaaatgtcacc

SEQ ID NO: 7811327 - DNA, 22 bp, Homo sapiens
attcagttgtaatctttgttag

SEQ ID NO: 7811328 - DNA, 22 bp, Homo sapiens
attcagttgtctactactgcct

SEQ ID NO: 7811329 - DNA, 23 bp, Homo sapiens
attcagttgtgagagaagacaca

SEQ ID NO: 7811330 - DNA, 22 bp, Homo sapiens
attcagtttcaatcattgtagt

SEQ ID NO: 7811331 - DNA, 22 bp, Homo sapiens
gcagcagatgtgggcccagagc

SEQ ID NO: 7811332 - DNA, 22 bp, Homo sapiens
attcagttccttgtgattgtag

SEQ ID NO: 7811333 - DNA, 22 bp, Homo sapiens
attcagttccttgtgattgtag

SEQ ID NO: 7811334 - DNA, 22 bp, Homo sapiens
gcagcagatgtgggcccagagc

SEQ ID NO: 7811335 - DNA, 22 bp, Homo sapiens
gcagcagatgctttcatggaca

SEQ ID NO: 7811336 - DNA, 22 bp, Homo sapiens
gcagcagagtttgggagatggt

SEQ ID NO: 7811337 - DNA, 22 bp, Homo sapiens
gcagcagatgctttcatggaca

SEQ ID NO: 7811338 - DNA, 22 bp, Homo sapiens
gcagcagatgctttcatggaca

SEQ ID NO: 7811339 - DNA, 22 bp, Homo sapiens
gcagcagagtttgggagatggt

SEQ ID NO: 7811340 - DNA, 22 bp, Homo sapiens
gcagcagagtttgggagatggt

SEQ ID NO: 7811341 - DNA, 22 bp, Homo sapiens
gcagcagagtttgggagatggt

SEQ ID NO: 7811342 - DNA, 22 bp, Homo sapiens
gcagcagagtttgggagatggt

SEQ ID NO: 7811343 - DNA, 22 bp, Homo sapiens
gcagcagagtttgggagatggt

SEQ ID NO: 7811344 - DNA, 22 bp, Homo sapiens
gcagcagagtttgggagatggt

SEQ ID NO: 7811345 - DNA, 22 bp, Homo sapiens
gcagcagagtttgggagatggt

SEQ ID NO: 7811346 - DNA, 22 bp, Homo sapiens
gcagcagagtagacagagccct

SEQ ID NO: 7811347 - DNA, 22 bp, Homo sapiens
gcagcagagtagacagagccct

SEQ ID NO: 7811348 - DNA, 22 bp, Homo sapiens
gcagcagagtagacagagccct

SEQ ID NO: 7811349 - DNA, 22 bp, Homo sapiens
gcagcagagtagacagagccct

SEQ ID NO: 7811350 - DNA, 20 bp, Homo sapiens
attcagaataggcatgtaaa

SEQ ID NO: 7811351 - DNA, 20 bp, Homo sapiens
attcagaataggcatgtaaa

SEQ ID NO: 7811352 - DNA, 22 bp, Homo sapiens
attcagaatggcaaacttctag

SEQ ID NO: 7811353 - DNA, 22 bp, Homo sapiens
attcagaatggcaaacttctag

SEQ ID NO: 7811354 - DNA, 22 bp, Homo sapiens
attcagaatggcaaacttctag

SEQ ID NO: 7811355 - DNA, 20 bp, Homo sapiens
attcagaataggcatgtaaa

SEQ ID NO: 7811356 - DNA, 22 bp, Homo sapiens
attcagaagctattcttagttc

SEQ ID NO: 7811357 - DNA, 22 bp, Homo sapiens
attcagaagcaatcacagtgag

SEQ ID NO: 7811358 - DNA, 22 bp, Homo sapiens
attcagaagcaatcacagtgag

SEQ ID NO: 7811359 - DNA, 22 bp, Homo sapiens
attcagaattttggggagctaa

SEQ ID NO: 7811360 - DNA, 23 bp, Homo sapiens
attcagaattgtgtgtttgtata

SEQ ID NO: 7811361 - DNA, 22 bp, Homo sapiens
attcagaattgtgggcagtaca

SEQ ID NO: 7811362 - DNA, 22 bp, Homo sapiens
gcagatggaaagtgcttgaggg

SEQ ID NO: 7811363 - DNA, 20 bp, Homo sapiens
gcagcagacagacaggggac

SEQ ID NO: 7811364 - DNA, 22 bp, Homo sapiens
gcagatgcttggcactgacagt

SEQ ID NO: 7811365 - DNA, 22 bp, Homo sapiens
gcagatgctgtggtgatagaag

SEQ ID NO: 7811366 - DNA, 22 bp, Homo sapiens
gcagatggaaagtgcttgaggg

SEQ ID NO: 7811367 - DNA, 20 bp, Homo sapiens
gcagcagacagacaggggac

SEQ ID NO: 7811368 - DNA, 20 bp, Homo sapiens
gcagcagacagacaggggac

SEQ ID NO: 7811369 - DNA, 20 bp, Homo sapiens
gcagcagacagacaggggac

SEQ ID NO: 7811370 - DNA, 20 bp, Homo sapiens
gcagcagacagacaggggac

SEQ ID NO: 7811371 - DNA, 20 bp, Homo sapiens
gcagcagacagacaggggac

SEQ ID NO: 7811372 - DNA, 22 bp, Homo sapiens
gcagcagagaacacaatgatgg

SEQ ID NO: 7811373 - DNA, 22 bp, Homo sapiens
gcagcagagaacacaatgatgg

SEQ ID NO: 7811374 - DNA, 22 bp, Homo sapiens
gcagcagagaccccaggaagga

SEQ ID NO: 7811375 - DNA, 22 bp, Homo sapiens
gcagcagagaccccaggaagga

SEQ ID NO: 7811376 - DNA, 22 bp, Homo sapiens
gcagcagagaccccaggaagga

SEQ ID NO: 7811377 - DNA, 22 bp, Homo sapiens
gcagcagagaccccaggaagga

SEQ ID NO: 7811378 - DNA, 22 bp, Homo sapiens
gcagcagagaccccaggaagga

SEQ ID NO: 7811379 - DNA, 22 bp, Homo sapiens
gcagcagagaccccaggaagga

SEQ ID NO: 7811380 - DNA, 21 bp, Homo sapiens
gcagcagaggcttgacagaca

SEQ ID NO: 7811381 - DNA, 21 bp, Homo sapiens
gcagcagaggcttgacagaca

SEQ ID NO: 7811382 - DNA, 21 bp, Homo sapiens
gcagcagaggcttgacagaca

SEQ ID NO: 7811383 - DNA, 21 bp, Homo sapiens
gcagcagaggcttgacagaca

SEQ ID NO: 7811384 - DNA, 21 bp, Homo sapiens
gcagcagaggcttgacagaca

SEQ ID NO: 7811385 - DNA, 22 bp, Homo sapiens
gcagcagagtagacagagccct

SEQ ID NO: 7811386 - DNA, 22 bp, Homo sapiens
gcagcagagtagacagagccct

SEQ ID NO: 7811387 - DNA, 22 bp, Homo sapiens
gcagcagagtagacagagccct

SEQ ID NO: 7811388 - DNA, 22 bp, Homo sapiens
gcagcagagtagacagagccct

SEQ ID NO: 7811389 - DNA, 22 bp, Homo sapiens
gcagcagaggccctactctttg

SEQ ID NO: 7811390 - DNA, 22 bp, Homo sapiens
gcagcagaggccctactctttg

SEQ ID NO: 7811391 - DNA, 22 bp, Homo sapiens
gcagcagaggccctactctttg

SEQ ID NO: 7811392 - DNA, 22 bp, Homo sapiens
gcagcagaggccctactctttg

SEQ ID NO: 7811393 - DNA, 22 bp, Homo sapiens
gcagcagaggccctactctttg

SEQ ID NO: 7811394 - DNA, 22 bp, Homo sapiens
gcagcagagctttgtcctggct

SEQ ID NO: 7811395 - DNA, 22 bp, Homo sapiens
gcagcagagctttgtcctggct

SEQ ID NO: 7811396 - DNA, 22 bp, Homo sapiens
gcagcagagctttgtcctggct

SEQ ID NO: 7811397 - DNA, 17 bp, Homo sapiens
gcagcagagagaccctc

SEQ ID NO: 7811398 - DNA, 22 bp, Homo sapiens
gcagcagagctttgtcctggct

SEQ ID NO: 7811399 - DNA, 22 bp, Homo sapiens
attactagattgtcaagattta

SEQ ID NO: 7811400 - DNA, 22 bp, Homo sapiens
attacctatttcattttctgtc

SEQ ID NO: 7811401 - DNA, 22 bp, Homo sapiens
attacgagaatgaagtatcagg

SEQ ID NO: 7811402 - DNA, 22 bp, Homo sapiens
attactctgtctgcctctgacc

SEQ ID NO: 7811403 - DNA, 22 bp, Homo sapiens
attactcctagaatgcatttag

SEQ ID NO: 7811404 - DNA, 22 bp, Homo sapiens
attaccacttaatcaacatatg

SEQ ID NO: 7811405 - DNA, 22 bp, Homo sapiens
attaccactgcagttttgcatt

SEQ ID NO: 7811406 - DNA, 22 bp, Homo sapiens
attacatgagagaatgtaaata

SEQ ID NO: 7811407 - DNA, 22 bp, Homo sapiens
attacatgagagaatgtaaata

SEQ ID NO: 7811408 - DNA, 22 bp, Homo sapiens
attacccagggtaggaattcct

SEQ ID NO: 7811409 - DNA, 23 bp, Homo sapiens
attaccagcctgacaccaacaaa

SEQ ID NO: 7811410 - DNA, 22 bp, Homo sapiens
attacccagtctgtggtattct

SEQ ID NO: 7811411 - DNA, 22 bp, Homo sapiens
attaccgctgagtcctatggag

SEQ ID NO: 7811412 - DNA, 22 bp, Homo sapiens
attacagttctgcaggtagttt

SEQ ID NO: 7811413 - DNA, 22 bp, Homo sapiens
attacagttctacacatccttt

SEQ ID NO: 7811414 - DNA, 23 bp, Homo sapiens
attacagttaattacaacatctt

SEQ ID NO: 7811415 - DNA, 22 bp, Homo sapiens
attacatatgttggcaacattt

SEQ ID NO: 7811416 - DNA, 22 bp, Homo sapiens
attacatatgttggcaacattt

SEQ ID NO: 7811417 - DNA, 22 bp, Homo sapiens
attacatatgttggcaacattt

SEQ ID NO: 7811418 - DNA, 22 bp, Homo sapiens
attacaatcgagagaaacaaat

SEQ ID NO: 7811419 - DNA, 22 bp, Homo sapiens
attacaatcgagagaaacaaat

SEQ ID NO: 7811420 - DNA, 22 bp, Homo sapiens
attacaatcgagagaaacaaat

SEQ ID NO: 7811421 - DNA, 22 bp, Homo sapiens
attacagtgggtaaacagaatt

SEQ ID NO: 7811422 - DNA, 22 bp, Homo sapiens
gatattgataataaccatgaat

SEQ ID NO: 7811423 - DNA, 22 bp, Homo sapiens
gatatttaactctcacaggtcc

SEQ ID NO: 7811424 - DNA, 22 bp, Homo sapiens
attacaatcgagagaaacaaat

SEQ ID NO: 7811425 - DNA, 22 bp, Homo sapiens
attacaatcgagagaaacaaat

SEQ ID NO: 7811426 - DNA, 22 bp, Homo sapiens
gatattcctgaaggacagggtt

SEQ ID NO: 7811427 - DNA, 22 bp, Homo sapiens
gatattcctgaaggacagggtt

SEQ ID NO: 7811428 - DNA, 22 bp, Homo sapiens
gatattcctgaaggacagggtt

SEQ ID NO: 7811429 - DNA, 22 bp, Homo sapiens
gatattcctgaaggacagggtt

SEQ ID NO: 7811430 - DNA, 22 bp, Homo sapiens
gatattcataggcaggtattta

SEQ ID NO: 7811431 - DNA, 22 bp, Homo sapiens
gatattcataggcaggtattta

SEQ ID NO: 7811432 - DNA, 22 bp, Homo sapiens
gatattcaagtggaattattct

SEQ ID NO: 7811433 - DNA, 22 bp, Homo sapiens
gatattctacctgctgaccaag

SEQ ID NO: 7811434 - DNA, 22 bp, Homo sapiens
gatattcctgaaggacagggtt

SEQ ID NO: 7811435 - DNA, 22 bp, Homo sapiens
gatattcaactaaagtgaatta

SEQ ID NO: 7811436 - DNA, 22 bp, Homo sapiens
gatattcaactaaagtgaatta

SEQ ID NO: 7811437 - DNA, 22 bp, Homo sapiens
gatatgtattccactataaagg

SEQ ID NO: 7811438 - DNA, 22 bp, Homo sapiens
gatatgtattgaatgatcattt

SEQ ID NO: 7811439 - DNA, 22 bp, Homo sapiens
gatatgtgcttgtaatatttat

SEQ ID NO: 7811440 - DNA, 22 bp, Homo sapiens
gatatgtattgaatgatcattt

SEQ ID NO: 7811441 - DNA, 22 bp, Homo sapiens
attactgtgactagccatctgg

SEQ ID NO: 7811442 - DNA, 22 bp, Homo sapiens
attactgaggcaaagtagtttt

SEQ ID NO: 7811443 - DNA, 22 bp, Homo sapiens
attagaaaaactcaagggctct

SEQ ID NO: 7811444 - DNA, 22 bp, Homo sapiens
attagaaaaactcaagggctct

SEQ ID NO: 7811445 - DNA, 22 bp, Homo sapiens
attagaaaaactcaagggctct

SEQ ID NO: 7811446 - DNA, 22 bp, Homo sapiens
attagaaaaactcaagggctct

SEQ ID NO: 7811447 - DNA, 23 bp, Homo sapiens
attagaaaggctttctggtgaaa

SEQ ID NO: 7811448 - DNA, 23 bp, Homo sapiens
attagaaaggctttctggtgaaa

SEQ ID NO: 7811449 - DNA, 22 bp, Homo sapiens
attagaaaccaagaggcaggct

SEQ ID NO: 7811450 - DNA, 22 bp, Homo sapiens
attagaaaatacatgggctgtc

SEQ ID NO: 7811451 - DNA, 22 bp, Homo sapiens
attagaaaatacatgggctgtc

SEQ ID NO: 7811452 - DNA, 22 bp, Homo sapiens
attagaaaatacatgggctgtc

SEQ ID NO: 7811453 - DNA, 22 bp, Homo sapiens
attagaaaatctggaggtgggg

SEQ ID NO: 7811454 - DNA, 22 bp, Homo sapiens
gatttcagagtttattaggtta

SEQ ID NO: 7811455 - DNA, 22 bp, Homo sapiens
gatttcagagtttattaggtta

SEQ ID NO: 7811456 - DNA, 22 bp, Homo sapiens
gatttcagaagcaagaggaggt

SEQ ID NO: 7811457 - DNA, 21 bp, Homo sapiens
gatttcacttaccttcattta

SEQ ID NO: 7811458 - DNA, 22 bp, Homo sapiens
gatttcacctgatcttgtcatc

SEQ ID NO: 7811459 - DNA, 23 bp, Homo sapiens
attagaaaggctttctggtgaaa

SEQ ID NO: 7811460 - DNA, 22 bp, Homo sapiens
gatttccaggacgggaggtggg

SEQ ID NO: 7811461 - DNA, 22 bp, Homo sapiens
gatttcagtggctgtctcaaat

SEQ ID NO: 7811462 - DNA, 22 bp, Homo sapiens
gatttccaggtcattaataaag

SEQ ID NO: 7811463 - DNA, 22 bp, Homo sapiens
gatttccaggtcattaataaag

SEQ ID NO: 7811464 - DNA, 22 bp, Homo sapiens
gatttcagggtgtcttccagct

SEQ ID NO: 7811465 - DNA, 22 bp, Homo sapiens
gatttcagggtgcagatgatga

SEQ ID NO: 7811466 - DNA, 22 bp, Homo sapiens
gatttcaggctatctatgcaga

SEQ ID NO: 7811467 - DNA, 22 bp, Homo sapiens
gatttcagggtgcagatgatga

SEQ ID NO: 7811468 - DNA, 22 bp, Homo sapiens
gatttctgggctttatttcaga

SEQ ID NO: 7811469 - DNA, 22 bp, Homo sapiens
attagagtccctttggagtttt

SEQ ID NO: 7811470 - DNA, 22 bp, Homo sapiens
gatttctcaatcctagtactat

SEQ ID NO: 7811471 - DNA, 22 bp, Homo sapiens
gatttctagttcattatctatt

SEQ ID NO: 7811472 - DNA, 22 bp, Homo sapiens
gatttctcaatcctagtactat

SEQ ID NO: 7811473 - DNA, 22 bp, Homo sapiens
gatttctcaatcctagtactat

SEQ ID NO: 7811474 - DNA, 22 bp, Homo sapiens
gatttctaagttttaccacaaa

SEQ ID NO: 7811475 - DNA, 22 bp, Homo sapiens
gatttcgagaggtgtgaggcct

SEQ ID NO: 7811476 - DNA, 19 bp, Homo sapiens
gatttctacaaatgtcaga

SEQ ID NO: 7811477 - DNA, 19 bp, Homo sapiens
gatttctacaaatgtcaga

SEQ ID NO: 7811478 - DNA, 22 bp, Homo sapiens
gatttctacttgaacttgctaa

SEQ ID NO: 7811479 - DNA, 22 bp, Homo sapiens
gatttctacttgaacttgctaa

SEQ ID NO: 7811480 - DNA, 22 bp, Homo sapiens
gatttctagtaagtcatgaagg

SEQ ID NO: 7811481 - DNA, 22 bp, Homo sapiens
gatttcccagaaaagtgatctc

SEQ ID NO: 7811482 - DNA, 22 bp, Homo sapiens
gatttccctatagttttctctt

SEQ ID NO: 7811483 - DNA, 22 bp, Homo sapiens
attagtattcagtttataacac

SEQ ID NO: 7811484 - DNA, 22 bp, Homo sapiens
attagtattcagtttataacac

SEQ ID NO: 7811485 - DNA, 22 bp, Homo sapiens
attagtcagtatttgtttgcca

SEQ ID NO: 7811486 - DNA, 22 bp, Homo sapiens
attagtctactgtctaataaat

SEQ ID NO: 7811487 - DNA, 22 bp, Homo sapiens
attagtattcagtttataacac

SEQ ID NO: 7811488 - DNA, 22 bp, Homo sapiens
attagtagtagttagcagcctc

SEQ ID NO: 7811489 - DNA, 22 bp, Homo sapiens
attagtagctgtaataactggg

SEQ ID NO: 7811490 - DNA, 22 bp, Homo sapiens
attaggttagtgtgcaagagaa

SEQ ID NO: 7811491 - DNA, 22 bp, Homo sapiens
attaggtggggttgttactgtt

SEQ ID NO: 7811492 - DNA, 22 bp, Homo sapiens
attaggtagtataatctttgtt

SEQ ID NO: 7811493 - DNA, 22 bp, Homo sapiens
attaggtatgattctcatttca

SEQ ID NO: 7811494 - DNA, 22 bp, Homo sapiens
attaggtatttgaaaactgatt

SEQ ID NO: 7811495 - DNA, 22 bp, Homo sapiens
attagtaaaacattgtatatgt

SEQ ID NO: 7811496 - DNA, 22 bp, Homo sapiens
attaggttgaggtactcagagc

SEQ ID NO: 7811497 - DNA, 22 bp, Homo sapiens
attaggtaagataaagcagagg

SEQ ID NO: 7811498 - DNA, 22 bp, Homo sapiens
attaggtaatctttagatacac

SEQ ID NO: 7811499 - DNA, 22 bp, Homo sapiens
attaggcttcctcaagaggagt

SEQ ID NO: 7811500 - DNA, 22 bp, Homo sapiens
attagggctggatgcaaggaaa

SEQ ID NO: 7811501 - DNA, 22 bp, Homo sapiens
attaggcatatatgcttttaat

SEQ ID NO: 7811502 - DNA, 22 bp, Homo sapiens
attagcttattgtaaggtgaaa

SEQ ID NO: 7811503 - DNA, 22 bp, Homo sapiens
attagcttatcacacaagctgc

SEQ ID NO: 7811504 - DNA, 22 bp, Homo sapiens
attagcttaggcatgaagagaa

SEQ ID NO: 7811505 - DNA, 22 bp, Homo sapiens
attagatcctggcaccatccct

SEQ ID NO: 7811506 - DNA, 22 bp, Homo sapiens
attagatcagatcggcagtaat

SEQ ID NO: 7811507 - DNA, 22 bp, Homo sapiens
attagctttatttgaaatagga

SEQ ID NO: 7811508 - DNA, 22 bp, Homo sapiens
attagctttatttgaaatagga

SEQ ID NO: 7811509 - DNA, 22 bp, Homo sapiens
attagctttaaaccacagcagt

SEQ ID NO: 7811510 - DNA, 22 bp, Homo sapiens
attaggaaatgtgttgcaagca

SEQ ID NO: 7811511 - DNA, 22 bp, Homo sapiens
attaggaaactgaatgtcagaa

SEQ ID NO: 7811512 - DNA, 22 bp, Homo sapiens
attaggaagaggatgtcagcat

SEQ ID NO: 7811513 - DNA, 22 bp, Homo sapiens
attaggaagtaagtatcacaag

SEQ ID NO: 7811514 - DNA, 22 bp, Homo sapiens
attaggaagtaagtatcacaag

SEQ ID NO: 7811515 - DNA, 22 bp, Homo sapiens
attcaactgtaaacttgttcac

SEQ ID NO: 7811516 - DNA, 22 bp, Homo sapiens
attcaacttacaaaggagaaga

SEQ ID NO: 7811517 - DNA, 22 bp, Homo sapiens
attcaactgtaaacttgttcac

SEQ ID NO: 7811518 - DNA, 22 bp, Homo sapiens
attcaactatgtatagtcttct

SEQ ID NO: 7811519 - DNA, 22 bp, Homo sapiens
attcaacttataagatattaat

SEQ ID NO: 7811520 - DNA, 22 bp, Homo sapiens
attcaagagcccatgtttcctg

SEQ ID NO: 7811521 - DNA, 22 bp, Homo sapiens
attcaacttacaaaggagaaga

SEQ ID NO: 7811522 - DNA, 22 bp, Homo sapiens
attcaacttataagatattaat

SEQ ID NO: 7811523 - DNA, 22 bp, Homo sapiens
attcaacttataagatattaat

SEQ ID NO: 7811524 - DNA, 22 bp, Homo sapiens
attcaactagtgattgtgttat

SEQ ID NO: 7811525 - DNA, 22 bp, Homo sapiens
attcaactagtgattgtgttat

SEQ ID NO: 7811526 - DNA, 21 bp, Homo sapiens
attcaactagatgattatttc

SEQ ID NO: 7811527 - DNA, 21 bp, Homo sapiens
attcaactagatgattatttc

SEQ ID NO: 7811528 - DNA, 22 bp, Homo sapiens
attcaacatattctgagtaaaa

SEQ ID NO: 7811529 - DNA, 22 bp, Homo sapiens
attcaacatattctgagtaaaa

SEQ ID NO: 7811530 - DNA, 22 bp, Homo sapiens
attcaaattaagttaattcagc

SEQ ID NO: 7811531 - DNA, 22 bp, Homo sapiens
attcaaattaagttaattcagc

SEQ ID NO: 7811532 - DNA, 22 bp, Homo sapiens
attcaaattaagttaattcagc

SEQ ID NO: 7811533 - DNA, 22 bp, Homo sapiens
attcaaattaagttaattcagc

SEQ ID NO: 7811534 - DNA, 22 bp, Homo sapiens
attcaaattaagttaattcagc

SEQ ID NO: 7811535 - DNA, 22 bp, Homo sapiens
attcaaattaagttaattcagc

SEQ ID NO: 7811536 - DNA, 22 bp, Homo sapiens
attcaaatgtcaaatccaccag

SEQ ID NO: 7811537 - DNA, 22 bp, Homo sapiens
attcaaagtctagatgtagtgt

SEQ ID NO: 7811538 - DNA, 22 bp, Homo sapiens
attagtgtacatctcacacgca

SEQ ID NO: 7811539 - DNA, 22 bp, Homo sapiens
attagtgcccaggctgcctctt

SEQ ID NO: 7811540 - DNA, 22 bp, Homo sapiens
attagtgtacatctcacacgca

SEQ ID NO: 7811541 - DNA, 22 bp, Homo sapiens
attagtgtcatgttgaggactt

SEQ ID NO: 7811542 - DNA, 22 bp, Homo sapiens
attagtgcccaggctgcctctt

SEQ ID NO: 7811543 - DNA, 20 bp, Homo sapiens
attagtgcatctggacatgc

SEQ ID NO: 7811544 - DNA, 22 bp, Homo sapiens
attagtgactctcacatatgcc

SEQ ID NO: 7811545 - DNA, 22 bp, Homo sapiens
attagtgtcatgttgaggactt

SEQ ID NO: 7811546 - DNA, 22 bp, Homo sapiens
attagtggtatctatcatagaa

SEQ ID NO: 7811547 - DNA, 22 bp, Homo sapiens
attagtgtctgtgaataattct

SEQ ID NO: 7811548 - DNA, 22 bp, Homo sapiens
attagtgtctgtgaataattct

SEQ ID NO: 7811549 - DNA, 22 bp, Homo sapiens
attagtgtggaccctaatttaa

SEQ ID NO: 7811550 - DNA, 22 bp, Homo sapiens
attagtgttcttatcttctagg

SEQ ID NO: 7811551 - DNA, 22 bp, Homo sapiens
attagtgtgtaggctggaaaaa

SEQ ID NO: 7811552 - DNA, 22 bp, Homo sapiens
attagtgtggaccctaatttaa

SEQ ID NO: 7811553 - DNA, 22 bp, Homo sapiens
attagtgtgtaggctggaaaaa

SEQ ID NO: 7811554 - DNA, 22 bp, Homo sapiens
attatttccttgctttgaggaa

SEQ ID NO: 7811555 - DNA, 22 bp, Homo sapiens
attcaaagtaataaccagaact

SEQ ID NO: 7811556 - DNA, 22 bp, Homo sapiens
attcaaagtactagctattttt

SEQ ID NO: 7811557 - DNA, 22 bp, Homo sapiens
attagtgttgtaagaagctgcc

SEQ ID NO: 7811558 - DNA, 22 bp, Homo sapiens
attagtgttcttatcttctagg

SEQ ID NO: 7811559 - DNA, 22 bp, Homo sapiens
attagtgttgtggcttcatggc

SEQ ID NO: 7811560 - DNA, 22 bp, Homo sapiens
attagtgttgtaagaagctgcc

SEQ ID NO: 7811561 - DNA, 22 bp, Homo sapiens
attagtgttgtggcttcatggc

SEQ ID NO: 7811562 - DNA, 22 bp, Homo sapiens
attagtgttgtggcttcatggc

SEQ ID NO: 7811563 - DNA, 22 bp, Homo sapiens
atgatggaaaaagatcagtcaa

SEQ ID NO: 7811564 - DNA, 22 bp, Homo sapiens
gaaatttattatctacatcatt

SEQ ID NO: 7811565 - DNA, 22 bp, Homo sapiens
atgatgaagagtaacaggctga

SEQ ID NO: 7811566 - DNA, 22 bp, Homo sapiens
atgatgaaactaggaactagag

SEQ ID NO: 7811567 - DNA, 22 bp, Homo sapiens
atgatctcattctttcaaaggg

SEQ ID NO: 7811568 - DNA, 19 bp, Homo sapiens
atgatctgcccttgtaata

SEQ ID NO: 7811569 - DNA, 22 bp, Homo sapiens
atgatccacatctggtccatag

SEQ ID NO: 7811570 - DNA, 22 bp, Homo sapiens
atgatccagattttgggcagtt

SEQ ID NO: 7811571 - DNA, 22 bp, Homo sapiens
atgatccaaagccacaggggca

SEQ ID NO: 7811572 - DNA, 22 bp, Homo sapiens
atgatcagggcagaagcagaag

SEQ ID NO: 7811573 - DNA, 22 bp, Homo sapiens
gaaatatacatgaagtcggctg

SEQ ID NO: 7811574 - DNA, 22 bp, Homo sapiens
gaaatatacatgaagtcggctg

SEQ ID NO: 7811575 - DNA, 19 bp, Homo sapiens
atgatacaggtgaaaattg

SEQ ID NO: 7811576 - DNA, 19 bp, Homo sapiens
atgatacaggtgaaaattg

SEQ ID NO: 7811577 - DNA, 19 bp, Homo sapiens
atgatacaggtgaaaattg

SEQ ID NO: 7811578 - DNA, 19 bp, Homo sapiens
atgatacaggtgaaaattg

SEQ ID NO: 7811579 - DNA, 22 bp, Homo sapiens
gaaatagatctctgggatgcaa

SEQ ID NO: 7811580 - DNA, 22 bp, Homo sapiens
gaaatagaggacagctggatca

SEQ ID NO: 7811581 - DNA, 22 bp, Homo sapiens
gaaatagaggacagctggatca

SEQ ID NO: 7811582 - DNA, 22 bp, Homo sapiens
gaaatagaggacagctggatca

SEQ ID NO: 7811583 - DNA, 22 bp, Homo sapiens
gaaatagatctctgggatgcaa

SEQ ID NO: 7811584 - DNA, 22 bp, Homo sapiens
gaaatagatctctgggatgcaa

SEQ ID NO: 7811585 - DNA, 22 bp, Homo sapiens
gaaatagaggacagctggatca

SEQ ID NO: 7811586 - DNA, 22 bp, Homo sapiens
atgatattttagtaaagtgata

SEQ ID NO: 7811587 - DNA, 22 bp, Homo sapiens
atgatatttgcaatgtgcttgc

SEQ ID NO: 7811588 - DNA, 22 bp, Homo sapiens
atgatatttgcaatgtgcttgc

SEQ ID NO: 7811589 - DNA, 22 bp, Homo sapiens
atgatattttagtaaagtgata

SEQ ID NO: 7811590 - DNA, 22 bp, Homo sapiens
atgatatttgcaatgtgcttgc

SEQ ID NO: 7811591 - DNA, 22 bp, Homo sapiens
atgatatatgtgttgagcttgc

SEQ ID NO: 7811592 - DNA, 22 bp, Homo sapiens
gaaatactgtaaagttattatt

SEQ ID NO: 7811593 - DNA, 20 bp, Homo sapiens
gaaatacttacccaactgtt

SEQ ID NO: 7811594 - DNA, 22 bp, Homo sapiens
gaaatactgtaaagttattatt

SEQ ID NO: 7811595 - DNA, 22 bp, Homo sapiens
gaaatagaagctgccaatttct

SEQ ID NO: 7811596 - DNA, 22 bp, Homo sapiens
gaaatactgtaaagttattatt

SEQ ID NO: 7811597 - DNA, 22 bp, Homo sapiens
gaaatagaagctgccaatttct

SEQ ID NO: 7811598 - DNA, 22 bp, Homo sapiens
gaaatagaagctgccaatttct

SEQ ID NO: 7811599 - DNA, 22 bp, Homo sapiens
gaaatagacactttctatgaat

SEQ ID NO: 7811600 - DNA, 22 bp, Homo sapiens
gaaatagacactttctatgaat

SEQ ID NO: 7811601 - DNA, 22 bp, Homo sapiens
gaaatagacactttctatgaat

SEQ ID NO: 7811602 - DNA, 22 bp, Homo sapiens
gaaatagacactttctatgaat

SEQ ID NO: 7811603 - DNA, 22 bp, Homo sapiens
gaaatagacactttctatgaat

SEQ ID NO: 7811604 - DNA, 22 bp, Homo sapiens
gaaatagacactttctatgaat

SEQ ID NO: 7811605 - DNA, 22 bp, Homo sapiens
gaaatagacactttctatgaat

SEQ ID NO: 7811606 - DNA, 22 bp, Homo sapiens
gaaatacagttgggaggaggta

SEQ ID NO: 7811607 - DNA, 22 bp, Homo sapiens
gaaatactgcacaccctgtaag

SEQ ID NO: 7811608 - DNA, 21 bp, Homo sapiens
gaaatactgccttaggagctg

SEQ ID NO: 7811609 - DNA, 22 bp, Homo sapiens
gaaatactgcacaccctgtaag

SEQ ID NO: 7811610 - DNA, 22 bp, Homo sapiens
gaaatacagttgggaggaggta

SEQ ID NO: 7811611 - DNA, 21 bp, Homo sapiens
gaaatactgccttaggagctg

SEQ ID NO: 7811612 - DNA, 22 bp, Homo sapiens
gaaagtgcagtcagacaaggca

SEQ ID NO: 7811613 - DNA, 22 bp, Homo sapiens
gaaagtcatggatgaacactac

SEQ ID NO: 7811614 - DNA, 22 bp, Homo sapiens
gaaatacaggaatgccacacag

SEQ ID NO: 7811615 - DNA, 22 bp, Homo sapiens
gaaatacagttgggaggaggta

SEQ ID NO: 7811616 - DNA, 22 bp, Homo sapiens
gaaatacagttgggaggaggta

SEQ ID NO: 7811617 - DNA, 22 bp, Homo sapiens
gaaagtatttacattaacatct

SEQ ID NO: 7811618 - DNA, 22 bp, Homo sapiens
gaaagtatttacattaacatct

SEQ ID NO: 7811619 - DNA, 23 bp, Homo sapiens
gaaagtcaatatggtagctttga

SEQ ID NO: 7811620 - DNA, 22 bp, Homo sapiens
gaaagtcatggatgaacactac

SEQ ID NO: 7811621 - DNA, 19 bp, Homo sapiens
gaaagtcatagagcttgtc

SEQ ID NO: 7811622 - DNA, 23 bp, Homo sapiens
gaaagtcaatatggtagctttga

SEQ ID NO: 7811623 - DNA, 22 bp, Homo sapiens
gaaagtatttacattaacatct

SEQ ID NO: 7811624 - DNA, 22 bp, Homo sapiens
gaaagtatttaagtccatattt

SEQ ID NO: 7811625 - DNA, 22 bp, Homo sapiens
gaaagtatttaagtccatattt

SEQ ID NO: 7811626 - DNA, 22 bp, Homo sapiens
gaaagtattctccctgaatttt

SEQ ID NO: 7811627 - DNA, 22 bp, Homo sapiens
gaaagtatttaagtccatattt

SEQ ID NO: 7811628 - DNA, 22 bp, Homo sapiens
gaaagtattagcctagaagtca

SEQ ID NO: 7811629 - DNA, 22 bp, Homo sapiens
gaaagtattagcctagaagtca

SEQ ID NO: 7811630 - DNA, 22 bp, Homo sapiens
gaaagtattagcctagaagtca

SEQ ID NO: 7811631 - DNA, 22 bp, Homo sapiens
gaaagtattcacaaagttcttg

SEQ ID NO: 7811632 - DNA, 22 bp, Homo sapiens
gaaagtattctccctgaatttt

SEQ ID NO: 7811633 - DNA, 22 bp, Homo sapiens
gaaagtattctccctgaatttt

SEQ ID NO: 7811634 - DNA, 22 bp, Homo sapiens
gaaagtattcacaaagttcttg

SEQ ID NO: 7811635 - DNA, 22 bp, Homo sapiens
gaaagtatgccatctacctctt

SEQ ID NO: 7811636 - DNA, 22 bp, Homo sapiens
gaaagtaacatttcttgaatta

SEQ ID NO: 7811637 - DNA, 22 bp, Homo sapiens
gaaaggtttaagtaggatttgt

SEQ ID NO: 7811638 - DNA, 22 bp, Homo sapiens
gaaagtaacatttcttgaatta

SEQ ID NO: 7811639 - DNA, 22 bp, Homo sapiens
gaaacattcatatgagaaacct

SEQ ID NO: 7811640 - DNA, 20 bp, Homo sapiens
gaaacattggcagcaactga

SEQ ID NO: 7811641 - DNA, 20 bp, Homo sapiens
gaaacattggcagcaactga

SEQ ID NO: 7811642 - DNA, 22 bp, Homo sapiens
gaaacattggtctgccccttat

SEQ ID NO: 7811643 - DNA, 22 bp, Homo sapiens
gaaacattgtgttctacagatt

SEQ ID NO: 7811644 - DNA, 22 bp, Homo sapiens
gaaacattgtgttctacagatt

SEQ ID NO: 7811645 - DNA, 22 bp, Homo sapiens
gaaacattgtgttctacagatt

SEQ ID NO: 7811646 - DNA, 22 bp, Homo sapiens
gaaacattgtgttctacagatt

SEQ ID NO: 7811647 - DNA, 22 bp, Homo sapiens
gaaacattgtgttctacagatt

SEQ ID NO: 7811648 - DNA, 22 bp, Homo sapiens
gaaacattgtgttctacagatt

SEQ ID NO: 7811649 - DNA, 22 bp, Homo sapiens
gaaacagtcaactttctttccc

SEQ ID NO: 7811650 - DNA, 22 bp, Homo sapiens
gaaacatattaatccagtgaaa

SEQ ID NO: 7811651 - DNA, 22 bp, Homo sapiens
gaaacatgtctgacaatttacc

SEQ ID NO: 7811652 - DNA, 22 bp, Homo sapiens
gaaacatgtctgacaatttacc

SEQ ID NO: 7811653 - DNA, 22 bp, Homo sapiens
gaaacattcagtcaacagtgtt

SEQ ID NO: 7811654 - DNA, 22 bp, Homo sapiens
gaaacatgtctgacaatttacc

SEQ ID NO: 7811655 - DNA, 22 bp, Homo sapiens
gaaacatagttgagacactgct

SEQ ID NO: 7811656 - DNA, 22 bp, Homo sapiens
gaaacatagttgagacactgct

SEQ ID NO: 7811657 - DNA, 22 bp, Homo sapiens
gaaacatacgatttaggagaaa

SEQ ID NO: 7811658 - DNA, 22 bp, Homo sapiens
gaaacatagttgagacactgct

SEQ ID NO: 7811659 - DNA, 22 bp, Homo sapiens
gaaacatagttgagacactgct

SEQ ID NO: 7811660 - DNA, 22 bp, Homo sapiens
gaaacattcagtcaacagtgtt

SEQ ID NO: 7811661 - DNA, 22 bp, Homo sapiens
gaaacattcagtcaacagtgtt

SEQ ID NO: 7811662 - DNA, 22 bp, Homo sapiens
gaaacattcagtcaacagtgtt

SEQ ID NO: 7811663 - DNA, 22 bp, Homo sapiens
gaaacattcagtcaacagtgtt

SEQ ID NO: 7811664 - DNA, 22 bp, Homo sapiens
gaaacattcatatgagaaacct

SEQ ID NO: 7811665 - DNA, 22 bp, Homo sapiens
gaaacattcatatgagaaacct

SEQ ID NO: 7811666 - DNA, 22 bp, Homo sapiens
gaaaatgttagcttcatagtca

SEQ ID NO: 7811667 - DNA, 22 bp, Homo sapiens
gaaaatgttagcttcatagtca

SEQ ID NO: 7811668 - DNA, 22 bp, Homo sapiens
gaaacatacgatttaggagaaa

SEQ ID NO: 7811669 - DNA, 22 bp, Homo sapiens
gaaacagtgagaacttttcctg

SEQ ID NO: 7811670 - DNA, 22 bp, Homo sapiens
gaaacagtgagaacttttcctg

SEQ ID NO: 7811671 - DNA, 22 bp, Homo sapiens
gaaacagtcaactttctttccc

SEQ ID NO: 7811672 - DNA, 22 bp, Homo sapiens
gaaacaggccaggttccaggcc

SEQ ID NO: 7811673 - DNA, 22 bp, Homo sapiens
gaaaatgttagcttcatagtca

SEQ ID NO: 7811674 - DNA, 22 bp, Homo sapiens
gaaacaggtggcaggctagatt

SEQ ID NO: 7811675 - DNA, 22 bp, Homo sapiens
gaaacaggtggcaggctagatt

SEQ ID NO: 7811676 - DNA, 22 bp, Homo sapiens
ctttcttcatctgtaatatgga

SEQ ID NO: 7811677 - DNA, 22 bp, Homo sapiens
ctttcttcatctgtaatatgga

SEQ ID NO: 7811678 - DNA, 22 bp, Homo sapiens
ctttctttcgaagacgtgatta

SEQ ID NO: 7811679 - DNA, 22 bp, Homo sapiens
ctttctttcgaagacgtgatta

SEQ ID NO: 7811680 - DNA, 22 bp, Homo sapiens
ctttcttgcataatttgaaacc

SEQ ID NO: 7811681 - DNA, 22 bp, Homo sapiens
atgacagatgctgtggggaggt

SEQ ID NO: 7811682 - DNA, 22 bp, Homo sapiens
atgacagcattcaagacataga

SEQ ID NO: 7811683 - DNA, 22 bp, Homo sapiens
atgacagcattttcttctaagg

SEQ ID NO: 7811684 - DNA, 22 bp, Homo sapiens
atgacagcattcaagacataga

SEQ ID NO: 7811685 - DNA, 22 bp, Homo sapiens
atgacagtactggtgacaatac

SEQ ID NO: 7811686 - DNA, 22 bp, Homo sapiens
atgacaggtgattttatgcttt

SEQ ID NO: 7811687 - DNA, 22 bp, Homo sapiens
atgacaggaggcagctgggcag

SEQ ID NO: 7811688 - DNA, 22 bp, Homo sapiens
atgacaggtatgccttataatc

SEQ ID NO: 7811689 - DNA, 22 bp, Homo sapiens
atgacaggaataactatgatgg

SEQ ID NO: 7811690 - DNA, 22 bp, Homo sapiens
atgacaggaggcagctgggcag

SEQ ID NO: 7811691 - DNA, 22 bp, Homo sapiens
gaaacatttgttgagtacttgc

SEQ ID NO: 7811692 - DNA, 22 bp, Homo sapiens
gaaacatttgttgagtacttgc

SEQ ID NO: 7811693 - DNA, 22 bp, Homo sapiens
gaaaccacagtacccaggaaaa

SEQ ID NO: 7811694 - DNA, 22 bp, Homo sapiens
gaaacatttgttgagtacttgc

SEQ ID NO: 7811695 - DNA, 22 bp, Homo sapiens
gaaacatttgttgagtacttgc

SEQ ID NO: 7811696 - DNA, 20 bp, Homo sapiens
gaaaccagaacgcagccctg

SEQ ID NO: 7811697 - DNA, 20 bp, Homo sapiens
gaaaccagaacgcagccctg

SEQ ID NO: 7811698 - DNA, 21 bp, Homo sapiens
atgacagatgctgcagatcgt

SEQ ID NO: 7811699 - DNA, 21 bp, Homo sapiens
atgacagatgctgcagatcgt

SEQ ID NO: 7811700 - DNA, 22 bp, Homo sapiens
atgacataaagctatgctaggt

SEQ ID NO: 7811701 - DNA, 22 bp, Homo sapiens
atgacagttctttagagatgta

SEQ ID NO: 7811702 - DNA, 22 bp, Homo sapiens
atgacagttctttagagatgta

SEQ ID NO: 7811703 - DNA, 22 bp, Homo sapiens
atgacagttctttagagatgta

SEQ ID NO: 7811704 - DNA, 22 bp, Homo sapiens
atgacagttctacacttaatct

SEQ ID NO: 7811705 - DNA, 22 bp, Homo sapiens
atgacagtgggtcttgcaaaga

SEQ ID NO: 7811706 - DNA, 22 bp, Homo sapiens
atgacagttctacacttaatct

SEQ ID NO: 7811707 - DNA, 22 bp, Homo sapiens
atgacatatgattctgaagaca

SEQ ID NO: 7811708 - DNA, 22 bp, Homo sapiens
atgacataagtgaaaaacatca

SEQ ID NO: 7811709 - DNA, 22 bp, Homo sapiens
atgacataagtgaaaaacatca

SEQ ID NO: 7811710 - DNA, 22 bp, Homo sapiens
atgacagtgggtcttgcaaaga

SEQ ID NO: 7811711 - DNA, 22 bp, Homo sapiens
atgacagtaggtaaatgatagc

SEQ ID NO: 7811712 - DNA, 22 bp, Homo sapiens
atgacagtgggtcttgcaaaga

SEQ ID NO: 7811713 - DNA, 22 bp, Homo sapiens
atgacagtaggtaaatgatagc

SEQ ID NO: 7811714 - DNA, 22 bp, Homo sapiens
atgacagtaggtaaatgatagc

SEQ ID NO: 7811715 - DNA, 22 bp, Homo sapiens
atgacagtactggtgacaatac

SEQ ID NO: 7811716 - DNA, 22 bp, Homo sapiens
atgacagtactggtgacaatac

SEQ ID NO: 7811717 - DNA, 22 bp, Homo sapiens
atgacagtaggtaaatgatagc

SEQ ID NO: 7811718 - DNA, 22 bp, Homo sapiens
atgacagtaggtaaatgatagc

SEQ ID NO: 7811719 - DNA, 22 bp, Homo sapiens
atgacatcaacagtggtgctgt

SEQ ID NO: 7811720 - DNA, 22 bp, Homo sapiens
atgacatcactacattattcct

SEQ ID NO: 7811721 - DNA, 22 bp, Homo sapiens
atgacatgaataaaaatcgtgt

SEQ ID NO: 7811722 - DNA, 22 bp, Homo sapiens
atgacatgacctggtagagaca

SEQ ID NO: 7811723 - DNA, 22 bp, Homo sapiens
gaaagcagtatttagttctgtt

SEQ ID NO: 7811724 - DNA, 22 bp, Homo sapiens
gaaagcagtatttagttctgtt

SEQ ID NO: 7811725 - DNA, 22 bp, Homo sapiens
gaaagcagtatttagttctgtt

SEQ ID NO: 7811726 - DNA, 22 bp, Homo sapiens
atgacatgacctggtagagaca

SEQ ID NO: 7811727 - DNA, 22 bp, Homo sapiens
atgacatgattctttctttcat

SEQ ID NO: 7811728 - DNA, 22 bp, Homo sapiens
atgacatgaggcatctttggag

SEQ ID NO: 7811729 - DNA, 22 bp, Homo sapiens
gaaagcataactaatatttatt

SEQ ID NO: 7811730 - DNA, 22 bp, Homo sapiens
gaaagcataactaatatttatt

SEQ ID NO: 7811731 - DNA, 22 bp, Homo sapiens
gaaaggttgggtgaatggtgga

SEQ ID NO: 7811732 - DNA, 22 bp, Homo sapiens
ctttctcttgagcaagagctgt

SEQ ID NO: 7811733 - DNA, 22 bp, Homo sapiens
ctttctcttcgaaaacctgccc

SEQ ID NO: 7811734 - DNA, 22 bp, Homo sapiens
ctttctcttcgaaaacctgccc

SEQ ID NO: 7811735 - DNA, 22 bp, Homo sapiens
ctttctcttcgaaaacctgccc

SEQ ID NO: 7811736 - DNA, 22 bp, Homo sapiens
ctttctgaagtttaagttctaa

SEQ ID NO: 7811737 - DNA, 22 bp, Homo sapiens
ctttctgaaagacattttaact

SEQ ID NO: 7811738 - DNA, 22 bp, Homo sapiens
ctttctcttgagcaagagctgt

SEQ ID NO: 7811739 - DNA, 22 bp, Homo sapiens
ctttctcttgagcaagagctgt

SEQ ID NO: 7811740 - DNA, 22 bp, Homo sapiens
ctttctgaaagacattttaact

SEQ ID NO: 7811741 - DNA, 22 bp, Homo sapiens
ctttctggagtggaaaggtatt

SEQ ID NO: 7811742 - DNA, 22 bp, Homo sapiens
ctttctgattttaagctctaat

SEQ ID NO: 7811743 - DNA, 22 bp, Homo sapiens
ctttcttcaacctcattctgca

SEQ ID NO: 7811744 - DNA, 22 bp, Homo sapiens
ctttcttcaacctcattctgca

SEQ ID NO: 7811745 - DNA, 22 bp, Homo sapiens
ctttcttaatttttaaggacac

SEQ ID NO: 7811746 - DNA, 22 bp, Homo sapiens
ctttcttaatttttaaggacac

SEQ ID NO: 7811747 - DNA, 22 bp, Homo sapiens
ctttcttaatttttaaggacac

SEQ ID NO: 7811748 - DNA, 22 bp, Homo sapiens
ctttctggacaagacagaggga

SEQ ID NO: 7811749 - DNA, 23 bp, Homo sapiens
atgaacattagtttcagatattg

SEQ ID NO: 7811750 - DNA, 23 bp, Homo sapiens
atgaacattagtttcagatattg

SEQ ID NO: 7811751 - DNA, 22 bp, Homo sapiens
atgaacattaaaatggtagaat

SEQ ID NO: 7811752 - DNA, 22 bp, Homo sapiens
atgaacatgtgactcagacctg

SEQ ID NO: 7811753 - DNA, 22 bp, Homo sapiens
atgaacagtatgcaacatgatt

SEQ ID NO: 7811754 - DNA, 22 bp, Homo sapiens
atgaacatctctgatccaagca

SEQ ID NO: 7811755 - DNA, 22 bp, Homo sapiens
atgaacatgtgactcagacctg

SEQ ID NO: 7811756 - DNA, 22 bp, Homo sapiens
atgaaccttgatttgttcatct

SEQ ID NO: 7811757 - DNA, 22 bp, Homo sapiens
atgaactaagagtcattagtgt

SEQ ID NO: 7811758 - DNA, 22 bp, Homo sapiens
atgaactatcatcagttccacc

SEQ ID NO: 7811759 - DNA, 22 bp, Homo sapiens
atgaactacatgatcctgaaat

SEQ ID NO: 7811760 - DNA, 22 bp, Homo sapiens
atgaacatttggtttggcagca

SEQ ID NO: 7811761 - DNA, 22 bp, Homo sapiens
atgaaccataggcaagacaata

SEQ ID NO: 7811762 - DNA, 22 bp, Homo sapiens
atgaagaaaaatccagctgtcc

SEQ ID NO: 7811763 - DNA, 22 bp, Homo sapiens
atgaagaaaaatccagctgtcc

SEQ ID NO: 7811764 - DNA, 22 bp, Homo sapiens
atgaagaaactgttctgggtgg

SEQ ID NO: 7811765 - DNA, 22 bp, Homo sapiens
atgaactttctttacagttttg

SEQ ID NO: 7811766 - DNA, 22 bp, Homo sapiens
atgaacttatttctgaactttt

SEQ ID NO: 7811767 - DNA, 22 bp, Homo sapiens
atgaactgtccaatcttagagg

SEQ ID NO: 7811768 - DNA, 22 bp, Homo sapiens
atgaactgcagtataaacttgg

SEQ ID NO: 7811769 - DNA, 22 bp, Homo sapiens
atgaactgagcttaattgctga

SEQ ID NO: 7811770 - DNA, 22 bp, Homo sapiens
atgaaattaatcaacacataca

SEQ ID NO: 7811771 - DNA, 22 bp, Homo sapiens
atgaaacagtgtgtatagcaaa

SEQ ID NO: 7811772 - DNA, 22 bp, Homo sapiens
atgaaacagtgtgtatagcaaa

SEQ ID NO: 7811773 - DNA, 22 bp, Homo sapiens
atgaaacagtgaattagtcaag

SEQ ID NO: 7811774 - DNA, 22 bp, Homo sapiens
atgaaacagtgaattagtcaag

SEQ ID NO: 7811775 - DNA, 22 bp, Homo sapiens
atgaaacagagtacttaatata

SEQ ID NO: 7811776 - DNA, 22 bp, Homo sapiens
atgaaacagagtacttaatata

SEQ ID NO: 7811777 - DNA, 22 bp, Homo sapiens
atgaaacagtgaattagtcaag

SEQ ID NO: 7811778 - DNA, 22 bp, Homo sapiens
atgaaacagagtacttaatata

SEQ ID NO: 7811779 - DNA, 22 bp, Homo sapiens
atgaacagaggaatagaattct

SEQ ID NO: 7811780 - DNA, 22 bp, Homo sapiens
atgaacagaggcactaggaggg

SEQ ID NO: 7811781 - DNA, 20 bp, Homo sapiens
atgaaattcctgttttctga

SEQ ID NO: 7811782 - DNA, 22 bp, Homo sapiens
atgaacagcattgaaatccagc

SEQ ID NO: 7811783 - DNA, 22 bp, Homo sapiens
atgaacagcattgaaatccagc

SEQ ID NO: 7811784 - DNA, 22 bp, Homo sapiens
atgaacagcattgaaatccagc

SEQ ID NO: 7811785 - DNA, 22 bp, Homo sapiens
atgaacagaggcactaggaggg

SEQ ID NO: 7811786 - DNA, 22 bp, Homo sapiens
atgaaattcatctgagaatgct

SEQ ID NO: 7811787 - DNA, 22 bp, Homo sapiens
atgaacatcggaaatgagactg

SEQ ID NO: 7811788 - DNA, 22 bp, Homo sapiens
atgaacagtatgcaacatgatt

SEQ ID NO: 7811789 - DNA, 22 bp, Homo sapiens
atgaacagtatgcaacatgatt

SEQ ID NO: 7811790 - DNA, 22 bp, Homo sapiens
atgaacagtacaaagcacagac

SEQ ID NO: 7811791 - DNA, 22 bp, Homo sapiens
atgaaaatgtacatgtgtataa

SEQ ID NO: 7811792 - DNA, 22 bp, Homo sapiens
atgaaaatgtacatgtgtataa

SEQ ID NO: 7811793 - DNA, 22 bp, Homo sapiens
atgaaaagttcgatctagaagg

SEQ ID NO: 7811794 - DNA, 22 bp, Homo sapiens
atgaaaagttcgatctagaagg

SEQ ID NO: 7811795 - DNA, 22 bp, Homo sapiens
atgaaaatactgtggttgatag

SEQ ID NO: 7811796 - DNA, 22 bp, Homo sapiens
atgaaaatgtacatgtgtataa

SEQ ID NO: 7811797 - DNA, 22 bp, Homo sapiens
atgaaaatgtacatgtgtataa

SEQ ID NO: 7811798 - DNA, 22 bp, Homo sapiens
atgaaaattgacagcggaagta

SEQ ID NO: 7811799 - DNA, 22 bp, Homo sapiens
atgaaaattgacagcggaagta

SEQ ID NO: 7811800 - DNA, 22 bp, Homo sapiens
atgaaacaaacctctatggagt

SEQ ID NO: 7811801 - DNA, 22 bp, Homo sapiens
atgaaacaagggtattttctct

SEQ ID NO: 7811802 - DNA, 22 bp, Homo sapiens
atgaaacaaacctctatggagt

SEQ ID NO: 7811803 - DNA, 19 bp, Homo sapiens
atgaaacacagtggcctgg

SEQ ID NO: 7811804 - DNA, 22 bp, Homo sapiens
atgaaacacacacgcgcatact

SEQ ID NO: 7811805 - DNA, 22 bp, Homo sapiens
atgaaacagagtacttaatata

SEQ ID NO: 7811806 - DNA, 22 bp, Homo sapiens
atgaaacagagtacttaatata

SEQ ID NO: 7811807 - DNA, 22 bp, Homo sapiens
atgaaacaagggtattttctct

SEQ ID NO: 7811808 - DNA, 22 bp, Homo sapiens
atgaaacaagggtattttctct

SEQ ID NO: 7811809 - DNA, 22 bp, Homo sapiens
atgaaacaagggtattttctct

SEQ ID NO: 7811810 - DNA, 22 bp, Homo sapiens
atgaaacaagggtattttctct

SEQ ID NO: 7811811 - DNA, 22 bp, Homo sapiens
atctggctattgacatgttata

SEQ ID NO: 7811812 - DNA, 22 bp, Homo sapiens
atctggctattgacatgttata

SEQ ID NO: 7811813 - DNA, 22 bp, Homo sapiens
atctggctattgacatgttata

SEQ ID NO: 7811814 - DNA, 22 bp, Homo sapiens
atctggataggttgttttgcat

SEQ ID NO: 7811815 - DNA, 22 bp, Homo sapiens
ctttcaaagaccttggcatggg

SEQ ID NO: 7811816 - DNA, 22 bp, Homo sapiens
atctggctcacttagtctagga

SEQ ID NO: 7811817 - DNA, 22 bp, Homo sapiens
ctttcaaagaccttggcatggg

SEQ ID NO: 7811818 - DNA, 22 bp, Homo sapiens
ctttcaaagagtaggaggtttt

SEQ ID NO: 7811819 - DNA, 19 bp, Homo sapiens
ctttccagctcgagcaatt

SEQ ID NO: 7811820 - DNA, 22 bp, Homo sapiens
ctttcaactacatacaggcgat

SEQ ID NO: 7811821 - DNA, 22 bp, Homo sapiens
ctttccaggtctaaaggcaggg

SEQ ID NO: 7811822 - DNA, 22 bp, Homo sapiens
ctttccagtaccaggaagcgga

SEQ ID NO: 7811823 - DNA, 19 bp, Homo sapiens
ctttccaggagatgctgag

SEQ ID NO: 7811824 - DNA, 22 bp, Homo sapiens
ctttccaggctgagtttgcttg

SEQ ID NO: 7811825 - DNA, 22 bp, Homo sapiens
ctttccaggaatcctcacagcc

SEQ ID NO: 7811826 - DNA, 22 bp, Homo sapiens
ctttccaggaatcctcacagcc

SEQ ID NO: 7811827 - DNA, 22 bp, Homo sapiens
ctttccaggaatcctcacagcc

SEQ ID NO: 7811828 - DNA, 22 bp, Homo sapiens
ctttccaggacttgcatttctg

SEQ ID NO: 7811829 - DNA, 19 bp, Homo sapiens
ctttccaggagatgctgag

SEQ ID NO: 7811830 - DNA, 19 bp, Homo sapiens
ctttccaggagatgctgag

SEQ ID NO: 7811831 - DNA, 22 bp, Homo sapiens
atgaaaagttcgatctagaagg

SEQ ID NO: 7811832 - DNA, 22 bp, Homo sapiens
atgaaaagttcgatctagaagg

SEQ ID NO: 7811833 - DNA, 22 bp, Homo sapiens
atgaaaagttcgatctagaagg

SEQ ID NO: 7811834 - DNA, 22 bp, Homo sapiens
atgaaaagttcgatctagaagg

SEQ ID NO: 7811835 - DNA, 22 bp, Homo sapiens
atgaaaagttcgatctagaagg

SEQ ID NO: 7811836 - DNA, 22 bp, Homo sapiens
ctttcctagatggccatctttc

SEQ ID NO: 7811837 - DNA, 22 bp, Homo sapiens
ctttcctagatggccatctttc

SEQ ID NO: 7811838 - DNA, 22 bp, Homo sapiens
ctttcccttagccccattctat

SEQ ID NO: 7811839 - DNA, 22 bp, Homo sapiens
ctttcccttagccccattctat

SEQ ID NO: 7811840 - DNA, 22 bp, Homo sapiens
ctttcccttttgccttgcgtgg

SEQ ID NO: 7811841 - DNA, 22 bp, Homo sapiens
ctttcccttttgccttgcgtgg

SEQ ID NO: 7811842 - DNA, 22 bp, Homo sapiens
ctttcccttttgccttgcgtgg

SEQ ID NO: 7811843 - DNA, 22 bp, Homo sapiens
ctttcctagaaatatatactta

SEQ ID NO: 7811844 - DNA, 22 bp, Homo sapiens
ctttccccagtatatcattgcc

SEQ ID NO: 7811845 - DNA, 22 bp, Homo sapiens
ctttcccagagtagttgatgct

SEQ ID NO: 7811846 - DNA, 22 bp, Homo sapiens
ctttcccacgcagtggatgaga

SEQ ID NO: 7811847 - DNA, 22 bp, Homo sapiens
ctttccagtttctaagtacagt

SEQ ID NO: 7811848 - DNA, 22 bp, Homo sapiens
ctttcccacgcagtggatgaga

SEQ ID NO: 7811849 - DNA, 22 bp, Homo sapiens
ctttcccacgcagtggatgaga

SEQ ID NO: 7811850 - DNA, 22 bp, Homo sapiens
ctttcccacgcagtggatgaga

SEQ ID NO: 7811851 - DNA, 22 bp, Homo sapiens
ctttcccagagtagttgatgct

SEQ ID NO: 7811852 - DNA, 22 bp, Homo sapiens
ctttccctgcttagaaggattt

SEQ ID NO: 7811853 - DNA, 22 bp, Homo sapiens
ctttccctgcttagaaggattt

SEQ ID NO: 7811854 - DNA, 22 bp, Homo sapiens
ctttcccttagccccattctat

SEQ ID NO: 7811855 - DNA, 22 bp, Homo sapiens
ctttcccttagccccattctat

SEQ ID NO: 7811856 - DNA, 22 bp, Homo sapiens
ctttcccttagccccattctat

SEQ ID NO: 7811857 - DNA, 22 bp, Homo sapiens
ctttcccttagccccattctat

SEQ ID NO: 7811858 - DNA, 22 bp, Homo sapiens
ctttcccttagccccattctat

SEQ ID NO: 7811859 - DNA, 22 bp, Homo sapiens
ctttcccttagccccattctat

SEQ ID NO: 7811860 - DNA, 22 bp, Homo sapiens
cttctttaatgtatacaaaaga

SEQ ID NO: 7811861 - DNA, 22 bp, Homo sapiens
cttctttaccaagagatagagt

SEQ ID NO: 7811862 - DNA, 22 bp, Homo sapiens
cttctttactttctagaaataa

SEQ ID NO: 7811863 - DNA, 22 bp, Homo sapiens
cttctttactttctagaaataa

SEQ ID NO: 7811864 - DNA, 22 bp, Homo sapiens
atctggagagatcttcacaaaa

SEQ ID NO: 7811865 - DNA, 22 bp, Homo sapiens
atctggagaatgtttgtctccg

SEQ ID NO: 7811866 - DNA, 22 bp, Homo sapiens
atctggagagctggcagcccag

SEQ ID NO: 7811867 - DNA, 22 bp, Homo sapiens
atctggagatcagctggtggca

SEQ ID NO: 7811868 - DNA, 22 bp, Homo sapiens
cttctttaatgtatacaaaaga

SEQ ID NO: 7811869 - DNA, 22 bp, Homo sapiens
cttcttgttgttagggtcctgt

SEQ ID NO: 7811870 - DNA, 22 bp, Homo sapiens
cttcttgtcagtgatttcttcc

SEQ ID NO: 7811871 - DNA, 22 bp, Homo sapiens
atctggataggttgttttgcat

SEQ ID NO: 7811872 - DNA, 22 bp, Homo sapiens
atctggccctctcagccctgtt

SEQ ID NO: 7811873 - DNA, 22 bp, Homo sapiens
atctggattctagatctagatc

SEQ ID NO: 7811874 - DNA, 22 bp, Homo sapiens
atctggagtttcagttttctgg

SEQ ID NO: 7811875 - DNA, 23 bp, Homo sapiens
atctggagtgttgagtaggtact

SEQ ID NO: 7811876 - DNA, 22 bp, Homo sapiens
atctggagtgggacacagaaat

SEQ ID NO: 7811877 - DNA, 22 bp, Homo sapiens
atctggagtgggacacagaaat

SEQ ID NO: 7811878 - DNA, 22 bp, Homo sapiens
atctggaggcattactctgtct

SEQ ID NO: 7811879 - DNA, 22 bp, Homo sapiens
atctggaggcctgtcttatccc

SEQ ID NO: 7811880 - DNA, 22 bp, Homo sapiens
atctggaggctaagtcatttgc

SEQ ID NO: 7811881 - DNA, 22 bp, Homo sapiens
atctggaggtcatcgtttgttc

SEQ ID NO: 7811882 - DNA, 22 bp, Homo sapiens
atctggagtagaaaaatcgctt

SEQ ID NO: 7811883 - DNA, 22 bp, Homo sapiens
atctggagatctgaattttgtg

SEQ ID NO: 7811884 - DNA, 22 bp, Homo sapiens
atctggagatgggtctgtcacc

SEQ ID NO: 7811885 - DNA, 22 bp, Homo sapiens
atctggagatttcttttcaata

SEQ ID NO: 7811886 - DNA, 22 bp, Homo sapiens
atctggagcaagattaagagat

SEQ ID NO: 7811887 - DNA, 22 bp, Homo sapiens
atctggagcagggccacaaggc

SEQ ID NO: 7811888 - DNA, 22 bp, Homo sapiens
atctggagcttaagcttatata

SEQ ID NO: 7811889 - DNA, 22 bp, Homo sapiens
atctggagctctgcacacctgg

SEQ ID NO: 7811890 - DNA, 22 bp, Homo sapiens
atctggagcttgttagatgttt

SEQ ID NO: 7811891 - DNA, 22 bp, Homo sapiens
atctggaggattctgggacttg

SEQ ID NO: 7811892 - DNA, 22 bp, Homo sapiens
atctggaggcaaaggggcgtga

SEQ ID NO: 7811893 - DNA, 22 bp, Homo sapiens
gaatcagaatctgcatttttaa

SEQ ID NO: 7811894 - DNA, 22 bp, Homo sapiens
gaatcagaatctgcatgttaag

SEQ ID NO: 7811895 - DNA, 22 bp, Homo sapiens
gaatcagaatctgcatgttaag

SEQ ID NO: 7811896 - DNA, 22 bp, Homo sapiens
gaatcagatgcggtttagctta

SEQ ID NO: 7811897 - DNA, 22 bp, Homo sapiens
gaatcagatactgatttcagtc

SEQ ID NO: 7811898 - DNA, 22 bp, Homo sapiens
gaatcagataataagcaagcat

SEQ ID NO: 7811899 - DNA, 22 bp, Homo sapiens
gaatcagataataagcaagcat

SEQ ID NO: 7811900 - DNA, 22 bp, Homo sapiens
gaattttatcttattacttgca

SEQ ID NO: 7811901 - DNA, 22 bp, Homo sapiens
gaattttatcttattacttgca

SEQ ID NO: 7811902 - DNA, 19 bp, Homo sapiens
gaattttaggacttcagca

SEQ ID NO: 7811903 - DNA, 19 bp, Homo sapiens
gaattttaggacttcagca

SEQ ID NO: 7811904 - DNA, 22 bp, Homo sapiens
gaatcagcctgagtttgcagct

SEQ ID NO: 7811905 - DNA, 19 bp, Homo sapiens
gaattttaggacttcagca

SEQ ID NO: 7811906 - DNA, 22 bp, Homo sapiens
gaatcagcctgagtttgcagct

SEQ ID NO: 7811907 - DNA, 19 bp, Homo sapiens
gaattttaggacttcagca

SEQ ID NO: 7811908 - DNA, 22 bp, Homo sapiens
gacaataagaacagatactgtg

SEQ ID NO: 7811909 - DNA, 22 bp, Homo sapiens
gacaataagaaaagaggaggca

SEQ ID NO: 7811910 - DNA, 22 bp, Homo sapiens
gacaataaagtgatacatggga

SEQ ID NO: 7811911 - DNA, 22 bp, Homo sapiens
gacaatctagataatctgtctc

SEQ ID NO: 7811912 - DNA, 22 bp, Homo sapiens
gacaatgcagaagtacttgttc

SEQ ID NO: 7811913 - DNA, 21 bp, Homo sapiens
gacaatgcagtcttttttgga

SEQ ID NO: 7811914 - DNA, 22 bp, Homo sapiens
gacaatgtaaatcaggatagca

SEQ ID NO: 7811915 - DNA, 22 bp, Homo sapiens
gacaatgtgacagaccaatgat

SEQ ID NO: 7811916 - DNA, 22 bp, Homo sapiens
gaatattttcagtacagatggt

SEQ ID NO: 7811917 - DNA, 22 bp, Homo sapiens
gaatattttcagtacagatggt

SEQ ID NO: 7811918 - DNA, 22 bp, Homo sapiens
gaatacaaataataccaaggtg

SEQ ID NO: 7811919 - DNA, 22 bp, Homo sapiens
gaatacaaataataccaaggtg

SEQ ID NO: 7811920 - DNA, 22 bp, Homo sapiens
gaatattttcagtacagatggt

SEQ ID NO: 7811921 - DNA, 22 bp, Homo sapiens
gaatattttcagtacagatggt

SEQ ID NO: 7811922 - DNA, 22 bp, Homo sapiens
gaatattttcagtacagatggt

SEQ ID NO: 7811923 - DNA, 22 bp, Homo sapiens
gaatattttcagtacagatggt

SEQ ID NO: 7811924 - DNA, 22 bp, Homo sapiens
gaatattttcagtacagatggt

SEQ ID NO: 7811925 - DNA, 22 bp, Homo sapiens
gaatatttttaaagggactaat

SEQ ID NO: 7811926 - DNA, 22 bp, Homo sapiens
gaatatttttaaagggactaat

SEQ ID NO: 7811927 - DNA, 22 bp, Homo sapiens
gaatatttttaaagggactaat

SEQ ID NO: 7811928 - DNA, 22 bp, Homo sapiens
gaatatttttaaagggactaat

SEQ ID NO: 7811929 - DNA, 22 bp, Homo sapiens
gaatatttttaaagggactaat

SEQ ID NO: 7811930 - DNA, 22 bp, Homo sapiens
gaatattttcagtacagatggt

SEQ ID NO: 7811931 - DNA, 22 bp, Homo sapiens
gaatattttcagtacagatggt

SEQ ID NO: 7811932 - DNA, 22 bp, Homo sapiens
gaatattttcagtacagatggt

SEQ ID NO: 7811933 - DNA, 22 bp, Homo sapiens
gaatcagaatctctaaggtggg

SEQ ID NO: 7811934 - DNA, 22 bp, Homo sapiens
gaatcagaatctctaaggtggg

SEQ ID NO: 7811935 - DNA, 22 bp, Homo sapiens
gaatcacggtattctgcacggg

SEQ ID NO: 7811936 - DNA, 22 bp, Homo sapiens
gaatcacactcgtaagtgagtt

SEQ ID NO: 7811937 - DNA, 22 bp, Homo sapiens
gaatcacactcgtaagtgagtt

SEQ ID NO: 7811938 - DNA, 22 bp, Homo sapiens
gaatcacactcgtaagtgagtt

SEQ ID NO: 7811939 - DNA, 22 bp, Homo sapiens
gaatcaatggtagattaagtaa

SEQ ID NO: 7811940 - DNA, 22 bp, Homo sapiens
gaatcaattgtgaagactatga

SEQ ID NO: 7811941 - DNA, 22 bp, Homo sapiens
gaatcaattatccaggctgttg

SEQ ID NO: 7811942 - DNA, 22 bp, Homo sapiens
gaataatattgactttgcaggc

SEQ ID NO: 7811943 - DNA, 22 bp, Homo sapiens
gaataatagcagaaattagcag

SEQ ID NO: 7811944 - DNA, 22 bp, Homo sapiens
gaataagtgaagttggcagctt

SEQ ID NO: 7811945 - DNA, 22 bp, Homo sapiens
gaataactccatgatatgcttt

SEQ ID NO: 7811946 - DNA, 22 bp, Homo sapiens
gaataatagcagaaattagcag

SEQ ID NO: 7811947 - DNA, 22 bp, Homo sapiens
gaataacattttttcctttaca

SEQ ID NO: 7811948 - DNA, 22 bp, Homo sapiens
gaataactaaatggcagttctt

SEQ ID NO: 7811949 - DNA, 22 bp, Homo sapiens
gaagtcttcattctctctgaga

SEQ ID NO: 7811950 - DNA, 22 bp, Homo sapiens
gaagtctgtgggttcaaaggca

SEQ ID NO: 7811951 - DNA, 22 bp, Homo sapiens
gaagtctgggaggggcccaata

SEQ ID NO: 7811952 - DNA, 22 bp, Homo sapiens
atgcacaggaccacacataatg

SEQ ID NO: 7811953 - DNA, 22 bp, Homo sapiens
atgcacaggaccacacataatg

SEQ ID NO: 7811954 - DNA, 22 bp, Homo sapiens
atgcacaggtgctgatgcacgc

SEQ ID NO: 7811955 - DNA, 22 bp, Homo sapiens
gaatacaaacttaaggctttac

SEQ ID NO: 7811956 - DNA, 22 bp, Homo sapiens
gaatacaaacttaaggctttac

SEQ ID NO: 7811957 - DNA, 22 bp, Homo sapiens
gaatacaaacttaaggctttac

SEQ ID NO: 7811958 - DNA, 22 bp, Homo sapiens
gaatacaaacttaaggctttac

SEQ ID NO: 7811959 - DNA, 22 bp, Homo sapiens
gaatacaaagcagaactcatac

SEQ ID NO: 7811960 - DNA, 22 bp, Homo sapiens
gaatacaaagcagaactcatac

SEQ ID NO: 7811961 - DNA, 22 bp, Homo sapiens
gaatacaaagcagaactcatac

SEQ ID NO: 7811962 - DNA, 22 bp, Homo sapiens
gaatacaaagcagaactcatac

SEQ ID NO: 7811963 - DNA, 22 bp, Homo sapiens
gaatacaaagcagaactcatac

SEQ ID NO: 7811964 - DNA, 22 bp, Homo sapiens
gaatacaaagcagaactcatac

SEQ ID NO: 7811965 - DNA, 22 bp, Homo sapiens
gaatacaaagcagaactcatac

SEQ ID NO: 7811966 - DNA, 22 bp, Homo sapiens
gaatacaaagcagaactcatac

SEQ ID NO: 7811967 - DNA, 22 bp, Homo sapiens
gaatacaaataataccaaggtg

SEQ ID NO: 7811968 - DNA, 22 bp, Homo sapiens
gaatacaaataataccaaggtg

SEQ ID NO: 7811969 - DNA, 22 bp, Homo sapiens
gaatacaaataataccaaggtg

SEQ ID NO: 7811970 - DNA, 22 bp, Homo sapiens
gaatacaaataataccaaggtg

SEQ ID NO: 7811971 - DNA, 23 bp, Homo sapiens
gaatacaaagcagatggtccagc

SEQ ID NO: 7811972 - DNA, 23 bp, Homo sapiens
gaatacaaagcagatggtccagc

SEQ ID NO: 7811973 - DNA, 23 bp, Homo sapiens
gaatacaaagcagatggtccagc

SEQ ID NO: 7811974 - DNA, 23 bp, Homo sapiens
gaatacaaagcagatggtccagc

SEQ ID NO: 7811975 - DNA, 23 bp, Homo sapiens
gaatacaaagcagatggtccagc

SEQ ID NO: 7811976 - DNA, 23 bp, Homo sapiens
gaatacaaagcagatggtccagc

SEQ ID NO: 7811977 - DNA, 23 bp, Homo sapiens
gaatacaaagcagatggtccagc

SEQ ID NO: 7811978 - DNA, 22 bp, Homo sapiens
gaatacaaagcagaactcatac

SEQ ID NO: 7811979 - DNA, 22 bp, Homo sapiens
gaatacaaagcagaactcatac

SEQ ID NO: 7811980 - DNA, 22 bp, Homo sapiens
gaatacaaagcagaactcatac

SEQ ID NO: 7811981 - DNA, 22 bp, Homo sapiens
gaataattgtgatgcttgaagt

SEQ ID NO: 7811982 - DNA, 22 bp, Homo sapiens
gaataatcatgaaattcagtga

SEQ ID NO: 7811983 - DNA, 22 bp, Homo sapiens
gaataatattgactttgcaggc

SEQ ID NO: 7811984 - DNA, 22 bp, Homo sapiens
gaataatattgactttgcaggc

SEQ ID NO: 7811985 - DNA, 22 bp, Homo sapiens
gaataatcatatcgtctcacat

SEQ ID NO: 7811986 - DNA, 22 bp, Homo sapiens
gaataatcatgaaattcagtga

SEQ ID NO: 7811987 - DNA, 22 bp, Homo sapiens
gaataattttgatcagaaggga

SEQ ID NO: 7811988 - DNA, 22 bp, Homo sapiens
gaatacaaacttaaggctttac

SEQ ID NO: 7811989 - DNA, 22 bp, Homo sapiens
gaatacaaacttaaggctttac

SEQ ID NO: 7811990 - DNA, 22 bp, Homo sapiens
gaatacaaacttaaggctttac

SEQ ID NO: 7811991 - DNA, 16 bp, Homo sapiens
gaaggcttactgcagg

SEQ ID NO: 7811992 - DNA, 22 bp, Homo sapiens
gaaggctgtttctggtagtgat

SEQ ID NO: 7811993 - DNA, 22 bp, Homo sapiens
gaaggcttagaaacaagggagc

SEQ ID NO: 7811994 - DNA, 22 bp, Homo sapiens
gaaggctgtttctggtagtgat

SEQ ID NO: 7811995 - DNA, 22 bp, Homo sapiens
gaaggctgtggctggtctcagt

SEQ ID NO: 7811996 - DNA, 22 bp, Homo sapiens
gaaggctgtttctggtagtgat

SEQ ID NO: 7811997 - DNA, 22 bp, Homo sapiens
gaaggctgtttctggtagtgat

SEQ ID NO: 7811998 - DNA, 22 bp, Homo sapiens
gaaggctgtttctggtagtgat

SEQ ID NO: 7811999 - DNA, 22 bp, Homo sapiens
gaaggcttatgtgtgactttcg

SEQ ID NO: 7812000 - DNA, 22 bp, Homo sapiens
atgcacaaggtagattattatt

SEQ ID NO: 7812001 - DNA, 22 bp, Homo sapiens
atgcacaaggtagattattatt

SEQ ID NO: 7812002 - DNA, 22 bp, Homo sapiens
atgcacaagttatatgtatgga

SEQ ID NO: 7812003 - DNA, 22 bp, Homo sapiens
atgcacaaggtagattattatt

SEQ ID NO: 7812004 - DNA, 22 bp, Homo sapiens
atgcacaatgttttgatttgag

SEQ ID NO: 7812005 - DNA, 22 bp, Homo sapiens
atgcacaatgttttgatttgag

SEQ ID NO: 7812006 - DNA, 22 bp, Homo sapiens
atgcacaatgttttgatttgag

SEQ ID NO: 7812007 - DNA, 22 bp, Homo sapiens
gaaggctgtcagagaggagggc

SEQ ID NO: 7812008 - DNA, 22 bp, Homo sapiens
gaaggctgtggctggtctcagt

SEQ ID NO: 7812009 - DNA, 22 bp, Homo sapiens
gaaggctgtggctggtctcagt

SEQ ID NO: 7812010 - DNA, 22 bp, Homo sapiens
gaaggctgtcagagaggagggc

SEQ ID NO: 7812011 - DNA, 22 bp, Homo sapiens
gaaggctgtcagagaggagggc

SEQ ID NO: 7812012 - DNA, 22 bp, Homo sapiens
gaaggctggggcatcagtgaaa

SEQ ID NO: 7812013 - DNA, 22 bp, Homo sapiens
gaaggctggggcatcagtgaaa

SEQ ID NO: 7812014 - DNA, 22 bp, Homo sapiens
gaaggctggggccttctcatct

SEQ ID NO: 7812015 - DNA, 22 bp, Homo sapiens
gaaggctggggccttctcatct

SEQ ID NO: 7812016 - DNA, 22 bp, Homo sapiens
gaaggctgtcagagaggagggc

SEQ ID NO: 7812017 - DNA, 22 bp, Homo sapiens
gaaggctgtcagagaggagggc

SEQ ID NO: 7812018 - DNA, 22 bp, Homo sapiens
gaaggctgtcagagaggagggc

SEQ ID NO: 7812019 - DNA, 22 bp, Homo sapiens
gaaggctgtaggcaaagtagga

SEQ ID NO: 7812020 - DNA, 16 bp, Homo sapiens
gaaggctgggtgatcc

SEQ ID NO: 7812021 - DNA, 22 bp, Homo sapiens
gaaggctgtcagagaggagggc

SEQ ID NO: 7812022 - DNA, 22 bp, Homo sapiens
atgcacaattaggatatagctt

SEQ ID NO: 7812023 - DNA, 22 bp, Homo sapiens
atgcacacaagcttatgtatta

SEQ ID NO: 7812024 - DNA, 22 bp, Homo sapiens
atgcacacaagcttatgtatta

SEQ ID NO: 7812025 - DNA, 22 bp, Homo sapiens
atgcacacacattatgtctgtg

SEQ ID NO: 7812026 - DNA, 22 bp, Homo sapiens
atgcacacacattatgtctgtg

SEQ ID NO: 7812027 - DNA, 22 bp, Homo sapiens
atgcacacgtaccctacaaggc

SEQ ID NO: 7812028 - DNA, 19 bp, Homo sapiens
atgcacacattgaagagga

SEQ ID NO: 7812029 - DNA, 19 bp, Homo sapiens
atgcacacattgaagagga

SEQ ID NO: 7812030 - DNA, 22 bp, Homo sapiens
atgcacacacattatgtctgtg

SEQ ID NO: 7812031 - DNA, 22 bp, Homo sapiens
atgcacacacattatgtctgtg

SEQ ID NO: 7812032 - DNA, 22 bp, Homo sapiens
atgcacacgtaccctacaaggc

SEQ ID NO: 7812033 - DNA, 22 bp, Homo sapiens
atgcacacgtaccctacaaggc

SEQ ID NO: 7812034 - DNA, 22 bp, Homo sapiens
atgcacactgggattcaactgg

SEQ ID NO: 7812035 - DNA, 22 bp, Homo sapiens
atgcacactgggattcaactgg

SEQ ID NO: 7812036 - DNA, 22 bp, Homo sapiens
atgcacactgaatgcttacttt

SEQ ID NO: 7812037 - DNA, 22 bp, Homo sapiens
atgcacactgaatgcttacttt

SEQ ID NO: 7812038 - DNA, 22 bp, Homo sapiens
atgcacagaaaaattgcttact

SEQ ID NO: 7812039 - DNA, 22 bp, Homo sapiens
atgcacagctgaacactctaaa

SEQ ID NO: 7812040 - DNA, 22 bp, Homo sapiens
atgcacagctgaacactctaaa

SEQ ID NO: 7812041 - DNA, 22 bp, Homo sapiens
atgcacaggaccacacataatg

SEQ ID NO: 7812042 - DNA, 22 bp, Homo sapiens
atgcacagcagtgagttcagtg

SEQ ID NO: 7812043 - DNA, 22 bp, Homo sapiens
atgcacagatccccaggaccct

SEQ ID NO: 7812044 - DNA, 22 bp, Homo sapiens
gaacaaattctcatcaacttgt

SEQ ID NO: 7812045 - DNA, 22 bp, Homo sapiens
gaacaaatcccttcctgtctcc

SEQ ID NO: 7812046 - DNA, 22 bp, Homo sapiens
gaacaaatcccttcctgtctcc

SEQ ID NO: 7812047 - DNA, 22 bp, Homo sapiens
gaacaaattctcatcaacttgt

SEQ ID NO: 7812048 - DNA, 22 bp, Homo sapiens
gaacaaattctcatcaacttgt

SEQ ID NO: 7812049 - DNA, 22 bp, Homo sapiens
gaacaaattggagaaatcagga

SEQ ID NO: 7812050 - DNA, 22 bp, Homo sapiens
gaacaaattctcatcaacttgt

SEQ ID NO: 7812051 - DNA, 22 bp, Homo sapiens
gaacaaattggagaaatcagga

SEQ ID NO: 7812052 - DNA, 22 bp, Homo sapiens
gaacaaattggagaaatcagga

SEQ ID NO: 7812053 - DNA, 22 bp, Homo sapiens
gaacaaattggagaaatcagga

SEQ ID NO: 7812054 - DNA, 22 bp, Homo sapiens
gaacaaattggagaaatcagga

SEQ ID NO: 7812055 - DNA, 22 bp, Homo sapiens
gaacaaattggagaaatcagga

SEQ ID NO: 7812056 - DNA, 22 bp, Homo sapiens
gaacaaattggagaaatcagga

SEQ ID NO: 7812057 - DNA, 22 bp, Homo sapiens
gaacaaattggagaaatcagga

SEQ ID NO: 7812058 - DNA, 19 bp, Homo sapiens
gaacaaacttaaacttttc

SEQ ID NO: 7812059 - DNA, 22 bp, Homo sapiens
gaacaaagacatggaggaggat

SEQ ID NO: 7812060 - DNA, 19 bp, Homo sapiens
gaacaaacttaaacttttc

SEQ ID NO: 7812061 - DNA, 19 bp, Homo sapiens
gaacaaacttaaacttttc

SEQ ID NO: 7812062 - DNA, 22 bp, Homo sapiens
gaacaaacatttttggcagtat

SEQ ID NO: 7812063 - DNA, 22 bp, Homo sapiens
gaacaaactgggtcccaatgat

SEQ ID NO: 7812064 - DNA, 22 bp, Homo sapiens
gaacaaactgggtcccaatgat

SEQ ID NO: 7812065 - DNA, 22 bp, Homo sapiens
gaaatttattatctacatcatt

SEQ ID NO: 7812066 - DNA, 22 bp, Homo sapiens
gaacaaacacatcccagcagtg

SEQ ID NO: 7812067 - DNA, 22 bp, Homo sapiens
gaacaaacacatcccagcagtg

SEQ ID NO: 7812068 - DNA, 22 bp, Homo sapiens
gaacaaacacatcccagcagtg

SEQ ID NO: 7812069 - DNA, 22 bp, Homo sapiens
gaacaaacagaagaggcggaac

SEQ ID NO: 7812070 - DNA, 22 bp, Homo sapiens
gaacaaacagtcaggacagtct

SEQ ID NO: 7812071 - DNA, 22 bp, Homo sapiens
gaacaaacagtcaggacagtct

SEQ ID NO: 7812072 - DNA, 22 bp, Homo sapiens
gaacaatacaggctttattcct

SEQ ID NO: 7812073 - DNA, 22 bp, Homo sapiens
gaacaatacaggctttattcct

SEQ ID NO: 7812074 - DNA, 22 bp, Homo sapiens
gaacaatagtggtaacaaagcc

SEQ ID NO: 7812075 - DNA, 22 bp, Homo sapiens
gaacaagtttccaaattataac

SEQ ID NO: 7812076 - DNA, 22 bp, Homo sapiens
gaacaatacaggctttattcct

SEQ ID NO: 7812077 - DNA, 22 bp, Homo sapiens
gaacaaggattcccaaagaaga

SEQ ID NO: 7812078 - DNA, 22 bp, Homo sapiens
gaaggcaagcagcataaatgtc

SEQ ID NO: 7812079 - DNA, 22 bp, Homo sapiens
gaaggcaagcagcataaatgtc

SEQ ID NO: 7812080 - DNA, 22 bp, Homo sapiens
gaaggctgctgggaagtgtggt

SEQ ID NO: 7812081 - DNA, 22 bp, Homo sapiens
gaaggcaagcagcataaatgtc

SEQ ID NO: 7812082 - DNA, 22 bp, Homo sapiens
gaaggcaacaccaggatgcact

SEQ ID NO: 7812083 - DNA, 22 bp, Homo sapiens
gaaggcaagatctcagtggagg

SEQ ID NO: 7812084 - DNA, 22 bp, Homo sapiens
gaaggcaagatctcagtggagg

SEQ ID NO: 7812085 - DNA, 22 bp, Homo sapiens
gaaggcaagatctcagtggagg

SEQ ID NO: 7812086 - DNA, 22 bp, Homo sapiens
gaaggcaagatctcagtggagg

SEQ ID NO: 7812087 - DNA, 22 bp, Homo sapiens
gaaggcaagatctcagtggagg

SEQ ID NO: 7812088 - DNA, 22 bp, Homo sapiens
gaaggctgctgggaagtgtggt

SEQ ID NO: 7812089 - DNA, 22 bp, Homo sapiens
gaaggctggaaggcaagtagga

SEQ ID NO: 7812090 - DNA, 22 bp, Homo sapiens
gaaggctgctgggaagtgtggt

SEQ ID NO: 7812091 - DNA, 22 bp, Homo sapiens
gaaggctgctgggaagtgtggt

SEQ ID NO: 7812092 - DNA, 22 bp, Homo sapiens
gaaggctgctgggaagtgtggt

SEQ ID NO: 7812093 - DNA, 22 bp, Homo sapiens
gaaggctggaaggcaagtagga

SEQ ID NO: 7812094 - DNA, 22 bp, Homo sapiens
gaaggctggaaggcaagtagga

SEQ ID NO: 7812095 - DNA, 22 bp, Homo sapiens
gaaggctggaaggcaagtagga

SEQ ID NO: 7812096 - DNA, 22 bp, Homo sapiens
gaaggctggaaggcaagtagga

SEQ ID NO: 7812097 - DNA, 22 bp, Homo sapiens
gaaggctggctttctgagagca

SEQ ID NO: 7812098 - DNA, 22 bp, Homo sapiens
gaaggctggctttctgagagca

SEQ ID NO: 7812099 - DNA, 22 bp, Homo sapiens
gaaggctggctttctgagagca

SEQ ID NO: 7812100 - DNA, 22 bp, Homo sapiens
gaaggctggctttctgagagca

SEQ ID NO: 7812101 - DNA, 22 bp, Homo sapiens
gaaggctggctttctgagagca

SEQ ID NO: 7812102 - DNA, 22 bp, Homo sapiens
gaaggctggggcatcagtgaaa

SEQ ID NO: 7812103 - DNA, 22 bp, Homo sapiens
gaaggctggctttctgagagca

SEQ ID NO: 7812104 - DNA, 22 bp, Homo sapiens
atgctattccagaatgtaaatt

SEQ ID NO: 7812105 - DNA, 22 bp, Homo sapiens
atgctattccagaatgtaaatt

SEQ ID NO: 7812106 - DNA, 22 bp, Homo sapiens
atgctatttaccacacatcatt

SEQ ID NO: 7812107 - DNA, 22 bp, Homo sapiens
atgctattgaaaagaaataaga

SEQ ID NO: 7812108 - DNA, 22 bp, Homo sapiens
atgctattttacataggaatgg

SEQ ID NO: 7812109 - DNA, 22 bp, Homo sapiens
atgctcagggcacactctggac

SEQ ID NO: 7812110 - DNA, 22 bp, Homo sapiens
atgctcaggttttgcccaagac

SEQ ID NO: 7812111 - DNA, 22 bp, Homo sapiens
atgctcagtagctggctgaccc

SEQ ID NO: 7812112 - DNA, 22 bp, Homo sapiens
atgctcacttcagagaagatga

SEQ ID NO: 7812113 - DNA, 22 bp, Homo sapiens
atgctcacttcagagaagatga

SEQ ID NO: 7812114 - DNA, 22 bp, Homo sapiens
atgctcacttcagagaagatga

SEQ ID NO: 7812115 - DNA, 22 bp, Homo sapiens
atgctcacttcagagaagatga

SEQ ID NO: 7812116 - DNA, 22 bp, Homo sapiens
atgctcctcgagtgtctcacag

SEQ ID NO: 7812117 - DNA, 18 bp, Homo sapiens
atgctcctatctctgagc

SEQ ID NO: 7812118 - DNA, 22 bp, Homo sapiens
atgctccaccttttgcaggaac

SEQ ID NO: 7812119 - DNA, 22 bp, Homo sapiens
atgctcagtagctggctgaccc

SEQ ID NO: 7812120 - DNA, 22 bp, Homo sapiens
atgctccttggcttcaaagcca

SEQ ID NO: 7812121 - DNA, 18 bp, Homo sapiens
atgctctagtctttcctg

SEQ ID NO: 7812122 - DNA, 22 bp, Homo sapiens
gaccttgtgctccgaggcgggc

SEQ ID NO: 7812123 - DNA, 22 bp, Homo sapiens
gaccttgtgctccgaggcgggc

SEQ ID NO: 7812124 - DNA, 22 bp, Homo sapiens
gaccttgtgctccgaggcgggc

SEQ ID NO: 7812125 - DNA, 22 bp, Homo sapiens
gaccttgtgatctgcccacctt

SEQ ID NO: 7812126 - DNA, 22 bp, Homo sapiens
gaccttgtgatctgcccacctt

SEQ ID NO: 7812127 - DNA, 22 bp, Homo sapiens
gaccttgtgatctgcctgcctt

SEQ ID NO: 7812128 - DNA, 22 bp, Homo sapiens
gaccttgtgatccagccacctt

SEQ ID NO: 7812129 - DNA, 22 bp, Homo sapiens
gaccttgtgatccagccacctt

SEQ ID NO: 7812130 - DNA, 22 bp, Homo sapiens
gaccttgtgatccccctgcctt

SEQ ID NO: 7812131 - DNA, 22 bp, Homo sapiens
gaccttgtgatccagccacctt

SEQ ID NO: 7812132 - DNA, 22 bp, Homo sapiens
gaccttgtgatccagccacctt

SEQ ID NO: 7812133 - DNA, 22 bp, Homo sapiens
gaccttgtgatccacctgcctt

SEQ ID NO: 7812134 - DNA, 22 bp, Homo sapiens
gaccttgtgatccacctgcctt

SEQ ID NO: 7812135 - DNA, 22 bp, Homo sapiens
gaccttgtgatccgcccgcctt

SEQ ID NO: 7812136 - DNA, 22 bp, Homo sapiens
gaccttgtgatccgcccgcctt

SEQ ID NO: 7812137 - DNA, 22 bp, Homo sapiens
gaccttgtgatccgcccgcctt

SEQ ID NO: 7812138 - DNA, 22 bp, Homo sapiens
gaccttgtgatccccctgcctt

SEQ ID NO: 7812139 - DNA, 22 bp, Homo sapiens
gaccttgtgatctgcccacctt

SEQ ID NO: 7812140 - DNA, 22 bp, Homo sapiens
gaccctggagttagtcctgtgt

SEQ ID NO: 7812141 - DNA, 22 bp, Homo sapiens
gaccctggagttagtcctgtgt

SEQ ID NO: 7812142 - DNA, 22 bp, Homo sapiens
gaccctggcagataccgtcaca

SEQ ID NO: 7812143 - DNA, 22 bp, Homo sapiens
gaccctggcagataccgtcaca

SEQ ID NO: 7812144 - DNA, 22 bp, Homo sapiens
gaccctggcaggtagcctcaca

SEQ ID NO: 7812145 - DNA, 22 bp, Homo sapiens
gaccttgtgatccacccgcttt

SEQ ID NO: 7812146 - DNA, 22 bp, Homo sapiens
gaccttgtgatccacccgcttt

SEQ ID NO: 7812147 - DNA, 22 bp, Homo sapiens
gaccttgtgatccacctgcctt

SEQ ID NO: 7812148 - DNA, 22 bp, Homo sapiens
gaccctggagccgtctgaggca

SEQ ID NO: 7812149 - DNA, 22 bp, Homo sapiens
atgctctctgtcctgctcagag

SEQ ID NO: 7812150 - DNA, 22 bp, Homo sapiens
atgctctataaatatgacatgt

SEQ ID NO: 7812151 - DNA, 23 bp, Homo sapiens
atgctctatttgggatatgacag

SEQ ID NO: 7812152 - DNA, 22 bp, Homo sapiens
gacgggtgtccctatgtccatt

SEQ ID NO: 7812153 - DNA, 22 bp, Homo sapiens
gactaacagtctccgcttgaaa

SEQ ID NO: 7812154 - DNA, 22 bp, Homo sapiens
gactacaacaataagaacagct

SEQ ID NO: 7812155 - DNA, 22 bp, Homo sapiens
gactggaaagcctgtcctcaga

SEQ ID NO: 7812156 - DNA, 22 bp, Homo sapiens
gactggaaagcctgtcctcaga

SEQ ID NO: 7812157 - DNA, 22 bp, Homo sapiens
gacgccgtgtcccggcactctt

SEQ ID NO: 7812158 - DNA, 22 bp, Homo sapiens
gacggagctggttgctgcggct

SEQ ID NO: 7812159 - DNA, 22 bp, Homo sapiens
gacggagctggttgctgcggct

SEQ ID NO: 7812160 - DNA, 22 bp, Homo sapiens
gacggagctggttgctgcggct

SEQ ID NO: 7812161 - DNA, 22 bp, Homo sapiens
gacggagctggttgctgcggct

SEQ ID NO: 7812162 - DNA, 22 bp, Homo sapiens
gacggagctggttgctgcggct

SEQ ID NO: 7812163 - DNA, 22 bp, Homo sapiens
gacggcagaaactcatgaggtc

SEQ ID NO: 7812164 - DNA, 22 bp, Homo sapiens
gacggggcagccagctggtggc

SEQ ID NO: 7812165 - DNA, 22 bp, Homo sapiens
gacggggcagccagctggtggc

SEQ ID NO: 7812166 - DNA, 22 bp, Homo sapiens
gacctttagtgtcatgttatat

SEQ ID NO: 7812167 - DNA, 22 bp, Homo sapiens
gacctttagtgtcatgttatat

SEQ ID NO: 7812168 - DNA, 22 bp, Homo sapiens
gacctttagtgtcatgttatat

SEQ ID NO: 7812169 - DNA, 22 bp, Homo sapiens
gacgagagactccatccaccac

SEQ ID NO: 7812170 - DNA, 22 bp, Homo sapiens
gacctttttactgtgtacgctg

SEQ ID NO: 7812171 - DNA, 22 bp, Homo sapiens
gacgagagactccatccaccac

SEQ ID NO: 7812172 - DNA, 22 bp, Homo sapiens
gactgggagggttcagctgggt

SEQ ID NO: 7812173 - DNA, 22 bp, Homo sapiens
gactgggagggttcagctgggt

SEQ ID NO: 7812174 - DNA, 22 bp, Homo sapiens
gactgggccaaggtcagcagct

SEQ ID NO: 7812175 - DNA, 22 bp, Homo sapiens
gactgggatcagctagatgatt

SEQ ID NO: 7812176 - DNA, 22 bp, Homo sapiens
gactgggatcagctagatgatt

SEQ ID NO: 7812177 - DNA, 22 bp, Homo sapiens
gactgggacaggacagacatct

SEQ ID NO: 7812178 - DNA, 22 bp, Homo sapiens
gactgggagggttcagctgggt

SEQ ID NO: 7812179 - DNA, 22 bp, Homo sapiens
gactggatacccttttctgcat

SEQ ID NO: 7812180 - DNA, 22 bp, Homo sapiens
gactggatacccttttctgcat

SEQ ID NO: 7812181 - DNA, 22 bp, Homo sapiens
gactggatattgagtactgcaa

SEQ ID NO: 7812182 - DNA, 22 bp, Homo sapiens
gactggatggaggcttagaagg

SEQ ID NO: 7812183 - DNA, 22 bp, Homo sapiens
gactggatggaggcttagaagg

SEQ ID NO: 7812184 - DNA, 22 bp, Homo sapiens
gactggatgtttaatcaacaga

SEQ ID NO: 7812185 - DNA, 22 bp, Homo sapiens
gactggatgtttaatcaacaga

SEQ ID NO: 7812186 - DNA, 22 bp, Homo sapiens
gactggatgttttgaacatgag

SEQ ID NO: 7812187 - DNA, 22 bp, Homo sapiens
gactggatttaaggacttctga

SEQ ID NO: 7812188 - DNA, 22 bp, Homo sapiens
gactggatttaaggacttctga

SEQ ID NO: 7812189 - DNA, 22 bp, Homo sapiens
gactggatgttttgaacatgag

SEQ ID NO: 7812190 - DNA, 22 bp, Homo sapiens
gactggattctgctttggctgt

SEQ ID NO: 7812191 - DNA, 22 bp, Homo sapiens
gactggattctgctttggctgt

SEQ ID NO: 7812192 - DNA, 22 bp, Homo sapiens
gactggctcactccactcctat

SEQ ID NO: 7812193 - DNA, 22 bp, Homo sapiens
gactggatttatagatatcata

SEQ ID NO: 7812194 - DNA, 22 bp, Homo sapiens
gactggcctggggctgggcaca

SEQ ID NO: 7812195 - DNA, 22 bp, Homo sapiens
gactggagtgcctccaggaaag

SEQ ID NO: 7812196 - DNA, 21 bp, Homo sapiens
gactggataatgtataaacag

SEQ ID NO: 7812197 - DNA, 21 bp, Homo sapiens
gactggataatgtataaacag

SEQ ID NO: 7812198 - DNA, 22 bp, Homo sapiens
gactggagtcaatgagcagcac

SEQ ID NO: 7812199 - DNA, 22 bp, Homo sapiens
gactggagtgcctccaggaaag

SEQ ID NO: 7812200 - DNA, 22 bp, Homo sapiens
gactggagtcaatgagcagcac

SEQ ID NO: 7812201 - DNA, 22 bp, Homo sapiens
gactggaaagcctgtcctcaga

SEQ ID NO: 7812202 - DNA, 22 bp, Homo sapiens
gactggaatcccaggctctgtg

SEQ ID NO: 7812203 - DNA, 22 bp, Homo sapiens
gactggagcccccaaggacacc

SEQ ID NO: 7812204 - DNA, 22 bp, Homo sapiens
gactggagcccccaaggacacc

SEQ ID NO: 7812205 - DNA, 22 bp, Homo sapiens
gactggagataaaaccatgagt

SEQ ID NO: 7812206 - DNA, 22 bp, Homo sapiens
gactggagataaaaccatgagt

SEQ ID NO: 7812207 - DNA, 22 bp, Homo sapiens
gactggagataaaaccatgagt

SEQ ID NO: 7812208 - DNA, 21 bp, Homo sapiens
gactggagagaggaagtctgg

SEQ ID NO: 7812209 - DNA, 22 bp, Homo sapiens
gactggagataaaaccatgagt

SEQ ID NO: 7812210 - DNA, 22 bp, Homo sapiens
atgctatgtaactggcagatag

SEQ ID NO: 7812211 - DNA, 22 bp, Homo sapiens
atgctatgtttggtgttggaga

SEQ ID NO: 7812212 - DNA, 22 bp, Homo sapiens
atgctattccagaatgtaaatt

SEQ ID NO: 7812213 - DNA, 22 bp, Homo sapiens
atgctattccagaatgtaaatt

SEQ ID NO: 7812214 - DNA, 22 bp, Homo sapiens
atgctattccagaatgtaaatt

SEQ ID NO: 7812215 - DNA, 22 bp, Homo sapiens
gaccacagattcctaagtggca

SEQ ID NO: 7812216 - DNA, 22 bp, Homo sapiens
gaccacagcagtgcaagaggag

SEQ ID NO: 7812217 - DNA, 22 bp, Homo sapiens
gaccacagcagtgcaagaggag

SEQ ID NO: 7812218 - DNA, 22 bp, Homo sapiens
gaccacagaggtgtgggagaga

SEQ ID NO: 7812219 - DNA, 22 bp, Homo sapiens
gaccacagattcctaagtggca

SEQ ID NO: 7812220 - DNA, 22 bp, Homo sapiens
gaccacagaggtgtgggagaga

SEQ ID NO: 7812221 - DNA, 22 bp, Homo sapiens
gaccacagagcacggcctgctt

SEQ ID NO: 7812222 - DNA, 22 bp, Homo sapiens
gaccacagagcacggcctgctt

SEQ ID NO: 7812223 - DNA, 22 bp, Homo sapiens
gaccacagactggaaagagggc

SEQ ID NO: 7812224 - DNA, 22 bp, Homo sapiens
gaccaaagaagccacccgtcct

SEQ ID NO: 7812225 - DNA, 21 bp, Homo sapiens
gaccaaagggctggcactgcc

SEQ ID NO: 7812226 - DNA, 22 bp, Homo sapiens
gaccaagatacagcatcataga

SEQ ID NO: 7812227 - DNA, 22 bp, Homo sapiens
gaccaagatacagcatcataga

SEQ ID NO: 7812228 - DNA, 22 bp, Homo sapiens
gaccaagatacagcatcataga

SEQ ID NO: 7812229 - DNA, 22 bp, Homo sapiens
gaccaagatacagcatcataga

SEQ ID NO: 7812230 - DNA, 22 bp, Homo sapiens
gaccaaggccaggccagggcgt

SEQ ID NO: 7812231 - DNA, 22 bp, Homo sapiens
gaccaaggccaggccagggcgt

SEQ ID NO: 7812232 - DNA, 22 bp, Homo sapiens
gaccaaggccaggccagggcgt

SEQ ID NO: 7812233 - DNA, 22 bp, Homo sapiens
gacatttatgaaggagatatgc

SEQ ID NO: 7812234 - DNA, 22 bp, Homo sapiens
gacatttattagaaaactatca

SEQ ID NO: 7812235 - DNA, 22 bp, Homo sapiens
gacatacaagctggtacctcct

SEQ ID NO: 7812236 - DNA, 22 bp, Homo sapiens
gacatacaagctggtacctcct

SEQ ID NO: 7812237 - DNA, 22 bp, Homo sapiens
gacataatcctcctcacctact

SEQ ID NO: 7812238 - DNA, 22 bp, Homo sapiens
gacataataatctgacctagat

SEQ ID NO: 7812239 - DNA, 22 bp, Homo sapiens
gacactatatgacacttcagtt

SEQ ID NO: 7812240 - DNA, 22 bp, Homo sapiens
gacacgtttctgaattctgaag

SEQ ID NO: 7812241 - DNA, 22 bp, Homo sapiens
gacactctcctccagtggatag

SEQ ID NO: 7812242 - DNA, 22 bp, Homo sapiens
gacactctcctccagtggatag

SEQ ID NO: 7812243 - DNA, 22 bp, Homo sapiens
gacataaagttcttgcttgaat

SEQ ID NO: 7812244 - DNA, 22 bp, Homo sapiens
gacataaagttcttgcttgaat

SEQ ID NO: 7812245 - DNA, 22 bp, Homo sapiens
gacataaatgaagtttgactat

SEQ ID NO: 7812246 - DNA, 22 bp, Homo sapiens
gacataaatgaagtttgactat

SEQ ID NO: 7812247 - DNA, 22 bp, Homo sapiens
gacataaatgaagtttgactat

SEQ ID NO: 7812248 - DNA, 22 bp, Homo sapiens
gacatttattagaaaactatca

SEQ ID NO: 7812249 - DNA, 22 bp, Homo sapiens
gacatttattagaaaactatca

SEQ ID NO: 7812250 - DNA, 22 bp, Homo sapiens
gacatttattagaaaactatca

SEQ ID NO: 7812251 - DNA, 22 bp, Homo sapiens
gacatttattagaaaactatca

SEQ ID NO: 7812252 - DNA, 22 bp, Homo sapiens
gacatttattagaaaactatca

SEQ ID NO: 7812253 - DNA, 22 bp, Homo sapiens
gacatttcaatctcattatggg

SEQ ID NO: 7812254 - DNA, 22 bp, Homo sapiens
gacatttattggattttacgag

SEQ ID NO: 7812255 - DNA, 22 bp, Homo sapiens
gacatttattggattttacgag

SEQ ID NO: 7812256 - DNA, 22 bp, Homo sapiens
gacaatttctcaatatagaaac

SEQ ID NO: 7812257 - DNA, 22 bp, Homo sapiens
gacaattgcttttgccgaataa

SEQ ID NO: 7812258 - DNA, 22 bp, Homo sapiens
gacaattgcttttgccgaataa

SEQ ID NO: 7812259 - DNA, 22 bp, Homo sapiens
gacaattgcttttgccgaataa

SEQ ID NO: 7812260 - DNA, 19 bp, Homo sapiens
gacaattagagatcactca

SEQ ID NO: 7812261 - DNA, 19 bp, Homo sapiens
gacaattagagatcactca

SEQ ID NO: 7812262 - DNA, 22 bp, Homo sapiens
gacaatgtgcaattgcagctag

SEQ ID NO: 7812263 - DNA, 22 bp, Homo sapiens
gacaatgtgaggcgagtttgtt

SEQ ID NO: 7812264 - DNA, 22 bp, Homo sapiens
gacaattagatcattcctttga

SEQ ID NO: 7812265 - DNA, 22 bp, Homo sapiens
gacaattagatcattcctttga

SEQ ID NO: 7812266 - DNA, 22 bp, Homo sapiens
gacaatgtgttgaaagggaaaa

SEQ ID NO: 7812267 - DNA, 22 bp, Homo sapiens
gacaattgcttttgccgaataa

SEQ ID NO: 7812268 - DNA, 22 bp, Homo sapiens
gacaattaggttaagagcaaga

SEQ ID NO: 7812269 - DNA, 22 bp, Homo sapiens
gacacaaagtttgtcagaaatt

SEQ ID NO: 7812270 - DNA, 22 bp, Homo sapiens
gacacaaagtttgtcagaaatt

SEQ ID NO: 7812271 - DNA, 22 bp, Homo sapiens
gacacagtttttctcacggtgg

SEQ ID NO: 7812272 - DNA, 22 bp, Homo sapiens
gacacaaagtttgtcagaaatt

SEQ ID NO: 7812273 - DNA, 22 bp, Homo sapiens
gacacaaagtttgtcagaaatt

SEQ ID NO: 7812274 - DNA, 22 bp, Homo sapiens
gacacaaagtttgtcagaaatt

SEQ ID NO: 7812275 - DNA, 21 bp, Homo sapiens
gacacaaagggtagtaatggt

SEQ ID NO: 7812276 - DNA, 21 bp, Homo sapiens
gacacaaagggtagtaatggt

SEQ ID NO: 7812277 - DNA, 21 bp, Homo sapiens
gacacaaagggtagtaatggt

SEQ ID NO: 7812278 - DNA, 21 bp, Homo sapiens
gacacaaagggtagtaatggt

SEQ ID NO: 7812279 - DNA, 21 bp, Homo sapiens
gacacaaagggtagtaatggt

SEQ ID NO: 7812280 - DNA, 21 bp, Homo sapiens
gacacaaagggtagtaatggt

SEQ ID NO: 7812281 - DNA, 22 bp, Homo sapiens
gacacaaagtttgtcagaaatt

SEQ ID NO: 7812282 - DNA, 22 bp, Homo sapiens
gacacaaagtttgtcagaaatt

SEQ ID NO: 7812283 - DNA, 22 bp, Homo sapiens
gacacagtttttctcacggtgg

SEQ ID NO: 7812284 - DNA, 22 bp, Homo sapiens
gacacatagatctatctcactc

SEQ ID NO: 7812285 - DNA, 22 bp, Homo sapiens
gacacatagatctatctcactc

SEQ ID NO: 7812286 - DNA, 22 bp, Homo sapiens
gacacatagatctatctcactc

SEQ ID NO: 7812287 - DNA, 22 bp, Homo sapiens
gacacatatgcgtatagtttag

SEQ ID NO: 7812288 - DNA, 22 bp, Homo sapiens
gacacatatgcgtatagtttag

SEQ ID NO: 7812289 - DNA, 18 bp, Homo sapiens
gacacatccccaggcctc

SEQ ID NO: 7812290 - DNA, 22 bp, Homo sapiens
gacacatgaccataaatgctaa

SEQ ID NO: 7812291 - DNA, 22 bp, Homo sapiens
gacacatgaccataaatgctaa

SEQ ID NO: 7812292 - DNA, 22 bp, Homo sapiens
gacaccagaagacataagcaga

SEQ ID NO: 7812293 - DNA, 22 bp, Homo sapiens
gacacatgtcagacggacaccc

SEQ ID NO: 7812294 - DNA, 22 bp, Homo sapiens
gacaccagcaaggctgtgagga

SEQ ID NO: 7812295 - DNA, 18 bp, Homo sapiens
gacaccagcctctgcccc

SEQ ID NO: 7812296 - DNA, 22 bp, Homo sapiens
gacaccagcaaggctgtgagga

SEQ ID NO: 7812297 - DNA, 22 bp, Homo sapiens
gacaccagagactgatgaggcc

SEQ ID NO: 7812298 - DNA, 22 bp, Homo sapiens
gacaccagaagacataagcaga

SEQ ID NO: 7812299 - DNA, 22 bp, Homo sapiens
gacaccagagactgatgaggcc

SEQ ID NO: 7812300 - DNA, 22 bp, Homo sapiens
gacaccaggtctgttgtcctcc

SEQ ID NO: 7812301 - DNA, 23 bp, Homo sapiens
gacaccaggcgtggccctcgaca

SEQ ID NO: 7812302 - DNA, 23 bp, Homo sapiens
gacacctttgccagatcaagatg

SEQ ID NO: 7812303 - DNA, 22 bp, Homo sapiens
gacactaaagtatagggtatct

SEQ ID NO: 7812304 - DNA, 22 bp, Homo sapiens
gacaccattacctttctatatt

SEQ ID NO: 7812305 - DNA, 22 bp, Homo sapiens
gacaccagtaaatattcaaaag

SEQ ID NO: 7812306 - DNA, 22 bp, Homo sapiens
gacacccctttcaacttggtgg

SEQ ID NO: 7812307 - DNA, 22 bp, Homo sapiens
gaggcagcctcagtggacctcg

SEQ ID NO: 7812308 - DNA, 22 bp, Homo sapiens
gaggcagcctcagtggacctcg

SEQ ID NO: 7812309 - DNA, 22 bp, Homo sapiens
gaggcagcctcagtggacctcg

SEQ ID NO: 7812310 - DNA, 22 bp, Homo sapiens
gaggcagcggctcacagagaaa

SEQ ID NO: 7812311 - DNA, 22 bp, Homo sapiens
gaggcagcggctcacagagaaa

SEQ ID NO: 7812312 - DNA, 22 bp, Homo sapiens
gaggcagcggctcacagagaaa

SEQ ID NO: 7812313 - DNA, 22 bp, Homo sapiens
gaggcagccagaggttctcatt

SEQ ID NO: 7812314 - DNA, 22 bp, Homo sapiens
gaggcagccagaggttctcatt

SEQ ID NO: 7812315 - DNA, 22 bp, Homo sapiens
gaggcagccagaggttctcatt

SEQ ID NO: 7812316 - DNA, 22 bp, Homo sapiens
gaggcagcctcagtggacctcg

SEQ ID NO: 7812317 - DNA, 22 bp, Homo sapiens
gaggcagcctcagtggacctcg

SEQ ID NO: 7812318 - DNA, 22 bp, Homo sapiens
gaggcagcctcagtggacctcg

SEQ ID NO: 7812319 - DNA, 22 bp, Homo sapiens
gaggcagcctcagtggacctcg

SEQ ID NO: 7812320 - DNA, 22 bp, Homo sapiens
gaggcagcattcgcatagacag

SEQ ID NO: 7812321 - DNA, 22 bp, Homo sapiens
gaggcagcattcgcatagacag

SEQ ID NO: 7812322 - DNA, 22 bp, Homo sapiens
gaggcagcattcgcatagacag

SEQ ID NO: 7812323 - DNA, 22 bp, Homo sapiens
gaggcagcattcgcatagacag

SEQ ID NO: 7812324 - DNA, 22 bp, Homo sapiens
gaggcagcattcgcatagacag

SEQ ID NO: 7812325 - DNA, 22 bp, Homo sapiens
gaggcagcatggtaccttggag

SEQ ID NO: 7812326 - DNA, 22 bp, Homo sapiens
gaggcagcatggtaccttggag

SEQ ID NO: 7812327 - DNA, 22 bp, Homo sapiens
gaggcagcatggtaccttggag

SEQ ID NO: 7812328 - DNA, 22 bp, Homo sapiens
gaggcagcatggtaccttggag

SEQ ID NO: 7812329 - DNA, 22 bp, Homo sapiens
gaggcagcatggtaccttggag

SEQ ID NO: 7812330 - DNA, 22 bp, Homo sapiens
gaggcagcatggtaccttggag

SEQ ID NO: 7812331 - DNA, 22 bp, Homo sapiens
gaggcagcatctatggtgggaa

SEQ ID NO: 7812332 - DNA, 22 bp, Homo sapiens
gaggcagcatctatggtgggaa

SEQ ID NO: 7812333 - DNA, 22 bp, Homo sapiens
atggtgtttataggcaaagatc

SEQ ID NO: 7812334 - DNA, 22 bp, Homo sapiens
atggttattactgctgttccag

SEQ ID NO: 7812335 - DNA, 22 bp, Homo sapiens
gaggcacatatatacagagccc

SEQ ID NO: 7812336 - DNA, 22 bp, Homo sapiens
gaggcacatatatacagagccc

SEQ ID NO: 7812337 - DNA, 22 bp, Homo sapiens
gaggcacatatatacagagccc

SEQ ID NO: 7812338 - DNA, 22 bp, Homo sapiens
gaggcacatatatacagagccc

SEQ ID NO: 7812339 - DNA, 22 bp, Homo sapiens
gaggcagcatctatggtgggaa

SEQ ID NO: 7812340 - DNA, 22 bp, Homo sapiens
gaggcagcatctatggtgggaa

SEQ ID NO: 7812341 - DNA, 22 bp, Homo sapiens
gaggcagcatctatggtgggaa

SEQ ID NO: 7812342 - DNA, 22 bp, Homo sapiens
gaggcagcagggctggttcctt

SEQ ID NO: 7812343 - DNA, 22 bp, Homo sapiens
gaggcagcagggctggttcctt

SEQ ID NO: 7812344 - DNA, 22 bp, Homo sapiens
atggtggactcttgattcaggc

SEQ ID NO: 7812345 - DNA, 22 bp, Homo sapiens
atggtggacgggagacaggact

SEQ ID NO: 7812346 - DNA, 22 bp, Homo sapiens
atggtggactcttgattcaggc

SEQ ID NO: 7812347 - DNA, 22 bp, Homo sapiens
atggtggatttgtgattcagct

SEQ ID NO: 7812348 - DNA, 22 bp, Homo sapiens
atggtggatttgtgattcagct

SEQ ID NO: 7812349 - DNA, 22 bp, Homo sapiens
atggtggaggtgtattctggat

SEQ ID NO: 7812350 - DNA, 22 bp, Homo sapiens
atggtgtacagcaatgtgtcag

SEQ ID NO: 7812351 - DNA, 22 bp, Homo sapiens
atggtgtaagactgtatttctt

SEQ ID NO: 7812352 - DNA, 22 bp, Homo sapiens
atggtgtccccagcctttgaag

SEQ ID NO: 7812353 - DNA, 22 bp, Homo sapiens
atggtgtattcatgtttttaaa

SEQ ID NO: 7812354 - DNA, 22 bp, Homo sapiens
atggtgtatgtaaagtctgagg

SEQ ID NO: 7812355 - DNA, 22 bp, Homo sapiens
atggtgtacagccagatgtaga

SEQ ID NO: 7812356 - DNA, 22 bp, Homo sapiens
atggtgtatctatccttgttct

SEQ ID NO: 7812357 - DNA, 22 bp, Homo sapiens
gaggagaagctaagaaacacag

SEQ ID NO: 7812358 - DNA, 22 bp, Homo sapiens
gaggagaagctaagaaacacag

SEQ ID NO: 7812359 - DNA, 22 bp, Homo sapiens
gaggagaagctaagaaacacag

SEQ ID NO: 7812360 - DNA, 22 bp, Homo sapiens
gaggagaagctaagaaacacag

SEQ ID NO: 7812361 - DNA, 22 bp, Homo sapiens
gaggagaagctaagaaacacag

SEQ ID NO: 7812362 - DNA, 22 bp, Homo sapiens
gaggagaagctaagaaacacag

SEQ ID NO: 7812363 - DNA, 22 bp, Homo sapiens
gaggagaagctattggaaggac

SEQ ID NO: 7812364 - DNA, 22 bp, Homo sapiens
gaggagaagctattggaaggac

SEQ ID NO: 7812365 - DNA, 22 bp, Homo sapiens
gaggagaagctattggaaggac

SEQ ID NO: 7812366 - DNA, 22 bp, Homo sapiens
gaggagaagctattggaaggac

SEQ ID NO: 7812367 - DNA, 22 bp, Homo sapiens
gaggagaagctattggaaggac

SEQ ID NO: 7812368 - DNA, 22 bp, Homo sapiens
gaggagaagctattggaaggac

SEQ ID NO: 7812369 - DNA, 22 bp, Homo sapiens
gaggagaaatttggggacctga

SEQ ID NO: 7812370 - DNA, 22 bp, Homo sapiens
gaggagaaatttggggacctga

SEQ ID NO: 7812371 - DNA, 22 bp, Homo sapiens
gaggagaagctaagaaacacag

SEQ ID NO: 7812372 - DNA, 22 bp, Homo sapiens
gaggagaaatttggggacctga

SEQ ID NO: 7812373 - DNA, 22 bp, Homo sapiens
gaggagaaattatccttggtgt

SEQ ID NO: 7812374 - DNA, 22 bp, Homo sapiens
gaggagaaatttggggacctga

SEQ ID NO: 7812375 - DNA, 22 bp, Homo sapiens
gaggagaaatttggggacctga

SEQ ID NO: 7812376 - DNA, 22 bp, Homo sapiens
gaggaaggctaaggggcttaga

SEQ ID NO: 7812377 - DNA, 22 bp, Homo sapiens
gaggaagggactttattatctg

SEQ ID NO: 7812378 - DNA, 22 bp, Homo sapiens
gaggaaggctaaggggcttaga

SEQ ID NO: 7812379 - DNA, 22 bp, Homo sapiens
atggtcttgggcttaggcagag

SEQ ID NO: 7812380 - DNA, 22 bp, Homo sapiens
atggtcttgtgagagtaacagt

SEQ ID NO: 7812381 - DNA, 18 bp, Homo sapiens
atggtctcatactgggag

SEQ ID NO: 7812382 - DNA, 18 bp, Homo sapiens
atggtctcatactgggag

SEQ ID NO: 7812383 - DNA, 18 bp, Homo sapiens
atggtctcatactgggag

SEQ ID NO: 7812384 - DNA, 22 bp, Homo sapiens
atggtctgatgtcccatggctt

SEQ ID NO: 7812385 - DNA, 22 bp, Homo sapiens
atggtgccaaagatttctaagc

SEQ ID NO: 7812386 - DNA, 22 bp, Homo sapiens
atggtggaatcggcgtgaatgg

SEQ ID NO: 7812387 - DNA, 22 bp, Homo sapiens
atggtggaagagcatcagaaag

SEQ ID NO: 7812388 - DNA, 22 bp, Homo sapiens
atggtggaagagcatcagaaag

SEQ ID NO: 7812389 - DNA, 22 bp, Homo sapiens
atggtctttttgttatgagaga

SEQ ID NO: 7812390 - DNA, 22 bp, Homo sapiens
atggtcttgtgagagtaacagt

SEQ ID NO: 7812391 - DNA, 22 bp, Homo sapiens
atggtgactcctaaatgtgaaa

SEQ ID NO: 7812392 - DNA, 21 bp, Homo sapiens
atggtgagatactgggtgtgg

SEQ ID NO: 7812393 - DNA, 22 bp, Homo sapiens
gaggagaatgcgcaccacatat

SEQ ID NO: 7812394 - DNA, 18 bp, Homo sapiens
atggtctcatactgggag

SEQ ID NO: 7812395 - DNA, 18 bp, Homo sapiens
atggtctcatactgggag

SEQ ID NO: 7812396 - DNA, 22 bp, Homo sapiens
gaggagaagggcacggagaaaa

SEQ ID NO: 7812397 - DNA, 22 bp, Homo sapiens
gaggagaagggcacggagaaaa

SEQ ID NO: 7812398 - DNA, 22 bp, Homo sapiens
gaggagaagggcacggagaaaa

SEQ ID NO: 7812399 - DNA, 22 bp, Homo sapiens
gaggagaagctattggaaggac

SEQ ID NO: 7812400 - DNA, 22 bp, Homo sapiens
gaggagaagctattggaaggac

SEQ ID NO: 7812401 - DNA, 22 bp, Homo sapiens
gaggagaagggcacggagaaaa

SEQ ID NO: 7812402 - DNA, 22 bp, Homo sapiens
atgggctgtccattgctggctg

SEQ ID NO: 7812403 - DNA, 22 bp, Homo sapiens
atgggctgtccattgctggctg

SEQ ID NO: 7812404 - DNA, 20 bp, Homo sapiens
atgggctggttaggaagtgt

SEQ ID NO: 7812405 - DNA, 20 bp, Homo sapiens
atgggctggttaggaagtgt

SEQ ID NO: 7812406 - DNA, 20 bp, Homo sapiens
atgggctggttaggaagtgt

SEQ ID NO: 7812407 - DNA, 20 bp, Homo sapiens
atgggctggttaggaagtgt

SEQ ID NO: 7812408 - DNA, 20 bp, Homo sapiens
atgggctggttaggaagtgt

SEQ ID NO: 7812409 - DNA, 22 bp, Homo sapiens
atgggctggggaagctcactcc

SEQ ID NO: 7812410 - DNA, 22 bp, Homo sapiens
atgggctggggaagctcactcc

SEQ ID NO: 7812411 - DNA, 22 bp, Homo sapiens
atgggctggggaagctcactcc

SEQ ID NO: 7812412 - DNA, 22 bp, Homo sapiens
atgggctggggaagctcactcc

SEQ ID NO: 7812413 - DNA, 22 bp, Homo sapiens
atgggctgtcctagtccagccc

SEQ ID NO: 7812414 - DNA, 22 bp, Homo sapiens
atgggctgtcctagtccagccc

SEQ ID NO: 7812415 - DNA, 22 bp, Homo sapiens
atgggctgtccattgctggctg

SEQ ID NO: 7812416 - DNA, 22 bp, Homo sapiens
atgggctgtgaggtccggcagg

SEQ ID NO: 7812417 - DNA, 22 bp, Homo sapiens
atgggctgtgaggtccggcagg

SEQ ID NO: 7812418 - DNA, 22 bp, Homo sapiens
atgggctgggatctgagtgtca

SEQ ID NO: 7812419 - DNA, 22 bp, Homo sapiens
atgggctgggatctgagtgtca

SEQ ID NO: 7812420 - DNA, 22 bp, Homo sapiens
atgggctgggaatacacagggg

SEQ ID NO: 7812421 - DNA, 22 bp, Homo sapiens
atgggctgggatctgagtgtca

SEQ ID NO: 7812422 - DNA, 22 bp, Homo sapiens
atgggctgggatctgagtgtca

SEQ ID NO: 7812423 - DNA, 22 bp, Homo sapiens
atgggctgggaatacacagggg

SEQ ID NO: 7812424 - DNA, 22 bp, Homo sapiens
atgggctggggaagctcactcc

SEQ ID NO: 7812425 - DNA, 22 bp, Homo sapiens
atgggctgggatctgagtgtca

SEQ ID NO: 7812426 - DNA, 22 bp, Homo sapiens
atgggctgggaatacacagggg

SEQ ID NO: 7812427 - DNA, 22 bp, Homo sapiens
atgggctggcctttcccgctct

SEQ ID NO: 7812428 - DNA, 22 bp, Homo sapiens
atgggctggcagcctgaacagc

SEQ ID NO: 7812429 - DNA, 22 bp, Homo sapiens
atgggctggcctttcccgctct

SEQ ID NO: 7812430 - DNA, 22 bp, Homo sapiens
atgggctgcttggcttccaccc

SEQ ID NO: 7812431 - DNA, 22 bp, Homo sapiens
atgggctgcttggcttccaccc

SEQ ID NO: 7812432 - DNA, 22 bp, Homo sapiens
atgggctgcttggcttccaccc

SEQ ID NO: 7812433 - DNA, 22 bp, Homo sapiens
atgggctgtgggaccctggacc

SEQ ID NO: 7812434 - DNA, 23 bp, Homo sapiens
atgggcttagaaagcaagtggga

SEQ ID NO: 7812435 - DNA, 22 bp, Homo sapiens
atgggctgtgggaccctggacc

SEQ ID NO: 7812436 - DNA, 22 bp, Homo sapiens
atggggaagagccagtgagctg

SEQ ID NO: 7812437 - DNA, 22 bp, Homo sapiens
atggggaagagccagtgagctg

SEQ ID NO: 7812438 - DNA, 22 bp, Homo sapiens
atggggaagagccagtgagctg

SEQ ID NO: 7812439 - DNA, 22 bp, Homo sapiens
atggggaagagccagtgagctg

SEQ ID NO: 7812440 - DNA, 22 bp, Homo sapiens
atggggaagcaattggatttcc

SEQ ID NO: 7812441 - DNA, 22 bp, Homo sapiens
atggggaagcaattggatttcc

SEQ ID NO: 7812442 - DNA, 22 bp, Homo sapiens
atggggagagaagggctgagct

SEQ ID NO: 7812443 - DNA, 22 bp, Homo sapiens
atggggagagaagggctgagct

SEQ ID NO: 7812444 - DNA, 22 bp, Homo sapiens
atggggagagaagggctgagct

SEQ ID NO: 7812445 - DNA, 22 bp, Homo sapiens
atggggagagaagggctgagct

SEQ ID NO: 7812446 - DNA, 22 bp, Homo sapiens
atggggagagaagggctgagct

SEQ ID NO: 7812447 - DNA, 22 bp, Homo sapiens
atggggagagaagggctgagct

SEQ ID NO: 7812448 - DNA, 22 bp, Homo sapiens
atggggagagaagggctgagct

SEQ ID NO: 7812449 - DNA, 22 bp, Homo sapiens
atggggagagaagggctgagct

SEQ ID NO: 7812450 - DNA, 22 bp, Homo sapiens
atggggagctcaccacctgttt

SEQ ID NO: 7812451 - DNA, 22 bp, Homo sapiens
atggggagctcaccacctgttt

SEQ ID NO: 7812452 - DNA, 22 bp, Homo sapiens
atggggagctcaccacctgttt

SEQ ID NO: 7812453 - DNA, 22 bp, Homo sapiens
atggggagctcaccacctgttt

SEQ ID NO: 7812454 - DNA, 22 bp, Homo sapiens
atggggctagacaaccagtgcc

SEQ ID NO: 7812455 - DNA, 22 bp, Homo sapiens
atggggctagacaaccagtgcc

SEQ ID NO: 7812456 - DNA, 23 bp, Homo sapiens
atggggctcaacacttagtagct

SEQ ID NO: 7812457 - DNA, 22 bp, Homo sapiens
atggggcagaggttaaaggtgg

SEQ ID NO: 7812458 - DNA, 22 bp, Homo sapiens
atggggagctcaccacctgttt

SEQ ID NO: 7812459 - DNA, 22 bp, Homo sapiens
atggggagagcctctgtcccca

SEQ ID NO: 7812460 - DNA, 22 bp, Homo sapiens
atggggagagcctctgtcccca

SEQ ID NO: 7812461 - DNA, 22 bp, Homo sapiens
atggggagagcctctgtcccca

SEQ ID NO: 7812462 - DNA, 22 bp, Homo sapiens
atggggagagcctctgtcccca

SEQ ID NO: 7812463 - DNA, 22 bp, Homo sapiens
atggggagagcctctgtcccca

SEQ ID NO: 7812464 - DNA, 22 bp, Homo sapiens
atggggagagcctctgtcccca

SEQ ID NO: 7812465 - DNA, 22 bp, Homo sapiens
atgggaagctgacctgcatgga

SEQ ID NO: 7812466 - DNA, 22 bp, Homo sapiens
atgggaagctgacctgcatgga

SEQ ID NO: 7812467 - DNA, 22 bp, Homo sapiens
atgggaagctgacctgcatgga

SEQ ID NO: 7812468 - DNA, 22 bp, Homo sapiens
atgggaaggttttgagagcggg

SEQ ID NO: 7812469 - DNA, 22 bp, Homo sapiens
atgggaaggttttgagagcggg

SEQ ID NO: 7812470 - DNA, 22 bp, Homo sapiens
atgggaagctgacctgcatgga

SEQ ID NO: 7812471 - DNA, 22 bp, Homo sapiens
atgggaagctgacctgcatgga

SEQ ID NO: 7812472 - DNA, 22 bp, Homo sapiens
atgggaagctgacctgcatgga

SEQ ID NO: 7812473 - DNA, 19 bp, Homo sapiens
atgggaagcggccagcgga

SEQ ID NO: 7812474 - DNA, 22 bp, Homo sapiens
atgggaagtgaagtcagggagg

SEQ ID NO: 7812475 - DNA, 22 bp, Homo sapiens
atgggaaggttttgagagcggg

SEQ ID NO: 7812476 - DNA, 22 bp, Homo sapiens
atgggagaaacatcatgaggca

SEQ ID NO: 7812477 - DNA, 22 bp, Homo sapiens
atgggagaaacatcatgaggca

SEQ ID NO: 7812478 - DNA, 22 bp, Homo sapiens
atgggacatagatccttgaggt

SEQ ID NO: 7812479 - DNA, 22 bp, Homo sapiens
atgggacaggtactagaaaggg

SEQ ID NO: 7812480 - DNA, 22 bp, Homo sapiens
atgggacagggctggctggtcc

SEQ ID NO: 7812481 - DNA, 22 bp, Homo sapiens
atgggacaggcatgggacttag

SEQ ID NO: 7812482 - DNA, 22 bp, Homo sapiens
atgggacagggctggctggtcc

SEQ ID NO: 7812483 - DNA, 22 bp, Homo sapiens
atgggacaatttgaacacagtg

SEQ ID NO: 7812484 - DNA, 22 bp, Homo sapiens
atgggacacagtccgccctcta

SEQ ID NO: 7812485 - DNA, 22 bp, Homo sapiens
atgggagaaacatcatgaggca

SEQ ID NO: 7812486 - DNA, 22 bp, Homo sapiens
atgggagaaacatcatgaggca

SEQ ID NO: 7812487 - DNA, 22 bp, Homo sapiens
atgggagaaacatcatgaggca

SEQ ID NO: 7812488 - DNA, 22 bp, Homo sapiens
atgggcagggcagtgtataaga

SEQ ID NO: 7812489 - DNA, 22 bp, Homo sapiens
atgggagaaacatcatgaggca

SEQ ID NO: 7812490 - DNA, 22 bp, Homo sapiens
atgggagaaacatcatgaggca

SEQ ID NO: 7812491 - DNA, 22 bp, Homo sapiens
atgggctgacaagacatgcata

SEQ ID NO: 7812492 - DNA, 18 bp, Homo sapiens
atgggcaggtaagatcca

SEQ ID NO: 7812493 - DNA, 22 bp, Homo sapiens
atgggctgacaagacatgcata

SEQ ID NO: 7812494 - DNA, 22 bp, Homo sapiens
atgggctgacaagacatgcata

SEQ ID NO: 7812495 - DNA, 22 bp, Homo sapiens
atgggctgaaagagtaagctgt

SEQ ID NO: 7812496 - DNA, 22 bp, Homo sapiens
atgggctgaaagagtaagctgt

SEQ ID NO: 7812497 - DNA, 22 bp, Homo sapiens
atgggctgaaagagtaagctgt

SEQ ID NO: 7812498 - DNA, 22 bp, Homo sapiens
atgggcagtaacagtggcagtc

SEQ ID NO: 7812499 - DNA, 22 bp, Homo sapiens
atgggctgaggtgggatagaag

SEQ ID NO: 7812500 - DNA, 22 bp, Homo sapiens
atgggctgcttctccagcacct

SEQ ID NO: 7812501 - DNA, 22 bp, Homo sapiens
atgggctgaggtgggatagaag

SEQ ID NO: 7812502 - DNA, 22 bp, Homo sapiens
atgggctgaggtgggatagaag

SEQ ID NO: 7812503 - DNA, 22 bp, Homo sapiens
atgggctgaggaagctcctgag

SEQ ID NO: 7812504 - DNA, 22 bp, Homo sapiens
atgggctgagaatcaagaatat

SEQ ID NO: 7812505 - DNA, 22 bp, Homo sapiens
atgggctgaggaagctcctgag

SEQ ID NO: 7812506 - DNA, 22 bp, Homo sapiens
atgggctgaggaagctcctgag

SEQ ID NO: 7812507 - DNA, 22 bp, Homo sapiens
atgggctgaggaagctcctgag

SEQ ID NO: 7812508 - DNA, 22 bp, Homo sapiens
atgggctgaggaagctcctgag

SEQ ID NO: 7812509 - DNA, 22 bp, Homo sapiens
atgggctgacccagtcgtggca

SEQ ID NO: 7812510 - DNA, 22 bp, Homo sapiens
atgggctgacccagtcgtggca

SEQ ID NO: 7812511 - DNA, 22 bp, Homo sapiens
atgggctgacaagacatgcata

SEQ ID NO: 7812512 - DNA, 22 bp, Homo sapiens
atgggctgacccagtcgtggca

SEQ ID NO: 7812513 - DNA, 22 bp, Homo sapiens
atgggctgactaatggtaaact

SEQ ID NO: 7812514 - DNA, 22 bp, Homo sapiens
atgggctgaggaagctcctgag

SEQ ID NO: 7812515 - DNA, 22 bp, Homo sapiens
atgggctgacccagtcgtggca

SEQ ID NO: 7812516 - DNA, 22 bp, Homo sapiens
atgggctgactaatggtaaact

SEQ ID NO: 7812517 - DNA, 22 bp, Homo sapiens
gagatggtagcctcagaagagt

SEQ ID NO: 7812518 - DNA, 22 bp, Homo sapiens
gagatggtgttccactgccagt

SEQ ID NO: 7812519 - DNA, 22 bp, Homo sapiens
gagatggtagcctcagaagagt

SEQ ID NO: 7812520 - DNA, 22 bp, Homo sapiens
atggcatctcaacttacaaaag

SEQ ID NO: 7812521 - DNA, 22 bp, Homo sapiens
atggcattaggaccatgagcct

SEQ ID NO: 7812522 - DNA, 22 bp, Homo sapiens
atggcattccaagtcttctttt

SEQ ID NO: 7812523 - DNA, 22 bp, Homo sapiens
atggcattcacatttccagaga

SEQ ID NO: 7812524 - DNA, 17 bp, Homo sapiens
gagatgggtggatcacc

SEQ ID NO: 7812525 - DNA, 17 bp, Homo sapiens
gagatgggtggatcacc

SEQ ID NO: 7812526 - DNA, 17 bp, Homo sapiens
gagatgggtggatcacc

SEQ ID NO: 7812527 - DNA, 22 bp, Homo sapiens
gagatggggaataggagcaagc

SEQ ID NO: 7812528 - DNA, 22 bp, Homo sapiens
gagatggggtcagctgggacat

SEQ ID NO: 7812529 - DNA, 22 bp, Homo sapiens
gagatggggtcagctgggacat

SEQ ID NO: 7812530 - DNA, 22 bp, Homo sapiens
gagatggggtcagctgggacat

SEQ ID NO: 7812531 - DNA, 22 bp, Homo sapiens
gagatggggtcagctgggacat

SEQ ID NO: 7812532 - DNA, 22 bp, Homo sapiens
gagatggggtcagctgggacat

SEQ ID NO: 7812533 - DNA, 22 bp, Homo sapiens
gagatggggtcttgctatgttg

SEQ ID NO: 7812534 - DNA, 22 bp, Homo sapiens
gagatggggtcttgctatgttg

SEQ ID NO: 7812535 - DNA, 22 bp, Homo sapiens
gagatggggtcttgctatgttg

SEQ ID NO: 7812536 - DNA, 22 bp, Homo sapiens
gagatgggcgagaaggtggact

SEQ ID NO: 7812537 - DNA, 22 bp, Homo sapiens
gagatgggcgagaaggtggact

SEQ ID NO: 7812538 - DNA, 22 bp, Homo sapiens
gagatggggaataggagcaagc

SEQ ID NO: 7812539 - DNA, 22 bp, Homo sapiens
gagatggggaataggagcaagc

SEQ ID NO: 7812540 - DNA, 22 bp, Homo sapiens
gagatggggaataggagcaagc

SEQ ID NO: 7812541 - DNA, 22 bp, Homo sapiens
gagatggggaataggagcaagc

SEQ ID NO: 7812542 - DNA, 22 bp, Homo sapiens
gagatggggaataggagcaagc

SEQ ID NO: 7812543 - DNA, 22 bp, Homo sapiens
gagatggggaataggagcaagc

SEQ ID NO: 7812544 - DNA, 22 bp, Homo sapiens
atggcattgtttatagattgca

SEQ ID NO: 7812545 - DNA, 22 bp, Homo sapiens
atggcatttgaccgctttgtgg

SEQ ID NO: 7812546 - DNA, 22 bp, Homo sapiens
atggcatttgaatctgtctttt

SEQ ID NO: 7812547 - DNA, 22 bp, Homo sapiens
atggccaaagccacagcagagg

SEQ ID NO: 7812548 - DNA, 22 bp, Homo sapiens
atggccaagcatatacagattg

SEQ ID NO: 7812549 - DNA, 22 bp, Homo sapiens
atggccaactgaaatgaaagat

SEQ ID NO: 7812550 - DNA, 22 bp, Homo sapiens
atggccacatttagtaactggt

SEQ ID NO: 7812551 - DNA, 22 bp, Homo sapiens
atggccaaggggcctaggcagg

SEQ ID NO: 7812552 - DNA, 22 bp, Homo sapiens
atggccaagcatatacagattg

SEQ ID NO: 7812553 - DNA, 22 bp, Homo sapiens
atggccaccatttaatgaagct

SEQ ID NO: 7812554 - DNA, 22 bp, Homo sapiens
atggccaccatctctaaaacac

SEQ ID NO: 7812555 - DNA, 21 bp, Homo sapiens
atggccactatggtgcagcag

SEQ ID NO: 7812556 - DNA, 22 bp, Homo sapiens
atggccagagaaggcagggtca

SEQ ID NO: 7812557 - DNA, 22 bp, Homo sapiens
atggccagagaaggcagggtca

SEQ ID NO: 7812558 - DNA, 22 bp, Homo sapiens
atggccagagaaggcagggtca

SEQ ID NO: 7812559 - DNA, 22 bp, Homo sapiens
atggccagagaaggcagggtca

SEQ ID NO: 7812560 - DNA, 22 bp, Homo sapiens
atggccagagaaggcagggtca

SEQ ID NO: 7812561 - DNA, 22 bp, Homo sapiens
atggccagagagagcacacctg

SEQ ID NO: 7812562 - DNA, 22 bp, Homo sapiens
atggccagagagagcacacctg

SEQ ID NO: 7812563 - DNA, 22 bp, Homo sapiens
atggcttggttggttaaagcac

SEQ ID NO: 7812564 - DNA, 22 bp, Homo sapiens
atggcttgcttttagagagatc

SEQ ID NO: 7812565 - DNA, 22 bp, Homo sapiens
atggcttgcagagaaaagaggt

SEQ ID NO: 7812566 - DNA, 22 bp, Homo sapiens
atggcttctgtcttggaaattt

SEQ ID NO: 7812567 - DNA, 22 bp, Homo sapiens
atggcttctgtcttggaaattt

SEQ ID NO: 7812568 - DNA, 22 bp, Homo sapiens
atggcttctgtcttggaaactt

SEQ ID NO: 7812569 - DNA, 22 bp, Homo sapiens
atggctttcctgggacatgggc

SEQ ID NO: 7812570 - DNA, 21 bp, Homo sapiens
atggcttttttaaagcttgtg

SEQ ID NO: 7812571 - DNA, 22 bp, Homo sapiens
atggctttttagactttggtac

SEQ ID NO: 7812572 - DNA, 22 bp, Homo sapiens
atggcttttgatcaaaagaaat

SEQ ID NO: 7812573 - DNA, 22 bp, Homo sapiens
atggctttgttccaataaaact

SEQ ID NO: 7812574 - DNA, 22 bp, Homo sapiens
atggctttgaagtaatgtaatt

SEQ ID NO: 7812575 - DNA, 22 bp, Homo sapiens
atggctttctctaatgtggtat

SEQ ID NO: 7812576 - DNA, 22 bp, Homo sapiens
atggctttggtgtgaccctggg

SEQ ID NO: 7812577 - DNA, 22 bp, Homo sapiens
atggctttgctcaagtttagcc

SEQ ID NO: 7812578 - DNA, 22 bp, Homo sapiens
atggctggcatccaggtgggct

SEQ ID NO: 7812579 - DNA, 22 bp, Homo sapiens
atggctggcatccaggtgggct

SEQ ID NO: 7812580 - DNA, 22 bp, Homo sapiens
atggctggcatccaggtgggct

SEQ ID NO: 7812581 - DNA, 21 bp, Homo sapiens
atggccagatctattaggtgg

SEQ ID NO: 7812582 - DNA, 22 bp, Homo sapiens
atggccagagaggccagcctgg

SEQ ID NO: 7812583 - DNA, 22 bp, Homo sapiens
atggccagagaggccagcctgg

SEQ ID NO: 7812584 - DNA, 22 bp, Homo sapiens
atggccagagaggccagcctgg

SEQ ID NO: 7812585 - DNA, 22 bp, Homo sapiens
atggccagagaggccagcctgg

SEQ ID NO: 7812586 - DNA, 22 bp, Homo sapiens
atggctgtttagcttctctgct

SEQ ID NO: 7812587 - DNA, 22 bp, Homo sapiens
atggctgtttagcttctctgct

SEQ ID NO: 7812588 - DNA, 22 bp, Homo sapiens
atggctggcatccaggtgggct

SEQ ID NO: 7812589 - DNA, 21 bp, Homo sapiens
atggcttctcaggtgcactga

SEQ ID NO: 7812590 - DNA, 22 bp, Homo sapiens
atggcttctagcattgtcacaa

SEQ ID NO: 7812591 - DNA, 22 bp, Homo sapiens
atggcttctcgctggcacctgt

SEQ ID NO: 7812592 - DNA, 22 bp, Homo sapiens
atggcttcctctggattggatt

SEQ ID NO: 7812593 - DNA, 22 bp, Homo sapiens
atggcttcgagtatatacatag

SEQ ID NO: 7812594 - DNA, 22 bp, Homo sapiens
atggcttcctctggattggatt

SEQ ID NO: 7812595 - DNA, 22 bp, Homo sapiens
atggcttcatcttttagtcctt

SEQ ID NO: 7812596 - DNA, 22 bp, Homo sapiens
gagatggcttgctctcacgtgg

SEQ ID NO: 7812597 - DNA, 22 bp, Homo sapiens
gagatgggcgagaaggtggact

SEQ ID NO: 7812598 - DNA, 22 bp, Homo sapiens
gagatgggcgagaaggtggact

SEQ ID NO: 7812599 - DNA, 22 bp, Homo sapiens
gagatgggcgagaaggtggact

SEQ ID NO: 7812600 - DNA, 22 bp, Homo sapiens
gagatgggcgagaaggtggact

SEQ ID NO: 7812601 - DNA, 22 bp, Homo sapiens
gagatgggcgagaaggtggact

SEQ ID NO: 7812602 - DNA, 22 bp, Homo sapiens
gagatgggcgagaaggtggact

SEQ ID NO: 7812603 - DNA, 22 bp, Homo sapiens
gagatgggcgagaaggtggact

SEQ ID NO: 7812604 - DNA, 22 bp, Homo sapiens
gagatgggcgagaaggtggact

SEQ ID NO: 7812605 - DNA, 20 bp, Homo sapiens
gagatggctaagtgctgaac

SEQ ID NO: 7812606 - DNA, 22 bp, Homo sapiens
gagatggctctcagatctttga

SEQ ID NO: 7812607 - DNA, 23 bp, Homo sapiens
gagatggctggttgtcctctgaa

SEQ ID NO: 7812608 - DNA, 23 bp, Homo sapiens
gagatggctggttgtcctctgaa

SEQ ID NO: 7812609 - DNA, 22 bp, Homo sapiens
gagatggccagtgccaggacaa

SEQ ID NO: 7812610 - DNA, 21 bp, Homo sapiens
gagatggcccagtagcgggcc

SEQ ID NO: 7812611 - DNA, 22 bp, Homo sapiens
gagatggccctggcatgtagct

SEQ ID NO: 7812612 - DNA, 22 bp, Homo sapiens
gagatggccctggcatgtagct

SEQ ID NO: 7812613 - DNA, 22 bp, Homo sapiens
gagatggcaggtgtgtgggaca

SEQ ID NO: 7812614 - DNA, 22 bp, Homo sapiens
gagagtccaggtctgggtcctt

SEQ ID NO: 7812615 - DNA, 22 bp, Homo sapiens
gagatggagtctttttctgtca

SEQ ID NO: 7812616 - DNA, 22 bp, Homo sapiens
gagagtcactgtctgcatttcc

SEQ ID NO: 7812617 - DNA, 22 bp, Homo sapiens
gagagtattacaaattttacaa

SEQ ID NO: 7812618 - DNA, 22 bp, Homo sapiens
gagagtcactgtctgcatttcc

SEQ ID NO: 7812619 - DNA, 22 bp, Homo sapiens
atggagggtggtaagacagaga

SEQ ID NO: 7812620 - DNA, 22 bp, Homo sapiens
atggagggtgtcagagagcgaa

SEQ ID NO: 7812621 - DNA, 22 bp, Homo sapiens
atggagggtgtcagagagcgaa

SEQ ID NO: 7812622 - DNA, 22 bp, Homo sapiens
atggagggtgtcagagagcgaa

SEQ ID NO: 7812623 - DNA, 22 bp, Homo sapiens
atggaggatgtgcagcatgggc

SEQ ID NO: 7812624 - DNA, 22 bp, Homo sapiens
atggaggatgtgcagcatgggc

SEQ ID NO: 7812625 - DNA, 17 bp, Homo sapiens
atggaggcagacaggtc

SEQ ID NO: 7812626 - DNA, 17 bp, Homo sapiens
atggaggcagacaggtc

SEQ ID NO: 7812627 - DNA, 17 bp, Homo sapiens
atggaggcagacaggtc

SEQ ID NO: 7812628 - DNA, 22 bp, Homo sapiens
atggagggaaaagtggagagcc

SEQ ID NO: 7812629 - DNA, 22 bp, Homo sapiens
atggagggaaaagtggagagcc

SEQ ID NO: 7812630 - DNA, 22 bp, Homo sapiens
atggagggaaaagtggagagcc

SEQ ID NO: 7812631 - DNA, 18 bp, Homo sapiens
atggaggcagagagctga

SEQ ID NO: 7812632 - DNA, 18 bp, Homo sapiens
atggaggcagagagctga

SEQ ID NO: 7812633 - DNA, 18 bp, Homo sapiens
atggaggcagagagctga

SEQ ID NO: 7812634 - DNA, 18 bp, Homo sapiens
atggaggcagagagctga

SEQ ID NO: 7812635 - DNA, 22 bp, Homo sapiens
atggagggtggtaagacagaga

SEQ ID NO: 7812636 - DNA, 22 bp, Homo sapiens
atggagggtggtaagacagaga

SEQ ID NO: 7812637 - DNA, 21 bp, Homo sapiens
atggagggaccagggaagcag

SEQ ID NO: 7812638 - DNA, 21 bp, Homo sapiens
atggagggaccagggaagcag

SEQ ID NO: 7812639 - DNA, 22 bp, Homo sapiens
atggagggaaaagtggagagcc

SEQ ID NO: 7812640 - DNA, 22 bp, Homo sapiens
atggagggaaaagtggagagcc

SEQ ID NO: 7812641 - DNA, 22 bp, Homo sapiens
atggagggaaaagtggagagcc

SEQ ID NO: 7812642 - DNA, 21 bp, Homo sapiens
atggagggaccagggaagcag

SEQ ID NO: 7812643 - DNA, 21 bp, Homo sapiens
atggagggaccagggaagcag

SEQ ID NO: 7812644 - DNA, 21 bp, Homo sapiens
atggagggaccagggaagcag

SEQ ID NO: 7812645 - DNA, 21 bp, Homo sapiens
atggagggaccagggaagcag

SEQ ID NO: 7812646 - DNA, 21 bp, Homo sapiens
atggagggaccagggaagcag

SEQ ID NO: 7812647 - DNA, 21 bp, Homo sapiens
atggagggaccagggaagcag

SEQ ID NO: 7812648 - DNA, 21 bp, Homo sapiens
atggagggaccagggaagcag

SEQ ID NO: 7812649 - DNA, 22 bp, Homo sapiens
gagagataggttgcaggaagct

SEQ ID NO: 7812650 - DNA, 22 bp, Homo sapiens
gagagatccagactgtgggtga

SEQ ID NO: 7812651 - DNA, 23 bp, Homo sapiens
gagagcaatgagatgtaaacact

SEQ ID NO: 7812652 - DNA, 23 bp, Homo sapiens
gagagcaatgagatgtaaacact

SEQ ID NO: 7812653 - DNA, 22 bp, Homo sapiens
gagagcaatggggacgggcagg

SEQ ID NO: 7812654 - DNA, 22 bp, Homo sapiens
gagagcaatggggacgggcagg

SEQ ID NO: 7812655 - DNA, 22 bp, Homo sapiens
gagagcacatgaacatggagga

SEQ ID NO: 7812656 - DNA, 22 bp, Homo sapiens
gagagcaatggggacgggcagg

SEQ ID NO: 7812657 - DNA, 22 bp, Homo sapiens
gagagcagactctcaaagctgg

SEQ ID NO: 7812658 - DNA, 22 bp, Homo sapiens
gagagcagactctcaaagctgg

SEQ ID NO: 7812659 - DNA, 22 bp, Homo sapiens
gagagagctctgtgcctgggat

SEQ ID NO: 7812660 - DNA, 22 bp, Homo sapiens
gagagagctctgtgcctgggat

SEQ ID NO: 7812661 - DNA, 22 bp, Homo sapiens
gagagagctctgtgcctgggat

SEQ ID NO: 7812662 - DNA, 23 bp, Homo sapiens
gagagagattgctaaaccactcc

SEQ ID NO: 7812663 - DNA, 23 bp, Homo sapiens
gagagagattgctaaaccactcc

SEQ ID NO: 7812664 - DNA, 23 bp, Homo sapiens
gagagagattgctaaaccactcc

SEQ ID NO: 7812665 - DNA, 22 bp, Homo sapiens
gagagagctctgtgcctgggat

SEQ ID NO: 7812666 - DNA, 22 bp, Homo sapiens
gagagagctctgtgcctgggat

SEQ ID NO: 7812667 - DNA, 22 bp, Homo sapiens
gagagagctctgtgcctgggat

SEQ ID NO: 7812668 - DNA, 22 bp, Homo sapiens
gagagaggcctccatgtactga

SEQ ID NO: 7812669 - DNA, 22 bp, Homo sapiens
gagagaggcctccatgtactga

SEQ ID NO: 7812670 - DNA, 22 bp, Homo sapiens
gagagaggcctccatgtactga

SEQ ID NO: 7812671 - DNA, 22 bp, Homo sapiens
gagagaggcctccatgtactga

SEQ ID NO: 7812672 - DNA, 22 bp, Homo sapiens
gagagaggcctccatgtactga

SEQ ID NO: 7812673 - DNA, 22 bp, Homo sapiens
gactggggctctagccaggcct

SEQ ID NO: 7812674 - DNA, 22 bp, Homo sapiens
gactggggaaggacccgagacc

SEQ ID NO: 7812675 - DNA, 21 bp, Homo sapiens
gactgggctgacttgtgctgg

SEQ ID NO: 7812676 - DNA, 22 bp, Homo sapiens
gactgggctccaagagggagag

SEQ ID NO: 7812677 - DNA, 22 bp, Homo sapiens
gactgggctccaagagggagag

SEQ ID NO: 7812678 - DNA, 22 bp, Homo sapiens
gactgggccaaggtcagcagct

SEQ ID NO: 7812679 - DNA, 22 bp, Homo sapiens
gactgggccaaggtcagcagct

SEQ ID NO: 7812680 - DNA, 22 bp, Homo sapiens
gagacagtgtcagccattgaaa

SEQ ID NO: 7812681 - DNA, 22 bp, Homo sapiens
gagacatcataatgaagtttcc

SEQ ID NO: 7812682 - DNA, 22 bp, Homo sapiens
gactggggctctagccaggcct

SEQ ID NO: 7812683 - DNA, 22 bp, Homo sapiens
gactggggctctagccaggcct

SEQ ID NO: 7812684 - DNA, 22 bp, Homo sapiens
gagagagaggtgctgccaggca

SEQ ID NO: 7812685 - DNA, 22 bp, Homo sapiens
gagagagaggtgctgccaggca

SEQ ID NO: 7812686 - DNA, 22 bp, Homo sapiens
gagagagaggtgctgccaggca

SEQ ID NO: 7812687 - DNA, 22 bp, Homo sapiens
gagagagagctaatattaagct

SEQ ID NO: 7812688 - DNA, 22 bp, Homo sapiens
gagagagacatgtaaacgcggt

SEQ ID NO: 7812689 - DNA, 22 bp, Homo sapiens
gagagagagctaatattaagct

SEQ ID NO: 7812690 - DNA, 22 bp, Homo sapiens
gagagagagctaatattaagct

SEQ ID NO: 7812691 - DNA, 22 bp, Homo sapiens
gagagagaggtgctgccaggca

SEQ ID NO: 7812692 - DNA, 22 bp, Homo sapiens
gagagagaggtgctgccaggca

SEQ ID NO: 7812693 - DNA, 22 bp, Homo sapiens
gagagagacatgtaaacgcggt

SEQ ID NO: 7812694 - DNA, 22 bp, Homo sapiens
gagagagaagtgggtgtcacct

SEQ ID NO: 7812695 - DNA, 22 bp, Homo sapiens
gagagagaagtgggtgtcacct

SEQ ID NO: 7812696 - DNA, 22 bp, Homo sapiens
gagagagaaggcctgtgggtgt

SEQ ID NO: 7812697 - DNA, 22 bp, Homo sapiens
gaggcagcggctcacagagaaa

SEQ ID NO: 7812698 - DNA, 22 bp, Homo sapiens
gaggcagcggctcacagagaaa

SEQ ID NO: 7812699 - DNA, 22 bp, Homo sapiens
gaggcagcggctcacagagaaa

SEQ ID NO: 7812700 - DNA, 22 bp, Homo sapiens
gaggcagcgggtcaggaccgtg

SEQ ID NO: 7812701 - DNA, 22 bp, Homo sapiens
gaggcagcgggtcaggaccgtg

SEQ ID NO: 7812702 - DNA, 22 bp, Homo sapiens
gaggcagcgggtcaggaccgtg

SEQ ID NO: 7812703 - DNA, 22 bp, Homo sapiens
gaggcagcgggtcaggaccgtg

SEQ ID NO: 7812704 - DNA, 22 bp, Homo sapiens
atgtagaaagttattttactct

SEQ ID NO: 7812705 - DNA, 22 bp, Homo sapiens
atgtagaaataatttcagttcc

SEQ ID NO: 7812706 - DNA, 22 bp, Homo sapiens
atgtagaaataatttcagttcc

SEQ ID NO: 7812707 - DNA, 22 bp, Homo sapiens
atgtagaaagttcatagatgcg

SEQ ID NO: 7812708 - DNA, 22 bp, Homo sapiens
atgtagaaataatttcagttcc

SEQ ID NO: 7812709 - DNA, 22 bp, Homo sapiens
atgtagaaattaggatgatagt

SEQ ID NO: 7812710 - DNA, 22 bp, Homo sapiens
atgtagaaattaggatgatagt

SEQ ID NO: 7812711 - DNA, 22 bp, Homo sapiens
atgtagaacaggttaatgacag

SEQ ID NO: 7812712 - DNA, 22 bp, Homo sapiens
atgtagaacaggttaatgacag

SEQ ID NO: 7812713 - DNA, 22 bp, Homo sapiens
atgtagagtagaatagtacaac

SEQ ID NO: 7812714 - DNA, 22 bp, Homo sapiens
atgtagagggtttggccaggag

SEQ ID NO: 7812715 - DNA, 22 bp, Homo sapiens
atgtagagctccttgatcctcc

SEQ ID NO: 7812716 - DNA, 22 bp, Homo sapiens
atgtagaattccttctactttg

SEQ ID NO: 7812717 - DNA, 22 bp, Homo sapiens
atgtagaattccttctactttg

SEQ ID NO: 7812718 - DNA, 22 bp, Homo sapiens
atgtagagcagtgttgtccaat

SEQ ID NO: 7812719 - DNA, 22 bp, Homo sapiens
atgtagacctttctttgtgatt

SEQ ID NO: 7812720 - DNA, 22 bp, Homo sapiens
atgtagaagtgggcattataga

SEQ ID NO: 7812721 - DNA, 22 bp, Homo sapiens
atgtagaagtgggcattataga

SEQ ID NO: 7812722 - DNA, 22 bp, Homo sapiens
atgtagaagctgacagtgctgt

SEQ ID NO: 7812723 - DNA, 22 bp, Homo sapiens
atgtagaagctgacagtgctgt

SEQ ID NO: 7812724 - DNA, 22 bp, Homo sapiens
atgtagaagctgacagtgctgt

SEQ ID NO: 7812725 - DNA, 22 bp, Homo sapiens
atgtagaacaggttaatgacag

SEQ ID NO: 7812726 - DNA, 22 bp, Homo sapiens
atgtagaatggtgattggcagg

SEQ ID NO: 7812727 - DNA, 22 bp, Homo sapiens
atgtagaattccttctactttg

SEQ ID NO: 7812728 - DNA, 22 bp, Homo sapiens
atgtagaagtgggcattataga

SEQ ID NO: 7812729 - DNA, 22 bp, Homo sapiens
atgtagaatggtgattggcagg

SEQ ID NO: 7812730 - DNA, 22 bp, Homo sapiens
atgtagaagtgggcattataga

SEQ ID NO: 7812731 - DNA, 22 bp, Homo sapiens
atgtagaagtgggcattataga

SEQ ID NO: 7812732 - DNA, 22 bp, Homo sapiens
atgtcatgggccaaaaatagtt

SEQ ID NO: 7812733 - DNA, 22 bp, Homo sapiens
atgtcatgggccaaaaatagtt

SEQ ID NO: 7812734 - DNA, 22 bp, Homo sapiens
atgtcattgccaagatgctaat

SEQ ID NO: 7812735 - DNA, 20 bp, Homo sapiens
atgtcctcagccactgccct

SEQ ID NO: 7812736 - DNA, 22 bp, Homo sapiens
atgtcccttgtctgtgatgtct

SEQ ID NO: 7812737 - DNA, 22 bp, Homo sapiens
atgtagcatctatcctgataaa

SEQ ID NO: 7812738 - DNA, 22 bp, Homo sapiens
atgtagcatctatcctgataaa

SEQ ID NO: 7812739 - DNA, 20 bp, Homo sapiens
atgtagcagtgtgctgggaa

SEQ ID NO: 7812740 - DNA, 22 bp, Homo sapiens
atgtagctgcagatgataatgc

SEQ ID NO: 7812741 - DNA, 22 bp, Homo sapiens
atgtcatctcttaaaaattgca

SEQ ID NO: 7812742 - DNA, 22 bp, Homo sapiens
atgtagctgcagatgataatgc

SEQ ID NO: 7812743 - DNA, 22 bp, Homo sapiens
atgtcatgaaatgctactaact

SEQ ID NO: 7812744 - DNA, 22 bp, Homo sapiens
atgtagctgcagatgataatgc

SEQ ID NO: 7812745 - DNA, 20 bp, Homo sapiens
atgtagatgaaagcaaaggc

SEQ ID NO: 7812746 - DNA, 22 bp, Homo sapiens
atgtagatgcaatggatgtcct

SEQ ID NO: 7812747 - DNA, 22 bp, Homo sapiens
atgtagatgcaccaagactgct

SEQ ID NO: 7812748 - DNA, 22 bp, Homo sapiens
atgtagatgttcacttgatttt

SEQ ID NO: 7812749 - DNA, 22 bp, Homo sapiens
atgtagatttgcttctcctgcc

SEQ ID NO: 7812750 - DNA, 22 bp, Homo sapiens
atgtagatttgcttctcctgcc

SEQ ID NO: 7812751 - DNA, 22 bp, Homo sapiens
atgtagatgttggtttaaattt

SEQ ID NO: 7812752 - DNA, 19 bp, Homo sapiens
atgtctctgtagcacatac

SEQ ID NO: 7812753 - DNA, 23 bp, Homo sapiens
atgtctctgggcagtagggcttg

SEQ ID NO: 7812754 - DNA, 19 bp, Homo sapiens
atgtctctgtagcacatac

SEQ ID NO: 7812755 - DNA, 22 bp, Homo sapiens
atgtctctgctgtggttagctt

SEQ ID NO: 7812756 - DNA, 22 bp, Homo sapiens
atgtctctctctgagtgccaga

SEQ ID NO: 7812757 - DNA, 22 bp, Homo sapiens
atgtctatgttctttactgtgt

SEQ ID NO: 7812758 - DNA, 22 bp, Homo sapiens
atgtctcagagtggtcactggg

SEQ ID NO: 7812759 - DNA, 22 bp, Homo sapiens
atgtctctcaggtttaacttta

SEQ ID NO: 7812760 - DNA, 22 bp, Homo sapiens
atgtctctcatgaccaaagaag

SEQ ID NO: 7812761 - DNA, 22 bp, Homo sapiens
atgtctctgccccagagagctt

SEQ ID NO: 7812762 - DNA, 22 bp, Homo sapiens
atgtctctctctgagtgccaga

SEQ ID NO: 7812763 - DNA, 22 bp, Homo sapiens
atgtccttttatttaaagcagg

SEQ ID NO: 7812764 - DNA, 22 bp, Homo sapiens
atgtccttttatttaaagcagg

SEQ ID NO: 7812765 - DNA, 22 bp, Homo sapiens
atgtccttttaaaatgtgagaa

SEQ ID NO: 7812766 - DNA, 22 bp, Homo sapiens
atgtccttttaaaatgtgagaa

SEQ ID NO: 7812767 - DNA, 22 bp, Homo sapiens
atgtccttttaaaatgtgagaa

SEQ ID NO: 7812768 - DNA, 22 bp, Homo sapiens
atgtcctttgtgtgtagctctc

SEQ ID NO: 7812769 - DNA, 22 bp, Homo sapiens
atgtcctttgttctgagggagt

SEQ ID NO: 7812770 - DNA, 22 bp, Homo sapiens
atgtcctttgtatccctaggca

SEQ ID NO: 7812771 - DNA, 21 bp, Homo sapiens
atgtctatgacatatttcctt

SEQ ID NO: 7812772 - DNA, 21 bp, Homo sapiens
atgtctatgacatatttcctt

SEQ ID NO: 7812773 - DNA, 21 bp, Homo sapiens
atgtctatgacatatttcctt

SEQ ID NO: 7812774 - DNA, 22 bp, Homo sapiens
atgtctagagcaagagatgctg

SEQ ID NO: 7812775 - DNA, 22 bp, Homo sapiens
atgtctatatagtcaataatca

SEQ ID NO: 7812776 - DNA, 22 bp, Homo sapiens
atgtcctttgcttctctggtcc

SEQ ID NO: 7812777 - DNA, 22 bp, Homo sapiens
atgtccttgtgagtaaatgatg

SEQ ID NO: 7812778 - DNA, 22 bp, Homo sapiens
atgtccttgtgagtaaatgatg

SEQ ID NO: 7812779 - DNA, 22 bp, Homo sapiens
atgtccttggaacacctgaggt

SEQ ID NO: 7812780 - DNA, 22 bp, Homo sapiens
atgtccttgagaccctcctcgg

SEQ ID NO: 7812781 - DNA, 22 bp, Homo sapiens
atgtccttcggacaaaattctt

SEQ ID NO: 7812782 - DNA, 22 bp, Homo sapiens
atgtccttcggacaaaattctt

SEQ ID NO: 7812783 - DNA, 22 bp, Homo sapiens
atgtccttcggacaaaattctt

SEQ ID NO: 7812784 - DNA, 22 bp, Homo sapiens
atgtccttctcctcttacctgc

SEQ ID NO: 7812785 - DNA, 22 bp, Homo sapiens
atgtccttaatctgaatgttag

SEQ ID NO: 7812786 - DNA, 22 bp, Homo sapiens
atgtccttcatctaggagatgg

SEQ ID NO: 7812787 - DNA, 22 bp, Homo sapiens
atgtccttcatctaggagatgg

SEQ ID NO: 7812788 - DNA, 22 bp, Homo sapiens
atgtccttccattttgatctgt

SEQ ID NO: 7812789 - DNA, 22 bp, Homo sapiens
atgtccttccattttgatctgt

SEQ ID NO: 7812790 - DNA, 22 bp, Homo sapiens
atgtcctgttttggcttgctct

SEQ ID NO: 7812791 - DNA, 22 bp, Homo sapiens
atgtccttaatctgaatgttag

SEQ ID NO: 7812792 - DNA, 22 bp, Homo sapiens
atgtcctgttttggcttgctct

SEQ ID NO: 7812793 - DNA, 22 bp, Homo sapiens
atgtcctgttaaatagattgta

SEQ ID NO: 7812794 - DNA, 20 bp, Homo sapiens
atgtcctgttgctgccccag

SEQ ID NO: 7812795 - DNA, 22 bp, Homo sapiens
atgtcctgggctgggttatgtt

SEQ ID NO: 7812796 - DNA, 22 bp, Homo sapiens
atgtcctggggtcttctcttca

SEQ ID NO: 7812797 - DNA, 22 bp, Homo sapiens
atgtcctggtctagcttccggg

SEQ ID NO: 7812798 - DNA, 22 bp, Homo sapiens
atgtcctggagcagaggcaagg

SEQ ID NO: 7812799 - DNA, 22 bp, Homo sapiens
atgtcctcttctgcctcaggcc

SEQ ID NO: 7812800 - DNA, 23 bp, Homo sapiens
atgtcctgcatagttgcttctgt

SEQ ID NO: 7812801 - DNA, 23 bp, Homo sapiens
atgtcctgcatagttgcttctgt

SEQ ID NO: 7812802 - DNA, 20 bp, Homo sapiens
atgtcctgcttctcctcacc

SEQ ID NO: 7812803 - DNA, 22 bp, Homo sapiens
atgtcctgctgattcacattat

SEQ ID NO: 7812804 - DNA, 22 bp, Homo sapiens
atgtcctgctgattcacattat

SEQ ID NO: 7812805 - DNA, 19 bp, Homo sapiens
gagggctcatttgaacaat

SEQ ID NO: 7812806 - DNA, 19 bp, Homo sapiens
gagggctcatttgaacaat

SEQ ID NO: 7812807 - DNA, 22 bp, Homo sapiens
gagggctcctcacattctctat

SEQ ID NO: 7812808 - DNA, 22 bp, Homo sapiens
gagggctctaccaagtaactct

SEQ ID NO: 7812809 - DNA, 23 bp, Homo sapiens
gagggctctgagtgcttgggcca

SEQ ID NO: 7812810 - DNA, 22 bp, Homo sapiens
gagggctctactcaccaccctg

SEQ ID NO: 7812811 - DNA, 22 bp, Homo sapiens
gagggctctgaaaggaggtcac

SEQ ID NO: 7812812 - DNA, 22 bp, Homo sapiens
gagggctgaagattgtggcccc

SEQ ID NO: 7812813 - DNA, 22 bp, Homo sapiens
gagggctctgtctggaagggaa

SEQ ID NO: 7812814 - DNA, 22 bp, Homo sapiens
gagggctgaagattgtggcccc

SEQ ID NO: 7812815 - DNA, 22 bp, Homo sapiens
gagggctgaagattgtggcccc

SEQ ID NO: 7812816 - DNA, 22 bp, Homo sapiens
gagggctgaagattgtggcccc

SEQ ID NO: 7812817 - DNA, 22 bp, Homo sapiens
gagggctgaagattgtggcccc

SEQ ID NO: 7812818 - DNA, 22 bp, Homo sapiens
gagggctgaagattgtggcccc

SEQ ID NO: 7812819 - DNA, 22 bp, Homo sapiens
gagggctgaagattgtggcccc

SEQ ID NO: 7812820 - DNA, 22 bp, Homo sapiens
gagggctcaactactactaggc

SEQ ID NO: 7812821 - DNA, 22 bp, Homo sapiens
gagggctcactgagaaagcagt

SEQ ID NO: 7812822 - DNA, 22 bp, Homo sapiens
gagggcgttcagtcagtgtctc

SEQ ID NO: 7812823 - DNA, 22 bp, Homo sapiens
gagggcgttcagtcagtgtctc

SEQ ID NO: 7812824 - DNA, 22 bp, Homo sapiens
gagggcgcttcagagagatgaa

SEQ ID NO: 7812825 - DNA, 22 bp, Homo sapiens
gagggcgatggtttcagtttct

SEQ ID NO: 7812826 - DNA, 22 bp, Homo sapiens
atgtctgcgttatatcaatatc

SEQ ID NO: 7812827 - DNA, 22 bp, Homo sapiens
atgtctgataaataatgcataa

SEQ ID NO: 7812828 - DNA, 22 bp, Homo sapiens
atgtctgataaataatgcataa

SEQ ID NO: 7812829 - DNA, 20 bp, Homo sapiens
atgtctgaagtaatccattt

SEQ ID NO: 7812830 - DNA, 20 bp, Homo sapiens
atgtctgaagtaatccattt

SEQ ID NO: 7812831 - DNA, 22 bp, Homo sapiens
atgtctctttagagcaacagta

SEQ ID NO: 7812832 - DNA, 19 bp, Homo sapiens
atgtctctgtagcacatac

SEQ ID NO: 7812833 - DNA, 19 bp, Homo sapiens
atgtctctgtagcacatac

SEQ ID NO: 7812834 - DNA, 19 bp, Homo sapiens
atgtctctgtagcacatac

SEQ ID NO: 7812835 - DNA, 22 bp, Homo sapiens
gaggtagggcagaggctgaatg

SEQ ID NO: 7812836 - DNA, 22 bp, Homo sapiens
gaggtagggcagaggctgaatg

SEQ ID NO: 7812837 - DNA, 20 bp, Homo sapiens
gaggtagggcttaaggcaag

SEQ ID NO: 7812838 - DNA, 22 bp, Homo sapiens
gaggtaggtgtaggaggcctgc

SEQ ID NO: 7812839 - DNA, 22 bp, Homo sapiens
gaggtggatgttgcagtgagct

SEQ ID NO: 7812840 - DNA, 22 bp, Homo sapiens
gaggtggatgttgcagtgagct

SEQ ID NO: 7812841 - DNA, 23 bp, Homo sapiens
gaggtggcaatgagggcagttgg

SEQ ID NO: 7812842 - DNA, 22 bp, Homo sapiens
gaggtggatgttgcagtgagct

SEQ ID NO: 7812843 - DNA, 22 bp, Homo sapiens
atgtgactccaggcagttttgt

SEQ ID NO: 7812844 - DNA, 22 bp, Homo sapiens
atgtgactccaggcagttttgt

SEQ ID NO: 7812845 - DNA, 22 bp, Homo sapiens
atgtgacttcagtcttcttaca

SEQ ID NO: 7812846 - DNA, 22 bp, Homo sapiens
atgtgacttcagtcttcttaca

SEQ ID NO: 7812847 - DNA, 22 bp, Homo sapiens
atgtgactttgtgtcttccatc

SEQ ID NO: 7812848 - DNA, 22 bp, Homo sapiens
atgtgactagcccttcatgacc

SEQ ID NO: 7812849 - DNA, 22 bp, Homo sapiens
atgtgacagtgtttgacagatg

SEQ ID NO: 7812850 - DNA, 22 bp, Homo sapiens
atgtgactccacagctgtgctg

SEQ ID NO: 7812851 - DNA, 22 bp, Homo sapiens
atgtgactccacagctgtgctg

SEQ ID NO: 7812852 - DNA, 18 bp, Homo sapiens
atgtgagagaatcttctt

SEQ ID NO: 7812853 - DNA, 18 bp, Homo sapiens
atgtgagagaatcttctt

SEQ ID NO: 7812854 - DNA, 22 bp, Homo sapiens
atgtgagactaaaaagatgtgc

SEQ ID NO: 7812855 - DNA, 22 bp, Homo sapiens
atgtgagaactcaggaaatact

SEQ ID NO: 7812856 - DNA, 22 bp, Homo sapiens
atgtgagaataactcaaaacaa

SEQ ID NO: 7812857 - DNA, 22 bp, Homo sapiens
atgtgagaataactcaaaacaa

SEQ ID NO: 7812858 - DNA, 22 bp, Homo sapiens
atgtgagaataactcaaaacaa

SEQ ID NO: 7812859 - DNA, 22 bp, Homo sapiens
atgtgagatgcacataattata

SEQ ID NO: 7812860 - DNA, 22 bp, Homo sapiens
atgtgagatgcacataattata

SEQ ID NO: 7812861 - DNA, 22 bp, Homo sapiens
atgtgagatgcacataattata

SEQ ID NO: 7812862 - DNA, 22 bp, Homo sapiens
atgtgagctccggcaggtggaa

SEQ ID NO: 7812863 - DNA, 22 bp, Homo sapiens
atgtgaaatagctggatatgaa

SEQ ID NO: 7812864 - DNA, 22 bp, Homo sapiens
atgtgaaatagctggatatgaa

SEQ ID NO: 7812865 - DNA, 20 bp, Homo sapiens
atgtgaaagatcagttgtct

SEQ ID NO: 7812866 - DNA, 20 bp, Homo sapiens
atgtgaaagatcagttgtct

SEQ ID NO: 7812867 - DNA, 22 bp, Homo sapiens
atgtgaaatagctggatatgaa

SEQ ID NO: 7812868 - DNA, 20 bp, Homo sapiens
atgtgaaagatcagttgtct

SEQ ID NO: 7812869 - DNA, 22 bp, Homo sapiens
atgtgaaagaggtgttcagtgg

SEQ ID NO: 7812870 - DNA, 20 bp, Homo sapiens
atgtgaaagatcagttgtct

SEQ ID NO: 7812871 - DNA, 22 bp, Homo sapiens
atgtgaaagaggtgttcagtgg

SEQ ID NO: 7812872 - DNA, 22 bp, Homo sapiens
gagggctgaagattgtggcccc

SEQ ID NO: 7812873 - DNA, 22 bp, Homo sapiens
atgtgaaacgcaatgggatcat

SEQ ID NO: 7812874 - DNA, 22 bp, Homo sapiens
atgtgaaactgaagcatccata

SEQ ID NO: 7812875 - DNA, 22 bp, Homo sapiens
atgtgaaactgaagcatccata

SEQ ID NO: 7812876 - DNA, 21 bp, Homo sapiens
atgtgaaatatcatcagagca

SEQ ID NO: 7812877 - DNA, 21 bp, Homo sapiens
atgtgaaatatcatcagagca

SEQ ID NO: 7812878 - DNA, 22 bp, Homo sapiens
atgtgaagcttgtgctaacata

SEQ ID NO: 7812879 - DNA, 22 bp, Homo sapiens
atgtgaactctgtactctctga

SEQ ID NO: 7812880 - DNA, 22 bp, Homo sapiens
atgtgaaatattaagccgagga

SEQ ID NO: 7812881 - DNA, 22 bp, Homo sapiens
atgtgaaatattaagccgagga

SEQ ID NO: 7812882 - DNA, 22 bp, Homo sapiens
atgtgaatgcagttatctataa

SEQ ID NO: 7812883 - DNA, 22 bp, Homo sapiens
atgtgaatgcagttatctataa

SEQ ID NO: 7812884 - DNA, 22 bp, Homo sapiens
atgtgaatgcagttatctataa

SEQ ID NO: 7812885 - DNA, 20 bp, Homo sapiens
atgtgaagtaggaagggtgt

SEQ ID NO: 7812886 - DNA, 22 bp, Homo sapiens
atgtgacagtgtttgacagatg

SEQ ID NO: 7812887 - DNA, 22 bp, Homo sapiens
gatacacaaaagtctagtgagg

SEQ ID NO: 7812888 - DNA, 22 bp, Homo sapiens
gatacaagactaataggaaaca

SEQ ID NO: 7812889 - DNA, 22 bp, Homo sapiens
gatacaaattcatgtctgaatt

SEQ ID NO: 7812890 - DNA, 22 bp, Homo sapiens
gatacaaattcatgtctgaatt

SEQ ID NO: 7812891 - DNA, 22 bp, Homo sapiens
gatacaaattcatgtctgaatt

SEQ ID NO: 7812892 - DNA, 22 bp, Homo sapiens
gatacaaattcatgtctgaatt

SEQ ID NO: 7812893 - DNA, 22 bp, Homo sapiens
gatacaaattcatgtctgaatt

SEQ ID NO: 7812894 - DNA, 22 bp, Homo sapiens
gatacaaattcatgtctgaatt

SEQ ID NO: 7812895 - DNA, 22 bp, Homo sapiens
gatacacaagtggaaggagacg

SEQ ID NO: 7812896 - DNA, 22 bp, Homo sapiens
gatatatttggaccagagcatt

SEQ ID NO: 7812897 - DNA, 22 bp, Homo sapiens
gatatattttccatggtctgca

SEQ ID NO: 7812898 - DNA, 22 bp, Homo sapiens
gatatattttccatggtctgca

SEQ ID NO: 7812899 - DNA, 22 bp, Homo sapiens
gatatcatgggaaggtgtactt

SEQ ID NO: 7812900 - DNA, 22 bp, Homo sapiens
gatatgaagtggcattgtgaag

SEQ ID NO: 7812901 - DNA, 22 bp, Homo sapiens
gatatgcacattcaaaaattgc

SEQ ID NO: 7812902 - DNA, 22 bp, Homo sapiens
gatatgaagtggcattgtgaag

SEQ ID NO: 7812903 - DNA, 18 bp, Homo sapiens
gatatggaaggccatgcc

SEQ ID NO: 7812904 - DNA, 22 bp, Homo sapiens
gatatgtaccacctcttaaaag

SEQ ID NO: 7812905 - DNA, 18 bp, Homo sapiens
gatatggaaggccatgcc

SEQ ID NO: 7812906 - DNA, 22 bp, Homo sapiens
gatatgtaccacctcttaaaag

SEQ ID NO: 7812907 - DNA, 22 bp, Homo sapiens
gatatgtaccacctcttaaaag

SEQ ID NO: 7812908 - DNA, 22 bp, Homo sapiens
gatatgtatgaggagtatgtat

SEQ ID NO: 7812909 - DNA, 22 bp, Homo sapiens
gatatgtatgaggagtatgtat

SEQ ID NO: 7812910 - DNA, 22 bp, Homo sapiens
gatatgtatgaggagtatgtat

SEQ ID NO: 7812911 - DNA, 22 bp, Homo sapiens
gataattataggctaagccact

SEQ ID NO: 7812912 - DNA, 22 bp, Homo sapiens
gataattataggctaagccact

SEQ ID NO: 7812913 - DNA, 22 bp, Homo sapiens
gataattataggctaagccact

SEQ ID NO: 7812914 - DNA, 22 bp, Homo sapiens
gataatttgatacctcaatcag

SEQ ID NO: 7812915 - DNA, 22 bp, Homo sapiens
gataatttctccatctcaaggt

SEQ ID NO: 7812916 - DNA, 22 bp, Homo sapiens
gataatttctccatctcaaggt

SEQ ID NO: 7812917 - DNA, 22 bp, Homo sapiens
gataatgtgccgataatttcta

SEQ ID NO: 7812918 - DNA, 22 bp, Homo sapiens
gataatgtggatttattgtgat

SEQ ID NO: 7812919 - DNA, 22 bp, Homo sapiens
gataatgtggatttattgtgat

SEQ ID NO: 7812920 - DNA, 22 bp, Homo sapiens
gataattttagtctgaaaattg

SEQ ID NO: 7812921 - DNA, 22 bp, Homo sapiens
gataattttagtctgaaaattg

SEQ ID NO: 7812922 - DNA, 22 bp, Homo sapiens
gataattttagtctgaaaattg

SEQ ID NO: 7812923 - DNA, 22 bp, Homo sapiens
gataattttggttccaggttgg

SEQ ID NO: 7812924 - DNA, 22 bp, Homo sapiens
gatacaaaatataaatggagag

SEQ ID NO: 7812925 - DNA, 22 bp, Homo sapiens
gatacaaattcatgtctgaatt

SEQ ID NO: 7812926 - DNA, 22 bp, Homo sapiens
gatacaaaatataaatggagag

SEQ ID NO: 7812927 - DNA, 22 bp, Homo sapiens
gatacaaaatataaatggagag

SEQ ID NO: 7812928 - DNA, 22 bp, Homo sapiens
gatacaaaatataaatggagag

SEQ ID NO: 7812929 - DNA, 22 bp, Homo sapiens
gatacaaaatataaatggagag

SEQ ID NO: 7812930 - DNA, 22 bp, Homo sapiens
gatacaaaatataaatggagag

SEQ ID NO: 7812931 - DNA, 22 bp, Homo sapiens
gatacaaaatataaatggagag

SEQ ID NO: 7812932 - DNA, 22 bp, Homo sapiens
gataatgatgacaatgacaacc

SEQ ID NO: 7812933 - DNA, 22 bp, Homo sapiens
gataatgatgacaatgacaacc

SEQ ID NO: 7812934 - DNA, 22 bp, Homo sapiens
gagttcatattcagagatcgct

SEQ ID NO: 7812935 - DNA, 22 bp, Homo sapiens
gagttcagtagttatagtctag

SEQ ID NO: 7812936 - DNA, 22 bp, Homo sapiens
atgtttaatcggctgcctttcc

SEQ ID NO: 7812937 - DNA, 22 bp, Homo sapiens
atgtttaatcggctgcctttcc

SEQ ID NO: 7812938 - DNA, 22 bp, Homo sapiens
atgtttaatcggctgcctttcc

SEQ ID NO: 7812939 - DNA, 22 bp, Homo sapiens
atgtttaatcggctgcctttcc

SEQ ID NO: 7812940 - DNA, 22 bp, Homo sapiens
atgtttaagaaagtcttccata

SEQ ID NO: 7812941 - DNA, 22 bp, Homo sapiens
atgtttaagaaagtcttccata

SEQ ID NO: 7812942 - DNA, 22 bp, Homo sapiens
atgtttaaggaactggtttgct

SEQ ID NO: 7812943 - DNA, 22 bp, Homo sapiens
atgtttaaagggttgagaaata

SEQ ID NO: 7812944 - DNA, 22 bp, Homo sapiens
atgtttaaagggttgagaaata

SEQ ID NO: 7812945 - DNA, 22 bp, Homo sapiens
atgtttaaagggttgagaaata

SEQ ID NO: 7812946 - DNA, 22 bp, Homo sapiens
atgtttaaagggttgagaaata

SEQ ID NO: 7812947 - DNA, 22 bp, Homo sapiens
atgtttaaagggttgagaaata

SEQ ID NO: 7812948 - DNA, 22 bp, Homo sapiens
atgtttaaatttatagacagtg

SEQ ID NO: 7812949 - DNA, 22 bp, Homo sapiens
atgtttaaatttatagacagtg

SEQ ID NO: 7812950 - DNA, 22 bp, Homo sapiens
atgtttaaatttatagacagtg

SEQ ID NO: 7812951 - DNA, 22 bp, Homo sapiens
atgtttaaatttatagacagtg

SEQ ID NO: 7812952 - DNA, 22 bp, Homo sapiens
atgttggagtcgtaaggcatgg

SEQ ID NO: 7812953 - DNA, 22 bp, Homo sapiens
atgttggccaggctggtcttga

SEQ ID NO: 7812954 - DNA, 22 bp, Homo sapiens
atgttgggaaggccgcaggcac

SEQ ID NO: 7812955 - DNA, 22 bp, Homo sapiens
atgttgggaaggccgcaggcac

SEQ ID NO: 7812956 - DNA, 22 bp, Homo sapiens
atgttgtactgagaattaggag

SEQ ID NO: 7812957 - DNA, 22 bp, Homo sapiens
atgttggagtcgtaaggcatgg

SEQ ID NO: 7812958 - DNA, 22 bp, Homo sapiens
atgttggagtcgtaaggcatgg

SEQ ID NO: 7812959 - DNA, 22 bp, Homo sapiens
atgttggagtcgtaaggcatgg

SEQ ID NO: 7812960 - DNA, 22 bp, Homo sapiens
atgttggagtcgtaaggcatgg

SEQ ID NO: 7812961 - DNA, 22 bp, Homo sapiens
atgttggagtcgtaaggcatgg

SEQ ID NO: 7812962 - DNA, 22 bp, Homo sapiens
atgttgcccattccaggagata

SEQ ID NO: 7812963 - DNA, 22 bp, Homo sapiens
atgttgcacaaagtccatccat

SEQ ID NO: 7812964 - DNA, 21 bp, Homo sapiens
atgttggaatccaaaaacatt

SEQ ID NO: 7812965 - DNA, 22 bp, Homo sapiens
atgttggagtcgtaaggcatgg

SEQ ID NO: 7812966 - DNA, 22 bp, Homo sapiens
atgtttaaaggagtcagagact

SEQ ID NO: 7812967 - DNA, 22 bp, Homo sapiens
atgtttaaaggagtcagagact

SEQ ID NO: 7812968 - DNA, 22 bp, Homo sapiens
atgtttaaaggagtcagagact

SEQ ID NO: 7812969 - DNA, 22 bp, Homo sapiens
atgttgttttttcataaagtat

SEQ ID NO: 7812970 - DNA, 22 bp, Homo sapiens
atgttgttttttcataaagtat

SEQ ID NO: 7812971 - DNA, 22 bp, Homo sapiens
atgttgttttttcataaagtat

SEQ ID NO: 7812972 - DNA, 20 bp, Homo sapiens
atgttgtttactcatagcat

SEQ ID NO: 7812973 - DNA, 22 bp, Homo sapiens
atgttgtgtttgactgttaccc

SEQ ID NO: 7812974 - DNA, 22 bp, Homo sapiens
atgttgttccctctacacaggt

SEQ ID NO: 7812975 - DNA, 22 bp, Homo sapiens
atgttgttgaactctttgcatg

SEQ ID NO: 7812976 - DNA, 22 bp, Homo sapiens
atgttgtgtttgactgttaccc

SEQ ID NO: 7812977 - DNA, 22 bp, Homo sapiens
atgttgtgtttgactgttaccc

SEQ ID NO: 7812978 - DNA, 23 bp, Homo sapiens
atgttgtcatctgcattccactg

SEQ ID NO: 7812979 - DNA, 22 bp, Homo sapiens
atgttgtgtttgactgttaccc

SEQ ID NO: 7812980 - DNA, 22 bp, Homo sapiens
atgttgtaggtctcatggtaca

SEQ ID NO: 7812981 - DNA, 22 bp, Homo sapiens
atgttgtattatgttattgtct

SEQ ID NO: 7812982 - DNA, 22 bp, Homo sapiens
atgtgtctctaccaatgcaatt

SEQ ID NO: 7812983 - DNA, 22 bp, Homo sapiens
atgtgtctctaccaatgcaatt

SEQ ID NO: 7812984 - DNA, 22 bp, Homo sapiens
atgtgtctctaaaatttagtaa

SEQ ID NO: 7812985 - DNA, 22 bp, Homo sapiens
atgtgtctctaccaatgcaatt

SEQ ID NO: 7812986 - DNA, 17 bp, Homo sapiens
atgtgtctagtgcaacc

SEQ ID NO: 7812987 - DNA, 22 bp, Homo sapiens
atgtgtctctaaaatttagtaa

SEQ ID NO: 7812988 - DNA, 22 bp, Homo sapiens
atgtgtctctaccaatgcaatt

SEQ ID NO: 7812989 - DNA, 22 bp, Homo sapiens
atgtgtctgaccactgtattgg

SEQ ID NO: 7812990 - DNA, 22 bp, Homo sapiens
atgtgtctgaccactgtattgg

SEQ ID NO: 7812991 - DNA, 17 bp, Homo sapiens
atgtgtctgagtgtcct

SEQ ID NO: 7812992 - DNA, 17 bp, Homo sapiens
atgtgtctgagtgtcct

SEQ ID NO: 7812993 - DNA, 22 bp, Homo sapiens
atgtgtctgatggccctgaatt

SEQ ID NO: 7812994 - DNA, 17 bp, Homo sapiens
atgtgtctgagtgtcct

SEQ ID NO: 7812995 - DNA, 20 bp, Homo sapiens
atgtgtctgcctctgtgttc

SEQ ID NO: 7812996 - DNA, 22 bp, Homo sapiens
atgtgtctggcatggaaagtgt

SEQ ID NO: 7812997 - DNA, 22 bp, Homo sapiens
atgtgtctggcatggaaagtgt

SEQ ID NO: 7812998 - DNA, 22 bp, Homo sapiens
atgtgtctgatggccctgaatt

SEQ ID NO: 7812999 - DNA, 20 bp, Homo sapiens
atgtgtctgcctctgtgttc

SEQ ID NO: 7813000 - DNA, 22 bp, Homo sapiens
atgtgtctggcatggaaagtgt

SEQ ID NO: 7813001 - DNA, 22 bp, Homo sapiens
gaggtggctccaggagcaatgc

SEQ ID NO: 7813002 - DNA, 22 bp, Homo sapiens
gaggtggcgcgccatccctgcc

SEQ ID NO: 7813003 - DNA, 22 bp, Homo sapiens
gaggtggcctcaagcagtcttc

SEQ ID NO: 7813004 - DNA, 22 bp, Homo sapiens
gaggtggcgcgccatccctgcc

SEQ ID NO: 7813005 - DNA, 22 bp, Homo sapiens
gaggtggcgcgccatccctgcc

SEQ ID NO: 7813006 - DNA, 22 bp, Homo sapiens
gaggtggcgcgccatccctgcc

SEQ ID NO: 7813007 - DNA, 22 bp, Homo sapiens
atgtgtctaattccaggagcac

SEQ ID NO: 7813008 - DNA, 22 bp, Homo sapiens
atgtgtctaattccaggagcac

SEQ ID NO: 7813009 - DNA, 22 bp, Homo sapiens
atgtgtccttataagaagaaga

SEQ ID NO: 7813010 - DNA, 22 bp, Homo sapiens
atgtgtccttgttcccattcca

SEQ ID NO: 7813011 - DNA, 22 bp, Homo sapiens
atgtgtctaattccaggagcac

SEQ ID NO: 7813012 - DNA, 22 bp, Homo sapiens
atgtgtctctaaaatttagtaa

SEQ ID NO: 7813013 - DNA, 22 bp, Homo sapiens
atgtgtctagattgctgtaccg

SEQ ID NO: 7813014 - DNA, 22 bp, Homo sapiens
atgtgtctagattgctgtaccg

SEQ ID NO: 7813015 - DNA, 17 bp, Homo sapiens
atgtgtctagtgcaacc

SEQ ID NO: 7813016 - DNA, 22 bp, Homo sapiens
atgtgtctagattgctgtaccg

SEQ ID NO: 7813017 - DNA, 22 bp, Homo sapiens
gaggtggcctcaagcagtcttc

SEQ ID NO: 7813018 - DNA, 22 bp, Homo sapiens
gaggtggcctcaagcagtcttc

SEQ ID NO: 7813019 - DNA, 22 bp, Homo sapiens
gaggtggcctcaagcagtcttc

SEQ ID NO: 7813020 - DNA, 22 bp, Homo sapiens
gaggtggcctcaagcagtcttc

SEQ ID NO: 7813021 - DNA, 22 bp, Homo sapiens
gaggtggcctcaagcagtcttc

SEQ ID NO: 7813022 - DNA, 22 bp, Homo sapiens
gaggtggcctcaagcagtcttc

SEQ ID NO: 7813023 - DNA, 22 bp, Homo sapiens
gaggtggcctcaagcagtcttc

SEQ ID NO: 7813024 - DNA, 22 bp, Homo sapiens
gaggtggcccttgctcagcctt

SEQ ID NO: 7813025 - DNA, 22 bp, Homo sapiens
gaggtggcccttgctcagcctt

SEQ ID NO: 7813026 - DNA, 22 bp, Homo sapiens
gaggtggccaagcgaggaaggg

SEQ ID NO: 7813027 - DNA, 22 bp, Homo sapiens
gaggtggccaagcgaggaaggg

SEQ ID NO: 7813028 - DNA, 22 bp, Homo sapiens
gaggtggccaagcgaggaaggg

SEQ ID NO: 7813029 - DNA, 22 bp, Homo sapiens
gaggtggccaagcgaggaaggg

SEQ ID NO: 7813030 - DNA, 22 bp, Homo sapiens
gaggtggccaagcgaggaaggg

SEQ ID NO: 7813031 - DNA, 22 bp, Homo sapiens
gaggtggccaagcgaggaaggg

SEQ ID NO: 7813032 - DNA, 22 bp, Homo sapiens
gaggtggccagagtcaagagcc

SEQ ID NO: 7813033 - DNA, 22 bp, Homo sapiens
gaggtggccagagtcaagagcc

SEQ ID NO: 7813034 - DNA, 22 bp, Homo sapiens
gaggtggccagagtcaagagcc

SEQ ID NO: 7813035 - DNA, 22 bp, Homo sapiens
gaggtggcactgtgaggagcac

SEQ ID NO: 7813036 - DNA, 22 bp, Homo sapiens
gaggtggcactgtgaggagcac

SEQ ID NO: 7813037 - DNA, 22 bp, Homo sapiens
gaggtggcactgtgaggagcac

SEQ ID NO: 7813038 - DNA, 22 bp, Homo sapiens
gaggtggcactgtgaggagcac

SEQ ID NO: 7813039 - DNA, 22 bp, Homo sapiens
gaggtggcagaggcctggacct

SEQ ID NO: 7813040 - DNA, 22 bp, Homo sapiens
gaggtggcattaagattctggt

SEQ ID NO: 7813041 - DNA, 22 bp, Homo sapiens
gaggtggcattaagattctggt

SEQ ID NO: 7813042 - DNA, 22 bp, Homo sapiens
gaggtggcagaggcctggacct

SEQ ID NO: 7813043 - DNA, 22 bp, Homo sapiens
gaggtggcactgtgaggagcac

SEQ ID NO: 7813044 - DNA, 22 bp, Homo sapiens
gaggtggcactgtgaggagcac

SEQ ID NO: 7813045 - DNA, 22 bp, Homo sapiens
gaggtggcactgtgaggagcac

SEQ ID NO: 7813046 - DNA, 22 bp, Homo sapiens
gaggtggcactgtgaggagcac

SEQ ID NO: 7813047 - DNA, 22 bp, Homo sapiens
gaggtggcactgtgaggagcac

SEQ ID NO: 7813048 - DNA, 22 bp, Homo sapiens
gaggtggcactgtgaggagcac

SEQ ID NO: 7813049 - DNA, 22 bp, Homo sapiens
gaggtggcactgtgaggagcac

SEQ ID NO: 7813050 - DNA, 22 bp, Homo sapiens
gaggtggcactgtgaggagcac

SEQ ID NO: 7813051 - DNA, 22 bp, Homo sapiens
gaggtggcactgtgaggagcac

SEQ ID NO: 7813052 - DNA, 22 bp, Homo sapiens
gaggtggcaatttaatgcagtc

SEQ ID NO: 7813053 - DNA, 23 bp, Homo sapiens
gaggtggcaatgagggcagttgg

SEQ ID NO: 7813054 - DNA, 22 bp, Homo sapiens
gaggtggcaatttaatgcagtc

SEQ ID NO: 7813055 - DNA, 22 bp, Homo sapiens
atgttctttgaaatattttaga

SEQ ID NO: 7813056 - DNA, 22 bp, Homo sapiens
atgttctttcagccagtgcatc

SEQ ID NO: 7813057 - DNA, 22 bp, Homo sapiens
atgttcttgttcaaatgtcagt

SEQ ID NO: 7813058 - DNA, 22 bp, Homo sapiens
atgttcttgttcaaatgtcagt

SEQ ID NO: 7813059 - DNA, 22 bp, Homo sapiens
atgttctttcagccagtgcatc

SEQ ID NO: 7813060 - DNA, 22 bp, Homo sapiens
atgttctttcagccagtgcatc

SEQ ID NO: 7813061 - DNA, 22 bp, Homo sapiens
atgttctttgtgattctgagct

SEQ ID NO: 7813062 - DNA, 22 bp, Homo sapiens
atgttctttggaatttatgaaa

SEQ ID NO: 7813063 - DNA, 22 bp, Homo sapiens
atgttctttggaatttatgaaa

SEQ ID NO: 7813064 - DNA, 22 bp, Homo sapiens
atgttgcacaaagtccatccat

SEQ ID NO: 7813065 - DNA, 22 bp, Homo sapiens
atgttgcacaaagtccatccat

SEQ ID NO: 7813066 - DNA, 22 bp, Homo sapiens
atgttgactcagagtgagggta

SEQ ID NO: 7813067 - DNA, 22 bp, Homo sapiens
atgttcttggatgttgtgtata

SEQ ID NO: 7813068 - DNA, 22 bp, Homo sapiens
atgttcttgactttcctgcctg

SEQ ID NO: 7813069 - DNA, 22 bp, Homo sapiens
atgttcttctatctttattaaa

SEQ ID NO: 7813070 - DNA, 22 bp, Homo sapiens
atgttcttctatctttattaaa

SEQ ID NO: 7813071 - DNA, 22 bp, Homo sapiens
atgttcttctatctttattaaa

SEQ ID NO: 7813072 - DNA, 22 bp, Homo sapiens
atgttcttccaaatctgtaaca

SEQ ID NO: 7813073 - DNA, 22 bp, Homo sapiens
atgttctgttttgtaattcata

SEQ ID NO: 7813074 - DNA, 22 bp, Homo sapiens
atgttctgttttgtaattcata

SEQ ID NO: 7813075 - DNA, 22 bp, Homo sapiens
atgttcttagcaaagtacttgc

SEQ ID NO: 7813076 - DNA, 22 bp, Homo sapiens
atgttcttccaaatctgtaaca

SEQ ID NO: 7813077 - DNA, 22 bp, Homo sapiens
atgttcttccaaatctgtaaca

SEQ ID NO: 7813078 - DNA, 20 bp, Homo sapiens
atgttcttcatttaatgttc

SEQ ID NO: 7813079 - DNA, 20 bp, Homo sapiens
atgttcttcatttaatgttc

SEQ ID NO: 7813080 - DNA, 20 bp, Homo sapiens
atgttcttcatttaatgttc

SEQ ID NO: 7813081 - DNA, 22 bp, Homo sapiens
atgttctgaataatgtgcatta

SEQ ID NO: 7813082 - DNA, 22 bp, Homo sapiens
atgttctgaataatgtgcatta

SEQ ID NO: 7813083 - DNA, 22 bp, Homo sapiens
atgttctgaatcaagcaactct

SEQ ID NO: 7813084 - DNA, 22 bp, Homo sapiens
atgttctgaataatgtgcatta

SEQ ID NO: 7813085 - DNA, 22 bp, Homo sapiens
atgttattttggaaaatacaaa

SEQ ID NO: 7813086 - DNA, 22 bp, Homo sapiens
atgttattttggaaaatacaaa

SEQ ID NO: 7813087 - DNA, 22 bp, Homo sapiens
atgttattttggaaaatacaaa

SEQ ID NO: 7813088 - DNA, 22 bp, Homo sapiens
atgttctgaataatgtgcatta

SEQ ID NO: 7813089 - DNA, 22 bp, Homo sapiens
atgttattttggaaaatacaaa

SEQ ID NO: 7813090 - DNA, 22 bp, Homo sapiens
atgttattttggaaaatacaaa

SEQ ID NO: 7813091 - DNA, 22 bp, Homo sapiens
atgttattttggaaaatacaaa

SEQ ID NO: 7813092 - DNA, 22 bp, Homo sapiens
atgtgtcttctaagccaagcct

SEQ ID NO: 7813093 - DNA, 22 bp, Homo sapiens
atgttattttggaaaatacaaa

SEQ ID NO: 7813094 - DNA, 22 bp, Homo sapiens
atgttatttctgaaagatcatt

SEQ ID NO: 7813095 - DNA, 22 bp, Homo sapiens
atgttctgcctccattttgagt

SEQ ID NO: 7813096 - DNA, 20 bp, Homo sapiens
atgttctgtggctgtcatgg

SEQ ID NO: 7813097 - DNA, 19 bp, Homo sapiens
atgttctgaattactgtaa

SEQ ID NO: 7813098 - DNA, 19 bp, Homo sapiens
atgttctgaattactgtaa

SEQ ID NO: 7813099 - DNA, 22 bp, Homo sapiens
atgttctgaatcaagcaactct

SEQ ID NO: 7813100 - DNA, 22 bp, Homo sapiens
atgttctgaatcaagcaactct

SEQ ID NO: 7813101 - DNA, 20 bp, Homo sapiens
atgttctgtggctgtcatgg

SEQ ID NO: 7813102 - DNA, 20 bp, Homo sapiens
atgttctgtggctgtcatgg

SEQ ID NO: 7813103 - DNA, 22 bp, Homo sapiens
atgttctgtttcttaatcttga

SEQ ID NO: 7813104 - DNA, 22 bp, Homo sapiens
atgttctgtttcttaatcttga

SEQ ID NO: 7813105 - DNA, 22 bp, Homo sapiens
atgttctgtttcttaatcttga

SEQ ID NO: 7813106 - DNA, 22 bp, Homo sapiens
atgttctgttttgtaattcata

SEQ ID NO: 7813107 - DNA, 20 bp, Homo sapiens
atgtgtctgtaaacaactct

SEQ ID NO: 7813108 - DNA, 22 bp, Homo sapiens
atgtgtctggttattgacatgc

SEQ ID NO: 7813109 - DNA, 22 bp, Homo sapiens
atgtgtctggttattgacatgc

SEQ ID NO: 7813110 - DNA, 22 bp, Homo sapiens
atgtgtctggttattgacatgc

SEQ ID NO: 7813111 - DNA, 20 bp, Homo sapiens
atgtgtctgtaaacaactct

SEQ ID NO: 7813112 - DNA, 22 bp, Homo sapiens
atgtgtctggcatggctctatt

SEQ ID NO: 7813113 - DNA, 22 bp, Homo sapiens
atgtgtctggcatggctctatt

SEQ ID NO: 7813114 - DNA, 22 bp, Homo sapiens
atgtgtctggttattgacatgc

SEQ ID NO: 7813115 - DNA, 22 bp, Homo sapiens
atgtgtctggcatggctctatt

SEQ ID NO: 7813116 - DNA, 20 bp, Homo sapiens
atgtgtcttagagcatcagg

SEQ ID NO: 7813117 - DNA, 20 bp, Homo sapiens
atgtgtcttagagcatcagg

SEQ ID NO: 7813118 - DNA, 20 bp, Homo sapiens
atgtgtcttagagcatcagg

SEQ ID NO: 7813119 - DNA, 22 bp, Homo sapiens
atgtgtctgtgggcacacacac

SEQ ID NO: 7813120 - DNA, 22 bp, Homo sapiens
atgtgtctgtgggcacacacac

SEQ ID NO: 7813121 - DNA, 22 bp, Homo sapiens
atgtgtcttatttgattccaca

SEQ ID NO: 7813122 - DNA, 22 bp, Homo sapiens
atgtgtcttctaagccaagcct

SEQ ID NO: 7813123 - DNA, 22 bp, Homo sapiens
atgtgtcttatttgattccaca

SEQ ID NO: 7813124 - DNA, 20 bp, Homo sapiens
atgtgtcttagagcatcagg

SEQ ID NO: 7813125 - DNA, 22 bp, Homo sapiens
ggaaggggccttgagcaaactg

SEQ ID NO: 7813126 - DNA, 22 bp, Homo sapiens
cacactgtccccttctccccag

SEQ ID NO: 7813127 - DNA, 22 bp, Homo sapiens
ggaaggggccttgagcaaactg

SEQ ID NO: 7813128 - DNA, 22 bp, Homo sapiens
ggaaggggccttgagcaaactg

SEQ ID NO: 7813129 - DNA, 22 bp, Homo sapiens
cacactgtctttatgagctgta

SEQ ID NO: 7813130 - DNA, 22 bp, Homo sapiens
cacactgtctttatgagctgta

SEQ ID NO: 7813131 - DNA, 22 bp, Homo sapiens
cacactgtctttcagaatggtt

SEQ ID NO: 7813132 - DNA, 22 bp, Homo sapiens
cacagaactggttaatagcaga

SEQ ID NO: 7813133 - DNA, 22 bp, Homo sapiens
cacagaatggaccagttttaga

SEQ ID NO: 7813134 - DNA, 22 bp, Homo sapiens
cacagaatcggccgatggtgct

SEQ ID NO: 7813135 - DNA, 22 bp, Homo sapiens
cacagaatcatattgtcagttt

SEQ ID NO: 7813136 - DNA, 22 bp, Homo sapiens
cacagaagtttcatagtctcga

SEQ ID NO: 7813137 - DNA, 22 bp, Homo sapiens
ggaaggggagctggaaagggta

SEQ ID NO: 7813138 - DNA, 22 bp, Homo sapiens
ggaaggggagctggaaagggta

SEQ ID NO: 7813139 - DNA, 22 bp, Homo sapiens
ggaaggggagctggaaagggta

SEQ ID NO: 7813140 - DNA, 20 bp, Homo sapiens
ggaaggggcaaagtgtgtga

SEQ ID NO: 7813141 - DNA, 20 bp, Homo sapiens
ggaaggggcaaagtgtgtga

SEQ ID NO: 7813142 - DNA, 20 bp, Homo sapiens
ggaaggggcaaagtgtgtga

SEQ ID NO: 7813143 - DNA, 20 bp, Homo sapiens
ggaaggggcaaagtgtgtga

SEQ ID NO: 7813144 - DNA, 22 bp, Homo sapiens
ggaaggggagctggaaagggta

SEQ ID NO: 7813145 - DNA, 22 bp, Homo sapiens
ggaaggggagctggaaagggta

SEQ ID NO: 7813146 - DNA, 22 bp, Homo sapiens
ggaaggggagctaaatctactg

SEQ ID NO: 7813147 - DNA, 22 bp, Homo sapiens
ggaaggggagctggaaagggta

SEQ ID NO: 7813148 - DNA, 22 bp, Homo sapiens
ggaaggggagctggaaagggta

SEQ ID NO: 7813149 - DNA, 22 bp, Homo sapiens
ggaaggggagctggaaagggta

SEQ ID NO: 7813150 - DNA, 22 bp, Homo sapiens
ggaaggggagctggaaagggta

SEQ ID NO: 7813151 - DNA, 22 bp, Homo sapiens
ggaaggggagctggaaagggta

SEQ ID NO: 7813152 - DNA, 22 bp, Homo sapiens
ggaaggggagctggaaagggta

SEQ ID NO: 7813153 - DNA, 22 bp, Homo sapiens
ggaaggggagctggaaagggta

SEQ ID NO: 7813154 - DNA, 22 bp, Homo sapiens
ggaaggggagctggaaagggta

SEQ ID NO: 7813155 - DNA, 22 bp, Homo sapiens
ggaagggcctcgggcgtgggac

SEQ ID NO: 7813156 - DNA, 22 bp, Homo sapiens
ggaaggggagctaaatctactg

SEQ ID NO: 7813157 - DNA, 21 bp, Homo sapiens
ggaagggctctgaggacggct

SEQ ID NO: 7813158 - DNA, 15 bp, Homo sapiens
cacacagacagcttg

SEQ ID NO: 7813159 - DNA, 22 bp, Homo sapiens
cacacagacagctctctgaaga

SEQ ID NO: 7813160 - DNA, 22 bp, Homo sapiens
cacacagacagctctctgaaga

SEQ ID NO: 7813161 - DNA, 22 bp, Homo sapiens
cacacagatggtaagggaggga

SEQ ID NO: 7813162 - DNA, 22 bp, Homo sapiens
cacacagatggtaagggaggga

SEQ ID NO: 7813163 - DNA, 22 bp, Homo sapiens
cacacagatggtaagggaggga

SEQ ID NO: 7813164 - DNA, 22 bp, Homo sapiens
cacacagatggtaagggaggga

SEQ ID NO: 7813165 - DNA, 22 bp, Homo sapiens
caatgttttcaactgacaagta

SEQ ID NO: 7813166 - DNA, 22 bp, Homo sapiens
caatgtttgtgatctactgact

SEQ ID NO: 7813167 - DNA, 22 bp, Homo sapiens
caatgtttgttagagctctaga

SEQ ID NO: 7813168 - DNA, 22 bp, Homo sapiens
cacaattttaatacacagtcaa

SEQ ID NO: 7813169 - DNA, 22 bp, Homo sapiens
cacaatttgttttatcagtatt

SEQ ID NO: 7813170 - DNA, 22 bp, Homo sapiens
cacaattttaatacacagtcaa

SEQ ID NO: 7813171 - DNA, 22 bp, Homo sapiens
cacacagacagctctctgaaga

SEQ ID NO: 7813172 - DNA, 22 bp, Homo sapiens
cacacagacagctctctgaaga

SEQ ID NO: 7813173 - DNA, 22 bp, Homo sapiens
cacacagacagctctctgaaga

SEQ ID NO: 7813174 - DNA, 22 bp, Homo sapiens
ggaagggcaataaaatctcagg

SEQ ID NO: 7813175 - DNA, 22 bp, Homo sapiens
ggaagggcctcgggcgtgggac

SEQ ID NO: 7813176 - DNA, 22 bp, Homo sapiens
cacacaggagagtgctggaggt

SEQ ID NO: 7813177 - DNA, 22 bp, Homo sapiens
ggaagggcctcgggcgtgggac

SEQ ID NO: 7813178 - DNA, 22 bp, Homo sapiens
ggaagggcctcgggcgtgggac

SEQ ID NO: 7813179 - DNA, 22 bp, Homo sapiens
ggaagggcctcgggcgtgggac

SEQ ID NO: 7813180 - DNA, 22 bp, Homo sapiens
cacacaggaaaattggaattaa

SEQ ID NO: 7813181 - DNA, 22 bp, Homo sapiens
cacacaggagagtgctggaggt

SEQ ID NO: 7813182 - DNA, 21 bp, Homo sapiens
cacacagctgcccttaggtag

SEQ ID NO: 7813183 - DNA, 21 bp, Homo sapiens
cacacagctgcccttaggtag

SEQ ID NO: 7813184 - DNA, 22 bp, Homo sapiens
cacacagctcaggggcactgcc

SEQ ID NO: 7813185 - DNA, 22 bp, Homo sapiens
cacacagctagtgacaggagaa

SEQ ID NO: 7813186 - DNA, 22 bp, Homo sapiens
cacacagctcaggggcactgcc

SEQ ID NO: 7813187 - DNA, 22 bp, Homo sapiens
cacacagctcaggggcactgcc

SEQ ID NO: 7813188 - DNA, 22 bp, Homo sapiens
cacacagctcaggggcactgcc

SEQ ID NO: 7813189 - DNA, 22 bp, Homo sapiens
cacacagcaacaagaatagcca

SEQ ID NO: 7813190 - DNA, 22 bp, Homo sapiens
cacacagcaacaagaatagcca

SEQ ID NO: 7813191 - DNA, 22 bp, Homo sapiens
cacacagcaacaagaatagcca

SEQ ID NO: 7813192 - DNA, 22 bp, Homo sapiens
cacacagctagtgacaggagaa

SEQ ID NO: 7813193 - DNA, 22 bp, Homo sapiens
cacacagctagtgacaggagaa

SEQ ID NO: 7813194 - DNA, 22 bp, Homo sapiens
cacacagctagtgacaggagaa

SEQ ID NO: 7813195 - DNA, 22 bp, Homo sapiens
cacacagctagtgacaggagaa

SEQ ID NO: 7813196 - DNA, 22 bp, Homo sapiens
cacacagctagtgacaggagaa

SEQ ID NO: 7813197 - DNA, 22 bp, Homo sapiens
cacacagctagtgacaggagaa

SEQ ID NO: 7813198 - DNA, 22 bp, Homo sapiens
cacacagctagtgacaggagaa

SEQ ID NO: 7813199 - DNA, 22 bp, Homo sapiens
cacagagctggaaaggctgggc

SEQ ID NO: 7813200 - DNA, 22 bp, Homo sapiens
cacagaggaaaggcagttggta

SEQ ID NO: 7813201 - DNA, 22 bp, Homo sapiens
cacagagctgaacctgggtcat

SEQ ID NO: 7813202 - DNA, 22 bp, Homo sapiens
cacagagctggaaaggctgggc

SEQ ID NO: 7813203 - DNA, 22 bp, Homo sapiens
cacagagctggaaaggctgggc

SEQ ID NO: 7813204 - DNA, 22 bp, Homo sapiens
cacagagctggaaaggctgggc

SEQ ID NO: 7813205 - DNA, 22 bp, Homo sapiens
cacagagctggaaaggctgggc

SEQ ID NO: 7813206 - DNA, 22 bp, Homo sapiens
cacagagctggaaaggctgggc

SEQ ID NO: 7813207 - DNA, 22 bp, Homo sapiens
cacagagctgaacctgggtcat

SEQ ID NO: 7813208 - DNA, 22 bp, Homo sapiens
cacagagctgaacctgggtcat

SEQ ID NO: 7813209 - DNA, 22 bp, Homo sapiens
cacagagctgaacctgggtcat

SEQ ID NO: 7813210 - DNA, 22 bp, Homo sapiens
cacagagctgaacctgggtcat

SEQ ID NO: 7813211 - DNA, 22 bp, Homo sapiens
cacagagctgaacctgggtcat

SEQ ID NO: 7813212 - DNA, 22 bp, Homo sapiens
cacagagctgaacctgggtcat

SEQ ID NO: 7813213 - DNA, 22 bp, Homo sapiens
cacagagagctacgtgcagcgt

SEQ ID NO: 7813214 - DNA, 22 bp, Homo sapiens
cacagagagctacgtgcagcgt

SEQ ID NO: 7813215 - DNA, 22 bp, Homo sapiens
cacagagagctacgtgcagcgt

SEQ ID NO: 7813216 - DNA, 22 bp, Homo sapiens
cacagagctcaagtcttagaaa

SEQ ID NO: 7813217 - DNA, 22 bp, Homo sapiens
cacagagctgaacctgggtcat

SEQ ID NO: 7813218 - DNA, 22 bp, Homo sapiens
cacagaggaaaggcagttggta

SEQ ID NO: 7813219 - DNA, 22 bp, Homo sapiens
cacagaggaaaggcagttggta

SEQ ID NO: 7813220 - DNA, 22 bp, Homo sapiens
cacagaggaaatgactttctta

SEQ ID NO: 7813221 - DNA, 22 bp, Homo sapiens
cacagaggaaatgactttctta

SEQ ID NO: 7813222 - DNA, 22 bp, Homo sapiens
cacagaggaatgcatcagcaga

SEQ ID NO: 7813223 - DNA, 22 bp, Homo sapiens
cacagaggagtgcacactctct

SEQ ID NO: 7813224 - DNA, 22 bp, Homo sapiens
cacagaggagtgcacactctct

SEQ ID NO: 7813225 - DNA, 22 bp, Homo sapiens
cacagaggagtgcacactctct

SEQ ID NO: 7813226 - DNA, 22 bp, Homo sapiens
cacagaggactgtagcggggag

SEQ ID NO: 7813227 - DNA, 22 bp, Homo sapiens
cacagaggatttttagggcagt

SEQ ID NO: 7813228 - DNA, 22 bp, Homo sapiens
cacagaggatttttagggcagt

SEQ ID NO: 7813229 - DNA, 22 bp, Homo sapiens
cacagaggcaaccttctggggt

SEQ ID NO: 7813230 - DNA, 22 bp, Homo sapiens
cacagaggatgcccaagcgatc

SEQ ID NO: 7813231 - DNA, 22 bp, Homo sapiens
cacagaggatgcccaagcgatc

SEQ ID NO: 7813232 - DNA, 22 bp, Homo sapiens
cacagaggatgcccaagcgatc

SEQ ID NO: 7813233 - DNA, 22 bp, Homo sapiens
cacagaggatgcccaagcgatc

SEQ ID NO: 7813234 - DNA, 22 bp, Homo sapiens
cacagaggatgcccaagcgatc

SEQ ID NO: 7813235 - DNA, 21 bp, Homo sapiens
cacagaggcgctgtatggctg

SEQ ID NO: 7813236 - DNA, 21 bp, Homo sapiens
cacagaggcgctgtatggctg

SEQ ID NO: 7813237 - DNA, 21 bp, Homo sapiens
cacagaggcgctgtatggctg

SEQ ID NO: 7813238 - DNA, 22 bp, Homo sapiens
cacagaggcatgaccctgccct

SEQ ID NO: 7813239 - DNA, 22 bp, Homo sapiens
cacagaggcatgaccctgccct

SEQ ID NO: 7813240 - DNA, 22 bp, Homo sapiens
cacagaggcatgaccctgccct

SEQ ID NO: 7813241 - DNA, 22 bp, Homo sapiens
cacagaggcggaaaattctgaa

SEQ ID NO: 7813242 - DNA, 22 bp, Homo sapiens
cacagaggctcaaagccaggtg

SEQ ID NO: 7813243 - DNA, 22 bp, Homo sapiens
ggactgggtaggagcccagggc

SEQ ID NO: 7813244 - DNA, 22 bp, Homo sapiens
cacagagagctacgtgcagcgt

SEQ ID NO: 7813245 - DNA, 22 bp, Homo sapiens
cacagagaccccttctggggcc

SEQ ID NO: 7813246 - DNA, 22 bp, Homo sapiens
ggactgggtaggagcccagggc

SEQ ID NO: 7813247 - DNA, 22 bp, Homo sapiens
ggactggggccaacacctccct

SEQ ID NO: 7813248 - DNA, 22 bp, Homo sapiens
ggactggggccaacacctccct

SEQ ID NO: 7813249 - DNA, 17 bp, Homo sapiens
ggactgggcggggcagg

SEQ ID NO: 7813250 - DNA, 22 bp, Homo sapiens
ggactgggattctggatctgct

SEQ ID NO: 7813251 - DNA, 22 bp, Homo sapiens
ggactgggattctggatctgct

SEQ ID NO: 7813252 - DNA, 22 bp, Homo sapiens
ggactgggattctggatctgct

SEQ ID NO: 7813253 - DNA, 22 bp, Homo sapiens
ggactgggattctggatctgct

SEQ ID NO: 7813254 - DNA, 22 bp, Homo sapiens
ggactgggcatgggtgctctgc

SEQ ID NO: 7813255 - DNA, 22 bp, Homo sapiens
ggactgggattctggatctgct

SEQ ID NO: 7813256 - DNA, 22 bp, Homo sapiens
ggactgggcatgggtgctctgc

SEQ ID NO: 7813257 - DNA, 22 bp, Homo sapiens
ggactgggcatgggtgctctgc

SEQ ID NO: 7813258 - DNA, 22 bp, Homo sapiens
ggactgggcatgggtgctctgc

SEQ ID NO: 7813259 - DNA, 22 bp, Homo sapiens
ggactgggcatgggtgctctgc

SEQ ID NO: 7813260 - DNA, 22 bp, Homo sapiens
ggactgggccaggggttggact

SEQ ID NO: 7813261 - DNA, 22 bp, Homo sapiens
ggactgggccaggggttggact

SEQ ID NO: 7813262 - DNA, 22 bp, Homo sapiens
ggactgggccaggggttggact

SEQ ID NO: 7813263 - DNA, 22 bp, Homo sapiens
ggactgggcatgggtgctctgc

SEQ ID NO: 7813264 - DNA, 20 bp, Homo sapiens
cacagactgtatgggcacca

SEQ ID NO: 7813265 - DNA, 20 bp, Homo sapiens
cacagactgtatgggcacca

SEQ ID NO: 7813266 - DNA, 22 bp, Homo sapiens
cacagactccccgccatagtgg

SEQ ID NO: 7813267 - DNA, 22 bp, Homo sapiens
cacagacagtgtccctttgttg

SEQ ID NO: 7813268 - DNA, 22 bp, Homo sapiens
cacagacagtgtccctttgttg

SEQ ID NO: 7813269 - DNA, 22 bp, Homo sapiens
cacagactccccgccatagtgg

SEQ ID NO: 7813270 - DNA, 22 bp, Homo sapiens
cacagaattaagggagaaatat

SEQ ID NO: 7813271 - DNA, 22 bp, Homo sapiens
cacagaattttctctttacaat

SEQ ID NO: 7813272 - DNA, 22 bp, Homo sapiens
cacagaattaagggagaaatat

SEQ ID NO: 7813273 - DNA, 22 bp, Homo sapiens
cacagacttgagaagcacctta

SEQ ID NO: 7813274 - DNA, 22 bp, Homo sapiens
cacagacttgagaagcacctta

SEQ ID NO: 7813275 - DNA, 22 bp, Homo sapiens
cacagacttgagaagcacctta

SEQ ID NO: 7813276 - DNA, 22 bp, Homo sapiens
cacagagaaaatgttggtgctt

SEQ ID NO: 7813277 - DNA, 22 bp, Homo sapiens
cacagagaaaatgttggtgctt

SEQ ID NO: 7813278 - DNA, 22 bp, Homo sapiens
ggactgggagaatggaggcaag

SEQ ID NO: 7813279 - DNA, 22 bp, Homo sapiens
ggactgggagaatggaggcaag

SEQ ID NO: 7813280 - DNA, 22 bp, Homo sapiens
ggactgggagaatggaggcaag

SEQ ID NO: 7813281 - DNA, 22 bp, Homo sapiens
cacagagaaaatgttggtgctt

SEQ ID NO: 7813282 - DNA, 22 bp, Homo sapiens
ggactgggagaatggaggcaag

SEQ ID NO: 7813283 - DNA, 22 bp, Homo sapiens
ggactgggagaatggaggcaag

SEQ ID NO: 7813284 - DNA, 22 bp, Homo sapiens
ggactgggagaatggaggcaag

SEQ ID NO: 7813285 - DNA, 22 bp, Homo sapiens
ggactgggagaatggaggcaag

SEQ ID NO: 7813286 - DNA, 22 bp, Homo sapiens
ggactgggagaatggaggcaag

SEQ ID NO: 7813287 - DNA, 22 bp, Homo sapiens
cacaggaatcagcattaatggc

SEQ ID NO: 7813288 - DNA, 22 bp, Homo sapiens
cacaggaatcagcattaatggc

SEQ ID NO: 7813289 - DNA, 22 bp, Homo sapiens
cacaggaatcagcattaatggc

SEQ ID NO: 7813290 - DNA, 22 bp, Homo sapiens
cacaggaatcgtcacttagcgc

SEQ ID NO: 7813291 - DNA, 22 bp, Homo sapiens
cacaggaatcgtcacttagcgc

SEQ ID NO: 7813292 - DNA, 22 bp, Homo sapiens
cacaggaatcgtcacttagcgc

SEQ ID NO: 7813293 - DNA, 22 bp, Homo sapiens
cacaggaatcgtcacttagcgc

SEQ ID NO: 7813294 - DNA, 22 bp, Homo sapiens
cacaggaatataagtttgagtt

SEQ ID NO: 7813295 - DNA, 22 bp, Homo sapiens
cacaggaatataagtttgagtt

SEQ ID NO: 7813296 - DNA, 22 bp, Homo sapiens
cacaggaatataagtttgagtt

SEQ ID NO: 7813297 - DNA, 22 bp, Homo sapiens
cacaggaataagtcaaacttca

SEQ ID NO: 7813298 - DNA, 22 bp, Homo sapiens
cacaggaataagtcaaacttca

SEQ ID NO: 7813299 - DNA, 22 bp, Homo sapiens
cacaggaaggccttctcacaat

SEQ ID NO: 7813300 - DNA, 18 bp, Homo sapiens
cacaggaaggggaatatc

SEQ ID NO: 7813301 - DNA, 18 bp, Homo sapiens
cacaggaaggggaatatc

SEQ ID NO: 7813302 - DNA, 22 bp, Homo sapiens
cacaggaagtggtcagtgccag

SEQ ID NO: 7813303 - DNA, 22 bp, Homo sapiens
cacaggaagtggtcagtgccag

SEQ ID NO: 7813304 - DNA, 22 bp, Homo sapiens
cacaggaagtggtcagtgccag

SEQ ID NO: 7813305 - DNA, 20 bp, Homo sapiens
ggagctggcatccagcctct

SEQ ID NO: 7813306 - DNA, 20 bp, Homo sapiens
ggagctggcatccagcctct

SEQ ID NO: 7813307 - DNA, 20 bp, Homo sapiens
ggagctggcatccagcctct

SEQ ID NO: 7813308 - DNA, 22 bp, Homo sapiens
cacagctttgctttccttaata

SEQ ID NO: 7813309 - DNA, 22 bp, Homo sapiens
cacagctttgctttccttaata

SEQ ID NO: 7813310 - DNA, 22 bp, Homo sapiens
cacaggaaggccttctcacaat

SEQ ID NO: 7813311 - DNA, 22 bp, Homo sapiens
cacaggaaaaatgggtccttta

SEQ ID NO: 7813312 - DNA, 22 bp, Homo sapiens
cacaggaaggccttctcacaat

SEQ ID NO: 7813313 - DNA, 22 bp, Homo sapiens
cacaggaatgaacagggaaaga

SEQ ID NO: 7813314 - DNA, 22 bp, Homo sapiens
cacaggaatgaacagggaaaga

SEQ ID NO: 7813315 - DNA, 22 bp, Homo sapiens
cacaggaatctgcattttgacc

SEQ ID NO: 7813316 - DNA, 22 bp, Homo sapiens
cacaggaatctgcattttgacc

SEQ ID NO: 7813317 - DNA, 22 bp, Homo sapiens
cacaggaatctgcattttgacc

SEQ ID NO: 7813318 - DNA, 22 bp, Homo sapiens
cacaggaatgaacagggaaaga

SEQ ID NO: 7813319 - DNA, 22 bp, Homo sapiens
cacaggaatctgcattttgacc

SEQ ID NO: 7813320 - DNA, 22 bp, Homo sapiens
cacaggaattagcagcctaaaa

SEQ ID NO: 7813321 - DNA, 22 bp, Homo sapiens
cacaggactcgactgcagacag

SEQ ID NO: 7813322 - DNA, 22 bp, Homo sapiens
cacaggactcgactgcagacag

SEQ ID NO: 7813323 - DNA, 22 bp, Homo sapiens
cacaggactcgactgcagacag

SEQ ID NO: 7813324 - DNA, 22 bp, Homo sapiens
cacaggactcgactgcagacag

SEQ ID NO: 7813325 - DNA, 22 bp, Homo sapiens
cacaggaattagcagcctaaaa

SEQ ID NO: 7813326 - DNA, 22 bp, Homo sapiens
cacaggaattagcagcctaaaa

SEQ ID NO: 7813327 - DNA, 22 bp, Homo sapiens
cacaggaccaattcacattcca

SEQ ID NO: 7813328 - DNA, 22 bp, Homo sapiens
ggaggcaggaaagacaggttca

SEQ ID NO: 7813329 - DNA, 22 bp, Homo sapiens
ggaggcagaatagagtgtgggt

SEQ ID NO: 7813330 - DNA, 22 bp, Homo sapiens
ggaggcagaatagagtgtgggt

SEQ ID NO: 7813331 - DNA, 22 bp, Homo sapiens
ggaggcagaatagagtgtgggt

SEQ ID NO: 7813332 - DNA, 22 bp, Homo sapiens
cacaggagaaaggggaagctcg

SEQ ID NO: 7813333 - DNA, 22 bp, Homo sapiens
cacaggagaaaggggaagctcg

SEQ ID NO: 7813334 - DNA, 22 bp, Homo sapiens
cacaggagaaaggggaagctcg

SEQ ID NO: 7813335 - DNA, 22 bp, Homo sapiens
cacaggagaaaggggaagctcg

SEQ ID NO: 7813336 - DNA, 22 bp, Homo sapiens
ggaggcagaatagagtgtgggt

SEQ ID NO: 7813337 - DNA, 22 bp, Homo sapiens
cacaggagaaaggggaagctcg

SEQ ID NO: 7813338 - DNA, 22 bp, Homo sapiens
ggaggcagaatagagtgtgggt

SEQ ID NO: 7813339 - DNA, 22 bp, Homo sapiens
ggaggccaaggcaggtggatca

SEQ ID NO: 7813340 - DNA, 22 bp, Homo sapiens
ggaggccaaggcaggcggatca

SEQ ID NO: 7813341 - DNA, 22 bp, Homo sapiens
ggaggccaaggcaggcggatca

SEQ ID NO: 7813342 - DNA, 20 bp, Homo sapiens
cacaggctatatgagagcca

SEQ ID NO: 7813343 - DNA, 20 bp, Homo sapiens
cacaggctatatgagagcca

SEQ ID NO: 7813344 - DNA, 20 bp, Homo sapiens
cacaggccttgtgagcagac

SEQ ID NO: 7813345 - DNA, 22 bp, Homo sapiens
ggaggccaaggaggagcttgcc

SEQ ID NO: 7813346 - DNA, 22 bp, Homo sapiens
ggaggccaaggagggcggatca

SEQ ID NO: 7813347 - DNA, 22 bp, Homo sapiens
ggaggccaaggagggcggatca

SEQ ID NO: 7813348 - DNA, 22 bp, Homo sapiens
ggaggccaaggaggagcttgcc

SEQ ID NO: 7813349 - DNA, 22 bp, Homo sapiens
ggaggccaaggaggagcttgcc

SEQ ID NO: 7813350 - DNA, 22 bp, Homo sapiens
ggaggccaaagtgtgggcggct

SEQ ID NO: 7813351 - DNA, 22 bp, Homo sapiens
ggaggccaaggaggagcttgcc

SEQ ID NO: 7813352 - DNA, 22 bp, Homo sapiens
ggaggccaaggaggagcttgcc

SEQ ID NO: 7813353 - DNA, 22 bp, Homo sapiens
ggaggccaaggaggagcttgcc

SEQ ID NO: 7813354 - DNA, 22 bp, Homo sapiens
ggaggccaaggaggagcttgcc

SEQ ID NO: 7813355 - DNA, 22 bp, Homo sapiens
ggaggccaaagtgtgggcggct

SEQ ID NO: 7813356 - DNA, 22 bp, Homo sapiens
ggaggccaaagtgtgggcggct

SEQ ID NO: 7813357 - DNA, 22 bp, Homo sapiens
ggaggcatctctgtggctgtct

SEQ ID NO: 7813358 - DNA, 22 bp, Homo sapiens
ggaggcatctctgtggctgtct

SEQ ID NO: 7813359 - DNA, 22 bp, Homo sapiens
ggaggcatctctgtggctgtct

SEQ ID NO: 7813360 - DNA, 22 bp, Homo sapiens
ggaggcattatggggaagactt

SEQ ID NO: 7813361 - DNA, 22 bp, Homo sapiens
ggaggcaggaaagacaggttca

SEQ ID NO: 7813362 - DNA, 22 bp, Homo sapiens
ggaggcaggaaagacaggttca

SEQ ID NO: 7813363 - DNA, 22 bp, Homo sapiens
cacaggcttgtcagcatgaggc

SEQ ID NO: 7813364 - DNA, 22 bp, Homo sapiens
cacaggcttgtcagcatgaggc

SEQ ID NO: 7813365 - DNA, 22 bp, Homo sapiens
cacaggcttgtcagcatgaggc

SEQ ID NO: 7813366 - DNA, 22 bp, Homo sapiens
cacaggcttgtcagcatgaggc

SEQ ID NO: 7813367 - DNA, 22 bp, Homo sapiens
cacaggcttttctgacataggc

SEQ ID NO: 7813368 - DNA, 22 bp, Homo sapiens
cacaggcttgtcagcatgaggc

SEQ ID NO: 7813369 - DNA, 22 bp, Homo sapiens
cacaggcttccagtccccagct

SEQ ID NO: 7813370 - DNA, 22 bp, Homo sapiens
cacaggcttccagtccccagct

SEQ ID NO: 7813371 - DNA, 22 bp, Homo sapiens
cacaggcttgtcagcatgaggc

SEQ ID NO: 7813372 - DNA, 22 bp, Homo sapiens
cacaggcttccagtccccagct

SEQ ID NO: 7813373 - DNA, 22 bp, Homo sapiens
cacaggcttccagtccccagct

SEQ ID NO: 7813374 - DNA, 22 bp, Homo sapiens
cacaggctgggaagcctaggcc

SEQ ID NO: 7813375 - DNA, 22 bp, Homo sapiens
cacaggctgggaagcctaggcc

SEQ ID NO: 7813376 - DNA, 20 bp, Homo sapiens
cacaggccttgtgagcagac

SEQ ID NO: 7813377 - DNA, 22 bp, Homo sapiens
ggagcctgacagtgcccagcat

SEQ ID NO: 7813378 - DNA, 22 bp, Homo sapiens
ggagcctgacagtgcccagcat

SEQ ID NO: 7813379 - DNA, 22 bp, Homo sapiens
ggagcctgacagtgcccagcat

SEQ ID NO: 7813380 - DNA, 23 bp, Homo sapiens
ggagcctccggtgtgtgagaggc

SEQ ID NO: 7813381 - DNA, 22 bp, Homo sapiens
ggagcctgaaaagtctgcattt

SEQ ID NO: 7813382 - DNA, 22 bp, Homo sapiens
ggagcctgaaaagtctgcattt

SEQ ID NO: 7813383 - DNA, 22 bp, Homo sapiens
ggagcctgacagtgcccagcat

SEQ ID NO: 7813384 - DNA, 22 bp, Homo sapiens
ggagcctgagcggcccagggcc

SEQ ID NO: 7813385 - DNA, 22 bp, Homo sapiens
ggagcctgacagtgcccagcat

SEQ ID NO: 7813386 - DNA, 22 bp, Homo sapiens
ggagcctgagcggcccagggcc

SEQ ID NO: 7813387 - DNA, 22 bp, Homo sapiens
ggagcctgagcggcccagggcc

SEQ ID NO: 7813388 - DNA, 22 bp, Homo sapiens
ggagcctgagggccctcttgga

SEQ ID NO: 7813389 - DNA, 22 bp, Homo sapiens
ggagcctgcgggagctcccatt

SEQ ID NO: 7813390 - DNA, 22 bp, Homo sapiens
ggagcctgcgggagctcccatt

SEQ ID NO: 7813391 - DNA, 22 bp, Homo sapiens
ggagcctgcgggagctcccatt

SEQ ID NO: 7813392 - DNA, 19 bp, Homo sapiens
ggagcctggagcacgtgcc

SEQ ID NO: 7813393 - DNA, 19 bp, Homo sapiens
ggagcctggagcacgtgcc

SEQ ID NO: 7813394 - DNA, 19 bp, Homo sapiens
ggagcctggagcacgtgcc

SEQ ID NO: 7813395 - DNA, 19 bp, Homo sapiens
ggagcctggagcacgtgcc

SEQ ID NO: 7813396 - DNA, 19 bp, Homo sapiens
ggagcctggagcacgtgcc

SEQ ID NO: 7813397 - DNA, 22 bp, Homo sapiens
ggagctgctccttcagccaagt

SEQ ID NO: 7813398 - DNA, 23 bp, Homo sapiens
ggagctgctgttgggggagctgc

SEQ ID NO: 7813399 - DNA, 23 bp, Homo sapiens
ggagctgctgttgggggagctgc

SEQ ID NO: 7813400 - DNA, 23 bp, Homo sapiens
ggagctgctgttgggggagctgc

SEQ ID NO: 7813401 - DNA, 23 bp, Homo sapiens
ggagctgctgttgggggagctgc

SEQ ID NO: 7813402 - DNA, 22 bp, Homo sapiens
ggagctggcagcgcaacccaga

SEQ ID NO: 7813403 - DNA, 20 bp, Homo sapiens
ggagctggcatccagcctct

SEQ ID NO: 7813404 - DNA, 22 bp, Homo sapiens
ggagctggcagcgcaacccaga

SEQ ID NO: 7813405 - DNA, 22 bp, Homo sapiens
ggagctggcagcgcaacccaga

SEQ ID NO: 7813406 - DNA, 20 bp, Homo sapiens
ggagctggcatccagcctct

SEQ ID NO: 7813407 - DNA, 20 bp, Homo sapiens
ggagctggcatccagcctct

SEQ ID NO: 7813408 - DNA, 20 bp, Homo sapiens
ggagctggcatccagcctct

SEQ ID NO: 7813409 - DNA, 20 bp, Homo sapiens
ggagctggcatccagcctct

SEQ ID NO: 7813410 - DNA, 20 bp, Homo sapiens
ggagctggcatccagcctct

SEQ ID NO: 7813411 - DNA, 22 bp, Homo sapiens
ggagctggcagcgcaacccaga

SEQ ID NO: 7813412 - DNA, 20 bp, Homo sapiens
ggagctggcatccagcctct

SEQ ID NO: 7813413 - DNA, 20 bp, Homo sapiens
ggagctggcatccagcctct

SEQ ID NO: 7813414 - DNA, 22 bp, Homo sapiens
ggagctggagagtacagagttt

SEQ ID NO: 7813415 - DNA, 22 bp, Homo sapiens
ggagctggagagtacagagttt

SEQ ID NO: 7813416 - DNA, 22 bp, Homo sapiens
ggagctggagagtacagagttt

SEQ ID NO: 7813417 - DNA, 22 bp, Homo sapiens
ggagctggagagtacagagttt

SEQ ID NO: 7813418 - DNA, 22 bp, Homo sapiens
ggagctggagagtacagagttt

SEQ ID NO: 7813419 - DNA, 22 bp, Homo sapiens
ggagctggcagcgcaacccaga

SEQ ID NO: 7813420 - DNA, 22 bp, Homo sapiens
ggagctggcagcgcaacccaga

SEQ ID NO: 7813421 - DNA, 22 bp, Homo sapiens
ggagctggcagcgcaacccaga

SEQ ID NO: 7813422 - DNA, 22 bp, Homo sapiens
ggagctggcagcgcaacccaga

SEQ ID NO: 7813423 - DNA, 22 bp, Homo sapiens
ggagctggagagctagcctagg

SEQ ID NO: 7813424 - DNA, 22 bp, Homo sapiens
ggagctggagagctagcctagg

SEQ ID NO: 7813425 - DNA, 22 bp, Homo sapiens
ggagctggagagctagcctagg

SEQ ID NO: 7813426 - DNA, 22 bp, Homo sapiens
ggagctggagagctagcctagg

SEQ ID NO: 7813427 - DNA, 22 bp, Homo sapiens
ggagctggagagtacagagttt

SEQ ID NO: 7813428 - DNA, 22 bp, Homo sapiens
ggagctggagagtacagagttt

SEQ ID NO: 7813429 - DNA, 22 bp, Homo sapiens
ggagctggagagctagcctagg

SEQ ID NO: 7813430 - DNA, 22 bp, Homo sapiens
ggagctggagagctagcctagg

SEQ ID NO: 7813431 - DNA, 22 bp, Homo sapiens
ggagctggagagctagcctagg

SEQ ID NO: 7813432 - DNA, 23 bp, Homo sapiens
ggagctggacccttacacctttc

SEQ ID NO: 7813433 - DNA, 23 bp, Homo sapiens
ggagctggacccttacacctttc

SEQ ID NO: 7813434 - DNA, 23 bp, Homo sapiens
ggagctggacccttacacctttc

SEQ ID NO: 7813435 - DNA, 23 bp, Homo sapiens
ggagctgctgttgggggagctgc

SEQ ID NO: 7813436 - DNA, 22 bp, Homo sapiens
ggagctgctttgatctgaagaa

SEQ ID NO: 7813437 - DNA, 22 bp, Homo sapiens
ggagctgcttcttgctgtgggt

SEQ ID NO: 7813438 - DNA, 22 bp, Homo sapiens
ggagctggaatatattgaaacc

SEQ ID NO: 7813439 - DNA, 23 bp, Homo sapiens
ggagctggacccttacacctttc

SEQ ID NO: 7813440 - DNA, 22 bp, Homo sapiens
ggagctgctttgatctgaagaa

SEQ ID NO: 7813441 - DNA, 22 bp, Homo sapiens
ggagctggaatatattgaaacc

SEQ ID NO: 7813442 - DNA, 22 bp, Homo sapiens
ggagccctgccctaggcagctc

SEQ ID NO: 7813443 - DNA, 22 bp, Homo sapiens
ggagccctgccctaggcagctc

SEQ ID NO: 7813444 - DNA, 22 bp, Homo sapiens
ggagcaggcagggccgtgtctg

SEQ ID NO: 7813445 - DNA, 22 bp, Homo sapiens
ggagcaggcagggccgtgtctg

SEQ ID NO: 7813446 - DNA, 22 bp, Homo sapiens
ggagccctccatcccttgcggc

SEQ ID NO: 7813447 - DNA, 22 bp, Homo sapiens
cacagatttcctaagcatcaat

SEQ ID NO: 7813448 - DNA, 22 bp, Homo sapiens
cacagattatgagacgagatac

SEQ ID NO: 7813449 - DNA, 22 bp, Homo sapiens
cacagatttctggtcttcaccc

SEQ ID NO: 7813450 - DNA, 22 bp, Homo sapiens
cacagattatgagacgagatac

SEQ ID NO: 7813451 - DNA, 22 bp, Homo sapiens
cacagatttcctaagcatcaat

SEQ ID NO: 7813452 - DNA, 22 bp, Homo sapiens
ggagcaggcagggccgtgtctg

SEQ ID NO: 7813453 - DNA, 22 bp, Homo sapiens
cacagcaaagacactctcaact

SEQ ID NO: 7813454 - DNA, 22 bp, Homo sapiens
ggagcaggcagggccgtgtctg

SEQ ID NO: 7813455 - DNA, 22 bp, Homo sapiens
ggagcaggcagggccgtgtctg

SEQ ID NO: 7813456 - DNA, 22 bp, Homo sapiens
ggagcaggcagggccgtgtctg

SEQ ID NO: 7813457 - DNA, 22 bp, Homo sapiens
ggagcccttgctgaccttccaa

SEQ ID NO: 7813458 - DNA, 22 bp, Homo sapiens
ggagcccttctattccatggag

SEQ ID NO: 7813459 - DNA, 22 bp, Homo sapiens
ggagcccttctattccatggag

SEQ ID NO: 7813460 - DNA, 22 bp, Homo sapiens
ggagccctgccctaggcagctc

SEQ ID NO: 7813461 - DNA, 22 bp, Homo sapiens
ggagccctgccctaggcagctc

SEQ ID NO: 7813462 - DNA, 19 bp, Homo sapiens
ggagccgccgcccttcatt

SEQ ID NO: 7813463 - DNA, 22 bp, Homo sapiens
ggagccggagggccactggcag

SEQ ID NO: 7813464 - DNA, 22 bp, Homo sapiens
ggagcccttggcacctagtagg

SEQ ID NO: 7813465 - DNA, 22 bp, Homo sapiens
cacagaggtgatagtggtcaag

SEQ ID NO: 7813466 - DNA, 20 bp, Homo sapiens
cacagagtcttgcagcgttc

SEQ ID NO: 7813467 - DNA, 22 bp, Homo sapiens
cacagagttgaatattgacatt

SEQ ID NO: 7813468 - DNA, 22 bp, Homo sapiens
cacagagtggaggcttggcctg

SEQ ID NO: 7813469 - DNA, 22 bp, Homo sapiens
cacagagttgaatattgacatt

SEQ ID NO: 7813470 - DNA, 22 bp, Homo sapiens
cacagaggtctgggcccagcag

SEQ ID NO: 7813471 - DNA, 22 bp, Homo sapiens
cacagaggtctgggcccagcag

SEQ ID NO: 7813472 - DNA, 22 bp, Homo sapiens
cacagaggtgatagtggtcaag

SEQ ID NO: 7813473 - DNA, 22 bp, Homo sapiens
cacagaggtgatagtggtcaag

SEQ ID NO: 7813474 - DNA, 22 bp, Homo sapiens
cacagaggtgatagtggtcaag

SEQ ID NO: 7813475 - DNA, 22 bp, Homo sapiens
cacagaggtgatagtggtcaag

SEQ ID NO: 7813476 - DNA, 19 bp, Homo sapiens
cacagatgattgacacata

SEQ ID NO: 7813477 - DNA, 19 bp, Homo sapiens
cacagatgattgacacata

SEQ ID NO: 7813478 - DNA, 20 bp, Homo sapiens
cacagatgggacaggaaagg

SEQ ID NO: 7813479 - DNA, 19 bp, Homo sapiens
cacagatgattgacacata

SEQ ID NO: 7813480 - DNA, 22 bp, Homo sapiens
cacagatgagctgaatagcttt

SEQ ID NO: 7813481 - DNA, 22 bp, Homo sapiens
cacagatagaccttatgagatt

SEQ ID NO: 7813482 - DNA, 22 bp, Homo sapiens
cacagatgaagtaaacaactct

SEQ ID NO: 7813483 - DNA, 22 bp, Homo sapiens
cacagatagaccttatgagatt

SEQ ID NO: 7813484 - DNA, 22 bp, Homo sapiens
cacagataaggatgttaatttt

SEQ ID NO: 7813485 - DNA, 22 bp, Homo sapiens
cacagatacctagtgaaacata

SEQ ID NO: 7813486 - DNA, 22 bp, Homo sapiens
cacagatacctagtgaaacata

SEQ ID NO: 7813487 - DNA, 22 bp, Homo sapiens
gctttgcacagtgctgtgttaa

SEQ ID NO: 7813488 - DNA, 22 bp, Homo sapiens
gctttgattcttggcttatcag

SEQ ID NO: 7813489 - DNA, 22 bp, Homo sapiens
gctttgaagacttttccagggt

SEQ ID NO: 7813490 - DNA, 22 bp, Homo sapiens
gctttgaagtctgtgtcttttg

SEQ ID NO: 7813491 - DNA, 22 bp, Homo sapiens
gctttgaagtctgtgtcttttg

SEQ ID NO: 7813492 - DNA, 21 bp, Homo sapiens
gctttgatgctgccttgctcc

SEQ ID NO: 7813493 - DNA, 22 bp, Homo sapiens
gctttgaagtctgtgtcttttg

SEQ ID NO: 7813494 - DNA, 22 bp, Homo sapiens
gctttgacactcgcccagccct

SEQ ID NO: 7813495 - DNA, 22 bp, Homo sapiens
gctttgaagacttttccagggt

SEQ ID NO: 7813496 - DNA, 22 bp, Homo sapiens
gctttcttgctgcatggtggct

SEQ ID NO: 7813497 - DNA, 22 bp, Homo sapiens
gctttgcattgtgatgggatgc

SEQ ID NO: 7813498 - DNA, 18 bp, Homo sapiens
gctttgcagaaatacaga

SEQ ID NO: 7813499 - DNA, 22 bp, Homo sapiens
gctttgcagacaaaattccagc

SEQ ID NO: 7813500 - DNA, 22 bp, Homo sapiens
gctttgcattcttgtgtgatca

SEQ ID NO: 7813501 - DNA, 18 bp, Homo sapiens
gctttgcagaaatacaga

SEQ ID NO: 7813502 - DNA, 18 bp, Homo sapiens
gctttgcactcatgttgt

SEQ ID NO: 7813503 - DNA, 18 bp, Homo sapiens
gctttgcactcatgttgt

SEQ ID NO: 7813504 - DNA, 18 bp, Homo sapiens
gctttgcagaaatacaga

SEQ ID NO: 7813505 - DNA, 22 bp, Homo sapiens
gctttgcactccagctgtggcc

SEQ ID NO: 7813506 - DNA, 22 bp, Homo sapiens
caatgtcaaggagaccaaaacg

SEQ ID NO: 7813507 - DNA, 22 bp, Homo sapiens
gctttgctagcactgcgcttcc

SEQ ID NO: 7813508 - DNA, 22 bp, Homo sapiens
gctttgctagcactgcgcttcc

SEQ ID NO: 7813509 - DNA, 22 bp, Homo sapiens
caatgtatcaagaagcatcagt

SEQ ID NO: 7813510 - DNA, 22 bp, Homo sapiens
caatgtctgaccgttttgccca

SEQ ID NO: 7813511 - DNA, 22 bp, Homo sapiens
caatgtctgaccgttttgccca

SEQ ID NO: 7813512 - DNA, 22 bp, Homo sapiens
caatgtcatgattttccattag

SEQ ID NO: 7813513 - DNA, 22 bp, Homo sapiens
caatgtctagtttcccaaatcc

SEQ ID NO: 7813514 - DNA, 22 bp, Homo sapiens
caatgtgtttgcatattaaaat

SEQ ID NO: 7813515 - DNA, 22 bp, Homo sapiens
caatgttccctgtactgctttt

SEQ ID NO: 7813516 - DNA, 22 bp, Homo sapiens
caatgttccctgtactgctttt

SEQ ID NO: 7813517 - DNA, 22 bp, Homo sapiens
caatgtttgtgatctactgact

SEQ ID NO: 7813518 - DNA, 22 bp, Homo sapiens
caatgtttgtgatctactgact

SEQ ID NO: 7813519 - DNA, 22 bp, Homo sapiens
caatgtcttctatagttactca

SEQ ID NO: 7813520 - DNA, 22 bp, Homo sapiens
caatgtctgggagacctgtgat

SEQ ID NO: 7813521 - DNA, 21 bp, Homo sapiens
caatgtctgctctctgcctag

SEQ ID NO: 7813522 - DNA, 21 bp, Homo sapiens
caatgtctgctctctgcctag

SEQ ID NO: 7813523 - DNA, 21 bp, Homo sapiens
caatgtctgctctctgcctag

SEQ ID NO: 7813524 - DNA, 22 bp, Homo sapiens
caatgtgtgtgtttttctcaac

SEQ ID NO: 7813525 - DNA, 22 bp, Homo sapiens
caatgtgtgtgtttttctcaac

SEQ ID NO: 7813526 - DNA, 18 bp, Homo sapiens
gctttctgtgcagcggag

SEQ ID NO: 7813527 - DNA, 18 bp, Homo sapiens
gctttctgtgcagcggag

SEQ ID NO: 7813528 - DNA, 22 bp, Homo sapiens
gctttctgtaggtagttactgt

SEQ ID NO: 7813529 - DNA, 18 bp, Homo sapiens
gctttctgtagaaaaggg

SEQ ID NO: 7813530 - DNA, 18 bp, Homo sapiens
gctttctgtagaaaaggg

SEQ ID NO: 7813531 - DNA, 22 bp, Homo sapiens
gctttctggtttgtgctacagg

SEQ ID NO: 7813532 - DNA, 21 bp, Homo sapiens
gctttctgtggactctgcacc

SEQ ID NO: 7813533 - DNA, 21 bp, Homo sapiens
gctttctgtggactctgcacc

SEQ ID NO: 7813534 - DNA, 22 bp, Homo sapiens
gctttctgtgcagtgaacacta

SEQ ID NO: 7813535 - DNA, 22 bp, Homo sapiens
gctttcttagtgtgttaattgg

SEQ ID NO: 7813536 - DNA, 22 bp, Homo sapiens
gctttcttagtgtgttaattgg

SEQ ID NO: 7813537 - DNA, 22 bp, Homo sapiens
gctttctgtggtgatgtaaagg

SEQ ID NO: 7813538 - DNA, 22 bp, Homo sapiens
gctttctggttctcaaagcact

SEQ ID NO: 7813539 - DNA, 22 bp, Homo sapiens
gctttctggtttgtgctacagg

SEQ ID NO: 7813540 - DNA, 22 bp, Homo sapiens
gctttctggttctcaaagcact

SEQ ID NO: 7813541 - DNA, 22 bp, Homo sapiens
gctttctgctctgtaaaatggg

SEQ ID NO: 7813542 - DNA, 22 bp, Homo sapiens
gctttctgggctatagaacggg

SEQ ID NO: 7813543 - DNA, 22 bp, Homo sapiens
gctttctggagcctgggggaac

SEQ ID NO: 7813544 - DNA, 17 bp, Homo sapiens
gcttgggctgcctgttg

SEQ ID NO: 7813545 - DNA, 22 bp, Homo sapiens
gcttgggcttaactgtaggttc

SEQ ID NO: 7813546 - DNA, 22 bp, Homo sapiens
gcttggggagctcagtgtcctt

SEQ ID NO: 7813547 - DNA, 22 bp, Homo sapiens
gcttggggagctcagtgtcctt

SEQ ID NO: 7813548 - DNA, 22 bp, Homo sapiens
gcttggggagctcagtgtcctt

SEQ ID NO: 7813549 - DNA, 22 bp, Homo sapiens
caagttttgattttgcagtaaa

SEQ ID NO: 7813550 - DNA, 22 bp, Homo sapiens
caagttttctgggttcagagca

SEQ ID NO: 7813551 - DNA, 22 bp, Homo sapiens
caagtttggattatgaaaaagt

SEQ ID NO: 7813552 - DNA, 22 bp, Homo sapiens
caagtttgtgttctatcattct

SEQ ID NO: 7813553 - DNA, 22 bp, Homo sapiens
caagtttgctgatccttgtttt

SEQ ID NO: 7813554 - DNA, 22 bp, Homo sapiens
caagtttacaatgtgtatgtgt

SEQ ID NO: 7813555 - DNA, 22 bp, Homo sapiens
caagttttgcatagttctgtat

SEQ ID NO: 7813556 - DNA, 21 bp, Homo sapiens
caataaactgcacattgagac

SEQ ID NO: 7813557 - DNA, 22 bp, Homo sapiens
caataaagaagatttttgcaat

SEQ ID NO: 7813558 - DNA, 21 bp, Homo sapiens
caataaactgcacattgagac

SEQ ID NO: 7813559 - DNA, 21 bp, Homo sapiens
caataaactgcacattgagac

SEQ ID NO: 7813560 - DNA, 22 bp, Homo sapiens
caagtcaactcaaattgttatc

SEQ ID NO: 7813561 - DNA, 22 bp, Homo sapiens
caagtcaactcaaattgttatc

SEQ ID NO: 7813562 - DNA, 22 bp, Homo sapiens
caagtcaactcaaattgttatc

SEQ ID NO: 7813563 - DNA, 22 bp, Homo sapiens
caagtcaaagactagaactagt

SEQ ID NO: 7813564 - DNA, 22 bp, Homo sapiens
caagtattttaaggactagtgg

SEQ ID NO: 7813565 - DNA, 22 bp, Homo sapiens
caagtattttaaggactagtgg

SEQ ID NO: 7813566 - DNA, 22 bp, Homo sapiens
caagtatttgcggagttccacg

SEQ ID NO: 7813567 - DNA, 22 bp, Homo sapiens
gctgtggcggcagcagctggtg

SEQ ID NO: 7813568 - DNA, 22 bp, Homo sapiens
gctgtggcggcagcagctggtg

SEQ ID NO: 7813569 - DNA, 22 bp, Homo sapiens
gctgtggcctggcgcagagctg

SEQ ID NO: 7813570 - DNA, 22 bp, Homo sapiens
caagtcaatacctgtggacaaa

SEQ ID NO: 7813571 - DNA, 22 bp, Homo sapiens
caagtcaagcatgcccttattt

SEQ ID NO: 7813572 - DNA, 22 bp, Homo sapiens
caagtcaagcatgcccttattt

SEQ ID NO: 7813573 - DNA, 22 bp, Homo sapiens
gctgttcagatgcgattcagga

SEQ ID NO: 7813574 - DNA, 22 bp, Homo sapiens
gctgttcagggcactcatgggc

SEQ ID NO: 7813575 - DNA, 22 bp, Homo sapiens
gctgttcccttgtgcctctgtc

SEQ ID NO: 7813576 - DNA, 22 bp, Homo sapiens
gctgttcattagaaatagaatg

SEQ ID NO: 7813577 - DNA, 22 bp, Homo sapiens
gctgttcacagactctgctctg

SEQ ID NO: 7813578 - DNA, 22 bp, Homo sapiens
gctgttcacagactctgctctg

SEQ ID NO: 7813579 - DNA, 19 bp, Homo sapiens
gctgttaaggaccctcgga

SEQ ID NO: 7813580 - DNA, 22 bp, Homo sapiens
gctgtgttttatgttaggttaa

SEQ ID NO: 7813581 - DNA, 22 bp, Homo sapiens
caagtttaaggcactgataagt

SEQ ID NO: 7813582 - DNA, 22 bp, Homo sapiens
caagtttacaatgtgtatgtgt

SEQ ID NO: 7813583 - DNA, 21 bp, Homo sapiens
gctgttgcccgccgcctcttc

SEQ ID NO: 7813584 - DNA, 22 bp, Homo sapiens
gctgttgcaatcaaggccatgg

SEQ ID NO: 7813585 - DNA, 22 bp, Homo sapiens
gctgttctttggtcaaaggtat

SEQ ID NO: 7813586 - DNA, 22 bp, Homo sapiens
gctgttctttcagcccagggct

SEQ ID NO: 7813587 - DNA, 22 bp, Homo sapiens
gctgttctttcagcccagggct

SEQ ID NO: 7813588 - DNA, 18 bp, Homo sapiens
gctgttcttcgcactggc

SEQ ID NO: 7813589 - DNA, 22 bp, Homo sapiens
gctgttctttgcatctctggtg

SEQ ID NO: 7813590 - DNA, 21 bp, Homo sapiens
gctgttctttcagctggtctt

SEQ ID NO: 7813591 - DNA, 21 bp, Homo sapiens
gctgttctttcagctggtctt

SEQ ID NO: 7813592 - DNA, 22 bp, Homo sapiens
gctgttctaggagctgtgagca

SEQ ID NO: 7813593 - DNA, 22 bp, Homo sapiens
gctgttctagcttcagtttcgc

SEQ ID NO: 7813594 - DNA, 20 bp, Homo sapiens
gctgttctgaagcagaaggc

SEQ ID NO: 7813595 - DNA, 22 bp, Homo sapiens
gctgttctctgtaacatgcatt

SEQ ID NO: 7813596 - DNA, 22 bp, Homo sapiens
gctgttctaggagctgtgagca

SEQ ID NO: 7813597 - DNA, 22 bp, Homo sapiens
gctgttctgtccccatgggtaa

SEQ ID NO: 7813598 - DNA, 22 bp, Homo sapiens
gctgttctgtccccatgggtaa

SEQ ID NO: 7813599 - DNA, 22 bp, Homo sapiens
gctgttctgtccccatgggtaa

SEQ ID NO: 7813600 - DNA, 22 bp, Homo sapiens
gctgttctgcgtcccaggctgg

SEQ ID NO: 7813601 - DNA, 22 bp, Homo sapiens
gctgttctgcgtcccaggctgg

SEQ ID NO: 7813602 - DNA, 22 bp, Homo sapiens
gctgttctgcaccagacttcag

SEQ ID NO: 7813603 - DNA, 19 bp, Homo sapiens
gctgttctgaccatcaccc

SEQ ID NO: 7813604 - DNA, 19 bp, Homo sapiens
gctgttctgaccatcaccc

SEQ ID NO: 7813605 - DNA, 22 bp, Homo sapiens
caaggtgccatgctgggcgggg

SEQ ID NO: 7813606 - DNA, 22 bp, Homo sapiens
caaggtgccatgctgggcgggg

SEQ ID NO: 7813607 - DNA, 22 bp, Homo sapiens
caaggtgccatgctgggcgggg

SEQ ID NO: 7813608 - DNA, 22 bp, Homo sapiens
caaggtgccatgctgggcgggg

SEQ ID NO: 7813609 - DNA, 22 bp, Homo sapiens
caaggtgccatgctgggcgggg

SEQ ID NO: 7813610 - DNA, 22 bp, Homo sapiens
caaggtgccatgctgggcgggg

SEQ ID NO: 7813611 - DNA, 22 bp, Homo sapiens
caaggttattatgtgcatctgt

SEQ ID NO: 7813612 - DNA, 22 bp, Homo sapiens
caaggttctatagcaaaatctg

SEQ ID NO: 7813613 - DNA, 22 bp, Homo sapiens
caaggttctatagcaaaatctg

SEQ ID NO: 7813614 - DNA, 20 bp, Homo sapiens
caagggtttgcattggcttt

SEQ ID NO: 7813615 - DNA, 22 bp, Homo sapiens
caaggtcacataacttgtcaaa

SEQ ID NO: 7813616 - DNA, 22 bp, Homo sapiens
caaggtaagcgagagatgaggt

SEQ ID NO: 7813617 - DNA, 22 bp, Homo sapiens
caaggtcacataacttgtcaaa

SEQ ID NO: 7813618 - DNA, 22 bp, Homo sapiens
caaggtcacataacttgtcaaa

SEQ ID NO: 7813619 - DNA, 22 bp, Homo sapiens
caaggtctggttcctctgggtg

SEQ ID NO: 7813620 - DNA, 22 bp, Homo sapiens
caaggtgcagctggctgtgtga

SEQ ID NO: 7813621 - DNA, 22 bp, Homo sapiens
caaggtgattgggatagctggt

SEQ ID NO: 7813622 - DNA, 22 bp, Homo sapiens
caaggtgccatgctgggcgggg

SEQ ID NO: 7813623 - DNA, 22 bp, Homo sapiens
caaggtgccatgctgggcgggg

SEQ ID NO: 7813624 - DNA, 22 bp, Homo sapiens
caaggtgccatgctgggcgggg

SEQ ID NO: 7813625 - DNA, 22 bp, Homo sapiens
caaggtgccatgctgggcgggg

SEQ ID NO: 7813626 - DNA, 22 bp, Homo sapiens
caaggtgattgggatagctggt

SEQ ID NO: 7813627 - DNA, 22 bp, Homo sapiens
caagtaaagaatcacatttctt

SEQ ID NO: 7813628 - DNA, 22 bp, Homo sapiens
caagtaaagaatcacatttctt

SEQ ID NO: 7813629 - DNA, 22 bp, Homo sapiens
caagtaaatgtgaactggaagg

SEQ ID NO: 7813630 - DNA, 22 bp, Homo sapiens
caagtaaatgtgaactggaagg

SEQ ID NO: 7813631 - DNA, 22 bp, Homo sapiens
caagtaaacaatatgtgattca

SEQ ID NO: 7813632 - DNA, 22 bp, Homo sapiens
caagtacaaaatgatatttagt

SEQ ID NO: 7813633 - DNA, 22 bp, Homo sapiens
caagtacaaaatgatatttagt

SEQ ID NO: 7813634 - DNA, 22 bp, Homo sapiens
caagtacaaaatgatatttagt

SEQ ID NO: 7813635 - DNA, 22 bp, Homo sapiens
caagtacaaaatgatatttagt

SEQ ID NO: 7813636 - DNA, 22 bp, Homo sapiens
caagtaatggttttataatagt

SEQ ID NO: 7813637 - DNA, 22 bp, Homo sapiens
caagtaacttgattaaggtaag

SEQ ID NO: 7813638 - DNA, 22 bp, Homo sapiens
caagtaatggttttataatagt

SEQ ID NO: 7813639 - DNA, 22 bp, Homo sapiens
caagtattctgtaaaaagtcaa

SEQ ID NO: 7813640 - DNA, 22 bp, Homo sapiens
caagtagttgacatttatggag

SEQ ID NO: 7813641 - DNA, 22 bp, Homo sapiens
caagtatatttgaacatgtaaa

SEQ ID NO: 7813642 - DNA, 22 bp, Homo sapiens
caagtacaatagctctggaact

SEQ ID NO: 7813643 - DNA, 22 bp, Homo sapiens
caagtacaagggtgtcagttta

SEQ ID NO: 7813644 - DNA, 22 bp, Homo sapiens
caagtacaatagctctggaact

SEQ ID NO: 7813645 - DNA, 22 bp, Homo sapiens
caagtactttgaaaagttgaat

SEQ ID NO: 7813646 - DNA, 22 bp, Homo sapiens
caagtactgtgatagctgaagt

SEQ ID NO: 7813647 - DNA, 22 bp, Homo sapiens
caagtagaaggatgtgattgta

SEQ ID NO: 7813648 - DNA, 22 bp, Homo sapiens
caagtactttgaaaagttgaat

SEQ ID NO: 7813649 - DNA, 22 bp, Homo sapiens
caagtagaacagagctaccttg

SEQ ID NO: 7813650 - DNA, 22 bp, Homo sapiens
caagtagagattacagtgtgca

SEQ ID NO: 7813651 - DNA, 22 bp, Homo sapiens
caagcatactgtgagagtttta

SEQ ID NO: 7813652 - DNA, 22 bp, Homo sapiens
caagcatgtcttcttaagcaat

SEQ ID NO: 7813653 - DNA, 22 bp, Homo sapiens
caagcatactgtgagagtttta

SEQ ID NO: 7813654 - DNA, 22 bp, Homo sapiens
caagcatactgtgagagtttta

SEQ ID NO: 7813655 - DNA, 22 bp, Homo sapiens
caagcatactgtgagagtttta

SEQ ID NO: 7813656 - DNA, 21 bp, Homo sapiens
caagccagaccaatagcagcc

SEQ ID NO: 7813657 - DNA, 22 bp, Homo sapiens
caagcatttattataattatca

SEQ ID NO: 7813658 - DNA, 22 bp, Homo sapiens
caagcatgtcttcttaagcaat

SEQ ID NO: 7813659 - DNA, 22 bp, Homo sapiens
caagcaggtcctgaatctggtc

SEQ ID NO: 7813660 - DNA, 22 bp, Homo sapiens
caagcaggtttgctattttctt

SEQ ID NO: 7813661 - DNA, 22 bp, Homo sapiens
caagcaggtcctgaatctggtc

SEQ ID NO: 7813662 - DNA, 22 bp, Homo sapiens
caagcagggtttatgcatggag

SEQ ID NO: 7813663 - DNA, 22 bp, Homo sapiens
caagcagggtttatgcatggag

SEQ ID NO: 7813664 - DNA, 22 bp, Homo sapiens
caagcagggatactgcagggag

SEQ ID NO: 7813665 - DNA, 22 bp, Homo sapiens
caagcagggatactgcagggag

SEQ ID NO: 7813666 - DNA, 22 bp, Homo sapiens
caagcagggatactgcagggag

SEQ ID NO: 7813667 - DNA, 22 bp, Homo sapiens
caagccagtcagctcagtagat

SEQ ID NO: 7813668 - DNA, 22 bp, Homo sapiens
caagccagtcagctcagtagat

SEQ ID NO: 7813669 - DNA, 22 bp, Homo sapiens
caagccagtcagctcagtagat

SEQ ID NO: 7813670 - DNA, 22 bp, Homo sapiens
caagccagtgacagccagggaa

SEQ ID NO: 7813671 - DNA, 22 bp, Homo sapiens
caagccaggtgaacataacaag

SEQ ID NO: 7813672 - DNA, 22 bp, Homo sapiens
caagccaggtgaacataacaag

SEQ ID NO: 7813673 - DNA, 22 bp, Homo sapiens
caagccaggtgaacataacaag

SEQ ID NO: 7813674 - DNA, 20 bp, Homo sapiens
caagccaggccctgctgctg

SEQ ID NO: 7813675 - DNA, 22 bp, Homo sapiens
caagccaggaaggatccagcac

SEQ ID NO: 7813676 - DNA, 22 bp, Homo sapiens
caagccagcttgatgacctgtc

SEQ ID NO: 7813677 - DNA, 22 bp, Homo sapiens
caagccagcttgatgacctgtc

SEQ ID NO: 7813678 - DNA, 22 bp, Homo sapiens
caagccagctcctgccacagag

SEQ ID NO: 7813679 - DNA, 22 bp, Homo sapiens
caagccagctcctgccacagag

SEQ ID NO: 7813680 - DNA, 22 bp, Homo sapiens
caagccagctcctgccacagag

SEQ ID NO: 7813681 - DNA, 22 bp, Homo sapiens
caagccagctcctgccacagag

SEQ ID NO: 7813682 - DNA, 22 bp, Homo sapiens
caagccagagagcaactgttct

SEQ ID NO: 7813683 - DNA, 22 bp, Homo sapiens
caagccagagagcaactgttct

SEQ ID NO: 7813684 - DNA, 22 bp, Homo sapiens
caagccagcagtttaatgactc

SEQ ID NO: 7813685 - DNA, 22 bp, Homo sapiens
caagccagcagtttaatgactc

SEQ ID NO: 7813686 - DNA, 22 bp, Homo sapiens
gctggaggaggaagtgtgaggg

SEQ ID NO: 7813687 - DNA, 22 bp, Homo sapiens
gctggaggaggaagtgtgaggg

SEQ ID NO: 7813688 - DNA, 22 bp, Homo sapiens
gctggaggaggaagtgtgaggg

SEQ ID NO: 7813689 - DNA, 22 bp, Homo sapiens
gctggaggaggaagtgtgaggg

SEQ ID NO: 7813690 - DNA, 22 bp, Homo sapiens
gctggaggaggaagtgtgaggg

SEQ ID NO: 7813691 - DNA, 22 bp, Homo sapiens
gctggaggaggaagtgtgaggg

SEQ ID NO: 7813692 - DNA, 22 bp, Homo sapiens
gctggaggaggaagtgtgaggg

SEQ ID NO: 7813693 - DNA, 22 bp, Homo sapiens
caagccagtgacagccagggaa

SEQ ID NO: 7813694 - DNA, 22 bp, Homo sapiens
caagccagtgacagccagggaa

SEQ ID NO: 7813695 - DNA, 22 bp, Homo sapiens
caagccagtgacagccagggaa

SEQ ID NO: 7813696 - DNA, 22 bp, Homo sapiens
caagccagtgatgtttgctgcc

SEQ ID NO: 7813697 - DNA, 22 bp, Homo sapiens
caagccagtgatgtttgctgcc

SEQ ID NO: 7813698 - DNA, 22 bp, Homo sapiens
caagccagtgacagccagggaa

SEQ ID NO: 7813699 - DNA, 22 bp, Homo sapiens
caagccagtttgtagttctctc

SEQ ID NO: 7813700 - DNA, 22 bp, Homo sapiens
caagccagtttgtagttctctc

SEQ ID NO: 7813701 - DNA, 22 bp, Homo sapiens
gctggaggaggaagtgtgaggg

SEQ ID NO: 7813702 - DNA, 22 bp, Homo sapiens
gctggaggatcacttgagccca

SEQ ID NO: 7813703 - DNA, 22 bp, Homo sapiens
gctggaggatggactggaagaa

SEQ ID NO: 7813704 - DNA, 22 bp, Homo sapiens
gctggaggatggactggaagaa

SEQ ID NO: 7813705 - DNA, 22 bp, Homo sapiens
gctggaggatggactggaagaa

SEQ ID NO: 7813706 - DNA, 22 bp, Homo sapiens
gctggaggatcacttgagccca

SEQ ID NO: 7813707 - DNA, 22 bp, Homo sapiens
gctggaggatggactggaagaa

SEQ ID NO: 7813708 - DNA, 22 bp, Homo sapiens
gctggaggatggactggaagaa

SEQ ID NO: 7813709 - DNA, 22 bp, Homo sapiens
gctggaggatggactggaagaa

SEQ ID NO: 7813710 - DNA, 22 bp, Homo sapiens
gctggaggatggactggaagaa

SEQ ID NO: 7813711 - DNA, 22 bp, Homo sapiens
gctggaggatggactggaagaa

SEQ ID NO: 7813712 - DNA, 22 bp, Homo sapiens
gctggaggatggactggaagaa

SEQ ID NO: 7813713 - DNA, 22 bp, Homo sapiens
gctggaggatggactggaagaa

SEQ ID NO: 7813714 - DNA, 22 bp, Homo sapiens
gctggaggatggactggaagaa

SEQ ID NO: 7813715 - DNA, 22 bp, Homo sapiens
gctggaggatggactggaagaa

SEQ ID NO: 7813716 - DNA, 22 bp, Homo sapiens
gctggaggatggactggaagaa

SEQ ID NO: 7813717 - DNA, 22 bp, Homo sapiens
caaatgtgtaaggaagtgttag

SEQ ID NO: 7813718 - DNA, 22 bp, Homo sapiens
caagattatcttcttcttgtta

SEQ ID NO: 7813719 - DNA, 22 bp, Homo sapiens
caagattatcttcttcttgtta

SEQ ID NO: 7813720 - DNA, 22 bp, Homo sapiens
caaatgtgtaaggaagtgttag

SEQ ID NO: 7813721 - DNA, 22 bp, Homo sapiens
caaatgtggtttctcagcattc

SEQ ID NO: 7813722 - DNA, 22 bp, Homo sapiens
caaatgtggtttctcagcattc

SEQ ID NO: 7813723 - DNA, 22 bp, Homo sapiens
caaatgtattctcacttcaggg

SEQ ID NO: 7813724 - DNA, 22 bp, Homo sapiens
caaatgtattctcacttcaggg

SEQ ID NO: 7813725 - DNA, 22 bp, Homo sapiens
caaatgtattctcacttcaggg

SEQ ID NO: 7813726 - DNA, 22 bp, Homo sapiens
caaatgtgacttttgggcttct

SEQ ID NO: 7813727 - DNA, 22 bp, Homo sapiens
caaatgtggtttctcagcattc

SEQ ID NO: 7813728 - DNA, 22 bp, Homo sapiens
caagcagccccaacatgaggat

SEQ ID NO: 7813729 - DNA, 22 bp, Homo sapiens
caagcagccccaacatgaggat

SEQ ID NO: 7813730 - DNA, 22 bp, Homo sapiens
caagcagccccaacatgaggat

SEQ ID NO: 7813731 - DNA, 22 bp, Homo sapiens
caagcagccccaacatgaggat

SEQ ID NO: 7813732 - DNA, 22 bp, Homo sapiens
caagattcagccctcctgacct

SEQ ID NO: 7813733 - DNA, 22 bp, Homo sapiens
caagatttaagagtcagccttg

SEQ ID NO: 7813734 - DNA, 22 bp, Homo sapiens
caagcaggatgaagcccaggga

SEQ ID NO: 7813735 - DNA, 22 bp, Homo sapiens
caagcaggatgaagcccaggga

SEQ ID NO: 7813736 - DNA, 22 bp, Homo sapiens
caagcaggatgaagcccaggga

SEQ ID NO: 7813737 - DNA, 22 bp, Homo sapiens
caagcaggatgaagcccaggga

SEQ ID NO: 7813738 - DNA, 22 bp, Homo sapiens
caagcaggatgaagcccaggga

SEQ ID NO: 7813739 - DNA, 22 bp, Homo sapiens
caagcaggaggagaagtttctg

SEQ ID NO: 7813740 - DNA, 22 bp, Homo sapiens
caagcaggaggagaagtttctg

SEQ ID NO: 7813741 - DNA, 22 bp, Homo sapiens
caagcagggagcatcaagggag

SEQ ID NO: 7813742 - DNA, 22 bp, Homo sapiens
caagcaggcctggctggaccgt

SEQ ID NO: 7813743 - DNA, 19 bp, Homo sapiens
caaatgggacaggaaggca

SEQ ID NO: 7813744 - DNA, 22 bp, Homo sapiens
caaatgtaaattcttttgaagc

SEQ ID NO: 7813745 - DNA, 22 bp, Homo sapiens
caaatgtaaattcttttgaagc

SEQ ID NO: 7813746 - DNA, 22 bp, Homo sapiens
caaatggtcatttctcttttgt

SEQ ID NO: 7813747 - DNA, 22 bp, Homo sapiens
caaatgtaaattcttttgaagc

SEQ ID NO: 7813748 - DNA, 22 bp, Homo sapiens
caaatgtaatggcaggttttgc

SEQ ID NO: 7813749 - DNA, 22 bp, Homo sapiens
caaatgtaatggcaggttttgc

SEQ ID NO: 7813750 - DNA, 22 bp, Homo sapiens
caaatgtaatggcaggttttgc

SEQ ID NO: 7813751 - DNA, 22 bp, Homo sapiens
caaatgtaatggcaggttttgc

SEQ ID NO: 7813752 - DNA, 22 bp, Homo sapiens
caaatgtaaattcttttgaagc

SEQ ID NO: 7813753 - DNA, 22 bp, Homo sapiens
caaatgtaataaggagtttccc

SEQ ID NO: 7813754 - DNA, 22 bp, Homo sapiens
caaatgtaataaggagtttccc

SEQ ID NO: 7813755 - DNA, 22 bp, Homo sapiens
caaatgtaataaggagtttccc

SEQ ID NO: 7813756 - DNA, 22 bp, Homo sapiens
caaatgtataaatgtactttct

SEQ ID NO: 7813757 - DNA, 23 bp, Homo sapiens
caaatgtagtgtgtccacccctg

SEQ ID NO: 7813758 - DNA, 22 bp, Homo sapiens
caaatgtataaatgtactttct

SEQ ID NO: 7813759 - DNA, 23 bp, Homo sapiens
caaatgtagtgtgtccacccctg

SEQ ID NO: 7813760 - DNA, 23 bp, Homo sapiens
caaatgtagtgtgtccacccctg

SEQ ID NO: 7813761 - DNA, 22 bp, Homo sapiens
caaatgtataaatgtactttct

SEQ ID NO: 7813762 - DNA, 22 bp, Homo sapiens
caaatgtataaatgtactttct

SEQ ID NO: 7813763 - DNA, 22 bp, Homo sapiens
caaatgtaattgcggtttttgc

SEQ ID NO: 7813764 - DNA, 22 bp, Homo sapiens
caaatgtaattgcggtttttgc

SEQ ID NO: 7813765 - DNA, 22 bp, Homo sapiens
caaatgtaattgcggtttttgc

SEQ ID NO: 7813766 - DNA, 22 bp, Homo sapiens
caaatgtaattgcggtttttgc

SEQ ID NO: 7813767 - DNA, 22 bp, Homo sapiens
caaatgtatcagcccagggatt

SEQ ID NO: 7813768 - DNA, 22 bp, Homo sapiens
caaatgtatcagcccagggatt

SEQ ID NO: 7813769 - DNA, 22 bp, Homo sapiens
caaatgtatcagcccagggatt

SEQ ID NO: 7813770 - DNA, 22 bp, Homo sapiens
caaatgtataaatgtactttct

SEQ ID NO: 7813771 - DNA, 22 bp, Homo sapiens
caaatgtataaatgtactttct

SEQ ID NO: 7813772 - DNA, 22 bp, Homo sapiens
caaatgtatgttttcctatgta

SEQ ID NO: 7813773 - DNA, 22 bp, Homo sapiens
caaatgtatgttttcctatgta

SEQ ID NO: 7813774 - DNA, 22 bp, Homo sapiens
caaatgtatgttttcctatgta

SEQ ID NO: 7813775 - DNA, 22 bp, Homo sapiens
caaatgtatgttttcctatgta

SEQ ID NO: 7813776 - DNA, 22 bp, Homo sapiens
caaatgtatcagcccagggatt

SEQ ID NO: 7813777 - DNA, 22 bp, Homo sapiens
caaatgtatgttttcctatgta

SEQ ID NO: 7813778 - DNA, 22 bp, Homo sapiens
caaggccttcgtctcctagctt

SEQ ID NO: 7813779 - DNA, 22 bp, Homo sapiens
caaggccttcttgggagagatt

SEQ ID NO: 7813780 - DNA, 22 bp, Homo sapiens
gctggctggctgtgcaaaggca

SEQ ID NO: 7813781 - DNA, 22 bp, Homo sapiens
gctggctggctgtgcaaaggca

SEQ ID NO: 7813782 - DNA, 22 bp, Homo sapiens
gctggctggctgtgcaaaggca

SEQ ID NO: 7813783 - DNA, 22 bp, Homo sapiens
gctggctggctgtgcaaaggca

SEQ ID NO: 7813784 - DNA, 22 bp, Homo sapiens
gctggctggctgtgcaaaggca

SEQ ID NO: 7813785 - DNA, 22 bp, Homo sapiens
gctggctgggacagattccatt

SEQ ID NO: 7813786 - DNA, 22 bp, Homo sapiens
gctggctgggacagattccatt

SEQ ID NO: 7813787 - DNA, 22 bp, Homo sapiens
gctggctgggacagattccatt

SEQ ID NO: 7813788 - DNA, 22 bp, Homo sapiens
gctggctgggtccctgagaggc

SEQ ID NO: 7813789 - DNA, 22 bp, Homo sapiens
gctggctgggtccctgagaggc

SEQ ID NO: 7813790 - DNA, 22 bp, Homo sapiens
gctggctgggtccctgagaggc

SEQ ID NO: 7813791 - DNA, 22 bp, Homo sapiens
gctggctgggtccctgagaggc

SEQ ID NO: 7813792 - DNA, 22 bp, Homo sapiens
gctggctgtatcacctggccag

SEQ ID NO: 7813793 - DNA, 22 bp, Homo sapiens
gctggctgtatcacctggccag

SEQ ID NO: 7813794 - DNA, 22 bp, Homo sapiens
gctggctgtatcacctggccag

SEQ ID NO: 7813795 - DNA, 22 bp, Homo sapiens
gctggctgtatcacctggccag

SEQ ID NO: 7813796 - DNA, 22 bp, Homo sapiens
gctggctggtccagcaggggct

SEQ ID NO: 7813797 - DNA, 22 bp, Homo sapiens
gctggctggtccagcaggggct

SEQ ID NO: 7813798 - DNA, 22 bp, Homo sapiens
gctggctgtatcacctggccag

SEQ ID NO: 7813799 - DNA, 22 bp, Homo sapiens
gctggctgggtccctgagaggc

SEQ ID NO: 7813800 - DNA, 22 bp, Homo sapiens
gctggctgggtccctgagaggc

SEQ ID NO: 7813801 - DNA, 22 bp, Homo sapiens
gctggctgggtccctgagaggc

SEQ ID NO: 7813802 - DNA, 22 bp, Homo sapiens
gctggctggtccagcaggggct

SEQ ID NO: 7813803 - DNA, 22 bp, Homo sapiens
gctggctgggtccctgagaggc

SEQ ID NO: 7813804 - DNA, 22 bp, Homo sapiens
gctggctgtatcacctggccag

SEQ ID NO: 7813805 - DNA, 22 bp, Homo sapiens
gctggctgtatcacctggccag

SEQ ID NO: 7813806 - DNA, 21 bp, Homo sapiens
gctggctgtcccagggaagca

SEQ ID NO: 7813807 - DNA, 21 bp, Homo sapiens
gctggctgtcccagggaagca

SEQ ID NO: 7813808 - DNA, 22 bp, Homo sapiens
caaggcttggagagaatgccat

SEQ ID NO: 7813809 - DNA, 22 bp, Homo sapiens
caagggaagaggacagggacct

SEQ ID NO: 7813810 - DNA, 22 bp, Homo sapiens
caagggaagaggacagggacct

SEQ ID NO: 7813811 - DNA, 22 bp, Homo sapiens
caaggcttattttcctccttcc

SEQ ID NO: 7813812 - DNA, 22 bp, Homo sapiens
caaggcttcacgtccccagtgc

SEQ ID NO: 7813813 - DNA, 22 bp, Homo sapiens
caaggcttatcagccaggagcc

SEQ ID NO: 7813814 - DNA, 21 bp, Homo sapiens
gctggctgtcccagggaagca

SEQ ID NO: 7813815 - DNA, 20 bp, Homo sapiens
caagggtttgcattggcttt

SEQ ID NO: 7813816 - DNA, 19 bp, Homo sapiens
caagggttgggtctgtcat

SEQ ID NO: 7813817 - DNA, 22 bp, Homo sapiens
caagggtggtattgggagcata

SEQ ID NO: 7813818 - DNA, 22 bp, Homo sapiens
caagggttctgtgcctcctgct

SEQ ID NO: 7813819 - DNA, 22 bp, Homo sapiens
caagggtgaaggctcctccagg

SEQ ID NO: 7813820 - DNA, 22 bp, Homo sapiens
caagggtgaaggctcctccagg

SEQ ID NO: 7813821 - DNA, 22 bp, Homo sapiens
caagggtggaaatatttttaag

SEQ ID NO: 7813822 - DNA, 19 bp, Homo sapiens
caagggtcatgacaggaac

SEQ ID NO: 7813823 - DNA, 22 bp, Homo sapiens
caagggggcaggatcacacttg

SEQ ID NO: 7813824 - DNA, 22 bp, Homo sapiens
caaggcctatgcacacctagga

SEQ ID NO: 7813825 - DNA, 22 bp, Homo sapiens
caaggcctaatcatactgctaa

SEQ ID NO: 7813826 - DNA, 22 bp, Homo sapiens
caaggcctgactgcttgtctaa

SEQ ID NO: 7813827 - DNA, 22 bp, Homo sapiens
caaggcctgcctctggcagaaa

SEQ ID NO: 7813828 - DNA, 22 bp, Homo sapiens
caaggccctgcaacctgacttg

SEQ ID NO: 7813829 - DNA, 22 bp, Homo sapiens
caaggcctaatcatactgctaa

SEQ ID NO: 7813830 - DNA, 22 bp, Homo sapiens
caaggccctgcaacctgacttg

SEQ ID NO: 7813831 - DNA, 22 bp, Homo sapiens
caaggccatgagcagcgagtgt

SEQ ID NO: 7813832 - DNA, 22 bp, Homo sapiens
caaggccagagccagcgataag

SEQ ID NO: 7813833 - DNA, 17 bp, Homo sapiens
caaggccagcatcttca

SEQ ID NO: 7813834 - DNA, 22 bp, Homo sapiens
caaggccagtccattttggaag

SEQ ID NO: 7813835 - DNA, 22 bp, Homo sapiens
caaggccagttcaccaagggca

SEQ ID NO: 7813836 - DNA, 22 bp, Homo sapiens
caaggccataagagatacaaaa

SEQ ID NO: 7813837 - DNA, 22 bp, Homo sapiens
caaggcaggaagcctgtcttat

SEQ ID NO: 7813838 - DNA, 22 bp, Homo sapiens
caaggcagcttaatagaatttg

SEQ ID NO: 7813839 - DNA, 22 bp, Homo sapiens
gctggaggctggagtgcagtgg

SEQ ID NO: 7813840 - DNA, 22 bp, Homo sapiens
gctggaggctggagtgcagtgg

SEQ ID NO: 7813841 - DNA, 22 bp, Homo sapiens
gctggaggctggagtgcagtgg

SEQ ID NO: 7813842 - DNA, 22 bp, Homo sapiens
gctggaggcagttcagacacca

SEQ ID NO: 7813843 - DNA, 22 bp, Homo sapiens
gctggaggcagttcagacacca

SEQ ID NO: 7813844 - DNA, 22 bp, Homo sapiens
gctggaggcagttcagacacca

SEQ ID NO: 7813845 - DNA, 22 bp, Homo sapiens
gctggaggcagttcagacacca

SEQ ID NO: 7813846 - DNA, 22 bp, Homo sapiens
gctggaggcagttcagacacca

SEQ ID NO: 7813847 - DNA, 22 bp, Homo sapiens
gctggaggcagttcagacacca

SEQ ID NO: 7813848 - DNA, 22 bp, Homo sapiens
gctggaggcagttcagacacca

SEQ ID NO: 7813849 - DNA, 22 bp, Homo sapiens
caaggccactccagagactggt

SEQ ID NO: 7813850 - DNA, 22 bp, Homo sapiens
caaggccacgttctgcatgcgg

SEQ ID NO: 7813851 - DNA, 22 bp, Homo sapiens
caaggccactccagagactggt

SEQ ID NO: 7813852 - DNA, 22 bp, Homo sapiens
caaggccaagtctctgtgaaga

SEQ ID NO: 7813853 - DNA, 22 bp, Homo sapiens
caaggccaagtctctgtgaaga

SEQ ID NO: 7813854 - DNA, 22 bp, Homo sapiens
caaggccaaagggccactgtca

SEQ ID NO: 7813855 - DNA, 22 bp, Homo sapiens
caaggcaggaagcctgtcttat

SEQ ID NO: 7813856 - DNA, 22 bp, Homo sapiens
ggccactgctgctctggtggag

SEQ ID NO: 7813857 - DNA, 22 bp, Homo sapiens
ggccactgctgctctggtggag

SEQ ID NO: 7813858 - DNA, 22 bp, Homo sapiens
ggccactgctctccagcctggg

SEQ ID NO: 7813859 - DNA, 22 bp, Homo sapiens
ggccactgctgctctggtggag

SEQ ID NO: 7813860 - DNA, 22 bp, Homo sapiens
ggccactgtttcctgggcagtt

SEQ ID NO: 7813861 - DNA, 22 bp, Homo sapiens
ggccactgtttcctgggcagtt

SEQ ID NO: 7813862 - DNA, 22 bp, Homo sapiens
ggccactgtcctctagcccaga

SEQ ID NO: 7813863 - DNA, 22 bp, Homo sapiens
ggccactggccaggatctaaga

SEQ ID NO: 7813864 - DNA, 22 bp, Homo sapiens
ggccactgctctccagcctggg

SEQ ID NO: 7813865 - DNA, 22 bp, Homo sapiens
ggccactgctctccagcctggg

SEQ ID NO: 7813866 - DNA, 22 bp, Homo sapiens
ggccactgctctccagcctggg

SEQ ID NO: 7813867 - DNA, 22 bp, Homo sapiens
ggccactgcctccgccatggct

SEQ ID NO: 7813868 - DNA, 22 bp, Homo sapiens
ggccactgctctccagcctggg

SEQ ID NO: 7813869 - DNA, 22 bp, Homo sapiens
ggccactgctctccagcctggg

SEQ ID NO: 7813870 - DNA, 22 bp, Homo sapiens
ggccactgctctccagcctggg

SEQ ID NO: 7813871 - DNA, 22 bp, Homo sapiens
ggccactgctctccagcctggg

SEQ ID NO: 7813872 - DNA, 22 bp, Homo sapiens
ggccactgcctccgccatggct

SEQ ID NO: 7813873 - DNA, 22 bp, Homo sapiens
ggccactgcctccgccatggct

SEQ ID NO: 7813874 - DNA, 22 bp, Homo sapiens
ggccactgcctccgccatggct

SEQ ID NO: 7813875 - DNA, 22 bp, Homo sapiens
ggccactgccctggctacaccg

SEQ ID NO: 7813876 - DNA, 22 bp, Homo sapiens
ggccactgccctggctacaccg

SEQ ID NO: 7813877 - DNA, 22 bp, Homo sapiens
ggccactgcctccgccatggct

SEQ ID NO: 7813878 - DNA, 22 bp, Homo sapiens
ggccactgcctccgccatggct

SEQ ID NO: 7813879 - DNA, 23 bp, Homo sapiens
ggccactgaattttctgcatctt

SEQ ID NO: 7813880 - DNA, 22 bp, Homo sapiens
ggccactgacctacatctgggg

SEQ ID NO: 7813881 - DNA, 22 bp, Homo sapiens
ggccactgacctacatctgggg

SEQ ID NO: 7813882 - DNA, 22 bp, Homo sapiens
ggccactgacctacatctgggg

SEQ ID NO: 7813883 - DNA, 22 bp, Homo sapiens
ggccactgacctacatctgggg

SEQ ID NO: 7813884 - DNA, 22 bp, Homo sapiens
ggccactgacctacatctgggg

SEQ ID NO: 7813885 - DNA, 22 bp, Homo sapiens
ggccactgacctacatctgggg

SEQ ID NO: 7813886 - DNA, 22 bp, Homo sapiens
ggccactgacctacatctgggg

SEQ ID NO: 7813887 - DNA, 22 bp, Homo sapiens
ggccactgccctggctacaccg

SEQ ID NO: 7813888 - DNA, 22 bp, Homo sapiens
ggccactgccctggctacaccg

SEQ ID NO: 7813889 - DNA, 22 bp, Homo sapiens
ggccccaggtagaagatataga

SEQ ID NO: 7813890 - DNA, 22 bp, Homo sapiens
ggccccaggtagaagatataga

SEQ ID NO: 7813891 - DNA, 22 bp, Homo sapiens
ggccctgtcctggctgtctccg

SEQ ID NO: 7813892 - DNA, 22 bp, Homo sapiens
ggccctgtgatggatgtattag

SEQ ID NO: 7813893 - DNA, 22 bp, Homo sapiens
ggccctgtctgtctgcccagct

SEQ ID NO: 7813894 - DNA, 22 bp, Homo sapiens
ggccctgtccctggccgtctgt

SEQ ID NO: 7813895 - DNA, 22 bp, Homo sapiens
ggccctgtccctggccgtctgt

SEQ ID NO: 7813896 - DNA, 22 bp, Homo sapiens
ggccctgtcctggctgtctccg

SEQ ID NO: 7813897 - DNA, 22 bp, Homo sapiens
ggccctgtcctggctgtctccg

SEQ ID NO: 7813898 - DNA, 22 bp, Homo sapiens
ggcccttcctcttgtgctggca

SEQ ID NO: 7813899 - DNA, 22 bp, Homo sapiens
ggccctgttccacgtggggtgt

SEQ ID NO: 7813900 - DNA, 22 bp, Homo sapiens
ggccctgtggttttgcaaagtc

SEQ ID NO: 7813901 - DNA, 22 bp, Homo sapiens
ggccctgtggttttgcaaagtc

SEQ ID NO: 7813902 - DNA, 22 bp, Homo sapiens
ggccgccctttccacggtttct

SEQ ID NO: 7813903 - DNA, 22 bp, Homo sapiens
ggcccttgcagcaggcgctggc

SEQ ID NO: 7813904 - DNA, 22 bp, Homo sapiens
ggcccttgcagcaggcgctggc

SEQ ID NO: 7813905 - DNA, 22 bp, Homo sapiens
ggcccttcctcttgtgctggca

SEQ ID NO: 7813906 - DNA, 22 bp, Homo sapiens
ggcccttcctgctctcttagct

SEQ ID NO: 7813907 - DNA, 22 bp, Homo sapiens
cacctgttagctctaattttct

SEQ ID NO: 7813908 - DNA, 22 bp, Homo sapiens
cacctgttcattacccatccca

SEQ ID NO: 7813909 - DNA, 22 bp, Homo sapiens
cacctgttagctctaattttct

SEQ ID NO: 7813910 - DNA, 21 bp, Homo sapiens
cacctgtgagactctcagacc

SEQ ID NO: 7813911 - DNA, 22 bp, Homo sapiens
cacctgtacagggccgggctgg

SEQ ID NO: 7813912 - DNA, 22 bp, Homo sapiens
cacctggttctagtgaaagtct

SEQ ID NO: 7813913 - DNA, 22 bp, Homo sapiens
cacctgtacagggccgggctgg

SEQ ID NO: 7813914 - DNA, 22 bp, Homo sapiens
cacctgggtcattgctggtgtt

SEQ ID NO: 7813915 - DNA, 22 bp, Homo sapiens
cacctgggtcattgctggtgtt

SEQ ID NO: 7813916 - DNA, 22 bp, Homo sapiens
cacctgggtcattgctggtgtt

SEQ ID NO: 7813917 - DNA, 22 bp, Homo sapiens
ggccggggcctccccgcgtcgc

SEQ ID NO: 7813918 - DNA, 22 bp, Homo sapiens
ggccggggcctgctcgcctgtg

SEQ ID NO: 7813919 - DNA, 22 bp, Homo sapiens
ggccggggcctgctcgcctgtg

SEQ ID NO: 7813920 - DNA, 22 bp, Homo sapiens
ggccggtgtcatggcttggtct

SEQ ID NO: 7813921 - DNA, 21 bp, Homo sapiens
ggccgccgccttgtgctctgc

SEQ ID NO: 7813922 - DNA, 21 bp, Homo sapiens
ggccgccgccttgtgctctgc

SEQ ID NO: 7813923 - DNA, 21 bp, Homo sapiens
ggccgccgccttgtgctctgc

SEQ ID NO: 7813924 - DNA, 21 bp, Homo sapiens
ggccgccgccttgtgctctgc

SEQ ID NO: 7813925 - DNA, 22 bp, Homo sapiens
ggccgcggattttcccgctggc

SEQ ID NO: 7813926 - DNA, 19 bp, Homo sapiens
ggccgcggcccgcagtggg

SEQ ID NO: 7813927 - DNA, 22 bp, Homo sapiens
ggccgctgcgcctccaaccgag

SEQ ID NO: 7813928 - DNA, 20 bp, Homo sapiens
ggccggggagctctccaggg

SEQ ID NO: 7813929 - DNA, 22 bp, Homo sapiens
ggccggcctttgcgagcattct

SEQ ID NO: 7813930 - DNA, 22 bp, Homo sapiens
ggccggggcctccccgcgtcgc

SEQ ID NO: 7813931 - DNA, 20 bp, Homo sapiens
ggccggggagctctccaggg

SEQ ID NO: 7813932 - DNA, 22 bp, Homo sapiens
ggccggctgccgtagggctcag

SEQ ID NO: 7813933 - DNA, 22 bp, Homo sapiens
ggccggcttactgggtagggtg

SEQ ID NO: 7813934 - DNA, 22 bp, Homo sapiens
ggccgggcaggtctcagccagc

SEQ ID NO: 7813935 - DNA, 20 bp, Homo sapiens
caccttcaaatttcctggca

SEQ ID NO: 7813936 - DNA, 22 bp, Homo sapiens
cacctgttgtttattcatctct

SEQ ID NO: 7813937 - DNA, 22 bp, Homo sapiens
cacctgttcattacccatccca

SEQ ID NO: 7813938 - DNA, 22 bp, Homo sapiens
caccttcagaatgctccaggca

SEQ ID NO: 7813939 - DNA, 22 bp, Homo sapiens
caccttccatctccttggctag

SEQ ID NO: 7813940 - DNA, 22 bp, Homo sapiens
cacctgttgtttattcatctct

SEQ ID NO: 7813941 - DNA, 22 bp, Homo sapiens
caccttccatctccttggctag

SEQ ID NO: 7813942 - DNA, 22 bp, Homo sapiens
cacctttgaccttgcagcgcac

SEQ ID NO: 7813943 - DNA, 22 bp, Homo sapiens
cacgaaatctaggagagtaaca

SEQ ID NO: 7813944 - DNA, 22 bp, Homo sapiens
cacctttgcaaaccaaatctga

SEQ ID NO: 7813945 - DNA, 22 bp, Homo sapiens
caccttttgtgtctgcgtttgt

SEQ ID NO: 7813946 - DNA, 22 bp, Homo sapiens
ggcctctctccagtcagtgcag

SEQ ID NO: 7813947 - DNA, 22 bp, Homo sapiens
cacgaatggaagggtcttggct

SEQ ID NO: 7813948 - DNA, 22 bp, Homo sapiens
cacgactgttaccggacccatg

SEQ ID NO: 7813949 - DNA, 22 bp, Homo sapiens
cacgaggccatctccttctgga

SEQ ID NO: 7813950 - DNA, 22 bp, Homo sapiens
cacgaggccatctccttctgga

SEQ ID NO: 7813951 - DNA, 22 bp, Homo sapiens
cacgagggcacacgtgggaggg

SEQ ID NO: 7813952 - DNA, 22 bp, Homo sapiens
cacgattactgtgtgaaagtga

SEQ ID NO: 7813953 - DNA, 22 bp, Homo sapiens
ggcagggagtggagactcccta

SEQ ID NO: 7813954 - DNA, 22 bp, Homo sapiens
ggcagggagtggagactcccta

SEQ ID NO: 7813955 - DNA, 22 bp, Homo sapiens
ggcagggagtggagactcccta

SEQ ID NO: 7813956 - DNA, 20 bp, Homo sapiens
ggcagggagggatactgagg

SEQ ID NO: 7813957 - DNA, 22 bp, Homo sapiens
ggcagggagtggagactcccta

SEQ ID NO: 7813958 - DNA, 22 bp, Homo sapiens
ggcagggagtggagactcccta

SEQ ID NO: 7813959 - DNA, 22 bp, Homo sapiens
ggcagggcagcgctgattaggg

SEQ ID NO: 7813960 - DNA, 22 bp, Homo sapiens
ggcagggcagcgctgattaggg

SEQ ID NO: 7813961 - DNA, 22 bp, Homo sapiens
ggcagggcagcgctgattaggg

SEQ ID NO: 7813962 - DNA, 22 bp, Homo sapiens
ggcagggcagcgctgattaggg

SEQ ID NO: 7813963 - DNA, 22 bp, Homo sapiens
ggcagggcagcgctgattaggg

SEQ ID NO: 7813964 - DNA, 22 bp, Homo sapiens
ggcagggcaggaaagtcaggaa

SEQ ID NO: 7813965 - DNA, 22 bp, Homo sapiens
ggcagggcaggaaagtcaggaa

SEQ ID NO: 7813966 - DNA, 22 bp, Homo sapiens
ggcagggcaggaaagtcaggaa

SEQ ID NO: 7813967 - DNA, 22 bp, Homo sapiens
ggcagggcaggaaagtcaggaa

SEQ ID NO: 7813968 - DNA, 22 bp, Homo sapiens
ggcagggcaggaaagtcaggaa

SEQ ID NO: 7813969 - DNA, 22 bp, Homo sapiens
ggcagggcaggaaagtcaggaa

SEQ ID NO: 7813970 - DNA, 22 bp, Homo sapiens
ggcagggcaggaaagtcaggaa

SEQ ID NO: 7813971 - DNA, 22 bp, Homo sapiens
ggcagggcaggaaagtcaggaa

SEQ ID NO: 7813972 - DNA, 22 bp, Homo sapiens
ggcagggcaggaaagtcaggaa

SEQ ID NO: 7813973 - DNA, 22 bp, Homo sapiens
ggcagggcaggaaagtcaggaa

SEQ ID NO: 7813974 - DNA, 22 bp, Homo sapiens
ggcaggtgcacctgagccatct

SEQ ID NO: 7813975 - DNA, 22 bp, Homo sapiens
ggcaggtgcacctgagccatct

SEQ ID NO: 7813976 - DNA, 22 bp, Homo sapiens
ggcaggtgatctagagtcaata

SEQ ID NO: 7813977 - DNA, 22 bp, Homo sapiens
ggcaggtgcacctgagccatct

SEQ ID NO: 7813978 - DNA, 22 bp, Homo sapiens
ggcaggtgcacctgagccatct

SEQ ID NO: 7813979 - DNA, 22 bp, Homo sapiens
ggcaggtgcacctgagccatct

SEQ ID NO: 7813980 - DNA, 22 bp, Homo sapiens
ggcaggtgcacctgagccatct

SEQ ID NO: 7813981 - DNA, 22 bp, Homo sapiens
ggcaggtgatctagagtcaata

SEQ ID NO: 7813982 - DNA, 22 bp, Homo sapiens
ggcaggtgatctagagtcaata

SEQ ID NO: 7813983 - DNA, 22 bp, Homo sapiens
ggcaggtgatctagagtcaata

SEQ ID NO: 7813984 - DNA, 22 bp, Homo sapiens
ggcaggtgatctagagtcaata

SEQ ID NO: 7813985 - DNA, 22 bp, Homo sapiens
ggcaggtgcacctgagccatct

SEQ ID NO: 7813986 - DNA, 22 bp, Homo sapiens
ggcaggtgatctagagtcaata

SEQ ID NO: 7813987 - DNA, 22 bp, Homo sapiens
ggcaggtgatctagagtcaata

SEQ ID NO: 7813988 - DNA, 22 bp, Homo sapiens
ggcaggtgcccagagagcacga

SEQ ID NO: 7813989 - DNA, 22 bp, Homo sapiens
ggcaggtgccttctgtgctagc

SEQ ID NO: 7813990 - DNA, 22 bp, Homo sapiens
ggcaggtgcccagagagcacga

SEQ ID NO: 7813991 - DNA, 22 bp, Homo sapiens
ggcaggtgcccagagagcacga

SEQ ID NO: 7813992 - DNA, 22 bp, Homo sapiens
ggcaggtgcccagagagcacga

SEQ ID NO: 7813993 - DNA, 22 bp, Homo sapiens
ggcaggtgcccagagagcacga

SEQ ID NO: 7813994 - DNA, 22 bp, Homo sapiens
ggcaggtgccagttggcttggg

SEQ ID NO: 7813995 - DNA, 22 bp, Homo sapiens
ggcaggtgcccagagagcacga

SEQ ID NO: 7813996 - DNA, 22 bp, Homo sapiens
ggcaggtgccagttggcttggg

SEQ ID NO: 7813997 - DNA, 22 bp, Homo sapiens
ggcaggtgccagttggcttggg

SEQ ID NO: 7813998 - DNA, 22 bp, Homo sapiens
ggcaggtgccagttggcttggg

SEQ ID NO: 7813999 - DNA, 22 bp, Homo sapiens
ggcattgatgggagatggtgga

SEQ ID NO: 7814000 - DNA, 22 bp, Homo sapiens
ggcattgtgtgctttccttgcc

SEQ ID NO: 7814001 - DNA, 22 bp, Homo sapiens
ggcattgtggtgtgtgcttcct

SEQ ID NO: 7814002 - DNA, 22 bp, Homo sapiens
ggcatcaggatctgtcttgctt

SEQ ID NO: 7814003 - DNA, 22 bp, Homo sapiens
ggcattaggtgaatgctcagca

SEQ ID NO: 7814004 - DNA, 22 bp, Homo sapiens
ggcatcaggatctgtcttgctt

SEQ ID NO: 7814005 - DNA, 22 bp, Homo sapiens
ggcatcaggatctgtcttgctt

SEQ ID NO: 7814006 - DNA, 22 bp, Homo sapiens
ggcatcaggagcttcttcaggt

SEQ ID NO: 7814007 - DNA, 22 bp, Homo sapiens
ggcatcaggagcttcttcaggt

SEQ ID NO: 7814008 - DNA, 22 bp, Homo sapiens
ggcaggtgccttctgtgctagc

SEQ ID NO: 7814009 - DNA, 22 bp, Homo sapiens
ggcaggtgcccagagagcacga

SEQ ID NO: 7814010 - DNA, 22 bp, Homo sapiens
ggcatttgactcagtgactggg

SEQ ID NO: 7814011 - DNA, 22 bp, Homo sapiens
ggcatttgagccattggcctgt

SEQ ID NO: 7814012 - DNA, 22 bp, Homo sapiens
ggcatttagttttcatattctg

SEQ ID NO: 7814013 - DNA, 22 bp, Homo sapiens
ggcatttaggcagataacagac

SEQ ID NO: 7814014 - DNA, 22 bp, Homo sapiens
ggccaagatcccattatacaaa

SEQ ID NO: 7814015 - DNA, 22 bp, Homo sapiens
ggccaagaatgataggctcagt

SEQ ID NO: 7814016 - DNA, 22 bp, Homo sapiens
ggccaagatggaaggagagatg

SEQ ID NO: 7814017 - DNA, 22 bp, Homo sapiens
ggccaagatggaaggagagatg

SEQ ID NO: 7814018 - DNA, 21 bp, Homo sapiens
ggccaacatggtctcatctct

SEQ ID NO: 7814019 - DNA, 22 bp, Homo sapiens
ggccaaatttatttgcagctgg

SEQ ID NO: 7814020 - DNA, 22 bp, Homo sapiens
ggcatttttgacaaagagcaat

SEQ ID NO: 7814021 - DNA, 17 bp, Homo sapiens
ggcatttgtcaggcaga

SEQ ID NO: 7814022 - DNA, 22 bp, Homo sapiens
ggccaaatcctccatggtggct

SEQ ID NO: 7814023 - DNA, 22 bp, Homo sapiens
ggccaaaagcataatcctcaca

SEQ ID NO: 7814024 - DNA, 22 bp, Homo sapiens
ggcatttttgacaaagagcaat

SEQ ID NO: 7814025 - DNA, 22 bp, Homo sapiens
ggcatttttgacaaagagcaat

SEQ ID NO: 7814026 - DNA, 22 bp, Homo sapiens
ggccaaaagcataatcctcaca

SEQ ID NO: 7814027 - DNA, 22 bp, Homo sapiens
ggccaaggatggtggctctggt

SEQ ID NO: 7814028 - DNA, 22 bp, Homo sapiens
ggccaaggatggtggctctggt

SEQ ID NO: 7814029 - DNA, 22 bp, Homo sapiens
ggccaccttcctgtggtctctg

SEQ ID NO: 7814030 - DNA, 22 bp, Homo sapiens
ggccaaggatggtggctctggt

SEQ ID NO: 7814031 - DNA, 22 bp, Homo sapiens
ggccaaggatggtggctctggt

SEQ ID NO: 7814032 - DNA, 22 bp, Homo sapiens
ggccaaggatggtggctctggt

SEQ ID NO: 7814033 - DNA, 22 bp, Homo sapiens
ggccaaggatggtggctctggt

SEQ ID NO: 7814034 - DNA, 19 bp, Homo sapiens
ggccactcctggtgactgg

SEQ ID NO: 7814035 - DNA, 22 bp, Homo sapiens
ggccactccgctgctactggaa

SEQ ID NO: 7814036 - DNA, 23 bp, Homo sapiens
ggccactgaattttctgcatctt

SEQ ID NO: 7814037 - DNA, 22 bp, Homo sapiens
ggccactcggccacccctgccg

SEQ ID NO: 7814038 - DNA, 23 bp, Homo sapiens
ggccactgaattttctgcatctt

SEQ ID NO: 7814039 - DNA, 22 bp, Homo sapiens
cacatacttgtgtgtacatatg

SEQ ID NO: 7814040 - DNA, 22 bp, Homo sapiens
cacatactgagaatcacaccca

SEQ ID NO: 7814041 - DNA, 22 bp, Homo sapiens
cacatacattcatgttactcta

SEQ ID NO: 7814042 - DNA, 22 bp, Homo sapiens
cacatacattcatgttactcta

SEQ ID NO: 7814043 - DNA, 22 bp, Homo sapiens
cacatacattcatgttactcta

SEQ ID NO: 7814044 - DNA, 22 bp, Homo sapiens
cacatacatgcacacctaaata

SEQ ID NO: 7814045 - DNA, 22 bp, Homo sapiens
cacatacatgcacacctaaata

SEQ ID NO: 7814046 - DNA, 22 bp, Homo sapiens
cacatacatgcacacctaaata

SEQ ID NO: 7814047 - DNA, 22 bp, Homo sapiens
cacatacattcatgttactcta

SEQ ID NO: 7814048 - DNA, 22 bp, Homo sapiens
cacatacatgcacacctaaata

SEQ ID NO: 7814049 - DNA, 22 bp, Homo sapiens
cacatacatgcacacctaaata

SEQ ID NO: 7814050 - DNA, 22 bp, Homo sapiens
cacatacatacgtatgtataca

SEQ ID NO: 7814051 - DNA, 22 bp, Homo sapiens
cacatacatacgtatgtataca

SEQ ID NO: 7814052 - DNA, 22 bp, Homo sapiens
cacatacatacgtatgtataca

SEQ ID NO: 7814053 - DNA, 22 bp, Homo sapiens
cacatacatacgtatgtataca

SEQ ID NO: 7814054 - DNA, 19 bp, Homo sapiens
cacatacagaaaagagtaa

SEQ ID NO: 7814055 - DNA, 22 bp, Homo sapiens
cacatacatacgtatgtataca

SEQ ID NO: 7814056 - DNA, 19 bp, Homo sapiens
cacatacagaaaagagtaa

SEQ ID NO: 7814057 - DNA, 19 bp, Homo sapiens
cacatacagaaaagagtaa

SEQ ID NO: 7814058 - DNA, 19 bp, Homo sapiens
cacatacagaaaagagtaa

SEQ ID NO: 7814059 - DNA, 19 bp, Homo sapiens
cacatacagaaaagagtaa

SEQ ID NO: 7814060 - DNA, 22 bp, Homo sapiens
cacatacaatggtgttatttgg

SEQ ID NO: 7814061 - DNA, 22 bp, Homo sapiens
cacatacaaggcacactggagg

SEQ ID NO: 7814062 - DNA, 22 bp, Homo sapiens
cacatacaaggcacactggagg

SEQ ID NO: 7814063 - DNA, 22 bp, Homo sapiens
cacatacaaggcacactggagg

SEQ ID NO: 7814064 - DNA, 22 bp, Homo sapiens
cacatacaaggcacactggagg

SEQ ID NO: 7814065 - DNA, 22 bp, Homo sapiens
cacatacaatggtgttatttgg

SEQ ID NO: 7814066 - DNA, 22 bp, Homo sapiens
cacatacaatggtgttatttgg

SEQ ID NO: 7814067 - DNA, 22 bp, Homo sapiens
cacatacaaggcacactggagg

SEQ ID NO: 7814068 - DNA, 22 bp, Homo sapiens
cacatacaatggtgttatttgg

SEQ ID NO: 7814069 - DNA, 22 bp, Homo sapiens
cacataattgaacgtgatgagt

SEQ ID NO: 7814070 - DNA, 22 bp, Homo sapiens
cacataattgaacgtgatgagt

SEQ ID NO: 7814071 - DNA, 22 bp, Homo sapiens
cacatacaagccatggggggat

SEQ ID NO: 7814072 - DNA, 22 bp, Homo sapiens
cacataatcaccaagtcctttc

SEQ ID NO: 7814073 - DNA, 22 bp, Homo sapiens
cacataattgaacgtgatgagt

SEQ ID NO: 7814074 - DNA, 22 bp, Homo sapiens
cacataataaatgttcctgatg

SEQ ID NO: 7814075 - DNA, 22 bp, Homo sapiens
cacataataaatgttcctgatg

SEQ ID NO: 7814076 - DNA, 22 bp, Homo sapiens
cacataatacatgttccactta

SEQ ID NO: 7814077 - DNA, 22 bp, Homo sapiens
cacataatacatgttccactta

SEQ ID NO: 7814078 - DNA, 22 bp, Homo sapiens
cacagttttgtcttggtttcca

SEQ ID NO: 7814079 - DNA, 22 bp, Homo sapiens
cacagttttgcccagggcttct

SEQ ID NO: 7814080 - DNA, 22 bp, Homo sapiens
cacagttttgcccagggcttct

SEQ ID NO: 7814081 - DNA, 22 bp, Homo sapiens
cacagttttgcccagggcttct

SEQ ID NO: 7814082 - DNA, 22 bp, Homo sapiens
cacataaatggtgccatgtttt

SEQ ID NO: 7814083 - DNA, 22 bp, Homo sapiens
cacataaatggtgccatgtttt

SEQ ID NO: 7814084 - DNA, 22 bp, Homo sapiens
cacataaatggtgccatgtttt

SEQ ID NO: 7814085 - DNA, 22 bp, Homo sapiens
cacataagaaatgaatatgaga

SEQ ID NO: 7814086 - DNA, 22 bp, Homo sapiens
cacataagaaatgaatatgaga

SEQ ID NO: 7814087 - DNA, 22 bp, Homo sapiens
cacataataaatgttcctgatg

SEQ ID NO: 7814088 - DNA, 22 bp, Homo sapiens
cacagttttatcttatactgat

SEQ ID NO: 7814089 - DNA, 22 bp, Homo sapiens
cacagtttggttttgctgtaat

SEQ ID NO: 7814090 - DNA, 22 bp, Homo sapiens
cacagtttggttttgctgtaat

SEQ ID NO: 7814091 - DNA, 22 bp, Homo sapiens
ggaggtggaggttgcagtgagc

SEQ ID NO: 7814092 - DNA, 22 bp, Homo sapiens
cacagtgtgggcatggtgcctg

SEQ ID NO: 7814093 - DNA, 22 bp, Homo sapiens
cacagtgtgggcatggtgcctg

SEQ ID NO: 7814094 - DNA, 22 bp, Homo sapiens
ggaggtggaggttgcagtgagc

SEQ ID NO: 7814095 - DNA, 22 bp, Homo sapiens
ggaggtggaggttgcagtgagc

SEQ ID NO: 7814096 - DNA, 22 bp, Homo sapiens
ggaggtggaggttgcaatgagc

SEQ ID NO: 7814097 - DNA, 22 bp, Homo sapiens
ggaggtggaggttgcagtgagc

SEQ ID NO: 7814098 - DNA, 22 bp, Homo sapiens
ggaggtggaggttgcaatgagc

SEQ ID NO: 7814099 - DNA, 22 bp, Homo sapiens
ggaggtggaggttgcaatgagc

SEQ ID NO: 7814100 - DNA, 22 bp, Homo sapiens
ggaggtggaggttgcaatgagc

SEQ ID NO: 7814101 - DNA, 22 bp, Homo sapiens
ggaggtggagctggaagttcca

SEQ ID NO: 7814102 - DNA, 22 bp, Homo sapiens
ggaggtggaggttgcaatgagc

SEQ ID NO: 7814103 - DNA, 22 bp, Homo sapiens
ggaggtggaggttgcaatgagc

SEQ ID NO: 7814104 - DNA, 22 bp, Homo sapiens
ggaggtggaggttgcaatgagc

SEQ ID NO: 7814105 - DNA, 22 bp, Homo sapiens
ggaggtggaggttgcaatgagc

SEQ ID NO: 7814106 - DNA, 22 bp, Homo sapiens
ggaggtgctggcggccagctct

SEQ ID NO: 7814107 - DNA, 22 bp, Homo sapiens
ggaggtggagctggaagttcca

SEQ ID NO: 7814108 - DNA, 22 bp, Homo sapiens
ggaggtggagctggaagttcca

SEQ ID NO: 7814109 - DNA, 22 bp, Homo sapiens
ggaggtggagctggaagttcca

SEQ ID NO: 7814110 - DNA, 22 bp, Homo sapiens
ggaggtggagctggaagttcca

SEQ ID NO: 7814111 - DNA, 22 bp, Homo sapiens
ggaggtgcagagtagggttggt

SEQ ID NO: 7814112 - DNA, 22 bp, Homo sapiens
ggaggtgcagagtagggttggt

SEQ ID NO: 7814113 - DNA, 22 bp, Homo sapiens
ggaggtgctgatcccagtcaac

SEQ ID NO: 7814114 - DNA, 22 bp, Homo sapiens
ggaggtgcagagtagggttggt

SEQ ID NO: 7814115 - DNA, 22 bp, Homo sapiens
ggaggtgctggcggccagctct

SEQ ID NO: 7814116 - DNA, 22 bp, Homo sapiens
ggaggtgaggccgtagggtgtg

SEQ ID NO: 7814117 - DNA, 22 bp, Homo sapiens
ggaggtgactggatcatgggca

SEQ ID NO: 7814118 - DNA, 22 bp, Homo sapiens
ggaggtgactggatcatgggca

SEQ ID NO: 7814119 - DNA, 22 bp, Homo sapiens
ggaggtgatcagagttttgagg

SEQ ID NO: 7814120 - DNA, 22 bp, Homo sapiens
ggaggtgaggccgtagggtgtg

SEQ ID NO: 7814121 - DNA, 22 bp, Homo sapiens
ggaggtgaggccgtagggtgtg

SEQ ID NO: 7814122 - DNA, 22 bp, Homo sapiens
ggaggtgaggccgtagggtgtg

SEQ ID NO: 7814123 - DNA, 22 bp, Homo sapiens
cacagggaaccaaggctgggcc

SEQ ID NO: 7814124 - DNA, 22 bp, Homo sapiens
cacagggaaccaaggctgggcc

SEQ ID NO: 7814125 - DNA, 22 bp, Homo sapiens
cacagggaaccaaggctgggcc

SEQ ID NO: 7814126 - DNA, 22 bp, Homo sapiens
cacagggaaccaaggctgggcc

SEQ ID NO: 7814127 - DNA, 22 bp, Homo sapiens
cacaggcttttttggctgatgt

SEQ ID NO: 7814128 - DNA, 22 bp, Homo sapiens
cacaggcttttttggctgatgt

SEQ ID NO: 7814129 - DNA, 22 bp, Homo sapiens
ggaggtgacgaaaagaaattgt

SEQ ID NO: 7814130 - DNA, 22 bp, Homo sapiens
ggaggtgacgaaaagaaattgt

SEQ ID NO: 7814131 - DNA, 22 bp, Homo sapiens
ggaggtcccaggcctggcagca

SEQ ID NO: 7814132 - DNA, 19 bp, Homo sapiens
cacagggagaccacatgtc

SEQ ID NO: 7814133 - DNA, 22 bp, Homo sapiens
cacagggaaccaaggctgggcc

SEQ ID NO: 7814134 - DNA, 22 bp, Homo sapiens
cacagggaaccaaggctgggcc

SEQ ID NO: 7814135 - DNA, 22 bp, Homo sapiens
cacatagataggcagaagaaca

SEQ ID NO: 7814136 - DNA, 22 bp, Homo sapiens
cacatacttgtgtgtacatatg

SEQ ID NO: 7814137 - DNA, 22 bp, Homo sapiens
cacatacttgtgtgtacatatg

SEQ ID NO: 7814138 - DNA, 22 bp, Homo sapiens
cacatagataggcagaagaaca

SEQ ID NO: 7814139 - DNA, 23 bp, Homo sapiens
cacatatagcagccactaaggtc

SEQ ID NO: 7814140 - DNA, 23 bp, Homo sapiens
cacatatagcagccactaaggtc

SEQ ID NO: 7814141 - DNA, 22 bp, Homo sapiens
cacatatacctcttcttgagtt

SEQ ID NO: 7814142 - DNA, 22 bp, Homo sapiens
cacattcttgagttacagtcta

SEQ ID NO: 7814143 - DNA, 22 bp, Homo sapiens
cacattctgtgaagctgatttt

SEQ ID NO: 7814144 - DNA, 22 bp, Homo sapiens
cacattcttgagttacagtcta

SEQ ID NO: 7814145 - DNA, 22 bp, Homo sapiens
cacattctgtccttgaactgca

SEQ ID NO: 7814146 - DNA, 22 bp, Homo sapiens
cacattctttcacagttctgaa

SEQ ID NO: 7814147 - DNA, 22 bp, Homo sapiens
cacattctttcacagttctgaa

SEQ ID NO: 7814148 - DNA, 22 bp, Homo sapiens
cacattctttcacagttctgaa

SEQ ID NO: 7814149 - DNA, 22 bp, Homo sapiens
cacattcttgagttacagtcta

SEQ ID NO: 7814150 - DNA, 22 bp, Homo sapiens
cacattcttggtcaccttgtgg

SEQ ID NO: 7814151 - DNA, 22 bp, Homo sapiens
cacatttaattggtttagggtg

SEQ ID NO: 7814152 - DNA, 22 bp, Homo sapiens
cacatttacatataaaactttc

SEQ ID NO: 7814153 - DNA, 22 bp, Homo sapiens
cacattctttcacagttctgaa

SEQ ID NO: 7814154 - DNA, 22 bp, Homo sapiens
cacatttacatataaaactttc

SEQ ID NO: 7814155 - DNA, 18 bp, Homo sapiens
cacatttacctggctccc

SEQ ID NO: 7814156 - DNA, 22 bp, Homo sapiens
cacatttacatataaaactttc

SEQ ID NO: 7814157 - DNA, 22 bp, Homo sapiens
cacatttagaggttagcatggt

SEQ ID NO: 7814158 - DNA, 22 bp, Homo sapiens
cacatttagaggttagcatggt

SEQ ID NO: 7814159 - DNA, 22 bp, Homo sapiens
cacatttagaggttagcatggt

SEQ ID NO: 7814160 - DNA, 22 bp, Homo sapiens
cacatttatctgttctttctag

SEQ ID NO: 7814161 - DNA, 22 bp, Homo sapiens
cacatttaggttcctatagcca

SEQ ID NO: 7814162 - DNA, 22 bp, Homo sapiens
cacatttaggttcctatagcca

SEQ ID NO: 7814163 - DNA, 22 bp, Homo sapiens
ggcaggcatggggtctgccatt

SEQ ID NO: 7814164 - DNA, 22 bp, Homo sapiens
ggcaggcatggggtctgccatt

SEQ ID NO: 7814165 - DNA, 22 bp, Homo sapiens
ggcagggagagcatgctgataa

SEQ ID NO: 7814166 - DNA, 22 bp, Homo sapiens
ggcagggagagcatgctgataa

SEQ ID NO: 7814167 - DNA, 22 bp, Homo sapiens
ggcagggaggaggtgaaagtga

SEQ ID NO: 7814168 - DNA, 22 bp, Homo sapiens
ggcagggaggaggtgaaagtga

SEQ ID NO: 7814169 - DNA, 22 bp, Homo sapiens
ggcagggaggaggtgaaagtga

SEQ ID NO: 7814170 - DNA, 20 bp, Homo sapiens
ggcagggagggatactgagg

SEQ ID NO: 7814171 - DNA, 20 bp, Homo sapiens
ggcagggagggatactgagg

SEQ ID NO: 7814172 - DNA, 20 bp, Homo sapiens
ggcagggagggatactgagg

SEQ ID NO: 7814173 - DNA, 22 bp, Homo sapiens
ggcaggcatggccactccctag

SEQ ID NO: 7814174 - DNA, 22 bp, Homo sapiens
ggcaggcatcatgtggtcatta

SEQ ID NO: 7814175 - DNA, 22 bp, Homo sapiens
ggcaggcatcatgtggtcatta

SEQ ID NO: 7814176 - DNA, 22 bp, Homo sapiens
ggcaggcatcatcagttgatca

SEQ ID NO: 7814177 - DNA, 22 bp, Homo sapiens
ggcaggcatcatgtggtcatta

SEQ ID NO: 7814178 - DNA, 22 bp, Homo sapiens
ggcaggcatggggtctgccatt

SEQ ID NO: 7814179 - DNA, 22 bp, Homo sapiens
ggcaggcatggggtctgccatt

SEQ ID NO: 7814180 - DNA, 22 bp, Homo sapiens
ggcaggcatggggtctgccatt

SEQ ID NO: 7814181 - DNA, 22 bp, Homo sapiens
ggcaggcatggccactccctag

SEQ ID NO: 7814182 - DNA, 22 bp, Homo sapiens
ggcaggcatggccactccctag

SEQ ID NO: 7814183 - DNA, 22 bp, Homo sapiens
ggcaggcatggccactccctag

SEQ ID NO: 7814184 - DNA, 22 bp, Homo sapiens
ggcaggcatggccactccctag

SEQ ID NO: 7814185 - DNA, 22 bp, Homo sapiens
ggcaggcatggggtctgccatt

SEQ ID NO: 7814186 - DNA, 22 bp, Homo sapiens
cacatttctaggaaattaaatg

SEQ ID NO: 7814187 - DNA, 22 bp, Homo sapiens
cacatttcattggcttacgtaa

SEQ ID NO: 7814188 - DNA, 22 bp, Homo sapiens
cacatttatttgaggctaattg

SEQ ID NO: 7814189 - DNA, 22 bp, Homo sapiens
ggcaggcaggagcgtgcttggg

SEQ ID NO: 7814190 - DNA, 22 bp, Homo sapiens
ggcaggcaggagctctgtctcc

SEQ ID NO: 7814191 - DNA, 22 bp, Homo sapiens
ggcaggcaggagcgtgcttggg

SEQ ID NO: 7814192 - DNA, 22 bp, Homo sapiens
ggcaggcaggagctctgtctcc

SEQ ID NO: 7814193 - DNA, 20 bp, Homo sapiens
ggcaggcaggaggtttccag

SEQ ID NO: 7814194 - DNA, 22 bp, Homo sapiens
ggcaggcaggtcttcatggccc

SEQ ID NO: 7814195 - DNA, 22 bp, Homo sapiens
ggcaggcaggtcttcatggccc

SEQ ID NO: 7814196 - DNA, 22 bp, Homo sapiens
ggcaggcaggtcttcatggccc

SEQ ID NO: 7814197 - DNA, 22 bp, Homo sapiens
ggcaggcaggtcttcatggccc

SEQ ID NO: 7814198 - DNA, 22 bp, Homo sapiens
ggcaggcaggtcttcatggccc

SEQ ID NO: 7814199 - DNA, 22 bp, Homo sapiens
ggcaggcagtgtggtgtgaaac

SEQ ID NO: 7814200 - DNA, 22 bp, Homo sapiens
ggcaggcatcatcagttgatca

SEQ ID NO: 7814201 - DNA, 22 bp, Homo sapiens
ggcaggcatcatcagttgatca

SEQ ID NO: 7814202 - DNA, 22 bp, Homo sapiens
ggcaggcagtgtggtgtgaaac

SEQ ID NO: 7814203 - DNA, 22 bp, Homo sapiens
ggcaggcagtgtggtgtgaaac

SEQ ID NO: 7814204 - DNA, 22 bp, Homo sapiens
ggcaggcagtgtggtgtgaaac

SEQ ID NO: 7814205 - DNA, 22 bp, Homo sapiens
ggcctgagcagacagcatgatg

SEQ ID NO: 7814206 - DNA, 22 bp, Homo sapiens
ggcctgagcagacagcatgatg

SEQ ID NO: 7814207 - DNA, 22 bp, Homo sapiens
ggcctgagcagacagcatgatg

SEQ ID NO: 7814208 - DNA, 22 bp, Homo sapiens
ggcctgagcagacagcatgatg

SEQ ID NO: 7814209 - DNA, 20 bp, Homo sapiens
ggcctgagcatggctggcag

SEQ ID NO: 7814210 - DNA, 20 bp, Homo sapiens
ggcctgagcatggctggcag

SEQ ID NO: 7814211 - DNA, 20 bp, Homo sapiens
ggcctgagcatggctggcag

SEQ ID NO: 7814212 - DNA, 20 bp, Homo sapiens
ggcctgagcatggctggcag

SEQ ID NO: 7814213 - DNA, 20 bp, Homo sapiens
ggcctgagcatggctggcag

SEQ ID NO: 7814214 - DNA, 20 bp, Homo sapiens
ggcctgagcatggctggcag

SEQ ID NO: 7814215 - DNA, 20 bp, Homo sapiens
ggcctgagcatggctggcag

SEQ ID NO: 7814216 - DNA, 22 bp, Homo sapiens
ggcctgagctctggggaggcaa

SEQ ID NO: 7814217 - DNA, 22 bp, Homo sapiens
ggcctgagctctggggaggcaa

SEQ ID NO: 7814218 - DNA, 22 bp, Homo sapiens
ggcctgagctctggggaggcaa

SEQ ID NO: 7814219 - DNA, 22 bp, Homo sapiens
ggcctgagctctggggaggcaa

SEQ ID NO: 7814220 - DNA, 22 bp, Homo sapiens
ggcctgagctctggggaggcaa

SEQ ID NO: 7814221 - DNA, 22 bp, Homo sapiens
ggcctgagcttgggcagcgtat

SEQ ID NO: 7814222 - DNA, 22 bp, Homo sapiens
ggcctgagcttgggcagcgtat

SEQ ID NO: 7814223 - DNA, 22 bp, Homo sapiens
ggcctgagcttgggcagcgtat

SEQ ID NO: 7814224 - DNA, 22 bp, Homo sapiens
ggcctgagcttgggcagcgtat

SEQ ID NO: 7814225 - DNA, 22 bp, Homo sapiens
ggcctgaggcaatagtcagaca

SEQ ID NO: 7814226 - DNA, 22 bp, Homo sapiens
ggcctgaggcaatagtcagaca

SEQ ID NO: 7814227 - DNA, 22 bp, Homo sapiens
ggcctgaggcaatagtcagaca

SEQ ID NO: 7814228 - DNA, 19 bp, Homo sapiens
ggcctgaggccacagatcc

SEQ ID NO: 7814229 - DNA, 19 bp, Homo sapiens
ggcctgaggccacagatcc

SEQ ID NO: 7814230 - DNA, 22 bp, Homo sapiens
ggcctgaggcaatagtcagaca

SEQ ID NO: 7814231 - DNA, 19 bp, Homo sapiens
ggcctgaggccacagatcc

SEQ ID NO: 7814232 - DNA, 22 bp, Homo sapiens
ggcctgaggccaccagcagccc

SEQ ID NO: 7814233 - DNA, 22 bp, Homo sapiens
ggcctgaggccaccagcagccc

SEQ ID NO: 7814234 - DNA, 22 bp, Homo sapiens
ggcctgaggccaccagcagccc

SEQ ID NO: 7814235 - DNA, 22 bp, Homo sapiens
ggcctgaggccaccagcagccc

SEQ ID NO: 7814236 - DNA, 22 bp, Homo sapiens
ggcctgaggccaccagcagccc

SEQ ID NO: 7814237 - DNA, 22 bp, Homo sapiens
ggcctgaggccaccagcagccc

SEQ ID NO: 7814238 - DNA, 22 bp, Homo sapiens
ggcctgggctccgggagttact

SEQ ID NO: 7814239 - DNA, 22 bp, Homo sapiens
ggcctgggctccgggagttact

SEQ ID NO: 7814240 - DNA, 20 bp, Homo sapiens
ggcctggtgaatgagagaat

SEQ ID NO: 7814241 - DNA, 20 bp, Homo sapiens
ggcctggtgaatgagagaat

SEQ ID NO: 7814242 - DNA, 22 bp, Homo sapiens
ggcctgaggcgtcccagctgtg

SEQ ID NO: 7814243 - DNA, 22 bp, Homo sapiens
ggcctgaggcgtcccagctgtg

SEQ ID NO: 7814244 - DNA, 22 bp, Homo sapiens
ggcctgaggcgtcccagctgtg

SEQ ID NO: 7814245 - DNA, 22 bp, Homo sapiens
ggcctgaggcgtcccagctgtg

SEQ ID NO: 7814246 - DNA, 22 bp, Homo sapiens
ggcctgaggccaccagcagccc

SEQ ID NO: 7814247 - DNA, 22 bp, Homo sapiens
ggcctgaggcgtcccagctgtg

SEQ ID NO: 7814248 - DNA, 22 bp, Homo sapiens
ggcctgtgcacatgtgcaggaa

SEQ ID NO: 7814249 - DNA, 22 bp, Homo sapiens
ggcctgtgcaagacagcacccc

SEQ ID NO: 7814250 - DNA, 22 bp, Homo sapiens
ggcctgtgcacatgtgcaggaa

SEQ ID NO: 7814251 - DNA, 22 bp, Homo sapiens
ggcctgtgcaagacagcacccc

SEQ ID NO: 7814252 - DNA, 22 bp, Homo sapiens
ggcctgtctcacccccgggtgc

SEQ ID NO: 7814253 - DNA, 22 bp, Homo sapiens
ggcctgtccagcctgcctggct

SEQ ID NO: 7814254 - DNA, 22 bp, Homo sapiens
ggcctgtgagaatcaaggaaaa

SEQ ID NO: 7814255 - DNA, 22 bp, Homo sapiens
ggcctgtccagcctgcctggct

SEQ ID NO: 7814256 - DNA, 22 bp, Homo sapiens
ggctcaatgcaacttctgcctc

SEQ ID NO: 7814257 - DNA, 17 bp, Homo sapiens
ggcctgtgtggctgcag

SEQ ID NO: 7814258 - DNA, 22 bp, Homo sapiens
ggctcaatgcaacttctgcctc

SEQ ID NO: 7814259 - DNA, 22 bp, Homo sapiens
ggctcaatgcaacttctgcctc

SEQ ID NO: 7814260 - DNA, 22 bp, Homo sapiens
ggctcaatgcaacttctgcctc

SEQ ID NO: 7814261 - DNA, 17 bp, Homo sapiens
ggcctgtgtggctgcag

SEQ ID NO: 7814262 - DNA, 22 bp, Homo sapiens
ggcctgtgtctgtgcctgtcct

SEQ ID NO: 7814263 - DNA, 22 bp, Homo sapiens
ggcctgtgtcctccttgccctg

SEQ ID NO: 7814264 - DNA, 22 bp, Homo sapiens
ggcctgtgtcctccttgccctg

SEQ ID NO: 7814265 - DNA, 22 bp, Homo sapiens
ggcctgtgtcctccttgccctg

SEQ ID NO: 7814266 - DNA, 22 bp, Homo sapiens
ggcctgtgtctgtgcctgtcct

SEQ ID NO: 7814267 - DNA, 22 bp, Homo sapiens
ggcctgtgtctgtgcctgtcct

SEQ ID NO: 7814268 - DNA, 22 bp, Homo sapiens
ggcctgtgtcggccccgggttc

SEQ ID NO: 7814269 - DNA, 22 bp, Homo sapiens
ggcctgtggctttggcgtctaa

SEQ ID NO: 7814270 - DNA, 22 bp, Homo sapiens
ggcctgtgggaggacagctggg

SEQ ID NO: 7814271 - DNA, 22 bp, Homo sapiens
ggcctgtggcaaggtgagaatg

SEQ ID NO: 7814272 - DNA, 22 bp, Homo sapiens
ggcctgtgggaggacagctggg

SEQ ID NO: 7814273 - DNA, 22 bp, Homo sapiens
ggcctgtgggaggacagctggg

SEQ ID NO: 7814274 - DNA, 22 bp, Homo sapiens
ggcctgtgctgagaacctggct

SEQ ID NO: 7814275 - DNA, 22 bp, Homo sapiens
ggcctgtgctgtcagccctagt

SEQ ID NO: 7814276 - DNA, 22 bp, Homo sapiens
ggcctgtgctgtcagccctagt

SEQ ID NO: 7814277 - DNA, 22 bp, Homo sapiens
ggctcaggggccaggcctgtcc

SEQ ID NO: 7814278 - DNA, 22 bp, Homo sapiens
ggctcaggggccaggcctgtcc

SEQ ID NO: 7814279 - DNA, 22 bp, Homo sapiens
ggctcaggggccaggcctgtcc

SEQ ID NO: 7814280 - DNA, 22 bp, Homo sapiens
ggctcaggggccaggcctgtcc

SEQ ID NO: 7814281 - DNA, 19 bp, Homo sapiens
ggctcagggcgctgccgcc

SEQ ID NO: 7814282 - DNA, 19 bp, Homo sapiens
ggctcagggcgctgccgcc

SEQ ID NO: 7814283 - DNA, 22 bp, Homo sapiens
ggctcagggaatgaggaagaat

SEQ ID NO: 7814284 - DNA, 22 bp, Homo sapiens
ggctcagggaatgaggaagaat

SEQ ID NO: 7814285 - DNA, 22 bp, Homo sapiens
ggctcagggaatgaggaagaat

SEQ ID NO: 7814286 - DNA, 19 bp, Homo sapiens
ggctcagggcgctgccgcc

SEQ ID NO: 7814287 - DNA, 22 bp, Homo sapiens
ggctcagggaatgaggaagaat

SEQ ID NO: 7814288 - DNA, 22 bp, Homo sapiens
ggctcagggaatgaggaagaat

SEQ ID NO: 7814289 - DNA, 22 bp, Homo sapiens
ggctcaggctggagtgcagtgg

SEQ ID NO: 7814290 - DNA, 22 bp, Homo sapiens
ggctcaggctggagtgcagtgg

SEQ ID NO: 7814291 - DNA, 22 bp, Homo sapiens
ggctcaggctggagtgcagtgg

SEQ ID NO: 7814292 - DNA, 22 bp, Homo sapiens
ggctcaggctggagtgcagtgg

SEQ ID NO: 7814293 - DNA, 18 bp, Homo sapiens
ggctcaggctatcctaac

SEQ ID NO: 7814294 - DNA, 18 bp, Homo sapiens
ggctcaggctatcctaac

SEQ ID NO: 7814295 - DNA, 22 bp, Homo sapiens
ggctcaggctggagtgcagtgg

SEQ ID NO: 7814296 - DNA, 22 bp, Homo sapiens
ggctcaggctggagtgcagtgg

SEQ ID NO: 7814297 - DNA, 22 bp, Homo sapiens
ggctcacaacagttttctgtaa

SEQ ID NO: 7814298 - DNA, 18 bp, Homo sapiens
ggctcaggctatcctaac

SEQ ID NO: 7814299 - DNA, 22 bp, Homo sapiens
ggctctggtgagggtaggagat

SEQ ID NO: 7814300 - DNA, 22 bp, Homo sapiens
ggctctggtgagggtaggagat

SEQ ID NO: 7814301 - DNA, 22 bp, Homo sapiens
ggctctggtgagggtaggagat

SEQ ID NO: 7814302 - DNA, 22 bp, Homo sapiens
ggctctggtgagggtaggagat

SEQ ID NO: 7814303 - DNA, 22 bp, Homo sapiens
ggctctggtgagggtaggagat

SEQ ID NO: 7814304 - DNA, 22 bp, Homo sapiens
ggctctggtgagggtaggagat

SEQ ID NO: 7814305 - DNA, 22 bp, Homo sapiens
ggctctggtgagggtaggagat

SEQ ID NO: 7814306 - DNA, 22 bp, Homo sapiens
ggctctggtgagggtaggagat

SEQ ID NO: 7814307 - DNA, 22 bp, Homo sapiens
ggctctggtgagggtaggagat

SEQ ID NO: 7814308 - DNA, 22 bp, Homo sapiens
ggctctggtgccctggctccca

SEQ ID NO: 7814309 - DNA, 22 bp, Homo sapiens
ggctctggtgccctggctccca

SEQ ID NO: 7814310 - DNA, 22 bp, Homo sapiens
ggctctggtgccctggctccca

SEQ ID NO: 7814311 - DNA, 22 bp, Homo sapiens
ggctctggtgccctggctccca

SEQ ID NO: 7814312 - DNA, 22 bp, Homo sapiens
ggctctggtgccctggctccca

SEQ ID NO: 7814313 - DNA, 22 bp, Homo sapiens
ggctctggtgagggtaggagat

SEQ ID NO: 7814314 - DNA, 22 bp, Homo sapiens
ggctctggtgccctggctccca

SEQ ID NO: 7814315 - DNA, 22 bp, Homo sapiens
ggctctggtgccctggctccca

SEQ ID NO: 7814316 - DNA, 22 bp, Homo sapiens
ggctctggtgggaaggttagat

SEQ ID NO: 7814317 - DNA, 22 bp, Homo sapiens
ggctctggtgggaaggttagat

SEQ ID NO: 7814318 - DNA, 22 bp, Homo sapiens
ggctctggtgggaaggttagat

SEQ ID NO: 7814319 - DNA, 22 bp, Homo sapiens
ggctctggtggcaattgactgg

SEQ ID NO: 7814320 - DNA, 22 bp, Homo sapiens
ggctctggtggcaattgactgg

SEQ ID NO: 7814321 - DNA, 22 bp, Homo sapiens
ggctctggtggcaattgactgg

SEQ ID NO: 7814322 - DNA, 22 bp, Homo sapiens
ggctctggtgccctggctccca

SEQ ID NO: 7814323 - DNA, 22 bp, Homo sapiens
ggctctggtgtgaagcagcctc

SEQ ID NO: 7814324 - DNA, 22 bp, Homo sapiens
ggctctggtgtgaagcagcctc

SEQ ID NO: 7814325 - DNA, 22 bp, Homo sapiens
ggctctggtgggaaggttagat

SEQ ID NO: 7814326 - DNA, 22 bp, Homo sapiens
ggctctggtgggaaggttagat

SEQ ID NO: 7814327 - DNA, 22 bp, Homo sapiens
ggctgagccccctctgcgtagg

SEQ ID NO: 7814328 - DNA, 22 bp, Homo sapiens
ggctgagccccctctgcgtagg

SEQ ID NO: 7814329 - DNA, 22 bp, Homo sapiens
ggctgagccccctctgcgtagg

SEQ ID NO: 7814330 - DNA, 22 bp, Homo sapiens
ggctgagccccctctgcgtagg

SEQ ID NO: 7814331 - DNA, 22 bp, Homo sapiens
ggctgagctcaggggcagcagg

SEQ ID NO: 7814332 - DNA, 22 bp, Homo sapiens
ggctgagctcaggggcagcagg

SEQ ID NO: 7814333 - DNA, 22 bp, Homo sapiens
ggctgagcgtggctgccgtggg

SEQ ID NO: 7814334 - DNA, 19 bp, Homo sapiens
ggctgagcgccttggctgc

SEQ ID NO: 7814335 - DNA, 22 bp, Homo sapiens
ggctgagcgtggctgccgtggg

SEQ ID NO: 7814336 - DNA, 22 bp, Homo sapiens
ggctgagcctggagcatctggt

SEQ ID NO: 7814337 - DNA, 22 bp, Homo sapiens
ggctgagccccctctgcgtagg

SEQ ID NO: 7814338 - DNA, 22 bp, Homo sapiens
ggctgagcctggagcatctggt

SEQ ID NO: 7814339 - DNA, 22 bp, Homo sapiens
ggctgagcctggagcatctggt

SEQ ID NO: 7814340 - DNA, 22 bp, Homo sapiens
ggctgagcctggagcatctggt

SEQ ID NO: 7814341 - DNA, 22 bp, Homo sapiens
ggctgagcctggagcatctggt

SEQ ID NO: 7814342 - DNA, 22 bp, Homo sapiens
ggctgagcctggagcatctggt

SEQ ID NO: 7814343 - DNA, 19 bp, Homo sapiens
ggctgagcgccttggctgc

SEQ ID NO: 7814344 - DNA, 19 bp, Homo sapiens
ggctgagcgccttggctgc

SEQ ID NO: 7814345 - DNA, 19 bp, Homo sapiens
ggctgagcgccttggctgc

SEQ ID NO: 7814346 - DNA, 19 bp, Homo sapiens
ggctgagcgccttggctgc

SEQ ID NO: 7814347 - DNA, 22 bp, Homo sapiens
ggctgagcctggagcatctggt

SEQ ID NO: 7814348 - DNA, 22 bp, Homo sapiens
ggctgaggcggcgatgcccttg

SEQ ID NO: 7814349 - DNA, 22 bp, Homo sapiens
ggctgaggctcatgccatcttg

SEQ ID NO: 7814350 - DNA, 22 bp, Homo sapiens
ggctgaggcggcgatgcccttg

SEQ ID NO: 7814351 - DNA, 22 bp, Homo sapiens
ggctgaggcggcgatgcccttg

SEQ ID NO: 7814352 - DNA, 22 bp, Homo sapiens
ggctgagctcaggggcagcagg

SEQ ID NO: 7814353 - DNA, 22 bp, Homo sapiens
ggctgagctccaagtattccat

SEQ ID NO: 7814354 - DNA, 22 bp, Homo sapiens
ggctgagcttatatatgtgctg

SEQ ID NO: 7814355 - DNA, 22 bp, Homo sapiens
ggctgaggcggcgatgcccttg

SEQ ID NO: 7814356 - DNA, 22 bp, Homo sapiens
ggctccagggtacccctggatg

SEQ ID NO: 7814357 - DNA, 22 bp, Homo sapiens
ggctccagggtacccctggatg

SEQ ID NO: 7814358 - DNA, 22 bp, Homo sapiens
ggctccagggtacccctggatg

SEQ ID NO: 7814359 - DNA, 22 bp, Homo sapiens
ggctccagggtacccctggatg

SEQ ID NO: 7814360 - DNA, 22 bp, Homo sapiens
ggctccagggtacccctggatg

SEQ ID NO: 7814361 - DNA, 22 bp, Homo sapiens
ggctccagggtacccctggatg

SEQ ID NO: 7814362 - DNA, 22 bp, Homo sapiens
ggctcaggttgggtcacatgac

SEQ ID NO: 7814363 - DNA, 22 bp, Homo sapiens
ggctcaggtttaaagtgcttta

SEQ ID NO: 7814364 - DNA, 22 bp, Homo sapiens
ggctcaggttgggtcacatgac

SEQ ID NO: 7814365 - DNA, 22 bp, Homo sapiens
ggctcaggttaccagtccctcc

SEQ ID NO: 7814366 - DNA, 22 bp, Homo sapiens
ggctcaggttaccagtccctcc

SEQ ID NO: 7814367 - DNA, 22 bp, Homo sapiens
ggctcaggttaccagtccctcc

SEQ ID NO: 7814368 - DNA, 22 bp, Homo sapiens
ggctccagggtctctccttgtg

SEQ ID NO: 7814369 - DNA, 22 bp, Homo sapiens
ggctccagggtctctccttgtg

SEQ ID NO: 7814370 - DNA, 22 bp, Homo sapiens
ggctccagggtctctccttgtg

SEQ ID NO: 7814371 - DNA, 22 bp, Homo sapiens
ggctccagggtctctccttgtg

SEQ ID NO: 7814372 - DNA, 22 bp, Homo sapiens
ggctccagggtctctccttgtg

SEQ ID NO: 7814373 - DNA, 22 bp, Homo sapiens
ggctccagggtctctccttgtg

SEQ ID NO: 7814374 - DNA, 22 bp, Homo sapiens
ggctccagggtctctccttgtg

SEQ ID NO: 7814375 - DNA, 22 bp, Homo sapiens
ggctccagggtacccctggatg

SEQ ID NO: 7814376 - DNA, 22 bp, Homo sapiens
ggctccagggtctctccttgtg

SEQ ID NO: 7814377 - DNA, 22 bp, Homo sapiens
ggctccaggtacgtatgggagg

SEQ ID NO: 7814378 - DNA, 22 bp, Homo sapiens
ggctccaggtgcatgccaggct

SEQ ID NO: 7814379 - DNA, 22 bp, Homo sapiens
ggctccaggtgcatgccaggct

SEQ ID NO: 7814380 - DNA, 22 bp, Homo sapiens
ggctccaggtgcatgccaggct

SEQ ID NO: 7814381 - DNA, 22 bp, Homo sapiens
ggctccaggtgcatgccaggct

SEQ ID NO: 7814382 - DNA, 22 bp, Homo sapiens
ggctctggtcagtgaggggcct

SEQ ID NO: 7814383 - DNA, 22 bp, Homo sapiens
ggctctggtcagtgaggggcct

SEQ ID NO: 7814384 - DNA, 22 bp, Homo sapiens
ggctctggtcagtgaggggcct

SEQ ID NO: 7814385 - DNA, 22 bp, Homo sapiens
ggctctggtcagtgaggggcct

SEQ ID NO: 7814386 - DNA, 22 bp, Homo sapiens
ggctctggtcagtgaggggcct

SEQ ID NO: 7814387 - DNA, 22 bp, Homo sapiens
ggctctggtcagtgaggggcct

SEQ ID NO: 7814388 - DNA, 22 bp, Homo sapiens
ggctctggtcagtgaggggcct

SEQ ID NO: 7814389 - DNA, 22 bp, Homo sapiens
ggctctggtgagggtaggagat

SEQ ID NO: 7814390 - DNA, 22 bp, Homo sapiens
ggctctggtcagtgaggggcct

SEQ ID NO: 7814391 - DNA, 22 bp, Homo sapiens
ggctctgggttctgcaatgcgt

SEQ ID NO: 7814392 - DNA, 22 bp, Homo sapiens
ggctctggaatgtgtagtcagg

SEQ ID NO: 7814393 - DNA, 22 bp, Homo sapiens
ggctctggaatgtgtagtcagg

SEQ ID NO: 7814394 - DNA, 22 bp, Homo sapiens
ggctctggaatgtgtagtcagg

SEQ ID NO: 7814395 - DNA, 20 bp, Homo sapiens
ggctctggaatctggtgggc

SEQ ID NO: 7814396 - DNA, 20 bp, Homo sapiens
ggctctggaatctggtgggc

SEQ ID NO: 7814397 - DNA, 22 bp, Homo sapiens
ggctccaggtgcatgccaggct

SEQ ID NO: 7814398 - DNA, 22 bp, Homo sapiens
ggctccaggtgcatgccaggct

SEQ ID NO: 7814399 - DNA, 22 bp, Homo sapiens
ggctccaggtgcatgccaggct

SEQ ID NO: 7814400 - DNA, 22 bp, Homo sapiens
ggctccaggtgcatgccaggct

SEQ ID NO: 7814401 - DNA, 22 bp, Homo sapiens
ggctccaggtttaagggtatgt

SEQ ID NO: 7814402 - DNA, 22 bp, Homo sapiens
ggctccaggtgcatgccaggct

SEQ ID NO: 7814403 - DNA, 22 bp, Homo sapiens
ggctccagtttccccttggggc

SEQ ID NO: 7814404 - DNA, 22 bp, Homo sapiens
ggctccagtttccccttggggc

SEQ ID NO: 7814405 - DNA, 22 bp, Homo sapiens
ggctccagtttccccttggggc

SEQ ID NO: 7814406 - DNA, 22 bp, Homo sapiens
ggctccagtttccccttggggc

SEQ ID NO: 7814407 - DNA, 18 bp, Homo sapiens
ggctccagtcttcagtgg

SEQ ID NO: 7814408 - DNA, 18 bp, Homo sapiens
ggctccagtcttcagtgg

SEQ ID NO: 7814409 - DNA, 20 bp, Homo sapiens
ggctgcccactccagagtac

SEQ ID NO: 7814410 - DNA, 22 bp, Homo sapiens
ggctgccataacagagtaccac

SEQ ID NO: 7814411 - DNA, 22 bp, Homo sapiens
ggctgccataactgataccata

SEQ ID NO: 7814412 - DNA, 22 bp, Homo sapiens
ggctgccccatgggctgggctg

SEQ ID NO: 7814413 - DNA, 22 bp, Homo sapiens
ggctgccccagtgctcatggct

SEQ ID NO: 7814414 - DNA, 22 bp, Homo sapiens
ggctgccccagtgctcatggct

SEQ ID NO: 7814415 - DNA, 22 bp, Homo sapiens
ggctgccctagagctggcaagg

SEQ ID NO: 7814416 - DNA, 22 bp, Homo sapiens
ggctgccccatgggctgggctg

SEQ ID NO: 7814417 - DNA, 22 bp, Homo sapiens
ggctgccccatgggctgggctg

SEQ ID NO: 7814418 - DNA, 22 bp, Homo sapiens
ggctgccccatgggctgggctg

SEQ ID NO: 7814419 - DNA, 22 bp, Homo sapiens
cagaaaataaagtttctacgca

SEQ ID NO: 7814420 - DNA, 22 bp, Homo sapiens
cagaaaataaacatttgtggaa

SEQ ID NO: 7814421 - DNA, 22 bp, Homo sapiens
cagaaaataaagtttctacgca

SEQ ID NO: 7814422 - DNA, 22 bp, Homo sapiens
cagaaaataaacatttgtggaa

SEQ ID NO: 7814423 - DNA, 22 bp, Homo sapiens
cagaaaataaacatttgtggaa

SEQ ID NO: 7814424 - DNA, 22 bp, Homo sapiens
cagaaaaggaagagctatgtaa

SEQ ID NO: 7814425 - DNA, 22 bp, Homo sapiens
cagaaaaggaagagctatgtaa

SEQ ID NO: 7814426 - DNA, 22 bp, Homo sapiens
cagaaaacctgactctagaact

SEQ ID NO: 7814427 - DNA, 22 bp, Homo sapiens
cagaaaaggaagagctatgtaa

SEQ ID NO: 7814428 - DNA, 22 bp, Homo sapiens
cagaaaaggaagagctatgtaa

SEQ ID NO: 7814429 - DNA, 22 bp, Homo sapiens
cagaaaaggaagagctatgtaa

SEQ ID NO: 7814430 - DNA, 22 bp, Homo sapiens
cagaaaagggtgtttgttcagg

SEQ ID NO: 7814431 - DNA, 22 bp, Homo sapiens
cagaaaagggtgtttgttcagg

SEQ ID NO: 7814432 - DNA, 22 bp, Homo sapiens
cacttttaaatgggtccgtgtt

SEQ ID NO: 7814433 - DNA, 22 bp, Homo sapiens
cacttttaacaggagaattccc

SEQ ID NO: 7814434 - DNA, 22 bp, Homo sapiens
cacttttaacaggagaattccc

SEQ ID NO: 7814435 - DNA, 22 bp, Homo sapiens
cactttgtttattgtgcagtta

SEQ ID NO: 7814436 - DNA, 17 bp, Homo sapiens
cactttgttgctgtggg

SEQ ID NO: 7814437 - DNA, 22 bp, Homo sapiens
cactttggtagctgttttggga

SEQ ID NO: 7814438 - DNA, 22 bp, Homo sapiens
cactttggtagctgttttggga

SEQ ID NO: 7814439 - DNA, 22 bp, Homo sapiens
cactttggttcacctgagtttc

SEQ ID NO: 7814440 - DNA, 22 bp, Homo sapiens
cactttacccttgttactcatg

SEQ ID NO: 7814441 - DNA, 22 bp, Homo sapiens
cactttggatgccactggtcta

SEQ ID NO: 7814442 - DNA, 22 bp, Homo sapiens
cactttggatgccactggtcta

SEQ ID NO: 7814443 - DNA, 22 bp, Homo sapiens
cactttggggtatgacaagttt

SEQ ID NO: 7814444 - DNA, 22 bp, Homo sapiens
cactttgggtttatgtcaatca

SEQ ID NO: 7814445 - DNA, 21 bp, Homo sapiens
cactttaatggatatttgttt

SEQ ID NO: 7814446 - DNA, 21 bp, Homo sapiens
cactttaatggatatttgttt

SEQ ID NO: 7814447 - DNA, 21 bp, Homo sapiens
cactttaatggatatttgttt

SEQ ID NO: 7814448 - DNA, 22 bp, Homo sapiens
cacttttaacaggagaattccc

SEQ ID NO: 7814449 - DNA, 22 bp, Homo sapiens
cacttttaacaggagaattccc

SEQ ID NO: 7814450 - DNA, 22 bp, Homo sapiens
cagaaaacaaacctatcctgag

SEQ ID NO: 7814451 - DNA, 22 bp, Homo sapiens
cagaaaacctgactctagaact

SEQ ID NO: 7814452 - DNA, 22 bp, Homo sapiens
cagaaaacctgactctagaact

SEQ ID NO: 7814453 - DNA, 22 bp, Homo sapiens
cagaaaacctgactctagaact

SEQ ID NO: 7814454 - DNA, 23 bp, Homo sapiens
cagaaaacccagagctcagtccc

SEQ ID NO: 7814455 - DNA, 22 bp, Homo sapiens
cagaaaacctgactctagaact

SEQ ID NO: 7814456 - DNA, 23 bp, Homo sapiens
cagaaaacccagagctcagtccc

SEQ ID NO: 7814457 - DNA, 23 bp, Homo sapiens
cagaaaacccagagctcagtccc

SEQ ID NO: 7814458 - DNA, 22 bp, Homo sapiens
cagaaacatgtataaagttgta

SEQ ID NO: 7814459 - DNA, 22 bp, Homo sapiens
cagaaacatgtataaagttgta

SEQ ID NO: 7814460 - DNA, 22 bp, Homo sapiens
cagaaacatgtataaagttgta

SEQ ID NO: 7814461 - DNA, 22 bp, Homo sapiens
cagaaacatgtataaagttgta

SEQ ID NO: 7814462 - DNA, 22 bp, Homo sapiens
cagaaacatgtataaagttgta

SEQ ID NO: 7814463 - DNA, 22 bp, Homo sapiens
cagaaacatgtataaagttgta

SEQ ID NO: 7814464 - DNA, 22 bp, Homo sapiens
cagaaacatgtataaagttgta

SEQ ID NO: 7814465 - DNA, 22 bp, Homo sapiens
cagaaacatgtataaagttgta

SEQ ID NO: 7814466 - DNA, 22 bp, Homo sapiens
ggctgcctcaaagctcaagctc

SEQ ID NO: 7814467 - DNA, 22 bp, Homo sapiens
cagaaacaggcaacgtgtgcac

SEQ ID NO: 7814468 - DNA, 22 bp, Homo sapiens
ggctgcctcaaagctcaagctc

SEQ ID NO: 7814469 - DNA, 22 bp, Homo sapiens
ggctgcctatagaattattagt

SEQ ID NO: 7814470 - DNA, 22 bp, Homo sapiens
ggctgcctagacttggaatttc

SEQ ID NO: 7814471 - DNA, 22 bp, Homo sapiens
ggctgcctagacttggaatttc

SEQ ID NO: 7814472 - DNA, 22 bp, Homo sapiens
ggctgcctactttcccagagtt

SEQ ID NO: 7814473 - DNA, 22 bp, Homo sapiens
ggctgccctcgtctactgccca

SEQ ID NO: 7814474 - DNA, 22 bp, Homo sapiens
ggctgccctcgtctactgccca

SEQ ID NO: 7814475 - DNA, 22 bp, Homo sapiens
ggctgccctcgtctactgccca

SEQ ID NO: 7814476 - DNA, 22 bp, Homo sapiens
ggctgccctcggggtcgcaggc

SEQ ID NO: 7814477 - DNA, 22 bp, Homo sapiens
ggctgccctagagctggcaagg

SEQ ID NO: 7814478 - DNA, 22 bp, Homo sapiens
ggctgccctcggggtcgcaggc

SEQ ID NO: 7814479 - DNA, 22 bp, Homo sapiens
ggctgccctcggggtcgcaggc

SEQ ID NO: 7814480 - DNA, 22 bp, Homo sapiens
ggctgccctctgctgactgcaa

SEQ ID NO: 7814481 - DNA, 22 bp, Homo sapiens
ggctgccctgggaggcaagggt

SEQ ID NO: 7814482 - DNA, 22 bp, Homo sapiens
ggctgcctactttcccagagtt

SEQ ID NO: 7814483 - DNA, 22 bp, Homo sapiens
ggctgcctactttcccagagtt

SEQ ID NO: 7814484 - DNA, 22 bp, Homo sapiens
ggctgcctaacccttaagtgtc

SEQ ID NO: 7814485 - DNA, 22 bp, Homo sapiens
ggctgcctaacccttaagtgtc

SEQ ID NO: 7814486 - DNA, 20 bp, Homo sapiens
cagaaagcatgttccagggc

SEQ ID NO: 7814487 - DNA, 20 bp, Homo sapiens
cagaaagcatgttccagggc

SEQ ID NO: 7814488 - DNA, 22 bp, Homo sapiens
cagaaagccctatgtacagtgg

SEQ ID NO: 7814489 - DNA, 22 bp, Homo sapiens
cagaaagccctatgtacagtgg

SEQ ID NO: 7814490 - DNA, 22 bp, Homo sapiens
cagaaagcaaaatggatctctg

SEQ ID NO: 7814491 - DNA, 22 bp, Homo sapiens
cagaaagcaagccattcactgt

SEQ ID NO: 7814492 - DNA, 22 bp, Homo sapiens
cagaaagcaagccattcactgt

SEQ ID NO: 7814493 - DNA, 22 bp, Homo sapiens
cagaaagcagagctgagccttt

SEQ ID NO: 7814494 - DNA, 22 bp, Homo sapiens
cagaaagcaagccattcactgt

SEQ ID NO: 7814495 - DNA, 22 bp, Homo sapiens
cagaaagcagagctgagccttt

SEQ ID NO: 7814496 - DNA, 22 bp, Homo sapiens
cagaaagcagagctgagccttt

SEQ ID NO: 7814497 - DNA, 22 bp, Homo sapiens
cagaaagcagagctgagccttt

SEQ ID NO: 7814498 - DNA, 22 bp, Homo sapiens
cagaaagcagttgtcaatgggc

SEQ ID NO: 7814499 - DNA, 22 bp, Homo sapiens
cagaaagcagttgtcaatgggc

SEQ ID NO: 7814500 - DNA, 22 bp, Homo sapiens
cagaaagcagttgtcaatgggc

SEQ ID NO: 7814501 - DNA, 22 bp, Homo sapiens
cagaaagcgggatgcagcatgt

SEQ ID NO: 7814502 - DNA, 22 bp, Homo sapiens
cagaaagctctttcaatcttgc

SEQ ID NO: 7814503 - DNA, 22 bp, Homo sapiens
cagaaagcgggatgcagcatgt

SEQ ID NO: 7814504 - DNA, 22 bp, Homo sapiens
cagaaagcgggatgcagcatgt

SEQ ID NO: 7814505 - DNA, 22 bp, Homo sapiens
cagaaagcgggatgcagcatgt

SEQ ID NO: 7814506 - DNA, 22 bp, Homo sapiens
cagaaagcgggatgcagcatgt

SEQ ID NO: 7814507 - DNA, 23 bp, Homo sapiens
cagaaagccctttccccacagta

SEQ ID NO: 7814508 - DNA, 23 bp, Homo sapiens
cagaaagccctttccccacagta

SEQ ID NO: 7814509 - DNA, 22 bp, Homo sapiens
cagaaagccctatgtacagtgg

SEQ ID NO: 7814510 - DNA, 22 bp, Homo sapiens
cagaaagccgacttacaatgga

SEQ ID NO: 7814511 - DNA, 22 bp, Homo sapiens
cagaaagccgacttacaatgga

SEQ ID NO: 7814512 - DNA, 22 bp, Homo sapiens
cagaaagccctatgtacagtgg

SEQ ID NO: 7814513 - DNA, 22 bp, Homo sapiens
ggctggtgttacagtcggcagc

SEQ ID NO: 7814514 - DNA, 22 bp, Homo sapiens
ggctggtgttacagtcggcagc

SEQ ID NO: 7814515 - DNA, 22 bp, Homo sapiens
ggctggtgttacagtcggcagc

SEQ ID NO: 7814516 - DNA, 22 bp, Homo sapiens
ggctggtgttacagtcggcagc

SEQ ID NO: 7814517 - DNA, 22 bp, Homo sapiens
ggctggtgttacagtcggcagc

SEQ ID NO: 7814518 - DNA, 22 bp, Homo sapiens
ggctggtgttgagtgcctgtag

SEQ ID NO: 7814519 - DNA, 22 bp, Homo sapiens
ggctggtgttgagtgcctgtag

SEQ ID NO: 7814520 - DNA, 22 bp, Homo sapiens
ggctggtgttgagtgcctgtag

SEQ ID NO: 7814521 - DNA, 22 bp, Homo sapiens
ggctggtgttgagtgcctgtag

SEQ ID NO: 7814522 - DNA, 22 bp, Homo sapiens
ggctggtgttgagtgcctgtag

SEQ ID NO: 7814523 - DNA, 22 bp, Homo sapiens
ggctggttttcagttactgagt

SEQ ID NO: 7814524 - DNA, 22 bp, Homo sapiens
ggctggtttgacaaactgacaa

SEQ ID NO: 7814525 - DNA, 21 bp, Homo sapiens
ggctggtgtttagctgtgata

SEQ ID NO: 7814526 - DNA, 21 bp, Homo sapiens
ggctggtgtttagctgtgata

SEQ ID NO: 7814527 - DNA, 21 bp, Homo sapiens
ggctggtgtttagctgtgata

SEQ ID NO: 7814528 - DNA, 21 bp, Homo sapiens
ggctggtgtttagctgtgata

SEQ ID NO: 7814529 - DNA, 21 bp, Homo sapiens
ggctggtgtttagctgtgata

SEQ ID NO: 7814530 - DNA, 21 bp, Homo sapiens
ggctggtgtttagctgtgata

SEQ ID NO: 7814531 - DNA, 21 bp, Homo sapiens
ggctggtgtttagctgtgata

SEQ ID NO: 7814532 - DNA, 21 bp, Homo sapiens
ggctggtgtttagctgtgata

SEQ ID NO: 7814533 - DNA, 21 bp, Homo sapiens
ggctggtgtttagctgtgata

SEQ ID NO: 7814534 - DNA, 22 bp, Homo sapiens
ggctggtgttgagtgcctgtag

SEQ ID NO: 7814535 - DNA, 22 bp, Homo sapiens
ggctgtatatactgtatacagt

SEQ ID NO: 7814536 - DNA, 22 bp, Homo sapiens
ggctgtataaagttaaaggctt

SEQ ID NO: 7814537 - DNA, 22 bp, Homo sapiens
ggctgtatatactgtatacagt

SEQ ID NO: 7814538 - DNA, 22 bp, Homo sapiens
ggctgtatcctggttttggaga

SEQ ID NO: 7814539 - DNA, 22 bp, Homo sapiens
ggctgtagtcagtgacatggta

SEQ ID NO: 7814540 - DNA, 22 bp, Homo sapiens
ggctgtagttacctgatgaaat

SEQ ID NO: 7814541 - DNA, 22 bp, Homo sapiens
ggctgtaggttggtgctggaca

SEQ ID NO: 7814542 - DNA, 22 bp, Homo sapiens
ggctgtaggttggtgctggaca

SEQ ID NO: 7814543 - DNA, 22 bp, Homo sapiens
ggctgtaggttggtgctggaca

SEQ ID NO: 7814544 - DNA, 22 bp, Homo sapiens
ggctgtccacctaccatgccgg

SEQ ID NO: 7814545 - DNA, 20 bp, Homo sapiens
ggctgtcccgcggctgccgg

SEQ ID NO: 7814546 - DNA, 19 bp, Homo sapiens
ggctgtctcggcccagcca

SEQ ID NO: 7814547 - DNA, 22 bp, Homo sapiens
ggcttaaagttttctagaataa

SEQ ID NO: 7814548 - DNA, 22 bp, Homo sapiens
ggcttaaagaattaacagagat

SEQ ID NO: 7814549 - DNA, 22 bp, Homo sapiens
ggcttaaagttttctagaataa

SEQ ID NO: 7814550 - DNA, 22 bp, Homo sapiens
ggcttaaaactttgaaagtgtt

SEQ ID NO: 7814551 - DNA, 22 bp, Homo sapiens
ggctgtttttatagagtccata

SEQ ID NO: 7814552 - DNA, 22 bp, Homo sapiens
ggcttaaaaggaaaatgagagt

SEQ ID NO: 7814553 - DNA, 22 bp, Homo sapiens
ggctgttgacagacataggttt

SEQ ID NO: 7814554 - DNA, 17 bp, Homo sapiens
ggctgtttttaggctgt

SEQ ID NO: 7814555 - DNA, 22 bp, Homo sapiens
ggctgttcctctgagagctgat

SEQ ID NO: 7814556 - DNA, 22 bp, Homo sapiens
ggctgttcctctaacattgcag

SEQ ID NO: 7814557 - DNA, 22 bp, Homo sapiens
ggctgtgttccaagtgtcagga

SEQ ID NO: 7814558 - DNA, 22 bp, Homo sapiens
ggctgtgttccaagtgtcagga

SEQ ID NO: 7814559 - DNA, 22 bp, Homo sapiens
ggctgtgtttctgtttgacatt

SEQ ID NO: 7814560 - DNA, 22 bp, Homo sapiens
ggctgtgtttctgtttgacatt

SEQ ID NO: 7814561 - DNA, 22 bp, Homo sapiens
ggctgtgtttctgtttgacatt

SEQ ID NO: 7814562 - DNA, 22 bp, Homo sapiens
ggctgtcttgggagctcccccg

SEQ ID NO: 7814563 - DNA, 22 bp, Homo sapiens
ggctgtctctgtgactgccacc

SEQ ID NO: 7814564 - DNA, 22 bp, Homo sapiens
ggctgtctctgtgactgccacc

SEQ ID NO: 7814565 - DNA, 19 bp, Homo sapiens
ggctgtctcggcccagcca

SEQ ID NO: 7814566 - DNA, 22 bp, Homo sapiens
ggctgtgaaccctggcagtgtg

SEQ ID NO: 7814567 - DNA, 22 bp, Homo sapiens
ggctgtgaaccctggcagtgtg

SEQ ID NO: 7814568 - DNA, 22 bp, Homo sapiens
ggctgtgaagtagcaggggcag

SEQ ID NO: 7814569 - DNA, 22 bp, Homo sapiens
ggctgtgaaccctggcagtgtg

SEQ ID NO: 7814570 - DNA, 22 bp, Homo sapiens
cagaaaggacagagtgagggtg

SEQ ID NO: 7814571 - DNA, 22 bp, Homo sapiens
cagaaaggacagagtgagggtg

SEQ ID NO: 7814572 - DNA, 22 bp, Homo sapiens
cagaaagcttggtacaatatgc

SEQ ID NO: 7814573 - DNA, 22 bp, Homo sapiens
cagaaaggcacccactgggtct

SEQ ID NO: 7814574 - DNA, 22 bp, Homo sapiens
cagaaaggactttggttggctt

SEQ ID NO: 7814575 - DNA, 22 bp, Homo sapiens
cagaaagctctttcaatcttgc

SEQ ID NO: 7814576 - DNA, 22 bp, Homo sapiens
cagaaagctctttcaatcttgc

SEQ ID NO: 7814577 - DNA, 22 bp, Homo sapiens
cagaaagcttggtacaatatgc

SEQ ID NO: 7814578 - DNA, 22 bp, Homo sapiens
cagaaagcttggtacaatatgc

SEQ ID NO: 7814579 - DNA, 22 bp, Homo sapiens
cagaaagcttggtacaatatgc

SEQ ID NO: 7814580 - DNA, 23 bp, Homo sapiens
cagaaagtttgagaagatacatc

SEQ ID NO: 7814581 - DNA, 23 bp, Homo sapiens
cagaaagtttgagaagatacatc

SEQ ID NO: 7814582 - DNA, 18 bp, Homo sapiens
cagaaagttatttactct

SEQ ID NO: 7814583 - DNA, 22 bp, Homo sapiens
cagaaaggtatgtgtgcctttg

SEQ ID NO: 7814584 - DNA, 22 bp, Homo sapiens
cagaaaggcacccactgggtct

SEQ ID NO: 7814585 - DNA, 22 bp, Homo sapiens
cagaaaggtatgtgtgcctttg

SEQ ID NO: 7814586 - DNA, 22 bp, Homo sapiens
cagaaagtgatttgctattcca

SEQ ID NO: 7814587 - DNA, 18 bp, Homo sapiens
cagaaagttatttactct

SEQ ID NO: 7814588 - DNA, 18 bp, Homo sapiens
cagaaagttatttactct

SEQ ID NO: 7814589 - DNA, 22 bp, Homo sapiens
cagaaagtgatttgctattcca

SEQ ID NO: 7814590 - DNA, 22 bp, Homo sapiens
cagaaataaagtggacagagta

SEQ ID NO: 7814591 - DNA, 22 bp, Homo sapiens
cagaaataaagtggacagagta

SEQ ID NO: 7814592 - DNA, 22 bp, Homo sapiens
cagaaataaagtggacagagta

SEQ ID NO: 7814593 - DNA, 22 bp, Homo sapiens
cagaaatacccagcatttggag

SEQ ID NO: 7814594 - DNA, 22 bp, Homo sapiens
cagaaataaagtggacagagta

SEQ ID NO: 7814595 - DNA, 22 bp, Homo sapiens
ggctgggaggatgacttgctac

SEQ ID NO: 7814596 - DNA, 22 bp, Homo sapiens
cagaaatacccagcatttggag

SEQ ID NO: 7814597 - DNA, 22 bp, Homo sapiens
cagaaatagacaatggcagtgg

SEQ ID NO: 7814598 - DNA, 22 bp, Homo sapiens
ggctgggaggatgacttgctac

SEQ ID NO: 7814599 - DNA, 23 bp, Homo sapiens
cagaaataaactggtttgtagat

SEQ ID NO: 7814600 - DNA, 23 bp, Homo sapiens
cagaaataaactggtttgtagat

SEQ ID NO: 7814601 - DNA, 23 bp, Homo sapiens
cagaaataaactggtttgtagat

SEQ ID NO: 7814602 - DNA, 23 bp, Homo sapiens
cagaaataaactggtttgtagat

SEQ ID NO: 7814603 - DNA, 23 bp, Homo sapiens
cagaaataaactggtttgtagat

SEQ ID NO: 7814604 - DNA, 23 bp, Homo sapiens
cagaaataaactggtttgtagat

SEQ ID NO: 7814605 - DNA, 23 bp, Homo sapiens
cagaaataaactggtttgtagat

SEQ ID NO: 7814606 - DNA, 23 bp, Homo sapiens
cagaaataaactggtttgtagat

SEQ ID NO: 7814607 - DNA, 23 bp, Homo sapiens
cagaaataaactggtttgtagat

SEQ ID NO: 7814608 - DNA, 22 bp, Homo sapiens
cagaaataaacttctcacatcg

SEQ ID NO: 7814609 - DNA, 22 bp, Homo sapiens
cagaaataaacttctcacatcg

SEQ ID NO: 7814610 - DNA, 22 bp, Homo sapiens
cagaaataaacttctcacatcg

SEQ ID NO: 7814611 - DNA, 22 bp, Homo sapiens
cagaaataaacttctcacatcg

SEQ ID NO: 7814612 - DNA, 22 bp, Homo sapiens
cagaaataaacttctcacatcg

SEQ ID NO: 7814613 - DNA, 22 bp, Homo sapiens
cagaaataaacttctcacatcg

SEQ ID NO: 7814614 - DNA, 22 bp, Homo sapiens
cagaaataaacttctcacatcg

SEQ ID NO: 7814615 - DNA, 22 bp, Homo sapiens
cagaaataaacttctcacatcg

SEQ ID NO: 7814616 - DNA, 22 bp, Homo sapiens
gtgctgtgtgatccatgctggc

SEQ ID NO: 7814617 - DNA, 22 bp, Homo sapiens
gtgctgtgtgatccatgctggc

SEQ ID NO: 7814618 - DNA, 22 bp, Homo sapiens
gtgctgtgtgatccatgctggc

SEQ ID NO: 7814619 - DNA, 22 bp, Homo sapiens
gtgctgtgtgatccatgctggc

SEQ ID NO: 7814620 - DNA, 22 bp, Homo sapiens
gtgctgtgtctatcaggaataa

SEQ ID NO: 7814621 - DNA, 22 bp, Homo sapiens
gtgctgtgtgatccatgctggc

SEQ ID NO: 7814622 - DNA, 22 bp, Homo sapiens
gtgctgtgtgatccatgctggc

SEQ ID NO: 7814623 - DNA, 22 bp, Homo sapiens
gtgctgttaaatggggaggagc

SEQ ID NO: 7814624 - DNA, 22 bp, Homo sapiens
gtgctgttctggctgccaccac

SEQ ID NO: 7814625 - DNA, 18 bp, Homo sapiens
gtgctgtgggcagtggcc

SEQ ID NO: 7814626 - DNA, 18 bp, Homo sapiens
gtgctgtgggcagtggcc

SEQ ID NO: 7814627 - DNA, 18 bp, Homo sapiens
gtgctgtgggcagtggcc

SEQ ID NO: 7814628 - DNA, 18 bp, Homo sapiens
gtgctgtgggcagtggcc

SEQ ID NO: 7814629 - DNA, 22 bp, Homo sapiens
gtgctgtgcgctttttctgtat

SEQ ID NO: 7814630 - DNA, 18 bp, Homo sapiens
gtgctgtgggcagtggcc

SEQ ID NO: 7814631 - DNA, 22 bp, Homo sapiens
gtgctgttgcctggctgcacgg

SEQ ID NO: 7814632 - DNA, 22 bp, Homo sapiens
gtgctgttgcctggctgcacgg

SEQ ID NO: 7814633 - DNA, 22 bp, Homo sapiens
gtgctgtttgggagaaggttct

SEQ ID NO: 7814634 - DNA, 22 bp, Homo sapiens
gtgctgtttgaagccacttcat

SEQ ID NO: 7814635 - DNA, 22 bp, Homo sapiens
gtgctgtgcgctttttctgtat

SEQ ID NO: 7814636 - DNA, 22 bp, Homo sapiens
gtgctgagtagaatgaatgcct

SEQ ID NO: 7814637 - DNA, 22 bp, Homo sapiens
gtgctgagtagaatgaatgcct

SEQ ID NO: 7814638 - DNA, 22 bp, Homo sapiens
gtgctgagtagaatgaatgcct

SEQ ID NO: 7814639 - DNA, 21 bp, Homo sapiens
gtgcccgtcccaggagccgac

SEQ ID NO: 7814640 - DNA, 22 bp, Homo sapiens
gtgcccctggcaaatttccctg

SEQ ID NO: 7814641 - DNA, 22 bp, Homo sapiens
gtgccctccgtgttcatagagc

SEQ ID NO: 7814642 - DNA, 22 bp, Homo sapiens
gtgccctccgtgttcatagagc

SEQ ID NO: 7814643 - DNA, 22 bp, Homo sapiens
gtgccctcctgaagccatcaca

SEQ ID NO: 7814644 - DNA, 22 bp, Homo sapiens
gtgcccagtgcaggcccgcagg

SEQ ID NO: 7814645 - DNA, 22 bp, Homo sapiens
gtgcccagtgcaggcccgcagg

SEQ ID NO: 7814646 - DNA, 22 bp, Homo sapiens
gtgcccagttgaggccaggact

SEQ ID NO: 7814647 - DNA, 22 bp, Homo sapiens
gtgcccagttgaggccaggact

SEQ ID NO: 7814648 - DNA, 22 bp, Homo sapiens
gtgcccagttgaggccaggact

SEQ ID NO: 7814649 - DNA, 22 bp, Homo sapiens
gtgcccagttgaggccaggact

SEQ ID NO: 7814650 - DNA, 22 bp, Homo sapiens
gtgcccagttgaggccaggact

SEQ ID NO: 7814651 - DNA, 20 bp, Homo sapiens
gtgcccagttggtgacagac

SEQ ID NO: 7814652 - DNA, 20 bp, Homo sapiens
gtgcccagttggtgacagac

SEQ ID NO: 7814653 - DNA, 22 bp, Homo sapiens
cagccctgcttccccgctagtt

SEQ ID NO: 7814654 - DNA, 22 bp, Homo sapiens
cagccctgcttccccgctagtt

SEQ ID NO: 7814655 - DNA, 22 bp, Homo sapiens
cagccctgcttccccgctagtt

SEQ ID NO: 7814656 - DNA, 22 bp, Homo sapiens
cagccctgcttccccgctagtt

SEQ ID NO: 7814657 - DNA, 22 bp, Homo sapiens
cagccctgcttccccgctagtt

SEQ ID NO: 7814658 - DNA, 22 bp, Homo sapiens
cagccctgctggcaatgatgag

SEQ ID NO: 7814659 - DNA, 22 bp, Homo sapiens
cagccctgctggcaatgatgag

SEQ ID NO: 7814660 - DNA, 22 bp, Homo sapiens
cagccctgctggttttgggcaa

SEQ ID NO: 7814661 - DNA, 22 bp, Homo sapiens
cagccctgctggttttgggcaa

SEQ ID NO: 7814662 - DNA, 22 bp, Homo sapiens
cagccctgctggttttgggcaa

SEQ ID NO: 7814663 - DNA, 22 bp, Homo sapiens
cagccctgctcttagtgtctcc

SEQ ID NO: 7814664 - DNA, 22 bp, Homo sapiens
cagccctgctcttagtgtctcc

SEQ ID NO: 7814665 - DNA, 22 bp, Homo sapiens
cagccctgctgacactgtctga

SEQ ID NO: 7814666 - DNA, 22 bp, Homo sapiens
cagccctgctcttagtgtctcc

SEQ ID NO: 7814667 - DNA, 22 bp, Homo sapiens
cagccctgctcttagtgtctcc

SEQ ID NO: 7814668 - DNA, 22 bp, Homo sapiens
cagccctgctgacactgtctga

SEQ ID NO: 7814669 - DNA, 22 bp, Homo sapiens
cagccctgctggcaatgatgag

SEQ ID NO: 7814670 - DNA, 22 bp, Homo sapiens
cagccctgctgacactgtctga

SEQ ID NO: 7814671 - DNA, 22 bp, Homo sapiens
cagccctgctgccttagtgcct

SEQ ID NO: 7814672 - DNA, 22 bp, Homo sapiens
cagccctgccatggagcctcct

SEQ ID NO: 7814673 - DNA, 22 bp, Homo sapiens
cagccctgccatggagcctcct

SEQ ID NO: 7814674 - DNA, 22 bp, Homo sapiens
cagccctgccatggagcctcct

SEQ ID NO: 7814675 - DNA, 22 bp, Homo sapiens
cagccctgccatggagcctcct

SEQ ID NO: 7814676 - DNA, 22 bp, Homo sapiens
cagccctgcagctggatctcac

SEQ ID NO: 7814677 - DNA, 22 bp, Homo sapiens
cagccctgccatggagcctcct

SEQ ID NO: 7814678 - DNA, 17 bp, Homo sapiens
cagccctgccgttccca

SEQ ID NO: 7814679 - DNA, 22 bp, Homo sapiens
cagccctgccatggagcctcct

SEQ ID NO: 7814680 - DNA, 17 bp, Homo sapiens
cagccctgccgttccca

SEQ ID NO: 7814681 - DNA, 22 bp, Homo sapiens
cagccctgcggaggtgtatact

SEQ ID NO: 7814682 - DNA, 17 bp, Homo sapiens
cagccctgccgttccca

SEQ ID NO: 7814683 - DNA, 23 bp, Homo sapiens
cagccctgaaatcgaggtgacac

SEQ ID NO: 7814684 - DNA, 23 bp, Homo sapiens
cagccctgaaatcgaggtgacac

SEQ ID NO: 7814685 - DNA, 22 bp, Homo sapiens
cagccctgaaacaacctcctct

SEQ ID NO: 7814686 - DNA, 22 bp, Homo sapiens
cagccctgcagccatggcctgt

SEQ ID NO: 7814687 - DNA, 22 bp, Homo sapiens
cagccctgcagccatggcctgt

SEQ ID NO: 7814688 - DNA, 22 bp, Homo sapiens
cagccctgcagccatggcctgt

SEQ ID NO: 7814689 - DNA, 22 bp, Homo sapiens
cagccctgcagccatggcctgt

SEQ ID NO: 7814690 - DNA, 22 bp, Homo sapiens
cagccctgcagccatggcctgt

SEQ ID NO: 7814691 - DNA, 22 bp, Homo sapiens
cagccctgcagctggatctcac

SEQ ID NO: 7814692 - DNA, 22 bp, Homo sapiens
cagccctgcagctggatctcac

SEQ ID NO: 7814693 - DNA, 22 bp, Homo sapiens
cagccctgcagccatggcctgt

SEQ ID NO: 7814694 - DNA, 22 bp, Homo sapiens
cagccctgcagctggatctcac

SEQ ID NO: 7814695 - DNA, 16 bp, Homo sapiens
cagcctgcagtggtca

SEQ ID NO: 7814696 - DNA, 22 bp, Homo sapiens
cagcctgcagggctgcctgttg

SEQ ID NO: 7814697 - DNA, 22 bp, Homo sapiens
cagcctgcagggctgcctgttg

SEQ ID NO: 7814698 - DNA, 16 bp, Homo sapiens
cagcctgcagtggtca

SEQ ID NO: 7814699 - DNA, 20 bp, Homo sapiens
cagcctgcatcatctgcagc

SEQ ID NO: 7814700 - DNA, 20 bp, Homo sapiens
cagcctgcatcatctgcagc

SEQ ID NO: 7814701 - DNA, 20 bp, Homo sapiens
cagcctgcatcatctgcagc

SEQ ID NO: 7814702 - DNA, 22 bp, Homo sapiens
cagcctgctagggcaatgcctt

SEQ ID NO: 7814703 - DNA, 22 bp, Homo sapiens
cagcctgcctcagtttccctct

SEQ ID NO: 7814704 - DNA, 22 bp, Homo sapiens
cagcctgccgtcagccaggtag

SEQ ID NO: 7814705 - DNA, 22 bp, Homo sapiens
cagcctgccgtcagccaggtag

SEQ ID NO: 7814706 - DNA, 22 bp, Homo sapiens
cagcctgccgtcagccaggtag

SEQ ID NO: 7814707 - DNA, 22 bp, Homo sapiens
cagcctgccgtcagccaggtag

SEQ ID NO: 7814708 - DNA, 22 bp, Homo sapiens
cagcctgcatttgtatctgtat

SEQ ID NO: 7814709 - DNA, 22 bp, Homo sapiens
cagcctgcatttgtatctgtat

SEQ ID NO: 7814710 - DNA, 22 bp, Homo sapiens
cagcctgccctggaagcccagc

SEQ ID NO: 7814711 - DNA, 22 bp, Homo sapiens
cagcctgacaccagctttgggc

SEQ ID NO: 7814712 - DNA, 22 bp, Homo sapiens
cagcctgactatggctgcaggt

SEQ ID NO: 7814713 - DNA, 22 bp, Homo sapiens
cagcctgactatggctgcaggt

SEQ ID NO: 7814714 - DNA, 22 bp, Homo sapiens
cagcctgagccttctgtagcaa

SEQ ID NO: 7814715 - DNA, 22 bp, Homo sapiens
cagcctgagccttctgtagcaa

SEQ ID NO: 7814716 - DNA, 22 bp, Homo sapiens
cagcctgactatggctgcaggt

SEQ ID NO: 7814717 - DNA, 22 bp, Homo sapiens
cagcctgcaggaggccgtcagc

SEQ ID NO: 7814718 - DNA, 22 bp, Homo sapiens
cagcctgcagggctgcctgttg

SEQ ID NO: 7814719 - DNA, 22 bp, Homo sapiens
cagcctgcagggctgcctgttg

SEQ ID NO: 7814720 - DNA, 22 bp, Homo sapiens
cagcctgcagggctgcctgttg

SEQ ID NO: 7814721 - DNA, 22 bp, Homo sapiens
cagccctggaacagctgactca

SEQ ID NO: 7814722 - DNA, 22 bp, Homo sapiens
cagccctggaacagctgactca

SEQ ID NO: 7814723 - DNA, 22 bp, Homo sapiens
cagccctgcttccccgctagtt

SEQ ID NO: 7814724 - DNA, 22 bp, Homo sapiens
cagccctgcttccccgctagtt

SEQ ID NO: 7814725 - DNA, 22 bp, Homo sapiens
cagccctggaacagctgactca

SEQ ID NO: 7814726 - DNA, 22 bp, Homo sapiens
cagccctggaacagctgactca

SEQ ID NO: 7814727 - DNA, 22 bp, Homo sapiens
cagccctggaacagctgactca

SEQ ID NO: 7814728 - DNA, 22 bp, Homo sapiens
cagccctggaacagctgactca

SEQ ID NO: 7814729 - DNA, 23 bp, Homo sapiens
cagccctggagatgtgggaggca

SEQ ID NO: 7814730 - DNA, 23 bp, Homo sapiens
cagccctggagatgtgggaggca

SEQ ID NO: 7814731 - DNA, 23 bp, Homo sapiens
cagccctggagatgtgggaggca

SEQ ID NO: 7814732 - DNA, 22 bp, Homo sapiens
cagccctggaacagctgactca

SEQ ID NO: 7814733 - DNA, 23 bp, Homo sapiens
cagccctggagatgtgggaggca

SEQ ID NO: 7814734 - DNA, 23 bp, Homo sapiens
cagccctggagatgtgggaggca

SEQ ID NO: 7814735 - DNA, 23 bp, Homo sapiens
cagccctggagatgtgggaggca

SEQ ID NO: 7814736 - DNA, 22 bp, Homo sapiens
cagccctggcagctttcagggt

SEQ ID NO: 7814737 - DNA, 22 bp, Homo sapiens
cagccctggcagctttcagggt

SEQ ID NO: 7814738 - DNA, 22 bp, Homo sapiens
cagccctggcccaggtgcctta

SEQ ID NO: 7814739 - DNA, 22 bp, Homo sapiens
cagccctggcccaggtgcctta

SEQ ID NO: 7814740 - DNA, 20 bp, Homo sapiens
cagcctccactcactcagct

SEQ ID NO: 7814741 - DNA, 22 bp, Homo sapiens
cagccctggcccaggtgcctta

SEQ ID NO: 7814742 - DNA, 22 bp, Homo sapiens
cagcctctttccacatcaggca

SEQ ID NO: 7814743 - DNA, 20 bp, Homo sapiens
cagcctccactcactcagct

SEQ ID NO: 7814744 - DNA, 22 bp, Homo sapiens
cagccttcaaggcttagctcag

SEQ ID NO: 7814745 - DNA, 22 bp, Homo sapiens
cagcctgtggcagaggtctaat

SEQ ID NO: 7814746 - DNA, 22 bp, Homo sapiens
cagcctgtctgggcagagtgga

SEQ ID NO: 7814747 - DNA, 22 bp, Homo sapiens
cagcctgtagtctggtccaggt

SEQ ID NO: 7814748 - DNA, 22 bp, Homo sapiens
cagcctggtccccggctcaccc

SEQ ID NO: 7814749 - DNA, 22 bp, Homo sapiens
cagcctggtccccggctcaccc

SEQ ID NO: 7814750 - DNA, 22 bp, Homo sapiens
cagcctggtccccggctcaccc

SEQ ID NO: 7814751 - DNA, 22 bp, Homo sapiens
cagcctggtccccggctcaccc

SEQ ID NO: 7814752 - DNA, 22 bp, Homo sapiens
cagcctggattgcagaatgcta

SEQ ID NO: 7814753 - DNA, 22 bp, Homo sapiens
cagcctggattgcagaatgcta

SEQ ID NO: 7814754 - DNA, 22 bp, Homo sapiens
cagcctggcctgggactgctga

SEQ ID NO: 7814755 - DNA, 22 bp, Homo sapiens
cagcctggcctgggactgctga

SEQ ID NO: 7814756 - DNA, 22 bp, Homo sapiens
cagcctggcctgggactgctga

SEQ ID NO: 7814757 - DNA, 22 bp, Homo sapiens
cagcctggcctgggactgctga

SEQ ID NO: 7814758 - DNA, 22 bp, Homo sapiens
cagcctggcctgggactgctga

SEQ ID NO: 7814759 - DNA, 22 bp, Homo sapiens
cagcctggcctgggactgctga

SEQ ID NO: 7814760 - DNA, 22 bp, Homo sapiens
cagcctgggctccagagtccct

SEQ ID NO: 7814761 - DNA, 22 bp, Homo sapiens
cagcctgggctccagagtccct

SEQ ID NO: 7814762 - DNA, 22 bp, Homo sapiens
cagcctggtccccggctcaccc

SEQ ID NO: 7814763 - DNA, 22 bp, Homo sapiens
cagcctggtccccggctcaccc

SEQ ID NO: 7814764 - DNA, 22 bp, Homo sapiens
cagcctggtccccggctcaccc

SEQ ID NO: 7814765 - DNA, 22 bp, Homo sapiens
cagcctgggctccagagtccct

SEQ ID NO: 7814766 - DNA, 22 bp, Homo sapiens
cagcctgggctccagagtccct

SEQ ID NO: 7814767 - DNA, 22 bp, Homo sapiens
cagcctgggctccagagtccct

SEQ ID NO: 7814768 - DNA, 22 bp, Homo sapiens
cagcctgctctcagatgttgag

SEQ ID NO: 7814769 - DNA, 22 bp, Homo sapiens
cagcctgctctcagatgttgag

SEQ ID NO: 7814770 - DNA, 22 bp, Homo sapiens
cagcctgctctcagatgttgag

SEQ ID NO: 7814771 - DNA, 22 bp, Homo sapiens
cagcctgctagggcaatgcctt

SEQ ID NO: 7814772 - DNA, 22 bp, Homo sapiens
cagcctgctagggcaatgcctt

SEQ ID NO: 7814773 - DNA, 22 bp, Homo sapiens
cagcctgctagggcaatgcctt

SEQ ID NO: 7814774 - DNA, 22 bp, Homo sapiens
cagcctgctagggcaatgcctt

SEQ ID NO: 7814775 - DNA, 21 bp, Homo sapiens
cagcctgctgctccagggcca

SEQ ID NO: 7814776 - DNA, 21 bp, Homo sapiens
cagcctgctgctccagggcca

SEQ ID NO: 7814777 - DNA, 21 bp, Homo sapiens
cagcctgctgctccagggcca

SEQ ID NO: 7814778 - DNA, 21 bp, Homo sapiens
cagcctgctgctccagggcca

SEQ ID NO: 7814779 - DNA, 21 bp, Homo sapiens
cagcctgctgctccagggcca

SEQ ID NO: 7814780 - DNA, 21 bp, Homo sapiens
cagcctgctgctccagggcca

SEQ ID NO: 7814781 - DNA, 22 bp, Homo sapiens
cagcctggacagcgaccagagt

SEQ ID NO: 7814782 - DNA, 22 bp, Homo sapiens
cagcctggacagcgaccagagt

SEQ ID NO: 7814783 - DNA, 22 bp, Homo sapiens
cagcctggacagcgaccagagt

SEQ ID NO: 7814784 - DNA, 22 bp, Homo sapiens
cagcctggacagcgaccagagt

SEQ ID NO: 7814785 - DNA, 22 bp, Homo sapiens
cagcctggacagcgaccagagt

SEQ ID NO: 7814786 - DNA, 22 bp, Homo sapiens
cagcctggagccacagcccagg

SEQ ID NO: 7814787 - DNA, 22 bp, Homo sapiens
cagcctggagccacagcccagg

SEQ ID NO: 7814788 - DNA, 22 bp, Homo sapiens
cagcctggagccacagcccagg

SEQ ID NO: 7814789 - DNA, 22 bp, Homo sapiens
cagcctggacagcgaccagagt

SEQ ID NO: 7814790 - DNA, 22 bp, Homo sapiens
cagcctggagccacagcccagg

SEQ ID NO: 7814791 - DNA, 22 bp, Homo sapiens
cagcctggagccacagcccagg

SEQ ID NO: 7814792 - DNA, 22 bp, Homo sapiens
cagcctggagccacagcccagg

SEQ ID NO: 7814793 - DNA, 22 bp, Homo sapiens
cagcctggagccacagcccagg

SEQ ID NO: 7814794 - DNA, 22 bp, Homo sapiens
cagcctggattgcagaatgcta

SEQ ID NO: 7814795 - DNA, 22 bp, Homo sapiens
cagcctggattgcagaatgcta

SEQ ID NO: 7814796 - DNA, 22 bp, Homo sapiens
cagcctggattgcagaatgcta

SEQ ID NO: 7814797 - DNA, 22 bp, Homo sapiens
cagcctggagccacagcccagg

SEQ ID NO: 7814798 - DNA, 22 bp, Homo sapiens
cagcctggattgcagaatgcta

SEQ ID NO: 7814799 - DNA, 22 bp, Homo sapiens
cagcctggattgcagaatgcta

SEQ ID NO: 7814800 - DNA, 22 bp, Homo sapiens
cagcctggattgcagaatgcta

SEQ ID NO: 7814801 - DNA, 22 bp, Homo sapiens
cagctagtacaatgggagagca

SEQ ID NO: 7814802 - DNA, 22 bp, Homo sapiens
cagctagtacaatgggagagca

SEQ ID NO: 7814803 - DNA, 20 bp, Homo sapiens
cagctagtggtaggagtcgg

SEQ ID NO: 7814804 - DNA, 22 bp, Homo sapiens
cagctagtcagaggcagggcca

SEQ ID NO: 7814805 - DNA, 22 bp, Homo sapiens
cagctagggagtggcagagctt

SEQ ID NO: 7814806 - DNA, 22 bp, Homo sapiens
cagctagggagtggcagagctt

SEQ ID NO: 7814807 - DNA, 22 bp, Homo sapiens
cagctagtaaatggcaagacta

SEQ ID NO: 7814808 - DNA, 22 bp, Homo sapiens
cagctagtaaatggcaagacta

SEQ ID NO: 7814809 - DNA, 22 bp, Homo sapiens
cagctagggagtggcagagctt

SEQ ID NO: 7814810 - DNA, 22 bp, Homo sapiens
cagctagggagtggcagagctt

SEQ ID NO: 7814811 - DNA, 22 bp, Homo sapiens
cagctaggaagtccttggcgaa

SEQ ID NO: 7814812 - DNA, 22 bp, Homo sapiens
gtgcccagtcctgccttgacag

SEQ ID NO: 7814813 - DNA, 22 bp, Homo sapiens
gtgcccagtcctgccttgacag

SEQ ID NO: 7814814 - DNA, 22 bp, Homo sapiens
gtgcccagtcctgccttgacag

SEQ ID NO: 7814815 - DNA, 22 bp, Homo sapiens
gtgcccagtgcaggcccgcagg

SEQ ID NO: 7814816 - DNA, 22 bp, Homo sapiens
gtgcccagtaaatgaaagcttt

SEQ ID NO: 7814817 - DNA, 22 bp, Homo sapiens
gtgcccagtcctgccttgacag

SEQ ID NO: 7814818 - DNA, 22 bp, Homo sapiens
gtgcccagtcctgccttgacag

SEQ ID NO: 7814819 - DNA, 22 bp, Homo sapiens
gtgcccagtaaatgaaagcttt

SEQ ID NO: 7814820 - DNA, 22 bp, Homo sapiens
cagctattattttctctaaatt

SEQ ID NO: 7814821 - DNA, 22 bp, Homo sapiens
cagctatagatggactgaagag

SEQ ID NO: 7814822 - DNA, 22 bp, Homo sapiens
gtgcccaggtgtccctgagaag

SEQ ID NO: 7814823 - DNA, 22 bp, Homo sapiens
cagctaccatggtttgttccag

SEQ ID NO: 7814824 - DNA, 22 bp, Homo sapiens
cagctactcctcccatgacttc

SEQ ID NO: 7814825 - DNA, 22 bp, Homo sapiens
cagctagaaagtctgttaggga

SEQ ID NO: 7814826 - DNA, 22 bp, Homo sapiens
cagctagaaagtctgttaggga

SEQ ID NO: 7814827 - DNA, 22 bp, Homo sapiens
cagctacaggacgggcatctgc

SEQ ID NO: 7814828 - DNA, 22 bp, Homo sapiens
cagctacagttccactgagcat

SEQ ID NO: 7814829 - DNA, 22 bp, Homo sapiens
cagctacagttccactgagcat

SEQ ID NO: 7814830 - DNA, 22 bp, Homo sapiens
cagctaggaaaccagagggcag

SEQ ID NO: 7814831 - DNA, 22 bp, Homo sapiens
cagctaggaaaccagagggcag

SEQ ID NO: 7814832 - DNA, 22 bp, Homo sapiens
cagctagcttccctgcagtgct

SEQ ID NO: 7814833 - DNA, 22 bp, Homo sapiens
cagctagagggatgctgtgtga

SEQ ID NO: 7814834 - DNA, 22 bp, Homo sapiens
cagctagcggtgctggcggctc

SEQ ID NO: 7814835 - DNA, 22 bp, Homo sapiens
cagctagaaatgggattggtat

SEQ ID NO: 7814836 - DNA, 22 bp, Homo sapiens
cagctagcggtgctggcggctc

SEQ ID NO: 7814837 - DNA, 22 bp, Homo sapiens
cagctagctaagaaggccagag

SEQ ID NO: 7814838 - DNA, 22 bp, Homo sapiens
cagctagcggtgctggcggctc

SEQ ID NO: 7814839 - DNA, 22 bp, Homo sapiens
cagctacagaggccacatggct

SEQ ID NO: 7814840 - DNA, 22 bp, Homo sapiens
cagctacagaggccacatggct

SEQ ID NO: 7814841 - DNA, 22 bp, Homo sapiens
cagctacagaggccacatggct

SEQ ID NO: 7814842 - DNA, 22 bp, Homo sapiens
cagctacacgtgcccctggggt

SEQ ID NO: 7814843 - DNA, 22 bp, Homo sapiens
cagctacagtctgattggttca

SEQ ID NO: 7814844 - DNA, 22 bp, Homo sapiens
cagctacaggacctgatgcacc

SEQ ID NO: 7814845 - DNA, 22 bp, Homo sapiens
cagctacaggacctgatgcacc

SEQ ID NO: 7814846 - DNA, 22 bp, Homo sapiens
cagctacaggacctgatgcacc

SEQ ID NO: 7814847 - DNA, 22 bp, Homo sapiens
cagctacaaatacttttgtatg

SEQ ID NO: 7814848 - DNA, 22 bp, Homo sapiens
cagccttcaaggcttagctcag

SEQ ID NO: 7814849 - DNA, 22 bp, Homo sapiens
cagctacacaccagaactatta

SEQ ID NO: 7814850 - DNA, 22 bp, Homo sapiens
cagctacacaccagaactatta

SEQ ID NO: 7814851 - DNA, 22 bp, Homo sapiens
cagctaatcctctctatccaag

SEQ ID NO: 7814852 - DNA, 22 bp, Homo sapiens
cagctacaaatacttttgtatg

SEQ ID NO: 7814853 - DNA, 22 bp, Homo sapiens
cagccagggagcaaagagttga

SEQ ID NO: 7814854 - DNA, 22 bp, Homo sapiens
cagccagggagcaaagagttga

SEQ ID NO: 7814855 - DNA, 22 bp, Homo sapiens
cagccagggagggcaaatgaga

SEQ ID NO: 7814856 - DNA, 22 bp, Homo sapiens
cagccagggagcaaagagttga

SEQ ID NO: 7814857 - DNA, 22 bp, Homo sapiens
cagccagggagggcaaatgaga

SEQ ID NO: 7814858 - DNA, 22 bp, Homo sapiens
cagccagggagggcaaatgaga

SEQ ID NO: 7814859 - DNA, 22 bp, Homo sapiens
cagccaggcctggtgaccaaag

SEQ ID NO: 7814860 - DNA, 22 bp, Homo sapiens
cagccaggcctggtgaccaaag

SEQ ID NO: 7814861 - DNA, 22 bp, Homo sapiens
cagccaggcctggtgaccaaag

SEQ ID NO: 7814862 - DNA, 22 bp, Homo sapiens
cagccaggcctggtgaccaaag

SEQ ID NO: 7814863 - DNA, 22 bp, Homo sapiens
cagccaggcctggtgaccaaag

SEQ ID NO: 7814864 - DNA, 22 bp, Homo sapiens
cagccaggcctggtgaccaaag

SEQ ID NO: 7814865 - DNA, 22 bp, Homo sapiens
cagccaggcccccgagtcgttg

SEQ ID NO: 7814866 - DNA, 22 bp, Homo sapiens
gtctggagccccagtcaatgag

SEQ ID NO: 7814867 - DNA, 22 bp, Homo sapiens
gtctggagccactgctgctgct

SEQ ID NO: 7814868 - DNA, 22 bp, Homo sapiens
gtctggagccaccctaagcatt

SEQ ID NO: 7814869 - DNA, 22 bp, Homo sapiens
gtctggagacttgggtcatcaa

SEQ ID NO: 7814870 - DNA, 22 bp, Homo sapiens
gtctggagacttgggtcatcaa

SEQ ID NO: 7814871 - DNA, 22 bp, Homo sapiens
gtctggactttatcccaaggtt

SEQ ID NO: 7814872 - DNA, 22 bp, Homo sapiens
gtctggagacttgggtcatcaa

SEQ ID NO: 7814873 - DNA, 22 bp, Homo sapiens
gtctggagacttgggtcatcaa

SEQ ID NO: 7814874 - DNA, 22 bp, Homo sapiens
gtctggagagctgagcagagtt

SEQ ID NO: 7814875 - DNA, 22 bp, Homo sapiens
gtctggagagctgagcagagtt

SEQ ID NO: 7814876 - DNA, 22 bp, Homo sapiens
gtctggagagctgagcagagtt

SEQ ID NO: 7814877 - DNA, 22 bp, Homo sapiens
gtctggaagctctaggggagaa

SEQ ID NO: 7814878 - DNA, 22 bp, Homo sapiens
gtctggaaggaggagatggagc

SEQ ID NO: 7814879 - DNA, 22 bp, Homo sapiens
gtctggaagaactagggatgtt

SEQ ID NO: 7814880 - DNA, 22 bp, Homo sapiens
gtctggactgtggcagcttgcc

SEQ ID NO: 7814881 - DNA, 22 bp, Homo sapiens
gtctggacagcagcacctcggc

SEQ ID NO: 7814882 - DNA, 22 bp, Homo sapiens
gtctggaagggagtgcattttc

SEQ ID NO: 7814883 - DNA, 22 bp, Homo sapiens
gtctggaatatagcaagctctt

SEQ ID NO: 7814884 - DNA, 22 bp, Homo sapiens
gtctggaaatttaaggtatgag

SEQ ID NO: 7814885 - DNA, 22 bp, Homo sapiens
gtctggaaccaagacgtgtagc

SEQ ID NO: 7814886 - DNA, 22 bp, Homo sapiens
gtctggaagaacctgtgccagt

SEQ ID NO: 7814887 - DNA, 22 bp, Homo sapiens
gtctggaaccaatatttgaggg

SEQ ID NO: 7814888 - DNA, 22 bp, Homo sapiens
gtctggaagaacctgtgccagt

SEQ ID NO: 7814889 - DNA, 22 bp, Homo sapiens
gtctggaaagagctgaggttca

SEQ ID NO: 7814890 - DNA, 22 bp, Homo sapiens
gtctggaaaggggcttttatct

SEQ ID NO: 7814891 - DNA, 22 bp, Homo sapiens
gtctggaaattaagaggaggtt

SEQ ID NO: 7814892 - DNA, 22 bp, Homo sapiens
gtccctgggtctaaggcagtaa

SEQ ID NO: 7814893 - DNA, 22 bp, Homo sapiens
gtccctgggtctaaggcagtaa

SEQ ID NO: 7814894 - DNA, 22 bp, Homo sapiens
gtccctggtctaccgtggcttc

SEQ ID NO: 7814895 - DNA, 22 bp, Homo sapiens
gtccctggtttgcccaggacca

SEQ ID NO: 7814896 - DNA, 22 bp, Homo sapiens
gtccctgggggtttaggactca

SEQ ID NO: 7814897 - DNA, 22 bp, Homo sapiens
gtccctgggtagctcagtggct

SEQ ID NO: 7814898 - DNA, 22 bp, Homo sapiens
gtccctgggggtttaggactca

SEQ ID NO: 7814899 - DNA, 22 bp, Homo sapiens
gtccctgggtctaaggcagtaa

SEQ ID NO: 7814900 - DNA, 22 bp, Homo sapiens
gtccctgggtctaaggcagtaa

SEQ ID NO: 7814901 - DNA, 22 bp, Homo sapiens
gtccctgggtctaaggcagtaa

SEQ ID NO: 7814902 - DNA, 22 bp, Homo sapiens
gtccctgggtctaaggcagtaa

SEQ ID NO: 7814903 - DNA, 22 bp, Homo sapiens
gtccctgggtctaaggcagtaa

SEQ ID NO: 7814904 - DNA, 19 bp, Homo sapiens
gtcccttcactcctgctgg

SEQ ID NO: 7814905 - DNA, 19 bp, Homo sapiens
gtcccttcactcctgctgg

SEQ ID NO: 7814906 - DNA, 19 bp, Homo sapiens
gtcccttcactcctgctgg

SEQ ID NO: 7814907 - DNA, 22 bp, Homo sapiens
gtcccttcctcattccacttta

SEQ ID NO: 7814908 - DNA, 22 bp, Homo sapiens
gtcccttcctcattccacttta

SEQ ID NO: 7814909 - DNA, 22 bp, Homo sapiens
gtcccttcctcattccacttta

SEQ ID NO: 7814910 - DNA, 22 bp, Homo sapiens
gtctcttttatggtgagttgat

SEQ ID NO: 7814911 - DNA, 22 bp, Homo sapiens
gtctgctttgtctttcatgata

SEQ ID NO: 7814912 - DNA, 22 bp, Homo sapiens
gtctgcttttctgccctttcat

SEQ ID NO: 7814913 - DNA, 22 bp, Homo sapiens
gtcccaggctccatggcagcca

SEQ ID NO: 7814914 - DNA, 22 bp, Homo sapiens
gtcccaggctccatggcagcca

SEQ ID NO: 7814915 - DNA, 22 bp, Homo sapiens
gtcccaggctccatggcagcca

SEQ ID NO: 7814916 - DNA, 22 bp, Homo sapiens
gtcccaggctccatggcagcca

SEQ ID NO: 7814917 - DNA, 22 bp, Homo sapiens
gtcccaggcttatgtggagctt

SEQ ID NO: 7814918 - DNA, 22 bp, Homo sapiens
gtcccaggcttatgtggagctt

SEQ ID NO: 7814919 - DNA, 22 bp, Homo sapiens
gtcccagggaagaaggcagcac

SEQ ID NO: 7814920 - DNA, 22 bp, Homo sapiens
gtcccagggaagaaggcagcac

SEQ ID NO: 7814921 - DNA, 22 bp, Homo sapiens
gtcccagggaagaaggcagcac

SEQ ID NO: 7814922 - DNA, 22 bp, Homo sapiens
gtccctgggaaaggagagggca

SEQ ID NO: 7814923 - DNA, 22 bp, Homo sapiens
gtccctggggaatcagctggag

SEQ ID NO: 7814924 - DNA, 19 bp, Homo sapiens
gtccctgggcagaggcacc

SEQ ID NO: 7814925 - DNA, 22 bp, Homo sapiens
gtccctggggaatcagctggag

SEQ ID NO: 7814926 - DNA, 22 bp, Homo sapiens
gtccctgggcgcctccgtgctc

SEQ ID NO: 7814927 - DNA, 22 bp, Homo sapiens
gtccctgggaaaggagagggca

SEQ ID NO: 7814928 - DNA, 22 bp, Homo sapiens
gtccctgggaaaggagagggca

SEQ ID NO: 7814929 - DNA, 19 bp, Homo sapiens
gtccctgggcagaggcacc

SEQ ID NO: 7814930 - DNA, 19 bp, Homo sapiens
gtccctgggcagaggcacc

SEQ ID NO: 7814931 - DNA, 22 bp, Homo sapiens
cagccaggttagtgctaattgt

SEQ ID NO: 7814932 - DNA, 22 bp, Homo sapiens
cagccaggttagtgctaattgt

SEQ ID NO: 7814933 - DNA, 22 bp, Homo sapiens
cagccaggtatgggcgtgcggg

SEQ ID NO: 7814934 - DNA, 22 bp, Homo sapiens
cagccaggttagtgctaattgt

SEQ ID NO: 7814935 - DNA, 22 bp, Homo sapiens
cagccaggtatgggcgtgcggg

SEQ ID NO: 7814936 - DNA, 22 bp, Homo sapiens
cagccaggtatgggcgtgcggg

SEQ ID NO: 7814937 - DNA, 22 bp, Homo sapiens
cagccaggtatgggcgtgcggg

SEQ ID NO: 7814938 - DNA, 22 bp, Homo sapiens
cagccaggttcaagtccttata

SEQ ID NO: 7814939 - DNA, 22 bp, Homo sapiens
cagccaggttcaagtccttata

SEQ ID NO: 7814940 - DNA, 22 bp, Homo sapiens
cagcccaggctcagatgttggg

SEQ ID NO: 7814941 - DNA, 22 bp, Homo sapiens
cagcccaggctcagatgttggg

SEQ ID NO: 7814942 - DNA, 22 bp, Homo sapiens
cagcccaggctcagatgttggg

SEQ ID NO: 7814943 - DNA, 22 bp, Homo sapiens
cagccaggggctggcgtgttga

SEQ ID NO: 7814944 - DNA, 22 bp, Homo sapiens
cagccagggtcaggcagcttct

SEQ ID NO: 7814945 - DNA, 22 bp, Homo sapiens
cagccaggggctggcgtgttga

SEQ ID NO: 7814946 - DNA, 22 bp, Homo sapiens
cagccaggggctggcgtgttga

SEQ ID NO: 7814947 - DNA, 22 bp, Homo sapiens
cagccagggagggcaaatgaga

SEQ ID NO: 7814948 - DNA, 22 bp, Homo sapiens
cagccaggggctggcgtgttga

SEQ ID NO: 7814949 - DNA, 22 bp, Homo sapiens
cagccagggagggcaaatgaga

SEQ ID NO: 7814950 - DNA, 22 bp, Homo sapiens
cagccagggtcaggcagcttct

SEQ ID NO: 7814951 - DNA, 22 bp, Homo sapiens
cagccagggtcaggcagcttct

SEQ ID NO: 7814952 - DNA, 22 bp, Homo sapiens
cagccagggtcaggcagcttct

SEQ ID NO: 7814953 - DNA, 22 bp, Homo sapiens
cagccagggtcaggcagcttct

SEQ ID NO: 7814954 - DNA, 22 bp, Homo sapiens
cagccagggtcaggcagcttct

SEQ ID NO: 7814955 - DNA, 22 bp, Homo sapiens
cagccaggtatgggcgtgcggg

SEQ ID NO: 7814956 - DNA, 22 bp, Homo sapiens
cagccccttcctggcatctgga

SEQ ID NO: 7814957 - DNA, 22 bp, Homo sapiens
cagccccttcctggcatctgga

SEQ ID NO: 7814958 - DNA, 22 bp, Homo sapiens
cagccccttcctggcatctgga

SEQ ID NO: 7814959 - DNA, 22 bp, Homo sapiens
cagccccttgtccggtagccac

SEQ ID NO: 7814960 - DNA, 22 bp, Homo sapiens
cagccccttcctggcatctgga

SEQ ID NO: 7814961 - DNA, 22 bp, Homo sapiens
cagccccttcctggcatctgga

SEQ ID NO: 7814962 - DNA, 22 bp, Homo sapiens
cagccccttcctggcatctgga

SEQ ID NO: 7814963 - DNA, 22 bp, Homo sapiens
cagcccctggcgcacgccgagc

SEQ ID NO: 7814964 - DNA, 22 bp, Homo sapiens
cagcccctggcgcacgccgagc

SEQ ID NO: 7814965 - DNA, 22 bp, Homo sapiens
cagccccttcctggcatctgga

SEQ ID NO: 7814966 - DNA, 22 bp, Homo sapiens
cagccctcaaaccacttccagg

SEQ ID NO: 7814967 - DNA, 22 bp, Homo sapiens
cagccctcaaaccacttccagg

SEQ ID NO: 7814968 - DNA, 22 bp, Homo sapiens
cagccctcaaaccacttccagg

SEQ ID NO: 7814969 - DNA, 22 bp, Homo sapiens
cagcccgtcacacgctagcatc

SEQ ID NO: 7814970 - DNA, 22 bp, Homo sapiens
cagccccttgtccggtagccac

SEQ ID NO: 7814971 - DNA, 22 bp, Homo sapiens
cagccccttgtccggtagccac

SEQ ID NO: 7814972 - DNA, 22 bp, Homo sapiens
cagccccttgtccggtagccac

SEQ ID NO: 7814973 - DNA, 22 bp, Homo sapiens
cagccccttcctggcatctgga

SEQ ID NO: 7814974 - DNA, 22 bp, Homo sapiens
cagcccctcacagagctgtcct

SEQ ID NO: 7814975 - DNA, 22 bp, Homo sapiens
cagcccctcacagagctgtcct

SEQ ID NO: 7814976 - DNA, 22 bp, Homo sapiens
cagcccctcacagagctgtcct

SEQ ID NO: 7814977 - DNA, 22 bp, Homo sapiens
cagccccatggtgtgctccagc

SEQ ID NO: 7814978 - DNA, 22 bp, Homo sapiens
cagccccatggtgtgctccagc

SEQ ID NO: 7814979 - DNA, 22 bp, Homo sapiens
cagcccctccctcaggcaggtg

SEQ ID NO: 7814980 - DNA, 22 bp, Homo sapiens
cagcccctggcgcacgccgagc

SEQ ID NO: 7814981 - DNA, 22 bp, Homo sapiens
cagcccctccctcaggcaggtg

SEQ ID NO: 7814982 - DNA, 22 bp, Homo sapiens
cagcccctccctcaggcaggtg

SEQ ID NO: 7814983 - DNA, 22 bp, Homo sapiens
cagcccctccctcaggcaggtg

SEQ ID NO: 7814984 - DNA, 22 bp, Homo sapiens
cagcccctcacagagctgtcct

SEQ ID NO: 7814985 - DNA, 22 bp, Homo sapiens
cagcccctccctcaggcaggtg

SEQ ID NO: 7814986 - DNA, 22 bp, Homo sapiens
cagcccctcacagagctgtcct

SEQ ID NO: 7814987 - DNA, 22 bp, Homo sapiens
gtctgtgtgcacagagctttgg

SEQ ID NO: 7814988 - DNA, 22 bp, Homo sapiens
gtctgtggtccctgctggggac

SEQ ID NO: 7814989 - DNA, 19 bp, Homo sapiens
gtctgtgtatttgttgctg

SEQ ID NO: 7814990 - DNA, 22 bp, Homo sapiens
gtctgtggtccctgctggggac

SEQ ID NO: 7814991 - DNA, 22 bp, Homo sapiens
gtctgtgggccaaatacagccc

SEQ ID NO: 7814992 - DNA, 22 bp, Homo sapiens
gtctgtgtgcacagcgagtgcc

SEQ ID NO: 7814993 - DNA, 22 bp, Homo sapiens
gtctgtgtgcacagcgagtgcc

SEQ ID NO: 7814994 - DNA, 22 bp, Homo sapiens
gtctgtgtgcacagcgagtgcc

SEQ ID NO: 7814995 - DNA, 22 bp, Homo sapiens
gtctgtgtgcacagcgagtgcc

SEQ ID NO: 7814996 - DNA, 18 bp, Homo sapiens
gtctgtgtggcttgggga

SEQ ID NO: 7814997 - DNA, 22 bp, Homo sapiens
gtctgtgcagttactagctggt

SEQ ID NO: 7814998 - DNA, 22 bp, Homo sapiens
gtctgtgcttattcagcagggg

SEQ ID NO: 7814999 - DNA, 22 bp, Homo sapiens
gtctgtgcttattcagcagggg

SEQ ID NO: 7815000 - DNA, 22 bp, Homo sapiens
gtctgtgcttattcagcagggg

SEQ ID NO: 7815001 - DNA, 22 bp, Homo sapiens
gtctgtgcttattcagcagggg

SEQ ID NO: 7815002 - DNA, 22 bp, Homo sapiens
gtctgtggagttgcttgctgga

SEQ ID NO: 7815003 - DNA, 22 bp, Homo sapiens
gtctgtggagttgcttgctgga

SEQ ID NO: 7815004 - DNA, 21 bp, Homo sapiens
gtctgtgatcttactgctgtg

SEQ ID NO: 7815005 - DNA, 22 bp, Homo sapiens
cagccctcaggtcctcagcagc

SEQ ID NO: 7815006 - DNA, 22 bp, Homo sapiens
cagccctcaggtcctcagcagc

SEQ ID NO: 7815007 - DNA, 22 bp, Homo sapiens
cagccctcaggtcctcagcagc

SEQ ID NO: 7815008 - DNA, 22 bp, Homo sapiens
cagccctcaggtcctcagcagc

SEQ ID NO: 7815009 - DNA, 22 bp, Homo sapiens
cagccctcaggtcctcagcagc

SEQ ID NO: 7815010 - DNA, 22 bp, Homo sapiens
cagccctcaaaccacttccagg

SEQ ID NO: 7815011 - DNA, 22 bp, Homo sapiens
cagccctcaggtcctcagcagc

SEQ ID NO: 7815012 - DNA, 22 bp, Homo sapiens
gtctgtaattattaaagaaagg

SEQ ID NO: 7815013 - DNA, 22 bp, Homo sapiens
cagccctcatcccgcctgcgtt

SEQ ID NO: 7815014 - DNA, 22 bp, Homo sapiens
gtctgtagaataaatatgagta

SEQ ID NO: 7815015 - DNA, 22 bp, Homo sapiens
gtctgtagatattcactccttc

SEQ ID NO: 7815016 - DNA, 22 bp, Homo sapiens
cagccctcatcccgcctgcgtt

SEQ ID NO: 7815017 - DNA, 22 bp, Homo sapiens
cagccctcaggtcctcagcagc

SEQ ID NO: 7815018 - DNA, 22 bp, Homo sapiens
cagccctcatcccgcctgcgtt

SEQ ID NO: 7815019 - DNA, 22 bp, Homo sapiens
gtctgtccttccgactgtagct

SEQ ID NO: 7815020 - DNA, 22 bp, Homo sapiens
gtctgtccttccgactgtagct

SEQ ID NO: 7815021 - DNA, 22 bp, Homo sapiens
gtctgtcatctgagatggagtg

SEQ ID NO: 7815022 - DNA, 22 bp, Homo sapiens
gtctgtccatcagcaaaggctt

SEQ ID NO: 7815023 - DNA, 19 bp, Homo sapiens
gtctgtccccacgagtggc

SEQ ID NO: 7815024 - DNA, 22 bp, Homo sapiens
gtctgtagatgagtcttaagaa

SEQ ID NO: 7815025 - DNA, 22 bp, Homo sapiens
gtctgtagtcacacaggtgaca

SEQ ID NO: 7815026 - DNA, 22 bp, Homo sapiens
gtctgtcatctgagatggagtg

SEQ ID NO: 7815027 - DNA, 22 bp, Homo sapiens
gtctgtcactcaggggctggag

SEQ ID NO: 7815028 - DNA, 22 bp, Homo sapiens
gtctgtcatacggcttatgtaa

SEQ ID NO: 7815029 - DNA, 22 bp, Homo sapiens
gtctgtcatacggcttatgtaa

SEQ ID NO: 7815030 - DNA, 22 bp, Homo sapiens
gtctgtcactcaggggctggag

SEQ ID NO: 7815031 - DNA, 22 bp, Homo sapiens
gtctgtccaggtgaatgcttca

SEQ ID NO: 7815032 - DNA, 22 bp, Homo sapiens
gtctgtccagcaacacaggagt

SEQ ID NO: 7815033 - DNA, 22 bp, Homo sapiens
gtcataaagacagaaacattcc

SEQ ID NO: 7815034 - DNA, 22 bp, Homo sapiens
gtcataatataaaaactgactt

SEQ ID NO: 7815035 - DNA, 22 bp, Homo sapiens
gtcatagaggcctatataattt

SEQ ID NO: 7815036 - DNA, 22 bp, Homo sapiens
gtcataatcacagttttatgca

SEQ ID NO: 7815037 - DNA, 22 bp, Homo sapiens
gtcatatacactgcatgtaatc

SEQ ID NO: 7815038 - DNA, 22 bp, Homo sapiens
gtcatagtagtggaacagcagc

SEQ ID NO: 7815039 - DNA, 22 bp, Homo sapiens
gtcatcttcgcagagtgatttt

SEQ ID NO: 7815040 - DNA, 22 bp, Homo sapiens
gtcatcttctctcagcccaggc

SEQ ID NO: 7815041 - DNA, 22 bp, Homo sapiens
gtcatcttaaggactgctatag

SEQ ID NO: 7815042 - DNA, 22 bp, Homo sapiens
gtcatcttaaggactgctatag

SEQ ID NO: 7815043 - DNA, 22 bp, Homo sapiens
gtcatctgtttacttttctgct

SEQ ID NO: 7815044 - DNA, 21 bp, Homo sapiens
gtcatccacctctcgggctct

SEQ ID NO: 7815045 - DNA, 22 bp, Homo sapiens
gtcatcatttttagcatatggg

SEQ ID NO: 7815046 - DNA, 22 bp, Homo sapiens
gtcatcatttttagcatatggg

SEQ ID NO: 7815047 - DNA, 22 bp, Homo sapiens
gtcatcactggtagcaaagatt

SEQ ID NO: 7815048 - DNA, 23 bp, Homo sapiens
gtcatcattaaagtcacagagac

SEQ ID NO: 7815049 - DNA, 22 bp, Homo sapiens
gtcatcatcaggcagatgctgc

SEQ ID NO: 7815050 - DNA, 22 bp, Homo sapiens
gtcatccagactttgcctctgc

SEQ ID NO: 7815051 - DNA, 20 bp, Homo sapiens
cagcaggctatggggcaccc

SEQ ID NO: 7815052 - DNA, 20 bp, Homo sapiens
cagcaggctatggggcaccc

SEQ ID NO: 7815053 - DNA, 20 bp, Homo sapiens
cagcaggctatggggcaccc

SEQ ID NO: 7815054 - DNA, 22 bp, Homo sapiens
cagcaggcgttgggagaaagac

SEQ ID NO: 7815055 - DNA, 20 bp, Homo sapiens
cagcaggctatggggcaccc

SEQ ID NO: 7815056 - DNA, 20 bp, Homo sapiens
cagcaggctatggggcaccc

SEQ ID NO: 7815057 - DNA, 22 bp, Homo sapiens
cagcaggcggcccgcgggcccg

SEQ ID NO: 7815058 - DNA, 22 bp, Homo sapiens
gtcattataccattataattgt

SEQ ID NO: 7815059 - DNA, 22 bp, Homo sapiens
cagcaggcgttgggagaaagac

SEQ ID NO: 7815060 - DNA, 22 bp, Homo sapiens
cagcaggcgttgggagaaagac

SEQ ID NO: 7815061 - DNA, 22 bp, Homo sapiens
cagcaggcgttgggagaaagac

SEQ ID NO: 7815062 - DNA, 22 bp, Homo sapiens
gtcatgtatgttggaacagtgg

SEQ ID NO: 7815063 - DNA, 22 bp, Homo sapiens
gtcatgtgaataagtgtggggt

SEQ ID NO: 7815064 - DNA, 22 bp, Homo sapiens
gtcatcttgctgttttagatct

SEQ ID NO: 7815065 - DNA, 22 bp, Homo sapiens
gtcatcttgctgttttagatct

SEQ ID NO: 7815066 - DNA, 22 bp, Homo sapiens
gtcatgagaaatctttgaaggt

SEQ ID NO: 7815067 - DNA, 19 bp, Homo sapiens
gtcatcttttaataatgtg

SEQ ID NO: 7815068 - DNA, 22 bp, Homo sapiens
gtcatgcatgggctctgaagaa

SEQ ID NO: 7815069 - DNA, 22 bp, Homo sapiens
gtcccagcttcccactagcagc

SEQ ID NO: 7815070 - DNA, 22 bp, Homo sapiens
gtcccagcttcccactagcagc

SEQ ID NO: 7815071 - DNA, 22 bp, Homo sapiens
gtcccagcttcccactagcagc

SEQ ID NO: 7815072 - DNA, 22 bp, Homo sapiens
gtcccaggaacattctggctag

SEQ ID NO: 7815073 - DNA, 22 bp, Homo sapiens
gtcccaggaacattctggctag

SEQ ID NO: 7815074 - DNA, 22 bp, Homo sapiens
gtcccaggaacattctggctag

SEQ ID NO: 7815075 - DNA, 22 bp, Homo sapiens
gtcccaggaacattctggctag

SEQ ID NO: 7815076 - DNA, 22 bp, Homo sapiens
gtcccagatgtctggaactccc

SEQ ID NO: 7815077 - DNA, 22 bp, Homo sapiens
gtcccagaggctttggccacag

SEQ ID NO: 7815078 - DNA, 22 bp, Homo sapiens
gtcccagaggacagggtcacat

SEQ ID NO: 7815079 - DNA, 22 bp, Homo sapiens
gtcccagagagcactagtccat

SEQ ID NO: 7815080 - DNA, 22 bp, Homo sapiens
gtcccagagagcactagtccat

SEQ ID NO: 7815081 - DNA, 22 bp, Homo sapiens
gtcccaggcagagtcaggaggg

SEQ ID NO: 7815082 - DNA, 22 bp, Homo sapiens
gtcccaggcagagtcaggaggg

SEQ ID NO: 7815083 - DNA, 22 bp, Homo sapiens
gtcccaggcagagtcaggaggg

SEQ ID NO: 7815084 - DNA, 22 bp, Homo sapiens
gtcccaggcagagtcaggaggg

SEQ ID NO: 7815085 - DNA, 22 bp, Homo sapiens
gtcccaggagttgctgggcctt

SEQ ID NO: 7815086 - DNA, 22 bp, Homo sapiens
gtcccaggagttgctgggcctt

SEQ ID NO: 7815087 - DNA, 22 bp, Homo sapiens
gtcccaggaacattctggctag

SEQ ID NO: 7815088 - DNA, 22 bp, Homo sapiens
gtcccaggagttgctgggcctt

SEQ ID NO: 7815089 - DNA, 22 bp, Homo sapiens
gtcccaggcagagtcaggaggg

SEQ ID NO: 7815090 - DNA, 22 bp, Homo sapiens
gtcccaggcagagtcaggaggg

SEQ ID NO: 7815091 - DNA, 22 bp, Homo sapiens
gtcccaggcagagtcaggaggg

SEQ ID NO: 7815092 - DNA, 22 bp, Homo sapiens
gtcccaggcaggccactggcag

SEQ ID NO: 7815093 - DNA, 22 bp, Homo sapiens
gtcccaggcaggccactggcag

SEQ ID NO: 7815094 - DNA, 22 bp, Homo sapiens
gtcccaggcaggccactggcag

SEQ ID NO: 7815095 - DNA, 22 bp, Homo sapiens
gtcccaggctccatggcagcca

SEQ ID NO: 7815096 - DNA, 22 bp, Homo sapiens
gtcccaggctccatggcagcca

SEQ ID NO: 7815097 - DNA, 22 bp, Homo sapiens
gtcccaggctccatggcagcca

SEQ ID NO: 7815098 - DNA, 22 bp, Homo sapiens
gtcccaggcaggccactggcag

SEQ ID NO: 7815099 - DNA, 22 bp, Homo sapiens
cagcaggctctgagtggctgcc

SEQ ID NO: 7815100 - DNA, 22 bp, Homo sapiens
cagcaggctctgagtggctgcc

SEQ ID NO: 7815101 - DNA, 22 bp, Homo sapiens
cagcaggctctgagtggctgcc

SEQ ID NO: 7815102 - DNA, 22 bp, Homo sapiens
cagcaggctctgagtggctgcc

SEQ ID NO: 7815103 - DNA, 22 bp, Homo sapiens
cagcaggctgcgattgctcatt

SEQ ID NO: 7815104 - DNA, 22 bp, Homo sapiens
cagcaggctgcgattgctcatt

SEQ ID NO: 7815105 - DNA, 22 bp, Homo sapiens
cagcaggctctgagtggctgcc

SEQ ID NO: 7815106 - DNA, 22 bp, Homo sapiens
cagcaggctctgagtggctgcc

SEQ ID NO: 7815107 - DNA, 22 bp, Homo sapiens
cagcaggctctgagtggctgcc

SEQ ID NO: 7815108 - DNA, 22 bp, Homo sapiens
cagcaggctctgagtggctgcc

SEQ ID NO: 7815109 - DNA, 22 bp, Homo sapiens
cagcaggctgtggaaatcctgg

SEQ ID NO: 7815110 - DNA, 22 bp, Homo sapiens
cagcaggctgtggaaatcctgg

SEQ ID NO: 7815111 - DNA, 22 bp, Homo sapiens
cagcaggctgtggaaatcctgg

SEQ ID NO: 7815112 - DNA, 22 bp, Homo sapiens
cagcaggctggacttcagtccc

SEQ ID NO: 7815113 - DNA, 22 bp, Homo sapiens
cagcaggctgcgattgctcatt

SEQ ID NO: 7815114 - DNA, 22 bp, Homo sapiens
gtccagccactcaccttccagc

SEQ ID NO: 7815115 - DNA, 22 bp, Homo sapiens
gtccagccagctggtccttgcc

SEQ ID NO: 7815116 - DNA, 22 bp, Homo sapiens
gtccagccaccctggaggcacg

SEQ ID NO: 7815117 - DNA, 22 bp, Homo sapiens
gtccagccaccctggaggcacg

SEQ ID NO: 7815118 - DNA, 22 bp, Homo sapiens
gtccagccagctggtccttgcc

SEQ ID NO: 7815119 - DNA, 22 bp, Homo sapiens
gtcccagagagcactagtccat

SEQ ID NO: 7815120 - DNA, 22 bp, Homo sapiens
gtcccagaaacatattgctggt

SEQ ID NO: 7815121 - DNA, 22 bp, Homo sapiens
cagcaggacatggaggagtaaa

SEQ ID NO: 7815122 - DNA, 22 bp, Homo sapiens
cagcaggacatggaggagtaaa

SEQ ID NO: 7815123 - DNA, 22 bp, Homo sapiens
cagcaggacatggaggagtaaa

SEQ ID NO: 7815124 - DNA, 22 bp, Homo sapiens
cagcaggacatggaggagtaaa

SEQ ID NO: 7815125 - DNA, 22 bp, Homo sapiens
cagcaggacatggaggagtaaa

SEQ ID NO: 7815126 - DNA, 22 bp, Homo sapiens
cagcaggacatggaggagtaaa

SEQ ID NO: 7815127 - DNA, 22 bp, Homo sapiens
cagcaggaagtactagctttga

SEQ ID NO: 7815128 - DNA, 22 bp, Homo sapiens
cagcaggaaggtttcccctgca

SEQ ID NO: 7815129 - DNA, 22 bp, Homo sapiens
cagcaggaagtactagctttga

SEQ ID NO: 7815130 - DNA, 22 bp, Homo sapiens
gtcataaagacagaaacattcc

SEQ ID NO: 7815131 - DNA, 22 bp, Homo sapiens
gtcagcctgcactcagggagcg

SEQ ID NO: 7815132 - DNA, 22 bp, Homo sapiens
gtcagcgtgctcagcctattat

SEQ ID NO: 7815133 - DNA, 22 bp, Homo sapiens
gtcagcctgcactcagggagcg

SEQ ID NO: 7815134 - DNA, 22 bp, Homo sapiens
gtcagcatgagcaagggctgac

SEQ ID NO: 7815135 - DNA, 22 bp, Homo sapiens
gtcagcatagttcacacacagt

SEQ ID NO: 7815136 - DNA, 22 bp, Homo sapiens
gtcagcctgcactcagggagcg

SEQ ID NO: 7815137 - DNA, 22 bp, Homo sapiens
cagcaggaaggtttcccctgca

SEQ ID NO: 7815138 - DNA, 22 bp, Homo sapiens
cagcaggaaggtttcccctgca

SEQ ID NO: 7815139 - DNA, 22 bp, Homo sapiens
cagcaggaaggtttcccctgca

SEQ ID NO: 7815140 - DNA, 22 bp, Homo sapiens
cagcaggaaaatcaattctgtg

SEQ ID NO: 7815141 - DNA, 22 bp, Homo sapiens
cagcaggaaggtttcccctgca

SEQ ID NO: 7815142 - DNA, 22 bp, Homo sapiens
cagcaggaaagacatctgagca

SEQ ID NO: 7815143 - DNA, 22 bp, Homo sapiens
cagcaggaaagacatctgagca

SEQ ID NO: 7815144 - DNA, 22 bp, Homo sapiens
cagcaggaaagacatctgagca

SEQ ID NO: 7815145 - DNA, 22 bp, Homo sapiens
cagcaggaaagacatctgagca

SEQ ID NO: 7815146 - DNA, 22 bp, Homo sapiens
cagcaggaaacttaaaggtaat

SEQ ID NO: 7815147 - DNA, 22 bp, Homo sapiens
cagcaggaaacttaaaggtaat

SEQ ID NO: 7815148 - DNA, 22 bp, Homo sapiens
cagcaggaaacttaaaggtaat

SEQ ID NO: 7815149 - DNA, 22 bp, Homo sapiens
cagcaggaaaatcaattctgtg

SEQ ID NO: 7815150 - DNA, 22 bp, Homo sapiens
cagcaggaaaatcaattctgtg

SEQ ID NO: 7815151 - DNA, 22 bp, Homo sapiens
cagcaggaaaatcaattctgtg

SEQ ID NO: 7815152 - DNA, 20 bp, Homo sapiens
cagcaggaaaagtgcctcag

SEQ ID NO: 7815153 - DNA, 20 bp, Homo sapiens
cagcaggaaaagtgcctcag

SEQ ID NO: 7815154 - DNA, 20 bp, Homo sapiens
cagcaggaaaagtgcctcag

SEQ ID NO: 7815155 - DNA, 22 bp, Homo sapiens
cagcagcttttgcattctcatt

SEQ ID NO: 7815156 - DNA, 20 bp, Homo sapiens
cagcaggaaaagtgcctcag

SEQ ID NO: 7815157 - DNA, 22 bp, Homo sapiens
cagcagcttttgcattctcatt

SEQ ID NO: 7815158 - DNA, 22 bp, Homo sapiens
cagcagcttttgcattctcatt

SEQ ID NO: 7815159 - DNA, 22 bp, Homo sapiens
cagcagcttttgcattctcatt

SEQ ID NO: 7815160 - DNA, 22 bp, Homo sapiens
cagcagctttgccaagtcagcc

SEQ ID NO: 7815161 - DNA, 22 bp, Homo sapiens
cagcagcttttgcattctcatt

SEQ ID NO: 7815162 - DNA, 22 bp, Homo sapiens
cagcagcttctgttgatcagaa

SEQ ID NO: 7815163 - DNA, 22 bp, Homo sapiens
cagcagcttctgttgatcagaa

SEQ ID NO: 7815164 - DNA, 22 bp, Homo sapiens
cagcagcttctgttgatcagaa

SEQ ID NO: 7815165 - DNA, 22 bp, Homo sapiens
cagcagctggttgaatccttct

SEQ ID NO: 7815166 - DNA, 22 bp, Homo sapiens
cagcagctggttgaatccttct

SEQ ID NO: 7815167 - DNA, 22 bp, Homo sapiens
cagcagctggttatacctgtgg

SEQ ID NO: 7815168 - DNA, 22 bp, Homo sapiens
cagcagctggttatacctgtgg

SEQ ID NO: 7815169 - DNA, 22 bp, Homo sapiens
cagcagctggttatacctgtgg

SEQ ID NO: 7815170 - DNA, 22 bp, Homo sapiens
cagcagctgtttacggaacacc

SEQ ID NO: 7815171 - DNA, 22 bp, Homo sapiens
cagcagctggttgaatccttct

SEQ ID NO: 7815172 - DNA, 22 bp, Homo sapiens
cagcagctggttgaatccttct

SEQ ID NO: 7815173 - DNA, 22 bp, Homo sapiens
cagcagctggtgagacacagcc

SEQ ID NO: 7815174 - DNA, 22 bp, Homo sapiens
cagcagctggtgagacacagcc

SEQ ID NO: 7815175 - DNA, 22 bp, Homo sapiens
cagcagctggtgagacacagcc

SEQ ID NO: 7815176 - DNA, 22 bp, Homo sapiens
cagcagctggttatacctgtgg

SEQ ID NO: 7815177 - DNA, 22 bp, Homo sapiens
cagcagctggtgagacacagcc

SEQ ID NO: 7815178 - DNA, 22 bp, Homo sapiens
cagcagctggttatacctgtgg

SEQ ID NO: 7815179 - DNA, 22 bp, Homo sapiens
cagcagctggtgagacacagcc

SEQ ID NO: 7815180 - DNA, 22 bp, Homo sapiens
cagcagctgggaaggaggctga

SEQ ID NO: 7815181 - DNA, 22 bp, Homo sapiens
cagcagctgggaaggaggctga

SEQ ID NO: 7815182 - DNA, 22 bp, Homo sapiens
cagcagctgggaaggaggctga

SEQ ID NO: 7815183 - DNA, 22 bp, Homo sapiens
cagcagctgggaaggaggctga

SEQ ID NO: 7815184 - DNA, 22 bp, Homo sapiens
cagcagctgggaaggaggctga

SEQ ID NO: 7815185 - DNA, 22 bp, Homo sapiens
cagcagctgcgtgcccaggccg

SEQ ID NO: 7815186 - DNA, 22 bp, Homo sapiens
cagcagctgcgtgcccaggccg

SEQ ID NO: 7815187 - DNA, 22 bp, Homo sapiens
cagcagctgcgtgcccaggccg

SEQ ID NO: 7815188 - DNA, 22 bp, Homo sapiens
cagcagctgcgtgcccaggccg

SEQ ID NO: 7815189 - DNA, 22 bp, Homo sapiens
cagcagctgcgtgcccaggccg

SEQ ID NO: 7815190 - DNA, 22 bp, Homo sapiens
cagcagctgggaaggaggctga

SEQ ID NO: 7815191 - DNA, 22 bp, Homo sapiens
cagcagctgggaaggaggctga

SEQ ID NO: 7815192 - DNA, 22 bp, Homo sapiens
cagcagctgggaaggaggctga

SEQ ID NO: 7815193 - DNA, 22 bp, Homo sapiens
cagcagctgggaaggaggctga

SEQ ID NO: 7815194 - DNA, 23 bp, Homo sapiens
cagcagctgcctggttttttggt

SEQ ID NO: 7815195 - DNA, 22 bp, Homo sapiens
cagcagctgcgtgcccaggccg

SEQ ID NO: 7815196 - DNA, 23 bp, Homo sapiens
cagcagctgcctggttttttggt

SEQ ID NO: 7815197 - DNA, 22 bp, Homo sapiens
cagcagctgcctcagctgggga

SEQ ID NO: 7815198 - DNA, 22 bp, Homo sapiens
cagcagctgcctcagctgggga

SEQ ID NO: 7815199 - DNA, 22 bp, Homo sapiens
cagcagctgcaaatggaaacag

SEQ ID NO: 7815200 - DNA, 22 bp, Homo sapiens
cagcagctgcctcagctgggga

SEQ ID NO: 7815201 - DNA, 22 bp, Homo sapiens
cagcagctgcctcagctgggga

SEQ ID NO: 7815202 - DNA, 22 bp, Homo sapiens
cagcagctgcctcagctgggga

SEQ ID NO: 7815203 - DNA, 22 bp, Homo sapiens
cagcagctgcaaatggaaacag

SEQ ID NO: 7815204 - DNA, 22 bp, Homo sapiens
cagcagctgatggggaagtgat

SEQ ID NO: 7815205 - DNA, 22 bp, Homo sapiens
cagcagctgatggggaagtgat

SEQ ID NO: 7815206 - DNA, 22 bp, Homo sapiens
cagcagctgcaaatggaaacag

SEQ ID NO: 7815207 - DNA, 22 bp, Homo sapiens
cagcagctgcaaatggaaacag

SEQ ID NO: 7815208 - DNA, 22 bp, Homo sapiens
cagcagctgatggggaagtgat

SEQ ID NO: 7815209 - DNA, 22 bp, Homo sapiens
cagcagctcactcaggtggctc

SEQ ID NO: 7815210 - DNA, 22 bp, Homo sapiens
cagcagctcactcaggtggctc

SEQ ID NO: 7815211 - DNA, 22 bp, Homo sapiens
cagcaccttcctatccaggaga

SEQ ID NO: 7815212 - DNA, 22 bp, Homo sapiens
cagcaccttcctatccaggaga

SEQ ID NO: 7815213 - DNA, 22 bp, Homo sapiens
cagcaccttccttaactccagg

SEQ ID NO: 7815214 - DNA, 22 bp, Homo sapiens
cagcacctgttagcattaaata

SEQ ID NO: 7815215 - DNA, 22 bp, Homo sapiens
cagcacctgctcttagacacgg

SEQ ID NO: 7815216 - DNA, 22 bp, Homo sapiens
cagcacctgctcttagacacgg

SEQ ID NO: 7815217 - DNA, 22 bp, Homo sapiens
cagcacctggcacaggagggcc

SEQ ID NO: 7815218 - DNA, 22 bp, Homo sapiens
cagcagctacttggagcagcag

SEQ ID NO: 7815219 - DNA, 22 bp, Homo sapiens
cagcagctagaggaagggcaga

SEQ ID NO: 7815220 - DNA, 22 bp, Homo sapiens
cagcagctagaggaagggcaga

SEQ ID NO: 7815221 - DNA, 22 bp, Homo sapiens
cagcagctacttggagcagcag

SEQ ID NO: 7815222 - DNA, 22 bp, Homo sapiens
cagcacccctcctggctatgaa

SEQ ID NO: 7815223 - DNA, 22 bp, Homo sapiens
cagcaccattttcctggtcagc

SEQ ID NO: 7815224 - DNA, 22 bp, Homo sapiens
cagcaccattttcctggtcagc

SEQ ID NO: 7815225 - DNA, 22 bp, Homo sapiens
cagcaccattttcctggtcagc

SEQ ID NO: 7815226 - DNA, 22 bp, Homo sapiens
cagcaccctttccactgccttg

SEQ ID NO: 7815227 - DNA, 22 bp, Homo sapiens
cagcaccctcggaggctgccgt

SEQ ID NO: 7815228 - DNA, 22 bp, Homo sapiens
cagcaccctcggaggctgccgt

SEQ ID NO: 7815229 - DNA, 22 bp, Homo sapiens
cagcaccctcggaggctgccgt

SEQ ID NO: 7815230 - DNA, 22 bp, Homo sapiens
cagcacccctcctggctatgaa

SEQ ID NO: 7815231 - DNA, 22 bp, Homo sapiens
cagcacctaggacagtagtcag

SEQ ID NO: 7815232 - DNA, 22 bp, Homo sapiens
cagcacctctgggtcttgtctt

SEQ ID NO: 7815233 - DNA, 22 bp, Homo sapiens
cagcaccctttccactgccttg

SEQ ID NO: 7815234 - DNA, 22 bp, Homo sapiens
cagcacctacccatcctgagtc

SEQ ID NO: 7815235 - DNA, 22 bp, Homo sapiens
cagcacctacccatcctgagtc

SEQ ID NO: 7815236 - DNA, 22 bp, Homo sapiens
cagcacctacccatcctgagtc

SEQ ID NO: 7815237 - DNA, 22 bp, Homo sapiens
gggcagcattctgtgggcaggt

SEQ ID NO: 7815238 - DNA, 22 bp, Homo sapiens
gggcagcatttgaaaaacagat

SEQ ID NO: 7815239 - DNA, 22 bp, Homo sapiens
gggcagcatttgaaaaacagat

SEQ ID NO: 7815240 - DNA, 22 bp, Homo sapiens
gggcagcattctgtgggcaggt

SEQ ID NO: 7815241 - DNA, 22 bp, Homo sapiens
gggcagcattctgtgggcaggt

SEQ ID NO: 7815242 - DNA, 22 bp, Homo sapiens
gggcagcattctgtgggcaggt

SEQ ID NO: 7815243 - DNA, 22 bp, Homo sapiens
gggcagcatgtcactagcatgg

SEQ ID NO: 7815244 - DNA, 22 bp, Homo sapiens
gggcagcatgtcactagcatgg

SEQ ID NO: 7815245 - DNA, 22 bp, Homo sapiens
gggcagcatgaggaccctcatc

SEQ ID NO: 7815246 - DNA, 22 bp, Homo sapiens
gggcagcatgtcactagcatgg

SEQ ID NO: 7815247 - DNA, 22 bp, Homo sapiens
gggcagcattctgtgggcaggt

SEQ ID NO: 7815248 - DNA, 22 bp, Homo sapiens
gggcagcattctgtgggcaggt

SEQ ID NO: 7815249 - DNA, 22 bp, Homo sapiens
gggcagcattctgtgggcaggt

SEQ ID NO: 7815250 - DNA, 22 bp, Homo sapiens
gggcagcatgtcactagcatgg

SEQ ID NO: 7815251 - DNA, 22 bp, Homo sapiens
gggcagcatgtcactagcatgg

SEQ ID NO: 7815252 - DNA, 22 bp, Homo sapiens
gggcagcattctgtgggcaggt

SEQ ID NO: 7815253 - DNA, 22 bp, Homo sapiens
cagagacagcctgggagggaca

SEQ ID NO: 7815254 - DNA, 22 bp, Homo sapiens
cagagacagcctgggagggaca

SEQ ID NO: 7815255 - DNA, 22 bp, Homo sapiens
cagagacagcctgggagggaca

SEQ ID NO: 7815256 - DNA, 22 bp, Homo sapiens
cagagacagcctgggagggaca

SEQ ID NO: 7815257 - DNA, 22 bp, Homo sapiens
cagagacagcaagttgatttcc

SEQ ID NO: 7815258 - DNA, 22 bp, Homo sapiens
gggcagcccagaactgctgcag

SEQ ID NO: 7815259 - DNA, 22 bp, Homo sapiens
gggcagcccagaactgctgcag

SEQ ID NO: 7815260 - DNA, 22 bp, Homo sapiens
cagagacagcaagttgatttcc

SEQ ID NO: 7815261 - DNA, 22 bp, Homo sapiens
cagagacaggaatcagctgcag

SEQ ID NO: 7815262 - DNA, 22 bp, Homo sapiens
cagagacaggaatcagctgcag

SEQ ID NO: 7815263 - DNA, 22 bp, Homo sapiens
cagagacaggaatcagctgcag

SEQ ID NO: 7815264 - DNA, 22 bp, Homo sapiens
cagagacaggaatcagctgcag

SEQ ID NO: 7815265 - DNA, 22 bp, Homo sapiens
cagagacaggaatcagctgcag

SEQ ID NO: 7815266 - DNA, 22 bp, Homo sapiens
cagagacaggaatcagctgcag

SEQ ID NO: 7815267 - DNA, 22 bp, Homo sapiens
cagagacaggaatcagctgcag

SEQ ID NO: 7815268 - DNA, 22 bp, Homo sapiens
cagagacaggaatcagctgcag

SEQ ID NO: 7815269 - DNA, 22 bp, Homo sapiens
cagagacagcctgggagggaca

SEQ ID NO: 7815270 - DNA, 22 bp, Homo sapiens
cagagacaggaatcagctgcag

SEQ ID NO: 7815271 - DNA, 22 bp, Homo sapiens
gggcagcagagccctgccgagt

SEQ ID NO: 7815272 - DNA, 22 bp, Homo sapiens
gggcagcagagccctgccgagt

SEQ ID NO: 7815273 - DNA, 22 bp, Homo sapiens
gggcagcagaggatcccttaat

SEQ ID NO: 7815274 - DNA, 22 bp, Homo sapiens
gggcagcagaggatcccttaat

SEQ ID NO: 7815275 - DNA, 21 bp, Homo sapiens
gggcagcagcagcaacaaggg

SEQ ID NO: 7815276 - DNA, 22 bp, Homo sapiens
gggcagcagaggatcccttaat

SEQ ID NO: 7815277 - DNA, 21 bp, Homo sapiens
gggcagcagcagcaacaaggg

SEQ ID NO: 7815278 - DNA, 21 bp, Homo sapiens
gggcagcagcagcaacaaggg

SEQ ID NO: 7815279 - DNA, 22 bp, Homo sapiens
gggcagcagccactcatttagc

SEQ ID NO: 7815280 - DNA, 22 bp, Homo sapiens
gggcagcagccactcatttagc

SEQ ID NO: 7815281 - DNA, 22 bp, Homo sapiens
gggcagcaggctccacgttcct

SEQ ID NO: 7815282 - DNA, 22 bp, Homo sapiens
gggcagcagcaggaggtctctg

SEQ ID NO: 7815283 - DNA, 22 bp, Homo sapiens
gggcagcagcaggaggtctctg

SEQ ID NO: 7815284 - DNA, 22 bp, Homo sapiens
gggcagcagcaggaggtctctg

SEQ ID NO: 7815285 - DNA, 22 bp, Homo sapiens
gggcagcagcaggaggtctctg

SEQ ID NO: 7815286 - DNA, 22 bp, Homo sapiens
gggcagcaggctccacgttcct

SEQ ID NO: 7815287 - DNA, 22 bp, Homo sapiens
gggcagcaggctccacgttcct

SEQ ID NO: 7815288 - DNA, 22 bp, Homo sapiens
gggcagcaggctccacgttcct

SEQ ID NO: 7815289 - DNA, 22 bp, Homo sapiens
gggcagcagttgccctaatcaa

SEQ ID NO: 7815290 - DNA, 22 bp, Homo sapiens
gggcagcataacaatcactgaa

SEQ ID NO: 7815291 - DNA, 22 bp, Homo sapiens
gggcagcagttgccctaatcaa

SEQ ID NO: 7815292 - DNA, 22 bp, Homo sapiens
gggcagcataacaatcactgaa

SEQ ID NO: 7815293 - DNA, 22 bp, Homo sapiens
gggcagcatcaggaggggcttt

SEQ ID NO: 7815294 - DNA, 22 bp, Homo sapiens
gggcagcatcaggaggggcttt

SEQ ID NO: 7815295 - DNA, 22 bp, Homo sapiens
gggcagcatgaggaccctcatc

SEQ ID NO: 7815296 - DNA, 22 bp, Homo sapiens
gggcagcatgaggaccctcatc

SEQ ID NO: 7815297 - DNA, 22 bp, Homo sapiens
gggcagcatcaggaggggcttt

SEQ ID NO: 7815298 - DNA, 22 bp, Homo sapiens
gggcagcatcaggaggggcttt

SEQ ID NO: 7815299 - DNA, 22 bp, Homo sapiens
gggcagcatcaggaggggcttt

SEQ ID NO: 7815300 - DNA, 22 bp, Homo sapiens
gggcagtgtcgaggtctggtcc

SEQ ID NO: 7815301 - DNA, 22 bp, Homo sapiens
gggcagtggttacacagctgag

SEQ ID NO: 7815302 - DNA, 22 bp, Homo sapiens
gggcagtggttacacagctgag

SEQ ID NO: 7815303 - DNA, 22 bp, Homo sapiens
gggcagtggttacacagctgag

SEQ ID NO: 7815304 - DNA, 22 bp, Homo sapiens
gggcagtggttacacagctgag

SEQ ID NO: 7815305 - DNA, 22 bp, Homo sapiens
gggcagtggtccaggctacagc

SEQ ID NO: 7815306 - DNA, 22 bp, Homo sapiens
gggcagtggtccaggctacagc

SEQ ID NO: 7815307 - DNA, 22 bp, Homo sapiens
gggcagtggtccaggctacagc

SEQ ID NO: 7815308 - DNA, 22 bp, Homo sapiens
gggcagtgggtggctgcagcct

SEQ ID NO: 7815309 - DNA, 22 bp, Homo sapiens
gggcagtgggtggctgcagcct

SEQ ID NO: 7815310 - DNA, 22 bp, Homo sapiens
gggcagtggtccaggctacagc

SEQ ID NO: 7815311 - DNA, 22 bp, Homo sapiens
gggcagtggctcacgcctgtaa

SEQ ID NO: 7815312 - DNA, 22 bp, Homo sapiens
gggcagtggctcacgcctgtaa

SEQ ID NO: 7815313 - DNA, 22 bp, Homo sapiens
gggcagtgggaccaggcaccag

SEQ ID NO: 7815314 - DNA, 22 bp, Homo sapiens
gggcagtgggaccaggcaccag

SEQ ID NO: 7815315 - DNA, 22 bp, Homo sapiens
gggcagtgggaccaggcaccag

SEQ ID NO: 7815316 - DNA, 22 bp, Homo sapiens
gggcagtgggaccaggcaccag

SEQ ID NO: 7815317 - DNA, 22 bp, Homo sapiens
gggcagtgggtggctgcagcct

SEQ ID NO: 7815318 - DNA, 22 bp, Homo sapiens
gggcagtgggtggctgcagcct

SEQ ID NO: 7815319 - DNA, 22 bp, Homo sapiens
gggcagtgggtggctgcagcct

SEQ ID NO: 7815320 - DNA, 22 bp, Homo sapiens
gggcagtgggtggctgcagcct

SEQ ID NO: 7815321 - DNA, 22 bp, Homo sapiens
gggcagtgggtggctgcagcct

SEQ ID NO: 7815322 - DNA, 22 bp, Homo sapiens
cagagacaggagtgctcccagt

SEQ ID NO: 7815323 - DNA, 22 bp, Homo sapiens
cagagacaggagtgctcccagt

SEQ ID NO: 7815324 - DNA, 22 bp, Homo sapiens
cagagacaggatctcgaagact

SEQ ID NO: 7815325 - DNA, 22 bp, Homo sapiens
cagagacaggatctcgaagact

SEQ ID NO: 7815326 - DNA, 22 bp, Homo sapiens
cagagacaggatctcgaagact

SEQ ID NO: 7815327 - DNA, 22 bp, Homo sapiens
cagagacaggatctcgaagact

SEQ ID NO: 7815328 - DNA, 22 bp, Homo sapiens
cagagacaggaatcagctgcag

SEQ ID NO: 7815329 - DNA, 22 bp, Homo sapiens
cagagacaggaatcagctgcag

SEQ ID NO: 7815330 - DNA, 22 bp, Homo sapiens
cagagacaggagtgctcccagt

SEQ ID NO: 7815331 - DNA, 22 bp, Homo sapiens
cagagacaggagtgctcccagt

SEQ ID NO: 7815332 - DNA, 22 bp, Homo sapiens
cagagacaggagtgctcccagt

SEQ ID NO: 7815333 - DNA, 22 bp, Homo sapiens
cagagacaggagtgctcccagt

SEQ ID NO: 7815334 - DNA, 22 bp, Homo sapiens
cagagacagtttcacagggtct

SEQ ID NO: 7815335 - DNA, 22 bp, Homo sapiens
cagagacagtttcacagggtct

SEQ ID NO: 7815336 - DNA, 22 bp, Homo sapiens
cagagacagtttcacagggtct

SEQ ID NO: 7815337 - DNA, 22 bp, Homo sapiens
cagagacagtttcacagggtct

SEQ ID NO: 7815338 - DNA, 22 bp, Homo sapiens
gggcaggtatttatcttctatt

SEQ ID NO: 7815339 - DNA, 22 bp, Homo sapiens
cagagacaggcttgccctccac

SEQ ID NO: 7815340 - DNA, 22 bp, Homo sapiens
cagagacaggcttgccctccac

SEQ ID NO: 7815341 - DNA, 22 bp, Homo sapiens
cagagacagggcagggagtgtg

SEQ ID NO: 7815342 - DNA, 22 bp, Homo sapiens
cagagacagggcagggagtgtg

SEQ ID NO: 7815343 - DNA, 22 bp, Homo sapiens
cagagacagggcagggagtgtg

SEQ ID NO: 7815344 - DNA, 22 bp, Homo sapiens
cagagacagggcagggagtgtg

SEQ ID NO: 7815345 - DNA, 22 bp, Homo sapiens
cagagacagggcagggagtgtg

SEQ ID NO: 7815346 - DNA, 21 bp, Homo sapiens
cagaccctctagaggccacct

SEQ ID NO: 7815347 - DNA, 21 bp, Homo sapiens
cagaccctctagaggccacct

SEQ ID NO: 7815348 - DNA, 21 bp, Homo sapiens
cagaccctctagaggccacct

SEQ ID NO: 7815349 - DNA, 22 bp, Homo sapiens
cagaccctgggccacagaggag

SEQ ID NO: 7815350 - DNA, 22 bp, Homo sapiens
cagaccctgggccacagaggag

SEQ ID NO: 7815351 - DNA, 22 bp, Homo sapiens
cagacccttttctgagaggacc

SEQ ID NO: 7815352 - DNA, 22 bp, Homo sapiens
cagacccttttctgagaggacc

SEQ ID NO: 7815353 - DNA, 22 bp, Homo sapiens
cagacctcaaagctgcagtgct

SEQ ID NO: 7815354 - DNA, 22 bp, Homo sapiens
cagaccatgatggacagctctg

SEQ ID NO: 7815355 - DNA, 22 bp, Homo sapiens
cagacccaggatccaaatgttg

SEQ ID NO: 7815356 - DNA, 22 bp, Homo sapiens
cagaccatgatggacagctctg

SEQ ID NO: 7815357 - DNA, 22 bp, Homo sapiens
cagacatggcgccaagtgctag

SEQ ID NO: 7815358 - DNA, 22 bp, Homo sapiens
cagaccagtagggctcatccca

SEQ ID NO: 7815359 - DNA, 22 bp, Homo sapiens
cagaccagtagggctcatccca

SEQ ID NO: 7815360 - DNA, 22 bp, Homo sapiens
cagaccagccatttgcctcttc

SEQ ID NO: 7815361 - DNA, 22 bp, Homo sapiens
ggcttcaatgtattcacattca

SEQ ID NO: 7815362 - DNA, 22 bp, Homo sapiens
ggcttcaccaggtgcatgcatg

SEQ ID NO: 7815363 - DNA, 22 bp, Homo sapiens
ggcttagcaactcctgaggctc

SEQ ID NO: 7815364 - DNA, 22 bp, Homo sapiens
ggcttagcaactcctgaggctc

SEQ ID NO: 7815365 - DNA, 22 bp, Homo sapiens
ggcttagattgacactgatctc

SEQ ID NO: 7815366 - DNA, 22 bp, Homo sapiens
ggcttagcaactcctgaggctc

SEQ ID NO: 7815367 - DNA, 22 bp, Homo sapiens
ggcttcagaggggaggtagtgc

SEQ ID NO: 7815368 - DNA, 22 bp, Homo sapiens
ggcttcagatttctcagttgtt

SEQ ID NO: 7815369 - DNA, 22 bp, Homo sapiens
cagacagggtcctgtccgtcac

SEQ ID NO: 7815370 - DNA, 22 bp, Homo sapiens
ggcttcaccaggtgcatgcatg

SEQ ID NO: 7815371 - DNA, 22 bp, Homo sapiens
ggcttcagaagactggacaggt

SEQ ID NO: 7815372 - DNA, 22 bp, Homo sapiens
ggcttcagaagactggacaggt

SEQ ID NO: 7815373 - DNA, 22 bp, Homo sapiens
ggcttcagaagactggacaggt

SEQ ID NO: 7815374 - DNA, 22 bp, Homo sapiens
cagacgggtggtctgcgaggcc

SEQ ID NO: 7815375 - DNA, 22 bp, Homo sapiens
cagacgggctcatggcagtccc

SEQ ID NO: 7815376 - DNA, 19 bp, Homo sapiens
cagacctgtccagcctgtg

SEQ ID NO: 7815377 - DNA, 19 bp, Homo sapiens
cagacctgtccagcctgtg

SEQ ID NO: 7815378 - DNA, 19 bp, Homo sapiens
cagacctgtccagcctgtg

SEQ ID NO: 7815379 - DNA, 22 bp, Homo sapiens
cagacctgggtccctggcctgt

SEQ ID NO: 7815380 - DNA, 22 bp, Homo sapiens
cagacctgggtccctggcctgt

SEQ ID NO: 7815381 - DNA, 22 bp, Homo sapiens
cagacctgggtccctggcctgt

SEQ ID NO: 7815382 - DNA, 19 bp, Homo sapiens
cagacctgtccagcctgtg

SEQ ID NO: 7815383 - DNA, 19 bp, Homo sapiens
cagacctgtccagcctgtg

SEQ ID NO: 7815384 - DNA, 22 bp, Homo sapiens
cagacctgggtccctggcctgt

SEQ ID NO: 7815385 - DNA, 22 bp, Homo sapiens
cagacctgggtccctggcctgt

SEQ ID NO: 7815386 - DNA, 22 bp, Homo sapiens
cagacctggggcctgggagccc

SEQ ID NO: 7815387 - DNA, 22 bp, Homo sapiens
cagacctggggcctgggagccc

SEQ ID NO: 7815388 - DNA, 22 bp, Homo sapiens
cagacctggggcctgggagccc

SEQ ID NO: 7815389 - DNA, 22 bp, Homo sapiens
cagacctggaaaacaggcttgc

SEQ ID NO: 7815390 - DNA, 22 bp, Homo sapiens
cagacctggaaaacaggcttgc

SEQ ID NO: 7815391 - DNA, 22 bp, Homo sapiens
cagacctgaggagcactgagcc

SEQ ID NO: 7815392 - DNA, 22 bp, Homo sapiens
cagacctgaggagcactgagcc

SEQ ID NO: 7815393 - DNA, 22 bp, Homo sapiens
cagacctgaggagcactgagcc

SEQ ID NO: 7815394 - DNA, 22 bp, Homo sapiens
cagacctgaggagcactgagcc

SEQ ID NO: 7815395 - DNA, 22 bp, Homo sapiens
cagacctctttttagcactccc

SEQ ID NO: 7815396 - DNA, 22 bp, Homo sapiens
gggcagagactcagaaacagaa

SEQ ID NO: 7815397 - DNA, 22 bp, Homo sapiens
gggcagcagagccctgccgagt

SEQ ID NO: 7815398 - DNA, 22 bp, Homo sapiens
gggcagagactcagaaacagaa

SEQ ID NO: 7815399 - DNA, 22 bp, Homo sapiens
cagactgggctggtggaaagct

SEQ ID NO: 7815400 - DNA, 22 bp, Homo sapiens
cagactgggagtcaggaagaag

SEQ ID NO: 7815401 - DNA, 22 bp, Homo sapiens
cagactgggagtcaggaagaag

SEQ ID NO: 7815402 - DNA, 22 bp, Homo sapiens
cagactggccacatctgcactg

SEQ ID NO: 7815403 - DNA, 22 bp, Homo sapiens
cagactgagtggattaaacaat

SEQ ID NO: 7815404 - DNA, 22 bp, Homo sapiens
cagactggccacatctgcactg

SEQ ID NO: 7815405 - DNA, 22 bp, Homo sapiens
cagactggccacatctgcactg

SEQ ID NO: 7815406 - DNA, 22 bp, Homo sapiens
cagactggctgaaggccgagtg

SEQ ID NO: 7815407 - DNA, 22 bp, Homo sapiens
cagactggctgaaggccgagtg

SEQ ID NO: 7815408 - DNA, 22 bp, Homo sapiens
cagactggctgaaggccgagtg

SEQ ID NO: 7815409 - DNA, 22 bp, Homo sapiens
cagactctgatgcagccttgtg

SEQ ID NO: 7815410 - DNA, 22 bp, Homo sapiens
cagactctcttccatgcatcac

SEQ ID NO: 7815411 - DNA, 22 bp, Homo sapiens
cagactcttgagctgattgtat

SEQ ID NO: 7815412 - DNA, 22 bp, Homo sapiens
cagactcttgagctgattgtat

SEQ ID NO: 7815413 - DNA, 22 bp, Homo sapiens
cagactgaaaatccctggtagt

SEQ ID NO: 7815414 - DNA, 17 bp, Homo sapiens
gggctgacagtggcctc

SEQ ID NO: 7815415 - DNA, 22 bp, Homo sapiens
gggctgaatttgttgcatgtaa

SEQ ID NO: 7815416 - DNA, 22 bp, Homo sapiens
gggctgacaaccatctgacaag

SEQ ID NO: 7815417 - DNA, 22 bp, Homo sapiens
gggctgaaaggccgcctcagat

SEQ ID NO: 7815418 - DNA, 22 bp, Homo sapiens
gggctctgtttagatcagagat

SEQ ID NO: 7815419 - DNA, 20 bp, Homo sapiens
gggctcttaggtagcagggg

SEQ ID NO: 7815420 - DNA, 22 bp, Homo sapiens
gggctctgtttagatcagagat

SEQ ID NO: 7815421 - DNA, 22 bp, Homo sapiens
gggctctgtttagatcagagat

SEQ ID NO: 7815422 - DNA, 22 bp, Homo sapiens
gggctctgtttagatcagagat

SEQ ID NO: 7815423 - DNA, 22 bp, Homo sapiens
gggctctgtttagatcagagat

SEQ ID NO: 7815424 - DNA, 22 bp, Homo sapiens
gggctctgtttagaccagagat

SEQ ID NO: 7815425 - DNA, 22 bp, Homo sapiens
gggctctgtttagaccagagat

SEQ ID NO: 7815426 - DNA, 22 bp, Homo sapiens
gggctctgtttagaccagagat

SEQ ID NO: 7815427 - DNA, 22 bp, Homo sapiens
gggctctgtttagaccagagat

SEQ ID NO: 7815428 - DNA, 22 bp, Homo sapiens
gggctctgtttagaccagagat

SEQ ID NO: 7815429 - DNA, 22 bp, Homo sapiens
cagagcctcagaatcctgtgga

SEQ ID NO: 7815430 - DNA, 22 bp, Homo sapiens
cagagcctcagaatcctgtgga

SEQ ID NO: 7815431 - DNA, 22 bp, Homo sapiens
cagagcctcagaatcctgtgga

SEQ ID NO: 7815432 - DNA, 19 bp, Homo sapiens
cagagcctcagagctagaa

SEQ ID NO: 7815433 - DNA, 19 bp, Homo sapiens
cagagcctcagagctagaa

SEQ ID NO: 7815434 - DNA, 19 bp, Homo sapiens
cagagcctcagagctagaa

SEQ ID NO: 7815435 - DNA, 22 bp, Homo sapiens
cagagcctcatcatccactcca

SEQ ID NO: 7815436 - DNA, 22 bp, Homo sapiens
cagagcctcatcatccactcca

SEQ ID NO: 7815437 - DNA, 22 bp, Homo sapiens
cagagcctccctcctctgccat

SEQ ID NO: 7815438 - DNA, 22 bp, Homo sapiens
cagagcctccctcctctgccat

SEQ ID NO: 7815439 - DNA, 22 bp, Homo sapiens
cagagcctcatcatccactcca

SEQ ID NO: 7815440 - DNA, 22 bp, Homo sapiens
cagagcctcatcatccactcca

SEQ ID NO: 7815441 - DNA, 19 bp, Homo sapiens
cagagcctcagagctagaa

SEQ ID NO: 7815442 - DNA, 22 bp, Homo sapiens
gggctgactctgcactgagcca

SEQ ID NO: 7815443 - DNA, 22 bp, Homo sapiens
gggctgactcaaccttgcaaag

SEQ ID NO: 7815444 - DNA, 22 bp, Homo sapiens
gggctgagaagttgatcccaag

SEQ ID NO: 7815445 - DNA, 22 bp, Homo sapiens
gggctgactcaaccttgcaaag

SEQ ID NO: 7815446 - DNA, 22 bp, Homo sapiens
cagagcctaaaacgactccact

SEQ ID NO: 7815447 - DNA, 22 bp, Homo sapiens
cagagcctaaaacgactccact

SEQ ID NO: 7815448 - DNA, 22 bp, Homo sapiens
cagagcctaaaacgactccact

SEQ ID NO: 7815449 - DNA, 22 bp, Homo sapiens
cagagcccttggctggagccca

SEQ ID NO: 7815450 - DNA, 22 bp, Homo sapiens
cagagcctaaaacgactccact

SEQ ID NO: 7815451 - DNA, 20 bp, Homo sapiens
gggctctgcttggcagaagt

SEQ ID NO: 7815452 - DNA, 20 bp, Homo sapiens
gggctctgcttggcagaagt

SEQ ID NO: 7815453 - DNA, 22 bp, Homo sapiens
gggccagcagtatcggaggcat

SEQ ID NO: 7815454 - DNA, 22 bp, Homo sapiens
gggccagcagtatcggaggcat

SEQ ID NO: 7815455 - DNA, 22 bp, Homo sapiens
gggccagcctactgctagaccc

SEQ ID NO: 7815456 - DNA, 22 bp, Homo sapiens
gggccagagcttggcagctggg

SEQ ID NO: 7815457 - DNA, 22 bp, Homo sapiens
gggccagagcttggcagctggg

SEQ ID NO: 7815458 - DNA, 22 bp, Homo sapiens
gggccagagcttggcagctggg

SEQ ID NO: 7815459 - DNA, 22 bp, Homo sapiens
gggccagagcttggcagctggg

SEQ ID NO: 7815460 - DNA, 22 bp, Homo sapiens
gggccagagcttggcagctggg

SEQ ID NO: 7815461 - DNA, 22 bp, Homo sapiens
gggccagagcttggcagctggg

SEQ ID NO: 7815462 - DNA, 22 bp, Homo sapiens
gggccagcagtatcggaggcat

SEQ ID NO: 7815463 - DNA, 22 bp, Homo sapiens
gggccagcagtatcggaggcat

SEQ ID NO: 7815464 - DNA, 22 bp, Homo sapiens
gggccagagcacagaggatgtt

SEQ ID NO: 7815465 - DNA, 22 bp, Homo sapiens
gggccagacctcttctcaggga

SEQ ID NO: 7815466 - DNA, 22 bp, Homo sapiens
gggccagacctcttctcaggga

SEQ ID NO: 7815467 - DNA, 22 bp, Homo sapiens
gggccagacctcttctcaggga

SEQ ID NO: 7815468 - DNA, 22 bp, Homo sapiens
gggccagacctcttctcaggga

SEQ ID NO: 7815469 - DNA, 22 bp, Homo sapiens
gggccagacctcttctcaggga

SEQ ID NO: 7815470 - DNA, 22 bp, Homo sapiens
gggccagacctcttctcaggga

SEQ ID NO: 7815471 - DNA, 22 bp, Homo sapiens
gggccagacccttggcgatctg

SEQ ID NO: 7815472 - DNA, 22 bp, Homo sapiens
gggccagacccttggcgatctg

SEQ ID NO: 7815473 - DNA, 22 bp, Homo sapiens
gggccagacccttggcgatctg

SEQ ID NO: 7815474 - DNA, 22 bp, Homo sapiens
gggccagacccttggcgatctg

SEQ ID NO: 7815475 - DNA, 21 bp, Homo sapiens
gggccactctagagaaagaaa

SEQ ID NO: 7815476 - DNA, 22 bp, Homo sapiens
gggccacttctagtgcctcaga

SEQ ID NO: 7815477 - DNA, 22 bp, Homo sapiens
gggccacttctagtgcctcaga

SEQ ID NO: 7815478 - DNA, 22 bp, Homo sapiens
gggccactgggtcctgctggcc

SEQ ID NO: 7815479 - DNA, 22 bp, Homo sapiens
gggccaccccactgcccacgct

SEQ ID NO: 7815480 - DNA, 22 bp, Homo sapiens
gggccacctggattccatgtgt

SEQ ID NO: 7815481 - DNA, 22 bp, Homo sapiens
gggcagtgtggtcgtgcctttg

SEQ ID NO: 7815482 - DNA, 22 bp, Homo sapiens
gggccacattgaagggtgggta

SEQ ID NO: 7815483 - DNA, 22 bp, Homo sapiens
gggccaccccactgcccacgct

SEQ ID NO: 7815484 - DNA, 22 bp, Homo sapiens
gggccacggaaggaccagtggg

SEQ ID NO: 7815485 - DNA, 22 bp, Homo sapiens
gggccactcctggctgctgagt

SEQ ID NO: 7815486 - DNA, 22 bp, Homo sapiens
gggccactcctggctgctgagt

SEQ ID NO: 7815487 - DNA, 22 bp, Homo sapiens
gggccactcagattgtcccctt

SEQ ID NO: 7815488 - DNA, 22 bp, Homo sapiens
gggcagtgtcggggcccaggga

SEQ ID NO: 7815489 - DNA, 22 bp, Homo sapiens
gggcagtgtctgcaaatgaaca

SEQ ID NO: 7815490 - DNA, 22 bp, Homo sapiens
gggcagtgtctgcaaatgaaca

SEQ ID NO: 7815491 - DNA, 22 bp, Homo sapiens
gggcagtgtggtcgtgcctttg

SEQ ID NO: 7815492 - DNA, 22 bp, Homo sapiens
gggcagtgtggtcgtgcctttg

SEQ ID NO: 7815493 - DNA, 22 bp, Homo sapiens
gggcagtgtcgaggtctggtcc

SEQ ID NO: 7815494 - DNA, 22 bp, Homo sapiens
gggcagtgtcggggcccaggga

SEQ ID NO: 7815495 - DNA, 22 bp, Homo sapiens
gggcagtgtcggggcccaggga

SEQ ID NO: 7815496 - DNA, 22 bp, Homo sapiens
gggcagtgtcggggcccaggga

SEQ ID NO: 7815497 - DNA, 22 bp, Homo sapiens
gggcagtgtcgaggtctggtcc

SEQ ID NO: 7815498 - DNA, 22 bp, Homo sapiens
gggcagtgtcggggcccaggga

SEQ ID NO: 7815499 - DNA, 19 bp, Homo sapiens
cagagctgctggcctcgtc

SEQ ID NO: 7815500 - DNA, 19 bp, Homo sapiens
cagagctgctggcctcgtc

SEQ ID NO: 7815501 - DNA, 22 bp, Homo sapiens
cagagcctgctcacgtctctgt

SEQ ID NO: 7815502 - DNA, 22 bp, Homo sapiens
cagagcctgctcacgtctctgt

SEQ ID NO: 7815503 - DNA, 22 bp, Homo sapiens
cagagcctgctcacgtctctgt

SEQ ID NO: 7815504 - DNA, 22 bp, Homo sapiens
cagagcctgcctctggctgtgg

SEQ ID NO: 7815505 - DNA, 22 bp, Homo sapiens
cagagcctgcctctggctgtgg

SEQ ID NO: 7815506 - DNA, 22 bp, Homo sapiens
cagagctggctctgcatgtaca

SEQ ID NO: 7815507 - DNA, 22 bp, Homo sapiens
cagagctggctctgcatgtaca

SEQ ID NO: 7815508 - DNA, 22 bp, Homo sapiens
cagagctggctctgcatgtaca

SEQ ID NO: 7815509 - DNA, 23 bp, Homo sapiens
cagagctggctcagagctgcctg

SEQ ID NO: 7815510 - DNA, 23 bp, Homo sapiens
cagagctggctcagagctgcctg

SEQ ID NO: 7815511 - DNA, 22 bp, Homo sapiens
cagagcctccctcctctgccat

SEQ ID NO: 7815512 - DNA, 22 bp, Homo sapiens
cagagcctccctcctctgccat

SEQ ID NO: 7815513 - DNA, 22 bp, Homo sapiens
cagagcctctcagaggtcagac

SEQ ID NO: 7815514 - DNA, 22 bp, Homo sapiens
cagagcctctcagccccttggg

SEQ ID NO: 7815515 - DNA, 22 bp, Homo sapiens
cagagcctctcagccccttggg

SEQ ID NO: 7815516 - DNA, 22 bp, Homo sapiens
cagagcctctcagaggtcagac

SEQ ID NO: 7815517 - DNA, 22 bp, Homo sapiens
cagagcctctgccctgggcact

SEQ ID NO: 7815518 - DNA, 22 bp, Homo sapiens
cagagcctctgccctgggcact

SEQ ID NO: 7815519 - DNA, 22 bp, Homo sapiens
cagagcctctcagccccttggg

SEQ ID NO: 7815520 - DNA, 22 bp, Homo sapiens
cagagcctctgccctgggcact

SEQ ID NO: 7815521 - DNA, 22 bp, Homo sapiens
cagagcctgccacctttctccc

SEQ ID NO: 7815522 - DNA, 22 bp, Homo sapiens
cagagcctgcctctggctgtgg

SEQ ID NO: 7815523 - DNA, 22 bp, Homo sapiens
cagagcctgccacctttctccc

SEQ ID NO: 7815524 - DNA, 22 bp, Homo sapiens
cagagctgggatcccatgggcg

SEQ ID NO: 7815525 - DNA, 22 bp, Homo sapiens
cagagctgggatcccatgggcg

SEQ ID NO: 7815526 - DNA, 22 bp, Homo sapiens
cagagctgggatcccatgggcg

SEQ ID NO: 7815527 - DNA, 22 bp, Homo sapiens
cagagctgggatcccatgggcg

SEQ ID NO: 7815528 - DNA, 22 bp, Homo sapiens
cagagctgggatcccatgggcg

SEQ ID NO: 7815529 - DNA, 22 bp, Homo sapiens
cagagctgggatcccatgggcg

SEQ ID NO: 7815530 - DNA, 22 bp, Homo sapiens
cagagctgggatcccatgggcg

SEQ ID NO: 7815531 - DNA, 23 bp, Homo sapiens
cagagctggcttcatgggtgtgc

SEQ ID NO: 7815532 - DNA, 22 bp, Homo sapiens
cagagctgggatcccatgggcg

SEQ ID NO: 7815533 - DNA, 23 bp, Homo sapiens
cagagctggcttcatgggtgtgc

SEQ ID NO: 7815534 - DNA, 23 bp, Homo sapiens
cagagctggcttcatgggtgtgc

SEQ ID NO: 7815535 - DNA, 22 bp, Homo sapiens
cagagctggctctgcatgtaca

SEQ ID NO: 7815536 - DNA, 22 bp, Homo sapiens
cagagctggctctgcatgtaca

SEQ ID NO: 7815537 - DNA, 23 bp, Homo sapiens
cagagctggcttcatgggtgtgc

SEQ ID NO: 7815538 - DNA, 23 bp, Homo sapiens
cagagctggcttcatgggtgtgc

SEQ ID NO: 7815539 - DNA, 23 bp, Homo sapiens
cagagctggcttcatgggtgtgc

SEQ ID NO: 7815540 - DNA, 22 bp, Homo sapiens
cagagctgggatcccatgggcg

SEQ ID NO: 7815541 - DNA, 22 bp, Homo sapiens
cagagctggggactgttggatg

SEQ ID NO: 7815542 - DNA, 22 bp, Homo sapiens
cagagctggggactgttggatg

SEQ ID NO: 7815543 - DNA, 22 bp, Homo sapiens
cagagctgggtttgggaaacct

SEQ ID NO: 7815544 - DNA, 22 bp, Homo sapiens
cagagctggggactgttggatg

SEQ ID NO: 7815545 - DNA, 22 bp, Homo sapiens
cagagctggggactgttggatg

SEQ ID NO: 7815546 - DNA, 22 bp, Homo sapiens
cagagctgggcatggtgaaagg

SEQ ID NO: 7815547 - DNA, 22 bp, Homo sapiens
cagagctgggcatggtgaaagg

SEQ ID NO: 7815548 - DNA, 20 bp, Homo sapiens
cagagctgggatttgaacac

SEQ ID NO: 7815549 - DNA, 20 bp, Homo sapiens
cagagctgggatttgaacac

SEQ ID NO: 7815550 - DNA, 22 bp, Homo sapiens
cagagctgggatcccatgggcg

SEQ ID NO: 7815551 - DNA, 22 bp, Homo sapiens
cagaggcaaaagaggtggaggt

SEQ ID NO: 7815552 - DNA, 22 bp, Homo sapiens
cagaggcaaaagaggtggaggt

SEQ ID NO: 7815553 - DNA, 22 bp, Homo sapiens
cagaggcaaaagaggtggaggt

SEQ ID NO: 7815554 - DNA, 22 bp, Homo sapiens
cagaggcaaaagaggtggaggt

SEQ ID NO: 7815555 - DNA, 22 bp, Homo sapiens
cagaggcaaaagaggtggaggt

SEQ ID NO: 7815556 - DNA, 20 bp, Homo sapiens
cagaggcaaggagacttgga

SEQ ID NO: 7815557 - DNA, 20 bp, Homo sapiens
cagaggcaaggagacttgga

SEQ ID NO: 7815558 - DNA, 20 bp, Homo sapiens
cagaggcaaggagacttgga

SEQ ID NO: 7815559 - DNA, 22 bp, Homo sapiens
cagaggcacaagaaagcaaggc

SEQ ID NO: 7815560 - DNA, 22 bp, Homo sapiens
cagaggcacaagaaagcaaggc

SEQ ID NO: 7815561 - DNA, 20 bp, Homo sapiens
cagaggcaaggagacttgga

SEQ ID NO: 7815562 - DNA, 20 bp, Homo sapiens
cagaggcaaggagacttgga

SEQ ID NO: 7815563 - DNA, 20 bp, Homo sapiens
cagaggcaaggagacttgga

SEQ ID NO: 7815564 - DNA, 20 bp, Homo sapiens
cagaggcaaggagacttgga

SEQ ID NO: 7815565 - DNA, 20 bp, Homo sapiens
cagaggcaaggagacttgga

SEQ ID NO: 7815566 - DNA, 20 bp, Homo sapiens
cagaggcaaggagacttgga

SEQ ID NO: 7815567 - DNA, 22 bp, Homo sapiens
cagaggcaaaagaggtggaggt

SEQ ID NO: 7815568 - DNA, 22 bp, Homo sapiens
cagaggcaaaagaggtggaggt

SEQ ID NO: 7815569 - DNA, 22 bp, Homo sapiens
cagaggattatggagatggtct

SEQ ID NO: 7815570 - DNA, 22 bp, Homo sapiens
cagaggagaattgcgggatcat

SEQ ID NO: 7815571 - DNA, 22 bp, Homo sapiens
cagaggagaattgcgggatcat

SEQ ID NO: 7815572 - DNA, 22 bp, Homo sapiens
gggctgagtgggcctcttactt

SEQ ID NO: 7815573 - DNA, 22 bp, Homo sapiens
cagaggagaattgcgggatcat

SEQ ID NO: 7815574 - DNA, 22 bp, Homo sapiens
cagaggacttcccactcatctg

SEQ ID NO: 7815575 - DNA, 22 bp, Homo sapiens
gggctgagtcatctggggcctc

SEQ ID NO: 7815576 - DNA, 22 bp, Homo sapiens
gggctgagtcatctggggcctc

SEQ ID NO: 7815577 - DNA, 22 bp, Homo sapiens
gggctgagtcatctggggcctc

SEQ ID NO: 7815578 - DNA, 22 bp, Homo sapiens
gggctgagtcatctggggcctc

SEQ ID NO: 7815579 - DNA, 22 bp, Homo sapiens
gggctgagtcatctggggcctc

SEQ ID NO: 7815580 - DNA, 22 bp, Homo sapiens
gggctgaggggtatctcatggg

SEQ ID NO: 7815581 - DNA, 22 bp, Homo sapiens
gggctgaggggtatctcatggg

SEQ ID NO: 7815582 - DNA, 22 bp, Homo sapiens
gggctgagtcatctggggcctc

SEQ ID NO: 7815583 - DNA, 22 bp, Homo sapiens
gggctgaggggtatctcatggg

SEQ ID NO: 7815584 - DNA, 22 bp, Homo sapiens
gggctgaggggtatctcatggg

SEQ ID NO: 7815585 - DNA, 22 bp, Homo sapiens
gggctgaggggtatctcatggg

SEQ ID NO: 7815586 - DNA, 22 bp, Homo sapiens
gggctgaggggtatctcatggg

SEQ ID NO: 7815587 - DNA, 22 bp, Homo sapiens
cagagctggggactgttggatg

SEQ ID NO: 7815588 - DNA, 22 bp, Homo sapiens
gggctgaggggtatctcatggg

SEQ ID NO: 7815589 - DNA, 22 bp, Homo sapiens
cagagctgggtttgggaaacct

SEQ ID NO: 7815590 - DNA, 22 bp, Homo sapiens
cagagctgggtttgggaaacct

SEQ ID NO: 7815591 - DNA, 22 bp, Homo sapiens
gggctgaggggtatctcatggg

SEQ ID NO: 7815592 - DNA, 22 bp, Homo sapiens
gggctgaggggtatctcatggg

SEQ ID NO: 7815593 - DNA, 22 bp, Homo sapiens
gggctgagtctgctgcctgtca

SEQ ID NO: 7815594 - DNA, 22 bp, Homo sapiens
gggctgagtgacctcaggccaa

SEQ ID NO: 7815595 - DNA, 22 bp, Homo sapiens
gggctgagtgacctcaggccaa

SEQ ID NO: 7815596 - DNA, 22 bp, Homo sapiens
gggctgagtgacctcaggccaa

SEQ ID NO: 7815597 - DNA, 22 bp, Homo sapiens
gggctgagtgacctcaggccaa

SEQ ID NO: 7815598 - DNA, 22 bp, Homo sapiens
gggctgagtgacctcaggccaa

SEQ ID NO: 7815599 - DNA, 22 bp, Homo sapiens
gggctgagtgacctcaggccaa

SEQ ID NO: 7815600 - DNA, 22 bp, Homo sapiens
gggctgagtcatctggggcctc

SEQ ID NO: 7815601 - DNA, 22 bp, Homo sapiens
gggctgagtctgctgcctgtca

SEQ ID NO: 7815602 - DNA, 22 bp, Homo sapiens
gggctgagtctgctgcctgtca

SEQ ID NO: 7815603 - DNA, 22 bp, Homo sapiens
gggctgagtctgctgcctgtca

SEQ ID NO: 7815604 - DNA, 22 bp, Homo sapiens
gggctgagtctgctgcctgtca

SEQ ID NO: 7815605 - DNA, 22 bp, Homo sapiens
gggctgagtctgctgcctgtca

SEQ ID NO: 7815606 - DNA, 22 bp, Homo sapiens
gggctgagtctgctgcctgtca

SEQ ID NO: 7815607 - DNA, 22 bp, Homo sapiens
gggctgagtctgctgcctgtca

SEQ ID NO: 7815608 - DNA, 22 bp, Homo sapiens
gggctgagtctgctgcctgtca

SEQ ID NO: 7815609 - DNA, 22 bp, Homo sapiens
gggctgagtctgctgcctgtca

SEQ ID NO: 7815610 - DNA, 22 bp, Homo sapiens
gggctgagtctgctgcctgtca

SEQ ID NO: 7815611 - DNA, 22 bp, Homo sapiens
cagagtcatgggccgtcaggca

SEQ ID NO: 7815612 - DNA, 22 bp, Homo sapiens
cagagtcattgacttccaggag

SEQ ID NO: 7815613 - DNA, 22 bp, Homo sapiens
cagagtcagtattgaattgaaa

SEQ ID NO: 7815614 - DNA, 22 bp, Homo sapiens
cagagtcatatcagagaatatg

SEQ ID NO: 7815615 - DNA, 23 bp, Homo sapiens
cagagtcagggggccccacctct

SEQ ID NO: 7815616 - DNA, 22 bp, Homo sapiens
cagagtcagctagtcttgggat

SEQ ID NO: 7815617 - DNA, 22 bp, Homo sapiens
cagagtcagctagtcttgggat

SEQ ID NO: 7815618 - DNA, 22 bp, Homo sapiens
cagagtcagtattgaattgaaa

SEQ ID NO: 7815619 - DNA, 22 bp, Homo sapiens
cagagtcatgggccgtcaggca

SEQ ID NO: 7815620 - DNA, 22 bp, Homo sapiens
cagagtcatgggccgtcaggca

SEQ ID NO: 7815621 - DNA, 22 bp, Homo sapiens
ggtccaaggctcggtggcgggg

SEQ ID NO: 7815622 - DNA, 22 bp, Homo sapiens
ggtcattttcactttcaagtta

SEQ ID NO: 7815623 - DNA, 22 bp, Homo sapiens
ggtccagaagctggtagggtag

SEQ ID NO: 7815624 - DNA, 22 bp, Homo sapiens
ggtccagaagctggtagggtag

SEQ ID NO: 7815625 - DNA, 22 bp, Homo sapiens
ggtccacctccaagctggggac

SEQ ID NO: 7815626 - DNA, 23 bp, Homo sapiens
ggtccacccgagcctgcagcttc

SEQ ID NO: 7815627 - DNA, 22 bp, Homo sapiens
ggtcatgttttaaaaatattgt

SEQ ID NO: 7815628 - DNA, 22 bp, Homo sapiens
ggtcatgtgtccaggaggtagc

SEQ ID NO: 7815629 - DNA, 22 bp, Homo sapiens
ggtcatggatagctggagcctt

SEQ ID NO: 7815630 - DNA, 22 bp, Homo sapiens
cagagtcctggacacagagaca

SEQ ID NO: 7815631 - DNA, 22 bp, Homo sapiens
cagagtcctggacacagagaca

SEQ ID NO: 7815632 - DNA, 22 bp, Homo sapiens
cagagtctctgggaggctgggt

SEQ ID NO: 7815633 - DNA, 22 bp, Homo sapiens
cagagtctctgggaggctgggt

SEQ ID NO: 7815634 - DNA, 22 bp, Homo sapiens
cagagtctctgggaggctgggt

SEQ ID NO: 7815635 - DNA, 22 bp, Homo sapiens
cagagtctgcgagcagaggggc

SEQ ID NO: 7815636 - DNA, 22 bp, Homo sapiens
cagagtctgcgagcagaggggc

SEQ ID NO: 7815637 - DNA, 22 bp, Homo sapiens
cagagtctggactgcaggctcc

SEQ ID NO: 7815638 - DNA, 22 bp, Homo sapiens
cagagtctggactgcaggctcc

SEQ ID NO: 7815639 - DNA, 22 bp, Homo sapiens
cagagtctggactgcaggctcc

SEQ ID NO: 7815640 - DNA, 22 bp, Homo sapiens
cagagtctggactgcaggctcc

SEQ ID NO: 7815641 - DNA, 22 bp, Homo sapiens
cagagtctggactgcaggctcc

SEQ ID NO: 7815642 - DNA, 17 bp, Homo sapiens
cagagtctgtctgcatc

SEQ ID NO: 7815643 - DNA, 17 bp, Homo sapiens
cagagtctgtctgcatc

SEQ ID NO: 7815644 - DNA, 17 bp, Homo sapiens
cagagtctgtctgcatc

SEQ ID NO: 7815645 - DNA, 17 bp, Homo sapiens
cagagtctgtctgcatc

SEQ ID NO: 7815646 - DNA, 22 bp, Homo sapiens
cagagtcttgtgtgttcagccc

SEQ ID NO: 7815647 - DNA, 22 bp, Homo sapiens
ggtcctgggaagatgctcatga

SEQ ID NO: 7815648 - DNA, 22 bp, Homo sapiens
cagagtcttgtgtgttcagccc

SEQ ID NO: 7815649 - DNA, 22 bp, Homo sapiens
ggtcctgggaagatgctcatga

SEQ ID NO: 7815650 - DNA, 22 bp, Homo sapiens
ggtctgagatatttgttcagct

SEQ ID NO: 7815651 - DNA, 22 bp, Homo sapiens
ggtctgagagccactgaatccc

SEQ ID NO: 7815652 - DNA, 18 bp, Homo sapiens
ggtcctgggcctggctca

SEQ ID NO: 7815653 - DNA, 18 bp, Homo sapiens
ggtcctgggcctggctca

SEQ ID NO: 7815654 - DNA, 22 bp, Homo sapiens
ggtcacagggaagggctctcaa

SEQ ID NO: 7815655 - DNA, 22 bp, Homo sapiens
ggtcacaggggagaagagtgat

SEQ ID NO: 7815656 - DNA, 22 bp, Homo sapiens
ggtcacaggggagaagagtgat

SEQ ID NO: 7815657 - DNA, 22 bp, Homo sapiens
ggtcagggttccaggtatcttc

SEQ ID NO: 7815658 - DNA, 22 bp, Homo sapiens
ggtcaggtagctctgacaggcc

SEQ ID NO: 7815659 - DNA, 22 bp, Homo sapiens
cagaggtagaaggcatgcagtg

SEQ ID NO: 7815660 - DNA, 22 bp, Homo sapiens
cagaggtagaactggccctcac

SEQ ID NO: 7815661 - DNA, 22 bp, Homo sapiens
cagaggtagcatgctgtggctt

SEQ ID NO: 7815662 - DNA, 22 bp, Homo sapiens
ggtcacagggaagggctctcaa

SEQ ID NO: 7815663 - DNA, 21 bp, Homo sapiens
cagagggtttctcaggtgttt

SEQ ID NO: 7815664 - DNA, 21 bp, Homo sapiens
cagagggtttctcaggtgttt

SEQ ID NO: 7815665 - DNA, 22 bp, Homo sapiens
cagagggttgatgtgaggctta

SEQ ID NO: 7815666 - DNA, 22 bp, Homo sapiens
cagagggttgatgtgaggctta

SEQ ID NO: 7815667 - DNA, 23 bp, Homo sapiens
cagagggttccatggagcatggt

SEQ ID NO: 7815668 - DNA, 22 bp, Homo sapiens
cagaggtaccagcagcctctgg

SEQ ID NO: 7815669 - DNA, 22 bp, Homo sapiens
cagaggtacagccattgaagat

SEQ ID NO: 7815670 - DNA, 22 bp, Homo sapiens
cagaggtaccagcagcctctgg

SEQ ID NO: 7815671 - DNA, 22 bp, Homo sapiens
cagaggtacagccattgaagat

SEQ ID NO: 7815672 - DNA, 22 bp, Homo sapiens
cagaggtacaagctaagttggg

SEQ ID NO: 7815673 - DNA, 22 bp, Homo sapiens
cagaggtacaagctaagttggg

SEQ ID NO: 7815674 - DNA, 21 bp, Homo sapiens
cagagggtttctcaggtgttt

SEQ ID NO: 7815675 - DNA, 22 bp, Homo sapiens
ggtcagtgcgatttcccactcc

SEQ ID NO: 7815676 - DNA, 22 bp, Homo sapiens
ggtcagtgcgatttcccactcc

SEQ ID NO: 7815677 - DNA, 23 bp, Homo sapiens
ggtcagtgagttcgtttctctgg

SEQ ID NO: 7815678 - DNA, 23 bp, Homo sapiens
ggtcagtgagttcgtttctctgg

SEQ ID NO: 7815679 - DNA, 22 bp, Homo sapiens
ggtcagtgacttttttctgtgg

SEQ ID NO: 7815680 - DNA, 22 bp, Homo sapiens
ggtcagtgagcaaacaaccacg

SEQ ID NO: 7815681 - DNA, 22 bp, Homo sapiens
ggtcagtgacttttttctgtgg

SEQ ID NO: 7815682 - DNA, 22 bp, Homo sapiens
ggtcagtgacttttttctgtgg

SEQ ID NO: 7815683 - DNA, 22 bp, Homo sapiens
ggtcagtctctcccgagtgttg

SEQ ID NO: 7815684 - DNA, 22 bp, Homo sapiens
ggtcagtcaattagttctagca

SEQ ID NO: 7815685 - DNA, 22 bp, Homo sapiens
ggtcagtctctcccgagtgttg

SEQ ID NO: 7815686 - DNA, 22 bp, Homo sapiens
ggtcaggtttttaggagtgacc

SEQ ID NO: 7815687 - DNA, 22 bp, Homo sapiens
ggtcagtggcagggggtacttc

SEQ ID NO: 7815688 - DNA, 21 bp, Homo sapiens
ggtcagtggctttcttgcacc

SEQ ID NO: 7815689 - DNA, 22 bp, Homo sapiens
ggtcataatggatttgctgttc

SEQ ID NO: 7815690 - DNA, 22 bp, Homo sapiens
ggtcatacaggtatctggtact

SEQ ID NO: 7815691 - DNA, 22 bp, Homo sapiens
ggtcatctgcctccaaagcact

SEQ ID NO: 7815692 - DNA, 22 bp, Homo sapiens
ggtcagtgtacacatgtgcagg

SEQ ID NO: 7815693 - DNA, 22 bp, Homo sapiens
ggtcagtgtttcatctgtgaaa

SEQ ID NO: 7815694 - DNA, 16 bp, Homo sapiens
cagaggcacctggctc

SEQ ID NO: 7815695 - DNA, 16 bp, Homo sapiens
cagaggcacctggctc

SEQ ID NO: 7815696 - DNA, 22 bp, Homo sapiens
ggggagaccatctgaaggtgat

SEQ ID NO: 7815697 - DNA, 22 bp, Homo sapiens
ggggagaccatctgaaggtgat

SEQ ID NO: 7815698 - DNA, 19 bp, Homo sapiens
cagaggcaccaggtataga

SEQ ID NO: 7815699 - DNA, 19 bp, Homo sapiens
cagaggcaccaggtataga

SEQ ID NO: 7815700 - DNA, 19 bp, Homo sapiens
cagaggcaccaggtataga

SEQ ID NO: 7815701 - DNA, 22 bp, Homo sapiens
ggggagagtcctttccagttcc

SEQ ID NO: 7815702 - DNA, 22 bp, Homo sapiens
ggggagagtcctttccagttcc

SEQ ID NO: 7815703 - DNA, 22 bp, Homo sapiens
ggggagagtattttattcaagt

SEQ ID NO: 7815704 - DNA, 22 bp, Homo sapiens
ggggagagtattttattcaagt

SEQ ID NO: 7815705 - DNA, 22 bp, Homo sapiens
ggggagagtattttattcaagt

SEQ ID NO: 7815706 - DNA, 22 bp, Homo sapiens
cagaggcacaagaaagcaaggc

SEQ ID NO: 7815707 - DNA, 22 bp, Homo sapiens
cagaggcacaagaaagcaaggc

SEQ ID NO: 7815708 - DNA, 22 bp, Homo sapiens
cagaggcacaagaaagcaaggc

SEQ ID NO: 7815709 - DNA, 22 bp, Homo sapiens
cagaggcacagtgcgggccact

SEQ ID NO: 7815710 - DNA, 22 bp, Homo sapiens
cagaggcacagcttcttttaat

SEQ ID NO: 7815711 - DNA, 22 bp, Homo sapiens
cagaggcacagcttcttttaat

SEQ ID NO: 7815712 - DNA, 19 bp, Homo sapiens
cagaggcaccaggtataga

SEQ ID NO: 7815713 - DNA, 19 bp, Homo sapiens
cagaggcaccaggtataga

SEQ ID NO: 7815714 - DNA, 22 bp, Homo sapiens
cagaggcacagtgcgggccact

SEQ ID NO: 7815715 - DNA, 22 bp, Homo sapiens
cagaggcacagtgcgggccact

SEQ ID NO: 7815716 - DNA, 22 bp, Homo sapiens
cagaggcacagtgcgggccact

SEQ ID NO: 7815717 - DNA, 22 bp, Homo sapiens
cagaggcacagtgcgggccact

SEQ ID NO: 7815718 - DNA, 22 bp, Homo sapiens
cagaggcacagtgcgggccact

SEQ ID NO: 7815719 - DNA, 22 bp, Homo sapiens
ggggagcaggctgggctgtctg

SEQ ID NO: 7815720 - DNA, 22 bp, Homo sapiens
ggggagcaggctgggctgtctg

SEQ ID NO: 7815721 - DNA, 22 bp, Homo sapiens
ggggagcaggctgggctgtctg

SEQ ID NO: 7815722 - DNA, 22 bp, Homo sapiens
ggggagcaggctgggctgtctg

SEQ ID NO: 7815723 - DNA, 22 bp, Homo sapiens
ggggagcaggctgggctgtctg

SEQ ID NO: 7815724 - DNA, 22 bp, Homo sapiens
ggggagcaggctgggctgtctg

SEQ ID NO: 7815725 - DNA, 22 bp, Homo sapiens
ggggagctgagacactgccctc

SEQ ID NO: 7815726 - DNA, 22 bp, Homo sapiens
ggggagcttagggtctctgaat

SEQ ID NO: 7815727 - DNA, 22 bp, Homo sapiens
ggggagctgggaggtgagttac

SEQ ID NO: 7815728 - DNA, 22 bp, Homo sapiens
ggggagcaatagttgaggtgtg

SEQ ID NO: 7815729 - DNA, 22 bp, Homo sapiens
ggggagcaatagttgaggtgtg

SEQ ID NO: 7815730 - DNA, 22 bp, Homo sapiens
ggggagcaatagttgaggtgtg

SEQ ID NO: 7815731 - DNA, 22 bp, Homo sapiens
ggggagcaatagttgaggtgtg

SEQ ID NO: 7815732 - DNA, 22 bp, Homo sapiens
ggggagatgcttaggtccgggg

SEQ ID NO: 7815733 - DNA, 22 bp, Homo sapiens
ggggagagtcctttccagttcc

SEQ ID NO: 7815734 - DNA, 22 bp, Homo sapiens
ggggagcaatagttgaggtgtg

SEQ ID NO: 7815735 - DNA, 22 bp, Homo sapiens
ggggagcaatagttgaggtgtg

SEQ ID NO: 7815736 - DNA, 22 bp, Homo sapiens
ggggagcaatagttgaggtgtg

SEQ ID NO: 7815737 - DNA, 22 bp, Homo sapiens
ggggagcaatagttgaggtgtg

SEQ ID NO: 7815738 - DNA, 22 bp, Homo sapiens
ggggagcaattgcccccttaga

SEQ ID NO: 7815739 - DNA, 22 bp, Homo sapiens
ggggagcaattgcccccttaga

SEQ ID NO: 7815740 - DNA, 22 bp, Homo sapiens
ggggagcagaagcagcaacaac

SEQ ID NO: 7815741 - DNA, 22 bp, Homo sapiens
ggggagcaggctgggctgtctg

SEQ ID NO: 7815742 - DNA, 18 bp, Homo sapiens
ggggagcagactgaactc

SEQ ID NO: 7815743 - DNA, 22 bp, Homo sapiens
ggggagcaggctgggctgtctg

SEQ ID NO: 7815744 - DNA, 22 bp, Homo sapiens
ggggagcagaagcagcaacaac

SEQ ID NO: 7815745 - DNA, 18 bp, Homo sapiens
ggggagcagactgaactc

SEQ ID NO: 7815746 - DNA, 22 bp, Homo sapiens
cagagggctcggcggccgctcc

SEQ ID NO: 7815747 - DNA, 22 bp, Homo sapiens
cagagggctcggcggccgctcc

SEQ ID NO: 7815748 - DNA, 22 bp, Homo sapiens
cagagggctcggcggccgctcc

SEQ ID NO: 7815749 - DNA, 22 bp, Homo sapiens
cagagggctcttggctgcctgc

SEQ ID NO: 7815750 - DNA, 22 bp, Homo sapiens
cagagggctcggcggccgctcc

SEQ ID NO: 7815751 - DNA, 22 bp, Homo sapiens
cagagggctcagtcctgctgga

SEQ ID NO: 7815752 - DNA, 22 bp, Homo sapiens
cagagggctcagtcctgctgga

SEQ ID NO: 7815753 - DNA, 22 bp, Homo sapiens
cagagggctcagtcctgctgga

SEQ ID NO: 7815754 - DNA, 22 bp, Homo sapiens
cagagggctcggcggccgctcc

SEQ ID NO: 7815755 - DNA, 22 bp, Homo sapiens
cagagggctcggcggccgctcc

SEQ ID NO: 7815756 - DNA, 22 bp, Homo sapiens
cagagggaaaaggggagtaata

SEQ ID NO: 7815757 - DNA, 22 bp, Homo sapiens
cagagggaaaaggggagtaata

SEQ ID NO: 7815758 - DNA, 22 bp, Homo sapiens
cagagggaaaaggggagtaata

SEQ ID NO: 7815759 - DNA, 22 bp, Homo sapiens
cagaggctttgccctggaaacc

SEQ ID NO: 7815760 - DNA, 22 bp, Homo sapiens
cagagggcgtccgggttaactt

SEQ ID NO: 7815761 - DNA, 22 bp, Homo sapiens
cagagggaaaaggggagtaata

SEQ ID NO: 7815762 - DNA, 21 bp, Homo sapiens
cagagggccggcatgtggtct

SEQ ID NO: 7815763 - DNA, 22 bp, Homo sapiens
cagagggaaaaggggagtaata

SEQ ID NO: 7815764 - DNA, 22 bp, Homo sapiens
cagagggcttcaggttcaggat

SEQ ID NO: 7815765 - DNA, 22 bp, Homo sapiens
cagagggcttcaggttcaggat

SEQ ID NO: 7815766 - DNA, 22 bp, Homo sapiens
cagagggcttcaggttcaggat

SEQ ID NO: 7815767 - DNA, 22 bp, Homo sapiens
cagagggcttcaggttcaggat

SEQ ID NO: 7815768 - DNA, 22 bp, Homo sapiens
cagagggcttcaggttcaggat

SEQ ID NO: 7815769 - DNA, 22 bp, Homo sapiens
cagagggctgtgtaaggatgtt

SEQ ID NO: 7815770 - DNA, 22 bp, Homo sapiens
cagagggctgtgtaaggatgtt

SEQ ID NO: 7815771 - DNA, 22 bp, Homo sapiens
cagagggctgtgtaaggatgtt

SEQ ID NO: 7815772 - DNA, 22 bp, Homo sapiens
cagagggctgtgtaaggatgtt

SEQ ID NO: 7815773 - DNA, 22 bp, Homo sapiens
cagagggctgtgtaaggatgtt

SEQ ID NO: 7815774 - DNA, 22 bp, Homo sapiens
cagagggctgccctgagttcgt

SEQ ID NO: 7815775 - DNA, 22 bp, Homo sapiens
cagagggctcttggctgcctgc

SEQ ID NO: 7815776 - DNA, 22 bp, Homo sapiens
cagagggctcttggctgcctgc

SEQ ID NO: 7815777 - DNA, 22 bp, Homo sapiens
cagagggctcttggctgcctgc

SEQ ID NO: 7815778 - DNA, 22 bp, Homo sapiens
cagagggctcttggctgcctgc

SEQ ID NO: 7815779 - DNA, 22 bp, Homo sapiens
cagagggctcttggctgcctgc

SEQ ID NO: 7815780 - DNA, 22 bp, Homo sapiens
cagagggtcaccaggaagtgca

SEQ ID NO: 7815781 - DNA, 22 bp, Homo sapiens
cagagggtcaccaggaagtgca

SEQ ID NO: 7815782 - DNA, 22 bp, Homo sapiens
cagagggtggaggccaggctct

SEQ ID NO: 7815783 - DNA, 22 bp, Homo sapiens
cagaggggtgtagagatcactg

SEQ ID NO: 7815784 - DNA, 22 bp, Homo sapiens
cagaggggtgtagagatcactg

SEQ ID NO: 7815785 - DNA, 22 bp, Homo sapiens
cagaggggtgtagagatcactg

SEQ ID NO: 7815786 - DNA, 23 bp, Homo sapiens
cagagggttccatggagcatggt

SEQ ID NO: 7815787 - DNA, 23 bp, Homo sapiens
cagagggttccatggagcatggt

SEQ ID NO: 7815788 - DNA, 23 bp, Homo sapiens
cagagggttccatggagcatggt

SEQ ID NO: 7815789 - DNA, 23 bp, Homo sapiens
cagagggttccatggagcatggt

SEQ ID NO: 7815790 - DNA, 22 bp, Homo sapiens
cagagggtgtgaaggggatgaa

SEQ ID NO: 7815791 - DNA, 22 bp, Homo sapiens
cagagggtgtgaaggggatgaa

SEQ ID NO: 7815792 - DNA, 22 bp, Homo sapiens
cagagggtgtgaaggggatgaa

SEQ ID NO: 7815793 - DNA, 21 bp, Homo sapiens
cagagggcttttctctgttct

SEQ ID NO: 7815794 - DNA, 21 bp, Homo sapiens
cagagggcttttctctgttct

SEQ ID NO: 7815795 - DNA, 21 bp, Homo sapiens
cagagggcttttctctgttct

SEQ ID NO: 7815796 - DNA, 22 bp, Homo sapiens
cagaggggataacaggtgtaga

SEQ ID NO: 7815797 - DNA, 22 bp, Homo sapiens
cagaggggataacaggtgtaga

SEQ ID NO: 7815798 - DNA, 21 bp, Homo sapiens
cagaggggctagcctggctgc

SEQ ID NO: 7815799 - DNA, 21 bp, Homo sapiens
cagaggggctagcctggctgc

SEQ ID NO: 7815800 - DNA, 22 bp, Homo sapiens
cagaggggctgacacccttggc

SEQ ID NO: 7815801 - DNA, 22 bp, Homo sapiens
cagcaagatggtgaatgagacg

SEQ ID NO: 7815802 - DNA, 22 bp, Homo sapiens
cagcaagatggtgaatgagacg

SEQ ID NO: 7815803 - DNA, 22 bp, Homo sapiens
cagcaagattaagggcagaaaa

SEQ ID NO: 7815804 - DNA, 22 bp, Homo sapiens
cagcaagattaagggcagaaaa

SEQ ID NO: 7815805 - DNA, 22 bp, Homo sapiens
cagcaagatttttaaagcaagg

SEQ ID NO: 7815806 - DNA, 22 bp, Homo sapiens
cagcaagatttttaaagcaagg

SEQ ID NO: 7815807 - DNA, 22 bp, Homo sapiens
cagcaagattaagggcagaaaa

SEQ ID NO: 7815808 - DNA, 21 bp, Homo sapiens
cagcaaggaagtcgagtaggt

SEQ ID NO: 7815809 - DNA, 22 bp, Homo sapiens
cagcaagccaaatgtggcccga

SEQ ID NO: 7815810 - DNA, 21 bp, Homo sapiens
cagcaaggaagtcgagtaggt

SEQ ID NO: 7815811 - DNA, 21 bp, Homo sapiens
cagcaaggaagtcgagtaggt

SEQ ID NO: 7815812 - DNA, 21 bp, Homo sapiens
cagcaaggaagtcgagtaggt

SEQ ID NO: 7815813 - DNA, 22 bp, Homo sapiens
cagcaagatttttaaagcaagg

SEQ ID NO: 7815814 - DNA, 22 bp, Homo sapiens
cagcaagccaaatgtggcccga

SEQ ID NO: 7815815 - DNA, 22 bp, Homo sapiens
cagcaagacagtttcctaagtg

SEQ ID NO: 7815816 - DNA, 22 bp, Homo sapiens
cagcaagagactgttctctaag

SEQ ID NO: 7815817 - DNA, 22 bp, Homo sapiens
cagcaagagaggcagggcaaat

SEQ ID NO: 7815818 - DNA, 22 bp, Homo sapiens
cagcaagagactgttctctaag

SEQ ID NO: 7815819 - DNA, 22 bp, Homo sapiens
cagcaagagactgttctctaag

SEQ ID NO: 7815820 - DNA, 22 bp, Homo sapiens
cagcaagacttcagggcttggt

SEQ ID NO: 7815821 - DNA, 22 bp, Homo sapiens
cagcaagacttcagggcttggt

SEQ ID NO: 7815822 - DNA, 22 bp, Homo sapiens
cagcaagagactgttctctaag

SEQ ID NO: 7815823 - DNA, 22 bp, Homo sapiens
cagcaagagttggggttgttgg

SEQ ID NO: 7815824 - DNA, 22 bp, Homo sapiens
cagcaagagttggggttgttgg

SEQ ID NO: 7815825 - DNA, 22 bp, Homo sapiens
cagcaagagaggcagggcaaat

SEQ ID NO: 7815826 - DNA, 22 bp, Homo sapiens
cagcaagagggtaaggttgaag

SEQ ID NO: 7815827 - DNA, 22 bp, Homo sapiens
ggtgacggggcccaggtttcct

SEQ ID NO: 7815828 - DNA, 22 bp, Homo sapiens
ggtgacggggcccaggtttcct

SEQ ID NO: 7815829 - DNA, 22 bp, Homo sapiens
ggtgacgaatccatagcatcga

SEQ ID NO: 7815830 - DNA, 22 bp, Homo sapiens
ggtgactcccagctgctctctt

SEQ ID NO: 7815831 - DNA, 22 bp, Homo sapiens
ggtgagactttagaagagccag

SEQ ID NO: 7815832 - DNA, 22 bp, Homo sapiens
ggtgagagaaaagaaacactgt

SEQ ID NO: 7815833 - DNA, 22 bp, Homo sapiens
ggtgagactttagaagagccag

SEQ ID NO: 7815834 - DNA, 22 bp, Homo sapiens
cagcaaagtaagctgacatgta

SEQ ID NO: 7815835 - DNA, 17 bp, Homo sapiens
ggtgagacctcccactc

SEQ ID NO: 7815836 - DNA, 17 bp, Homo sapiens
ggtgagacctcccactc

SEQ ID NO: 7815837 - DNA, 22 bp, Homo sapiens
cagcaagacaaggaacaaactg

SEQ ID NO: 7815838 - DNA, 22 bp, Homo sapiens
cagcaaagtaagctgacatgta

SEQ ID NO: 7815839 - DNA, 22 bp, Homo sapiens
cagcaaagtaagctgacatgta

SEQ ID NO: 7815840 - DNA, 22 bp, Homo sapiens
cagcaaagtaagctgacatgta

SEQ ID NO: 7815841 - DNA, 22 bp, Homo sapiens
cagcaaagtaagctgacatgta

SEQ ID NO: 7815842 - DNA, 21 bp, Homo sapiens
cagcaagacatgtttatcaag

SEQ ID NO: 7815843 - DNA, 21 bp, Homo sapiens
cagcaagacatgtttatcaag

SEQ ID NO: 7815844 - DNA, 22 bp, Homo sapiens
cagcaagacagtttcctaagtg

SEQ ID NO: 7815845 - DNA, 22 bp, Homo sapiens
cagcaagacagtttcctaagtg

SEQ ID NO: 7815846 - DNA, 21 bp, Homo sapiens
cagcaagacatgtttatcaag

SEQ ID NO: 7815847 - DNA, 22 bp, Homo sapiens
cagcaagacagtttcctaagtg

SEQ ID NO: 7815848 - DNA, 22 bp, Homo sapiens
cagcaagacagtttcctaagtg

SEQ ID NO: 7815849 - DNA, 22 bp, Homo sapiens
cagcaagacaggattcccgtgg

SEQ ID NO: 7815850 - DNA, 22 bp, Homo sapiens
cagcaagacaggattcccgtgg

SEQ ID NO: 7815851 - DNA, 22 bp, Homo sapiens
ggtctggaataaggtccaggaa

SEQ ID NO: 7815852 - DNA, 22 bp, Homo sapiens
ggtgacagtggttaaaatttgt

SEQ ID NO: 7815853 - DNA, 22 bp, Homo sapiens
ggtgacagtggttaaaatttgt

SEQ ID NO: 7815854 - DNA, 22 bp, Homo sapiens
ggtgacagtggttaaaatttgt

SEQ ID NO: 7815855 - DNA, 22 bp, Homo sapiens
ggtgacagtggttaaaatttgt

SEQ ID NO: 7815856 - DNA, 22 bp, Homo sapiens
ggtgacagttccggaggtacag

SEQ ID NO: 7815857 - DNA, 22 bp, Homo sapiens
ggtgacctcacctggtcccacc

SEQ ID NO: 7815858 - DNA, 22 bp, Homo sapiens
ggtgacctcacctggtcccacc

SEQ ID NO: 7815859 - DNA, 22 bp, Homo sapiens
ggtgacctcacctggtcccacc

SEQ ID NO: 7815860 - DNA, 22 bp, Homo sapiens
ggtgaccagggtcagtagcttt

SEQ ID NO: 7815861 - DNA, 19 bp, Homo sapiens
ggtgaccacctggtcagtg

SEQ ID NO: 7815862 - DNA, 19 bp, Homo sapiens
ggtgaccacctggtcagtg

SEQ ID NO: 7815863 - DNA, 22 bp, Homo sapiens
ggtgacatgcacctatcccttg

SEQ ID NO: 7815864 - DNA, 22 bp, Homo sapiens
ggtgacatctagagacatccaa

SEQ ID NO: 7815865 - DNA, 22 bp, Homo sapiens
ggtgacagtggttaaaatttgt

SEQ ID NO: 7815866 - DNA, 22 bp, Homo sapiens
ggtctgctttccttgccactgt

SEQ ID NO: 7815867 - DNA, 22 bp, Homo sapiens
ggtctgccctgggtggaggcgc

SEQ ID NO: 7815868 - DNA, 21 bp, Homo sapiens
ggtctgctgtgtctagcctca

SEQ ID NO: 7815869 - DNA, 22 bp, Homo sapiens
ggtctgcccactactctccatt

SEQ ID NO: 7815870 - DNA, 22 bp, Homo sapiens
ggtctgagtgccagggagagaa

SEQ ID NO: 7815871 - DNA, 22 bp, Homo sapiens
ggtctgagtgccagggagagaa

SEQ ID NO: 7815872 - DNA, 22 bp, Homo sapiens
ggtctgagtgccagggagagaa

SEQ ID NO: 7815873 - DNA, 22 bp, Homo sapiens
ggtctgagtggggcctgagatt

SEQ ID NO: 7815874 - DNA, 22 bp, Homo sapiens
ggtctgagatatttgttcagct

SEQ ID NO: 7815875 - DNA, 18 bp, Homo sapiens
ggtctgagatcgtttttc

SEQ ID NO: 7815876 - DNA, 22 bp, Homo sapiens
ggtctgaggctccaaggaggtg

SEQ ID NO: 7815877 - DNA, 22 bp, Homo sapiens
ggtctgagcttgagcccatgct

SEQ ID NO: 7815878 - DNA, 22 bp, Homo sapiens
ggtctgagcttgagcccatgct

SEQ ID NO: 7815879 - DNA, 22 bp, Homo sapiens
ggtctgagtagagggctggcga

SEQ ID NO: 7815880 - DNA, 22 bp, Homo sapiens
ggtctgagtagagggctggcga

SEQ ID NO: 7815881 - DNA, 22 bp, Homo sapiens
ggtctgaggtgggacccaggaa

SEQ ID NO: 7815882 - DNA, 22 bp, Homo sapiens
ggtctgaggctccaaggaggtg

SEQ ID NO: 7815883 - DNA, 22 bp, Homo sapiens
ggtctgaggctccaaggaggtg

SEQ ID NO: 7815884 - DNA, 22 bp, Homo sapiens
ggtctgaggtgggacccaggaa

SEQ ID NO: 7815885 - DNA, 22 bp, Homo sapiens
cagcacagtttgcttggcagag

SEQ ID NO: 7815886 - DNA, 22 bp, Homo sapiens
cagcacagtttgcttggcagag

SEQ ID NO: 7815887 - DNA, 22 bp, Homo sapiens
cagcacataagccgaagactgt

SEQ ID NO: 7815888 - DNA, 22 bp, Homo sapiens
cagcacataagccgaagactgt

SEQ ID NO: 7815889 - DNA, 22 bp, Homo sapiens
cagcacataatcagtgattgtg

SEQ ID NO: 7815890 - DNA, 22 bp, Homo sapiens
cagcacatctccaagaatttct

SEQ ID NO: 7815891 - DNA, 22 bp, Homo sapiens
cagcacatctgattatatgact

SEQ ID NO: 7815892 - DNA, 22 bp, Homo sapiens
cagcacatagcatgcttgtcag

SEQ ID NO: 7815893 - DNA, 22 bp, Homo sapiens
cagcaccaggcagacctggagc

SEQ ID NO: 7815894 - DNA, 22 bp, Homo sapiens
cagcaccagcatattccagggc

SEQ ID NO: 7815895 - DNA, 22 bp, Homo sapiens
cagcacatttactcagccctca

SEQ ID NO: 7815896 - DNA, 22 bp, Homo sapiens
cagcaccattttcctggtcagc

SEQ ID NO: 7815897 - DNA, 22 bp, Homo sapiens
cagcaccatttgcagcctcttt

SEQ ID NO: 7815898 - DNA, 22 bp, Homo sapiens
cagcaccatttgcagcctcttt

SEQ ID NO: 7815899 - DNA, 22 bp, Homo sapiens
cagcacatcttctgatcttttg

SEQ ID NO: 7815900 - DNA, 22 bp, Homo sapiens
cagcacatcttctgatcttttg

SEQ ID NO: 7815901 - DNA, 22 bp, Homo sapiens
cagcacatgctcatcagggaag

SEQ ID NO: 7815902 - DNA, 19 bp, Homo sapiens
cagcacatgcttctctgag

SEQ ID NO: 7815903 - DNA, 22 bp, Homo sapiens
cagcacatgctcatcagggaag

SEQ ID NO: 7815904 - DNA, 19 bp, Homo sapiens
cagcacatgcttctctgag

SEQ ID NO: 7815905 - DNA, 19 bp, Homo sapiens
cagcacatgcttctctgag

SEQ ID NO: 7815906 - DNA, 22 bp, Homo sapiens
cagcacatttactcagccctca

SEQ ID NO: 7815907 - DNA, 22 bp, Homo sapiens
cagcacatttactcagccctca

SEQ ID NO: 7815908 - DNA, 22 bp, Homo sapiens
cagcacagtttcccccatgagc

SEQ ID NO: 7815909 - DNA, 22 bp, Homo sapiens
cagcacagtttcccccatgagc

SEQ ID NO: 7815910 - DNA, 22 bp, Homo sapiens
cagcacagtttcccccatgagc

SEQ ID NO: 7815911 - DNA, 22 bp, Homo sapiens
cagcacagtttctggcccgccg

SEQ ID NO: 7815912 - DNA, 22 bp, Homo sapiens
cagcacagtttctggcccgccg

SEQ ID NO: 7815913 - DNA, 22 bp, Homo sapiens
cagcacagtttctggcccgccg

SEQ ID NO: 7815914 - DNA, 22 bp, Homo sapiens
cagcacagtttgcttggcagag

SEQ ID NO: 7815915 - DNA, 22 bp, Homo sapiens
cagcacagtttctggcccgccg

SEQ ID NO: 7815916 - DNA, 22 bp, Homo sapiens
cagcacagtttgcttggcagag

SEQ ID NO: 7815917 - DNA, 22 bp, Homo sapiens
cagcacagtttgcttggcagag

SEQ ID NO: 7815918 - DNA, 22 bp, Homo sapiens
cagcacagtgcagatgctgact

SEQ ID NO: 7815919 - DNA, 22 bp, Homo sapiens
cagcacagtgcagatgctgact

SEQ ID NO: 7815920 - DNA, 22 bp, Homo sapiens
cagcacagtgcagatgctgact

SEQ ID NO: 7815921 - DNA, 22 bp, Homo sapiens
cagcacagtttcccccatgagc

SEQ ID NO: 7815922 - DNA, 22 bp, Homo sapiens
cagcacagtgttaggtaatttg

SEQ ID NO: 7815923 - DNA, 22 bp, Homo sapiens
cagcacagtttcccccatgagc

SEQ ID NO: 7815924 - DNA, 22 bp, Homo sapiens
cagcacagtttcccccatgagc

SEQ ID NO: 7815925 - DNA, 22 bp, Homo sapiens
cagcacagtgttaggtaatttg

SEQ ID NO: 7815926 - DNA, 22 bp, Homo sapiens
cagcacagtttcccccatgagc

SEQ ID NO: 7815927 - DNA, 22 bp, Homo sapiens
cagcacagtgcagatgctgact

SEQ ID NO: 7815928 - DNA, 22 bp, Homo sapiens
cagcacagtgcagatgctgact

SEQ ID NO: 7815929 - DNA, 22 bp, Homo sapiens
cagcacagtgaccagacccact

SEQ ID NO: 7815930 - DNA, 22 bp, Homo sapiens
cagcacagtgaccagacccact

SEQ ID NO: 7815931 - DNA, 22 bp, Homo sapiens
cagcacagtgaccagacccact

SEQ ID NO: 7815932 - DNA, 22 bp, Homo sapiens
cagcacagtgaccagacccact

SEQ ID NO: 7815933 - DNA, 22 bp, Homo sapiens
cagcacagtgaccagacccact

SEQ ID NO: 7815934 - DNA, 22 bp, Homo sapiens
cagcacagtgaccagacccact

SEQ ID NO: 7815935 - DNA, 22 bp, Homo sapiens
cagcacagtgaccagacccact

SEQ ID NO: 7815936 - DNA, 22 bp, Homo sapiens
cagcacagtagagtagttgtaa

SEQ ID NO: 7815937 - DNA, 22 bp, Homo sapiens
cagcacagtagagtagttgtaa

SEQ ID NO: 7815938 - DNA, 22 bp, Homo sapiens
ggtgctgacattcagagtctgg

SEQ ID NO: 7815939 - DNA, 22 bp, Homo sapiens
ggtgctgacattcagagtctgg

SEQ ID NO: 7815940 - DNA, 22 bp, Homo sapiens
ggtgctgacattcagagtctgg

SEQ ID NO: 7815941 - DNA, 22 bp, Homo sapiens
ggtgctgaattctggaggaggc

SEQ ID NO: 7815942 - DNA, 22 bp, Homo sapiens
ggtgctgaataaatactagtta

SEQ ID NO: 7815943 - DNA, 19 bp, Homo sapiens
ggtgctgacatcatgcttt

SEQ ID NO: 7815944 - DNA, 19 bp, Homo sapiens
ggtgctgacatcatgcttt

SEQ ID NO: 7815945 - DNA, 22 bp, Homo sapiens
ggtgctgaattctggaggaggc

SEQ ID NO: 7815946 - DNA, 22 bp, Homo sapiens
cagcaaggactgggcatgtgaa

SEQ ID NO: 7815947 - DNA, 22 bp, Homo sapiens
cagcaaggactgggcatgtgaa

SEQ ID NO: 7815948 - DNA, 22 bp, Homo sapiens
cagcaaggactgggcatgtgaa

SEQ ID NO: 7815949 - DNA, 21 bp, Homo sapiens
cagcaaggaagtcgagtaggt

SEQ ID NO: 7815950 - DNA, 22 bp, Homo sapiens
cagcaaggactgggcatgtgaa

SEQ ID NO: 7815951 - DNA, 22 bp, Homo sapiens
cagcaaggactgggcatgtgaa

SEQ ID NO: 7815952 - DNA, 22 bp, Homo sapiens
ggtgctgaaggactataacggt

SEQ ID NO: 7815953 - DNA, 20 bp, Homo sapiens
ggtgctgataagaaagaagt

SEQ ID NO: 7815954 - DNA, 22 bp, Homo sapiens
ggtgctgagtgagctagaggct

SEQ ID NO: 7815955 - DNA, 22 bp, Homo sapiens
ggtgctgagtgagctagaggct

SEQ ID NO: 7815956 - DNA, 22 bp, Homo sapiens
ggtgctgaggccttggcaggga

SEQ ID NO: 7815957 - DNA, 22 bp, Homo sapiens
ggtgctgatattgttttggtga

SEQ ID NO: 7815958 - DNA, 22 bp, Homo sapiens
ggtgctgatagtaacaataata

SEQ ID NO: 7815959 - DNA, 22 bp, Homo sapiens
ggtgctgatattgttttggtga

SEQ ID NO: 7815960 - DNA, 22 bp, Homo sapiens
ggtgctgatctaaatttaggac

SEQ ID NO: 7815961 - DNA, 22 bp, Homo sapiens
ggtgctgatgaagatgtagcct

SEQ ID NO: 7815962 - DNA, 22 bp, Homo sapiens
ggtgctgagagcctaggagggc

SEQ ID NO: 7815963 - DNA, 22 bp, Homo sapiens
ggtgctgagagcctaggagggc

SEQ ID NO: 7815964 - DNA, 22 bp, Homo sapiens
ggtgctgacttcacagtcttac

SEQ ID NO: 7815965 - DNA, 22 bp, Homo sapiens
ggtgctgactgaggatggcttg

SEQ ID NO: 7815966 - DNA, 22 bp, Homo sapiens
ggtgctgactgaggatggcttg

SEQ ID NO: 7815967 - DNA, 22 bp, Homo sapiens
ggtgctgactgaggatggcttg

SEQ ID NO: 7815968 - DNA, 22 bp, Homo sapiens
ggtgctgactgaggatggcttg

SEQ ID NO: 7815969 - DNA, 22 bp, Homo sapiens
ggtgctgactgaggatggcttg

SEQ ID NO: 7815970 - DNA, 22 bp, Homo sapiens
ggtgctgactctgtcgtgagca

SEQ ID NO: 7815971 - DNA, 23 bp, Homo sapiens
cagcacagtacatttcctgtctc

SEQ ID NO: 7815972 - DNA, 23 bp, Homo sapiens
cagcacagtacatttcctgtctc

SEQ ID NO: 7815973 - DNA, 23 bp, Homo sapiens
cagcacagtacatttcctgtctc

SEQ ID NO: 7815974 - DNA, 21 bp, Homo sapiens
cagcacagtactgggtcttgc

SEQ ID NO: 7815975 - DNA, 23 bp, Homo sapiens
cagcacagtacatttcctgtctc

SEQ ID NO: 7815976 - DNA, 21 bp, Homo sapiens
cagcacagtactgggtcttgc

SEQ ID NO: 7815977 - DNA, 22 bp, Homo sapiens
cagcacacagtgactcgcacct

SEQ ID NO: 7815978 - DNA, 22 bp, Homo sapiens
cagcacacagtgactcgcacct

SEQ ID NO: 7815979 - DNA, 22 bp, Homo sapiens
cagcacagtacaaggcacggat

SEQ ID NO: 7815980 - DNA, 22 bp, Homo sapiens
cagcacagtacaaggcacggat

SEQ ID NO: 7815981 - DNA, 22 bp, Homo sapiens
ggtgctggttcagggtggctgt

SEQ ID NO: 7815982 - DNA, 22 bp, Homo sapiens
cagcacaattttcaggagtcca

SEQ ID NO: 7815983 - DNA, 22 bp, Homo sapiens
cagcacaattttcaggagtcca

SEQ ID NO: 7815984 - DNA, 22 bp, Homo sapiens
cagcacaattttcaggagtcca

SEQ ID NO: 7815985 - DNA, 22 bp, Homo sapiens
ggtgctgggaacgaggaattca

SEQ ID NO: 7815986 - DNA, 22 bp, Homo sapiens
ggtgctgggaacgaggaattca

SEQ ID NO: 7815987 - DNA, 22 bp, Homo sapiens
ggtgctggacacgtggcactcc

SEQ ID NO: 7815988 - DNA, 22 bp, Homo sapiens
ggtgctgggaacgaggaattca

SEQ ID NO: 7815989 - DNA, 22 bp, Homo sapiens
ggtgctggacacgtggcactcc

SEQ ID NO: 7815990 - DNA, 22 bp, Homo sapiens
ggtgctggacacgtggcactcc

SEQ ID NO: 7815991 - DNA, 22 bp, Homo sapiens
ggtgctggacacgtggcactcc

SEQ ID NO: 7815992 - DNA, 22 bp, Homo sapiens
ggtgctgatttgttgctgagat

SEQ ID NO: 7815993 - DNA, 22 bp, Homo sapiens
ggtgctgatttgttgctgagat

SEQ ID NO: 7815994 - DNA, 22 bp, Homo sapiens
ggtgctgatgaagatgtagcct

SEQ ID NO: 7815995 - DNA, 22 bp, Homo sapiens
ggtgctgatgagttaggagagg

SEQ ID NO: 7815996 - DNA, 22 bp, Homo sapiens
ggtgctgatgagttaggagagg

SEQ ID NO: 7815997 - DNA, 22 bp, Homo sapiens
ggtgctgatgttattgatgctg

SEQ ID NO: 7815998 - DNA, 22 bp, Homo sapiens
ggtgctgattcactgacttctg

SEQ ID NO: 7815999 - DNA, 22 bp, Homo sapiens
ggtgctgattcactgacttctg

SEQ ID NO: 7816000 - DNA, 22 bp, Homo sapiens
ggtgctgattaagaactgtata

SEQ ID NO: 7816001 - DNA, 22 bp, Homo sapiens
ggtgctgatgttattgatgctg

SEQ ID NO: 7816002 - DNA, 22 bp, Homo sapiens
ggtgctgattaagaactgtata

SEQ ID NO: 7816003 - DNA, 22 bp, Homo sapiens
ctctgcgccaccctcgcctgct

SEQ ID NO: 7816004 - DNA, 22 bp, Homo sapiens
ctctgctaagcatgaacaatta

SEQ ID NO: 7816005 - DNA, 22 bp, Homo sapiens
ctctgcgtggctgggcccaggg

SEQ ID NO: 7816006 - DNA, 22 bp, Homo sapiens
ctctgctagggctgaggtgttc

SEQ ID NO: 7816007 - DNA, 22 bp, Homo sapiens
ctctgctcagatgatttatcaa

SEQ ID NO: 7816008 - DNA, 22 bp, Homo sapiens
ctctgctcaccagccatgtgat

SEQ ID NO: 7816009 - DNA, 22 bp, Homo sapiens
ctctgctgagccagagtcccca

SEQ ID NO: 7816010 - DNA, 21 bp, Homo sapiens
ctctgctgagctccattttca

SEQ ID NO: 7816011 - DNA, 22 bp, Homo sapiens
ctctgctgatatagcttttcaa

SEQ ID NO: 7816012 - DNA, 21 bp, Homo sapiens
ctctgctgagtcctaggattc

SEQ ID NO: 7816013 - DNA, 21 bp, Homo sapiens
ctctgctgagtcctaggattc

SEQ ID NO: 7816014 - DNA, 21 bp, Homo sapiens
ctctgctgagtcctaggattc

SEQ ID NO: 7816015 - DNA, 22 bp, Homo sapiens
ctctgctgatctcagctgggct

SEQ ID NO: 7816016 - DNA, 22 bp, Homo sapiens
ctctgctgatctcagctgggct

SEQ ID NO: 7816017 - DNA, 22 bp, Homo sapiens
ctctgctgatctcagctgggct

SEQ ID NO: 7816018 - DNA, 22 bp, Homo sapiens
ctctgctgatctcagctgggct

SEQ ID NO: 7816019 - DNA, 22 bp, Homo sapiens
ctctggattgctgtgagatgct

SEQ ID NO: 7816020 - DNA, 22 bp, Homo sapiens
ctctggatggttctgcacattc

SEQ ID NO: 7816021 - DNA, 22 bp, Homo sapiens
ctctggattgctgtgagatgct

SEQ ID NO: 7816022 - DNA, 20 bp, Homo sapiens
ctctggcaaaggatgcctat

SEQ ID NO: 7816023 - DNA, 22 bp, Homo sapiens
ctctggatctgccctgacgcca

SEQ ID NO: 7816024 - DNA, 22 bp, Homo sapiens
ctctggatctgccctgacgcca

SEQ ID NO: 7816025 - DNA, 23 bp, Homo sapiens
ctctggatcctgtagctcctggc

SEQ ID NO: 7816026 - DNA, 23 bp, Homo sapiens
ctctggatcctgtagctcctggc

SEQ ID NO: 7816027 - DNA, 23 bp, Homo sapiens
ctctggatcctgtagctcctggc

SEQ ID NO: 7816028 - DNA, 22 bp, Homo sapiens
ctctgcatgccacatgagtgac

SEQ ID NO: 7816029 - DNA, 22 bp, Homo sapiens
ctctgcatgccacatgagtgac

SEQ ID NO: 7816030 - DNA, 22 bp, Homo sapiens
ctctgcatgccttgctcagaca

SEQ ID NO: 7816031 - DNA, 22 bp, Homo sapiens
ctctgcatgccttgctcagaca

SEQ ID NO: 7816032 - DNA, 22 bp, Homo sapiens
ctctgcatcagcttcattctgt

SEQ ID NO: 7816033 - DNA, 22 bp, Homo sapiens
ctctgcagtgtaacagcgcttg

SEQ ID NO: 7816034 - DNA, 22 bp, Homo sapiens
ctctgcattttaacagatgatt

SEQ ID NO: 7816035 - DNA, 22 bp, Homo sapiens
ctctgcctgccactgttcaggc

SEQ ID NO: 7816036 - DNA, 22 bp, Homo sapiens
ctctgcctgccactgttcaggc

SEQ ID NO: 7816037 - DNA, 22 bp, Homo sapiens
ctctgcctgccactgttcaggc

SEQ ID NO: 7816038 - DNA, 22 bp, Homo sapiens
ctctgcattttaacagatgatt

SEQ ID NO: 7816039 - DNA, 22 bp, Homo sapiens
ctctgcattttaacagatgatt

SEQ ID NO: 7816040 - DNA, 22 bp, Homo sapiens
ctctgcatgccttgctcagaca

SEQ ID NO: 7816041 - DNA, 22 bp, Homo sapiens
ctctgccaagatgacaggtaag

SEQ ID NO: 7816042 - DNA, 22 bp, Homo sapiens
ctctgcctgcccaccgacccat

SEQ ID NO: 7816043 - DNA, 22 bp, Homo sapiens
ctctgcctgcccaccgacccat

SEQ ID NO: 7816044 - DNA, 22 bp, Homo sapiens
ctctgcctgcccaccgacccat

SEQ ID NO: 7816045 - DNA, 22 bp, Homo sapiens
ctctgcctgtgtcgccaccaca

SEQ ID NO: 7816046 - DNA, 22 bp, Homo sapiens
ctctgcctgtgtcgccaccaca

SEQ ID NO: 7816047 - DNA, 22 bp, Homo sapiens
ctctgcctgtgtcgccaccaca

SEQ ID NO: 7816048 - DNA, 22 bp, Homo sapiens
ctctgcctgtgtcgccaccaca

SEQ ID NO: 7816049 - DNA, 22 bp, Homo sapiens
ctctgcctgtgtcgccaccaca

SEQ ID NO: 7816050 - DNA, 22 bp, Homo sapiens
ctctgcctgtctcatcctgcaa

SEQ ID NO: 7816051 - DNA, 22 bp, Homo sapiens
ctctccaagttatcaagatgaa

SEQ ID NO: 7816052 - DNA, 22 bp, Homo sapiens
ctctgagcccgctgcagcccca

SEQ ID NO: 7816053 - DNA, 22 bp, Homo sapiens
ctctgagctccaaaagtcagca

SEQ ID NO: 7816054 - DNA, 22 bp, Homo sapiens
ctctgagcccgctgcagcccca

SEQ ID NO: 7816055 - DNA, 22 bp, Homo sapiens
ctctcagtgcctgccctaggct

SEQ ID NO: 7816056 - DNA, 22 bp, Homo sapiens
ctctcagtgcctgccctaggct

SEQ ID NO: 7816057 - DNA, 22 bp, Homo sapiens
ctctcagtgccacacagccatt

SEQ ID NO: 7816058 - DNA, 22 bp, Homo sapiens
ctctcagtttcctcaactgtaa

SEQ ID NO: 7816059 - DNA, 22 bp, Homo sapiens
ctctcatgagcattcctaaggg

SEQ ID NO: 7816060 - DNA, 22 bp, Homo sapiens
ctctcagtttcctcaactgtaa

SEQ ID NO: 7816061 - DNA, 22 bp, Homo sapiens
ctctcatagtgagtgtggtcca

SEQ ID NO: 7816062 - DNA, 22 bp, Homo sapiens
ctctcagggacccagccagcct

SEQ ID NO: 7816063 - DNA, 22 bp, Homo sapiens
ctctcagggacccagccagcct

SEQ ID NO: 7816064 - DNA, 22 bp, Homo sapiens
ctctcagggacccagccagcct

SEQ ID NO: 7816065 - DNA, 22 bp, Homo sapiens
ctctcaggcttgggtcgtggca

SEQ ID NO: 7816066 - DNA, 22 bp, Homo sapiens
ctctcaggcttgggtcgtggca

SEQ ID NO: 7816067 - DNA, 22 bp, Homo sapiens
ctctcaggcttgggtcgtggca

SEQ ID NO: 7816068 - DNA, 19 bp, Homo sapiens
ctctcagcctgtctccttg

SEQ ID NO: 7816069 - DNA, 19 bp, Homo sapiens
ctctcagcctgtctccttg

SEQ ID NO: 7816070 - DNA, 22 bp, Homo sapiens
ctctcagcaggaaagcatgcaa

SEQ ID NO: 7816071 - DNA, 19 bp, Homo sapiens
ctctcagcctgtctccttg

SEQ ID NO: 7816072 - DNA, 19 bp, Homo sapiens
ctctcagcctgtctccttg

SEQ ID NO: 7816073 - DNA, 22 bp, Homo sapiens
ctctcagggcaggtggcctttc

SEQ ID NO: 7816074 - DNA, 22 bp, Homo sapiens
ctctcagggtccctgcggagga

SEQ ID NO: 7816075 - DNA, 22 bp, Homo sapiens
ctctcagggtccctgcggagga

SEQ ID NO: 7816076 - DNA, 22 bp, Homo sapiens
ctctcagtgccacacagccatt

SEQ ID NO: 7816077 - DNA, 22 bp, Homo sapiens
ctctcagtcctgcgcgcctctg

SEQ ID NO: 7816078 - DNA, 22 bp, Homo sapiens
ctctcagtcctgcgcgcctctg

SEQ ID NO: 7816079 - DNA, 22 bp, Homo sapiens
ctctcagtaaatttctgcccca

SEQ ID NO: 7816080 - DNA, 22 bp, Homo sapiens
ctctcagggtccctgcggagga

SEQ ID NO: 7816081 - DNA, 22 bp, Homo sapiens
ctctgcaggcacccagggtggg

SEQ ID NO: 7816082 - DNA, 22 bp, Homo sapiens
ctctgcaggcctgtgaagggtg

SEQ ID NO: 7816083 - DNA, 22 bp, Homo sapiens
ctctgcaggcctgtgaagggtg

SEQ ID NO: 7816084 - DNA, 22 bp, Homo sapiens
ctctgcaggcacccagggtggg

SEQ ID NO: 7816085 - DNA, 22 bp, Homo sapiens
ctctgcaggcacccagggtggg

SEQ ID NO: 7816086 - DNA, 22 bp, Homo sapiens
ctctgcaggcacccagggtggg

SEQ ID NO: 7816087 - DNA, 21 bp, Homo sapiens
ctctgcagccctgcttccagg

SEQ ID NO: 7816088 - DNA, 23 bp, Homo sapiens
ctctgcaggagagtgggcagggc

SEQ ID NO: 7816089 - DNA, 23 bp, Homo sapiens
ctctgcaggagagtgggcagggc

SEQ ID NO: 7816090 - DNA, 17 bp, Homo sapiens
ctctgcagtgcatggct

SEQ ID NO: 7816091 - DNA, 17 bp, Homo sapiens
ctctgcagtgcatggct

SEQ ID NO: 7816092 - DNA, 21 bp, Homo sapiens
ctctgcagtgcccaccttgcc

SEQ ID NO: 7816093 - DNA, 22 bp, Homo sapiens
ctctgcagtgtaacagcgcttg

SEQ ID NO: 7816094 - DNA, 17 bp, Homo sapiens
ctctgcagtgcatggct

SEQ ID NO: 7816095 - DNA, 17 bp, Homo sapiens
ctctgcagtgcatggct

SEQ ID NO: 7816096 - DNA, 22 bp, Homo sapiens
ctctgcaggccttgagtgtggt

SEQ ID NO: 7816097 - DNA, 22 bp, Homo sapiens
ctctgcaggccttgagtgtggt

SEQ ID NO: 7816098 - DNA, 22 bp, Homo sapiens
ctctggctttaaggatgccaca

SEQ ID NO: 7816099 - DNA, 22 bp, Homo sapiens
ctctggctttaaggatgccaca

SEQ ID NO: 7816100 - DNA, 22 bp, Homo sapiens
ctctggcttgttaatgcatatt

SEQ ID NO: 7816101 - DNA, 22 bp, Homo sapiens
ctctggcttgttaatgcatatt

SEQ ID NO: 7816102 - DNA, 22 bp, Homo sapiens
ctctggcttgttaatgcatatt

SEQ ID NO: 7816103 - DNA, 22 bp, Homo sapiens
ctctggctttgctcatgcatcc

SEQ ID NO: 7816104 - DNA, 22 bp, Homo sapiens
ctctggctttgctcatgcatcc

SEQ ID NO: 7816105 - DNA, 22 bp, Homo sapiens
ctctggctttgctcatgcatcc

SEQ ID NO: 7816106 - DNA, 22 bp, Homo sapiens
ctctggctttgctcatgcatcc

SEQ ID NO: 7816107 - DNA, 22 bp, Homo sapiens
ctctggctttcccagggaggag

SEQ ID NO: 7816108 - DNA, 22 bp, Homo sapiens
ctctggctttgctcatgcatcc

SEQ ID NO: 7816109 - DNA, 22 bp, Homo sapiens
ctctgggaaagattgtgcaggc

SEQ ID NO: 7816110 - DNA, 22 bp, Homo sapiens
ctctgggaaagattgtgcaggc

SEQ ID NO: 7816111 - DNA, 22 bp, Homo sapiens
ctctgggaagggctgagcactg

SEQ ID NO: 7816112 - DNA, 22 bp, Homo sapiens
ctctgggaaagattgtgcaggc

SEQ ID NO: 7816113 - DNA, 22 bp, Homo sapiens
ctctgggaagggctgagcactg

SEQ ID NO: 7816114 - DNA, 22 bp, Homo sapiens
ctctgggaagggctgagcactg

SEQ ID NO: 7816115 - DNA, 22 bp, Homo sapiens
ctctgggaagggctgagcactg

SEQ ID NO: 7816116 - DNA, 22 bp, Homo sapiens
ctctgggaattctgagcaagca

SEQ ID NO: 7816117 - DNA, 22 bp, Homo sapiens
ctctgggaattctgagcaagca

SEQ ID NO: 7816118 - DNA, 22 bp, Homo sapiens
ctctgggaccatggcaagtgcg

SEQ ID NO: 7816119 - DNA, 18 bp, Homo sapiens
ctctgggagaggcataca

SEQ ID NO: 7816120 - DNA, 22 bp, Homo sapiens
ctctgggaccacgtgactctgc

SEQ ID NO: 7816121 - DNA, 21 bp, Homo sapiens
ctctgggacatttcttagcag

SEQ ID NO: 7816122 - DNA, 22 bp, Homo sapiens
ctctgggaattctgagcaagca

SEQ ID NO: 7816123 - DNA, 22 bp, Homo sapiens
ctctgggacatcccttggccta

SEQ ID NO: 7816124 - DNA, 22 bp, Homo sapiens
ctctgggcttcctttgtgggtt

SEQ ID NO: 7816125 - DNA, 22 bp, Homo sapiens
ctctgggcttcaagtcagattt

SEQ ID NO: 7816126 - DNA, 22 bp, Homo sapiens
ctctgggcttcaagtcagattt

SEQ ID NO: 7816127 - DNA, 22 bp, Homo sapiens
ctctgggcttgttgacctgcac

SEQ ID NO: 7816128 - DNA, 22 bp, Homo sapiens
ctctgggcttcctttgtgggtt

SEQ ID NO: 7816129 - DNA, 22 bp, Homo sapiens
ctctgggcttgttgacctgcac

SEQ ID NO: 7816130 - DNA, 22 bp, Homo sapiens
ctctgggcttgttgacctgcac

SEQ ID NO: 7816131 - DNA, 22 bp, Homo sapiens
ctctgggcttgttgacctgcac

SEQ ID NO: 7816132 - DNA, 22 bp, Homo sapiens
ctctgggctgccttttagctct

SEQ ID NO: 7816133 - DNA, 19 bp, Homo sapiens
ctctgggctgcatcttggt

SEQ ID NO: 7816134 - DNA, 22 bp, Homo sapiens
ctctgggcttacctgcttcctg

SEQ ID NO: 7816135 - DNA, 22 bp, Homo sapiens
ctctgggcttacctgcttcctg

SEQ ID NO: 7816136 - DNA, 20 bp, Homo sapiens
ctctgggctgcgttgcaaac

SEQ ID NO: 7816137 - DNA, 22 bp, Homo sapiens
ctgaaataaagttgctaaaatt

SEQ ID NO: 7816138 - DNA, 23 bp, Homo sapiens
ctgaaataccagaaaatcagtgt

SEQ ID NO: 7816139 - DNA, 23 bp, Homo sapiens
ctgaaataccagaaaatcagtgt

SEQ ID NO: 7816140 - DNA, 23 bp, Homo sapiens
ctgaaataccagaaaatcagtgt

SEQ ID NO: 7816141 - DNA, 22 bp, Homo sapiens
ctgaaataaagttgctaaaatt

SEQ ID NO: 7816142 - DNA, 22 bp, Homo sapiens
ctctttggttaatcacacagat

SEQ ID NO: 7816143 - DNA, 22 bp, Homo sapiens
ctctttggttaatcacacagat

SEQ ID NO: 7816144 - DNA, 22 bp, Homo sapiens
ctgaaagggagaacaccaagag

SEQ ID NO: 7816145 - DNA, 22 bp, Homo sapiens
ctgaaatatagatgtgaacagt

SEQ ID NO: 7816146 - DNA, 22 bp, Homo sapiens
ctgaaatatagatgtgaacagt

SEQ ID NO: 7816147 - DNA, 23 bp, Homo sapiens
ctgaaataccagaaaatcagtgt

SEQ ID NO: 7816148 - DNA, 22 bp, Homo sapiens
ctgaaatagtttcatagaactt

SEQ ID NO: 7816149 - DNA, 17 bp, Homo sapiens
ctgaaatattatgataa

SEQ ID NO: 7816150 - DNA, 22 bp, Homo sapiens
ctgaaatgggcaaaagtagatt

SEQ ID NO: 7816151 - DNA, 22 bp, Homo sapiens
ctgaaatcaattttgattatct

SEQ ID NO: 7816152 - DNA, 22 bp, Homo sapiens
ctgaaatattttaatctcagga

SEQ ID NO: 7816153 - DNA, 17 bp, Homo sapiens
ctgaaatattatgataa

SEQ ID NO: 7816154 - DNA, 17 bp, Homo sapiens
ctgaaatattatgataa

SEQ ID NO: 7816155 - DNA, 17 bp, Homo sapiens
ctgaaatattatgataa

SEQ ID NO: 7816156 - DNA, 22 bp, Homo sapiens
ctctggggaagcagccagctgg

SEQ ID NO: 7816157 - DNA, 22 bp, Homo sapiens
ctctggggaagcagccagctgg

SEQ ID NO: 7816158 - DNA, 22 bp, Homo sapiens
ctctgggcttgttgacctgcac

SEQ ID NO: 7816159 - DNA, 22 bp, Homo sapiens
ctctgggcttgttgacctgcac

SEQ ID NO: 7816160 - DNA, 17 bp, Homo sapiens
ctctggggacagttcta

SEQ ID NO: 7816161 - DNA, 22 bp, Homo sapiens
ctctggggtgcttcgacacttc

SEQ ID NO: 7816162 - DNA, 22 bp, Homo sapiens
ctctggggaagcagccagctgg

SEQ ID NO: 7816163 - DNA, 22 bp, Homo sapiens
ctctggggaagcagccagctgg

SEQ ID NO: 7816164 - DNA, 22 bp, Homo sapiens
ctctggggaagcagccagctgg

SEQ ID NO: 7816165 - DNA, 22 bp, Homo sapiens
ctctggggaagcagccagctgg

SEQ ID NO: 7816166 - DNA, 17 bp, Homo sapiens
ctctggggacagttcta

SEQ ID NO: 7816167 - DNA, 22 bp, Homo sapiens
ctctggggtggaggaggctgac

SEQ ID NO: 7816168 - DNA, 22 bp, Homo sapiens
ctctggggtggaggaggctgac

SEQ ID NO: 7816169 - DNA, 22 bp, Homo sapiens
ctctggggtggaggaggctgac

SEQ ID NO: 7816170 - DNA, 22 bp, Homo sapiens
ctctggggtggaggaggctgac

SEQ ID NO: 7816171 - DNA, 22 bp, Homo sapiens
ctctggggtgcttcgacacttc

SEQ ID NO: 7816172 - DNA, 22 bp, Homo sapiens
ctctttggtgcaccttgcagtc

SEQ ID NO: 7816173 - DNA, 22 bp, Homo sapiens
ctctggggttaagcttccatgg

SEQ ID NO: 7816174 - DNA, 22 bp, Homo sapiens
ctctggggttaagcttccatgg

SEQ ID NO: 7816175 - DNA, 22 bp, Homo sapiens
agttaagagtgtgaaaatgtta

SEQ ID NO: 7816176 - DNA, 22 bp, Homo sapiens
agttaagagtgtgaaaatgtta

SEQ ID NO: 7816177 - DNA, 22 bp, Homo sapiens
agttaagagtgtgaaaatgtta

SEQ ID NO: 7816178 - DNA, 22 bp, Homo sapiens
ctgagaaagatttgcctccgtg

SEQ ID NO: 7816179 - DNA, 22 bp, Homo sapiens
ctgagaaaggacctcaaacagg

SEQ ID NO: 7816180 - DNA, 22 bp, Homo sapiens
ctgagaaaggacctcaaacagg

SEQ ID NO: 7816181 - DNA, 22 bp, Homo sapiens
ctgagaaaccaggtgctctgat

SEQ ID NO: 7816182 - DNA, 22 bp, Homo sapiens
ctgagaaaccaggtgctctgat

SEQ ID NO: 7816183 - DNA, 22 bp, Homo sapiens
ctgagaaaccaggtgctctgat

SEQ ID NO: 7816184 - DNA, 22 bp, Homo sapiens
ctgagaaacatatttccatcta

SEQ ID NO: 7816185 - DNA, 22 bp, Homo sapiens
ctgagaaacatatttccatcta

SEQ ID NO: 7816186 - DNA, 22 bp, Homo sapiens
ctgagaaacaatgaattgtgat

SEQ ID NO: 7816187 - DNA, 22 bp, Homo sapiens
ctgagaaaatttcaggaagtgt

SEQ ID NO: 7816188 - DNA, 22 bp, Homo sapiens
ctgagaaacaatgaattgtgat

SEQ ID NO: 7816189 - DNA, 22 bp, Homo sapiens
agttactcactgagggtttatt

SEQ ID NO: 7816190 - DNA, 22 bp, Homo sapiens
agttactcaaggctgatataag

SEQ ID NO: 7816191 - DNA, 22 bp, Homo sapiens
agttactttctgatcagtgtgt

SEQ ID NO: 7816192 - DNA, 22 bp, Homo sapiens
agttacttgagacgtttatgaa

SEQ ID NO: 7816193 - DNA, 22 bp, Homo sapiens
agttaaggagagttggaatcag

SEQ ID NO: 7816194 - DNA, 22 bp, Homo sapiens
agttagaagtgtgtcatctgtg

SEQ ID NO: 7816195 - DNA, 22 bp, Homo sapiens
agttagaatagtcagattgtag

SEQ ID NO: 7816196 - DNA, 22 bp, Homo sapiens
agttagaatagtcagattgtag

SEQ ID NO: 7816197 - DNA, 18 bp, Homo sapiens
agttagaaatgaaggcca

SEQ ID NO: 7816198 - DNA, 22 bp, Homo sapiens
agttagaaagtaaatcatttga

SEQ ID NO: 7816199 - DNA, 22 bp, Homo sapiens
agttagaaagtaaatcatttga

SEQ ID NO: 7816200 - DNA, 22 bp, Homo sapiens
agttagaaagtaaatcatttga

SEQ ID NO: 7816201 - DNA, 23 bp, Homo sapiens
agttaggtcaagttaggtcaatt

SEQ ID NO: 7816202 - DNA, 22 bp, Homo sapiens
agttagtacaagaaagatgaac

SEQ ID NO: 7816203 - DNA, 22 bp, Homo sapiens
agttagtacaagaaagatgaac

SEQ ID NO: 7816204 - DNA, 22 bp, Homo sapiens
agttagcgatgtaaaataacaa

SEQ ID NO: 7816205 - DNA, 22 bp, Homo sapiens
agttagcatctcctccagtcta

SEQ ID NO: 7816206 - DNA, 22 bp, Homo sapiens
agttagcagcttattagaaaca

SEQ ID NO: 7816207 - DNA, 20 bp, Homo sapiens
agttagcaggtgctggtgtc

SEQ ID NO: 7816208 - DNA, 22 bp, Homo sapiens
agttagaatataattatgttaa

SEQ ID NO: 7816209 - DNA, 22 bp, Homo sapiens
agttagaatataattatgttaa

SEQ ID NO: 7816210 - DNA, 22 bp, Homo sapiens
agttagaatataattatgttaa

SEQ ID NO: 7816211 - DNA, 22 bp, Homo sapiens
agttagaatggatgttgagagc

SEQ ID NO: 7816212 - DNA, 22 bp, Homo sapiens
agttagaatggatgttgagagc

SEQ ID NO: 7816213 - DNA, 22 bp, Homo sapiens
agttagagacacatgcacatgc

SEQ ID NO: 7816214 - DNA, 22 bp, Homo sapiens
agttagagacacatgcacatgc

SEQ ID NO: 7816215 - DNA, 22 bp, Homo sapiens
agttagcagcttattagaaaca

SEQ ID NO: 7816216 - DNA, 21 bp, Homo sapiens
agttagcagatttctgtctcc

SEQ ID NO: 7816217 - DNA, 22 bp, Homo sapiens
agttagcaaataccacaatctg

SEQ ID NO: 7816218 - DNA, 22 bp, Homo sapiens
agttataatctgctactgatat

SEQ ID NO: 7816219 - DNA, 22 bp, Homo sapiens
agttataatctgctactgatat

SEQ ID NO: 7816220 - DNA, 22 bp, Homo sapiens
agttataaaaggagcactgatt

SEQ ID NO: 7816221 - DNA, 22 bp, Homo sapiens
agttataaaaggagcactgatt

SEQ ID NO: 7816222 - DNA, 20 bp, Homo sapiens
agttagtgagtaattgagct

SEQ ID NO: 7816223 - DNA, 22 bp, Homo sapiens
agttagtatacaaagtaacagc

SEQ ID NO: 7816224 - DNA, 22 bp, Homo sapiens
agttagtatgcattaccctcca

SEQ ID NO: 7816225 - DNA, 22 bp, Homo sapiens
agttataatctgctactgatat

SEQ ID NO: 7816226 - DNA, 22 bp, Homo sapiens
agttataccttatacacatatg

SEQ ID NO: 7816227 - DNA, 22 bp, Homo sapiens
agttatataactatctagatgc

SEQ ID NO: 7816228 - DNA, 22 bp, Homo sapiens
agttatataactatctagatgc

SEQ ID NO: 7816229 - DNA, 22 bp, Homo sapiens
agttatataactatctagatgc

SEQ ID NO: 7816230 - DNA, 22 bp, Homo sapiens
ctgaggagaggtggcctgtgtt

SEQ ID NO: 7816231 - DNA, 22 bp, Homo sapiens
ctgaggagaggtggcctgtgtt

SEQ ID NO: 7816232 - DNA, 22 bp, Homo sapiens
ctgaggagaggtggcctgtgtt

SEQ ID NO: 7816233 - DNA, 22 bp, Homo sapiens
ctgaggagaggtggcctgtgtt

SEQ ID NO: 7816234 - DNA, 22 bp, Homo sapiens
ctgaggagaccatcaactaatt

SEQ ID NO: 7816235 - DNA, 22 bp, Homo sapiens
ctgaggagagatcacgtggtgt

SEQ ID NO: 7816236 - DNA, 17 bp, Homo sapiens
ctgaggagaacagaaag

SEQ ID NO: 7816237 - DNA, 22 bp, Homo sapiens
ctgaggagaacaatgagatcaa

SEQ ID NO: 7816238 - DNA, 22 bp, Homo sapiens
ctgagctgggactcagtagcaa

SEQ ID NO: 7816239 - DNA, 22 bp, Homo sapiens
ctgagcagcagggagactggtg

SEQ ID NO: 7816240 - DNA, 22 bp, Homo sapiens
ctgagcagcagggagactggtg

SEQ ID NO: 7816241 - DNA, 22 bp, Homo sapiens
ctgagcagcagggagactggtg

SEQ ID NO: 7816242 - DNA, 22 bp, Homo sapiens
ctgagcagccccaccagccatt

SEQ ID NO: 7816243 - DNA, 22 bp, Homo sapiens
ctgagctgggactcagtagcaa

SEQ ID NO: 7816244 - DNA, 22 bp, Homo sapiens
ctgagctgggactcagtagcaa

SEQ ID NO: 7816245 - DNA, 22 bp, Homo sapiens
ctgagctgggactcagtagcaa

SEQ ID NO: 7816246 - DNA, 22 bp, Homo sapiens
ctgagcagcacagggcgccagg

SEQ ID NO: 7816247 - DNA, 22 bp, Homo sapiens
ctgagcagcaccttcaagaaac

SEQ ID NO: 7816248 - DNA, 22 bp, Homo sapiens
ctgagcagcaccttcaagaaac

SEQ ID NO: 7816249 - DNA, 22 bp, Homo sapiens
ctgagcagcaccttcaagaaac

SEQ ID NO: 7816250 - DNA, 22 bp, Homo sapiens
ctgagcagcaccttcaagaaac

SEQ ID NO: 7816251 - DNA, 22 bp, Homo sapiens
ctgagcagcagggagactggtg

SEQ ID NO: 7816252 - DNA, 22 bp, Homo sapiens
ctgagcagcaccttcaagaaac

SEQ ID NO: 7816253 - DNA, 22 bp, Homo sapiens
ctgagcagcaattgctggccca

SEQ ID NO: 7816254 - DNA, 22 bp, Homo sapiens
ctgagcagcaattgctggccca

SEQ ID NO: 7816255 - DNA, 22 bp, Homo sapiens
ctgagcagcaacccagagcctc

SEQ ID NO: 7816256 - DNA, 22 bp, Homo sapiens
ctgagcagcaattgctggccca

SEQ ID NO: 7816257 - DNA, 22 bp, Homo sapiens
ctgagcagcaattgctggccca

SEQ ID NO: 7816258 - DNA, 22 bp, Homo sapiens
ctgagcagcacagggcgccagg

SEQ ID NO: 7816259 - DNA, 22 bp, Homo sapiens
ctgagcagcacagggcgccagg

SEQ ID NO: 7816260 - DNA, 22 bp, Homo sapiens
ctgagcagatgttgcccagaag

SEQ ID NO: 7816261 - DNA, 22 bp, Homo sapiens
ctgagcagatgttgcccagaag

SEQ ID NO: 7816262 - DNA, 22 bp, Homo sapiens
ctgagcagcaacccagagcctc

SEQ ID NO: 7816263 - DNA, 22 bp, Homo sapiens
ctgagcagcaacccagagcctc

SEQ ID NO: 7816264 - DNA, 22 bp, Homo sapiens
ctgagcagcaacccagagcctc

SEQ ID NO: 7816265 - DNA, 22 bp, Homo sapiens
ctgagcagcaacccagagcctc

SEQ ID NO: 7816266 - DNA, 22 bp, Homo sapiens
ctgagcagcaacccagagcctc

SEQ ID NO: 7816267 - DNA, 22 bp, Homo sapiens
ctgagcagcaacccagagcctc

SEQ ID NO: 7816268 - DNA, 19 bp, Homo sapiens
ctgagcagagggaggaact

SEQ ID NO: 7816269 - DNA, 19 bp, Homo sapiens
ctgagcagagggaggaact

SEQ ID NO: 7816270 - DNA, 19 bp, Homo sapiens
ctgagcagagggaggaact

SEQ ID NO: 7816271 - DNA, 22 bp, Homo sapiens
ctgagcagaggtcaagatactt

SEQ ID NO: 7816272 - DNA, 22 bp, Homo sapiens
ctgagcagaggtcaagatactt

SEQ ID NO: 7816273 - DNA, 22 bp, Homo sapiens
ctgagcagatgaccagccccag

SEQ ID NO: 7816274 - DNA, 22 bp, Homo sapiens
agtgtctgctttgagtcaggtg

SEQ ID NO: 7816275 - DNA, 22 bp, Homo sapiens
agtgtctgctttgagtcaggtg

SEQ ID NO: 7816276 - DNA, 22 bp, Homo sapiens
agtgtctgctttgagtcaggtg

SEQ ID NO: 7816277 - DNA, 22 bp, Homo sapiens
agtgtctgctttgagtcaggtg

SEQ ID NO: 7816278 - DNA, 22 bp, Homo sapiens
agtgtctgctttgagtcaggtg

SEQ ID NO: 7816279 - DNA, 22 bp, Homo sapiens
agtgtctgctttgagtcaggtg

SEQ ID NO: 7816280 - DNA, 20 bp, Homo sapiens
agtgtctggattttgtaacc

SEQ ID NO: 7816281 - DNA, 20 bp, Homo sapiens
agtgtctgggcctcaggccc

SEQ ID NO: 7816282 - DNA, 20 bp, Homo sapiens
agtgtctggattttgtaacc

SEQ ID NO: 7816283 - DNA, 18 bp, Homo sapiens
agtgtctggatatttggg

SEQ ID NO: 7816284 - DNA, 18 bp, Homo sapiens
agtgtctggatatttggg

SEQ ID NO: 7816285 - DNA, 22 bp, Homo sapiens
agtgtctggaggcattcttggt

SEQ ID NO: 7816286 - DNA, 22 bp, Homo sapiens
ctgaatgaggaaaagagtgagg

SEQ ID NO: 7816287 - DNA, 22 bp, Homo sapiens
ctgaatgaatggtttgtcttat

SEQ ID NO: 7816288 - DNA, 22 bp, Homo sapiens
ctgaatgaaatcaaggactgag

SEQ ID NO: 7816289 - DNA, 22 bp, Homo sapiens
ctgaatccattcatgcaagata

SEQ ID NO: 7816290 - DNA, 22 bp, Homo sapiens
ctgaatccattcatgcaagata

SEQ ID NO: 7816291 - DNA, 22 bp, Homo sapiens
ctgaatgagggattctgagggc

SEQ ID NO: 7816292 - DNA, 22 bp, Homo sapiens
ctgaatgagggattctgagggc

SEQ ID NO: 7816293 - DNA, 22 bp, Homo sapiens
ctgaaggaagcaggtggcctgt

SEQ ID NO: 7816294 - DNA, 22 bp, Homo sapiens
ctgaaggaagcaggtggcctgt

SEQ ID NO: 7816295 - DNA, 20 bp, Homo sapiens
agtgtctgggcctcaggccc

SEQ ID NO: 7816296 - DNA, 22 bp, Homo sapiens
ctgaagctttacttcaaataca

SEQ ID NO: 7816297 - DNA, 22 bp, Homo sapiens
ctgaagctttacttcaaataca

SEQ ID NO: 7816298 - DNA, 22 bp, Homo sapiens
agtgtctgcctgggaggagcat

SEQ ID NO: 7816299 - DNA, 22 bp, Homo sapiens
agtgtctgcctgggaggagcat

SEQ ID NO: 7816300 - DNA, 22 bp, Homo sapiens
ctgaaattctgcctctgcacaa

SEQ ID NO: 7816301 - DNA, 22 bp, Homo sapiens
agtgtctgcctgggaggagcat

SEQ ID NO: 7816302 - DNA, 22 bp, Homo sapiens
agtgtctgcctgggaggagcat

SEQ ID NO: 7816303 - DNA, 22 bp, Homo sapiens
ctgaaattccatttcagccaca

SEQ ID NO: 7816304 - DNA, 23 bp, Homo sapiens
ctgaaattcagatgctaaagata

SEQ ID NO: 7816305 - DNA, 23 bp, Homo sapiens
ctgaaattcagatgctaaagata

SEQ ID NO: 7816306 - DNA, 22 bp, Homo sapiens
ctgaaattattgtttaatcaaa

SEQ ID NO: 7816307 - DNA, 22 bp, Homo sapiens
ctgaaattattgtttaatcaaa

SEQ ID NO: 7816308 - DNA, 22 bp, Homo sapiens
ctgaaattactggccctggagc

SEQ ID NO: 7816309 - DNA, 22 bp, Homo sapiens
ctgaaatggttgcctggagaat

SEQ ID NO: 7816310 - DNA, 22 bp, Homo sapiens
agtgtctgcctgggaggagcat

SEQ ID NO: 7816311 - DNA, 22 bp, Homo sapiens
agtgtctgcggcggggaggcgg

SEQ ID NO: 7816312 - DNA, 22 bp, Homo sapiens
agtgtctgcgggcagaggagcg

SEQ ID NO: 7816313 - DNA, 22 bp, Homo sapiens
agtgtctgcgggcagaggagcg

SEQ ID NO: 7816314 - DNA, 22 bp, Homo sapiens
agtgtctgctaggttcatcaac

SEQ ID NO: 7816315 - DNA, 22 bp, Homo sapiens
agtgtctgcgggcagaggagcg

SEQ ID NO: 7816316 - DNA, 22 bp, Homo sapiens
agtgtctgcgggcagaggagcg

SEQ ID NO: 7816317 - DNA, 22 bp, Homo sapiens
agtgtctgcggcggggaggcgg

SEQ ID NO: 7816318 - DNA, 22 bp, Homo sapiens
agtgtctgctcagacagctaca

SEQ ID NO: 7816319 - DNA, 22 bp, Homo sapiens
agtgtctgctcagacagctaca

SEQ ID NO: 7816320 - DNA, 22 bp, Homo sapiens
agtgtctgcttatcagttcttg

SEQ ID NO: 7816321 - DNA, 22 bp, Homo sapiens
agtgtctgcttatcagttcttg

SEQ ID NO: 7816322 - DNA, 22 bp, Homo sapiens
agtgtctgcttatcagttcttg

SEQ ID NO: 7816323 - DNA, 22 bp, Homo sapiens
agtgtctgctcagacagctaca

SEQ ID NO: 7816324 - DNA, 22 bp, Homo sapiens
agtgtctgcgggcagaggagcg

SEQ ID NO: 7816325 - DNA, 22 bp, Homo sapiens
ctgaattatttaaggtgaaggg

SEQ ID NO: 7816326 - DNA, 22 bp, Homo sapiens
ctgacaaaccactgctccagct

SEQ ID NO: 7816327 - DNA, 18 bp, Homo sapiens
ctgaattatctcatcatt

SEQ ID NO: 7816328 - DNA, 22 bp, Homo sapiens
ctgacaaaccactgctccagct

SEQ ID NO: 7816329 - DNA, 22 bp, Homo sapiens
ctgacaaaccactgctccagct

SEQ ID NO: 7816330 - DNA, 22 bp, Homo sapiens
ctgacaaacttaattttctgaa

SEQ ID NO: 7816331 - DNA, 22 bp, Homo sapiens
ctgacacactgagcatttgata

SEQ ID NO: 7816332 - DNA, 22 bp, Homo sapiens
ctgacaaacttaattttctgaa

SEQ ID NO: 7816333 - DNA, 22 bp, Homo sapiens
ctgacaaaggcaaggcaggggg

SEQ ID NO: 7816334 - DNA, 20 bp, Homo sapiens
ctgacagaaaatatttcatc

SEQ ID NO: 7816335 - DNA, 22 bp, Homo sapiens
ctgacaaaggcaaggcaggggg

SEQ ID NO: 7816336 - DNA, 22 bp, Homo sapiens
ctgacaaaggcaaggcaggggg

SEQ ID NO: 7816337 - DNA, 22 bp, Homo sapiens
ctgacaaaggcaaggcaggggg

SEQ ID NO: 7816338 - DNA, 22 bp, Homo sapiens
ctgaattaagcattacatacat

SEQ ID NO: 7816339 - DNA, 22 bp, Homo sapiens
ctgaatgatataagatctttct

SEQ ID NO: 7816340 - DNA, 22 bp, Homo sapiens
ctgaatgcctgcagagccagag

SEQ ID NO: 7816341 - DNA, 22 bp, Homo sapiens
ctgaatgcctgcagagccagag

SEQ ID NO: 7816342 - DNA, 22 bp, Homo sapiens
ctgaattacttattagtgggga

SEQ ID NO: 7816343 - DNA, 22 bp, Homo sapiens
ctgaattactgaaggtcaactt

SEQ ID NO: 7816344 - DNA, 22 bp, Homo sapiens
ctgaattaagcattacatacat

SEQ ID NO: 7816345 - DNA, 22 bp, Homo sapiens
ctgaattaatacacagaatggc

SEQ ID NO: 7816346 - DNA, 22 bp, Homo sapiens
ctgaattaatacacagaatggc

SEQ ID NO: 7816347 - DNA, 22 bp, Homo sapiens
ctgaattaatacacagaatggc

SEQ ID NO: 7816348 - DNA, 18 bp, Homo sapiens
ctgaattatctcatcatt

SEQ ID NO: 7816349 - DNA, 22 bp, Homo sapiens
ctgaattagatgaaaaaggctc

SEQ ID NO: 7816350 - DNA, 22 bp, Homo sapiens
ctgaattaatacacagaatggc

SEQ ID NO: 7816351 - DNA, 22 bp, Homo sapiens
ctgaattagatgaaaaaggctc

SEQ ID NO: 7816352 - DNA, 18 bp, Homo sapiens
ctgaattatctcatcatt

SEQ ID NO: 7816353 - DNA, 21 bp, Homo sapiens
ctgaattatgtgcttaccttt

SEQ ID NO: 7816354 - DNA, 22 bp, Homo sapiens
ctgacttttttcagccacagtg

SEQ ID NO: 7816355 - DNA, 22 bp, Homo sapiens
ctgacttttccaaataatactt

SEQ ID NO: 7816356 - DNA, 22 bp, Homo sapiens
ctgactttgctcataggtcaaa

SEQ ID NO: 7816357 - DNA, 22 bp, Homo sapiens
ctgactttgacttggtcattga

SEQ ID NO: 7816358 - DNA, 22 bp, Homo sapiens
ctgacttttccaaataatactt

SEQ ID NO: 7816359 - DNA, 22 bp, Homo sapiens
ctgactttgctcataggtcaaa

SEQ ID NO: 7816360 - DNA, 22 bp, Homo sapiens
ctgactttagaacccaaaaagt

SEQ ID NO: 7816361 - DNA, 22 bp, Homo sapiens
ctgactttagaacccaaaaagt

SEQ ID NO: 7816362 - DNA, 20 bp, Homo sapiens
ctgacagaaaatatttcatc

SEQ ID NO: 7816363 - DNA, 22 bp, Homo sapiens
ctgagaaaagacatttctagat

SEQ ID NO: 7816364 - DNA, 22 bp, Homo sapiens
ctgacttttttcagccacagtg

SEQ ID NO: 7816365 - DNA, 22 bp, Homo sapiens
ctgagaaaagacatttctagat

SEQ ID NO: 7816366 - DNA, 22 bp, Homo sapiens
ctgagaaaagctttcttataca

SEQ ID NO: 7816367 - DNA, 22 bp, Homo sapiens
ctgagaaaagctttcttataca

SEQ ID NO: 7816368 - DNA, 22 bp, Homo sapiens
ctgagaaaagctttcttataca

SEQ ID NO: 7816369 - DNA, 22 bp, Homo sapiens
ctgagaaaagtatgagctctgg

SEQ ID NO: 7816370 - DNA, 22 bp, Homo sapiens
ctgagaaaagtatgagctctgg

SEQ ID NO: 7816371 - DNA, 22 bp, Homo sapiens
ctgagaaaatttcaggaagtgt

SEQ ID NO: 7816372 - DNA, 22 bp, Homo sapiens
ctgagaaaatttcaggaagtgt

SEQ ID NO: 7816373 - DNA, 22 bp, Homo sapiens
ctgagaaaagtatgagctctgg

SEQ ID NO: 7816374 - DNA, 22 bp, Homo sapiens
ctgagaaaatttcaggaagtgt

SEQ ID NO: 7816375 - DNA, 22 bp, Homo sapiens
agtcctgatgctctggcaggag

SEQ ID NO: 7816376 - DNA, 22 bp, Homo sapiens
agtcctgatgctctggcaggag

SEQ ID NO: 7816377 - DNA, 22 bp, Homo sapiens
agtcctgatgctctggcaggag

SEQ ID NO: 7816378 - DNA, 22 bp, Homo sapiens
agtcctgcatccagttacatct

SEQ ID NO: 7816379 - DNA, 22 bp, Homo sapiens
agtcctggacttggagtcaggg

SEQ ID NO: 7816380 - DNA, 22 bp, Homo sapiens
agtcctggacttggagtcaggg

SEQ ID NO: 7816381 - DNA, 22 bp, Homo sapiens
agtcctggacttggagtcaggg

SEQ ID NO: 7816382 - DNA, 22 bp, Homo sapiens
agtcctggacttggagtcaggg

SEQ ID NO: 7816383 - DNA, 22 bp, Homo sapiens
agtcctggacttggagtcaggg

SEQ ID NO: 7816384 - DNA, 22 bp, Homo sapiens
agtcctcccttggggccacctt

SEQ ID NO: 7816385 - DNA, 22 bp, Homo sapiens
agtcctaatgccttggaattca

SEQ ID NO: 7816386 - DNA, 22 bp, Homo sapiens
agtcctagacttttctgccact

SEQ ID NO: 7816387 - DNA, 22 bp, Homo sapiens
agtcctagccctggatccatca

SEQ ID NO: 7816388 - DNA, 22 bp, Homo sapiens
agtcctggcatataggtcctca

SEQ ID NO: 7816389 - DNA, 22 bp, Homo sapiens
agtcctggcatataggtcctca

SEQ ID NO: 7816390 - DNA, 22 bp, Homo sapiens
agtcctggcatataggtcctca

SEQ ID NO: 7816391 - DNA, 18 bp, Homo sapiens
agtcctggagatcaccaa

SEQ ID NO: 7816392 - DNA, 22 bp, Homo sapiens
agtcctggcatataggtcctca

SEQ ID NO: 7816393 - DNA, 22 bp, Homo sapiens
agtcctggacttggagtcaggg

SEQ ID NO: 7816394 - DNA, 22 bp, Homo sapiens
agtcctggacttggagtcaggg

SEQ ID NO: 7816395 - DNA, 18 bp, Homo sapiens
agtcctggagatcaccaa

SEQ ID NO: 7816396 - DNA, 22 bp, Homo sapiens
agtcctggacttggagtcaggg

SEQ ID NO: 7816397 - DNA, 18 bp, Homo sapiens
agtcctggagatcaccaa

SEQ ID NO: 7816398 - DNA, 22 bp, Homo sapiens
agtcctggcatataggtcctca

SEQ ID NO: 7816399 - DNA, 22 bp, Homo sapiens
agtcctggcatataggtcctca

SEQ ID NO: 7816400 - DNA, 22 bp, Homo sapiens
agtcctggcatggaattgtccc

SEQ ID NO: 7816401 - DNA, 22 bp, Homo sapiens
agtcctggccccaaggaaggat

SEQ ID NO: 7816402 - DNA, 22 bp, Homo sapiens
agtcctggcatggaattgtccc

SEQ ID NO: 7816403 - DNA, 22 bp, Homo sapiens
agtcctggccccaaggaaggat

SEQ ID NO: 7816404 - DNA, 22 bp, Homo sapiens
agtcctggccccaaggaaggat

SEQ ID NO: 7816405 - DNA, 22 bp, Homo sapiens
agtccgtttcatgccacacttg

SEQ ID NO: 7816406 - DNA, 22 bp, Homo sapiens
agtccggggtctggacacctgg

SEQ ID NO: 7816407 - DNA, 21 bp, Homo sapiens
agtccgctgagatcggagctt

SEQ ID NO: 7816408 - DNA, 22 bp, Homo sapiens
agtccgcctgctgccgtggcag

SEQ ID NO: 7816409 - DNA, 20 bp, Homo sapiens
agtccctttggtcaggtatt

SEQ ID NO: 7816410 - DNA, 20 bp, Homo sapiens
agtccctttggtcaggtatt

SEQ ID NO: 7816411 - DNA, 22 bp, Homo sapiens
agtcccttgagggagtactgtt

SEQ ID NO: 7816412 - DNA, 22 bp, Homo sapiens
agtccctttagtctggagagct

SEQ ID NO: 7816413 - DNA, 22 bp, Homo sapiens
agtcccttctcaaagtgtgcgg

SEQ ID NO: 7816414 - DNA, 22 bp, Homo sapiens
agtccctgtactttccactgcc

SEQ ID NO: 7816415 - DNA, 22 bp, Homo sapiens
agtccctgtactttccactgcc

SEQ ID NO: 7816416 - DNA, 22 bp, Homo sapiens
agtcccttctcaaagtgtgcgg

SEQ ID NO: 7816417 - DNA, 22 bp, Homo sapiens
agtccctgtactttccactgcc

SEQ ID NO: 7816418 - DNA, 22 bp, Homo sapiens
agtccctggattgtctctgtca

SEQ ID NO: 7816419 - DNA, 22 bp, Homo sapiens
agtccctggattgtctctgtca

SEQ ID NO: 7816420 - DNA, 22 bp, Homo sapiens
agtccctggattgtctctgtca

SEQ ID NO: 7816421 - DNA, 22 bp, Homo sapiens
agtccctgtactttccactgcc

SEQ ID NO: 7816422 - DNA, 21 bp, Homo sapiens
agtcccctgtccttacttcta

SEQ ID NO: 7816423 - DNA, 22 bp, Homo sapiens
agtcccctctcgcttggctgag

SEQ ID NO: 7816424 - DNA, 22 bp, Homo sapiens
agtcccctctaacccaacttta

SEQ ID NO: 7816425 - DNA, 22 bp, Homo sapiens
agtcccctggcaggagggacgt

SEQ ID NO: 7816426 - DNA, 23 bp, Homo sapiens
agtcccctacatagttcctgggg

SEQ ID NO: 7816427 - DNA, 23 bp, Homo sapiens
agtcccctacatagttcctgggg

SEQ ID NO: 7816428 - DNA, 22 bp, Homo sapiens
agtccccctctgagcccaggga

SEQ ID NO: 7816429 - DNA, 22 bp, Homo sapiens
ctcattctttcacagtctgtgg

SEQ ID NO: 7816430 - DNA, 22 bp, Homo sapiens
ctcattgattcagtgctgctct

SEQ ID NO: 7816431 - DNA, 22 bp, Homo sapiens
ctcattcattcccgcagccacc

SEQ ID NO: 7816432 - DNA, 22 bp, Homo sapiens
ctcattgcaacctccgcctccc

SEQ ID NO: 7816433 - DNA, 22 bp, Homo sapiens
ctcattgcaacctccgcctccc

SEQ ID NO: 7816434 - DNA, 22 bp, Homo sapiens
ctcattgcaacctccgcctccc

SEQ ID NO: 7816435 - DNA, 22 bp, Homo sapiens
ctcattgcccagatccccacag

SEQ ID NO: 7816436 - DNA, 22 bp, Homo sapiens
ctcattgcagctgcattactgt

SEQ ID NO: 7816437 - DNA, 22 bp, Homo sapiens
ctcattgcaacctccgcctccc

SEQ ID NO: 7816438 - DNA, 22 bp, Homo sapiens
ctcattgcagctgcattactgt

SEQ ID NO: 7816439 - DNA, 22 bp, Homo sapiens
ctcatggcagagtcacctgtcc

SEQ ID NO: 7816440 - DNA, 22 bp, Homo sapiens
ctcatggatataagaactgttt

SEQ ID NO: 7816441 - DNA, 22 bp, Homo sapiens
ctcatgtcaggggtgtcaatgt

SEQ ID NO: 7816442 - DNA, 22 bp, Homo sapiens
ctcatgtcccagacttaatcag

SEQ ID NO: 7816443 - DNA, 22 bp, Homo sapiens
ctcatgtcttcacccattctaa

SEQ ID NO: 7816444 - DNA, 22 bp, Homo sapiens
ctcattagacaggtatacttta

SEQ ID NO: 7816445 - DNA, 22 bp, Homo sapiens
ctcattagacaggtatacttta

SEQ ID NO: 7816446 - DNA, 22 bp, Homo sapiens
ctcattaaaggaaatcacctgc

SEQ ID NO: 7816447 - DNA, 22 bp, Homo sapiens
ctcattaaaggaaatcacctgc

SEQ ID NO: 7816448 - DNA, 20 bp, Homo sapiens
ctcatgtggcaccaggcact

SEQ ID NO: 7816449 - DNA, 18 bp, Homo sapiens
ctcatgtgtggtcccagc

SEQ ID NO: 7816450 - DNA, 18 bp, Homo sapiens
ctcagtgtttgctgaaaa

SEQ ID NO: 7816451 - DNA, 22 bp, Homo sapiens
ctcatgatttgagtagtaaact

SEQ ID NO: 7816452 - DNA, 22 bp, Homo sapiens
ctcatgcccagagccactgttg

SEQ ID NO: 7816453 - DNA, 22 bp, Homo sapiens
agtcctgggtccagcaggtcct

SEQ ID NO: 7816454 - DNA, 22 bp, Homo sapiens
agtcctgggtccagcaggtcct

SEQ ID NO: 7816455 - DNA, 22 bp, Homo sapiens
agtcctgggtccagcaggtcct

SEQ ID NO: 7816456 - DNA, 22 bp, Homo sapiens
agtcctgggtccagcaggtcct

SEQ ID NO: 7816457 - DNA, 22 bp, Homo sapiens
ctcagtgttggagaccttcagg

SEQ ID NO: 7816458 - DNA, 18 bp, Homo sapiens
ctcagtgtttgctgaaaa

SEQ ID NO: 7816459 - DNA, 18 bp, Homo sapiens
ctcagtgtttgctgaaaa

SEQ ID NO: 7816460 - DNA, 22 bp, Homo sapiens
ctcagtgttggagaccttcagg

SEQ ID NO: 7816461 - DNA, 22 bp, Homo sapiens
agtcctggccccaaggaaggat

SEQ ID NO: 7816462 - DNA, 22 bp, Homo sapiens
agtcctggccccaaggaaggat

SEQ ID NO: 7816463 - DNA, 22 bp, Homo sapiens
agtcctggccccaaggaaggat

SEQ ID NO: 7816464 - DNA, 22 bp, Homo sapiens
agtcctggccccaaggaaggat

SEQ ID NO: 7816465 - DNA, 19 bp, Homo sapiens
agtcctggcctgggggacc

SEQ ID NO: 7816466 - DNA, 22 bp, Homo sapiens
agtcctggccccaaggaaggat

SEQ ID NO: 7816467 - DNA, 19 bp, Homo sapiens
agtcctggcctgggggacc

SEQ ID NO: 7816468 - DNA, 19 bp, Homo sapiens
agtcctggcctgggggacc

SEQ ID NO: 7816469 - DNA, 22 bp, Homo sapiens
agtcctggctctacgggcttca

SEQ ID NO: 7816470 - DNA, 22 bp, Homo sapiens
agtcctgggtccagcaggtcct

SEQ ID NO: 7816471 - DNA, 22 bp, Homo sapiens
agtcctgggtccagcaggtcct

SEQ ID NO: 7816472 - DNA, 22 bp, Homo sapiens
agtcctgggtccagcaggtcct

SEQ ID NO: 7816473 - DNA, 22 bp, Homo sapiens
agtcctggctctacgggcttca

SEQ ID NO: 7816474 - DNA, 22 bp, Homo sapiens
agtcctgggtccagcaggtcct

SEQ ID NO: 7816475 - DNA, 18 bp, Homo sapiens
agtcctggctctaccacc

SEQ ID NO: 7816476 - DNA, 18 bp, Homo sapiens
agtcctggctctaccacc

SEQ ID NO: 7816477 - DNA, 22 bp, Homo sapiens
agtcctggctctacgggcttca

SEQ ID NO: 7816478 - DNA, 22 bp, Homo sapiens
agtcctggctctacgggcttca

SEQ ID NO: 7816479 - DNA, 18 bp, Homo sapiens
agtcctggctctaccacc

SEQ ID NO: 7816480 - DNA, 22 bp, Homo sapiens
ctccagctcttaactgcggaag

SEQ ID NO: 7816481 - DNA, 22 bp, Homo sapiens
ctccagctcttaactgcggaag

SEQ ID NO: 7816482 - DNA, 22 bp, Homo sapiens
ctccagctcgcgagctctgctc

SEQ ID NO: 7816483 - DNA, 22 bp, Homo sapiens
ctccagctcttaactgcggaag

SEQ ID NO: 7816484 - DNA, 22 bp, Homo sapiens
ctccagctcttaactgcggaag

SEQ ID NO: 7816485 - DNA, 22 bp, Homo sapiens
ctccagctgagtaagaacacta

SEQ ID NO: 7816486 - DNA, 18 bp, Homo sapiens
ctccagagctgtgagaca

SEQ ID NO: 7816487 - DNA, 18 bp, Homo sapiens
agtcttctgatccatttt

SEQ ID NO: 7816488 - DNA, 22 bp, Homo sapiens
ctccagagatccattgaatgta

SEQ ID NO: 7816489 - DNA, 22 bp, Homo sapiens
ctccagagccagtgcttttcca

SEQ ID NO: 7816490 - DNA, 22 bp, Homo sapiens
ctccagagatccattgaatgta

SEQ ID NO: 7816491 - DNA, 18 bp, Homo sapiens
agtcttctgatccatttt

SEQ ID NO: 7816492 - DNA, 21 bp, Homo sapiens
agtcttctccagaggctgggg

SEQ ID NO: 7816493 - DNA, 22 bp, Homo sapiens
agtcttctgaataagaatcact

SEQ ID NO: 7816494 - DNA, 22 bp, Homo sapiens
agtcttctgaataagaatcact

SEQ ID NO: 7816495 - DNA, 22 bp, Homo sapiens
agtcttctgaataagaatcact

SEQ ID NO: 7816496 - DNA, 21 bp, Homo sapiens
agtcttctccagaggctgggg

SEQ ID NO: 7816497 - DNA, 21 bp, Homo sapiens
agtcttctccagaggctgggg

SEQ ID NO: 7816498 - DNA, 22 bp, Homo sapiens
agtcttcatttagttgatccag

SEQ ID NO: 7816499 - DNA, 20 bp, Homo sapiens
agtcttcccccagaagaggg

SEQ ID NO: 7816500 - DNA, 22 bp, Homo sapiens
agtcttcccagaggaggtgcca

SEQ ID NO: 7816501 - DNA, 22 bp, Homo sapiens
agtcttctcatttcacatgctt

SEQ ID NO: 7816502 - DNA, 22 bp, Homo sapiens
agtcttctcatttcacatgctt

SEQ ID NO: 7816503 - DNA, 22 bp, Homo sapiens
agtcttctcatttcacatgctt

SEQ ID NO: 7816504 - DNA, 22 bp, Homo sapiens
agtcttcatttagttgatccag

SEQ ID NO: 7816505 - DNA, 22 bp, Homo sapiens
agtcttcagcagggttaaaccc

SEQ ID NO: 7816506 - DNA, 22 bp, Homo sapiens
agtcttcagcatagcatatggc

SEQ ID NO: 7816507 - DNA, 22 bp, Homo sapiens
agtcttcagcagccttctcagg

SEQ ID NO: 7816508 - DNA, 22 bp, Homo sapiens
agtcttcactcttcactactat

SEQ ID NO: 7816509 - DNA, 22 bp, Homo sapiens
agtcttcagagaaattaactct

SEQ ID NO: 7816510 - DNA, 22 bp, Homo sapiens
agtcttcagcagccttctcagg

SEQ ID NO: 7816511 - DNA, 22 bp, Homo sapiens
agtcttcagcagccttctcagg

SEQ ID NO: 7816512 - DNA, 22 bp, Homo sapiens
agtcttcacatcagtctaaaga

SEQ ID NO: 7816513 - DNA, 22 bp, Homo sapiens
agtcttatgtgatttatctttc

SEQ ID NO: 7816514 - DNA, 22 bp, Homo sapiens
agtcttatgtttgtgaagaact

SEQ ID NO: 7816515 - DNA, 22 bp, Homo sapiens
agtcttatggttaaatagatgc

SEQ ID NO: 7816516 - DNA, 22 bp, Homo sapiens
agtcttaggctccattagtaga

SEQ ID NO: 7816517 - DNA, 22 bp, Homo sapiens
agtcttagtatggttttaggtt

SEQ ID NO: 7816518 - DNA, 22 bp, Homo sapiens
agtcttatatcactatgctctg

SEQ ID NO: 7816519 - DNA, 22 bp, Homo sapiens
agtcttatggttaaatagatgc

SEQ ID NO: 7816520 - DNA, 22 bp, Homo sapiens
agtcttaggctccattagtaga

SEQ ID NO: 7816521 - DNA, 21 bp, Homo sapiens
agtcttaggcacagctgtgtc

SEQ ID NO: 7816522 - DNA, 22 bp, Homo sapiens
agtcttagagtctgtgtcatga

SEQ ID NO: 7816523 - DNA, 22 bp, Homo sapiens
agtcttagattttattttggtc

SEQ ID NO: 7816524 - DNA, 22 bp, Homo sapiens
agtcttagaactacagtgccta

SEQ ID NO: 7816525 - DNA, 22 bp, Homo sapiens
ctcattgcccagatccccacag

SEQ ID NO: 7816526 - DNA, 22 bp, Homo sapiens
ctcattgcccagatccccacag

SEQ ID NO: 7816527 - DNA, 22 bp, Homo sapiens
agtcttagaactacagtgccta

SEQ ID NO: 7816528 - DNA, 22 bp, Homo sapiens
agtcttagaactacagtgccta

SEQ ID NO: 7816529 - DNA, 22 bp, Homo sapiens
ctccaggctcgtccaagatcga

SEQ ID NO: 7816530 - DNA, 22 bp, Homo sapiens
ctccaggctggatccaagtcaa

SEQ ID NO: 7816531 - DNA, 22 bp, Homo sapiens
ctccaggacactaacccaggct

SEQ ID NO: 7816532 - DNA, 22 bp, Homo sapiens
ctccaggacactaacccaggct

SEQ ID NO: 7816533 - DNA, 22 bp, Homo sapiens
ctccaggaacagcaccctgctg

SEQ ID NO: 7816534 - DNA, 22 bp, Homo sapiens
ctccaggcgggaggcggttcca

SEQ ID NO: 7816535 - DNA, 22 bp, Homo sapiens
ctccaggcgggaggcggttcca

SEQ ID NO: 7816536 - DNA, 22 bp, Homo sapiens
ctccaggacactaacccaggct

SEQ ID NO: 7816537 - DNA, 22 bp, Homo sapiens
ctccaggcgggaggcggttcca

SEQ ID NO: 7816538 - DNA, 22 bp, Homo sapiens
ctccaggaaagtcaggcttaga

SEQ ID NO: 7816539 - DNA, 22 bp, Homo sapiens
ctccaggaaagtcaggcttaga

SEQ ID NO: 7816540 - DNA, 22 bp, Homo sapiens
ctccaggaaagtcaggcttaga

SEQ ID NO: 7816541 - DNA, 22 bp, Homo sapiens
ctccaggaacagcaccctgctg

SEQ ID NO: 7816542 - DNA, 22 bp, Homo sapiens
ctccaggaacagcaccctgctg

SEQ ID NO: 7816543 - DNA, 22 bp, Homo sapiens
ctccaggaacagcaccctgctg

SEQ ID NO: 7816544 - DNA, 22 bp, Homo sapiens
ctccaggcttcaagggccggcc

SEQ ID NO: 7816545 - DNA, 22 bp, Homo sapiens
ctccagggaaaggggcgtccgc

SEQ ID NO: 7816546 - DNA, 22 bp, Homo sapiens
ctccagggaaaggggcgtccgc

SEQ ID NO: 7816547 - DNA, 22 bp, Homo sapiens
ctccagggaaaggggcgtccgc

SEQ ID NO: 7816548 - DNA, 22 bp, Homo sapiens
ctccaggctggggtgcaggttg

SEQ ID NO: 7816549 - DNA, 22 bp, Homo sapiens
ctccaggctggggtgcaggttg

SEQ ID NO: 7816550 - DNA, 22 bp, Homo sapiens
ctccaggcttcaagggccggcc

SEQ ID NO: 7816551 - DNA, 22 bp, Homo sapiens
ctccaggcttcaagggccggcc

SEQ ID NO: 7816552 - DNA, 22 bp, Homo sapiens
ctccaggcttcaagggccggcc

SEQ ID NO: 7816553 - DNA, 22 bp, Homo sapiens
ctccaggctggatccaagtcaa

SEQ ID NO: 7816554 - DNA, 22 bp, Homo sapiens
ctccaggctggatccaagtcaa

SEQ ID NO: 7816555 - DNA, 22 bp, Homo sapiens
ctccaggctggggtgcaggttg

SEQ ID NO: 7816556 - DNA, 22 bp, Homo sapiens
ctccaggctggggtgcaggttg

SEQ ID NO: 7816557 - DNA, 22 bp, Homo sapiens
ctccaggctggggtgcaggttg

SEQ ID NO: 7816558 - DNA, 22 bp, Homo sapiens
ctccaggctggggtgcaggttg

SEQ ID NO: 7816559 - DNA, 22 bp, Homo sapiens
ctccaggctggggtgcaggttg

SEQ ID NO: 7816560 - DNA, 22 bp, Homo sapiens
ctccagctgccaccagatgttt

SEQ ID NO: 7816561 - DNA, 22 bp, Homo sapiens
ctccagctgccaccagatgttt

SEQ ID NO: 7816562 - DNA, 22 bp, Homo sapiens
ctccagctgccaccagatgttt

SEQ ID NO: 7816563 - DNA, 22 bp, Homo sapiens
ctccagctgccaccagatgttt

SEQ ID NO: 7816564 - DNA, 22 bp, Homo sapiens
ctccagcttccctcagctgtgg

SEQ ID NO: 7816565 - DNA, 22 bp, Homo sapiens
ctccagcttctgcccagagact

SEQ ID NO: 7816566 - DNA, 22 bp, Homo sapiens
ctccagcttctgcccagagact

SEQ ID NO: 7816567 - DNA, 22 bp, Homo sapiens
ctccagcttctgcccagagact

SEQ ID NO: 7816568 - DNA, 22 bp, Homo sapiens
ctccagctttagctctccaggg

SEQ ID NO: 7816569 - DNA, 22 bp, Homo sapiens
ctccagcttctgcccagagact

SEQ ID NO: 7816570 - DNA, 22 bp, Homo sapiens
ctccagcttctgcccagagact

SEQ ID NO: 7816571 - DNA, 22 bp, Homo sapiens
ctccagcttccctcagctgtgg

SEQ ID NO: 7816572 - DNA, 22 bp, Homo sapiens
ctccagcttccctcagctgtgg

SEQ ID NO: 7816573 - DNA, 22 bp, Homo sapiens
ctccagcttccctcagctgtgg

SEQ ID NO: 7816574 - DNA, 22 bp, Homo sapiens
ctccagcttccctcagctgtgg

SEQ ID NO: 7816575 - DNA, 22 bp, Homo sapiens
ctccagcttctgcccagagact

SEQ ID NO: 7816576 - DNA, 22 bp, Homo sapiens
ctccaggaaagcctgaggcccg

SEQ ID NO: 7816577 - DNA, 22 bp, Homo sapiens
ctccaggaaagcctgaggcccg

SEQ ID NO: 7816578 - DNA, 22 bp, Homo sapiens
ctccaggaaagcctgaggcccg

SEQ ID NO: 7816579 - DNA, 22 bp, Homo sapiens
ctccaggaaaatagggaatgag

SEQ ID NO: 7816580 - DNA, 22 bp, Homo sapiens
ctccagctttagctctccaggg

SEQ ID NO: 7816581 - DNA, 22 bp, Homo sapiens
ctccagctttagctctccaggg

SEQ ID NO: 7816582 - DNA, 22 bp, Homo sapiens
ctccagctttagctctccaggg

SEQ ID NO: 7816583 - DNA, 22 bp, Homo sapiens
ctccaggaaaatagggaatgag

SEQ ID NO: 7816584 - DNA, 22 bp, Homo sapiens
ctccagctttttcccagttggc

SEQ ID NO: 7816585 - DNA, 22 bp, Homo sapiens
ctccagctttttcccagttggc

SEQ ID NO: 7816586 - DNA, 22 bp, Homo sapiens
ctcctgggaaatgaaggggcag

SEQ ID NO: 7816587 - DNA, 22 bp, Homo sapiens
ctcctgggaaatgaaggggcag

SEQ ID NO: 7816588 - DNA, 22 bp, Homo sapiens
ctcctgggaatttagttgtgag

SEQ ID NO: 7816589 - DNA, 22 bp, Homo sapiens
ctcctgggaaatgaaggggcag

SEQ ID NO: 7816590 - DNA, 22 bp, Homo sapiens
ctcctgggaaatgaaggggcag

SEQ ID NO: 7816591 - DNA, 22 bp, Homo sapiens
ctcctgggaaaggctggacaca

SEQ ID NO: 7816592 - DNA, 22 bp, Homo sapiens
ctcctgggaaatgaaggggcag

SEQ ID NO: 7816593 - DNA, 22 bp, Homo sapiens
ctcctgggaaaggctggacaca

SEQ ID NO: 7816594 - DNA, 22 bp, Homo sapiens
ctcctgggaatttagttgtgag

SEQ ID NO: 7816595 - DNA, 22 bp, Homo sapiens
ctcctgggaatttagttgtgag

SEQ ID NO: 7816596 - DNA, 22 bp, Homo sapiens
ctcctggctttcccagaccagg

SEQ ID NO: 7816597 - DNA, 22 bp, Homo sapiens
ctcctgggaaaggctggacaca

SEQ ID NO: 7816598 - DNA, 22 bp, Homo sapiens
ctcctgggaaaggctggacaca

SEQ ID NO: 7816599 - DNA, 22 bp, Homo sapiens
ctcctgggaaaggctggacaca

SEQ ID NO: 7816600 - DNA, 22 bp, Homo sapiens
ctcctgggaaaggctggacaca

SEQ ID NO: 7816601 - DNA, 22 bp, Homo sapiens
ctcctgggaaaggctggacaca

SEQ ID NO: 7816602 - DNA, 22 bp, Homo sapiens
ctcctgggaaaggctggacaca

SEQ ID NO: 7816603 - DNA, 18 bp, Homo sapiens
ctcctggctgatggtgag

SEQ ID NO: 7816604 - DNA, 22 bp, Homo sapiens
ctcctggctttcccagaccagg

SEQ ID NO: 7816605 - DNA, 22 bp, Homo sapiens
ctcctggctttcccagaccagg

SEQ ID NO: 7816606 - DNA, 22 bp, Homo sapiens
ctcctggctttcccagaccagg

SEQ ID NO: 7816607 - DNA, 22 bp, Homo sapiens
ctcctggggccatggaaggaac

SEQ ID NO: 7816608 - DNA, 22 bp, Homo sapiens
ctcctggggccatggaaggaac

SEQ ID NO: 7816609 - DNA, 22 bp, Homo sapiens
ctcctggggccatggaaggaac

SEQ ID NO: 7816610 - DNA, 22 bp, Homo sapiens
ctcctggggcacttagaagcaa

SEQ ID NO: 7816611 - DNA, 22 bp, Homo sapiens
ctcctggggcacttagaagcaa

SEQ ID NO: 7816612 - DNA, 22 bp, Homo sapiens
ctcctggggcacttagaagcaa

SEQ ID NO: 7816613 - DNA, 22 bp, Homo sapiens
ctcctggggcacttagaagcaa

SEQ ID NO: 7816614 - DNA, 22 bp, Homo sapiens
ctcctgggagcagggatggatg

SEQ ID NO: 7816615 - DNA, 20 bp, Homo sapiens
ctcctgggactgctggttat

SEQ ID NO: 7816616 - DNA, 22 bp, Homo sapiens
ctcctgggcttcgaaggctccc

SEQ ID NO: 7816617 - DNA, 20 bp, Homo sapiens
ctcctgggactgctggttat

SEQ ID NO: 7816618 - DNA, 22 bp, Homo sapiens
ctcctgggggacagcggcaggg

SEQ ID NO: 7816619 - DNA, 22 bp, Homo sapiens
ctcctgggggacagcggcaggg

SEQ ID NO: 7816620 - DNA, 22 bp, Homo sapiens
ctcctgggggacagcggcaggg

SEQ ID NO: 7816621 - DNA, 22 bp, Homo sapiens
ctcctgggggacagcggcaggg

SEQ ID NO: 7816622 - DNA, 22 bp, Homo sapiens
ctcctgggggacagcggcaggg

SEQ ID NO: 7816623 - DNA, 22 bp, Homo sapiens
ctcctgggggacagcggcaggg

SEQ ID NO: 7816624 - DNA, 22 bp, Homo sapiens
ctcctgggtcattgccagcaaa

SEQ ID NO: 7816625 - DNA, 22 bp, Homo sapiens
ctcctgggtcattgccagcaaa

SEQ ID NO: 7816626 - DNA, 22 bp, Homo sapiens
ctcctgggtcattgccagcaaa

SEQ ID NO: 7816627 - DNA, 22 bp, Homo sapiens
ctcctgggtcattgccagcaaa

SEQ ID NO: 7816628 - DNA, 22 bp, Homo sapiens
ctcctgggtcattgccagcaaa

SEQ ID NO: 7816629 - DNA, 22 bp, Homo sapiens
ctcctgggtcattgccagcaaa

SEQ ID NO: 7816630 - DNA, 22 bp, Homo sapiens
ctcctgggtcattgccagcaaa

SEQ ID NO: 7816631 - DNA, 22 bp, Homo sapiens
agtggcagaagccaagtctgca

SEQ ID NO: 7816632 - DNA, 22 bp, Homo sapiens
agtggcagaagccaagtctgca

SEQ ID NO: 7816633 - DNA, 22 bp, Homo sapiens
agtggcagaagccaagtctgca

SEQ ID NO: 7816634 - DNA, 22 bp, Homo sapiens
agtggcagaagccaagtctgca

SEQ ID NO: 7816635 - DNA, 22 bp, Homo sapiens
agtggcagaagccaagtctgca

SEQ ID NO: 7816636 - DNA, 22 bp, Homo sapiens
agtggcagaagccaagtctgca

SEQ ID NO: 7816637 - DNA, 22 bp, Homo sapiens
agtggcagaagccaagtctgca

SEQ ID NO: 7816638 - DNA, 22 bp, Homo sapiens
agtggcagaagtcactgggtag

SEQ ID NO: 7816639 - DNA, 22 bp, Homo sapiens
agtggcagaagtcactgggtag

SEQ ID NO: 7816640 - DNA, 22 bp, Homo sapiens
agtggcagagctgtgtcttgaa

SEQ ID NO: 7816641 - DNA, 22 bp, Homo sapiens
agtggcagagctgtgtcttgaa

SEQ ID NO: 7816642 - DNA, 22 bp, Homo sapiens
agtggcagaggttgactgcagt

SEQ ID NO: 7816643 - DNA, 22 bp, Homo sapiens
agtggcagagctgtgtcttgaa

SEQ ID NO: 7816644 - DNA, 23 bp, Homo sapiens
ctcctggtgctgctatcaggggt

SEQ ID NO: 7816645 - DNA, 22 bp, Homo sapiens
ctcctggtgctggggctgccgc

SEQ ID NO: 7816646 - DNA, 22 bp, Homo sapiens
ctcctggtgctggggctgccgc

SEQ ID NO: 7816647 - DNA, 22 bp, Homo sapiens
ctcctggtgctggggctgccgc

SEQ ID NO: 7816648 - DNA, 22 bp, Homo sapiens
ctcctggtgactcccagataaa

SEQ ID NO: 7816649 - DNA, 22 bp, Homo sapiens
ctcctggtgactcccagataaa

SEQ ID NO: 7816650 - DNA, 20 bp, Homo sapiens
ctcctggtccaggagcctga

SEQ ID NO: 7816651 - DNA, 20 bp, Homo sapiens
ctcctggtccaggagcctga

SEQ ID NO: 7816652 - DNA, 20 bp, Homo sapiens
ctcctggtccaggagcctga

SEQ ID NO: 7816653 - DNA, 20 bp, Homo sapiens
ctcctggtccaggagcctga

SEQ ID NO: 7816654 - DNA, 20 bp, Homo sapiens
ctcctggtccaggagcctga

SEQ ID NO: 7816655 - DNA, 22 bp, Homo sapiens
ctcctgggtcattgccagcaaa

SEQ ID NO: 7816656 - DNA, 22 bp, Homo sapiens
agtggcagagtcagggtttgga

SEQ ID NO: 7816657 - DNA, 22 bp, Homo sapiens
agtggcagagtcagggtttgga

SEQ ID NO: 7816658 - DNA, 22 bp, Homo sapiens
agtggcagagtcagggtttgga

SEQ ID NO: 7816659 - DNA, 22 bp, Homo sapiens
agtggcagagtcagggtttgga

SEQ ID NO: 7816660 - DNA, 22 bp, Homo sapiens
agtggcagagtgcactcaggca

SEQ ID NO: 7816661 - DNA, 22 bp, Homo sapiens
agtggcagagtcagggtttgga

SEQ ID NO: 7816662 - DNA, 22 bp, Homo sapiens
agtggcagagtcagggtttgga

SEQ ID NO: 7816663 - DNA, 22 bp, Homo sapiens
agtggcagagtgcactcaggca

SEQ ID NO: 7816664 - DNA, 22 bp, Homo sapiens
agtggcagagtgcactcaggca

SEQ ID NO: 7816665 - DNA, 22 bp, Homo sapiens
agtggcagagtgcactcaggca

SEQ ID NO: 7816666 - DNA, 22 bp, Homo sapiens
agtggcagagtgcactcaggca

SEQ ID NO: 7816667 - DNA, 22 bp, Homo sapiens
agtggcagagtgcactcaggca

SEQ ID NO: 7816668 - DNA, 22 bp, Homo sapiens
agtggcagagtgcactcaggca

SEQ ID NO: 7816669 - DNA, 22 bp, Homo sapiens
agtggcagagtgcactcaggca

SEQ ID NO: 7816670 - DNA, 22 bp, Homo sapiens
agtggcagaggttgactgcagt

SEQ ID NO: 7816671 - DNA, 22 bp, Homo sapiens
agtggcagaggttgactgcagt

SEQ ID NO: 7816672 - DNA, 22 bp, Homo sapiens
agtggcagaggttgactgcagt

SEQ ID NO: 7816673 - DNA, 22 bp, Homo sapiens
agtggcagaggttgactgcagt

SEQ ID NO: 7816674 - DNA, 22 bp, Homo sapiens
agtggcagaggttgactgcagt

SEQ ID NO: 7816675 - DNA, 22 bp, Homo sapiens
agtggcagaggttgactgcagt

SEQ ID NO: 7816676 - DNA, 22 bp, Homo sapiens
agtggcagagctgtgtcttgaa

SEQ ID NO: 7816677 - DNA, 22 bp, Homo sapiens
agtggcagaggttgactgcagt

SEQ ID NO: 7816678 - DNA, 22 bp, Homo sapiens
agtggcagaggttgactgcagt

SEQ ID NO: 7816679 - DNA, 22 bp, Homo sapiens
agtggcagaggttgactgcagt

SEQ ID NO: 7816680 - DNA, 22 bp, Homo sapiens
agtggcagagtgcactcaggca

SEQ ID NO: 7816681 - DNA, 22 bp, Homo sapiens
agtggcagagtgcactcaggca

SEQ ID NO: 7816682 - DNA, 22 bp, Homo sapiens
agtggcagagtgcactcaggca

SEQ ID NO: 7816683 - DNA, 22 bp, Homo sapiens
agtggcagagttgaataattga

SEQ ID NO: 7816684 - DNA, 22 bp, Homo sapiens
agtggcagagttgaataattga

SEQ ID NO: 7816685 - DNA, 22 bp, Homo sapiens
agtggcagagtgcactcaggca

SEQ ID NO: 7816686 - DNA, 22 bp, Homo sapiens
agtggcagatctctggtctgga

SEQ ID NO: 7816687 - DNA, 22 bp, Homo sapiens
agtggcagatctctggtctgga

SEQ ID NO: 7816688 - DNA, 16 bp, Homo sapiens
agtggcagataatacc

SEQ ID NO: 7816689 - DNA, 22 bp, Homo sapiens
agtggcagagttgaataattga

SEQ ID NO: 7816690 - DNA, 22 bp, Homo sapiens
agtggcagatctctggtctgga

SEQ ID NO: 7816691 - DNA, 22 bp, Homo sapiens
agtggcagatctctggtctgga

SEQ ID NO: 7816692 - DNA, 22 bp, Homo sapiens
agtggcagatctctggtctgga

SEQ ID NO: 7816693 - DNA, 22 bp, Homo sapiens
agtggcagatctctggtctgga

SEQ ID NO: 7816694 - DNA, 22 bp, Homo sapiens
agtggcagatctctggtctgga

SEQ ID NO: 7816695 - DNA, 22 bp, Homo sapiens
agtggcagatctctggtctgga

SEQ ID NO: 7816696 - DNA, 22 bp, Homo sapiens
agtggcagatctctggtctgga

SEQ ID NO: 7816697 - DNA, 19 bp, Homo sapiens
agtggcagatctggaagta

SEQ ID NO: 7816698 - DNA, 19 bp, Homo sapiens
agtggcagatctggaagta

SEQ ID NO: 7816699 - DNA, 19 bp, Homo sapiens
agtggcagatctggaagta

SEQ ID NO: 7816700 - DNA, 19 bp, Homo sapiens
agtggcagatctggaagta

SEQ ID NO: 7816701 - DNA, 22 bp, Homo sapiens
ctctcagaagtttatgtcagaa

SEQ ID NO: 7816702 - DNA, 22 bp, Homo sapiens
ctctcagaagtttatgtcagaa

SEQ ID NO: 7816703 - DNA, 22 bp, Homo sapiens
ctctcagaagtagcacgtgggc

SEQ ID NO: 7816704 - DNA, 22 bp, Homo sapiens
agtggcagccgagcaggagatg

SEQ ID NO: 7816705 - DNA, 22 bp, Homo sapiens
agtggcagccgagcaggagatg

SEQ ID NO: 7816706 - DNA, 19 bp, Homo sapiens
agtggcagatctggaagta

SEQ ID NO: 7816707 - DNA, 22 bp, Homo sapiens
ctctcagcaggaaagcatgcaa

SEQ ID NO: 7816708 - DNA, 22 bp, Homo sapiens
ctctcagatggagtgtgaatgg

SEQ ID NO: 7816709 - DNA, 22 bp, Homo sapiens
ctctcagatggagtgtgaatgg

SEQ ID NO: 7816710 - DNA, 22 bp, Homo sapiens
ctctcagacacccatttggaaa

SEQ ID NO: 7816711 - DNA, 22 bp, Homo sapiens
ctctcagatggagtgtgaatgg

SEQ ID NO: 7816712 - DNA, 22 bp, Homo sapiens
ctctcagacacccatttggaaa

SEQ ID NO: 7816713 - DNA, 22 bp, Homo sapiens
ctctcagacacccatttggaaa

SEQ ID NO: 7816714 - DNA, 22 bp, Homo sapiens
ctctcagaagtttatgtcagaa

SEQ ID NO: 7816715 - DNA, 22 bp, Homo sapiens
ctccctctcaccggagccctgg

SEQ ID NO: 7816716 - DNA, 22 bp, Homo sapiens
ctccctcctcaaatatctttgt

SEQ ID NO: 7816717 - DNA, 22 bp, Homo sapiens
ctccctcctcaaatatctttgt

SEQ ID NO: 7816718 - DNA, 22 bp, Homo sapiens
ctccctcgagaacgcccctctc

SEQ ID NO: 7816719 - DNA, 22 bp, Homo sapiens
ctccctcgagaacgcccctctc

SEQ ID NO: 7816720 - DNA, 22 bp, Homo sapiens
ctccctctcaccggagccctgg

SEQ ID NO: 7816721 - DNA, 22 bp, Homo sapiens
ctccctccctacgtgagctcac

SEQ ID NO: 7816722 - DNA, 22 bp, Homo sapiens
ctccctcaggccttagccctgc

SEQ ID NO: 7816723 - DNA, 22 bp, Homo sapiens
ctccctcaggccttagccctgc

SEQ ID NO: 7816724 - DNA, 22 bp, Homo sapiens
ctccctcatatacccagcgaga

SEQ ID NO: 7816725 - DNA, 22 bp, Homo sapiens
ctccctcagaggagcacctgtt

SEQ ID NO: 7816726 - DNA, 22 bp, Homo sapiens
ctccctcaggccttagccctgc

SEQ ID NO: 7816727 - DNA, 22 bp, Homo sapiens
ctccctccaaataagactcggg

SEQ ID NO: 7816728 - DNA, 22 bp, Homo sapiens
ctccctccaaataagactcggg

SEQ ID NO: 7816729 - DNA, 22 bp, Homo sapiens
ctccctccaaataagactcggg

SEQ ID NO: 7816730 - DNA, 22 bp, Homo sapiens
ctccctcatatacccagcgaga

SEQ ID NO: 7816731 - DNA, 22 bp, Homo sapiens
ctccctcatatacccagcgaga

SEQ ID NO: 7816732 - DNA, 22 bp, Homo sapiens
ctccctcatatacccagcgaga

SEQ ID NO: 7816733 - DNA, 22 bp, Homo sapiens
ctccctccctacgtgagctcac

SEQ ID NO: 7816734 - DNA, 22 bp, Homo sapiens
ctccctccctacgtgagctcac

SEQ ID NO: 7816735 - DNA, 22 bp, Homo sapiens
ctccctccctacgtgagctcac

SEQ ID NO: 7816736 - DNA, 22 bp, Homo sapiens
ctccctcacacccttgcccaga

SEQ ID NO: 7816737 - DNA, 22 bp, Homo sapiens
ctccctcaccatgacccgctgt

SEQ ID NO: 7816738 - DNA, 22 bp, Homo sapiens
ctccctcacacccttgcccaga

SEQ ID NO: 7816739 - DNA, 22 bp, Homo sapiens
ctcccaggttgattctttccct

SEQ ID NO: 7816740 - DNA, 22 bp, Homo sapiens
ctccctcagaggagcacctgtt

SEQ ID NO: 7816741 - DNA, 22 bp, Homo sapiens
ctccctcagaggagcacctgtt

SEQ ID NO: 7816742 - DNA, 22 bp, Homo sapiens
ctccctcaccatgacccgctgt

SEQ ID NO: 7816743 - DNA, 22 bp, Homo sapiens
ctccctcagaggagcacctgtt

SEQ ID NO: 7816744 - DNA, 22 bp, Homo sapiens
ctccctcagaggagcacctgtt

SEQ ID NO: 7816745 - DNA, 22 bp, Homo sapiens
ctccctcagaggagcacctgtt

SEQ ID NO: 7816746 - DNA, 18 bp, Homo sapiens
ctccagggaactcagtca

SEQ ID NO: 7816747 - DNA, 20 bp, Homo sapiens
ctccagggaacagactggag

SEQ ID NO: 7816748 - DNA, 20 bp, Homo sapiens
ctccagggaacagactggag

SEQ ID NO: 7816749 - DNA, 20 bp, Homo sapiens
ctccagggaacagactggag

SEQ ID NO: 7816750 - DNA, 20 bp, Homo sapiens
ctccagggaacagactggag

SEQ ID NO: 7816751 - DNA, 18 bp, Homo sapiens
ctccagggaactcagtca

SEQ ID NO: 7816752 - DNA, 18 bp, Homo sapiens
ctccagggaactcagtca

SEQ ID NO: 7816753 - DNA, 20 bp, Homo sapiens
ctccagggaacagactggag

SEQ ID NO: 7816754 - DNA, 20 bp, Homo sapiens
ctccagggaacagactggag

SEQ ID NO: 7816755 - DNA, 20 bp, Homo sapiens
ctccagggaacagactggag

SEQ ID NO: 7816756 - DNA, 20 bp, Homo sapiens
ctccagggaacagactggag

SEQ ID NO: 7816757 - DNA, 20 bp, Homo sapiens
ctccagggaacagactggag

SEQ ID NO: 7816758 - DNA, 22 bp, Homo sapiens
ctccagggaaaggggcgtccgc

SEQ ID NO: 7816759 - DNA, 22 bp, Homo sapiens
ctcctcactttccagactgggc

SEQ ID NO: 7816760 - DNA, 22 bp, Homo sapiens
ctcctcagaacagccttggctg

SEQ ID NO: 7816761 - DNA, 22 bp, Homo sapiens
ctcctcagaacagccttggctg

SEQ ID NO: 7816762 - DNA, 22 bp, Homo sapiens
ctcctcacacccactgcaacca

SEQ ID NO: 7816763 - DNA, 22 bp, Homo sapiens
ctcctcaaggtctcaggaataa

SEQ ID NO: 7816764 - DNA, 22 bp, Homo sapiens
ctcctcaaggtctcaggaataa

SEQ ID NO: 7816765 - DNA, 22 bp, Homo sapiens
ctcctcacacccactgcaacca

SEQ ID NO: 7816766 - DNA, 22 bp, Homo sapiens
ctcctaggacgccgctgctcct

SEQ ID NO: 7816767 - DNA, 22 bp, Homo sapiens
ctcctaggtgctcactggggtc

SEQ ID NO: 7816768 - DNA, 22 bp, Homo sapiens
ctcctaggtgctcactggggtc

SEQ ID NO: 7816769 - DNA, 22 bp, Homo sapiens
ctcctaggtgctcactggggtc

SEQ ID NO: 7816770 - DNA, 22 bp, Homo sapiens
ctcctagtgcacacctgtccac

SEQ ID NO: 7816771 - DNA, 22 bp, Homo sapiens
ctcctacagtgtttgagtccag

SEQ ID NO: 7816772 - DNA, 22 bp, Homo sapiens
ctcctacagtgtttgagtccag

SEQ ID NO: 7816773 - DNA, 22 bp, Homo sapiens
ctcctagatgtcttcagagaaa

SEQ ID NO: 7816774 - DNA, 22 bp, Homo sapiens
ctcctacattccaccttggact

SEQ ID NO: 7816775 - DNA, 22 bp, Homo sapiens
ctcctacacatagatgctttca

SEQ ID NO: 7816776 - DNA, 22 bp, Homo sapiens
ctccgtgctattttagtatcgc

SEQ ID NO: 7816777 - DNA, 22 bp, Homo sapiens
ctccgggtagctgaggccctgg

SEQ ID NO: 7816778 - DNA, 22 bp, Homo sapiens
ctccctctgaggctttgagcct

SEQ ID NO: 7816779 - DNA, 22 bp, Homo sapiens
ctccctctctaaggcaaagaga

SEQ ID NO: 7816780 - DNA, 22 bp, Homo sapiens
ctccctctgtccgaggccggct

SEQ ID NO: 7816781 - DNA, 21 bp, Homo sapiens
ctccggagtgagctgtgggta

SEQ ID NO: 7816782 - DNA, 19 bp, Homo sapiens
ctccggccagcaactgcat

SEQ ID NO: 7816783 - DNA, 22 bp, Homo sapiens
ctcctggctctctgtttagtgt

SEQ ID NO: 7816784 - DNA, 22 bp, Homo sapiens
ctcctggctctctgtttagtgt

SEQ ID NO: 7816785 - DNA, 22 bp, Homo sapiens
ctcctgcctgtgggactgagga

SEQ ID NO: 7816786 - DNA, 22 bp, Homo sapiens
ctcctggctcgcccccagctga

SEQ ID NO: 7816787 - DNA, 22 bp, Homo sapiens
ctcctggctctgccacttacta

SEQ ID NO: 7816788 - DNA, 19 bp, Homo sapiens
ctcctggctctgtcatttt

SEQ ID NO: 7816789 - DNA, 18 bp, Homo sapiens
ctcctggctgatggtgag

SEQ ID NO: 7816790 - DNA, 18 bp, Homo sapiens
ctcctggctgatggtgag

SEQ ID NO: 7816791 - DNA, 19 bp, Homo sapiens
ctcctggctctgtcatttt

SEQ ID NO: 7816792 - DNA, 22 bp, Homo sapiens
ctcctcagactttccttgtccg

SEQ ID NO: 7816793 - DNA, 22 bp, Homo sapiens
ctcctcagactttccttgtccg

SEQ ID NO: 7816794 - DNA, 22 bp, Homo sapiens
ctcctcagactttccttgtccg

SEQ ID NO: 7816795 - DNA, 22 bp, Homo sapiens
ctcctcagagagcagcttgggg

SEQ ID NO: 7816796 - DNA, 22 bp, Homo sapiens
ctcctgccaccgcggtgtcctg

SEQ ID NO: 7816797 - DNA, 22 bp, Homo sapiens
ctcctgccaccgcggtgtcctg

SEQ ID NO: 7816798 - DNA, 22 bp, Homo sapiens
ctcctgccaccgcggtgtcctg

SEQ ID NO: 7816799 - DNA, 22 bp, Homo sapiens
ctcctgcccacgtgctacttct

SEQ ID NO: 7816800 - DNA, 22 bp, Homo sapiens
ctcctgcccacgtgctacttct

SEQ ID NO: 7816801 - DNA, 22 bp, Homo sapiens
ctcctgcccacgtgctacttct

SEQ ID NO: 7816802 - DNA, 22 bp, Homo sapiens
ctcctcagaagagggtaacaca

SEQ ID NO: 7816803 - DNA, 22 bp, Homo sapiens
ctcctcagaacagccttggctg

SEQ ID NO: 7816804 - DNA, 22 bp, Homo sapiens
ctcctcagaacagccttggctg

SEQ ID NO: 7816805 - DNA, 22 bp, Homo sapiens
ctcctcagaacagccttggctg

SEQ ID NO: 7816806 - DNA, 22 bp, Homo sapiens
ctcctcagaacagccttggctg

SEQ ID NO: 7816807 - DNA, 22 bp, Homo sapiens
ctcctcagaagagggtaacaca

SEQ ID NO: 7816808 - DNA, 22 bp, Homo sapiens
ctaggtgatccactgctctctt

SEQ ID NO: 7816809 - DNA, 22 bp, Homo sapiens
ctaggtacttagtaaatattaa

SEQ ID NO: 7816810 - DNA, 22 bp, Homo sapiens
ctaggtgatccactgctctctt

SEQ ID NO: 7816811 - DNA, 22 bp, Homo sapiens
ctagggtgtgcagattttgcct

SEQ ID NO: 7816812 - DNA, 22 bp, Homo sapiens
ctaggtgatccactgctctctt

SEQ ID NO: 7816813 - DNA, 18 bp, Homo sapiens
ctagggtggagtaccttt

SEQ ID NO: 7816814 - DNA, 22 bp, Homo sapiens
ctagggtggatttgtgcagagt

SEQ ID NO: 7816815 - DNA, 22 bp, Homo sapiens
ctagggtggatttgtgcagagt

SEQ ID NO: 7816816 - DNA, 22 bp, Homo sapiens
ctagggtgtgcagattttgcct

SEQ ID NO: 7816817 - DNA, 22 bp, Homo sapiens
ctagggtggatttgtgcagagt

SEQ ID NO: 7816818 - DNA, 19 bp, Homo sapiens
ctagggcttggcagcaggc

SEQ ID NO: 7816819 - DNA, 22 bp, Homo sapiens
ctagggtcaggggcctgcgtcg

SEQ ID NO: 7816820 - DNA, 22 bp, Homo sapiens
ctagggtcaggggcctgcgtcg

SEQ ID NO: 7816821 - DNA, 22 bp, Homo sapiens
ctagggtcaggggcctgcgtcg

SEQ ID NO: 7816822 - DNA, 22 bp, Homo sapiens
agtcccaacagcttacaaggaa

SEQ ID NO: 7816823 - DNA, 22 bp, Homo sapiens
agtcccaacagcttacaaggaa

SEQ ID NO: 7816824 - DNA, 22 bp, Homo sapiens
agtcccaacagcttacaaggaa

SEQ ID NO: 7816825 - DNA, 22 bp, Homo sapiens
agtcccaacagcttacaaggaa

SEQ ID NO: 7816826 - DNA, 22 bp, Homo sapiens
agtccatggttctgactcatct

SEQ ID NO: 7816827 - DNA, 22 bp, Homo sapiens
agtccatggttctgactcatct

SEQ ID NO: 7816828 - DNA, 22 bp, Homo sapiens
agtccatggttgtagttctctc

SEQ ID NO: 7816829 - DNA, 22 bp, Homo sapiens
agtccatagtttacattacagc

SEQ ID NO: 7816830 - DNA, 22 bp, Homo sapiens
agtccatcttctcttgctggtc

SEQ ID NO: 7816831 - DNA, 19 bp, Homo sapiens
agtccatgaatggaggatg

SEQ ID NO: 7816832 - DNA, 19 bp, Homo sapiens
agtccatgaatggaggatg

SEQ ID NO: 7816833 - DNA, 18 bp, Homo sapiens
agtccatgcatggctata

SEQ ID NO: 7816834 - DNA, 18 bp, Homo sapiens
agtccatgcatggctata

SEQ ID NO: 7816835 - DNA, 18 bp, Homo sapiens
agtccatgcatggctata

SEQ ID NO: 7816836 - DNA, 22 bp, Homo sapiens
agtcccagctactcaagaggct

SEQ ID NO: 7816837 - DNA, 22 bp, Homo sapiens
agtcccatgtcattatttctgc

SEQ ID NO: 7816838 - DNA, 16 bp, Homo sapiens
agtcccatgtttgagt

SEQ ID NO: 7816839 - DNA, 22 bp, Homo sapiens
agtcccatttgtgaccttggga

SEQ ID NO: 7816840 - DNA, 22 bp, Homo sapiens
agtcccattgcaagttatgcga

SEQ ID NO: 7816841 - DNA, 22 bp, Homo sapiens
agtcccagctactcaagaggct

SEQ ID NO: 7816842 - DNA, 22 bp, Homo sapiens
agtcccagctactcaagaggct

SEQ ID NO: 7816843 - DNA, 22 bp, Homo sapiens
agtcccagctactcaagaggct

SEQ ID NO: 7816844 - DNA, 22 bp, Homo sapiens
ctagtccactgtcctgcctcca

SEQ ID NO: 7816845 - DNA, 22 bp, Homo sapiens
ctagtcacgtctttcagttacc

SEQ ID NO: 7816846 - DNA, 20 bp, Homo sapiens
ctagtctcacatccctggca

SEQ ID NO: 7816847 - DNA, 22 bp, Homo sapiens
ctagtctctggaggtcagggct

SEQ ID NO: 7816848 - DNA, 22 bp, Homo sapiens
ctagtaaagtactcaaatagcc

SEQ ID NO: 7816849 - DNA, 22 bp, Homo sapiens
ctagtaaagtactcaaatagcc

SEQ ID NO: 7816850 - DNA, 22 bp, Homo sapiens
ctagtaaagctatgattctgcc

SEQ ID NO: 7816851 - DNA, 22 bp, Homo sapiens
ctaggttaaagcggttttatgt

SEQ ID NO: 7816852 - DNA, 22 bp, Homo sapiens
ctaggtattcatgtttcgtggc

SEQ ID NO: 7816853 - DNA, 22 bp, Homo sapiens
ctaggtgatccactgctctctt

SEQ ID NO: 7816854 - DNA, 22 bp, Homo sapiens
ctaggtggtggtgggttgacat

SEQ ID NO: 7816855 - DNA, 22 bp, Homo sapiens
ctaggtgatccactgctctctt

SEQ ID NO: 7816856 - DNA, 22 bp, Homo sapiens
ctaggtgatccactgctctctt

SEQ ID NO: 7816857 - DNA, 22 bp, Homo sapiens
ctaggtgatccactgctctctt

SEQ ID NO: 7816858 - DNA, 22 bp, Homo sapiens
ctagtattaagtgtgagtaaaa

SEQ ID NO: 7816859 - DNA, 22 bp, Homo sapiens
ctagtattacatttttgtgtgt

SEQ ID NO: 7816860 - DNA, 22 bp, Homo sapiens
ctagtattaagtgtgagtaaaa

SEQ ID NO: 7816861 - DNA, 22 bp, Homo sapiens
ctagtaaggaataaattatgat

SEQ ID NO: 7816862 - DNA, 23 bp, Homo sapiens
ctagtaaatcctgaatagcaggc

SEQ ID NO: 7816863 - DNA, 22 bp, Homo sapiens
agtccagtctcactcttggcag

SEQ ID NO: 7816864 - DNA, 22 bp, Homo sapiens
agtccagtctcttctggtgagt

SEQ ID NO: 7816865 - DNA, 22 bp, Homo sapiens
agtccagtctcactcttggcag

SEQ ID NO: 7816866 - DNA, 22 bp, Homo sapiens
agtccaggtctctgagtcacaa

SEQ ID NO: 7816867 - DNA, 22 bp, Homo sapiens
agtccaggtctctgagtcacaa

SEQ ID NO: 7816868 - DNA, 22 bp, Homo sapiens
agtccaggtggaccttggccag

SEQ ID NO: 7816869 - DNA, 22 bp, Homo sapiens
agtccaggtggaccttggccag

SEQ ID NO: 7816870 - DNA, 22 bp, Homo sapiens
agtccaggtggaccttggccag

SEQ ID NO: 7816871 - DNA, 22 bp, Homo sapiens
agtccagtgtgttctggcagca

SEQ ID NO: 7816872 - DNA, 22 bp, Homo sapiens
agtccagtgaactgtaaatagg

SEQ ID NO: 7816873 - DNA, 22 bp, Homo sapiens
agtccagtcttgttggcacggt

SEQ ID NO: 7816874 - DNA, 22 bp, Homo sapiens
agtccagtgaactgtaaatagg

SEQ ID NO: 7816875 - DNA, 22 bp, Homo sapiens
agtccataggcagttcataaca

SEQ ID NO: 7816876 - DNA, 22 bp, Homo sapiens
agtccatacattgagaataaca

SEQ ID NO: 7816877 - DNA, 22 bp, Homo sapiens
agtccataggcagttcataaca

SEQ ID NO: 7816878 - DNA, 22 bp, Homo sapiens
agtccatacattgagaataaca

SEQ ID NO: 7816879 - DNA, 22 bp, Homo sapiens
agtccagggagcccaggctttg

SEQ ID NO: 7816880 - DNA, 22 bp, Homo sapiens
agtccagggagcccaggctttg

SEQ ID NO: 7816881 - DNA, 22 bp, Homo sapiens
agtccagggagcccaggctttg

SEQ ID NO: 7816882 - DNA, 22 bp, Homo sapiens
agtccaggctcttcctgaagaa

SEQ ID NO: 7816883 - DNA, 22 bp, Homo sapiens
agtccaggctcttcctgaagaa

SEQ ID NO: 7816884 - DNA, 22 bp, Homo sapiens
agtccagggctctctgtgggat

SEQ ID NO: 7816885 - DNA, 22 bp, Homo sapiens
agtccagggctctctgtgggat

SEQ ID NO: 7816886 - DNA, 22 bp, Homo sapiens
agtccagggagcccaggctttg

SEQ ID NO: 7816887 - DNA, 22 bp, Homo sapiens
agtccaggtctctgagtcacaa

SEQ ID NO: 7816888 - DNA, 22 bp, Homo sapiens
agtccaggtctctgagtcacaa

SEQ ID NO: 7816889 - DNA, 22 bp, Homo sapiens
agtccaggtctctgagtcacaa

SEQ ID NO: 7816890 - DNA, 22 bp, Homo sapiens
agtccagggcttagtcagcggg

SEQ ID NO: 7816891 - DNA, 22 bp, Homo sapiens
agtccaggtctctgagtcacaa

SEQ ID NO: 7816892 - DNA, 22 bp, Homo sapiens
agtccagggcttagtcagcggg

SEQ ID NO: 7816893 - DNA, 22 bp, Homo sapiens
agtccagggcttagtcagcggg

SEQ ID NO: 7816894 - DNA, 22 bp, Homo sapiens
agtccagggcttagtcagcggg

SEQ ID NO: 7816895 - DNA, 22 bp, Homo sapiens
agtccagggctctctgtgggat

SEQ ID NO: 7816896 - DNA, 22 bp, Homo sapiens
agtccagggctctctgtgggat

SEQ ID NO: 7816897 - DNA, 22 bp, Homo sapiens
agtccagggctctctgtgggat

SEQ ID NO: 7816898 - DNA, 22 bp, Homo sapiens
ctagaatatcatatgaagagac

SEQ ID NO: 7816899 - DNA, 22 bp, Homo sapiens
ctagaatcccaaatggactggg

SEQ ID NO: 7816900 - DNA, 22 bp, Homo sapiens
ctagaatcccaaatggactggg

SEQ ID NO: 7816901 - DNA, 22 bp, Homo sapiens
ctagaatcccaaatggactggg

SEQ ID NO: 7816902 - DNA, 22 bp, Homo sapiens
ctagaatatcatatgaagagac

SEQ ID NO: 7816903 - DNA, 22 bp, Homo sapiens
ctagaatactcgtattattccc

SEQ ID NO: 7816904 - DNA, 22 bp, Homo sapiens
ctagaatctgggatttctgact

SEQ ID NO: 7816905 - DNA, 22 bp, Homo sapiens
ctagaatctccaagtttactca

SEQ ID NO: 7816906 - DNA, 22 bp, Homo sapiens
ctagaatctatgtcaggaactc

SEQ ID NO: 7816907 - DNA, 22 bp, Homo sapiens
ctagaatctatgtcaggaactc

SEQ ID NO: 7816908 - DNA, 22 bp, Homo sapiens
ctagaatctgggatttctgact

SEQ ID NO: 7816909 - DNA, 22 bp, Homo sapiens
agtccacagagtctctcctgaa

SEQ ID NO: 7816910 - DNA, 22 bp, Homo sapiens
agtccacagctcatagtttttt

SEQ ID NO: 7816911 - DNA, 22 bp, Homo sapiens
agtccacagagtctctcctgaa

SEQ ID NO: 7816912 - DNA, 22 bp, Homo sapiens
agtccaccacccatgctcctct

SEQ ID NO: 7816913 - DNA, 22 bp, Homo sapiens
agtccaaggttcatggcacaga

SEQ ID NO: 7816914 - DNA, 22 bp, Homo sapiens
agtccaataacctctttccttc

SEQ ID NO: 7816915 - DNA, 18 bp, Homo sapiens
agtccaatccttgattct

SEQ ID NO: 7816916 - DNA, 22 bp, Homo sapiens
agtccactgccccagctcctcg

SEQ ID NO: 7816917 - DNA, 22 bp, Homo sapiens
agtccaccggcagagatgctga

SEQ ID NO: 7816918 - DNA, 22 bp, Homo sapiens
agtccactgccccagctcctcg

SEQ ID NO: 7816919 - DNA, 22 bp, Homo sapiens
agtccaggctcttcctgaagaa

SEQ ID NO: 7816920 - DNA, 22 bp, Homo sapiens
agtccagaacttcagctagttt

SEQ ID NO: 7816921 - DNA, 22 bp, Homo sapiens
ctagaacagaaagtacaggaaa

SEQ ID NO: 7816922 - DNA, 22 bp, Homo sapiens
ctagaacagtcaaagtgagctc

SEQ ID NO: 7816923 - DNA, 22 bp, Homo sapiens
ctagaacagtcaaagtgagctc

SEQ ID NO: 7816924 - DNA, 22 bp, Homo sapiens
ctagaacctaggagtactaaag

SEQ ID NO: 7816925 - DNA, 20 bp, Homo sapiens
ctagaactgagaaatttaaa

SEQ ID NO: 7816926 - DNA, 22 bp, Homo sapiens
ctagaactacatcttttaatag

SEQ ID NO: 7816927 - DNA, 20 bp, Homo sapiens
ctagaagcagaattgctgat

SEQ ID NO: 7816928 - DNA, 22 bp, Homo sapiens
ctagaagcaatgtaggggagac

SEQ ID NO: 7816929 - DNA, 20 bp, Homo sapiens
ctagaagcagaattgctgat

SEQ ID NO: 7816930 - DNA, 22 bp, Homo sapiens
ctagaaggaagcccagcacttc

SEQ ID NO: 7816931 - DNA, 22 bp, Homo sapiens
ctagaatactcgtattattccc

SEQ ID NO: 7816932 - DNA, 22 bp, Homo sapiens
ctagaagttggggctagggata

SEQ ID NO: 7816933 - DNA, 20 bp, Homo sapiens
ctagaagtgcctcatctaga

SEQ ID NO: 7816934 - DNA, 22 bp, Homo sapiens
ctacatttggagagtataggaa

SEQ ID NO: 7816935 - DNA, 22 bp, Homo sapiens
ctacatttgttcaaataagctg

SEQ ID NO: 7816936 - DNA, 22 bp, Homo sapiens
ctacatttggagagtataggaa

SEQ ID NO: 7816937 - DNA, 22 bp, Homo sapiens
ctacatttgttcaaataagctg

SEQ ID NO: 7816938 - DNA, 22 bp, Homo sapiens
ctacatttgttcaaataagctg

SEQ ID NO: 7816939 - DNA, 22 bp, Homo sapiens
ctacatttgttcaaataagctg

SEQ ID NO: 7816940 - DNA, 22 bp, Homo sapiens
ctacatttgttcaaataagctg

SEQ ID NO: 7816941 - DNA, 22 bp, Homo sapiens
ctacatttcccagctgccttcc

SEQ ID NO: 7816942 - DNA, 22 bp, Homo sapiens
ctacatttcccagctgccttcc

SEQ ID NO: 7816943 - DNA, 22 bp, Homo sapiens
ctacatttggagagtataggaa

SEQ ID NO: 7816944 - DNA, 22 bp, Homo sapiens
ctacagaattcaacaaatggtt

SEQ ID NO: 7816945 - DNA, 22 bp, Homo sapiens
ctacatttcccagctgccttcc

SEQ ID NO: 7816946 - DNA, 22 bp, Homo sapiens
ctacagaatggagggtcagaga

SEQ ID NO: 7816947 - DNA, 22 bp, Homo sapiens
ctacagaattcaacaaatggtt

SEQ ID NO: 7816948 - DNA, 22 bp, Homo sapiens
ctacatttgttctatagctttt

SEQ ID NO: 7816949 - DNA, 22 bp, Homo sapiens
ctacatttgttctatagctttt

SEQ ID NO: 7816950 - DNA, 22 bp, Homo sapiens
ctacattttaataagctgctta

SEQ ID NO: 7816951 - DNA, 22 bp, Homo sapiens
ctacatttgttctatagctttt

SEQ ID NO: 7816952 - DNA, 22 bp, Homo sapiens
ctacatttgttctatagctttt

SEQ ID NO: 7816953 - DNA, 22 bp, Homo sapiens
ctacatttgttctatagctttt

SEQ ID NO: 7816954 - DNA, 22 bp, Homo sapiens
ctacatttgttcaaataagctg

SEQ ID NO: 7816955 - DNA, 22 bp, Homo sapiens
ctacattttgtgattatgaaat

SEQ ID NO: 7816956 - DNA, 22 bp, Homo sapiens
ctacattttgtgattatgaaat

SEQ ID NO: 7816957 - DNA, 22 bp, Homo sapiens
ctacattttaataagctgctta

SEQ ID NO: 7816958 - DNA, 22 bp, Homo sapiens
ctacattttaataagctgctta

SEQ ID NO: 7816959 - DNA, 22 bp, Homo sapiens
ctacattttgtgattatgaaat

SEQ ID NO: 7816960 - DNA, 22 bp, Homo sapiens
ctacattttaataagctgctta

SEQ ID NO: 7816961 - DNA, 22 bp, Homo sapiens
ctacatttttcaccgagcctct

SEQ ID NO: 7816962 - DNA, 22 bp, Homo sapiens
ctacatttttcaccgagcctct

SEQ ID NO: 7816963 - DNA, 22 bp, Homo sapiens
ctacatttttcaccgagcctct

SEQ ID NO: 7816964 - DNA, 22 bp, Homo sapiens
ctaccagcttctttgtctggga

SEQ ID NO: 7816965 - DNA, 22 bp, Homo sapiens
ctaccagcttctttgtctggga

SEQ ID NO: 7816966 - DNA, 22 bp, Homo sapiens
ctaccactggctctgtgacttt

SEQ ID NO: 7816967 - DNA, 22 bp, Homo sapiens
ctacattttgtgattatgaaat

SEQ ID NO: 7816968 - DNA, 22 bp, Homo sapiens
ctacccacaaggctttgggcac

SEQ ID NO: 7816969 - DNA, 22 bp, Homo sapiens
ctacccacaaggctttgggcac

SEQ ID NO: 7816970 - DNA, 22 bp, Homo sapiens
ctacccagcacctaggctgcct

SEQ ID NO: 7816971 - DNA, 22 bp, Homo sapiens
ctacccagcacctaggctgcct

SEQ ID NO: 7816972 - DNA, 22 bp, Homo sapiens
ctacccagatccaggatggcta

SEQ ID NO: 7816973 - DNA, 22 bp, Homo sapiens
ctagaaatattttacagtcaag

SEQ ID NO: 7816974 - DNA, 22 bp, Homo sapiens
ctagaaatctctgtttacatca

SEQ ID NO: 7816975 - DNA, 22 bp, Homo sapiens
ctagaaatctctgtttacatca

SEQ ID NO: 7816976 - DNA, 22 bp, Homo sapiens
ctagaaatattttacagtcaag

SEQ ID NO: 7816977 - DNA, 22 bp, Homo sapiens
ctagaaatctctgtttacatca

SEQ ID NO: 7816978 - DNA, 22 bp, Homo sapiens
ctagaaatctctgtttacatca

SEQ ID NO: 7816979 - DNA, 22 bp, Homo sapiens
ctagaaatctctgtttacatca

SEQ ID NO: 7816980 - DNA, 22 bp, Homo sapiens
ctagaaatctctgtttacatca

SEQ ID NO: 7816981 - DNA, 22 bp, Homo sapiens
ctagaaatgctcaagagaaagt

SEQ ID NO: 7816982 - DNA, 22 bp, Homo sapiens
ctagaaatgtagattcttagtg

SEQ ID NO: 7816983 - DNA, 22 bp, Homo sapiens
ctagaaattctgattcagtagg

SEQ ID NO: 7816984 - DNA, 22 bp, Homo sapiens
ctagaaattctgattcagtagg

SEQ ID NO: 7816985 - DNA, 22 bp, Homo sapiens
ctagaacaaattaggaggcata

SEQ ID NO: 7816986 - DNA, 22 bp, Homo sapiens
ctagaacaaattaggaggcata

SEQ ID NO: 7816987 - DNA, 22 bp, Homo sapiens
ctagaacagaaagtacaggaaa

SEQ ID NO: 7816988 - DNA, 22 bp, Homo sapiens
ctagaaattctgattcagtagg

SEQ ID NO: 7816989 - DNA, 22 bp, Homo sapiens
ctagaaattctgattcagtagg

SEQ ID NO: 7816990 - DNA, 22 bp, Homo sapiens
ctagaaattctgattcagtagg

SEQ ID NO: 7816991 - DNA, 22 bp, Homo sapiens
ctagaaattctgattcagtagg

SEQ ID NO: 7816992 - DNA, 22 bp, Homo sapiens
ctagaaatgtagattcttagtg

SEQ ID NO: 7816993 - DNA, 22 bp, Homo sapiens
ctagaaatgtagattcttagtg

SEQ ID NO: 7816994 - DNA, 22 bp, Homo sapiens
ctagaaatgtagattcttagtg

SEQ ID NO: 7816995 - DNA, 22 bp, Homo sapiens
agtatttagagacacaagatgg

SEQ ID NO: 7816996 - DNA, 22 bp, Homo sapiens
agtatttagcatagtggttagt

SEQ ID NO: 7816997 - DNA, 22 bp, Homo sapiens
agtatttagctgactcgctaca

SEQ ID NO: 7816998 - DNA, 22 bp, Homo sapiens
agtatttcagttactttaaaat

SEQ ID NO: 7816999 - DNA, 22 bp, Homo sapiens
agtatttcagttactttaaaat

SEQ ID NO: 7817000 - DNA, 22 bp, Homo sapiens
agtatttagctgactcgctaca

SEQ ID NO: 7817001 - DNA, 22 bp, Homo sapiens
agtatttagctgactcgctaca

SEQ ID NO: 7817002 - DNA, 21 bp, Homo sapiens
ctacagaatcgagcattctgg

SEQ ID NO: 7817003 - DNA, 22 bp, Homo sapiens
ctacagaatctacctcaagcca

SEQ ID NO: 7817004 - DNA, 22 bp, Homo sapiens
ctacagaatggagggtcagaga

SEQ ID NO: 7817005 - DNA, 22 bp, Homo sapiens
agtatttcctggcttatctgct

SEQ ID NO: 7817006 - DNA, 21 bp, Homo sapiens
agtatgtgttagggataattt

SEQ ID NO: 7817007 - DNA, 22 bp, Homo sapiens
agtatgttgagttttgctttag

SEQ ID NO: 7817008 - DNA, 22 bp, Homo sapiens
agtattaccctcagaacttgat

SEQ ID NO: 7817009 - DNA, 22 bp, Homo sapiens
agtattaccctcagaacttgat

SEQ ID NO: 7817010 - DNA, 23 bp, Homo sapiens
agtattcaaaaggcaagctatat

SEQ ID NO: 7817011 - DNA, 23 bp, Homo sapiens
agtattcaaaaggcaagctatat

SEQ ID NO: 7817012 - DNA, 23 bp, Homo sapiens
agtattcaaaaggcaagctatat

SEQ ID NO: 7817013 - DNA, 22 bp, Homo sapiens
agtattcagcaaacgtgaacag

SEQ ID NO: 7817014 - DNA, 22 bp, Homo sapiens
agtatttagagacacaagatgg

SEQ ID NO: 7817015 - DNA, 22 bp, Homo sapiens
agtatttagagacacaagatgg

SEQ ID NO: 7817016 - DNA, 22 bp, Homo sapiens
agtatttagagacacaagatgg

SEQ ID NO: 7817017 - DNA, 22 bp, Homo sapiens
agtatttagagacacaagacgg

SEQ ID NO: 7817018 - DNA, 22 bp, Homo sapiens
agtatttagagacacaagatgg

SEQ ID NO: 7817019 - DNA, 22 bp, Homo sapiens
agtattgtaaacttcctaagga

SEQ ID NO: 7817020 - DNA, 22 bp, Homo sapiens
agtatgtaattttcaatgtgtt

SEQ ID NO: 7817021 - DNA, 22 bp, Homo sapiens
agtatgtattttatacttacag

SEQ ID NO: 7817022 - DNA, 22 bp, Homo sapiens
agtatgtattttatacttacag

SEQ ID NO: 7817023 - DNA, 22 bp, Homo sapiens
agtatgtcagagtgaaaatggt

SEQ ID NO: 7817024 - DNA, 22 bp, Homo sapiens
agtatgtagtgcaatcagtcag

SEQ ID NO: 7817025 - DNA, 20 bp, Homo sapiens
agtatgtatatgtaacgtgt

SEQ ID NO: 7817026 - DNA, 22 bp, Homo sapiens
agtatgtcaatcttttgttgtt

SEQ ID NO: 7817027 - DNA, 19 bp, Homo sapiens
agtatgtctatgagtcttt

SEQ ID NO: 7817028 - DNA, 22 bp, Homo sapiens
ctaaggaattggagcatgtgtt

SEQ ID NO: 7817029 - DNA, 22 bp, Homo sapiens
agtatgaattgctttgcctgta

SEQ ID NO: 7817030 - DNA, 22 bp, Homo sapiens
agtatgcatatttcaaagtaag

SEQ ID NO: 7817031 - DNA, 22 bp, Homo sapiens
ctaaggaaatatgtcacttgct

SEQ ID NO: 7817032 - DNA, 22 bp, Homo sapiens
ctaaggaaaggaaatacagtaa

SEQ ID NO: 7817033 - DNA, 22 bp, Homo sapiens
ctaagcatccatctcttcttca

SEQ ID NO: 7817034 - DNA, 22 bp, Homo sapiens
ctaaggaaaaggatatatatgt

SEQ ID NO: 7817035 - DNA, 22 bp, Homo sapiens
ctaagcatccatctcttcttca

SEQ ID NO: 7817036 - DNA, 22 bp, Homo sapiens
ctaagcacaatgctttgagtat

SEQ ID NO: 7817037 - DNA, 22 bp, Homo sapiens
ctaagcacaatgctttgagtat

SEQ ID NO: 7817038 - DNA, 22 bp, Homo sapiens
ctaaggaatcctaaaacagctg

SEQ ID NO: 7817039 - DNA, 22 bp, Homo sapiens
ctaaggaagtgacagtgggatt

SEQ ID NO: 7817040 - DNA, 22 bp, Homo sapiens
ctaaggaattcaaatagttagt

SEQ ID NO: 7817041 - DNA, 22 bp, Homo sapiens
ctaaggaatcctaaaacagctg

SEQ ID NO: 7817042 - DNA, 22 bp, Homo sapiens
ctaaggaatcctaaaacagctg

SEQ ID NO: 7817043 - DNA, 22 bp, Homo sapiens
ctaaggaacagatgtcagcaga

SEQ ID NO: 7817044 - DNA, 22 bp, Homo sapiens
ctaaggaacaccaggagatggt

SEQ ID NO: 7817045 - DNA, 22 bp, Homo sapiens
ctaaggaagtgacagtgggatt

SEQ ID NO: 7817046 - DNA, 22 bp, Homo sapiens
ctaaggaaatatgtcacttgct

SEQ ID NO: 7817047 - DNA, 22 bp, Homo sapiens
ctaaggaacatcacaggccgtc

SEQ ID NO: 7817048 - DNA, 22 bp, Homo sapiens
ctaaggaacatcacaggccgtc

SEQ ID NO: 7817049 - DNA, 22 bp, Homo sapiens
ctaaggaacagatgtcagcaga

SEQ ID NO: 7817050 - DNA, 22 bp, Homo sapiens
cctgtgttagttatgggtctct

SEQ ID NO: 7817051 - DNA, 18 bp, Homo sapiens
cctgtgtgtgttgcaggc

SEQ ID NO: 7817052 - DNA, 18 bp, Homo sapiens
cctgtgtgtgttgcaggc

SEQ ID NO: 7817053 - DNA, 22 bp, Homo sapiens
cctgtgttagttatgggtctct

SEQ ID NO: 7817054 - DNA, 22 bp, Homo sapiens
cctgtgttagttatgggtctct

SEQ ID NO: 7817055 - DNA, 17 bp, Homo sapiens
cctgtgtttgctccttc

SEQ ID NO: 7817056 - DNA, 22 bp, Homo sapiens
cctgtgtttctgttggaattaa

SEQ ID NO: 7817057 - DNA, 22 bp, Homo sapiens
cctgttcaagggatgattgacc

SEQ ID NO: 7817058 - DNA, 21 bp, Homo sapiens
cctgttcacagatctgtaact

SEQ ID NO: 7817059 - DNA, 22 bp, Homo sapiens
cctgttcaccctccatgcacag

SEQ ID NO: 7817060 - DNA, 22 bp, Homo sapiens
cctgttcaatattcttccttgt

SEQ ID NO: 7817061 - DNA, 21 bp, Homo sapiens
cctgttcacagatctgtaact

SEQ ID NO: 7817062 - DNA, 22 bp, Homo sapiens
cctgttcaatgccctggcttca

SEQ ID NO: 7817063 - DNA, 19 bp, Homo sapiens
cctgttcttggctgaggct

SEQ ID NO: 7817064 - DNA, 19 bp, Homo sapiens
cctgttcttggctgaggct

SEQ ID NO: 7817065 - DNA, 22 bp, Homo sapiens
cctgttcattttttgactctgc

SEQ ID NO: 7817066 - DNA, 19 bp, Homo sapiens
cctgttcatgactctgtcc

SEQ ID NO: 7817067 - DNA, 19 bp, Homo sapiens
cctgttcatgactctgtcc

SEQ ID NO: 7817068 - DNA, 22 bp, Homo sapiens
cctgttcagagctaagcatcat

SEQ ID NO: 7817069 - DNA, 22 bp, Homo sapiens
cctgttcagagctaagcatcat

SEQ ID NO: 7817070 - DNA, 22 bp, Homo sapiens
cctgttcaccctccatgcacag

SEQ ID NO: 7817071 - DNA, 22 bp, Homo sapiens
cctgttcaccatggtcacgtgc

SEQ ID NO: 7817072 - DNA, 20 bp, Homo sapiens
cctgttcactgcgcagtttc

SEQ ID NO: 7817073 - DNA, 22 bp, Homo sapiens
cctgttcactgcacagtttccg

SEQ ID NO: 7817074 - DNA, 22 bp, Homo sapiens
cctgttcactttgacttctcca

SEQ ID NO: 7817075 - DNA, 22 bp, Homo sapiens
cgcaggcaagagagtacagtta

SEQ ID NO: 7817076 - DNA, 22 bp, Homo sapiens
cgcaggcaagagagtacagtta

SEQ ID NO: 7817077 - DNA, 22 bp, Homo sapiens
cgcaggcacagagtggacagcg

SEQ ID NO: 7817078 - DNA, 22 bp, Homo sapiens
cgcaggcaatgctccgcggggg

SEQ ID NO: 7817079 - DNA, 22 bp, Homo sapiens
cgcaggcaatgctccgcggggg

SEQ ID NO: 7817080 - DNA, 22 bp, Homo sapiens
cgcaggcacagagtggacagcg

SEQ ID NO: 7817081 - DNA, 22 bp, Homo sapiens
cgcaggcacagagtggacagcg

SEQ ID NO: 7817082 - DNA, 19 bp, Homo sapiens
cgcaggagccgaggtgacc

SEQ ID NO: 7817083 - DNA, 22 bp, Homo sapiens
cgcagctgtccatgtgtggggg

SEQ ID NO: 7817084 - DNA, 22 bp, Homo sapiens
cgcaggcaagagagtacagtta

SEQ ID NO: 7817085 - DNA, 19 bp, Homo sapiens
cgcaggagccgaggtgacc

SEQ ID NO: 7817086 - DNA, 19 bp, Homo sapiens
cgcaggagccgaggtgacc

SEQ ID NO: 7817087 - DNA, 22 bp, Homo sapiens
cgaggccatgcatgctgaggac

SEQ ID NO: 7817088 - DNA, 22 bp, Homo sapiens
cgaggccatgcatgctgaggac

SEQ ID NO: 7817089 - DNA, 22 bp, Homo sapiens
cctgttgtttactgcagtgagt

SEQ ID NO: 7817090 - DNA, 22 bp, Homo sapiens
cgaggccatgcatgctgaggac

SEQ ID NO: 7817091 - DNA, 22 bp, Homo sapiens
cgaggcggcggaagtgcccgta

SEQ ID NO: 7817092 - DNA, 22 bp, Homo sapiens
cgcagctgtccatgtgtggggg

SEQ ID NO: 7817093 - DNA, 22 bp, Homo sapiens
cctgttgtggaaaaagcctgat

SEQ ID NO: 7817094 - DNA, 22 bp, Homo sapiens
cctgttgtggaaaaagcctgat

SEQ ID NO: 7817095 - DNA, 20 bp, Homo sapiens
cctgttggatgaggtccaga

SEQ ID NO: 7817096 - DNA, 22 bp, Homo sapiens
cctgttgctctgcatgagttta

SEQ ID NO: 7817097 - DNA, 22 bp, Homo sapiens
cctgttggaaggtgtaggcccc

SEQ ID NO: 7817098 - DNA, 22 bp, Homo sapiens
cctgttgagagagctcactgag

SEQ ID NO: 7817099 - DNA, 22 bp, Homo sapiens
aggtttctgcactgtcactggt

SEQ ID NO: 7817100 - DNA, 22 bp, Homo sapiens
aggtttctgcagcatagtggca

SEQ ID NO: 7817101 - DNA, 22 bp, Homo sapiens
aggtttctgctgtcctccttct

SEQ ID NO: 7817102 - DNA, 22 bp, Homo sapiens
aggtttctgctgtcctccttct

SEQ ID NO: 7817103 - DNA, 22 bp, Homo sapiens
aggtttctgcaatgtgtgtaca

SEQ ID NO: 7817104 - DNA, 22 bp, Homo sapiens
cgcaggtgaactgttctgcagt

SEQ ID NO: 7817105 - DNA, 22 bp, Homo sapiens
cgcaggggaggaaggtacacct

SEQ ID NO: 7817106 - DNA, 22 bp, Homo sapiens
cgcaggggaggaaggtacacct

SEQ ID NO: 7817107 - DNA, 22 bp, Homo sapiens
cgcagggccgcgagcgggacca

SEQ ID NO: 7817108 - DNA, 22 bp, Homo sapiens
cgcagggccgcgagcgggacca

SEQ ID NO: 7817109 - DNA, 22 bp, Homo sapiens
cgcaggtgaaagaggctgggca

SEQ ID NO: 7817110 - DNA, 19 bp, Homo sapiens
cgcaggcttcgggtcgctc

SEQ ID NO: 7817111 - DNA, 22 bp, Homo sapiens
cgcaggctttagaatctgctac

SEQ ID NO: 7817112 - DNA, 22 bp, Homo sapiens
cgcagggatttcaaggggcctt

SEQ ID NO: 7817113 - DNA, 22 bp, Homo sapiens
cgcaggctcggttcacagagca

SEQ ID NO: 7817114 - DNA, 22 bp, Homo sapiens
cgcaggctcggttcacagagca

SEQ ID NO: 7817115 - DNA, 22 bp, Homo sapiens
cgcaggctggcgcggagtggca

SEQ ID NO: 7817116 - DNA, 22 bp, Homo sapiens
cgcaggctgcagccaagaagag

SEQ ID NO: 7817117 - DNA, 22 bp, Homo sapiens
agtaaaaagttcagaatggttg

SEQ ID NO: 7817118 - DNA, 22 bp, Homo sapiens
agtaaaaagttcagaatggttg

SEQ ID NO: 7817119 - DNA, 22 bp, Homo sapiens
aggttttcacaggaagtatgtt

SEQ ID NO: 7817120 - DNA, 22 bp, Homo sapiens
cggctcagctagcttggcccca

SEQ ID NO: 7817121 - DNA, 22 bp, Homo sapiens
aggttttggtgatcattggaga

SEQ ID NO: 7817122 - DNA, 22 bp, Homo sapiens
agtaaaaagttcagaatggttg

SEQ ID NO: 7817123 - DNA, 22 bp, Homo sapiens
aggtttgggagtagaaatcaga

SEQ ID NO: 7817124 - DNA, 22 bp, Homo sapiens
aggtttgggttcattgctggct

SEQ ID NO: 7817125 - DNA, 22 bp, Homo sapiens
aggtttgggttcattgctggct

SEQ ID NO: 7817126 - DNA, 22 bp, Homo sapiens
aggtttgggagtagaaatcaga

SEQ ID NO: 7817127 - DNA, 22 bp, Homo sapiens
aggtttggtttgacaagactga

SEQ ID NO: 7817128 - DNA, 22 bp, Homo sapiens
aggtttcttcttaggaatatgt

SEQ ID NO: 7817129 - DNA, 22 bp, Homo sapiens
aggtttctttatgctgctagaa

SEQ ID NO: 7817130 - DNA, 22 bp, Homo sapiens
aggtttcttcttaggaatatgt

SEQ ID NO: 7817131 - DNA, 22 bp, Homo sapiens
aggtttctttatgctgctagaa

SEQ ID NO: 7817132 - DNA, 22 bp, Homo sapiens
aggtttctttatgctgctagaa

SEQ ID NO: 7817133 - DNA, 22 bp, Homo sapiens
aggtttgaagacgtcattgagg

SEQ ID NO: 7817134 - DNA, 22 bp, Homo sapiens
aggtttctggaaaggttttgct

SEQ ID NO: 7817135 - DNA, 22 bp, Homo sapiens
aggtttctggatttattatggc

SEQ ID NO: 7817136 - DNA, 22 bp, Homo sapiens
aggtttctggatttattatggc

SEQ ID NO: 7817137 - DNA, 22 bp, Homo sapiens
agtacacagaattctacttgtt

SEQ ID NO: 7817138 - DNA, 22 bp, Homo sapiens
agtacacacagtagaatagagt

SEQ ID NO: 7817139 - DNA, 22 bp, Homo sapiens
agtacacacagtagaatagagt

SEQ ID NO: 7817140 - DNA, 22 bp, Homo sapiens
agtacacacagtagaatagagt

SEQ ID NO: 7817141 - DNA, 22 bp, Homo sapiens
agtacacagtagactttctcat

SEQ ID NO: 7817142 - DNA, 22 bp, Homo sapiens
agtacacaagacacatttaaaa

SEQ ID NO: 7817143 - DNA, 22 bp, Homo sapiens
agtacaatttaatgaagatagc

SEQ ID NO: 7817144 - DNA, 22 bp, Homo sapiens
agtacaatttaatgaagatagc

SEQ ID NO: 7817145 - DNA, 22 bp, Homo sapiens
agtacaattatatttagatggt

SEQ ID NO: 7817146 - DNA, 22 bp, Homo sapiens
agtacaattatatttagatggt

SEQ ID NO: 7817147 - DNA, 22 bp, Homo sapiens
agtacagatttagacacgatag

SEQ ID NO: 7817148 - DNA, 22 bp, Homo sapiens
agtacagatttagacacgatag

SEQ ID NO: 7817149 - DNA, 19 bp, Homo sapiens
agtacagaaaagagccctg

SEQ ID NO: 7817150 - DNA, 22 bp, Homo sapiens
agtacactatggtaactggagt

SEQ ID NO: 7817151 - DNA, 22 bp, Homo sapiens
agtacacagtatatggtgagat

SEQ ID NO: 7817152 - DNA, 22 bp, Homo sapiens
agtacagtgctcagtaatctaa

SEQ ID NO: 7817153 - DNA, 22 bp, Homo sapiens
agtacagcaccatgagcacagg

SEQ ID NO: 7817154 - DNA, 22 bp, Homo sapiens
ctaagcaagaatgagtgcaaca

SEQ ID NO: 7817155 - DNA, 21 bp, Homo sapiens
ctaagcaaggagcaggggtag

SEQ ID NO: 7817156 - DNA, 21 bp, Homo sapiens
ctaagcaaggagcaggggtag

SEQ ID NO: 7817157 - DNA, 22 bp, Homo sapiens
ctaagcaagaatgagtgcaaca

SEQ ID NO: 7817158 - DNA, 22 bp, Homo sapiens
ctaagcaagaatgagtgcaaca

SEQ ID NO: 7817159 - DNA, 22 bp, Homo sapiens
ctaagataaatgctttgatgaa

SEQ ID NO: 7817160 - DNA, 20 bp, Homo sapiens
ctaagaggtccttccacatc

SEQ ID NO: 7817161 - DNA, 22 bp, Homo sapiens
ctaagaggaagtactctgttat

SEQ ID NO: 7817162 - DNA, 22 bp, Homo sapiens
ctaagactctgcaaatcagctt

SEQ ID NO: 7817163 - DNA, 22 bp, Homo sapiens
ctaagaggaagtactctgttat

SEQ ID NO: 7817164 - DNA, 22 bp, Homo sapiens
ctaagaaatgttgtgaatgcca

SEQ ID NO: 7817165 - DNA, 22 bp, Homo sapiens
ctaagaaatgttgtgaatgcca

SEQ ID NO: 7817166 - DNA, 22 bp, Homo sapiens
ctaagaaatgttgtgaatgcca

SEQ ID NO: 7817167 - DNA, 22 bp, Homo sapiens
ctaagaaatgttgtgaatgcca

SEQ ID NO: 7817168 - DNA, 22 bp, Homo sapiens
ctaagaaatgttgtgaatgcca

SEQ ID NO: 7817169 - DNA, 22 bp, Homo sapiens
ctaagaaggaggaaaagtgcca

SEQ ID NO: 7817170 - DNA, 22 bp, Homo sapiens
ctaagacatgccctgcatgata

SEQ ID NO: 7817171 - DNA, 22 bp, Homo sapiens
cgggctccgggtctttgcagtc

SEQ ID NO: 7817172 - DNA, 21 bp, Homo sapiens
cgggctggccgggccctcacc

SEQ ID NO: 7817173 - DNA, 21 bp, Homo sapiens
cgggctggccgggccctcacc

SEQ ID NO: 7817174 - DNA, 22 bp, Homo sapiens
cgggctcaggaggaaacaggag

SEQ ID NO: 7817175 - DNA, 22 bp, Homo sapiens
cgggcgcactccgggcagctgt

SEQ ID NO: 7817176 - DNA, 22 bp, Homo sapiens
cgggcgcactccgggcagctgt

SEQ ID NO: 7817177 - DNA, 22 bp, Homo sapiens
cgggcgcactccgggcagctgt

SEQ ID NO: 7817178 - DNA, 22 bp, Homo sapiens
cgggcgcactccgggcagctgt

SEQ ID NO: 7817179 - DNA, 18 bp, Homo sapiens
cgggcgggcgcctggccc

SEQ ID NO: 7817180 - DNA, 18 bp, Homo sapiens
cgggcgggcgcctggccc

SEQ ID NO: 7817181 - DNA, 18 bp, Homo sapiens
cgggcgggcgcctggccc

SEQ ID NO: 7817182 - DNA, 20 bp, Homo sapiens
agtacaatgtatgattcaga

SEQ ID NO: 7817183 - DNA, 20 bp, Homo sapiens
agtacaatgtatgattcaga

SEQ ID NO: 7817184 - DNA, 20 bp, Homo sapiens
agtacaatgtatgattcaga

SEQ ID NO: 7817185 - DNA, 22 bp, Homo sapiens
agtacaatgtctgacacagtag

SEQ ID NO: 7817186 - DNA, 22 bp, Homo sapiens
agtacaagtgatgtggtaaaaa

SEQ ID NO: 7817187 - DNA, 22 bp, Homo sapiens
agtacaagtgatgtggtaaaaa

SEQ ID NO: 7817188 - DNA, 23 bp, Homo sapiens
agtacaataagtataattctttc

SEQ ID NO: 7817189 - DNA, 22 bp, Homo sapiens
agtacaagtagaatgctacaag

SEQ ID NO: 7817190 - DNA, 22 bp, Homo sapiens
agtacaaattatagcgcttgga

SEQ ID NO: 7817191 - DNA, 22 bp, Homo sapiens
agtacaagtagaatgctacaag

SEQ ID NO: 7817192 - DNA, 22 bp, Homo sapiens
agtacaagtagaatgctacaag

SEQ ID NO: 7817193 - DNA, 22 bp, Homo sapiens
agtacaagtagaatgctacaag

SEQ ID NO: 7817194 - DNA, 22 bp, Homo sapiens
agtacaaattatagcgcttgga

SEQ ID NO: 7817195 - DNA, 21 bp, Homo sapiens
cgggctggccgggccctcacc

SEQ ID NO: 7817196 - DNA, 21 bp, Homo sapiens
cgggctggccgggccctcacc

SEQ ID NO: 7817197 - DNA, 21 bp, Homo sapiens
cgggctggccgggccctcacc

SEQ ID NO: 7817198 - DNA, 22 bp, Homo sapiens
cggctcaggccacaggacggca

SEQ ID NO: 7817199 - DNA, 22 bp, Homo sapiens
cgggcaaggcgagactaggccc

SEQ ID NO: 7817200 - DNA, 22 bp, Homo sapiens
cgggcacacacttgacaggttc

SEQ ID NO: 7817201 - DNA, 22 bp, Homo sapiens
cgggcagcggcgtggccatggt

SEQ ID NO: 7817202 - DNA, 22 bp, Homo sapiens
cgggcagtgtggctccagagtc

SEQ ID NO: 7817203 - DNA, 22 bp, Homo sapiens
cgggcagtgtggctccagagtc

SEQ ID NO: 7817204 - DNA, 22 bp, Homo sapiens
cgggcagattgggaaggttcat

SEQ ID NO: 7817205 - DNA, 22 bp, Homo sapiens
cgggcagatcacacagggcttg

SEQ ID NO: 7817206 - DNA, 17 bp, Homo sapiens
cgggcatggagggcagg

SEQ ID NO: 7817207 - DNA, 17 bp, Homo sapiens
cgggcatggagggcagg

SEQ ID NO: 7817208 - DNA, 17 bp, Homo sapiens
cgggcatggagggcagg

SEQ ID NO: 7817209 - DNA, 17 bp, Homo sapiens
cgggcatggagggcagg

SEQ ID NO: 7817210 - DNA, 22 bp, Homo sapiens
cgggcagtgtggctccagagtc

SEQ ID NO: 7817211 - DNA, 17 bp, Homo sapiens
cgggcatggagggcagg

SEQ ID NO: 7817212 - DNA, 17 bp, Homo sapiens
cgggcatggagggcagg

SEQ ID NO: 7817213 - DNA, 17 bp, Homo sapiens
cgggcatggagggcagg

SEQ ID NO: 7817214 - DNA, 17 bp, Homo sapiens
cgggcccgcggccgctc

SEQ ID NO: 7817215 - DNA, 17 bp, Homo sapiens
cgggcccgcggccgctc

SEQ ID NO: 7817216 - DNA, 22 bp, Homo sapiens
cgggccctactcaaagcttgca

SEQ ID NO: 7817217 - DNA, 22 bp, Homo sapiens
cgggccctactcaaagcttgca

SEQ ID NO: 7817218 - DNA, 22 bp, Homo sapiens
cgggccctttaaggatgtgtcg

SEQ ID NO: 7817219 - DNA, 22 bp, Homo sapiens
cgggccctttaaggatgtgtcg

SEQ ID NO: 7817220 - DNA, 22 bp, Homo sapiens
cgggccctttaaggatgtgtcg

SEQ ID NO: 7817221 - DNA, 21 bp, Homo sapiens
aggtggggctgcacctctgct

SEQ ID NO: 7817222 - DNA, 21 bp, Homo sapiens
aggtggggctgcacctctgct

SEQ ID NO: 7817223 - DNA, 21 bp, Homo sapiens
aggtggggctgcacctctgct

SEQ ID NO: 7817224 - DNA, 21 bp, Homo sapiens
aggtggggctgcacctctgct

SEQ ID NO: 7817225 - DNA, 22 bp, Homo sapiens
aggtggggcccaccaatttgca

SEQ ID NO: 7817226 - DNA, 22 bp, Homo sapiens
aggtggggcccaccaatttgca

SEQ ID NO: 7817227 - DNA, 21 bp, Homo sapiens
aggtggggctgcacctctgct

SEQ ID NO: 7817228 - DNA, 22 bp, Homo sapiens
aggtggggcccaccaatttgca

SEQ ID NO: 7817229 - DNA, 22 bp, Homo sapiens
aggtggggccaaatgctacagt

SEQ ID NO: 7817230 - DNA, 22 bp, Homo sapiens
aggtggggccaaatgctacagt

SEQ ID NO: 7817231 - DNA, 22 bp, Homo sapiens
aggtggggccaaatgctacagt

SEQ ID NO: 7817232 - DNA, 22 bp, Homo sapiens
aggtggggccaaatgctacagt

SEQ ID NO: 7817233 - DNA, 22 bp, Homo sapiens
aggtggggccaaatgctacagt

SEQ ID NO: 7817234 - DNA, 22 bp, Homo sapiens
aggtggggccaaatgctacagt

SEQ ID NO: 7817235 - DNA, 22 bp, Homo sapiens
aggtggggagtatatgtaattg

SEQ ID NO: 7817236 - DNA, 22 bp, Homo sapiens
aggtggggaggagtgtctcttt

SEQ ID NO: 7817237 - DNA, 22 bp, Homo sapiens
aggtggggagtatatgtaattg

SEQ ID NO: 7817238 - DNA, 22 bp, Homo sapiens
aggtggggaggagtgtctcttt

SEQ ID NO: 7817239 - DNA, 22 bp, Homo sapiens
aggtggggaggagtgtctcttt

SEQ ID NO: 7817240 - DNA, 22 bp, Homo sapiens
aggtggggaggagtgtctcttt

SEQ ID NO: 7817241 - DNA, 22 bp, Homo sapiens
aggtggggaggagtgtctcttt

SEQ ID NO: 7817242 - DNA, 22 bp, Homo sapiens
aggtggggaggagtgtctcttt

SEQ ID NO: 7817243 - DNA, 22 bp, Homo sapiens
aggtgggcacacctcccttctc

SEQ ID NO: 7817244 - DNA, 22 bp, Homo sapiens
aggtgggcacagatggagaagt

SEQ ID NO: 7817245 - DNA, 22 bp, Homo sapiens
aggtggggaggagtgtctcttt

SEQ ID NO: 7817246 - DNA, 22 bp, Homo sapiens
aggtgggcaatgaggcctgagt

SEQ ID NO: 7817247 - DNA, 22 bp, Homo sapiens
aggtgggcacacctcccttctc

SEQ ID NO: 7817248 - DNA, 22 bp, Homo sapiens
aggtgggcacacctcccttctc

SEQ ID NO: 7817249 - DNA, 22 bp, Homo sapiens
aggtgggcaatgaggcctgagt

SEQ ID NO: 7817250 - DNA, 22 bp, Homo sapiens
cctgtgccaaaatctaggcagt

SEQ ID NO: 7817251 - DNA, 21 bp, Homo sapiens
cctgtgccaaagtgtgttagg

SEQ ID NO: 7817252 - DNA, 22 bp, Homo sapiens
cctgtgccagccccttctgctg

SEQ ID NO: 7817253 - DNA, 22 bp, Homo sapiens
cctgtgccagccccttctgctg

SEQ ID NO: 7817254 - DNA, 22 bp, Homo sapiens
cctgtgccagccccttctgctg

SEQ ID NO: 7817255 - DNA, 22 bp, Homo sapiens
cctgtgccaaaatctaggcagt

SEQ ID NO: 7817256 - DNA, 21 bp, Homo sapiens
cctgtgccaaagtgtgttagg

SEQ ID NO: 7817257 - DNA, 22 bp, Homo sapiens
cctgtgccaaaatctaggcagt

SEQ ID NO: 7817258 - DNA, 22 bp, Homo sapiens
cctgtgccaaaatctaggcagt

SEQ ID NO: 7817259 - DNA, 22 bp, Homo sapiens
cctgtgccaaaatctaggcagt

SEQ ID NO: 7817260 - DNA, 22 bp, Homo sapiens
cctgtgccaaaatctaggcagt

SEQ ID NO: 7817261 - DNA, 22 bp, Homo sapiens
cctgtgccaaaaggctgcttat

SEQ ID NO: 7817262 - DNA, 22 bp, Homo sapiens
cctgtgcattgagtttgcaccc

SEQ ID NO: 7817263 - DNA, 22 bp, Homo sapiens
cctgtgcattgagtttgcaccc

SEQ ID NO: 7817264 - DNA, 22 bp, Homo sapiens
cctgtgcattgcagggtgttca

SEQ ID NO: 7817265 - DNA, 22 bp, Homo sapiens
cctgtgcattgaccacactctc

SEQ ID NO: 7817266 - DNA, 22 bp, Homo sapiens
cctgtgcatgccagggtacacc

SEQ ID NO: 7817267 - DNA, 20 bp, Homo sapiens
cctgtctcacgttccgcccc

SEQ ID NO: 7817268 - DNA, 20 bp, Homo sapiens
cctgtctcacgttccgcccc

SEQ ID NO: 7817269 - DNA, 22 bp, Homo sapiens
cctgtctatcaagacatcttca

SEQ ID NO: 7817270 - DNA, 22 bp, Homo sapiens
cctgtctccctggcatggctca

SEQ ID NO: 7817271 - DNA, 22 bp, Homo sapiens
cctgtctaccagtcacttagcg

SEQ ID NO: 7817272 - DNA, 22 bp, Homo sapiens
cctgtctaccagtcacttagcg

SEQ ID NO: 7817273 - DNA, 22 bp, Homo sapiens
cctgtctacataactgtgtgaa

SEQ ID NO: 7817274 - DNA, 22 bp, Homo sapiens
cctgtcctccggagcgggctgt

SEQ ID NO: 7817275 - DNA, 22 bp, Homo sapiens
cctgtcctccaagagcacatct

SEQ ID NO: 7817276 - DNA, 22 bp, Homo sapiens
cctgtcctccaagagcacatct

SEQ ID NO: 7817277 - DNA, 22 bp, Homo sapiens
cctgtcctccaagagcacatct

SEQ ID NO: 7817278 - DNA, 22 bp, Homo sapiens
cctgtcctccaagagcacatct

SEQ ID NO: 7817279 - DNA, 22 bp, Homo sapiens
cctgtcctccaagagcacatct

SEQ ID NO: 7817280 - DNA, 22 bp, Homo sapiens
cctgtcccctcacaatgccact

SEQ ID NO: 7817281 - DNA, 22 bp, Homo sapiens
cctgtcccccaggcctgtacca

SEQ ID NO: 7817282 - DNA, 22 bp, Homo sapiens
cctgtcccaagcagggctggcc

SEQ ID NO: 7817283 - DNA, 22 bp, Homo sapiens
cctgtcccaagcagggctggcc

SEQ ID NO: 7817284 - DNA, 22 bp, Homo sapiens
cctgtcccccaggcctgtacca

SEQ ID NO: 7817285 - DNA, 22 bp, Homo sapiens
cctgtcccccaggcctgtacca

SEQ ID NO: 7817286 - DNA, 20 bp, Homo sapiens
cctgtcatcccagcattttg

SEQ ID NO: 7817287 - DNA, 22 bp, Homo sapiens
cctgtcattttctcctgtcagc

SEQ ID NO: 7817288 - DNA, 22 bp, Homo sapiens
cctgtcatttttatcaatgtct

SEQ ID NO: 7817289 - DNA, 22 bp, Homo sapiens
cctgtcatatacatacctcctc

SEQ ID NO: 7817290 - DNA, 22 bp, Homo sapiens
cctgtcatactaacgtagtggg

SEQ ID NO: 7817291 - DNA, 22 bp, Homo sapiens
cctgtgatggtgttacactgtt

SEQ ID NO: 7817292 - DNA, 19 bp, Homo sapiens
cctgtgcacatgtgtcctt

SEQ ID NO: 7817293 - DNA, 22 bp, Homo sapiens
cctgtgcaatgttgaggtttca

SEQ ID NO: 7817294 - DNA, 22 bp, Homo sapiens
cctgtgagtcaacccctccttg

SEQ ID NO: 7817295 - DNA, 22 bp, Homo sapiens
cctgtgcaggctccataataga

SEQ ID NO: 7817296 - DNA, 22 bp, Homo sapiens
cctgtgcagcccttgccagttt

SEQ ID NO: 7817297 - DNA, 22 bp, Homo sapiens
cctgtgcactatctgcattttt

SEQ ID NO: 7817298 - DNA, 22 bp, Homo sapiens
cctgtgcaatgttgaggtttca

SEQ ID NO: 7817299 - DNA, 22 bp, Homo sapiens
cctgtgcatgccagggtacacc

SEQ ID NO: 7817300 - DNA, 22 bp, Homo sapiens
cctgtgcatccggtggtcattg

SEQ ID NO: 7817301 - DNA, 22 bp, Homo sapiens
cctgtgactctgtctgatggtc

SEQ ID NO: 7817302 - DNA, 22 bp, Homo sapiens
cctgtgacttggcaaacctcca

SEQ ID NO: 7817303 - DNA, 22 bp, Homo sapiens
cctgtgaggtcttgcatgtgaa

SEQ ID NO: 7817304 - DNA, 22 bp, Homo sapiens
cctgtgaggtcttgcatgtgaa

SEQ ID NO: 7817305 - DNA, 22 bp, Homo sapiens
cctgtgaggtcatctgtggtaa

SEQ ID NO: 7817306 - DNA, 22 bp, Homo sapiens
cctgtgagagggcgagtgtaga

SEQ ID NO: 7817307 - DNA, 22 bp, Homo sapiens
cctgtgacgtgtctcctggcac

SEQ ID NO: 7817308 - DNA, 22 bp, Homo sapiens
cctgtgacgtgtctcctggcac

SEQ ID NO: 7817309 - DNA, 22 bp, Homo sapiens
cctgtgacccttccagtctact

SEQ ID NO: 7817310 - DNA, 19 bp, Homo sapiens
cctgtgactatctttgtaa

SEQ ID NO: 7817311 - DNA, 20 bp, Homo sapiens
cctgtctcctcttacctggc

SEQ ID NO: 7817312 - DNA, 22 bp, Homo sapiens
cctgtgacattagaatttcatt

SEQ ID NO: 7817313 - DNA, 22 bp, Homo sapiens
cctgtgaccactctggttctgc

SEQ ID NO: 7817314 - DNA, 22 bp, Homo sapiens
cctgtgacattagaatttcatt

SEQ ID NO: 7817315 - DNA, 22 bp, Homo sapiens
cctgggcttgcatctgtgctgg

SEQ ID NO: 7817316 - DNA, 22 bp, Homo sapiens
cctgggcttgcatctgtgctgg

SEQ ID NO: 7817317 - DNA, 22 bp, Homo sapiens
cctgggcttgcatctgtgctgg

SEQ ID NO: 7817318 - DNA, 22 bp, Homo sapiens
cctgggcttctgtctagatgtt

SEQ ID NO: 7817319 - DNA, 22 bp, Homo sapiens
cctgggcttctgtctagatgtt

SEQ ID NO: 7817320 - DNA, 22 bp, Homo sapiens
cctgggcttctgtctagatgtt

SEQ ID NO: 7817321 - DNA, 22 bp, Homo sapiens
cctgggcttctgtctagatgtt

SEQ ID NO: 7817322 - DNA, 22 bp, Homo sapiens
cctgggcttgcatctgtgctgg

SEQ ID NO: 7817323 - DNA, 22 bp, Homo sapiens
cctgggcttctgtctagatgtt

SEQ ID NO: 7817324 - DNA, 22 bp, Homo sapiens
cctgggcttggttgttgagaac

SEQ ID NO: 7817325 - DNA, 22 bp, Homo sapiens
cctgggcttggttgttgagaac

SEQ ID NO: 7817326 - DNA, 22 bp, Homo sapiens
cctgggcttggttgttgagaac

SEQ ID NO: 7817327 - DNA, 22 bp, Homo sapiens
cctgggcttggttgttgagaac

SEQ ID NO: 7817328 - DNA, 22 bp, Homo sapiens
cctgggcttgcatctgtgctgg

SEQ ID NO: 7817329 - DNA, 22 bp, Homo sapiens
cctgggcttgcatctgtgctgg

SEQ ID NO: 7817330 - DNA, 22 bp, Homo sapiens
cctgggcttgcatctgtgctgg

SEQ ID NO: 7817331 - DNA, 22 bp, Homo sapiens
cctgggcttggttgttgagaac

SEQ ID NO: 7817332 - DNA, 20 bp, Homo sapiens
cctgggctccaggagccccg

SEQ ID NO: 7817333 - DNA, 20 bp, Homo sapiens
cctgggctccaggagccccg

SEQ ID NO: 7817334 - DNA, 20 bp, Homo sapiens
cctgggctccaggagccccg

SEQ ID NO: 7817335 - DNA, 22 bp, Homo sapiens
cctgggcttctgtctagatgtt

SEQ ID NO: 7817336 - DNA, 22 bp, Homo sapiens
cctgggctcgcgcacttcaccc

SEQ ID NO: 7817337 - DNA, 22 bp, Homo sapiens
cctgggcttctgtctagatgtt

SEQ ID NO: 7817338 - DNA, 22 bp, Homo sapiens
cctgggcttctgtctagatgtt

SEQ ID NO: 7817339 - DNA, 22 bp, Homo sapiens
cctgggctcgcgcacttcaccc

SEQ ID NO: 7817340 - DNA, 22 bp, Homo sapiens
cctgggctcgcgcacttcaccc

SEQ ID NO: 7817341 - DNA, 22 bp, Homo sapiens
cctggtgctgctatcaggggta

SEQ ID NO: 7817342 - DNA, 22 bp, Homo sapiens
cctggtgccggtagacgcgcag

SEQ ID NO: 7817343 - DNA, 22 bp, Homo sapiens
cctgtcagggtttgcctcagaa

SEQ ID NO: 7817344 - DNA, 22 bp, Homo sapiens
cctgtcagttgctgtcagggat

SEQ ID NO: 7817345 - DNA, 22 bp, Homo sapiens
cctgtcagttgctgtcagggat

SEQ ID NO: 7817346 - DNA, 22 bp, Homo sapiens
cctgtcagggtttgcctcagaa

SEQ ID NO: 7817347 - DNA, 22 bp, Homo sapiens
cctgtcagttgctgtcagggat

SEQ ID NO: 7817348 - DNA, 22 bp, Homo sapiens
cctgtcagttgctgtcagggat

SEQ ID NO: 7817349 - DNA, 22 bp, Homo sapiens
cctgggctttgagggcaggatg

SEQ ID NO: 7817350 - DNA, 22 bp, Homo sapiens
cctgggctttgagggcaggatg

SEQ ID NO: 7817351 - DNA, 22 bp, Homo sapiens
cctgggctttgagggcaggatg

SEQ ID NO: 7817352 - DNA, 22 bp, Homo sapiens
cctgggctttcggcggcttcct

SEQ ID NO: 7817353 - DNA, 22 bp, Homo sapiens
cctgggctttcggcggcttcct

SEQ ID NO: 7817354 - DNA, 22 bp, Homo sapiens
cctgggctttcggcggcttcct

SEQ ID NO: 7817355 - DNA, 22 bp, Homo sapiens
cctgggctttcggcggcttcct

SEQ ID NO: 7817356 - DNA, 22 bp, Homo sapiens
cctgggctttcggcggcttcct

SEQ ID NO: 7817357 - DNA, 22 bp, Homo sapiens
cctgggctttcggcggcttcct

SEQ ID NO: 7817358 - DNA, 22 bp, Homo sapiens
cctgggctttcaaaaccagcct

SEQ ID NO: 7817359 - DNA, 22 bp, Homo sapiens
cctgggctttcaaaaccagcct

SEQ ID NO: 7817360 - DNA, 22 bp, Homo sapiens
cctgggctttcaaaaccagcct

SEQ ID NO: 7817361 - DNA, 22 bp, Homo sapiens
cctggctctggggcggacagct

SEQ ID NO: 7817362 - DNA, 22 bp, Homo sapiens
cctggctctggggcggacagct

SEQ ID NO: 7817363 - DNA, 22 bp, Homo sapiens
cctggctctggttccctcagct

SEQ ID NO: 7817364 - DNA, 22 bp, Homo sapiens
cctggctctggttccctcagct

SEQ ID NO: 7817365 - DNA, 22 bp, Homo sapiens
cctggctctggtgaggagaagt

SEQ ID NO: 7817366 - DNA, 22 bp, Homo sapiens
cctggctctggtgaggagaagt

SEQ ID NO: 7817367 - DNA, 22 bp, Homo sapiens
cctggctctgcgtgcagctccg

SEQ ID NO: 7817368 - DNA, 22 bp, Homo sapiens
cctggctctgcgtgcagctccg

SEQ ID NO: 7817369 - DNA, 22 bp, Homo sapiens
cctggctctgcgtgcagctccg

SEQ ID NO: 7817370 - DNA, 22 bp, Homo sapiens
cctggctctgcgtgcagctccg

SEQ ID NO: 7817371 - DNA, 22 bp, Homo sapiens
cctggctctgcgtgcagctccg

SEQ ID NO: 7817372 - DNA, 22 bp, Homo sapiens
cctggctctgggatcttcgctt

SEQ ID NO: 7817373 - DNA, 22 bp, Homo sapiens
cctggctctgggatcttcgctt

SEQ ID NO: 7817374 - DNA, 22 bp, Homo sapiens
cctggctctgggatcttcgctt

SEQ ID NO: 7817375 - DNA, 22 bp, Homo sapiens
cctggctctggttccctcagct

SEQ ID NO: 7817376 - DNA, 22 bp, Homo sapiens
cctggctctggttccctcagct

SEQ ID NO: 7817377 - DNA, 22 bp, Homo sapiens
cctggctctgtcctcgcgcaaa

SEQ ID NO: 7817378 - DNA, 22 bp, Homo sapiens
cctggctctgtcctcgcgcaaa

SEQ ID NO: 7817379 - DNA, 22 bp, Homo sapiens
cctggctctgtcctcgcgcaaa

SEQ ID NO: 7817380 - DNA, 22 bp, Homo sapiens
cctgggcataaatcactccaag

SEQ ID NO: 7817381 - DNA, 22 bp, Homo sapiens
cctgggcataaatcactccaag

SEQ ID NO: 7817382 - DNA, 22 bp, Homo sapiens
cctgggctcaagtgatggtccc

SEQ ID NO: 7817383 - DNA, 22 bp, Homo sapiens
cctgggctcaagtgatcctcct

SEQ ID NO: 7817384 - DNA, 22 bp, Homo sapiens
cctgggctcaagtgatggtccc

SEQ ID NO: 7817385 - DNA, 22 bp, Homo sapiens
cctgggctcaagtgatggtccc

SEQ ID NO: 7817386 - DNA, 22 bp, Homo sapiens
cctgggctcaagtgatggtccc

SEQ ID NO: 7817387 - DNA, 22 bp, Homo sapiens
cctgggctcaagtgatggtccc

SEQ ID NO: 7817388 - DNA, 22 bp, Homo sapiens
cctgggctcacagccaaggctc

SEQ ID NO: 7817389 - DNA, 22 bp, Homo sapiens
cctgggctcacagccaaggctc

SEQ ID NO: 7817390 - DNA, 22 bp, Homo sapiens
cctgggctcaagtgatggtccc

SEQ ID NO: 7817391 - DNA, 22 bp, Homo sapiens
cctgggctcaagtgatggtccc

SEQ ID NO: 7817392 - DNA, 22 bp, Homo sapiens
cctgggctcaagtgatggtccc

SEQ ID NO: 7817393 - DNA, 22 bp, Homo sapiens
cctgggctcaccatgccttgga

SEQ ID NO: 7817394 - DNA, 22 bp, Homo sapiens
cctgggctcaccatgccttgga

SEQ ID NO: 7817395 - DNA, 22 bp, Homo sapiens
cctgggctcacagccaaggctc

SEQ ID NO: 7817396 - DNA, 22 bp, Homo sapiens
cctgggctcacagccaaggctc

SEQ ID NO: 7817397 - DNA, 22 bp, Homo sapiens
cctgggctcacagccaaggctc

SEQ ID NO: 7817398 - DNA, 22 bp, Homo sapiens
cctgggctcacagccaaggctc

SEQ ID NO: 7817399 - DNA, 22 bp, Homo sapiens
cctgggctccactccaagagca

SEQ ID NO: 7817400 - DNA, 22 bp, Homo sapiens
cctgggctccactccaagagca

SEQ ID NO: 7817401 - DNA, 22 bp, Homo sapiens
cctgggctccactccaagagca

SEQ ID NO: 7817402 - DNA, 22 bp, Homo sapiens
cctgggctccactccaagagca

SEQ ID NO: 7817403 - DNA, 22 bp, Homo sapiens
cctgggctccactccaagagca

SEQ ID NO: 7817404 - DNA, 22 bp, Homo sapiens
cctgggctccactccaagagca

SEQ ID NO: 7817405 - DNA, 22 bp, Homo sapiens
cctgggctccactccaagagca

SEQ ID NO: 7817406 - DNA, 20 bp, Homo sapiens
cctgggctccaggagccccg

SEQ ID NO: 7817407 - DNA, 22 bp, Homo sapiens
cctgggctcaggcttgggcagc

SEQ ID NO: 7817408 - DNA, 22 bp, Homo sapiens
cctgggctcaggcttgggcagc

SEQ ID NO: 7817409 - DNA, 22 bp, Homo sapiens
cctgggctcaggcttgggcagc

SEQ ID NO: 7817410 - DNA, 22 bp, Homo sapiens
cctgggctcaccatgccttgga

SEQ ID NO: 7817411 - DNA, 22 bp, Homo sapiens
cctgggctcaggcttgggcagc

SEQ ID NO: 7817412 - DNA, 22 bp, Homo sapiens
aggtaggatagataggaagacc

SEQ ID NO: 7817413 - DNA, 22 bp, Homo sapiens
aggtaggatgggtggagatgat

SEQ ID NO: 7817414 - DNA, 21 bp, Homo sapiens
aggtacaggtcttgtgagtct

SEQ ID NO: 7817415 - DNA, 22 bp, Homo sapiens
aggtacagggtgaaagtttatg

SEQ ID NO: 7817416 - DNA, 22 bp, Homo sapiens
aggtaggagttgatggatgttc

SEQ ID NO: 7817417 - DNA, 22 bp, Homo sapiens
aggtaggatagataggaagacc

SEQ ID NO: 7817418 - DNA, 22 bp, Homo sapiens
aggtaggatagataggaagacc

SEQ ID NO: 7817419 - DNA, 22 bp, Homo sapiens
cctgccagcgcttatctctcgg

SEQ ID NO: 7817420 - DNA, 22 bp, Homo sapiens
cctgccagctgtgggccagcct

SEQ ID NO: 7817421 - DNA, 22 bp, Homo sapiens
cctgccagctgtgggccagcct

SEQ ID NO: 7817422 - DNA, 22 bp, Homo sapiens
cctgccagctgtgggccagcct

SEQ ID NO: 7817423 - DNA, 22 bp, Homo sapiens
cctgccagctgtgggccagcct

SEQ ID NO: 7817424 - DNA, 21 bp, Homo sapiens
cctgccaggaaactgagtgtc

SEQ ID NO: 7817425 - DNA, 21 bp, Homo sapiens
cctgccaggaaactgagtgtc

SEQ ID NO: 7817426 - DNA, 21 bp, Homo sapiens
cctgccaggaaactgagtgtc

SEQ ID NO: 7817427 - DNA, 21 bp, Homo sapiens
cctgccaggaaactgagtgtc

SEQ ID NO: 7817428 - DNA, 21 bp, Homo sapiens
cctgccaggaaactgagtgtc

SEQ ID NO: 7817429 - DNA, 22 bp, Homo sapiens
aggtagggaagaaggcatgaaa

SEQ ID NO: 7817430 - DNA, 22 bp, Homo sapiens
aggtagggaagaaggcatgaaa

SEQ ID NO: 7817431 - DNA, 22 bp, Homo sapiens
aggtaggcctgacgctggggtg

SEQ ID NO: 7817432 - DNA, 22 bp, Homo sapiens
aggtagggaagaaggcatgaaa

SEQ ID NO: 7817433 - DNA, 22 bp, Homo sapiens
aggtagggaagaaggcatgaaa

SEQ ID NO: 7817434 - DNA, 22 bp, Homo sapiens
aggtagggaagaaggcatgaaa

SEQ ID NO: 7817435 - DNA, 22 bp, Homo sapiens
aggtagggaagaaggcatgaaa

SEQ ID NO: 7817436 - DNA, 22 bp, Homo sapiens
aggtagggaagaaggcatgaaa

SEQ ID NO: 7817437 - DNA, 22 bp, Homo sapiens
aggtaggcctgaaagtgacagc

SEQ ID NO: 7817438 - DNA, 22 bp, Homo sapiens
aggtaggccctgagtgctgttg

SEQ ID NO: 7817439 - DNA, 19 bp, Homo sapiens
aggtaggcagtggcatgga

SEQ ID NO: 7817440 - DNA, 23 bp, Homo sapiens
aggtaggttattgctgctacctg

SEQ ID NO: 7817441 - DNA, 23 bp, Homo sapiens
aggtaggttattgctgctacctg

SEQ ID NO: 7817442 - DNA, 23 bp, Homo sapiens
aggtaggttattgctgctacctg

SEQ ID NO: 7817443 - DNA, 23 bp, Homo sapiens
aggtaggttattgctgctacctg

SEQ ID NO: 7817444 - DNA, 23 bp, Homo sapiens
aggtaggttattgctgctacctg

SEQ ID NO: 7817445 - DNA, 23 bp, Homo sapiens
aggtaggttattgctgctacctg

SEQ ID NO: 7817446 - DNA, 22 bp, Homo sapiens
aggtagggttaatggagatata

SEQ ID NO: 7817447 - DNA, 22 bp, Homo sapiens
aggtagggggtttgggaactgc

SEQ ID NO: 7817448 - DNA, 22 bp, Homo sapiens
aggtagggggtttgggaactgc

SEQ ID NO: 7817449 - DNA, 22 bp, Homo sapiens
aggtagggttaatggagatata

SEQ ID NO: 7817450 - DNA, 22 bp, Homo sapiens
aggtagggggtttgggaactgc

SEQ ID NO: 7817451 - DNA, 22 bp, Homo sapiens
aggtagggttaatggagatata

SEQ ID NO: 7817452 - DNA, 22 bp, Homo sapiens
cctgcagagcaggagaggcatc

SEQ ID NO: 7817453 - DNA, 22 bp, Homo sapiens
cctgcagagccacgtgccagcg

SEQ ID NO: 7817454 - DNA, 22 bp, Homo sapiens
cctgcagagccacgtgccagcg

SEQ ID NO: 7817455 - DNA, 22 bp, Homo sapiens
cctgcagaccacactcagtcct

SEQ ID NO: 7817456 - DNA, 22 bp, Homo sapiens
cctgcagagcaggagaggcatc

SEQ ID NO: 7817457 - DNA, 22 bp, Homo sapiens
cctgcagagcaggagaggcatc

SEQ ID NO: 7817458 - DNA, 22 bp, Homo sapiens
cctgcagagggactggcaggaa

SEQ ID NO: 7817459 - DNA, 22 bp, Homo sapiens
cctgcagagggagggccttatt

SEQ ID NO: 7817460 - DNA, 22 bp, Homo sapiens
cctgcagaggtcaggccagaaa

SEQ ID NO: 7817461 - DNA, 22 bp, Homo sapiens
cctgcagagggactggcaggaa

SEQ ID NO: 7817462 - DNA, 22 bp, Homo sapiens
cctgcagagggactggcaggaa

SEQ ID NO: 7817463 - DNA, 22 bp, Homo sapiens
cctgcagagccacgtgccagcg

SEQ ID NO: 7817464 - DNA, 22 bp, Homo sapiens
cctgcagagccacgtgccagcg

SEQ ID NO: 7817465 - DNA, 22 bp, Homo sapiens
cctgcagagggactggcaggaa

SEQ ID NO: 7817466 - DNA, 22 bp, Homo sapiens
cctgcagagggactggcaggaa

SEQ ID NO: 7817467 - DNA, 21 bp, Homo sapiens
cctgcagcaccagaaggagat

SEQ ID NO: 7817468 - DNA, 21 bp, Homo sapiens
cctgcagcaccagaaggagat

SEQ ID NO: 7817469 - DNA, 18 bp, Homo sapiens
cctgcagcccaggaggcc

SEQ ID NO: 7817470 - DNA, 22 bp, Homo sapiens
cctgcagcagctgaaatcacag

SEQ ID NO: 7817471 - DNA, 22 bp, Homo sapiens
cctgcagcagctgaaatcacag

SEQ ID NO: 7817472 - DNA, 18 bp, Homo sapiens
cctgcagcccaggaggcc

SEQ ID NO: 7817473 - DNA, 18 bp, Homo sapiens
cctgcagcccaggaggcc

SEQ ID NO: 7817474 - DNA, 22 bp, Homo sapiens
cctgcagaggtcaggccagaaa

SEQ ID NO: 7817475 - DNA, 22 bp, Homo sapiens
cctgcagaggtcaggccagaaa

SEQ ID NO: 7817476 - DNA, 22 bp, Homo sapiens
cctgcagaggtcaggccagaaa

SEQ ID NO: 7817477 - DNA, 22 bp, Homo sapiens
cctgcagatgtgggacagctgt

SEQ ID NO: 7817478 - DNA, 21 bp, Homo sapiens
cctgcagcaccagaaggagat

SEQ ID NO: 7817479 - DNA, 22 bp, Homo sapiens
cctgcagatgtgggacagctgt

SEQ ID NO: 7817480 - DNA, 23 bp, Homo sapiens
cctgcagctgctggggctccacc

SEQ ID NO: 7817481 - DNA, 23 bp, Homo sapiens
cctgcagctgctggggctccacc

SEQ ID NO: 7817482 - DNA, 22 bp, Homo sapiens
cctgccagatcccctgagctga

SEQ ID NO: 7817483 - DNA, 22 bp, Homo sapiens
cctgccagatcccctgagctga

SEQ ID NO: 7817484 - DNA, 22 bp, Homo sapiens
cctgccagatcccctgagctga

SEQ ID NO: 7817485 - DNA, 22 bp, Homo sapiens
cctgcagccgtcctgtttgtct

SEQ ID NO: 7817486 - DNA, 22 bp, Homo sapiens
cctgcagcctcttctgaaaatc

SEQ ID NO: 7817487 - DNA, 23 bp, Homo sapiens
cctgcagctgccacgccctgctc

SEQ ID NO: 7817488 - DNA, 22 bp, Homo sapiens
cctgcagctccggatttctggg

SEQ ID NO: 7817489 - DNA, 23 bp, Homo sapiens
cctgcagctgccacgccctgctc

SEQ ID NO: 7817490 - DNA, 23 bp, Homo sapiens
cctgcagctgctggggctccacc

SEQ ID NO: 7817491 - DNA, 23 bp, Homo sapiens
cctgcagctgccacgccctgctc

SEQ ID NO: 7817492 - DNA, 22 bp, Homo sapiens
cctgccagccagatcactcgcc

SEQ ID NO: 7817493 - DNA, 22 bp, Homo sapiens
cctgccagcatcttcagcccct

SEQ ID NO: 7817494 - DNA, 22 bp, Homo sapiens
cctgccagatcccctgagctga

SEQ ID NO: 7817495 - DNA, 22 bp, Homo sapiens
cctgccagcccccatagagaca

SEQ ID NO: 7817496 - DNA, 22 bp, Homo sapiens
cctgccagcccgcgttcatgcc

SEQ ID NO: 7817497 - DNA, 22 bp, Homo sapiens
cctgccagcccccatagagaca

SEQ ID NO: 7817498 - DNA, 22 bp, Homo sapiens
cctggcacacggtggcattcaa

SEQ ID NO: 7817499 - DNA, 22 bp, Homo sapiens
cctggcacagagcggtggtcac

SEQ ID NO: 7817500 - DNA, 22 bp, Homo sapiens
aggtcatagagatgctgtttca

SEQ ID NO: 7817501 - DNA, 22 bp, Homo sapiens
aggtcataatcagttattcaaa

SEQ ID NO: 7817502 - DNA, 22 bp, Homo sapiens
aggtcatgggctggagcactgc

SEQ ID NO: 7817503 - DNA, 18 bp, Homo sapiens
aggtcatggtcatgggcg

SEQ ID NO: 7817504 - DNA, 22 bp, Homo sapiens
aggtcattaaagttaaatgagg

SEQ ID NO: 7817505 - DNA, 22 bp, Homo sapiens
aggtccagttttctgacaaggg

SEQ ID NO: 7817506 - DNA, 22 bp, Homo sapiens
aggtccagttttctgacaaggg

SEQ ID NO: 7817507 - DNA, 22 bp, Homo sapiens
aggtccagttttctgacaaggg

SEQ ID NO: 7817508 - DNA, 19 bp, Homo sapiens
aggtcattgatagtgcagg

SEQ ID NO: 7817509 - DNA, 22 bp, Homo sapiens
cctggcaagtgggctcccagat

SEQ ID NO: 7817510 - DNA, 22 bp, Homo sapiens
cctggcaagtcagaaccagcac

SEQ ID NO: 7817511 - DNA, 22 bp, Homo sapiens
cctggcaacatttcaaggtctt

SEQ ID NO: 7817512 - DNA, 22 bp, Homo sapiens
cctggattggctgcccatgctc

SEQ ID NO: 7817513 - DNA, 22 bp, Homo sapiens
cctggcaacatttcaaggtctt

SEQ ID NO: 7817514 - DNA, 22 bp, Homo sapiens
cctggattcaagtgtctattcc

SEQ ID NO: 7817515 - DNA, 22 bp, Homo sapiens
cctggattctcactggactcca

SEQ ID NO: 7817516 - DNA, 22 bp, Homo sapiens
cctggattctgctggccacttt

SEQ ID NO: 7817517 - DNA, 22 bp, Homo sapiens
cctggatgatccatgtcatgga

SEQ ID NO: 7817518 - DNA, 22 bp, Homo sapiens
cctggattataggccctctgaa

SEQ ID NO: 7817519 - DNA, 22 bp, Homo sapiens
cctggattataggccctctgaa

SEQ ID NO: 7817520 - DNA, 22 bp, Homo sapiens
cctggattcaagtctttctttc

SEQ ID NO: 7817521 - DNA, 23 bp, Homo sapiens
cctggcacacagttgacatggaa

SEQ ID NO: 7817522 - DNA, 23 bp, Homo sapiens
cctggcacacagttgacatggaa

SEQ ID NO: 7817523 - DNA, 22 bp, Homo sapiens
cctggcaagtgggctcccagat

SEQ ID NO: 7817524 - DNA, 22 bp, Homo sapiens
cctggcacaagagcagcattgg

SEQ ID NO: 7817525 - DNA, 22 bp, Homo sapiens
cctggcacaagagcagcattgg

SEQ ID NO: 7817526 - DNA, 22 bp, Homo sapiens
cctggcacaagagcagcattgg

SEQ ID NO: 7817527 - DNA, 22 bp, Homo sapiens
cctggagttgaaggaaggtggg

SEQ ID NO: 7817528 - DNA, 22 bp, Homo sapiens
cctggagtggggtccgtgcatg

SEQ ID NO: 7817529 - DNA, 22 bp, Homo sapiens
cctggagtggggtccgtgcatg

SEQ ID NO: 7817530 - DNA, 22 bp, Homo sapiens
cctggatctaaggaagctggga

SEQ ID NO: 7817531 - DNA, 22 bp, Homo sapiens
cctggatcgatgccgagggaaa

SEQ ID NO: 7817532 - DNA, 16 bp, Homo sapiens
cctggatcccctgtgg

SEQ ID NO: 7817533 - DNA, 22 bp, Homo sapiens
cctggatcccgatggctgtgag

SEQ ID NO: 7817534 - DNA, 22 bp, Homo sapiens
cctggatcccgatggctgtgag

SEQ ID NO: 7817535 - DNA, 22 bp, Homo sapiens
cctggatctcctctattcatat

SEQ ID NO: 7817536 - DNA, 22 bp, Homo sapiens
cctggatctttctgactgacaa

SEQ ID NO: 7817537 - DNA, 22 bp, Homo sapiens
cctggatctttgttgtaaatat

SEQ ID NO: 7817538 - DNA, 22 bp, Homo sapiens
cctggatcagtcactgttgctg

SEQ ID NO: 7817539 - DNA, 22 bp, Homo sapiens
cctggatccatgaaaaggctac

SEQ ID NO: 7817540 - DNA, 22 bp, Homo sapiens
cctggatcagagccagagaagc

SEQ ID NO: 7817541 - DNA, 22 bp, Homo sapiens
cctggatcagagccagagaagc

SEQ ID NO: 7817542 - DNA, 22 bp, Homo sapiens
cctggatcagagccagagaagc

SEQ ID NO: 7817543 - DNA, 22 bp, Homo sapiens
cctggatagctactggccaggc

SEQ ID NO: 7817544 - DNA, 19 bp, Homo sapiens
cctggagtcgcgctgcctc

SEQ ID NO: 7817545 - DNA, 22 bp, Homo sapiens
cctggagtaccgtggccatcca

SEQ ID NO: 7817546 - DNA, 19 bp, Homo sapiens
cctggagtcgcgctgcctc

SEQ ID NO: 7817547 - DNA, 19 bp, Homo sapiens
cctggagtcgcgctgcctc

SEQ ID NO: 7817548 - DNA, 22 bp, Homo sapiens
cctggagtgacaggtgtagcct

SEQ ID NO: 7817549 - DNA, 22 bp, Homo sapiens
cctggagtgacaggtgtagcct

SEQ ID NO: 7817550 - DNA, 21 bp, Homo sapiens
aggtagtaaatgtttgctcct

SEQ ID NO: 7817551 - DNA, 22 bp, Homo sapiens
aggtagtgtagctgagtgggat

SEQ ID NO: 7817552 - DNA, 22 bp, Homo sapiens
cctggaggtggaggttgcagtg

SEQ ID NO: 7817553 - DNA, 22 bp, Homo sapiens
cctggagtaccgtggccatcca

SEQ ID NO: 7817554 - DNA, 22 bp, Homo sapiens
cctggctctgcagccactccag

SEQ ID NO: 7817555 - DNA, 22 bp, Homo sapiens
cctggctctgaggtatgcctgg

SEQ ID NO: 7817556 - DNA, 22 bp, Homo sapiens
cctggctctgcagccactccag

SEQ ID NO: 7817557 - DNA, 22 bp, Homo sapiens
cctggctctgcagccactccag

SEQ ID NO: 7817558 - DNA, 22 bp, Homo sapiens
cctggctctgcagccactccag

SEQ ID NO: 7817559 - DNA, 22 bp, Homo sapiens
cctggctctgccacttactgcc

SEQ ID NO: 7817560 - DNA, 22 bp, Homo sapiens
cctggctctgccacttactgcc

SEQ ID NO: 7817561 - DNA, 22 bp, Homo sapiens
cctggctctgcagccactccag

SEQ ID NO: 7817562 - DNA, 22 bp, Homo sapiens
cctggctctgccgtaaccacca

SEQ ID NO: 7817563 - DNA, 22 bp, Homo sapiens
cctggctctgcgtgcagctccg

SEQ ID NO: 7817564 - DNA, 22 bp, Homo sapiens
cctggctctgcgtgcagctccg

SEQ ID NO: 7817565 - DNA, 22 bp, Homo sapiens
cctggctctgccgtaaccacca

SEQ ID NO: 7817566 - DNA, 22 bp, Homo sapiens
cctggctctgccgtaaccacca

SEQ ID NO: 7817567 - DNA, 22 bp, Homo sapiens
cctggctctgccgtaaccacca

SEQ ID NO: 7817568 - DNA, 22 bp, Homo sapiens
aggtcctccaccaggtctcctg

SEQ ID NO: 7817569 - DNA, 19 bp, Homo sapiens
aggtcctcaggatgaccct

SEQ ID NO: 7817570 - DNA, 19 bp, Homo sapiens
aggtccctgtcacctctca

SEQ ID NO: 7817571 - DNA, 19 bp, Homo sapiens
aggtccctgtcacctctca

SEQ ID NO: 7817572 - DNA, 19 bp, Homo sapiens
aggtccctgtcacctctca

SEQ ID NO: 7817573 - DNA, 22 bp, Homo sapiens
aggtccctggctagcactggaa

SEQ ID NO: 7817574 - DNA, 22 bp, Homo sapiens
aggtcctctgtgcctgctggcg

SEQ ID NO: 7817575 - DNA, 22 bp, Homo sapiens
aggtcctctgtgcctgctggcg

SEQ ID NO: 7817576 - DNA, 22 bp, Homo sapiens
aggtcctctgtgcctgctggcg

SEQ ID NO: 7817577 - DNA, 22 bp, Homo sapiens
aggtcctgagggttcgtctgca

SEQ ID NO: 7817578 - DNA, 22 bp, Homo sapiens
aggtcctgagggttcgtctgca

SEQ ID NO: 7817579 - DNA, 22 bp, Homo sapiens
aggtcctgaagattttactaga

SEQ ID NO: 7817580 - DNA, 22 bp, Homo sapiens
aggtcctgacgccctttgaaat

SEQ ID NO: 7817581 - DNA, 22 bp, Homo sapiens
aggtcctgactccacgttctag

SEQ ID NO: 7817582 - DNA, 22 bp, Homo sapiens
aggtcctgactccacgttctag

SEQ ID NO: 7817583 - DNA, 22 bp, Homo sapiens
aggtcctgactccacgttctag

SEQ ID NO: 7817584 - DNA, 22 bp, Homo sapiens
aggtcccagtctgtgatgactc

SEQ ID NO: 7817585 - DNA, 22 bp, Homo sapiens
aggtcccagtctgtgatgactc

SEQ ID NO: 7817586 - DNA, 22 bp, Homo sapiens
aggtcccagtgttagggtgaca

SEQ ID NO: 7817587 - DNA, 21 bp, Homo sapiens
aggtcccaggtttgggcagca

SEQ ID NO: 7817588 - DNA, 21 bp, Homo sapiens
aggtcccaggtttgggcagca

SEQ ID NO: 7817589 - DNA, 22 bp, Homo sapiens
aggtccctaggagagtaggaag

SEQ ID NO: 7817590 - DNA, 21 bp, Homo sapiens
aggtccctaattaattgacct

SEQ ID NO: 7817591 - DNA, 22 bp, Homo sapiens
aggtccctaatcatttcacttt

SEQ ID NO: 7817592 - DNA, 22 bp, Homo sapiens
aggtcccagtgttagggtgaca

SEQ ID NO: 7817593 - DNA, 22 bp, Homo sapiens
aggtccagttttctgacaaggg

SEQ ID NO: 7817594 - DNA, 22 bp, Homo sapiens
aggtcccaggcatagctggtct

SEQ ID NO: 7817595 - DNA, 22 bp, Homo sapiens
aggtccatggcagcgggtactt

SEQ ID NO: 7817596 - DNA, 21 bp, Homo sapiens
aggtcccaggtttgggcagca

SEQ ID NO: 7817597 - DNA, 22 bp, Homo sapiens
aggtcccaggcatagctggtct

SEQ ID NO: 7817598 - DNA, 22 bp, Homo sapiens
aggtcccaggcatagctggtct

SEQ ID NO: 7817599 - DNA, 22 bp, Homo sapiens
aggtccctcagaggcctcaccg

SEQ ID NO: 7817600 - DNA, 19 bp, Homo sapiens
aggtccctccctcgaggct

SEQ ID NO: 7817601 - DNA, 22 bp, Homo sapiens
aggtccctcagaggcctcaccg

SEQ ID NO: 7817602 - DNA, 22 bp, Homo sapiens
aggtccctgagtcagcggcgct

SEQ ID NO: 7817603 - DNA, 22 bp, Homo sapiens
aggtccctcgcacatgcagggt

SEQ ID NO: 7817604 - DNA, 22 bp, Homo sapiens
aggtccctcgcacatgcagggt

SEQ ID NO: 7817605 - DNA, 22 bp, Homo sapiens
aggtccctgggacagggcgatt

SEQ ID NO: 7817606 - DNA, 22 bp, Homo sapiens
aggtccctggctagcactggaa

SEQ ID NO: 7817607 - DNA, 22 bp, Homo sapiens
aggtccctggctagcactggaa

SEQ ID NO: 7817608 - DNA, 22 bp, Homo sapiens
aggtccctggctagcactggaa

SEQ ID NO: 7817609 - DNA, 22 bp, Homo sapiens
aggtccctgcagcagactgcca

SEQ ID NO: 7817610 - DNA, 22 bp, Homo sapiens
aggtccctgcagcagactgcca

SEQ ID NO: 7817611 - DNA, 22 bp, Homo sapiens
aggtccctaggagagtaggaag

SEQ ID NO: 7817612 - DNA, 22 bp, Homo sapiens
aggtccctcgcacatgcagggt

SEQ ID NO: 7817613 - DNA, 21 bp, Homo sapiens
ataagcatgctgattacattt

SEQ ID NO: 7817614 - DNA, 21 bp, Homo sapiens
ataagcatgctgattacattt

SEQ ID NO: 7817615 - DNA, 21 bp, Homo sapiens
ataagcatgctgattacattt

SEQ ID NO: 7817616 - DNA, 22 bp, Homo sapiens
ataagcagggtcaaatgcctac

SEQ ID NO: 7817617 - DNA, 22 bp, Homo sapiens
ataagattgtcatagtatggac

SEQ ID NO: 7817618 - DNA, 22 bp, Homo sapiens
ataagcacacaaatacatatat

SEQ ID NO: 7817619 - DNA, 22 bp, Homo sapiens
ataagaggaattacagaagagg

SEQ ID NO: 7817620 - DNA, 22 bp, Homo sapiens
ataagaggaattacagaagagg

SEQ ID NO: 7817621 - DNA, 22 bp, Homo sapiens
ataagagctatggtgggagttg

SEQ ID NO: 7817622 - DNA, 22 bp, Homo sapiens
atacaaagctaaatatggtttc

SEQ ID NO: 7817623 - DNA, 22 bp, Homo sapiens
ataatttggcttcctagatgta

SEQ ID NO: 7817624 - DNA, 22 bp, Homo sapiens
atacaaagctttctgtctggta

SEQ ID NO: 7817625 - DNA, 22 bp, Homo sapiens
atacaaagctaaatatggtttc

SEQ ID NO: 7817626 - DNA, 22 bp, Homo sapiens
ataatttactaagctctacctt

SEQ ID NO: 7817627 - DNA, 22 bp, Homo sapiens
ataatttactaagctctacctt

SEQ ID NO: 7817628 - DNA, 22 bp, Homo sapiens
ataatttggcttcctagatgta

SEQ ID NO: 7817629 - DNA, 22 bp, Homo sapiens
ataagaaacattattctttcca

SEQ ID NO: 7817630 - DNA, 22 bp, Homo sapiens
ataagaaacattattctttcca

SEQ ID NO: 7817631 - DNA, 22 bp, Homo sapiens
ataagaaacattattctttcca

SEQ ID NO: 7817632 - DNA, 22 bp, Homo sapiens
ataagaaacattattctttcca

SEQ ID NO: 7817633 - DNA, 23 bp, Homo sapiens
ataagaaaacagtaggctcagag

SEQ ID NO: 7817634 - DNA, 22 bp, Homo sapiens
ataagaataattaagttagtcc

SEQ ID NO: 7817635 - DNA, 22 bp, Homo sapiens
ataagaataattaagttagtcc

SEQ ID NO: 7817636 - DNA, 22 bp, Homo sapiens
ataagaataattaagttagtcc

SEQ ID NO: 7817637 - DNA, 22 bp, Homo sapiens
ataagagctacagccagttctg

SEQ ID NO: 7817638 - DNA, 17 bp, Homo sapiens
ataagacagaagacaat

SEQ ID NO: 7817639 - DNA, 17 bp, Homo sapiens
ataagacagaagacaat

SEQ ID NO: 7817640 - DNA, 22 bp, Homo sapiens
ataagacacgccccactcactc

SEQ ID NO: 7817641 - DNA, 22 bp, Homo sapiens
ataagacacgcaaataggtacg

SEQ ID NO: 7817642 - DNA, 22 bp, Homo sapiens
ataacttattagattggagctg

SEQ ID NO: 7817643 - DNA, 22 bp, Homo sapiens
ataacttaatgggtcatgctct

SEQ ID NO: 7817644 - DNA, 22 bp, Homo sapiens
ataacttagagtaggcaaaagt

SEQ ID NO: 7817645 - DNA, 22 bp, Homo sapiens
ataacttagagtaggcaaaagt

SEQ ID NO: 7817646 - DNA, 22 bp, Homo sapiens
ataactggaaggacacgtgtgt

SEQ ID NO: 7817647 - DNA, 22 bp, Homo sapiens
ataactggaaggacacgtgtgt

SEQ ID NO: 7817648 - DNA, 22 bp, Homo sapiens
ataacttaatgggtcatgctct

SEQ ID NO: 7817649 - DNA, 22 bp, Homo sapiens
ataactttcttcacccttgctg

SEQ ID NO: 7817650 - DNA, 23 bp, Homo sapiens
ataagaaaacagtaggctcagag

SEQ ID NO: 7817651 - DNA, 22 bp, Homo sapiens
ataacttgatgttatttgtcca

SEQ ID NO: 7817652 - DNA, 22 bp, Homo sapiens
ataacttcagtttctgtgtcct

SEQ ID NO: 7817653 - DNA, 22 bp, Homo sapiens
ctgctgaggtatactatgtgac

SEQ ID NO: 7817654 - DNA, 22 bp, Homo sapiens
ctgctgaggtatactatgtgac

SEQ ID NO: 7817655 - DNA, 22 bp, Homo sapiens
ctgctgaggtatactatgtgac

SEQ ID NO: 7817656 - DNA, 22 bp, Homo sapiens
ctgctgaggccttccctgtcct

SEQ ID NO: 7817657 - DNA, 22 bp, Homo sapiens
atacaactttatctgtaatgag

SEQ ID NO: 7817658 - DNA, 22 bp, Homo sapiens
atacaactgctctcagataagt

SEQ ID NO: 7817659 - DNA, 22 bp, Homo sapiens
atacaactgctctcagataagt

SEQ ID NO: 7817660 - DNA, 22 bp, Homo sapiens
atacaactgctctcagataagt

SEQ ID NO: 7817661 - DNA, 22 bp, Homo sapiens
atacaactttacatgcaattcc

SEQ ID NO: 7817662 - DNA, 22 bp, Homo sapiens
atacaactttacatgcaattcc

SEQ ID NO: 7817663 - DNA, 22 bp, Homo sapiens
atacaactgctctcagataagt

SEQ ID NO: 7817664 - DNA, 22 bp, Homo sapiens
atacaactgctctcagataagt

SEQ ID NO: 7817665 - DNA, 22 bp, Homo sapiens
ctgctgaggtccttgctcagac

SEQ ID NO: 7817666 - DNA, 22 bp, Homo sapiens
ctgctgaggtccttgctcagac

SEQ ID NO: 7817667 - DNA, 22 bp, Homo sapiens
ctgctgaggtccttgctcagac

SEQ ID NO: 7817668 - DNA, 22 bp, Homo sapiens
ctgctgaggtccttgctcagac

SEQ ID NO: 7817669 - DNA, 22 bp, Homo sapiens
ctgctgaggtccttgctcagac

SEQ ID NO: 7817670 - DNA, 22 bp, Homo sapiens
ctgctgaggtccttgctcagac

SEQ ID NO: 7817671 - DNA, 22 bp, Homo sapiens
ctgctgattcttaaatgtggtt

SEQ ID NO: 7817672 - DNA, 22 bp, Homo sapiens
ctgctgcaatctggcttccatg

SEQ ID NO: 7817673 - DNA, 22 bp, Homo sapiens
ctgctgcaatctggcttccatg

SEQ ID NO: 7817674 - DNA, 22 bp, Homo sapiens
ctgctgcaatctggcttccatg

SEQ ID NO: 7817675 - DNA, 22 bp, Homo sapiens
ctgctgcaatctggcttccatg

SEQ ID NO: 7817676 - DNA, 22 bp, Homo sapiens
atacaaatttatagatgcattt

SEQ ID NO: 7817677 - DNA, 22 bp, Homo sapiens
atacaaatttatagatgcattt

SEQ ID NO: 7817678 - DNA, 22 bp, Homo sapiens
atacaaattataggccccatcc

SEQ ID NO: 7817679 - DNA, 22 bp, Homo sapiens
atacaaatttatagatgcattt

SEQ ID NO: 7817680 - DNA, 22 bp, Homo sapiens
atacaaatttatagatgcattt

SEQ ID NO: 7817681 - DNA, 22 bp, Homo sapiens
atacaaatttatagatgcattt

SEQ ID NO: 7817682 - DNA, 22 bp, Homo sapiens
atacaaatttatagatgcattt

SEQ ID NO: 7817683 - DNA, 22 bp, Homo sapiens
atacaaatttatagatgcattt

SEQ ID NO: 7817684 - DNA, 22 bp, Homo sapiens
atacaacagaaaatgattattc

SEQ ID NO: 7817685 - DNA, 22 bp, Homo sapiens
atacaaatttatagatgcattt

SEQ ID NO: 7817686 - DNA, 22 bp, Homo sapiens
atacaacagaaaatgattattc

SEQ ID NO: 7817687 - DNA, 22 bp, Homo sapiens
atacaaagtattgatcctgagt

SEQ ID NO: 7817688 - DNA, 22 bp, Homo sapiens
atacaaagtattgatcctgagt

SEQ ID NO: 7817689 - DNA, 22 bp, Homo sapiens
atacaaagtattgatcctgagt

SEQ ID NO: 7817690 - DNA, 22 bp, Homo sapiens
atacaaatcctctgggatggta

SEQ ID NO: 7817691 - DNA, 22 bp, Homo sapiens
atacaaatcctctgggatggta

SEQ ID NO: 7817692 - DNA, 22 bp, Homo sapiens
atacaaatcctctgggatggta

SEQ ID NO: 7817693 - DNA, 22 bp, Homo sapiens
atacaaatcctctgggatggta

SEQ ID NO: 7817694 - DNA, 22 bp, Homo sapiens
atacaaattataggccccatcc

SEQ ID NO: 7817695 - DNA, 22 bp, Homo sapiens
atacaaattataggccccatcc

SEQ ID NO: 7817696 - DNA, 22 bp, Homo sapiens
atacaaagtattaatcctggat

SEQ ID NO: 7817697 - DNA, 22 bp, Homo sapiens
atacaaaggaacacaggcatgt

SEQ ID NO: 7817698 - DNA, 22 bp, Homo sapiens
atacaaaggaacacaggcatgt

SEQ ID NO: 7817699 - DNA, 22 bp, Homo sapiens
atacaaagctttctgtctggta

SEQ ID NO: 7817700 - DNA, 22 bp, Homo sapiens
atacaaaggaacacaggcatgt

SEQ ID NO: 7817701 - DNA, 22 bp, Homo sapiens
ctgcctctccccagagtggccc

SEQ ID NO: 7817702 - DNA, 22 bp, Homo sapiens
ataaatgaacattcacagagct

SEQ ID NO: 7817703 - DNA, 22 bp, Homo sapiens
ataaatgaacattcacagagct

SEQ ID NO: 7817704 - DNA, 22 bp, Homo sapiens
ataaatgattcagcaggaaata

SEQ ID NO: 7817705 - DNA, 22 bp, Homo sapiens
ataaatgattcagcaggaaata

SEQ ID NO: 7817706 - DNA, 22 bp, Homo sapiens
ataaatgattcagcaggaaata

SEQ ID NO: 7817707 - DNA, 22 bp, Homo sapiens
ataaatgattcagcaggaaata

SEQ ID NO: 7817708 - DNA, 22 bp, Homo sapiens
ataaatggctttcattcctagg

SEQ ID NO: 7817709 - DNA, 22 bp, Homo sapiens
ataaatgaacattcacagagct

SEQ ID NO: 7817710 - DNA, 22 bp, Homo sapiens
ataaatgaacattcacagagct

SEQ ID NO: 7817711 - DNA, 22 bp, Homo sapiens
ataaatctcttaagactcaaca

SEQ ID NO: 7817712 - DNA, 22 bp, Homo sapiens
ataaatctcttaagactcaaca

SEQ ID NO: 7817713 - DNA, 22 bp, Homo sapiens
ataaatctattggacatgtgtg

SEQ ID NO: 7817714 - DNA, 22 bp, Homo sapiens
ataaatctattggacatgtgtg

SEQ ID NO: 7817715 - DNA, 22 bp, Homo sapiens
ctgcctctgcgtcccacagagt

SEQ ID NO: 7817716 - DNA, 22 bp, Homo sapiens
ctgcctctgcgtcccacagagt

SEQ ID NO: 7817717 - DNA, 22 bp, Homo sapiens
ctgcctctgcgtcccacagagt

SEQ ID NO: 7817718 - DNA, 22 bp, Homo sapiens
ctgcctctgcgtcccacagagt

SEQ ID NO: 7817719 - DNA, 22 bp, Homo sapiens
ctgcctctccccagagtggccc

SEQ ID NO: 7817720 - DNA, 22 bp, Homo sapiens
ctgcctctgcgtcccacagagt

SEQ ID NO: 7817721 - DNA, 22 bp, Homo sapiens
ctgcctctgcgtcccacagagt

SEQ ID NO: 7817722 - DNA, 22 bp, Homo sapiens
ctgcctctccccagagtggccc

SEQ ID NO: 7817723 - DNA, 22 bp, Homo sapiens
ctgcctctccccagagtggccc

SEQ ID NO: 7817724 - DNA, 22 bp, Homo sapiens
ctgcctctccccagagtggccc

SEQ ID NO: 7817725 - DNA, 22 bp, Homo sapiens
ctgcctctccccagagtggccc

SEQ ID NO: 7817726 - DNA, 22 bp, Homo sapiens
ctgcctctccccagagtggccc

SEQ ID NO: 7817727 - DNA, 22 bp, Homo sapiens
ctgcctctcaggtccctgagat

SEQ ID NO: 7817728 - DNA, 22 bp, Homo sapiens
ctgcctctcaggtccctgagat

SEQ ID NO: 7817729 - DNA, 22 bp, Homo sapiens
ctgcctctcaggtccctgagat

SEQ ID NO: 7817730 - DNA, 22 bp, Homo sapiens
ctgcctctcaggtccctgagat

SEQ ID NO: 7817731 - DNA, 22 bp, Homo sapiens
ctgcctctcaggtccctgagat

SEQ ID NO: 7817732 - DNA, 22 bp, Homo sapiens
ctgcctctcaggtccctgagat

SEQ ID NO: 7817733 - DNA, 22 bp, Homo sapiens
ctgcctctcaggtccctgagat

SEQ ID NO: 7817734 - DNA, 22 bp, Homo sapiens
ctgcctctcaggtccctgagat

SEQ ID NO: 7817735 - DNA, 22 bp, Homo sapiens
ctgcctctcagcctgaccgcca

SEQ ID NO: 7817736 - DNA, 20 bp, Homo sapiens
ctgccgaccacagccatgga

SEQ ID NO: 7817737 - DNA, 22 bp, Homo sapiens
ctgcctctcagcctgaccgcca

SEQ ID NO: 7817738 - DNA, 22 bp, Homo sapiens
ctgcctctcagcctgaccgcca

SEQ ID NO: 7817739 - DNA, 22 bp, Homo sapiens
ctgcctctcagcctgaccgcca

SEQ ID NO: 7817740 - DNA, 22 bp, Homo sapiens
ctgccctttgaaagaacgtctt

SEQ ID NO: 7817741 - DNA, 22 bp, Homo sapiens
ctgccctttgaaagaacgtctt

SEQ ID NO: 7817742 - DNA, 22 bp, Homo sapiens
ctgccctttgaaagaacgtctt

SEQ ID NO: 7817743 - DNA, 22 bp, Homo sapiens
ctgccctttatttcacaaagta

SEQ ID NO: 7817744 - DNA, 20 bp, Homo sapiens
ctgccgaccacagccatgga

SEQ ID NO: 7817745 - DNA, 20 bp, Homo sapiens
ctgccgaccacagccatgga

SEQ ID NO: 7817746 - DNA, 20 bp, Homo sapiens
ctgccgaccacagccatgga

SEQ ID NO: 7817747 - DNA, 22 bp, Homo sapiens
ctgcatttcacatttaaacttt

SEQ ID NO: 7817748 - DNA, 22 bp, Homo sapiens
ctgcatttcacatttaaacttt

SEQ ID NO: 7817749 - DNA, 22 bp, Homo sapiens
ataacagatgtgaagtgctaat

SEQ ID NO: 7817750 - DNA, 22 bp, Homo sapiens
ataacagatgtgaagtgctaat

SEQ ID NO: 7817751 - DNA, 22 bp, Homo sapiens
ataacagatgcttcagcataaa

SEQ ID NO: 7817752 - DNA, 22 bp, Homo sapiens
ataacagatgtgaagtgctaat

SEQ ID NO: 7817753 - DNA, 22 bp, Homo sapiens
ataacagatgcttcagcataaa

SEQ ID NO: 7817754 - DNA, 22 bp, Homo sapiens
ataacagatgcttcagcataaa

SEQ ID NO: 7817755 - DNA, 22 bp, Homo sapiens
ataacatggagtttgtcattta

SEQ ID NO: 7817756 - DNA, 22 bp, Homo sapiens
ataacatgacctgtgcttcaca

SEQ ID NO: 7817757 - DNA, 22 bp, Homo sapiens
ataacagtgacctctcagcacc

SEQ ID NO: 7817758 - DNA, 22 bp, Homo sapiens
ataacagtgacctctcagcacc

SEQ ID NO: 7817759 - DNA, 22 bp, Homo sapiens
ataacagtgacctctcagcacc

SEQ ID NO: 7817760 - DNA, 22 bp, Homo sapiens
ataacatggagtttgtcattta

SEQ ID NO: 7817761 - DNA, 22 bp, Homo sapiens
ataaccttggctagtattgtgc

SEQ ID NO: 7817762 - DNA, 22 bp, Homo sapiens
ataacgaaggctgatgcgggat

SEQ ID NO: 7817763 - DNA, 22 bp, Homo sapiens
ataacctggtagtattaaatgt

SEQ ID NO: 7817764 - DNA, 22 bp, Homo sapiens
ataacctggtagtattaaatgt

SEQ ID NO: 7817765 - DNA, 22 bp, Homo sapiens
ataactctgtttttttcatgca

SEQ ID NO: 7817766 - DNA, 22 bp, Homo sapiens
ataaattaggatctggggttcc

SEQ ID NO: 7817767 - DNA, 22 bp, Homo sapiens
ataaattaggatctggggttcc

SEQ ID NO: 7817768 - DNA, 22 bp, Homo sapiens
ataaattaggatctggggttcc

SEQ ID NO: 7817769 - DNA, 23 bp, Homo sapiens
ataaattactatctccctagagc

SEQ ID NO: 7817770 - DNA, 22 bp, Homo sapiens
ataaattaggatctggggttcc

SEQ ID NO: 7817771 - DNA, 22 bp, Homo sapiens
ataaattaggatctggggttcc

SEQ ID NO: 7817772 - DNA, 22 bp, Homo sapiens
ataaattaggatctggggttcc

SEQ ID NO: 7817773 - DNA, 22 bp, Homo sapiens
ataaattaggatctggggttcc

SEQ ID NO: 7817774 - DNA, 22 bp, Homo sapiens
ataacagatactctctgtgagg

SEQ ID NO: 7817775 - DNA, 22 bp, Homo sapiens
ataacagatactctctgtgagg

SEQ ID NO: 7817776 - DNA, 22 bp, Homo sapiens
ataaattatgaatggccctttt

SEQ ID NO: 7817777 - DNA, 22 bp, Homo sapiens
ataaattatgaatggccctttt

SEQ ID NO: 7817778 - DNA, 22 bp, Homo sapiens
ataaatgtgaattagagctttg

SEQ ID NO: 7817779 - DNA, 22 bp, Homo sapiens
ataaatgtgaaatgagcagtta

SEQ ID NO: 7817780 - DNA, 22 bp, Homo sapiens
ataaatgtgaattagagctttg

SEQ ID NO: 7817781 - DNA, 23 bp, Homo sapiens
ataaattactatctccctagagc

SEQ ID NO: 7817782 - DNA, 23 bp, Homo sapiens
ataaattactatctccctagagc

SEQ ID NO: 7817783 - DNA, 23 bp, Homo sapiens
ataaattactatctccctagagc

SEQ ID NO: 7817784 - DNA, 23 bp, Homo sapiens
ataaattactatctccctagagc

SEQ ID NO: 7817785 - DNA, 23 bp, Homo sapiens
ataaattactatctccctagagc

SEQ ID NO: 7817786 - DNA, 23 bp, Homo sapiens
ataaattactatctccctagagc

SEQ ID NO: 7817787 - DNA, 20 bp, Homo sapiens
ctgcagggtgagtgggcgat

SEQ ID NO: 7817788 - DNA, 20 bp, Homo sapiens
ctgcagggttagaggctcca

SEQ ID NO: 7817789 - DNA, 20 bp, Homo sapiens
ctgcagggtgagtgggcgat

SEQ ID NO: 7817790 - DNA, 20 bp, Homo sapiens
ctgcagggtgagtgggcgat

SEQ ID NO: 7817791 - DNA, 20 bp, Homo sapiens
ctgcagggttagaggctcca

SEQ ID NO: 7817792 - DNA, 20 bp, Homo sapiens
ctgcagggttagaggctcca

SEQ ID NO: 7817793 - DNA, 20 bp, Homo sapiens
ctgcagggttagaggctcca

SEQ ID NO: 7817794 - DNA, 20 bp, Homo sapiens
ctgcagggttagaggctcca

SEQ ID NO: 7817795 - DNA, 22 bp, Homo sapiens
ctgcagggtgacgttgcccacc

SEQ ID NO: 7817796 - DNA, 22 bp, Homo sapiens
ctgcaggggtgtcctgtattgg

SEQ ID NO: 7817797 - DNA, 20 bp, Homo sapiens
ctgcagggtgagtgggcgat

SEQ ID NO: 7817798 - DNA, 20 bp, Homo sapiens
ctgcagggtgagtgggcgat

SEQ ID NO: 7817799 - DNA, 22 bp, Homo sapiens
ctgcagggtgacgttgcccacc

SEQ ID NO: 7817800 - DNA, 22 bp, Homo sapiens
ctgcagagcaagtaacatcctc

SEQ ID NO: 7817801 - DNA, 22 bp, Homo sapiens
ctgcagagcaagtaacatcctc

SEQ ID NO: 7817802 - DNA, 22 bp, Homo sapiens
ctgcagagatgaagaaggtggc

SEQ ID NO: 7817803 - DNA, 22 bp, Homo sapiens
ctgcagagatgaagaaggtggc

SEQ ID NO: 7817804 - DNA, 22 bp, Homo sapiens
ctgcagagatgaagaaggtggc

SEQ ID NO: 7817805 - DNA, 22 bp, Homo sapiens
ctgcagagcaagtaacatcctc

SEQ ID NO: 7817806 - DNA, 22 bp, Homo sapiens
ctgcagagacctaggtcaggtt

SEQ ID NO: 7817807 - DNA, 22 bp, Homo sapiens
ctgcagagagtaactgaaatat

SEQ ID NO: 7817808 - DNA, 22 bp, Homo sapiens
ctgcagagagtaactgaaatat

SEQ ID NO: 7817809 - DNA, 22 bp, Homo sapiens
ctgcagagagtgccgggcagcc

SEQ ID NO: 7817810 - DNA, 22 bp, Homo sapiens
ctgcagagagtaactgaaatat

SEQ ID NO: 7817811 - DNA, 22 bp, Homo sapiens
ctgcagagagtgccgggcagcc

SEQ ID NO: 7817812 - DNA, 22 bp, Homo sapiens
ctgcagagagtgccgggcagcc

SEQ ID NO: 7817813 - DNA, 22 bp, Homo sapiens
ctgcagagagtgccgggcagcc

SEQ ID NO: 7817814 - DNA, 22 bp, Homo sapiens
ctgcagagatgaagaaggtggc

SEQ ID NO: 7817815 - DNA, 22 bp, Homo sapiens
ctgcagagatgaagaaggtggc

SEQ ID NO: 7817816 - DNA, 22 bp, Homo sapiens
ctgcagagatgaagaaggtggc

SEQ ID NO: 7817817 - DNA, 22 bp, Homo sapiens
ctgcagagagtgccgggcagcc

SEQ ID NO: 7817818 - DNA, 22 bp, Homo sapiens
ctgcagagatgaagaaggtggc

SEQ ID NO: 7817819 - DNA, 23 bp, Homo sapiens
ctgcagagaactgagggacagcc

SEQ ID NO: 7817820 - DNA, 23 bp, Homo sapiens
ctgcagagaactgagggacagcc

SEQ ID NO: 7817821 - DNA, 22 bp, Homo sapiens
ctgcacaaattaatcagttaat

SEQ ID NO: 7817822 - DNA, 22 bp, Homo sapiens
ctgcaatggacagctctgagca

SEQ ID NO: 7817823 - DNA, 23 bp, Homo sapiens
ctgcaattgcctgatctcattgg

SEQ ID NO: 7817824 - DNA, 22 bp, Homo sapiens
ctgcacacatatggcttctctc

SEQ ID NO: 7817825 - DNA, 22 bp, Homo sapiens
ctgcagagaattgtggggcttc

SEQ ID NO: 7817826 - DNA, 22 bp, Homo sapiens
ctgcagagaattgtggggcttc

SEQ ID NO: 7817827 - DNA, 22 bp, Homo sapiens
ctgcagagacctaggtcaggtt

SEQ ID NO: 7817828 - DNA, 22 bp, Homo sapiens
ctgcagagaattgtggggcttc

SEQ ID NO: 7817829 - DNA, 22 bp, Homo sapiens
ctgcagagacctaggtcaggtt

SEQ ID NO: 7817830 - DNA, 22 bp, Homo sapiens
ctgcagagacctaggtcaggtt

SEQ ID NO: 7817831 - DNA, 22 bp, Homo sapiens
ctgcatctctgtgccagagggc

SEQ ID NO: 7817832 - DNA, 22 bp, Homo sapiens
ctgcatctctgctagtcagtca

SEQ ID NO: 7817833 - DNA, 21 bp, Homo sapiens
ctgcatctcatagaacatgtc

SEQ ID NO: 7817834 - DNA, 22 bp, Homo sapiens
ctgcatcttagtcaaaatctgt

SEQ ID NO: 7817835 - DNA, 22 bp, Homo sapiens
ctgcatgtgttatatttggttc

SEQ ID NO: 7817836 - DNA, 22 bp, Homo sapiens
ctgcatgtttacatttttgaga

SEQ ID NO: 7817837 - DNA, 22 bp, Homo sapiens
ctgcatgtgtttctgctgggtt

SEQ ID NO: 7817838 - DNA, 22 bp, Homo sapiens
ctgcattacagcctccttagga

SEQ ID NO: 7817839 - DNA, 22 bp, Homo sapiens
ctgcatgttttcttaattgtga

SEQ ID NO: 7817840 - DNA, 22 bp, Homo sapiens
ctgcatccatgttgctgcaaag

SEQ ID NO: 7817841 - DNA, 22 bp, Homo sapiens
ctgcatcccagggagcaatggg

SEQ ID NO: 7817842 - DNA, 22 bp, Homo sapiens
ctgcatcccagggagcaatggg

SEQ ID NO: 7817843 - DNA, 22 bp, Homo sapiens
ctgcatcctaacctccatgcag

SEQ ID NO: 7817844 - DNA, 22 bp, Homo sapiens
ctgcagggtttttcaaggacaa

SEQ ID NO: 7817845 - DNA, 22 bp, Homo sapiens
ctgcagggttttaacaatggac

SEQ ID NO: 7817846 - DNA, 22 bp, Homo sapiens
ctgcagggttttaacaatggac

SEQ ID NO: 7817847 - DNA, 22 bp, Homo sapiens
ctgcagggtttcgccagttgtg

SEQ ID NO: 7817848 - DNA, 22 bp, Homo sapiens
ctgcagggtttcgccagttgtg

SEQ ID NO: 7817849 - DNA, 22 bp, Homo sapiens
ctgcagggtttcgccagttgtg

SEQ ID NO: 7817850 - DNA, 22 bp, Homo sapiens
ctgcagggtttcgccagttgtg

SEQ ID NO: 7817851 - DNA, 22 bp, Homo sapiens
ctgcagggttcggagagttccc

SEQ ID NO: 7817852 - DNA, 22 bp, Homo sapiens
ctgcagggttcggagagttccc

SEQ ID NO: 7817853 - DNA, 22 bp, Homo sapiens
ctgcagggtttcgccagttgtg

SEQ ID NO: 7817854 - DNA, 20 bp, Homo sapiens
ctgcagggttagaggctcca

SEQ ID NO: 7817855 - DNA, 20 bp, Homo sapiens
ctgcagggttagaggctcca

SEQ ID NO: 7817856 - DNA, 22 bp, Homo sapiens
ctgcagggttcggagagttccc

SEQ ID NO: 7817857 - DNA, 22 bp, Homo sapiens
ctgcagggttcggagagttccc

SEQ ID NO: 7817858 - DNA, 22 bp, Homo sapiens
agttatttactcctttgtctct

SEQ ID NO: 7817859 - DNA, 22 bp, Homo sapiens
agttatttactcctttgtctct

SEQ ID NO: 7817860 - DNA, 22 bp, Homo sapiens
agttatttactcctttgtctct

SEQ ID NO: 7817861 - DNA, 22 bp, Homo sapiens
agttatttactcctttgtctct

SEQ ID NO: 7817862 - DNA, 22 bp, Homo sapiens
agttatttaaaatgattgtcct

SEQ ID NO: 7817863 - DNA, 22 bp, Homo sapiens
agttattcatttattctgtaca

SEQ ID NO: 7817864 - DNA, 22 bp, Homo sapiens
agttattcccttctggaggaga

SEQ ID NO: 7817865 - DNA, 22 bp, Homo sapiens
agttattgagtatctataatgt

SEQ ID NO: 7817866 - DNA, 22 bp, Homo sapiens
agttattgaggtcccttccagt

SEQ ID NO: 7817867 - DNA, 19 bp, Homo sapiens
agttattgatctattcagg

SEQ ID NO: 7817868 - DNA, 22 bp, Homo sapiens
agttattgttcagtacaatgtc

SEQ ID NO: 7817869 - DNA, 22 bp, Homo sapiens
agttattgtcctcctcacctta

SEQ ID NO: 7817870 - DNA, 22 bp, Homo sapiens
agttattgggttaaaattgcat

SEQ ID NO: 7817871 - DNA, 22 bp, Homo sapiens
agttattactctttaacatatt

SEQ ID NO: 7817872 - DNA, 22 bp, Homo sapiens
agttatcaggtgttttcatgga

SEQ ID NO: 7817873 - DNA, 22 bp, Homo sapiens
agttatcatcccttacactttg

SEQ ID NO: 7817874 - DNA, 22 bp, Homo sapiens
agttatcatcccttacactttg

SEQ ID NO: 7817875 - DNA, 22 bp, Homo sapiens
ctgaggagatccccccagaagt

SEQ ID NO: 7817876 - DNA, 22 bp, Homo sapiens
ctgaggagatgataatgtcatt

SEQ ID NO: 7817877 - DNA, 22 bp, Homo sapiens
ctgaggagcagctggcccgcta

SEQ ID NO: 7817878 - DNA, 22 bp, Homo sapiens
agttatatgtgaaaacacgtat

SEQ ID NO: 7817879 - DNA, 22 bp, Homo sapiens
agttatatgtgaaaacacgtat

SEQ ID NO: 7817880 - DNA, 22 bp, Homo sapiens
agttatattccatagattcaga

SEQ ID NO: 7817881 - DNA, 22 bp, Homo sapiens
agttatattccatagattcaga

SEQ ID NO: 7817882 - DNA, 22 bp, Homo sapiens
agttatattccatagattcaga

SEQ ID NO: 7817883 - DNA, 22 bp, Homo sapiens
ctgaggagctgaaggccctcca

SEQ ID NO: 7817884 - DNA, 22 bp, Homo sapiens
ctgaggagctgaaggccctcca

SEQ ID NO: 7817885 - DNA, 22 bp, Homo sapiens
ctgaggagccccctctcagcat

SEQ ID NO: 7817886 - DNA, 22 bp, Homo sapiens
ctgcaaatcaagttcttataat

SEQ ID NO: 7817887 - DNA, 23 bp, Homo sapiens
ctgcaactcagtctggagcagtt

SEQ ID NO: 7817888 - DNA, 22 bp, Homo sapiens
agttatttcagtaacataatag

SEQ ID NO: 7817889 - DNA, 22 bp, Homo sapiens
agttatttcagtaacataatag

SEQ ID NO: 7817890 - DNA, 22 bp, Homo sapiens
agttatttcagtaacataatag

SEQ ID NO: 7817891 - DNA, 22 bp, Homo sapiens
ctgcaaataggggtgtgaataa

SEQ ID NO: 7817892 - DNA, 22 bp, Homo sapiens
ctgatccagagccaaccaaggc

SEQ ID NO: 7817893 - DNA, 20 bp, Homo sapiens
ctgcaagcaggttattccag

SEQ ID NO: 7817894 - DNA, 20 bp, Homo sapiens
ctgcaagcaggttattccag

SEQ ID NO: 7817895 - DNA, 22 bp, Homo sapiens
ctgcaagcaaatcaactctttg

SEQ ID NO: 7817896 - DNA, 22 bp, Homo sapiens
ctgcaagattggaagatgcaat

SEQ ID NO: 7817897 - DNA, 22 bp, Homo sapiens
ctgcaagattggaagatgcaat

SEQ ID NO: 7817898 - DNA, 22 bp, Homo sapiens
ctgcaactctctccagaggctg

SEQ ID NO: 7817899 - DNA, 22 bp, Homo sapiens
ctgcaactctctccagaggctg

SEQ ID NO: 7817900 - DNA, 22 bp, Homo sapiens
ctgcaactctagtccagggctg

SEQ ID NO: 7817901 - DNA, 22 bp, Homo sapiens
ctgcaaggctggggtgagctgg

SEQ ID NO: 7817902 - DNA, 22 bp, Homo sapiens
ctgcaaggctgaattcagctga

SEQ ID NO: 7817903 - DNA, 22 bp, Homo sapiens
ctgcaagctggtaataagcaga

SEQ ID NO: 7817904 - DNA, 22 bp, Homo sapiens
ctgcaagctacccctagcatca

SEQ ID NO: 7817905 - DNA, 22 bp, Homo sapiens
ctgcaagccaagctgagagcct

SEQ ID NO: 7817906 - DNA, 20 bp, Homo sapiens
ctgcaagcaggttattccag

SEQ ID NO: 7817907 - DNA, 22 bp, Homo sapiens
ctgcaagctacccctagcatca

SEQ ID NO: 7817908 - DNA, 22 bp, Homo sapiens
ctgcaagccagggagagatgcc

SEQ ID NO: 7817909 - DNA, 22 bp, Homo sapiens
ctgcaaggtccacctgctacat

SEQ ID NO: 7817910 - DNA, 22 bp, Homo sapiens
ctgcaaggtccacctgctacat

SEQ ID NO: 7817911 - DNA, 22 bp, Homo sapiens
ctgcaatctccatgcttgattt

SEQ ID NO: 7817912 - DNA, 22 bp, Homo sapiens
ctgcaatatgatgtctgagaaa

SEQ ID NO: 7817913 - DNA, 22 bp, Homo sapiens
ctgcaagggatcttcaggtagc

SEQ ID NO: 7817914 - DNA, 23 bp, Homo sapiens
ctgcaaggtacaagatgctggat

SEQ ID NO: 7817915 - DNA, 23 bp, Homo sapiens
ctgcaaggtacaagatgctggat

SEQ ID NO: 7817916 - DNA, 22 bp, Homo sapiens
ctgcaaggtcatgactctctgg

SEQ ID NO: 7817917 - DNA, 22 bp, Homo sapiens
ctgcaaggtcatgactctctgg

SEQ ID NO: 7817918 - DNA, 22 bp, Homo sapiens
atacatatatggtacttcctgg

SEQ ID NO: 7817919 - DNA, 22 bp, Homo sapiens
atacatatatggtacttcctgg

SEQ ID NO: 7817920 - DNA, 22 bp, Homo sapiens
atacatgtgtgtgcatacatgt

SEQ ID NO: 7817921 - DNA, 22 bp, Homo sapiens
atacatgtgtgtgcatacatgt

SEQ ID NO: 7817922 - DNA, 22 bp, Homo sapiens
atacatgtgtgtgcatacatgt

SEQ ID NO: 7817923 - DNA, 22 bp, Homo sapiens
atacatgttcgtgtacatgttc

SEQ ID NO: 7817924 - DNA, 22 bp, Homo sapiens
atacattcaaaggaaggataga

SEQ ID NO: 7817925 - DNA, 22 bp, Homo sapiens
atacatgttcgtgtacatgttc

SEQ ID NO: 7817926 - DNA, 22 bp, Homo sapiens
atacatagttctgtgaaaagta

SEQ ID NO: 7817927 - DNA, 22 bp, Homo sapiens
atacatagttctgtgaaaagta

SEQ ID NO: 7817928 - DNA, 22 bp, Homo sapiens
atacatagtaccacatttgaca

SEQ ID NO: 7817929 - DNA, 22 bp, Homo sapiens
atacataggatatgtacgtgca

SEQ ID NO: 7817930 - DNA, 22 bp, Homo sapiens
atacatagtaccacatttgaca

SEQ ID NO: 7817931 - DNA, 22 bp, Homo sapiens
atacatagtaccacatttgaca

SEQ ID NO: 7817932 - DNA, 22 bp, Homo sapiens
atacataggatatgtacgtgca

SEQ ID NO: 7817933 - DNA, 22 bp, Homo sapiens
atacattcagcagtgctcatga

SEQ ID NO: 7817934 - DNA, 22 bp, Homo sapiens
atacattcatcacttttggtcc

SEQ ID NO: 7817935 - DNA, 22 bp, Homo sapiens
atacatgttcgtgtacatgttc

SEQ ID NO: 7817936 - DNA, 22 bp, Homo sapiens
atacattcagcagtgctcatga

SEQ ID NO: 7817937 - DNA, 22 bp, Homo sapiens
atacattcctactgactagcta

SEQ ID NO: 7817938 - DNA, 22 bp, Homo sapiens
atacattcctactgactagcta

SEQ ID NO: 7817939 - DNA, 21 bp, Homo sapiens
atacattctattaagcattta

SEQ ID NO: 7817940 - DNA, 22 bp, Homo sapiens
atacattgagttttgatgttct

SEQ ID NO: 7817941 - DNA, 17 bp, Homo sapiens
atacattgttaaagtat

SEQ ID NO: 7817942 - DNA, 22 bp, Homo sapiens
ataccaaagcacatactgtttg

SEQ ID NO: 7817943 - DNA, 22 bp, Homo sapiens
ataccaaagcacatactgtttg

SEQ ID NO: 7817944 - DNA, 22 bp, Homo sapiens
atacctgtgtatccacaagcgt

SEQ ID NO: 7817945 - DNA, 22 bp, Homo sapiens
atacctgtgtatccacaagcgt

SEQ ID NO: 7817946 - DNA, 22 bp, Homo sapiens
atacctgtgtatccacaagcgt

SEQ ID NO: 7817947 - DNA, 22 bp, Homo sapiens
atacctgtgtatccacaagcgt

SEQ ID NO: 7817948 - DNA, 22 bp, Homo sapiens
atacctgtgtatccacaagcgt

SEQ ID NO: 7817949 - DNA, 22 bp, Homo sapiens
atacctatgtgacagtattatt

SEQ ID NO: 7817950 - DNA, 22 bp, Homo sapiens
atacctatgtgacagtattatt

SEQ ID NO: 7817951 - DNA, 22 bp, Homo sapiens
atacctgatcaaggcaaaaatg

SEQ ID NO: 7817952 - DNA, 22 bp, Homo sapiens
atacctgatcaaggcaaaaatg

SEQ ID NO: 7817953 - DNA, 22 bp, Homo sapiens
ataccttttactcattatccat

SEQ ID NO: 7817954 - DNA, 22 bp, Homo sapiens
ataccttttactcattatccat

SEQ ID NO: 7817955 - DNA, 22 bp, Homo sapiens
atacctttaggcattttgcatc

SEQ ID NO: 7817956 - DNA, 22 bp, Homo sapiens
atacctgtgtatccacaagcgt

SEQ ID NO: 7817957 - DNA, 22 bp, Homo sapiens
atacctgtgtatccacaagcgt

SEQ ID NO: 7817958 - DNA, 22 bp, Homo sapiens
ataccctttacaggaacagcaa

SEQ ID NO: 7817959 - DNA, 22 bp, Homo sapiens
ataccctgttctggagtgaatg

SEQ ID NO: 7817960 - DNA, 22 bp, Homo sapiens
atacccattccttgtgttcagt

SEQ ID NO: 7817961 - DNA, 22 bp, Homo sapiens
atacccaggcttatgttggtca

SEQ ID NO: 7817962 - DNA, 22 bp, Homo sapiens
atacccagtccaatctcttagc

SEQ ID NO: 7817963 - DNA, 22 bp, Homo sapiens
atacccattccttgtgttcagt

SEQ ID NO: 7817964 - DNA, 22 bp, Homo sapiens
ataccatttccatgttacatta

SEQ ID NO: 7817965 - DNA, 21 bp, Homo sapiens
ataccatttgccaaaaggatc

SEQ ID NO: 7817966 - DNA, 22 bp, Homo sapiens
atacccagctctttcgttttgg

SEQ ID NO: 7817967 - DNA, 22 bp, Homo sapiens
ataccaccatctatgaaaggta

SEQ ID NO: 7817968 - DNA, 22 bp, Homo sapiens
ataccaccatctatgaaaggta

SEQ ID NO: 7817969 - DNA, 22 bp, Homo sapiens
atacattgagttttgatgttct

SEQ ID NO: 7817970 - DNA, 22 bp, Homo sapiens
ataccatggcagtttattcacg

SEQ ID NO: 7817971 - DNA, 22 bp, Homo sapiens
ataccatttccatgttacatta

SEQ ID NO: 7817972 - DNA, 22 bp, Homo sapiens
atacatacatgtatgcacatac

SEQ ID NO: 7817973 - DNA, 22 bp, Homo sapiens
atacatacatgtatgcacatac

SEQ ID NO: 7817974 - DNA, 22 bp, Homo sapiens
atacatacatgtatgcacatac

SEQ ID NO: 7817975 - DNA, 22 bp, Homo sapiens
atacatacatgtatgcacatac

SEQ ID NO: 7817976 - DNA, 22 bp, Homo sapiens
atacatacatgtatgcacatac

SEQ ID NO: 7817977 - DNA, 22 bp, Homo sapiens
atacatacgtacatacgtatgt

SEQ ID NO: 7817978 - DNA, 22 bp, Homo sapiens
atacatacgtacatacgtatgt

SEQ ID NO: 7817979 - DNA, 22 bp, Homo sapiens
atacatacgtacatacgtatgt

SEQ ID NO: 7817980 - DNA, 22 bp, Homo sapiens
atacatacgtacatacgtatgt

SEQ ID NO: 7817981 - DNA, 22 bp, Homo sapiens
atacatagatagataatctggc

SEQ ID NO: 7817982 - DNA, 22 bp, Homo sapiens
atacatagatagataatctggc

SEQ ID NO: 7817983 - DNA, 22 bp, Homo sapiens
atacatagcagagtcaattaat

SEQ ID NO: 7817984 - DNA, 22 bp, Homo sapiens
atacatagcagagtcaattaat

SEQ ID NO: 7817985 - DNA, 22 bp, Homo sapiens
atacatagctgaaaacttgtag

SEQ ID NO: 7817986 - DNA, 22 bp, Homo sapiens
atacatagctgaaaacttgtag

SEQ ID NO: 7817987 - DNA, 22 bp, Homo sapiens
atacatagcagggtagtagatc

SEQ ID NO: 7817988 - DNA, 22 bp, Homo sapiens
atacatagcagagtcaattaat

SEQ ID NO: 7817989 - DNA, 22 bp, Homo sapiens
atacatacatgtacacataaat

SEQ ID NO: 7817990 - DNA, 22 bp, Homo sapiens
atacatacatgtacacataaat

SEQ ID NO: 7817991 - DNA, 23 bp, Homo sapiens
atacatacagtcttactgacttt

SEQ ID NO: 7817992 - DNA, 23 bp, Homo sapiens
atacatacagtcttactgacttt

SEQ ID NO: 7817993 - DNA, 23 bp, Homo sapiens
atacatacagtcttactgacttt

SEQ ID NO: 7817994 - DNA, 23 bp, Homo sapiens
atacatacagtcttactgacttt

SEQ ID NO: 7817995 - DNA, 22 bp, Homo sapiens
atacatacatgtacacataaat

SEQ ID NO: 7817996 - DNA, 22 bp, Homo sapiens
atacatacatgtacacataaat

SEQ ID NO: 7817997 - DNA, 22 bp, Homo sapiens
atacatacatgtatgcacatac

SEQ ID NO: 7817998 - DNA, 22 bp, Homo sapiens
atacatacatgtatgcacatac

SEQ ID NO: 7817999 - DNA, 22 bp, Homo sapiens
atacataattacttccgatgtt

SEQ ID NO: 7818000 - DNA, 22 bp, Homo sapiens
atacataattacttccgatgtt

SEQ ID NO: 7818001 - DNA, 22 bp, Homo sapiens
atacataattacttccgatgtt

SEQ ID NO: 7818002 - DNA, 17 bp, Homo sapiens
atacagtttattttaca

SEQ ID NO: 7818003 - DNA, 22 bp, Homo sapiens
atacagtttaccacactccttg

SEQ ID NO: 7818004 - DNA, 22 bp, Homo sapiens
atacagttatagtcagggctaa

SEQ ID NO: 7818005 - DNA, 22 bp, Homo sapiens
atacagtagggaccatgtctga

SEQ ID NO: 7818006 - DNA, 20 bp, Homo sapiens
atacagtaggtgctcaatat

SEQ ID NO: 7818007 - DNA, 20 bp, Homo sapiens
atacagtaggtgctcaatat

SEQ ID NO: 7818008 - DNA, 20 bp, Homo sapiens
atacagtaggtgctcaatat

SEQ ID NO: 7818009 - DNA, 22 bp, Homo sapiens
atacagtattacctgttcagga

SEQ ID NO: 7818010 - DNA, 22 bp, Homo sapiens
atacagtattacctgttcagga

SEQ ID NO: 7818011 - DNA, 22 bp, Homo sapiens
atacagtattacctgttcagga

SEQ ID NO: 7818012 - DNA, 22 bp, Homo sapiens
atacagtataactaataaaccc

SEQ ID NO: 7818013 - DNA, 22 bp, Homo sapiens
atacagtataactaataaaccc

SEQ ID NO: 7818014 - DNA, 22 bp, Homo sapiens
atacagtataactaataaaccc

SEQ ID NO: 7818015 - DNA, 22 bp, Homo sapiens
atacagtatgtaggcttttcag

SEQ ID NO: 7818016 - DNA, 22 bp, Homo sapiens
atacagtataactaataaaccc

SEQ ID NO: 7818017 - DNA, 22 bp, Homo sapiens
atacagtgagaataattcttag

SEQ ID NO: 7818018 - DNA, 22 bp, Homo sapiens
atacagtgaatacttacagtgt

SEQ ID NO: 7818019 - DNA, 22 bp, Homo sapiens
atacagtgaatacttacagtgt

SEQ ID NO: 7818020 - DNA, 22 bp, Homo sapiens
atacagtgccccttttcacatg

SEQ ID NO: 7818021 - DNA, 22 bp, Homo sapiens
atacagtgccccttttcacatg

SEQ ID NO: 7818022 - DNA, 22 bp, Homo sapiens
atacagtcttcatattaagttt

SEQ ID NO: 7818023 - DNA, 22 bp, Homo sapiens
atacagtcagactttagccatt

SEQ ID NO: 7818024 - DNA, 22 bp, Homo sapiens
atacagtgaatacttacagtgt

SEQ ID NO: 7818025 - DNA, 22 bp, Homo sapiens
atacagtgaatacttacagtgt

SEQ ID NO: 7818026 - DNA, 22 bp, Homo sapiens
atacagtcagactttagccatt

SEQ ID NO: 7818027 - DNA, 22 bp, Homo sapiens
atacagtcttcatattaagttt

SEQ ID NO: 7818028 - DNA, 22 bp, Homo sapiens
atacagtgccccttttcacatg

SEQ ID NO: 7818029 - DNA, 22 bp, Homo sapiens
atacagtgcacaacctgtgcag

SEQ ID NO: 7818030 - DNA, 22 bp, Homo sapiens
atacagtggctgtgagctgggc

SEQ ID NO: 7818031 - DNA, 22 bp, Homo sapiens
atacagtgccccttttcacatg

SEQ ID NO: 7818032 - DNA, 22 bp, Homo sapiens
atacagtgtactatttagcagt

SEQ ID NO: 7818033 - DNA, 22 bp, Homo sapiens
atacagtgtactatttagcagt

SEQ ID NO: 7818034 - DNA, 21 bp, Homo sapiens
atacagtggtatgaatgtagg

SEQ ID NO: 7818035 - DNA, 22 bp, Homo sapiens
atacagttagaaaaaaagcctt

SEQ ID NO: 7818036 - DNA, 22 bp, Homo sapiens
atacagtgtactatttagcagt

SEQ ID NO: 7818037 - DNA, 22 bp, Homo sapiens
atacagtgtactatttagcagt

SEQ ID NO: 7818038 - DNA, 22 bp, Homo sapiens
ctggaagagcatttgcataggg

SEQ ID NO: 7818039 - DNA, 22 bp, Homo sapiens
ctggaagagcatttgcataggg

SEQ ID NO: 7818040 - DNA, 22 bp, Homo sapiens
ctgctgccattagggcacagac

SEQ ID NO: 7818041 - DNA, 22 bp, Homo sapiens
ctgctgccattagggcacagac

SEQ ID NO: 7818042 - DNA, 22 bp, Homo sapiens
ctgctgccattagggcacagac

SEQ ID NO: 7818043 - DNA, 22 bp, Homo sapiens
ctggaagactcaatggcctgcc

SEQ ID NO: 7818044 - DNA, 22 bp, Homo sapiens
ctgctgccattagggcacagac

SEQ ID NO: 7818045 - DNA, 18 bp, Homo sapiens
ctggaagttagtctttgg

SEQ ID NO: 7818046 - DNA, 22 bp, Homo sapiens
ctggaagtggggttggcttgaa

SEQ ID NO: 7818047 - DNA, 22 bp, Homo sapiens
ctggaagttggaactgatatga

SEQ ID NO: 7818048 - DNA, 22 bp, Homo sapiens
ctggaagtggggttggcttgaa

SEQ ID NO: 7818049 - DNA, 22 bp, Homo sapiens
ctggaagtttccttcctggtca

SEQ ID NO: 7818050 - DNA, 22 bp, Homo sapiens
ctggaagtttccttcctggtca

SEQ ID NO: 7818051 - DNA, 22 bp, Homo sapiens
ctggaataaacgatcttcagca

SEQ ID NO: 7818052 - DNA, 22 bp, Homo sapiens
ctgctgccaagggtgccacagg

SEQ ID NO: 7818053 - DNA, 22 bp, Homo sapiens
ctgctgccaagggtgccacagg

SEQ ID NO: 7818054 - DNA, 22 bp, Homo sapiens
ctgctgccaagggtgccacagg

SEQ ID NO: 7818055 - DNA, 22 bp, Homo sapiens
ctgctgccaagggtgccacagg

SEQ ID NO: 7818056 - DNA, 22 bp, Homo sapiens
ctgctgcattactcttctcaag

SEQ ID NO: 7818057 - DNA, 22 bp, Homo sapiens
ctgctgcattactcttctcaag

SEQ ID NO: 7818058 - DNA, 22 bp, Homo sapiens
ctgctgcaggatgggcactctg

SEQ ID NO: 7818059 - DNA, 22 bp, Homo sapiens
ctgctgcaggatgggcactctg

SEQ ID NO: 7818060 - DNA, 22 bp, Homo sapiens
ctgctgcaattatctgggtgtg

SEQ ID NO: 7818061 - DNA, 22 bp, Homo sapiens
ctgctgcagatgacagacccaa

SEQ ID NO: 7818062 - DNA, 22 bp, Homo sapiens
ctgctgcaggatgggcactctg

SEQ ID NO: 7818063 - DNA, 18 bp, Homo sapiens
ctgctgcaggcactcagg

SEQ ID NO: 7818064 - DNA, 18 bp, Homo sapiens
ctgctgcaggcactcagg

SEQ ID NO: 7818065 - DNA, 22 bp, Homo sapiens
ctggaatgaagctatgtacatt

SEQ ID NO: 7818066 - DNA, 22 bp, Homo sapiens
ctggaatctttggagaatgtgg

SEQ ID NO: 7818067 - DNA, 19 bp, Homo sapiens
ctggaatgagaacatgccc

SEQ ID NO: 7818068 - DNA, 19 bp, Homo sapiens
ctggaatgagaacatgccc

SEQ ID NO: 7818069 - DNA, 22 bp, Homo sapiens
ctggaatctttggagaatgtgg

SEQ ID NO: 7818070 - DNA, 22 bp, Homo sapiens
ctggaatgcctccctgtcagag

SEQ ID NO: 7818071 - DNA, 22 bp, Homo sapiens
ctggaatgagcagggcttatgg

SEQ ID NO: 7818072 - DNA, 22 bp, Homo sapiens
ctggaatgagagcccggggatc

SEQ ID NO: 7818073 - DNA, 19 bp, Homo sapiens
ctggaatgatagagacctc

SEQ ID NO: 7818074 - DNA, 20 bp, Homo sapiens
ctggaatgggtgtgggttag

SEQ ID NO: 7818075 - DNA, 20 bp, Homo sapiens
ctggaatgggtgtgggttag

SEQ ID NO: 7818076 - DNA, 22 bp, Homo sapiens
ctggaatgcggagagttggaga

SEQ ID NO: 7818077 - DNA, 22 bp, Homo sapiens
ctggaatgcggagagttggaga

SEQ ID NO: 7818078 - DNA, 22 bp, Homo sapiens
ctggaatggcaatgggaagtcc

SEQ ID NO: 7818079 - DNA, 22 bp, Homo sapiens
ctggaatggcaatgggaagtcc

SEQ ID NO: 7818080 - DNA, 22 bp, Homo sapiens
ctggaatgctggtaaaatagca

SEQ ID NO: 7818081 - DNA, 22 bp, Homo sapiens
ctggaatgggccatttgaggcc

SEQ ID NO: 7818082 - DNA, 22 bp, Homo sapiens
atacagtagggaccatgtctga

SEQ ID NO: 7818083 - DNA, 22 bp, Homo sapiens
atacagtagggaccatgtctga

SEQ ID NO: 7818084 - DNA, 22 bp, Homo sapiens
atacagtagggaccatgtctga

SEQ ID NO: 7818085 - DNA, 22 bp, Homo sapiens
atacagtagggaccatgtctga

SEQ ID NO: 7818086 - DNA, 22 bp, Homo sapiens
atacagtagacaatctcatgaa

SEQ ID NO: 7818087 - DNA, 22 bp, Homo sapiens
atacagtagggaccatgtctga

SEQ ID NO: 7818088 - DNA, 22 bp, Homo sapiens
atacagtagacaatctcatgaa

SEQ ID NO: 7818089 - DNA, 22 bp, Homo sapiens
atacagtagacaatctcatgaa

SEQ ID NO: 7818090 - DNA, 22 bp, Homo sapiens
atacagtagacaatctcatgaa

SEQ ID NO: 7818091 - DNA, 22 bp, Homo sapiens
atacagtagacaatctcatgaa

SEQ ID NO: 7818092 - DNA, 22 bp, Homo sapiens
atacagtaatttgtaactcatc

SEQ ID NO: 7818093 - DNA, 22 bp, Homo sapiens
atacagtaatttgtaactcatc

SEQ ID NO: 7818094 - DNA, 22 bp, Homo sapiens
atacagtaatttgtaactcatc

SEQ ID NO: 7818095 - DNA, 22 bp, Homo sapiens
atacagtaatttgtaactcatc

SEQ ID NO: 7818096 - DNA, 22 bp, Homo sapiens
atacagtaatttgtaactcatc

SEQ ID NO: 7818097 - DNA, 22 bp, Homo sapiens
atacagtaatttgtaactcatc

SEQ ID NO: 7818098 - DNA, 22 bp, Homo sapiens
atacagatgttaaagcaatttc

SEQ ID NO: 7818099 - DNA, 22 bp, Homo sapiens
atacagatgttaaagcaatttc

SEQ ID NO: 7818100 - DNA, 22 bp, Homo sapiens
ctggagagaatgtggaatgatt

SEQ ID NO: 7818101 - DNA, 22 bp, Homo sapiens
ctggagagaatgtggaatgatt

SEQ ID NO: 7818102 - DNA, 22 bp, Homo sapiens
ctggagagaatgttcattgcag

SEQ ID NO: 7818103 - DNA, 22 bp, Homo sapiens
ctggagagaatgttcattgcag

SEQ ID NO: 7818104 - DNA, 22 bp, Homo sapiens
ctggagagaatgttcattgcag

SEQ ID NO: 7818105 - DNA, 22 bp, Homo sapiens
ctggagagaccgaaagaggctg

SEQ ID NO: 7818106 - DNA, 19 bp, Homo sapiens
atacagatgtatccatgat

SEQ ID NO: 7818107 - DNA, 22 bp, Homo sapiens
ctggaatgtctgctcaatgttt

SEQ ID NO: 7818108 - DNA, 22 bp, Homo sapiens
ctggagaagccaaactagtcac

SEQ ID NO: 7818109 - DNA, 22 bp, Homo sapiens
ctggagaagcattcaaataatt

SEQ ID NO: 7818110 - DNA, 22 bp, Homo sapiens
ctggagaagcattcaaataatt

SEQ ID NO: 7818111 - DNA, 22 bp, Homo sapiens
ctggagaagcattcaaataatt

SEQ ID NO: 7818112 - DNA, 22 bp, Homo sapiens
ctggagaagaggtagtatgtag

SEQ ID NO: 7818113 - DNA, 22 bp, Homo sapiens
ctggagaagtactgagacattt

SEQ ID NO: 7818114 - DNA, 17 bp, Homo sapiens
ctggagaagcctgtgga

SEQ ID NO: 7818115 - DNA, 22 bp, Homo sapiens
ctggagaagtactgagacattt

SEQ ID NO: 7818116 - DNA, 22 bp, Homo sapiens
ctggagaagtactgagacattt

SEQ ID NO: 7818117 - DNA, 22 bp, Homo sapiens
ctggagaagtactgagacattt

SEQ ID NO: 7818118 - DNA, 22 bp, Homo sapiens
ctggagaattctatgaaatatt

SEQ ID NO: 7818119 - DNA, 22 bp, Homo sapiens
ctggagacctctcctgagagtg

SEQ ID NO: 7818120 - DNA, 22 bp, Homo sapiens
ctggagacctctcctgagagtg

SEQ ID NO: 7818121 - DNA, 22 bp, Homo sapiens
ctggagacctctcctgagagtg

SEQ ID NO: 7818122 - DNA, 22 bp, Homo sapiens
ctggagacctctcctgagagtg

SEQ ID NO: 7818123 - DNA, 22 bp, Homo sapiens
ctggagagaaatgacaaagcta

SEQ ID NO: 7818124 - DNA, 22 bp, Homo sapiens
ctggagacctctcctgagagtg

SEQ ID NO: 7818125 - DNA, 22 bp, Homo sapiens
ctggagagaatgtggaatgatt

SEQ ID NO: 7818126 - DNA, 22 bp, Homo sapiens
ctggagagaatgtggaatgatt

SEQ ID NO: 7818127 - DNA, 22 bp, Homo sapiens
ctggagagaatgtggaatgatt

SEQ ID NO: 7818128 - DNA, 22 bp, Homo sapiens
ctggagagaatgtggaatgatt

SEQ ID NO: 7818129 - DNA, 22 bp, Homo sapiens
atagcacctgtgatgggatgag

SEQ ID NO: 7818130 - DNA, 22 bp, Homo sapiens
atagcacctcctcagggaagtc

SEQ ID NO: 7818131 - DNA, 22 bp, Homo sapiens
atagcaccatgactaaacaatt

SEQ ID NO: 7818132 - DNA, 22 bp, Homo sapiens
atagcaccatgactaaacaatt

SEQ ID NO: 7818133 - DNA, 22 bp, Homo sapiens
atagcacaatattacctttatg

SEQ ID NO: 7818134 - DNA, 22 bp, Homo sapiens
atagcactggtttttcttggtt

SEQ ID NO: 7818135 - DNA, 22 bp, Homo sapiens
atagcagcatcagtttatctcc

SEQ ID NO: 7818136 - DNA, 22 bp, Homo sapiens
atagcagaaaccaagcttcttc

SEQ ID NO: 7818137 - DNA, 22 bp, Homo sapiens
atagcagcatcagtttatctcc

SEQ ID NO: 7818138 - DNA, 22 bp, Homo sapiens
atagcagcatttcttccaagga

SEQ ID NO: 7818139 - DNA, 22 bp, Homo sapiens
atagcagcatttcttccaagga

SEQ ID NO: 7818140 - DNA, 22 bp, Homo sapiens
atagcagcatcagtttatctcc

SEQ ID NO: 7818141 - DNA, 22 bp, Homo sapiens
atagcagaaaccaagcttcttc

SEQ ID NO: 7818142 - DNA, 22 bp, Homo sapiens
atagcaaatattttaatgagca

SEQ ID NO: 7818143 - DNA, 22 bp, Homo sapiens
atagcaaatattttaatgagca

SEQ ID NO: 7818144 - DNA, 22 bp, Homo sapiens
atagcaaatattttaatgagca

SEQ ID NO: 7818145 - DNA, 22 bp, Homo sapiens
atagcaaatattttaatgagca

SEQ ID NO: 7818146 - DNA, 22 bp, Homo sapiens
atagcaaattctttaggtgctt

SEQ ID NO: 7818147 - DNA, 22 bp, Homo sapiens
atagcaaattctttaggtgctt

SEQ ID NO: 7818148 - DNA, 22 bp, Homo sapiens
atagcaaattctttaggtgctt

SEQ ID NO: 7818149 - DNA, 22 bp, Homo sapiens
atagcaaggtatgactggagcc

SEQ ID NO: 7818150 - DNA, 22 bp, Homo sapiens
atagcaatggcaacaactaagc

SEQ ID NO: 7818151 - DNA, 22 bp, Homo sapiens
atagcaaggtatgactggagcc

SEQ ID NO: 7818152 - DNA, 22 bp, Homo sapiens
ctggctggccatgtagagatga

SEQ ID NO: 7818153 - DNA, 22 bp, Homo sapiens
ctggctggccatgcagcgccag

SEQ ID NO: 7818154 - DNA, 22 bp, Homo sapiens
ctggctggccatgtagagatga

SEQ ID NO: 7818155 - DNA, 22 bp, Homo sapiens
ctggctggccggagcgaggcgg

SEQ ID NO: 7818156 - DNA, 22 bp, Homo sapiens
ctggctggccggagcgaggcgg

SEQ ID NO: 7818157 - DNA, 22 bp, Homo sapiens
ctggctggccggagcgaggcgg

SEQ ID NO: 7818158 - DNA, 22 bp, Homo sapiens
ctggctggccatgcagcgccag

SEQ ID NO: 7818159 - DNA, 22 bp, Homo sapiens
ctggctggcagatgctcttgct

SEQ ID NO: 7818160 - DNA, 22 bp, Homo sapiens
ctggctggcagatgctcttgct

SEQ ID NO: 7818161 - DNA, 22 bp, Homo sapiens
ctggctggcagatgctcttgct

SEQ ID NO: 7818162 - DNA, 22 bp, Homo sapiens
ctggctggcagatgctcttgct

SEQ ID NO: 7818163 - DNA, 22 bp, Homo sapiens
ctggctggcagatgctcttgct

SEQ ID NO: 7818164 - DNA, 22 bp, Homo sapiens
ctggctggcagatgctcttgct

SEQ ID NO: 7818165 - DNA, 22 bp, Homo sapiens
ctggctggcaagtagaacacaa

SEQ ID NO: 7818166 - DNA, 22 bp, Homo sapiens
ctggctggcaagtagaacacaa

SEQ ID NO: 7818167 - DNA, 22 bp, Homo sapiens
ctggctggcaagtagaacacaa

SEQ ID NO: 7818168 - DNA, 22 bp, Homo sapiens
ctggctggagtgcaggtgagtg

SEQ ID NO: 7818169 - DNA, 22 bp, Homo sapiens
ctggctggagtgcaggtgagtg

SEQ ID NO: 7818170 - DNA, 22 bp, Homo sapiens
ctggctggagtgcaggtgagtg

SEQ ID NO: 7818171 - DNA, 22 bp, Homo sapiens
ctggctgcaggaaggagtgggc

SEQ ID NO: 7818172 - DNA, 22 bp, Homo sapiens
ctggctgcagctccgaggaaga

SEQ ID NO: 7818173 - DNA, 22 bp, Homo sapiens
atagcagtaacactgacatttt

SEQ ID NO: 7818174 - DNA, 22 bp, Homo sapiens
ctggctgcagctccgaggaaga

SEQ ID NO: 7818175 - DNA, 19 bp, Homo sapiens
atagcagctatacccagat

SEQ ID NO: 7818176 - DNA, 22 bp, Homo sapiens
atagcagggatgtcagcaagta

SEQ ID NO: 7818177 - DNA, 22 bp, Homo sapiens
atagcagtaacactgacatttt

SEQ ID NO: 7818178 - DNA, 22 bp, Homo sapiens
atagcagggatgtcagcaagta

SEQ ID NO: 7818179 - DNA, 19 bp, Homo sapiens
atagcagctatacccagat

SEQ ID NO: 7818180 - DNA, 22 bp, Homo sapiens
ctggctccatcactgggtgatg

SEQ ID NO: 7818181 - DNA, 22 bp, Homo sapiens
ctggctccatcactgggtgatg

SEQ ID NO: 7818182 - DNA, 22 bp, Homo sapiens
ctggctccagtgacaagtcgat

SEQ ID NO: 7818183 - DNA, 22 bp, Homo sapiens
ctggctccagtgacaagtcgat

SEQ ID NO: 7818184 - DNA, 22 bp, Homo sapiens
ctggctccagtgacaagtcgat

SEQ ID NO: 7818185 - DNA, 22 bp, Homo sapiens
ctggctccatcactgggtgatg

SEQ ID NO: 7818186 - DNA, 22 bp, Homo sapiens
ctggctccatcctaggcaaatg

SEQ ID NO: 7818187 - DNA, 22 bp, Homo sapiens
ctggctccatcctaggcaaatg

SEQ ID NO: 7818188 - DNA, 22 bp, Homo sapiens
ctggctccatcctaggcaaatg

SEQ ID NO: 7818189 - DNA, 22 bp, Homo sapiens
ctggctcacaggtgagatgcat

SEQ ID NO: 7818190 - DNA, 22 bp, Homo sapiens
ctggctcacaggtgagatgcat

SEQ ID NO: 7818191 - DNA, 22 bp, Homo sapiens
ctggctcacaggtgagatgcat

SEQ ID NO: 7818192 - DNA, 22 bp, Homo sapiens
ctggccctaggcaaacacagat

SEQ ID NO: 7818193 - DNA, 22 bp, Homo sapiens
ctggcccggctgcctggtcatt

SEQ ID NO: 7818194 - DNA, 22 bp, Homo sapiens
ctggctcacaggtgagatgcat

SEQ ID NO: 7818195 - DNA, 22 bp, Homo sapiens
ctggctcacaggtgagatgcat

SEQ ID NO: 7818196 - DNA, 22 bp, Homo sapiens
ctggctcacaggtgagatgcat

SEQ ID NO: 7818197 - DNA, 22 bp, Homo sapiens
ctggctcacctccgctccagca

SEQ ID NO: 7818198 - DNA, 22 bp, Homo sapiens
ctggctcacctccgctccagca

SEQ ID NO: 7818199 - DNA, 22 bp, Homo sapiens
ctggctccagtgacaagtcgat

SEQ ID NO: 7818200 - DNA, 22 bp, Homo sapiens
ctggctccatccttgagctctg

SEQ ID NO: 7818201 - DNA, 22 bp, Homo sapiens
ctggctccatccttgagctctg

SEQ ID NO: 7818202 - DNA, 22 bp, Homo sapiens
ctggctccatccttgagctctg

SEQ ID NO: 7818203 - DNA, 22 bp, Homo sapiens
ctggctccatccttgagctctg

SEQ ID NO: 7818204 - DNA, 22 bp, Homo sapiens
ctggctccatccttgagctctg

SEQ ID NO: 7818205 - DNA, 22 bp, Homo sapiens
ctggctccatccttgagctctg

SEQ ID NO: 7818206 - DNA, 22 bp, Homo sapiens
ctggctccatctttgcttcctg

SEQ ID NO: 7818207 - DNA, 22 bp, Homo sapiens
ctggctccatctttgcttcctg

SEQ ID NO: 7818208 - DNA, 22 bp, Homo sapiens
ctggctccattactcagcatct

SEQ ID NO: 7818209 - DNA, 22 bp, Homo sapiens
ctggctccattactcagcatct

SEQ ID NO: 7818210 - DNA, 22 bp, Homo sapiens
ctggctccattactcagcatct

SEQ ID NO: 7818211 - DNA, 22 bp, Homo sapiens
ctggctccattactcagcatct

SEQ ID NO: 7818212 - DNA, 22 bp, Homo sapiens
ctggctccatctttgcttcctg

SEQ ID NO: 7818213 - DNA, 22 bp, Homo sapiens
ctggctccatctttgcttcctg

SEQ ID NO: 7818214 - DNA, 22 bp, Homo sapiens
ctggctccatctttgcttcctg

SEQ ID NO: 7818215 - DNA, 22 bp, Homo sapiens
ctggctccatctttgcttcctg

SEQ ID NO: 7818216 - DNA, 22 bp, Homo sapiens
atagcaaatattttaatgagca

SEQ ID NO: 7818217 - DNA, 22 bp, Homo sapiens
atagcaaatattttaatgagca

SEQ ID NO: 7818218 - DNA, 22 bp, Homo sapiens
atagcaaagtgcaggggcagca

SEQ ID NO: 7818219 - DNA, 22 bp, Homo sapiens
atagcaaagtgcaggggcagca

SEQ ID NO: 7818220 - DNA, 22 bp, Homo sapiens
ctggctccctcgctgaggtgct

SEQ ID NO: 7818221 - DNA, 22 bp, Homo sapiens
ctggctccctcgctgaggtgct

SEQ ID NO: 7818222 - DNA, 22 bp, Homo sapiens
ctggctccctcgctgaggtgct

SEQ ID NO: 7818223 - DNA, 22 bp, Homo sapiens
ctggctcccgttgtccttgaag

SEQ ID NO: 7818224 - DNA, 22 bp, Homo sapiens
ctggctccctcgctgaggtgct

SEQ ID NO: 7818225 - DNA, 22 bp, Homo sapiens
ctggctcccgttgtccttgaag

SEQ ID NO: 7818226 - DNA, 22 bp, Homo sapiens
ctggctcccgtctggtggccat

SEQ ID NO: 7818227 - DNA, 22 bp, Homo sapiens
ctggctcccgaagccctcagtg

SEQ ID NO: 7818228 - DNA, 22 bp, Homo sapiens
ctggctcccggggatcgagcac

SEQ ID NO: 7818229 - DNA, 22 bp, Homo sapiens
ctggctcccgaagccctcagtg

SEQ ID NO: 7818230 - DNA, 22 bp, Homo sapiens
ctggctcccgaagccctcagtg

SEQ ID NO: 7818231 - DNA, 22 bp, Homo sapiens
ctggctcccgtctggtggccat

SEQ ID NO: 7818232 - DNA, 22 bp, Homo sapiens
ctggctcccgtctggtggccat

SEQ ID NO: 7818233 - DNA, 22 bp, Homo sapiens
ctggctcccgtctggtggccat

SEQ ID NO: 7818234 - DNA, 22 bp, Homo sapiens
ctggctcccagctttcagggag

SEQ ID NO: 7818235 - DNA, 22 bp, Homo sapiens
ctggctcccagctttcagggag

SEQ ID NO: 7818236 - DNA, 22 bp, Homo sapiens
ctggctcccatgagctctcacg

SEQ ID NO: 7818237 - DNA, 22 bp, Homo sapiens
ctggctcccatgagctctcacg

SEQ ID NO: 7818238 - DNA, 22 bp, Homo sapiens
ctggctcccatgagctctcacg

SEQ ID NO: 7818239 - DNA, 22 bp, Homo sapiens
ctggctcccatgagctctcacg

SEQ ID NO: 7818240 - DNA, 22 bp, Homo sapiens
ctggctcccatgagctctcacg

SEQ ID NO: 7818241 - DNA, 22 bp, Homo sapiens
ctggctcccgaagccctcagtg

SEQ ID NO: 7818242 - DNA, 22 bp, Homo sapiens
ctggctcccgaagccctcagtg

SEQ ID NO: 7818243 - DNA, 22 bp, Homo sapiens
ctggctcccgaagccctcagtg

SEQ ID NO: 7818244 - DNA, 22 bp, Homo sapiens
ctggctcccgaagccctcagtg

SEQ ID NO: 7818245 - DNA, 22 bp, Homo sapiens
ctggctcccgaagccctcagtg

SEQ ID NO: 7818246 - DNA, 22 bp, Homo sapiens
ctggctcccgaagccctcagtg

SEQ ID NO: 7818247 - DNA, 22 bp, Homo sapiens
ctggctcccatgagctctcacg

SEQ ID NO: 7818248 - DNA, 22 bp, Homo sapiens
ctggctcccatgagctctcacg

SEQ ID NO: 7818249 - DNA, 22 bp, Homo sapiens
ctggccccatctggagtctgag

SEQ ID NO: 7818250 - DNA, 22 bp, Homo sapiens
ctggccccatctggagtctgag

SEQ ID NO: 7818251 - DNA, 22 bp, Homo sapiens
ctggccccaggcagcctgctgg

SEQ ID NO: 7818252 - DNA, 22 bp, Homo sapiens
ctggccccaggcagcctgctgg

SEQ ID NO: 7818253 - DNA, 22 bp, Homo sapiens
ctggccccaggcagcctgctgg

SEQ ID NO: 7818254 - DNA, 22 bp, Homo sapiens
ctggccccaggcagcctgctgg

SEQ ID NO: 7818255 - DNA, 22 bp, Homo sapiens
ctggcccccacacctgtcaggg

SEQ ID NO: 7818256 - DNA, 22 bp, Homo sapiens
ctggcccccacacctgtcaggg

SEQ ID NO: 7818257 - DNA, 22 bp, Homo sapiens
ctggcccccacacctgtcaggg

SEQ ID NO: 7818258 - DNA, 22 bp, Homo sapiens
ctggcccccacacctgtcaggg

SEQ ID NO: 7818259 - DNA, 22 bp, Homo sapiens
ctggcccattgccttctctctc

SEQ ID NO: 7818260 - DNA, 22 bp, Homo sapiens
ctggccccaggcagcctgctgg

SEQ ID NO: 7818261 - DNA, 22 bp, Homo sapiens
ctggcccatggtgagctctggg

SEQ ID NO: 7818262 - DNA, 22 bp, Homo sapiens
ctggcccatggtgagctctggg

SEQ ID NO: 7818263 - DNA, 20 bp, Homo sapiens
ctggcccatctaccgctctg

SEQ ID NO: 7818264 - DNA, 20 bp, Homo sapiens
ctggcccatctaccgctctg

SEQ ID NO: 7818265 - DNA, 22 bp, Homo sapiens
ctggcccatggtgagctctggg

SEQ ID NO: 7818266 - DNA, 22 bp, Homo sapiens
ctggcccatggtgagctctggg

SEQ ID NO: 7818267 - DNA, 22 bp, Homo sapiens
ctggcccatggtgagctctggg

SEQ ID NO: 7818268 - DNA, 22 bp, Homo sapiens
ctggcccatggtgagctctggg

SEQ ID NO: 7818269 - DNA, 22 bp, Homo sapiens
ctggcccatggtgagctctggg

SEQ ID NO: 7818270 - DNA, 22 bp, Homo sapiens
ctggcccatggtgagctctggg

SEQ ID NO: 7818271 - DNA, 22 bp, Homo sapiens
ctggcccatggtgagctctggg

SEQ ID NO: 7818272 - DNA, 22 bp, Homo sapiens
atagcaaaagcatgtgcaatac

SEQ ID NO: 7818273 - DNA, 22 bp, Homo sapiens
atagcaaaagcatgtgcaatac

SEQ ID NO: 7818274 - DNA, 22 bp, Homo sapiens
atagcaaaaggcaccagagtga

SEQ ID NO: 7818275 - DNA, 22 bp, Homo sapiens
atagcaaaaggcaccagagtga

SEQ ID NO: 7818276 - DNA, 22 bp, Homo sapiens
atagcaaaaggcaccagagtga

SEQ ID NO: 7818277 - DNA, 22 bp, Homo sapiens
atagcaaaagcatgtgcaatac

SEQ ID NO: 7818278 - DNA, 22 bp, Homo sapiens
atagcaaaagcatgtgcaatac

SEQ ID NO: 7818279 - DNA, 22 bp, Homo sapiens
atagcaaaaatgaacaaagctt

SEQ ID NO: 7818280 - DNA, 22 bp, Homo sapiens
atagcaaaaatgaacaaagctt

SEQ ID NO: 7818281 - DNA, 22 bp, Homo sapiens
atagcaaaaatgaacaaagctt

SEQ ID NO: 7818282 - DNA, 22 bp, Homo sapiens
atagcaaaaatgaacaaagctt

SEQ ID NO: 7818283 - DNA, 22 bp, Homo sapiens
atagcaaaacccactgcattac

SEQ ID NO: 7818284 - DNA, 22 bp, Homo sapiens
atagcaaaacccactgcattac

SEQ ID NO: 7818285 - DNA, 22 bp, Homo sapiens
atagcaaaaggcaccagagtga

SEQ ID NO: 7818286 - DNA, 22 bp, Homo sapiens
atagcaaaaggcaccagagtga

SEQ ID NO: 7818287 - DNA, 22 bp, Homo sapiens
atagcaaactggagcttgcttt

SEQ ID NO: 7818288 - DNA, 22 bp, Homo sapiens
atagcaaactggagcttgcttt

SEQ ID NO: 7818289 - DNA, 22 bp, Homo sapiens
atagcaaactggagcttgcttt

SEQ ID NO: 7818290 - DNA, 22 bp, Homo sapiens
atagcaaactggcagcttgtgg

SEQ ID NO: 7818291 - DNA, 22 bp, Homo sapiens
atagcaaactggcagcttgtgg

SEQ ID NO: 7818292 - DNA, 22 bp, Homo sapiens
atagcaaagatcacttccttga

SEQ ID NO: 7818293 - DNA, 22 bp, Homo sapiens
atagcaaactggcagcttgtgg

SEQ ID NO: 7818294 - DNA, 22 bp, Homo sapiens
atagcaaactggcagcttgtgg

SEQ ID NO: 7818295 - DNA, 22 bp, Homo sapiens
atagcaaactggcagcttgtgg

SEQ ID NO: 7818296 - DNA, 22 bp, Homo sapiens
atagcaaactggcagcttgtgg

SEQ ID NO: 7818297 - DNA, 22 bp, Homo sapiens
atagcaaaggacaatagtcagt

SEQ ID NO: 7818298 - DNA, 22 bp, Homo sapiens
atagcaaaggacaatagtcagt

SEQ ID NO: 7818299 - DNA, 22 bp, Homo sapiens
atagcaaaggacaatagtcagt

SEQ ID NO: 7818300 - DNA, 22 bp, Homo sapiens
atagcaaaggacaatagtcagt

SEQ ID NO: 7818301 - DNA, 22 bp, Homo sapiens
atagcaaaggacaatagtcagt

SEQ ID NO: 7818302 - DNA, 22 bp, Homo sapiens
atagcaaaggacaatagtcagt

SEQ ID NO: 7818303 - DNA, 22 bp, Homo sapiens
ctggcccagttctgcgttttgc

SEQ ID NO: 7818304 - DNA, 22 bp, Homo sapiens
ctggcccagttctgcgttttgc

SEQ ID NO: 7818305 - DNA, 22 bp, Homo sapiens
atagcaaaggacaatagtcagt

SEQ ID NO: 7818306 - DNA, 22 bp, Homo sapiens
atagcaaaggacaatagtcagt

SEQ ID NO: 7818307 - DNA, 22 bp, Homo sapiens
atagcaaagatcacttccttga

SEQ ID NO: 7818308 - DNA, 22 bp, Homo sapiens
atagcaaagatcacttccttga

SEQ ID NO: 7818309 - DNA, 22 bp, Homo sapiens
atagcaaagatgtcaattcccc

SEQ ID NO: 7818310 - DNA, 22 bp, Homo sapiens
atagcaaagcctggcacaatga

SEQ ID NO: 7818311 - DNA, 22 bp, Homo sapiens
atagcaaagcctggcacaatga

SEQ ID NO: 7818312 - DNA, 22 bp, Homo sapiens
atagcaaagcctggcacaatga

SEQ ID NO: 7818313 - DNA, 22 bp, Homo sapiens
atagcaaagcctggcacaatga

SEQ ID NO: 7818314 - DNA, 22 bp, Homo sapiens
atagcaaagcctggcacaatga

SEQ ID NO: 7818315 - DNA, 22 bp, Homo sapiens
atagcaaagcctggcacaatga

SEQ ID NO: 7818316 - DNA, 22 bp, Homo sapiens
atactacaaggtatgtgctaaa

SEQ ID NO: 7818317 - DNA, 22 bp, Homo sapiens
atactaagcccaagaacacatg

SEQ ID NO: 7818318 - DNA, 22 bp, Homo sapiens
atactaagctcattacattttg

SEQ ID NO: 7818319 - DNA, 22 bp, Homo sapiens
atactaagcccaagaacacatg

SEQ ID NO: 7818320 - DNA, 22 bp, Homo sapiens
atactaaagtatagaacttagt

SEQ ID NO: 7818321 - DNA, 22 bp, Homo sapiens
atactaaagtatagaacttagt

SEQ ID NO: 7818322 - DNA, 22 bp, Homo sapiens
atactacaatcataattgtaca

SEQ ID NO: 7818323 - DNA, 22 bp, Homo sapiens
atactacaatcataattgtaca

SEQ ID NO: 7818324 - DNA, 22 bp, Homo sapiens
atactacaatcataattgtaca

SEQ ID NO: 7818325 - DNA, 22 bp, Homo sapiens
atactacaatcataattgtaca

SEQ ID NO: 7818326 - DNA, 22 bp, Homo sapiens
atactacaatcataattgtaca

SEQ ID NO: 7818327 - DNA, 22 bp, Homo sapiens
atactacacattgactatattt

SEQ ID NO: 7818328 - DNA, 22 bp, Homo sapiens
atactacacattgactatattt

SEQ ID NO: 7818329 - DNA, 22 bp, Homo sapiens
atactacaatcataattgtaca

SEQ ID NO: 7818330 - DNA, 22 bp, Homo sapiens
atactacacattgactatattt

SEQ ID NO: 7818331 - DNA, 22 bp, Homo sapiens
atactacacattgactatattt

SEQ ID NO: 7818332 - DNA, 22 bp, Homo sapiens
atactacattattagagcctgg

SEQ ID NO: 7818333 - DNA, 22 bp, Homo sapiens
atactacattattagagcctgg

SEQ ID NO: 7818334 - DNA, 21 bp, Homo sapiens
atactacatttctctgacttt

SEQ ID NO: 7818335 - DNA, 21 bp, Homo sapiens
atactacatttctctgacttt

SEQ ID NO: 7818336 - DNA, 22 bp, Homo sapiens
atactagactgttctgttatca

SEQ ID NO: 7818337 - DNA, 22 bp, Homo sapiens
atactacatttgaaaattgcag

SEQ ID NO: 7818338 - DNA, 22 bp, Homo sapiens
atactacatttgaaaattgcag

SEQ ID NO: 7818339 - DNA, 22 bp, Homo sapiens
atactacatactatgtaaacat

SEQ ID NO: 7818340 - DNA, 22 bp, Homo sapiens
atactacatactatgtaaacat

SEQ ID NO: 7818341 - DNA, 22 bp, Homo sapiens
atactacatcacagccaagaag

SEQ ID NO: 7818342 - DNA, 22 bp, Homo sapiens
atactacatactatgtaaacat

SEQ ID NO: 7818343 - DNA, 22 bp, Homo sapiens
atactacatactatgtaaacat

SEQ ID NO: 7818344 - DNA, 22 bp, Homo sapiens
atactacactatgcatggatgt

SEQ ID NO: 7818345 - DNA, 22 bp, Homo sapiens
atactacacattgactatattt

SEQ ID NO: 7818346 - DNA, 22 bp, Homo sapiens
atactacactatgcatggatgt

SEQ ID NO: 7818347 - DNA, 22 bp, Homo sapiens
atactacactatgcatggatgt

SEQ ID NO: 7818348 - DNA, 22 bp, Homo sapiens
atactacacattgactatattt

SEQ ID NO: 7818349 - DNA, 22 bp, Homo sapiens
atactcaaggttaatgattgaa

SEQ ID NO: 7818350 - DNA, 22 bp, Homo sapiens
atactcaatttgttggaaagca

SEQ ID NO: 7818351 - DNA, 23 bp, Homo sapiens
atagactgatttggatgtgaaag

SEQ ID NO: 7818352 - DNA, 22 bp, Homo sapiens
atactatattaccttctcaact

SEQ ID NO: 7818353 - DNA, 22 bp, Homo sapiens
atactatattaccttctcaact

SEQ ID NO: 7818354 - DNA, 22 bp, Homo sapiens
atactcaaggttaatgattgaa

SEQ ID NO: 7818355 - DNA, 18 bp, Homo sapiens
atactagagctctttgcc

SEQ ID NO: 7818356 - DNA, 22 bp, Homo sapiens
atactagactgttctgttatca

SEQ ID NO: 7818357 - DNA, 22 bp, Homo sapiens
atagatgttcaatcagatattt

SEQ ID NO: 7818358 - DNA, 22 bp, Homo sapiens
atagatgtgtgtaagtacataa

SEQ ID NO: 7818359 - DNA, 22 bp, Homo sapiens
atagatgttcaatcagatattt

SEQ ID NO: 7818360 - DNA, 22 bp, Homo sapiens
atagatgtgtgtaagtacataa

SEQ ID NO: 7818361 - DNA, 22 bp, Homo sapiens
atagagctataagaattttgtg

SEQ ID NO: 7818362 - DNA, 22 bp, Homo sapiens
atagagctataagaattttgtg

SEQ ID NO: 7818363 - DNA, 22 bp, Homo sapiens
atactacatactatgtaaacat

SEQ ID NO: 7818364 - DNA, 22 bp, Homo sapiens
atagagatgggtttagttataa

SEQ ID NO: 7818365 - DNA, 22 bp, Homo sapiens
atagagatgggtttagttataa

SEQ ID NO: 7818366 - DNA, 22 bp, Homo sapiens
atagattcattctatttctccg

SEQ ID NO: 7818367 - DNA, 22 bp, Homo sapiens
atagatttgaatttaagacttg

SEQ ID NO: 7818368 - DNA, 22 bp, Homo sapiens
atagattgctagttttaaaatt

SEQ ID NO: 7818369 - DNA, 22 bp, Homo sapiens
atagattcattctatttctccg

SEQ ID NO: 7818370 - DNA, 22 bp, Homo sapiens
atagattcattctatttctccg

SEQ ID NO: 7818371 - DNA, 22 bp, Homo sapiens
atagattgctagttttaaaatt

SEQ ID NO: 7818372 - DNA, 22 bp, Homo sapiens
atagattagccctatagtttta

SEQ ID NO: 7818373 - DNA, 22 bp, Homo sapiens
atagattagccctatagtttta

SEQ ID NO: 7818374 - DNA, 22 bp, Homo sapiens
atagattagccctatagtttta

SEQ ID NO: 7818375 - DNA, 22 bp, Homo sapiens
atagattagccctatagtttta

SEQ ID NO: 7818376 - DNA, 22 bp, Homo sapiens
atagattagccctatagtttta

SEQ ID NO: 7818377 - DNA, 22 bp, Homo sapiens
atagattatttgctcattactt

SEQ ID NO: 7818378 - DNA, 22 bp, Homo sapiens
atagattagccctatagtttta

SEQ ID NO: 7818379 - DNA, 22 bp, Homo sapiens
atagattatttgctcattactt

SEQ ID NO: 7818380 - DNA, 22 bp, Homo sapiens
atagattatttgctcattactt

SEQ ID NO: 7818381 - DNA, 22 bp, Homo sapiens
ctgtgtgtcatttgtcaatcct

SEQ ID NO: 7818382 - DNA, 22 bp, Homo sapiens
ctgtgtgtcatttgtcaatcct

SEQ ID NO: 7818383 - DNA, 22 bp, Homo sapiens
ctgtgtgtcatttgtcaatcct

SEQ ID NO: 7818384 - DNA, 22 bp, Homo sapiens
ctgtgtgtcctcggacgagttt

SEQ ID NO: 7818385 - DNA, 22 bp, Homo sapiens
ctgtgtgtcatttgtcaatcct

SEQ ID NO: 7818386 - DNA, 22 bp, Homo sapiens
ctgtgtgtcatttgtcaatcct

SEQ ID NO: 7818387 - DNA, 22 bp, Homo sapiens
ctgtgtgtcatttgtcaatcct

SEQ ID NO: 7818388 - DNA, 22 bp, Homo sapiens
ctgtgtgtcctcggacgagttt

SEQ ID NO: 7818389 - DNA, 22 bp, Homo sapiens
ctgtgtgtcctcggacgagttt

SEQ ID NO: 7818390 - DNA, 22 bp, Homo sapiens
ctgtgtgtcctcggacgagttt

SEQ ID NO: 7818391 - DNA, 22 bp, Homo sapiens
atcctgaaaacttacgaagtgg

SEQ ID NO: 7818392 - DNA, 22 bp, Homo sapiens
atcctgaaaacttacgaagtgg

SEQ ID NO: 7818393 - DNA, 22 bp, Homo sapiens
ctgtgtgctcggatggactcgt

SEQ ID NO: 7818394 - DNA, 22 bp, Homo sapiens
ctgtgtgcctcctgtgatcagg

SEQ ID NO: 7818395 - DNA, 22 bp, Homo sapiens
ctgtgtgcctagagggtggccg

SEQ ID NO: 7818396 - DNA, 22 bp, Homo sapiens
ctgtgtgctgaaatgcagtgag

SEQ ID NO: 7818397 - DNA, 22 bp, Homo sapiens
ctgtgtgctcggatggactcgt

SEQ ID NO: 7818398 - DNA, 22 bp, Homo sapiens
ctgtgtgctgttagggagctgc

SEQ ID NO: 7818399 - DNA, 22 bp, Homo sapiens
ctgtgtgctgttagggagctgc

SEQ ID NO: 7818400 - DNA, 22 bp, Homo sapiens
ctgtgtgctgaaatgcagtgag

SEQ ID NO: 7818401 - DNA, 22 bp, Homo sapiens
atcctgggctgcaccctcagcc

SEQ ID NO: 7818402 - DNA, 19 bp, Homo sapiens
atcctgggtcctccagctg

SEQ ID NO: 7818403 - DNA, 22 bp, Homo sapiens
atcctgtcatcatagtacttga

SEQ ID NO: 7818404 - DNA, 22 bp, Homo sapiens
atcctgtagtctcacagcccca

SEQ ID NO: 7818405 - DNA, 22 bp, Homo sapiens
atcctgtagtctcacagcccca

SEQ ID NO: 7818406 - DNA, 19 bp, Homo sapiens
atcctgggtcctccagctg

SEQ ID NO: 7818407 - DNA, 19 bp, Homo sapiens
atcctgggtcctccagctg

SEQ ID NO: 7818408 - DNA, 22 bp, Homo sapiens
atcctgggcaagtcaatgtccc

SEQ ID NO: 7818409 - DNA, 22 bp, Homo sapiens
atcctgggcaaagtatgctgtc

SEQ ID NO: 7818410 - DNA, 22 bp, Homo sapiens
atcctgaaaacttacgaagtgg

SEQ ID NO: 7818411 - DNA, 22 bp, Homo sapiens
atcctgaaaacttacgaagtgg

SEQ ID NO: 7818412 - DNA, 22 bp, Homo sapiens
atcctgggcagttttgagtgct

SEQ ID NO: 7818413 - DNA, 18 bp, Homo sapiens
atcctgggccagtctttc

SEQ ID NO: 7818414 - DNA, 22 bp, Homo sapiens
atccaggcttaatgggagccac

SEQ ID NO: 7818415 - DNA, 22 bp, Homo sapiens
atccaggctgtctaatgggaga

SEQ ID NO: 7818416 - DNA, 22 bp, Homo sapiens
atccaggcttcagctgcctact

SEQ ID NO: 7818417 - DNA, 22 bp, Homo sapiens
atccaggcttaatgggagccac

SEQ ID NO: 7818418 - DNA, 22 bp, Homo sapiens
atccaggcttaatgggagccac

SEQ ID NO: 7818419 - DNA, 22 bp, Homo sapiens
atccagggataaaagtaaggtt

SEQ ID NO: 7818420 - DNA, 22 bp, Homo sapiens
atccagggataaaagtaaggtt

SEQ ID NO: 7818421 - DNA, 22 bp, Homo sapiens
atccagggataaaagtaaggtt

SEQ ID NO: 7818422 - DNA, 22 bp, Homo sapiens
atccagggataaaagtaaggtt

SEQ ID NO: 7818423 - DNA, 22 bp, Homo sapiens
atccaggctgctatgaggatga

SEQ ID NO: 7818424 - DNA, 22 bp, Homo sapiens
atccaggctgctttctatgccc

SEQ ID NO: 7818425 - DNA, 22 bp, Homo sapiens
atccaggctgcgggtctcaagt

SEQ ID NO: 7818426 - DNA, 22 bp, Homo sapiens
atccaggctgggtgtggctact

SEQ ID NO: 7818427 - DNA, 22 bp, Homo sapiens
atccaggctgggtgtggctact

SEQ ID NO: 7818428 - DNA, 22 bp, Homo sapiens
atccaggctggagtgcattggt

SEQ ID NO: 7818429 - DNA, 22 bp, Homo sapiens
atccaccctgtggtggctttct

SEQ ID NO: 7818430 - DNA, 22 bp, Homo sapiens
atccaccctgtggtggctttct

SEQ ID NO: 7818431 - DNA, 22 bp, Homo sapiens
atccaggcattctgacttcaag

SEQ ID NO: 7818432 - DNA, 22 bp, Homo sapiens
atccaggcctgagtctggtcct

SEQ ID NO: 7818433 - DNA, 22 bp, Homo sapiens
atccaggcctgagtctggtcct

SEQ ID NO: 7818434 - DNA, 22 bp, Homo sapiens
atccaggcgaatgcagaaggcc

SEQ ID NO: 7818435 - DNA, 22 bp, Homo sapiens
atccaggcgaatgcagaaggcc

SEQ ID NO: 7818436 - DNA, 22 bp, Homo sapiens
atccaggccttgaagtaccagt

SEQ ID NO: 7818437 - DNA, 22 bp, Homo sapiens
atccagtcccacacatgctctg

SEQ ID NO: 7818438 - DNA, 22 bp, Homo sapiens
atccagtccatgacattctgtt

SEQ ID NO: 7818439 - DNA, 22 bp, Homo sapiens
atccagtcaaaattagtaaggt

SEQ ID NO: 7818440 - DNA, 22 bp, Homo sapiens
atccagtcaaaattagtaaggt

SEQ ID NO: 7818441 - DNA, 22 bp, Homo sapiens
atccagtctgtctaccttctca

SEQ ID NO: 7818442 - DNA, 22 bp, Homo sapiens
atccagtcccacacatgctctg

SEQ ID NO: 7818443 - DNA, 22 bp, Homo sapiens
atccagtctggggtgctgcatg

SEQ ID NO: 7818444 - DNA, 22 bp, Homo sapiens
atccagtgagtgcagctgttgt

SEQ ID NO: 7818445 - DNA, 19 bp, Homo sapiens
atccaggtcatgtagttct

SEQ ID NO: 7818446 - DNA, 22 bp, Homo sapiens
atccagggtgtggagagagctc

SEQ ID NO: 7818447 - DNA, 22 bp, Homo sapiens
atccagggtgtggagagagctc

SEQ ID NO: 7818448 - DNA, 22 bp, Homo sapiens
atccagggtgtggagagagctc

SEQ ID NO: 7818449 - DNA, 22 bp, Homo sapiens
atccagggtgtggagagagctc

SEQ ID NO: 7818450 - DNA, 22 bp, Homo sapiens
ctgtgtgcctagagggtggccg

SEQ ID NO: 7818451 - DNA, 22 bp, Homo sapiens
ctgtgtgcatagttgtgctcaa

SEQ ID NO: 7818452 - DNA, 22 bp, Homo sapiens
ctgtgtgcatagttgtgctcaa

SEQ ID NO: 7818453 - DNA, 22 bp, Homo sapiens
ctgtgtgcatagttgtgctcaa

SEQ ID NO: 7818454 - DNA, 22 bp, Homo sapiens
ctgtgtgcagggcacaatggaa

SEQ ID NO: 7818455 - DNA, 22 bp, Homo sapiens
ctgtgtgcaggtgctgggtacc

SEQ ID NO: 7818456 - DNA, 22 bp, Homo sapiens
ctgtgtgcaggtgctgggtacc

SEQ ID NO: 7818457 - DNA, 22 bp, Homo sapiens
ctgtgtgcaggtgctgggtacc

SEQ ID NO: 7818458 - DNA, 22 bp, Homo sapiens
atccatacagtggaatattatt

SEQ ID NO: 7818459 - DNA, 22 bp, Homo sapiens
atccagttcttggaagcacagg

SEQ ID NO: 7818460 - DNA, 22 bp, Homo sapiens
atccagttctcagtgcttacag

SEQ ID NO: 7818461 - DNA, 22 bp, Homo sapiens
atccagttccaaagatcattta

SEQ ID NO: 7818462 - DNA, 22 bp, Homo sapiens
ctgtgtgcagggcacaatggaa

SEQ ID NO: 7818463 - DNA, 22 bp, Homo sapiens
ctgtgtgcagggcacaatggaa

SEQ ID NO: 7818464 - DNA, 22 bp, Homo sapiens
ctgtgtgcagggcacaatggaa

SEQ ID NO: 7818465 - DNA, 22 bp, Homo sapiens
ctgtgtgcaacttgcagttttg

SEQ ID NO: 7818466 - DNA, 22 bp, Homo sapiens
atccatcagaagggcaaaattt

SEQ ID NO: 7818467 - DNA, 22 bp, Homo sapiens
atccatacagtggaatattatt

SEQ ID NO: 7818468 - DNA, 20 bp, Homo sapiens
atcagacttttaggaacata

SEQ ID NO: 7818469 - DNA, 22 bp, Homo sapiens
atcagagaaatggagggcgctt

SEQ ID NO: 7818470 - DNA, 22 bp, Homo sapiens
atcagagaagtttcactggcat

SEQ ID NO: 7818471 - DNA, 22 bp, Homo sapiens
atcagagacaaaaccagcactt

SEQ ID NO: 7818472 - DNA, 22 bp, Homo sapiens
atcagagcaatggataaaatca

SEQ ID NO: 7818473 - DNA, 22 bp, Homo sapiens
atcagagcaatggataaaatca

SEQ ID NO: 7818474 - DNA, 22 bp, Homo sapiens
atcagagattgtagtatgtgca

SEQ ID NO: 7818475 - DNA, 22 bp, Homo sapiens
atcagagattgtagtatgtgca

SEQ ID NO: 7818476 - DNA, 22 bp, Homo sapiens
ctgtggagtgtagatgctgggt

SEQ ID NO: 7818477 - DNA, 22 bp, Homo sapiens
ctgtggagtgtagatgctgggt

SEQ ID NO: 7818478 - DNA, 22 bp, Homo sapiens
atcagagcccggcaatttattt

SEQ ID NO: 7818479 - DNA, 22 bp, Homo sapiens
atcagaattagccagtgaggct

SEQ ID NO: 7818480 - DNA, 22 bp, Homo sapiens
atcagacaattgttgagtactg

SEQ ID NO: 7818481 - DNA, 22 bp, Homo sapiens
atcagacaattgttgagtactg

SEQ ID NO: 7818482 - DNA, 22 bp, Homo sapiens
atcagacactagtggactagaa

SEQ ID NO: 7818483 - DNA, 22 bp, Homo sapiens
atcagacactagtggactagaa

SEQ ID NO: 7818484 - DNA, 22 bp, Homo sapiens
atcagacagggagttctgtgtc

SEQ ID NO: 7818485 - DNA, 22 bp, Homo sapiens
atcagacagggaattatagcag

SEQ ID NO: 7818486 - DNA, 22 bp, Homo sapiens
atcagaattagccagtgaggct

SEQ ID NO: 7818487 - DNA, 22 bp, Homo sapiens
atcagaatggagcccacatggt

SEQ ID NO: 7818488 - DNA, 22 bp, Homo sapiens
atcagaatcttctgaacagtgg

SEQ ID NO: 7818489 - DNA, 22 bp, Homo sapiens
atcagaatcttctgaacagtgg

SEQ ID NO: 7818490 - DNA, 22 bp, Homo sapiens
atcagaatcttctgaacagtgg

SEQ ID NO: 7818491 - DNA, 22 bp, Homo sapiens
atcagaatgattagtaaccaat

SEQ ID NO: 7818492 - DNA, 19 bp, Homo sapiens
ctgtggcctccaggaggga

SEQ ID NO: 7818493 - DNA, 21 bp, Homo sapiens
ctgtggcctggctagcaccgt

SEQ ID NO: 7818494 - DNA, 22 bp, Homo sapiens
ctgtggccttggaccagcatct

SEQ ID NO: 7818495 - DNA, 22 bp, Homo sapiens
ctgtggcctttgttggaggtcc

SEQ ID NO: 7818496 - DNA, 22 bp, Homo sapiens
ctgtggcctttgttggaggtcc

SEQ ID NO: 7818497 - DNA, 22 bp, Homo sapiens
ctgtggcctttgttggaggtcc

SEQ ID NO: 7818498 - DNA, 22 bp, Homo sapiens
ctgtggccttggaccagcatct

SEQ ID NO: 7818499 - DNA, 23 bp, Homo sapiens
ctgtggccctgcttcatgcagcc

SEQ ID NO: 7818500 - DNA, 23 bp, Homo sapiens
ctgtggccctgcttcatgcagcc

SEQ ID NO: 7818501 - DNA, 23 bp, Homo sapiens
ctgtggccctgcttcatgcagcc

SEQ ID NO: 7818502 - DNA, 22 bp, Homo sapiens
ctgtggagttccatcaggggag

SEQ ID NO: 7818503 - DNA, 22 bp, Homo sapiens
ctgtggagttccatcaggggag

SEQ ID NO: 7818504 - DNA, 22 bp, Homo sapiens
ctgtggagttccatcaggggag

SEQ ID NO: 7818505 - DNA, 22 bp, Homo sapiens
ctgtggagtgtagatgctgggt

SEQ ID NO: 7818506 - DNA, 23 bp, Homo sapiens
ctgtggccctgcttcatgcagcc

SEQ ID NO: 7818507 - DNA, 22 bp, Homo sapiens
ctgtggccctgtgatctggcac

SEQ ID NO: 7818508 - DNA, 22 bp, Homo sapiens
ctgtggccctgtgatctggcac

SEQ ID NO: 7818509 - DNA, 22 bp, Homo sapiens
ctgtggccctgtgatctggcac

SEQ ID NO: 7818510 - DNA, 19 bp, Homo sapiens
ctgtggcctccaggaggga

SEQ ID NO: 7818511 - DNA, 19 bp, Homo sapiens
ctgtggcctccaggaggga

SEQ ID NO: 7818512 - DNA, 19 bp, Homo sapiens
ctgtggcctccaggaggga

SEQ ID NO: 7818513 - DNA, 19 bp, Homo sapiens
ctgtggcctccaggaggga

SEQ ID NO: 7818514 - DNA, 19 bp, Homo sapiens
ctgtggcctccaggaggga

SEQ ID NO: 7818515 - DNA, 22 bp, Homo sapiens
ctgtgggaaaggatgagattgc

SEQ ID NO: 7818516 - DNA, 18 bp, Homo sapiens
ctgtgggaagagtttggg

SEQ ID NO: 7818517 - DNA, 18 bp, Homo sapiens
ctgtgggaagagtttggg

SEQ ID NO: 7818518 - DNA, 18 bp, Homo sapiens
ctgtgggaaggctttcta

SEQ ID NO: 7818519 - DNA, 23 bp, Homo sapiens
ctgtgggaagtcggggagcgcgc

SEQ ID NO: 7818520 - DNA, 18 bp, Homo sapiens
ctgtgggaaggctttcta

SEQ ID NO: 7818521 - DNA, 23 bp, Homo sapiens
ctgtgggaagtcggggagcgcgc

SEQ ID NO: 7818522 - DNA, 23 bp, Homo sapiens
ctgtgggaagtcggggagcgcgc

SEQ ID NO: 7818523 - DNA, 23 bp, Homo sapiens
ctgtgggaagtcggggagcgcgc

SEQ ID NO: 7818524 - DNA, 22 bp, Homo sapiens
ctgtgggaatactgcgagtgta

SEQ ID NO: 7818525 - DNA, 22 bp, Homo sapiens
ctgtgggagaggtgcctggatt

SEQ ID NO: 7818526 - DNA, 22 bp, Homo sapiens
ctgtgggagaagttgctggagt

SEQ ID NO: 7818527 - DNA, 22 bp, Homo sapiens
ctgtgggagaagttgctggagt

SEQ ID NO: 7818528 - DNA, 21 bp, Homo sapiens
ctgtgggaccaagcactggga

SEQ ID NO: 7818529 - DNA, 21 bp, Homo sapiens
ctgtgggaccaagcactggga

SEQ ID NO: 7818530 - DNA, 22 bp, Homo sapiens
ctgtgggaaaggatgagattgc

SEQ ID NO: 7818531 - DNA, 22 bp, Homo sapiens
ctgtggcttttccggggagcct

SEQ ID NO: 7818532 - DNA, 22 bp, Homo sapiens
ctgtggctttgtgtctattgta

SEQ ID NO: 7818533 - DNA, 22 bp, Homo sapiens
ctgtggctttggggcggaggac

SEQ ID NO: 7818534 - DNA, 22 bp, Homo sapiens
ctgtggctttggggcggaggac

SEQ ID NO: 7818535 - DNA, 22 bp, Homo sapiens
ctgtggctttgcagggcttgtt

SEQ ID NO: 7818536 - DNA, 22 bp, Homo sapiens
ctgtggctttgcagggcttgtt

SEQ ID NO: 7818537 - DNA, 22 bp, Homo sapiens
ctgtggctcaattgcctactga

SEQ ID NO: 7818538 - DNA, 22 bp, Homo sapiens
ctgtggctcaattgcctactga

SEQ ID NO: 7818539 - DNA, 22 bp, Homo sapiens
ctgtggctcagcacggggtcag

SEQ ID NO: 7818540 - DNA, 22 bp, Homo sapiens
ctgtggctcaggcctgtaagcc

SEQ ID NO: 7818541 - DNA, 22 bp, Homo sapiens
ctgtggctcaattgcctactga

SEQ ID NO: 7818542 - DNA, 22 bp, Homo sapiens
ctgtggctcaattgcctactga

SEQ ID NO: 7818543 - DNA, 22 bp, Homo sapiens
ctgtggctcaaaatcccatgat

SEQ ID NO: 7818544 - DNA, 22 bp, Homo sapiens
ctgtggctcaaaatcccatgat

SEQ ID NO: 7818545 - DNA, 22 bp, Homo sapiens
ctgtggctcaaaatcccatgat

SEQ ID NO: 7818546 - DNA, 22 bp, Homo sapiens
ctgtggctcaaaatcccatgat

SEQ ID NO: 7818547 - DNA, 22 bp, Homo sapiens
ctgtggctatggtgtacatact

SEQ ID NO: 7818548 - DNA, 22 bp, Homo sapiens
ctgtggctatggtgtacatact

SEQ ID NO: 7818549 - DNA, 22 bp, Homo sapiens
ctgtggctaggaagctgtggga

SEQ ID NO: 7818550 - DNA, 22 bp, Homo sapiens
ctgtggctaggaagctgtggga

SEQ ID NO: 7818551 - DNA, 22 bp, Homo sapiens
ctgtggctaggaagctgtggga

SEQ ID NO: 7818552 - DNA, 22 bp, Homo sapiens
ctgtggctaggaagctgtggga

SEQ ID NO: 7818553 - DNA, 22 bp, Homo sapiens
cttagagcttaggctagccatt

SEQ ID NO: 7818554 - DNA, 22 bp, Homo sapiens
cttagagcttaggctagccatt

SEQ ID NO: 7818555 - DNA, 22 bp, Homo sapiens
cttagagccttactcttcttgt

SEQ ID NO: 7818556 - DNA, 22 bp, Homo sapiens
cttagatgaagtcacagaaccc

SEQ ID NO: 7818557 - DNA, 22 bp, Homo sapiens
cttagatgaagtcacagaaccc

SEQ ID NO: 7818558 - DNA, 22 bp, Homo sapiens
cttagatgaagtcacagaaccc

SEQ ID NO: 7818559 - DNA, 22 bp, Homo sapiens
cttagatgaagtcacagaaccc

SEQ ID NO: 7818560 - DNA, 22 bp, Homo sapiens
cttccaggtgctggcctggcct

SEQ ID NO: 7818561 - DNA, 22 bp, Homo sapiens
cttccaggtgctggcctggcct

SEQ ID NO: 7818562 - DNA, 22 bp, Homo sapiens
cttcattaactattggaatgca

SEQ ID NO: 7818563 - DNA, 22 bp, Homo sapiens
cttcattaatgtctataagttt

SEQ ID NO: 7818564 - DNA, 22 bp, Homo sapiens
cttagagatgggttttacttag

SEQ ID NO: 7818565 - DNA, 22 bp, Homo sapiens
cttagagatgggttttacttag

SEQ ID NO: 7818566 - DNA, 22 bp, Homo sapiens
cttagagatgggttttacttag

SEQ ID NO: 7818567 - DNA, 22 bp, Homo sapiens
cttagagatgggttttacttag

SEQ ID NO: 7818568 - DNA, 22 bp, Homo sapiens
cttagagatgggttttacttag

SEQ ID NO: 7818569 - DNA, 22 bp, Homo sapiens
cttagagatgggttttacttag

SEQ ID NO: 7818570 - DNA, 22 bp, Homo sapiens
cttagagatgggttttacttag

SEQ ID NO: 7818571 - DNA, 22 bp, Homo sapiens
cttagagccttactcttcttgt

SEQ ID NO: 7818572 - DNA, 22 bp, Homo sapiens
cttagaatgggacccaatgggt

SEQ ID NO: 7818573 - DNA, 22 bp, Homo sapiens
cttagaattttaatccagaaag

SEQ ID NO: 7818574 - DNA, 22 bp, Homo sapiens
cttagaattttaatccagaaag

SEQ ID NO: 7818575 - DNA, 22 bp, Homo sapiens
cttagaatgtctactcttacca

SEQ ID NO: 7818576 - DNA, 22 bp, Homo sapiens
cttagaagtgggctataattag

SEQ ID NO: 7818577 - DNA, 22 bp, Homo sapiens
cttagaataaaagggggctata

SEQ ID NO: 7818578 - DNA, 22 bp, Homo sapiens
cttagacatggcagctccaagt

SEQ ID NO: 7818579 - DNA, 22 bp, Homo sapiens
cttagagatgggttttacttag

SEQ ID NO: 7818580 - DNA, 22 bp, Homo sapiens
cttagagatgggttttacttag

SEQ ID NO: 7818581 - DNA, 22 bp, Homo sapiens
cttagaattttgcctactacaa

SEQ ID NO: 7818582 - DNA, 22 bp, Homo sapiens
cttagacatggcagctccaagt

SEQ ID NO: 7818583 - DNA, 20 bp, Homo sapiens
cttagaagggacatcctggg

SEQ ID NO: 7818584 - DNA, 22 bp, Homo sapiens
cttagaaggaacagtttagtgc

SEQ ID NO: 7818585 - DNA, 22 bp, Homo sapiens
cttagaaggatgtttgctgttt

SEQ ID NO: 7818586 - DNA, 22 bp, Homo sapiens
cttagaacattctgcctgggaa

SEQ ID NO: 7818587 - DNA, 18 bp, Homo sapiens
cttagaacatcattcctt

SEQ ID NO: 7818588 - DNA, 22 bp, Homo sapiens
cttagaacattctgcctgggaa

SEQ ID NO: 7818589 - DNA, 22 bp, Homo sapiens
cttagaagaatgcctaggacag

SEQ ID NO: 7818590 - DNA, 22 bp, Homo sapiens
cttagaacagtgtctgccagag

SEQ ID NO: 7818591 - DNA, 22 bp, Homo sapiens
cttagaacatacttagtgtgat

SEQ ID NO: 7818592 - DNA, 20 bp, Homo sapiens
cttagaaatttttaccctgg

SEQ ID NO: 7818593 - DNA, 20 bp, Homo sapiens
cttagaaatttttaccctgg

SEQ ID NO: 7818594 - DNA, 20 bp, Homo sapiens
cttagaaatttttaccctgg

SEQ ID NO: 7818595 - DNA, 22 bp, Homo sapiens
cttagaaattgttactcattca

SEQ ID NO: 7818596 - DNA, 22 bp, Homo sapiens
atccttaatttacttgcatctt

SEQ ID NO: 7818597 - DNA, 22 bp, Homo sapiens
cttagaaattgttactcattca

SEQ ID NO: 7818598 - DNA, 22 bp, Homo sapiens
cttagaaattgttactcattca

SEQ ID NO: 7818599 - DNA, 22 bp, Homo sapiens
cttagaaattgttactcattca

SEQ ID NO: 7818600 - DNA, 22 bp, Homo sapiens
atcctgtgttgctactggagga

SEQ ID NO: 7818601 - DNA, 20 bp, Homo sapiens
atccttaaagagaatttcta

SEQ ID NO: 7818602 - DNA, 22 bp, Homo sapiens
cttagaaattgttactcattca

SEQ ID NO: 7818603 - DNA, 22 bp, Homo sapiens
cttagaaattgttactcattca

SEQ ID NO: 7818604 - DNA, 22 bp, Homo sapiens
cttagaaattgttactcattca

SEQ ID NO: 7818605 - DNA, 22 bp, Homo sapiens
atccttaaaggaattctgattt

SEQ ID NO: 7818606 - DNA, 22 bp, Homo sapiens
atccttaagaaagttttctata

SEQ ID NO: 7818607 - DNA, 22 bp, Homo sapiens
atcctgtggctccagggagccg

SEQ ID NO: 7818608 - DNA, 22 bp, Homo sapiens
atcctgtggggcggctgcaggg

SEQ ID NO: 7818609 - DNA, 22 bp, Homo sapiens
atcctgtgtccactgctctgtg

SEQ ID NO: 7818610 - DNA, 22 bp, Homo sapiens
atcctgtgcaatgactgcatct

SEQ ID NO: 7818611 - DNA, 22 bp, Homo sapiens
atcctgtgagggagcatagtta

SEQ ID NO: 7818612 - DNA, 22 bp, Homo sapiens
cttcctagtgtctactttggag

SEQ ID NO: 7818613 - DNA, 22 bp, Homo sapiens
cttcctcaggcattagctggac

SEQ ID NO: 7818614 - DNA, 22 bp, Homo sapiens
cttcctcaggcattagctggac

SEQ ID NO: 7818615 - DNA, 22 bp, Homo sapiens
cttcccactagtatcacagagc

SEQ ID NO: 7818616 - DNA, 22 bp, Homo sapiens
cttcccactagtatcacagagc

SEQ ID NO: 7818617 - DNA, 22 bp, Homo sapiens
cttcccactagtatcacagagc

SEQ ID NO: 7818618 - DNA, 22 bp, Homo sapiens
cttcccactagtatcacagagc

SEQ ID NO: 7818619 - DNA, 22 bp, Homo sapiens
cttcctaaaagcttcaagagaa

SEQ ID NO: 7818620 - DNA, 22 bp, Homo sapiens
cttcctagagccggcagtgagg

SEQ ID NO: 7818621 - DNA, 22 bp, Homo sapiens
cttcctaaaagcttcaagagaa

SEQ ID NO: 7818622 - DNA, 22 bp, Homo sapiens
cttcccagaacaatgtaggctt

SEQ ID NO: 7818623 - DNA, 22 bp, Homo sapiens
cttcccagaacaatgtaggctt

SEQ ID NO: 7818624 - DNA, 22 bp, Homo sapiens
cttcccagaacaatgtaggctt

SEQ ID NO: 7818625 - DNA, 22 bp, Homo sapiens
cttcctcccccacacactcact

SEQ ID NO: 7818626 - DNA, 22 bp, Homo sapiens
cttcctcccccacacactcact

SEQ ID NO: 7818627 - DNA, 22 bp, Homo sapiens
cttcctcccccacacactcact

SEQ ID NO: 7818628 - DNA, 22 bp, Homo sapiens
cttcctcccccacacactcact

SEQ ID NO: 7818629 - DNA, 22 bp, Homo sapiens
cttcctcccggcccatgctctg

SEQ ID NO: 7818630 - DNA, 22 bp, Homo sapiens
cttcctcccccacacactcact

SEQ ID NO: 7818631 - DNA, 18 bp, Homo sapiens
cttcctcatcgctctccc

SEQ ID NO: 7818632 - DNA, 22 bp, Homo sapiens
cttcccaagctttagttatttt

SEQ ID NO: 7818633 - DNA, 21 bp, Homo sapiens
cttcccaaggcttcaaagcct

SEQ ID NO: 7818634 - DNA, 22 bp, Homo sapiens
cttcccaagctttagttatttt

SEQ ID NO: 7818635 - DNA, 22 bp, Homo sapiens
cttcccaagactgtattgcaag

SEQ ID NO: 7818636 - DNA, 22 bp, Homo sapiens
cttccagtggcaccaacatgca

SEQ ID NO: 7818637 - DNA, 22 bp, Homo sapiens
cttcccaagtaaatttgtattt

SEQ ID NO: 7818638 - DNA, 21 bp, Homo sapiens
cttcccaaggcttcaaagcct

SEQ ID NO: 7818639 - DNA, 22 bp, Homo sapiens
cttcccacagaattcaatcagt

SEQ ID NO: 7818640 - DNA, 17 bp, Homo sapiens
cttcccaccatctcctg

SEQ ID NO: 7818641 - DNA, 17 bp, Homo sapiens
cttcccaccatctcctg

SEQ ID NO: 7818642 - DNA, 17 bp, Homo sapiens
cttcccaccatctcctg

SEQ ID NO: 7818643 - DNA, 22 bp, Homo sapiens
cttcccaccaaagcccttgttg

SEQ ID NO: 7818644 - DNA, 22 bp, Homo sapiens
cttcccaccaaagcccttgttg

SEQ ID NO: 7818645 - DNA, 22 bp, Homo sapiens
cttcccaccaaagcccttgttg

SEQ ID NO: 7818646 - DNA, 17 bp, Homo sapiens
cttcccaccatctcctg

SEQ ID NO: 7818647 - DNA, 22 bp, Homo sapiens
cttcccactaaagcccttgttg

SEQ ID NO: 7818648 - DNA, 17 bp, Homo sapiens
cttcccaccatctcctg

SEQ ID NO: 7818649 - DNA, 22 bp, Homo sapiens
cttcccactaaagcccttgttg

SEQ ID NO: 7818650 - DNA, 22 bp, Homo sapiens
cttcccactaaagcccttgttg

SEQ ID NO: 7818651 - DNA, 22 bp, Homo sapiens
cttcccaagactgtattgcaag

SEQ ID NO: 7818652 - DNA, 22 bp, Homo sapiens
cttccagtggcaccaacatgca

SEQ ID NO: 7818653 - DNA, 22 bp, Homo sapiens
cttccagtggttctggagggag

SEQ ID NO: 7818654 - DNA, 22 bp, Homo sapiens
cttccagtttccccttccagtc

SEQ ID NO: 7818655 - DNA, 22 bp, Homo sapiens
cttccagtttccccttccagtc

SEQ ID NO: 7818656 - DNA, 22 bp, Homo sapiens
cttccagtcttttcagtggagt

SEQ ID NO: 7818657 - DNA, 22 bp, Homo sapiens
cttccagtcttttcagtggagt

SEQ ID NO: 7818658 - DNA, 22 bp, Homo sapiens
cttccagtggcaccaacatgca

SEQ ID NO: 7818659 - DNA, 22 bp, Homo sapiens
cttccagtgcataggtagatca

SEQ ID NO: 7818660 - DNA, 22 bp, Homo sapiens
cttccagtcttttcagtggagt

SEQ ID NO: 7818661 - DNA, 22 bp, Homo sapiens
cttccaggttctggttgggaag

SEQ ID NO: 7818662 - DNA, 23 bp, Homo sapiens
cttccagtactgcacactcaagg

SEQ ID NO: 7818663 - DNA, 22 bp, Homo sapiens
cttccaggttctggttgggaag

SEQ ID NO: 7818664 - DNA, 22 bp, Homo sapiens
cttccaggttctggttgggaag

SEQ ID NO: 7818665 - DNA, 22 bp, Homo sapiens
cttccaggtgctggcctggcct

SEQ ID NO: 7818666 - DNA, 22 bp, Homo sapiens
cttccaggtgctggcctggcct

SEQ ID NO: 7818667 - DNA, 22 bp, Homo sapiens
cttccagtagtatcattctcat

SEQ ID NO: 7818668 - DNA, 22 bp, Homo sapiens
cttccagtctagagctatctgt

SEQ ID NO: 7818669 - DNA, 23 bp, Homo sapiens
cttccagtactgcacactcaagg

SEQ ID NO: 7818670 - DNA, 22 bp, Homo sapiens
cttccagtagtatcattctcat

SEQ ID NO: 7818671 - DNA, 23 bp, Homo sapiens
cttccagtactgcacactcaagg

SEQ ID NO: 7818672 - DNA, 23 bp, Homo sapiens
cttccagtactgcacactcaagg

SEQ ID NO: 7818673 - DNA, 22 bp, Homo sapiens
atctgagtgttggatttattgt

SEQ ID NO: 7818674 - DNA, 18 bp, Homo sapiens
atctgatgcaattcaata

SEQ ID NO: 7818675 - DNA, 18 bp, Homo sapiens
atctgatgcaattcaata

SEQ ID NO: 7818676 - DNA, 22 bp, Homo sapiens
atctgagtgttggatttattgt

SEQ ID NO: 7818677 - DNA, 20 bp, Homo sapiens
atctgaggctgtcgctggaa

SEQ ID NO: 7818678 - DNA, 22 bp, Homo sapiens
atctgagtcaaatatttcattt

SEQ ID NO: 7818679 - DNA, 22 bp, Homo sapiens
atctgaggtatatgactggcta

SEQ ID NO: 7818680 - DNA, 22 bp, Homo sapiens
atctgagggtttgggcatcagc

SEQ ID NO: 7818681 - DNA, 22 bp, Homo sapiens
atctgcacttaagcgaggcctg

SEQ ID NO: 7818682 - DNA, 22 bp, Homo sapiens
atctgcacttaagcgaggcctg

SEQ ID NO: 7818683 - DNA, 22 bp, Homo sapiens
atctgatttgtaattttagaaa

SEQ ID NO: 7818684 - DNA, 22 bp, Homo sapiens
atctgatgtcagtgcaattatc

SEQ ID NO: 7818685 - DNA, 22 bp, Homo sapiens
atctgcaggatgttaggatgat

SEQ ID NO: 7818686 - DNA, 22 bp, Homo sapiens
atctgcaggaatgtgtgcagag

SEQ ID NO: 7818687 - DNA, 22 bp, Homo sapiens
atctgcaggaatgtgtgcagag

SEQ ID NO: 7818688 - DNA, 19 bp, Homo sapiens
atctgagattataaacaga

SEQ ID NO: 7818689 - DNA, 22 bp, Homo sapiens
atctgagatgcaggtgggtgga

SEQ ID NO: 7818690 - DNA, 19 bp, Homo sapiens
atctgagattataaacaga

SEQ ID NO: 7818691 - DNA, 22 bp, Homo sapiens
atctgacatctccctctgacat

SEQ ID NO: 7818692 - DNA, 22 bp, Homo sapiens
atctgacatctccctctgacat

SEQ ID NO: 7818693 - DNA, 22 bp, Homo sapiens
atctgagactgagtttggattt

SEQ ID NO: 7818694 - DNA, 22 bp, Homo sapiens
atctgagaagattttggcataa

SEQ ID NO: 7818695 - DNA, 22 bp, Homo sapiens
atctgacaaggccacatattct

SEQ ID NO: 7818696 - DNA, 22 bp, Homo sapiens
atctgacaagttgtgtgtatag

SEQ ID NO: 7818697 - DNA, 22 bp, Homo sapiens
atctgacaaggccacatattct

SEQ ID NO: 7818698 - DNA, 22 bp, Homo sapiens
atctgacaagttgtgtgtatag

SEQ ID NO: 7818699 - DNA, 22 bp, Homo sapiens
atctgacatctactagaacaga

SEQ ID NO: 7818700 - DNA, 22 bp, Homo sapiens
cttcttgggttctgagattaca

SEQ ID NO: 7818701 - DNA, 22 bp, Homo sapiens
cttcttgggtcagagaatcatt

SEQ ID NO: 7818702 - DNA, 22 bp, Homo sapiens
cttcttggtgatggcttacctg

SEQ ID NO: 7818703 - DNA, 22 bp, Homo sapiens
cttcttgtatctgccgccgagc

SEQ ID NO: 7818704 - DNA, 22 bp, Homo sapiens
cttcttggttggtttcattcca

SEQ ID NO: 7818705 - DNA, 22 bp, Homo sapiens
cttcttgtaaacggttccccga

SEQ ID NO: 7818706 - DNA, 22 bp, Homo sapiens
cttcttggctgcaagtctctgt

SEQ ID NO: 7818707 - DNA, 22 bp, Homo sapiens
cttcttggctgcaagtctctgt

SEQ ID NO: 7818708 - DNA, 22 bp, Homo sapiens
cttcttggctgcaagtctctgt

SEQ ID NO: 7818709 - DNA, 22 bp, Homo sapiens
cttcttgggctgccagtttcag

SEQ ID NO: 7818710 - DNA, 21 bp, Homo sapiens
cttcttggggagcagctagac

SEQ ID NO: 7818711 - DNA, 22 bp, Homo sapiens
cttcttggaagtcgtccttcca

SEQ ID NO: 7818712 - DNA, 22 bp, Homo sapiens
cttcttggactactcactagag

SEQ ID NO: 7818713 - DNA, 20 bp, Homo sapiens
cttcttggagatggtgtttt

SEQ ID NO: 7818714 - DNA, 20 bp, Homo sapiens
cttcttggagatggtgtttt

SEQ ID NO: 7818715 - DNA, 22 bp, Homo sapiens
cttcttggaagtcgtccttcca

SEQ ID NO: 7818716 - DNA, 22 bp, Homo sapiens
cttcttattaatccttctctgt

SEQ ID NO: 7818717 - DNA, 22 bp, Homo sapiens
cttcttgattgctttcaaacca

SEQ ID NO: 7818718 - DNA, 22 bp, Homo sapiens
cttcttaatgcataaactgtgt

SEQ ID NO: 7818719 - DNA, 22 bp, Homo sapiens
atctgcatgggtaataacacag

SEQ ID NO: 7818720 - DNA, 22 bp, Homo sapiens
atctgcagtttgttttctcttg

SEQ ID NO: 7818721 - DNA, 22 bp, Homo sapiens
atctgcagtttgttttctcttg

SEQ ID NO: 7818722 - DNA, 22 bp, Homo sapiens
atctgaaatagtcttatctgag

SEQ ID NO: 7818723 - DNA, 22 bp, Homo sapiens
atctgaaagtttagaattcttg

SEQ ID NO: 7818724 - DNA, 22 bp, Homo sapiens
atctgaaagtttagaattcttg

SEQ ID NO: 7818725 - DNA, 22 bp, Homo sapiens
atctgaaagctaggagttctca

SEQ ID NO: 7818726 - DNA, 22 bp, Homo sapiens
atctgaaagctaggagttctca

SEQ ID NO: 7818727 - DNA, 22 bp, Homo sapiens
atctgaaagctaggagttctca

SEQ ID NO: 7818728 - DNA, 22 bp, Homo sapiens
atctgaagaatgaatggaatta

SEQ ID NO: 7818729 - DNA, 22 bp, Homo sapiens
atctgaagaggtcatggctgac

SEQ ID NO: 7818730 - DNA, 22 bp, Homo sapiens
atctgaagaggtcatggctgac

SEQ ID NO: 7818731 - DNA, 22 bp, Homo sapiens
atctgaagaatgaatggaatta

SEQ ID NO: 7818732 - DNA, 19 bp, Homo sapiens
atctgaagtaggtgcagct

SEQ ID NO: 7818733 - DNA, 22 bp, Homo sapiens
atctgaagggaagtggaaggca

SEQ ID NO: 7818734 - DNA, 19 bp, Homo sapiens
atctgaagtaggtgcagct

SEQ ID NO: 7818735 - DNA, 22 bp, Homo sapiens
atctgaagaggtcatggctgac

SEQ ID NO: 7818736 - DNA, 22 bp, Homo sapiens
atctgaagaggtcatggctgac

SEQ ID NO: 7818737 - DNA, 22 bp, Homo sapiens
atctgaagctatctgcacttca

SEQ ID NO: 7818738 - DNA, 22 bp, Homo sapiens
atctgaagggaagtggaaggca

SEQ ID NO: 7818739 - DNA, 22 bp, Homo sapiens
atctgaagggaagtggaaggca

SEQ ID NO: 7818740 - DNA, 21 bp, Homo sapiens
atctgaagtttgagaggaaag

SEQ ID NO: 7818741 - DNA, 22 bp, Homo sapiens
atctgaagtccttataatctga

SEQ ID NO: 7818742 - DNA, 22 bp, Homo sapiens
atctgaagtccttataatctga

SEQ ID NO: 7818743 - DNA, 22 bp, Homo sapiens
atctgaagtggagaaaaatata

SEQ ID NO: 7818744 - DNA, 21 bp, Homo sapiens
atctgaagtttgagaggaaag

SEQ ID NO: 7818745 - DNA, 22 bp, Homo sapiens
atctgaagtggagaaaaatata

SEQ ID NO: 7818746 - DNA, 22 bp, Homo sapiens
atctctgatttacagcatctct

SEQ ID NO: 7818747 - DNA, 22 bp, Homo sapiens
atctctgatttacagcatctct

SEQ ID NO: 7818748 - DNA, 22 bp, Homo sapiens
cttcctctagcctagtaatgcc

SEQ ID NO: 7818749 - DNA, 22 bp, Homo sapiens
cttcctcccggcccatgctctg

SEQ ID NO: 7818750 - DNA, 22 bp, Homo sapiens
cttcctcccggcccatgctctg

SEQ ID NO: 7818751 - DNA, 22 bp, Homo sapiens
cttcctccgaagaagttgctgg

SEQ ID NO: 7818752 - DNA, 22 bp, Homo sapiens
cttcctccgaagaagttgctgg

SEQ ID NO: 7818753 - DNA, 22 bp, Homo sapiens
cttcctccgaagaagttgctgg

SEQ ID NO: 7818754 - DNA, 22 bp, Homo sapiens
cttcctccgaagaagttgctgg

SEQ ID NO: 7818755 - DNA, 22 bp, Homo sapiens
cttcctccgaagaagttgctgg

SEQ ID NO: 7818756 - DNA, 22 bp, Homo sapiens
cttcctcctccatctcgaaggc

SEQ ID NO: 7818757 - DNA, 22 bp, Homo sapiens
atctgaaactctgacattgtct

SEQ ID NO: 7818758 - DNA, 22 bp, Homo sapiens
atctgaaaagctttaatgagct

SEQ ID NO: 7818759 - DNA, 22 bp, Homo sapiens
atctgaaaagcctcttactcct

SEQ ID NO: 7818760 - DNA, 22 bp, Homo sapiens
atctctttgatggctcctgtga

SEQ ID NO: 7818761 - DNA, 22 bp, Homo sapiens
atctctgcgtccccagcatcga

SEQ ID NO: 7818762 - DNA, 22 bp, Homo sapiens
atcagaataattagatttcaga

SEQ ID NO: 7818763 - DNA, 22 bp, Homo sapiens
atcagaatactatcaacagtga

SEQ ID NO: 7818764 - DNA, 22 bp, Homo sapiens
atcagaatagtgggggacagtc

SEQ ID NO: 7818765 - DNA, 22 bp, Homo sapiens
atcagaatagtgggggacagtc

SEQ ID NO: 7818766 - DNA, 22 bp, Homo sapiens
atcagaatactatcaacagtga

SEQ ID NO: 7818767 - DNA, 21 bp, Homo sapiens
atcagaatctctagatttgga

SEQ ID NO: 7818768 - DNA, 22 bp, Homo sapiens
atcagaagtgatgtgtgttatt

SEQ ID NO: 7818769 - DNA, 22 bp, Homo sapiens
atcagaagtgatgtgtgttatt

SEQ ID NO: 7818770 - DNA, 20 bp, Homo sapiens
atcagaagtgatattaacca

SEQ ID NO: 7818771 - DNA, 22 bp, Homo sapiens
atcagaagttgtgcatgcatgg

SEQ ID NO: 7818772 - DNA, 21 bp, Homo sapiens
atcagaagttttggtcagtag

SEQ ID NO: 7818773 - DNA, 22 bp, Homo sapiens
atcagaagcttgtagtctctct

SEQ ID NO: 7818774 - DNA, 22 bp, Homo sapiens
atcagaaggggaggtaaagaag

SEQ ID NO: 7818775 - DNA, 22 bp, Homo sapiens
atcagaagcttgtagtctctct

SEQ ID NO: 7818776 - DNA, 22 bp, Homo sapiens
atcagaagcttgtagtctctct

SEQ ID NO: 7818777 - DNA, 22 bp, Homo sapiens
atcagaagcttgtagtctctct

SEQ ID NO: 7818778 - DNA, 22 bp, Homo sapiens
atcagaaattgcccagctgttt

SEQ ID NO: 7818779 - DNA, 22 bp, Homo sapiens
atcagaaattgctaccagtgga

SEQ ID NO: 7818780 - DNA, 22 bp, Homo sapiens
atcagaaattgcccagctgttt

SEQ ID NO: 7818781 - DNA, 22 bp, Homo sapiens
atcagaaattgcccagctgttt

SEQ ID NO: 7818782 - DNA, 22 bp, Homo sapiens
atcagaagaaatggatgtgact

SEQ ID NO: 7818783 - DNA, 22 bp, Homo sapiens
atcagaaatagtcatgttactt

SEQ ID NO: 7818784 - DNA, 22 bp, Homo sapiens
atcagaaatagtcatgttactt

SEQ ID NO: 7818785 - DNA, 22 bp, Homo sapiens
atcagaaatagtcatgttactt

SEQ ID NO: 7818786 - DNA, 22 bp, Homo sapiens
atcagaaatagtcatgttactt

SEQ ID NO: 7818787 - DNA, 22 bp, Homo sapiens
atcagaaatagtcatgttactt

SEQ ID NO: 7818788 - DNA, 22 bp, Homo sapiens
atcagaaatctaggattcagaa

SEQ ID NO: 7818789 - DNA, 22 bp, Homo sapiens
atcagaaatagtcatgttactt

SEQ ID NO: 7818790 - DNA, 22 bp, Homo sapiens
atcagaaattgcccagctgttt

SEQ ID NO: 7818791 - DNA, 22 bp, Homo sapiens
atcagaaagttcatcatgtttg

SEQ ID NO: 7818792 - DNA, 22 bp, Homo sapiens
atcagaaagttcatcatgtttg

SEQ ID NO: 7818793 - DNA, 22 bp, Homo sapiens
atcagaaaggtgggcaagcaga

SEQ ID NO: 7818794 - DNA, 22 bp, Homo sapiens
atcagaaaggtgggcaagcaga

SEQ ID NO: 7818795 - DNA, 22 bp, Homo sapiens
atcagaaaggtgggcaagcaga

SEQ ID NO: 7818796 - DNA, 22 bp, Homo sapiens
atcagaaaggtgggcaagcaga

SEQ ID NO: 7818797 - DNA, 22 bp, Homo sapiens
atcagaaaaacataatgttatt

SEQ ID NO: 7818798 - DNA, 22 bp, Homo sapiens
atcagaaaaatgagaagagctg

SEQ ID NO: 7818799 - DNA, 22 bp, Homo sapiens
atcagaaaatacccagtgttta

SEQ ID NO: 7818800 - DNA, 21 bp, Homo sapiens
atcagaaaatgtaatggagca

SEQ ID NO: 7818801 - DNA, 22 bp, Homo sapiens
atcagaaaatacccagtgttta

SEQ ID NO: 7818802 - DNA, 22 bp, Homo sapiens
atcagaaactcttagagcaggg

SEQ ID NO: 7818803 - DNA, 22 bp, Homo sapiens
atcagaaactcttagagcaggg

SEQ ID NO: 7818804 - DNA, 22 bp, Homo sapiens
atcagaaactcttagagcaggg

SEQ ID NO: 7818805 - DNA, 22 bp, Homo sapiens
atcagaaactcttagagcaggg

SEQ ID NO: 7818806 - DNA, 22 bp, Homo sapiens
atcagaaactcttagagcaggg

SEQ ID NO: 7818807 - DNA, 21 bp, Homo sapiens
atcagaaaatgtaatggagca

SEQ ID NO: 7818808 - DNA, 21 bp, Homo sapiens
atcagaaaatgtaatggagca

SEQ ID NO: 7818809 - DNA, 22 bp, Homo sapiens
atcaaagttcgtaactgataac

SEQ ID NO: 7818810 - DNA, 22 bp, Homo sapiens
atcaaagttcgtaactgataac

SEQ ID NO: 7818811 - DNA, 22 bp, Homo sapiens
atcaaagtttcccagaagttgt

SEQ ID NO: 7818812 - DNA, 22 bp, Homo sapiens
atcaaatacaaagggcataagg

SEQ ID NO: 7818813 - DNA, 22 bp, Homo sapiens
atcaaataaaggtacctagctt

SEQ ID NO: 7818814 - DNA, 22 bp, Homo sapiens
atcaaataaaggtacctagctt

SEQ ID NO: 7818815 - DNA, 22 bp, Homo sapiens
atcaaataaaggtacctagctt

SEQ ID NO: 7818816 - DNA, 22 bp, Homo sapiens
atcaaatacaaagggcataagg

SEQ ID NO: 7818817 - DNA, 22 bp, Homo sapiens
atcaaatacaaagggcataagg

SEQ ID NO: 7818818 - DNA, 22 bp, Homo sapiens
atcaaatacaaagggcataagg

SEQ ID NO: 7818819 - DNA, 22 bp, Homo sapiens
atcaaatacaaagggcataagg

SEQ ID NO: 7818820 - DNA, 22 bp, Homo sapiens
atcaaatataataattttcgct

SEQ ID NO: 7818821 - DNA, 22 bp, Homo sapiens
atcaaatacaaagggcataagg

SEQ ID NO: 7818822 - DNA, 22 bp, Homo sapiens
atcaaattggaatgaaaggctc

SEQ ID NO: 7818823 - DNA, 22 bp, Homo sapiens
atcaaattggaatgaaaggctc

SEQ ID NO: 7818824 - DNA, 22 bp, Homo sapiens
atcaaattatgtgctacaagaa

SEQ ID NO: 7818825 - DNA, 22 bp, Homo sapiens
atcaacagagcaaagcctgaac

SEQ ID NO: 7818826 - DNA, 22 bp, Homo sapiens
atcaacaggtatggatgagatt

SEQ ID NO: 7818827 - DNA, 22 bp, Homo sapiens
atcaacagtgaagagatcaaga

SEQ ID NO: 7818828 - DNA, 22 bp, Homo sapiens
atcaacagtgaagagatcaaga

SEQ ID NO: 7818829 - DNA, 22 bp, Homo sapiens
atcaacaggtatggatgagatt

SEQ ID NO: 7818830 - DNA, 22 bp, Homo sapiens
atcaaatcattgcattaatgtt

SEQ ID NO: 7818831 - DNA, 22 bp, Homo sapiens
atcaaatataataattttcgct

SEQ ID NO: 7818832 - DNA, 23 bp, Homo sapiens
atcaaatgattggccattcagtg

SEQ ID NO: 7818833 - DNA, 23 bp, Homo sapiens
atcaaatgattggccattcagtg

SEQ ID NO: 7818834 - DNA, 23 bp, Homo sapiens
atcaaatgattggccattcagtg

SEQ ID NO: 7818835 - DNA, 22 bp, Homo sapiens
atcaacatgtgagagcaccagt

SEQ ID NO: 7818836 - DNA, 22 bp, Homo sapiens
atcaacttaaagaaaagatact

SEQ ID NO: 7818837 - DNA, 22 bp, Homo sapiens
atcaacttaaagaaaagatact

SEQ ID NO: 7818838 - DNA, 22 bp, Homo sapiens
atcaacatgtcataaagtgaaa

SEQ ID NO: 7818839 - DNA, 22 bp, Homo sapiens
atcaacatggcaatgcccatct

SEQ ID NO: 7818840 - DNA, 22 bp, Homo sapiens
atcaacatgacaggagaagaga

SEQ ID NO: 7818841 - DNA, 22 bp, Homo sapiens
atcaacatactgctcaggcatt

SEQ ID NO: 7818842 - DNA, 22 bp, Homo sapiens
atcacattatgtagtgaaaagg

SEQ ID NO: 7818843 - DNA, 22 bp, Homo sapiens
atcaacttgtccttgatgttaa

SEQ ID NO: 7818844 - DNA, 22 bp, Homo sapiens
atcaagaaaagtgctttcggct

SEQ ID NO: 7818845 - DNA, 22 bp, Homo sapiens
atcacattctttcaaagcagtc

SEQ ID NO: 7818846 - DNA, 22 bp, Homo sapiens
atcacattctttcaaagcagtc

SEQ ID NO: 7818847 - DNA, 22 bp, Homo sapiens
atcacattgccagtgattaccc

SEQ ID NO: 7818848 - DNA, 22 bp, Homo sapiens
atcacattgccagtgattaccc

SEQ ID NO: 7818849 - DNA, 22 bp, Homo sapiens
atcagaaaaacataatgttatt

SEQ ID NO: 7818850 - DNA, 22 bp, Homo sapiens
atcagaaaaacataatgttatt

SEQ ID NO: 7818851 - DNA, 22 bp, Homo sapiens
atcagaaaaacataatgttatt

SEQ ID NO: 7818852 - DNA, 22 bp, Homo sapiens
atcactttggtaccaattcagc

SEQ ID NO: 7818853 - DNA, 22 bp, Homo sapiens
atcactttggtaccaattcagc

SEQ ID NO: 7818854 - DNA, 22 bp, Homo sapiens
atcagaaaaacataatgttatt

SEQ ID NO: 7818855 - DNA, 22 bp, Homo sapiens
atcactttggtaccaattcagc

SEQ ID NO: 7818856 - DNA, 22 bp, Homo sapiens
atcacttactcagagatccgag

SEQ ID NO: 7818857 - DNA, 22 bp, Homo sapiens
atcacttactcagagatccgag

SEQ ID NO: 7818858 - DNA, 22 bp, Homo sapiens
atattcttgtgattataaagta

SEQ ID NO: 7818859 - DNA, 22 bp, Homo sapiens
atattcttgtgattataaagta

SEQ ID NO: 7818860 - DNA, 22 bp, Homo sapiens
atattcttgtgattataaagta

SEQ ID NO: 7818861 - DNA, 22 bp, Homo sapiens
atattcttgtgattataaagta

SEQ ID NO: 7818862 - DNA, 22 bp, Homo sapiens
atattgcagggacagtctggat

SEQ ID NO: 7818863 - DNA, 22 bp, Homo sapiens
atattgcagtgtgtttatgtga

SEQ ID NO: 7818864 - DNA, 22 bp, Homo sapiens
atattgcaatagatgcatcatt

SEQ ID NO: 7818865 - DNA, 20 bp, Homo sapiens
atattgcaaggaagctggat

SEQ ID NO: 7818866 - DNA, 20 bp, Homo sapiens
atattgcaaggaagctggat

SEQ ID NO: 7818867 - DNA, 20 bp, Homo sapiens
atattgcaaggaagctggat

SEQ ID NO: 7818868 - DNA, 22 bp, Homo sapiens
atattgatggaggtgttagaca

SEQ ID NO: 7818869 - DNA, 22 bp, Homo sapiens
atattgatggaggtgttagaca

SEQ ID NO: 7818870 - DNA, 22 bp, Homo sapiens
atattgcagtgtgtttatgtga

SEQ ID NO: 7818871 - DNA, 22 bp, Homo sapiens
atattgcatggctttgctggtt

SEQ ID NO: 7818872 - DNA, 22 bp, Homo sapiens
atattgcatggctttgctggtt

SEQ ID NO: 7818873 - DNA, 22 bp, Homo sapiens
atattgcattggctggtcttga

SEQ ID NO: 7818874 - DNA, 22 bp, Homo sapiens
atattgggagctgagatctatt

SEQ ID NO: 7818875 - DNA, 22 bp, Homo sapiens
atattgggatgtttggaaatgc

SEQ ID NO: 7818876 - DNA, 22 bp, Homo sapiens
atattgggagctgagatctatt

SEQ ID NO: 7818877 - DNA, 18 bp, Homo sapiens
atattgggagcaggggca

SEQ ID NO: 7818878 - DNA, 18 bp, Homo sapiens
atattgggagcaggggca

SEQ ID NO: 7818879 - DNA, 23 bp, Homo sapiens
atattgggagatagggcctttaa

SEQ ID NO: 7818880 - DNA, 23 bp, Homo sapiens
atattgggagatagggcctttaa

SEQ ID NO: 7818881 - DNA, 22 bp, Homo sapiens
atattgctagcctatgagttca

SEQ ID NO: 7818882 - DNA, 22 bp, Homo sapiens
atattgtactagggttacatgt

SEQ ID NO: 7818883 - DNA, 22 bp, Homo sapiens
atattgtactagggttacatgt

SEQ ID NO: 7818884 - DNA, 22 bp, Homo sapiens
atattgtactagggttacatgt

SEQ ID NO: 7818885 - DNA, 22 bp, Homo sapiens
atattgtactagggttacatgt

SEQ ID NO: 7818886 - DNA, 22 bp, Homo sapiens
atattgtactagggttacatgt

SEQ ID NO: 7818887 - DNA, 21 bp, Homo sapiens
atattgtaggtaaagtgcagg

SEQ ID NO: 7818888 - DNA, 21 bp, Homo sapiens
atattgtaggtaaagtgcagg

SEQ ID NO: 7818889 - DNA, 21 bp, Homo sapiens
atattgtaggtaaagtgcagg

SEQ ID NO: 7818890 - DNA, 22 bp, Homo sapiens
atattgggattttaggttaaag

SEQ ID NO: 7818891 - DNA, 22 bp, Homo sapiens
atattgggatgtttggaaatgc

SEQ ID NO: 7818892 - DNA, 22 bp, Homo sapiens
atattgggattttaggttaaag

SEQ ID NO: 7818893 - DNA, 22 bp, Homo sapiens
atattgggcagggaagccagtg

SEQ ID NO: 7818894 - DNA, 22 bp, Homo sapiens
atattgggtgtgggcatcaggg

SEQ ID NO: 7818895 - DNA, 22 bp, Homo sapiens
atattggggataattgtgctgc

SEQ ID NO: 7818896 - DNA, 22 bp, Homo sapiens
atattggggataattgtgctgc

SEQ ID NO: 7818897 - DNA, 22 bp, Homo sapiens
atattgggcagggaagccagtg

SEQ ID NO: 7818898 - DNA, 22 bp, Homo sapiens
atattggtgattagccaatgct

SEQ ID NO: 7818899 - DNA, 22 bp, Homo sapiens
atattggtgaaatgctagcaaa

SEQ ID NO: 7818900 - DNA, 22 bp, Homo sapiens
atattgggtgtgggcatcaggg

SEQ ID NO: 7818901 - DNA, 22 bp, Homo sapiens
atatttaaacagggtaccaata

SEQ ID NO: 7818902 - DNA, 22 bp, Homo sapiens
atattgttgactataagagtaa

SEQ ID NO: 7818903 - DNA, 22 bp, Homo sapiens
atatttaaacagggtaccaata

SEQ ID NO: 7818904 - DNA, 22 bp, Homo sapiens
atatttaaacagggtaccaata

SEQ ID NO: 7818905 - DNA, 22 bp, Homo sapiens
atatttaaacagggtaccaata

SEQ ID NO: 7818906 - DNA, 21 bp, Homo sapiens
atattgtaggtaaagtgcagg

SEQ ID NO: 7818907 - DNA, 22 bp, Homo sapiens
atattgtgtgtacaagtagtta

SEQ ID NO: 7818908 - DNA, 22 bp, Homo sapiens
atattgtgtgtacaagtagtta

SEQ ID NO: 7818909 - DNA, 22 bp, Homo sapiens
atattgttagtaatatttcgaa

SEQ ID NO: 7818910 - DNA, 22 bp, Homo sapiens
atattgttgactataagagtaa

SEQ ID NO: 7818911 - DNA, 22 bp, Homo sapiens
atattgttgactataagagtaa

SEQ ID NO: 7818912 - DNA, 22 bp, Homo sapiens
atattgttgactataagagtaa

SEQ ID NO: 7818913 - DNA, 22 bp, Homo sapiens
atattgttagtaatatttcgaa

SEQ ID NO: 7818914 - DNA, 22 bp, Homo sapiens
atcaaaatgctccagtgatggt

SEQ ID NO: 7818915 - DNA, 22 bp, Homo sapiens
atattttggggtgatgtgcatc

SEQ ID NO: 7818916 - DNA, 22 bp, Homo sapiens
atcaaaatggaagaatttggct

SEQ ID NO: 7818917 - DNA, 22 bp, Homo sapiens
atcaaaatggaagaatttggct

SEQ ID NO: 7818918 - DNA, 22 bp, Homo sapiens
atcaaagaaggagaggttcctg

SEQ ID NO: 7818919 - DNA, 22 bp, Homo sapiens
atcaaagaatgtgactgaaata

SEQ ID NO: 7818920 - DNA, 22 bp, Homo sapiens
atcaaagaatgtgactgaaata

SEQ ID NO: 7818921 - DNA, 22 bp, Homo sapiens
atatttaactggtcccaatata

SEQ ID NO: 7818922 - DNA, 22 bp, Homo sapiens
atatttaactggtcccaatata

SEQ ID NO: 7818923 - DNA, 22 bp, Homo sapiens
atatttaaacagggtaccaata

SEQ ID NO: 7818924 - DNA, 22 bp, Homo sapiens
atatttaactggtcccaatata

SEQ ID NO: 7818925 - DNA, 22 bp, Homo sapiens
atattttggcaaatgtctagat

SEQ ID NO: 7818926 - DNA, 22 bp, Homo sapiens
atattttggggtgatgtgcatc

SEQ ID NO: 7818927 - DNA, 22 bp, Homo sapiens
atatttactgctgtggtgaagg

SEQ ID NO: 7818928 - DNA, 22 bp, Homo sapiens
atatttactgctgtggtgaagg

SEQ ID NO: 7818929 - DNA, 22 bp, Homo sapiens
atcaaagtaattaacactgaga

SEQ ID NO: 7818930 - DNA, 22 bp, Homo sapiens
atcaaagggattgggggctgct

SEQ ID NO: 7818931 - DNA, 22 bp, Homo sapiens
atcaaagtatctcaatatggta

SEQ ID NO: 7818932 - DNA, 22 bp, Homo sapiens
atcaaagtaggcatatgttttt

SEQ ID NO: 7818933 - DNA, 22 bp, Homo sapiens
atcaaagaatgtgactgaaata

SEQ ID NO: 7818934 - DNA, 22 bp, Homo sapiens
atcaaagagcttgacaatccta

SEQ ID NO: 7818935 - DNA, 22 bp, Homo sapiens
atcaaagagtgagatttttact

SEQ ID NO: 7818936 - DNA, 22 bp, Homo sapiens
atcaaagagtgagatttttact

SEQ ID NO: 7818937 - DNA, 23 bp, Homo sapiens
atcaaaggatgtagagaagaagc

SEQ ID NO: 7818938 - DNA, 22 bp, Homo sapiens
atcaaagagcttgacaatccta

SEQ ID NO: 7818939 - DNA, 22 bp, Homo sapiens
atcaaagttcgtaactgataac

SEQ ID NO: 7818940 - DNA, 22 bp, Homo sapiens
atcaaagttcgtaactgataac

SEQ ID NO: 7818941 - DNA, 23 bp, Homo sapiens
atcaaagtggaaatcaattatct

SEQ ID NO: 7818942 - DNA, 22 bp, Homo sapiens
atcaaagtccatcagaaggtag

SEQ ID NO: 7818943 - DNA, 22 bp, Homo sapiens
atcaaagtccatcagaaggtag

SEQ ID NO: 7818944 - DNA, 22 bp, Homo sapiens
atcaaagtgatttgtaaacagg

SEQ ID NO: 7818945 - DNA, 20 bp, Homo sapiens
ctgggctcaagtgagcctcc

SEQ ID NO: 7818946 - DNA, 20 bp, Homo sapiens
ctgggctcaagtgagcctcc

SEQ ID NO: 7818947 - DNA, 20 bp, Homo sapiens
ctgggctcaagtgagcctcc

SEQ ID NO: 7818948 - DNA, 20 bp, Homo sapiens
ctgggctcaagtgagcctcc

SEQ ID NO: 7818949 - DNA, 20 bp, Homo sapiens
ctgggctcaagtgagcctcc

SEQ ID NO: 7818950 - DNA, 20 bp, Homo sapiens
ctgggctcaagtgagcctcc

SEQ ID NO: 7818951 - DNA, 20 bp, Homo sapiens
ctgggctcaagtgagcctcc

SEQ ID NO: 7818952 - DNA, 20 bp, Homo sapiens
ctgggctcaagtgagcctcc

SEQ ID NO: 7818953 - DNA, 21 bp, Homo sapiens
ctgggctcaagcaatcctttc

SEQ ID NO: 7818954 - DNA, 20 bp, Homo sapiens
ctgggctcaagtgagcctcc

SEQ ID NO: 7818955 - DNA, 21 bp, Homo sapiens
ctgggctcaagcaatcctttc

SEQ ID NO: 7818956 - DNA, 21 bp, Homo sapiens
ctgggctcaagcaatcctttc

SEQ ID NO: 7818957 - DNA, 20 bp, Homo sapiens
ctgggctcaagtgatcctcc

SEQ ID NO: 7818958 - DNA, 20 bp, Homo sapiens
ctgggctcaagtgatcctcc

SEQ ID NO: 7818959 - DNA, 20 bp, Homo sapiens
ctgggctcaagtgatcctcc

SEQ ID NO: 7818960 - DNA, 20 bp, Homo sapiens
ctgggctcaagtgatcctcc

SEQ ID NO: 7818961 - DNA, 20 bp, Homo sapiens
ctgggctcaagtgatcctcc

SEQ ID NO: 7818962 - DNA, 20 bp, Homo sapiens
ctgggctcaagtgatcctcc

SEQ ID NO: 7818963 - DNA, 20 bp, Homo sapiens
ctgggctcaagtgatcctcc

SEQ ID NO: 7818964 - DNA, 20 bp, Homo sapiens
ctgggctcaagtgatcctcc

SEQ ID NO: 7818965 - DNA, 22 bp, Homo sapiens
ctgggctcaagtgatccaccca

SEQ ID NO: 7818966 - DNA, 22 bp, Homo sapiens
ctgggctcaagtgatccaccca

SEQ ID NO: 7818967 - DNA, 20 bp, Homo sapiens
ctgggctcaagtgatcctcc

SEQ ID NO: 7818968 - DNA, 22 bp, Homo sapiens
ctgggctcaagtgatccaccca

SEQ ID NO: 7818969 - DNA, 22 bp, Homo sapiens
ctgggctcaagtgatccaccca

SEQ ID NO: 7818970 - DNA, 20 bp, Homo sapiens
ctggcttcgggaactagttt

SEQ ID NO: 7818971 - DNA, 20 bp, Homo sapiens
ctggcttcgggaactagttt

SEQ ID NO: 7818972 - DNA, 22 bp, Homo sapiens
ctgggcctggggctgttgagag

SEQ ID NO: 7818973 - DNA, 22 bp, Homo sapiens
ctggcttctgggccagggcaga

SEQ ID NO: 7818974 - DNA, 22 bp, Homo sapiens
ctggcttctgggccagggcaga

SEQ ID NO: 7818975 - DNA, 22 bp, Homo sapiens
ctggcttctgggccagggcaga

SEQ ID NO: 7818976 - DNA, 22 bp, Homo sapiens
ctgggcctggtagggcttgaaa

SEQ ID NO: 7818977 - DNA, 22 bp, Homo sapiens
ctgggctcaagaagtcttccct

SEQ ID NO: 7818978 - DNA, 22 bp, Homo sapiens
ctgggcctggtagggcttgaaa

SEQ ID NO: 7818979 - DNA, 22 bp, Homo sapiens
ctgggcctggtgtggcacctgc

SEQ ID NO: 7818980 - DNA, 21 bp, Homo sapiens
ctgggctcaagcaatcctttc

SEQ ID NO: 7818981 - DNA, 21 bp, Homo sapiens
ctgggctcaagcaatcctttc

SEQ ID NO: 7818982 - DNA, 21 bp, Homo sapiens
ctgggctcaagcaatcctttc

SEQ ID NO: 7818983 - DNA, 21 bp, Homo sapiens
ctgggctcaagcaatcctttc

SEQ ID NO: 7818984 - DNA, 22 bp, Homo sapiens
ctgggctcaagaagtcttccct

SEQ ID NO: 7818985 - DNA, 22 bp, Homo sapiens
atatgcatatgtcaaaacttat

SEQ ID NO: 7818986 - DNA, 22 bp, Homo sapiens
atatgcagtctcttgcccttct

SEQ ID NO: 7818987 - DNA, 22 bp, Homo sapiens
atatgcagtctcttgcccttct

SEQ ID NO: 7818988 - DNA, 22 bp, Homo sapiens
atatgcagtctcttgcccttct

SEQ ID NO: 7818989 - DNA, 22 bp, Homo sapiens
atatgcagtctcttgcccttct

SEQ ID NO: 7818990 - DNA, 22 bp, Homo sapiens
atatgcagtctcttgcccttct

SEQ ID NO: 7818991 - DNA, 22 bp, Homo sapiens
atatgcacatacatacataggt

SEQ ID NO: 7818992 - DNA, 22 bp, Homo sapiens
ctgggctcagcaggccaaggcc

SEQ ID NO: 7818993 - DNA, 22 bp, Homo sapiens
atatgcagagagcatgaatagg

SEQ ID NO: 7818994 - DNA, 22 bp, Homo sapiens
atatgcagagagcatgaatagg

SEQ ID NO: 7818995 - DNA, 22 bp, Homo sapiens
atatgcacgcatacacacataa

SEQ ID NO: 7818996 - DNA, 22 bp, Homo sapiens
atatgcagtctcttgcccttct

SEQ ID NO: 7818997 - DNA, 22 bp, Homo sapiens
atatgcagtctcttgcccttct

SEQ ID NO: 7818998 - DNA, 22 bp, Homo sapiens
atatgcagtctcttgcccttct

SEQ ID NO: 7818999 - DNA, 22 bp, Homo sapiens
ctgggctcagatgagaggaagg

SEQ ID NO: 7819000 - DNA, 22 bp, Homo sapiens
ctgggctcagatgagaggaagg

SEQ ID NO: 7819001 - DNA, 22 bp, Homo sapiens
ctgggctcagaaccttgttaag

SEQ ID NO: 7819002 - DNA, 22 bp, Homo sapiens
ctgggctcagatgagaggaagg

SEQ ID NO: 7819003 - DNA, 22 bp, Homo sapiens
ctgggctcagaaccttgttaag

SEQ ID NO: 7819004 - DNA, 22 bp, Homo sapiens
ctgggctcagaaccttgttaag

SEQ ID NO: 7819005 - DNA, 22 bp, Homo sapiens
ctgggctcagaaccttgttaag

SEQ ID NO: 7819006 - DNA, 22 bp, Homo sapiens
ctgggctcacctgtggctggca

SEQ ID NO: 7819007 - DNA, 22 bp, Homo sapiens
ctgggctcacctgtggctggca

SEQ ID NO: 7819008 - DNA, 22 bp, Homo sapiens
ctgggctcacctgtggctggca

SEQ ID NO: 7819009 - DNA, 22 bp, Homo sapiens
ctgggctcacctgtggctggca

SEQ ID NO: 7819010 - DNA, 22 bp, Homo sapiens
ctggctggccggaggcatccct

SEQ ID NO: 7819011 - DNA, 22 bp, Homo sapiens
ctggctggccggagcgaggcgg

SEQ ID NO: 7819012 - DNA, 22 bp, Homo sapiens
ctggctggccggagcgaggcgg

SEQ ID NO: 7819013 - DNA, 22 bp, Homo sapiens
ctggctggccggagcgaggcgg

SEQ ID NO: 7819014 - DNA, 22 bp, Homo sapiens
ctggctggccggagcgaggcgg

SEQ ID NO: 7819015 - DNA, 22 bp, Homo sapiens
ctggctggctgtgcccctgccg

SEQ ID NO: 7819016 - DNA, 22 bp, Homo sapiens
ctggctgggaagtagagtaggt

SEQ ID NO: 7819017 - DNA, 22 bp, Homo sapiens
ctggctgggaagtagagtaggt

SEQ ID NO: 7819018 - DNA, 22 bp, Homo sapiens
ctggctggctgtgcccctgccg

SEQ ID NO: 7819019 - DNA, 22 bp, Homo sapiens
ctggctggccggaggcatccct

SEQ ID NO: 7819020 - DNA, 22 bp, Homo sapiens
ctggctggcgttttccaaaagc

SEQ ID NO: 7819021 - DNA, 22 bp, Homo sapiens
ctggctggccggaggcatccct

SEQ ID NO: 7819022 - DNA, 22 bp, Homo sapiens
ctggctggccggaggcatccct

SEQ ID NO: 7819023 - DNA, 22 bp, Homo sapiens
ctggctggctcatttttcattg

SEQ ID NO: 7819024 - DNA, 22 bp, Homo sapiens
ctggctggctcatttttcattg

SEQ ID NO: 7819025 - DNA, 22 bp, Homo sapiens
ctggctgggagcgagctgctca

SEQ ID NO: 7819026 - DNA, 22 bp, Homo sapiens
ctggctgggagcgagctgctca

SEQ ID NO: 7819027 - DNA, 22 bp, Homo sapiens
ctggctgggagcgagctgctca

SEQ ID NO: 7819028 - DNA, 22 bp, Homo sapiens
ctggctgggagcgagctgctca

SEQ ID NO: 7819029 - DNA, 22 bp, Homo sapiens
ctggctgggagcgagctgctca

SEQ ID NO: 7819030 - DNA, 22 bp, Homo sapiens
ctggctgggagcgagctgctca

SEQ ID NO: 7819031 - DNA, 22 bp, Homo sapiens
ctggctgggaagtagagtaggt

SEQ ID NO: 7819032 - DNA, 22 bp, Homo sapiens
ctggctgggaagtagagtaggt

SEQ ID NO: 7819033 - DNA, 22 bp, Homo sapiens
ctggctgtggtcacaggtaact

SEQ ID NO: 7819034 - DNA, 22 bp, Homo sapiens
ctggctgtggattatcacaggc

SEQ ID NO: 7819035 - DNA, 22 bp, Homo sapiens
ctggctgggagcgagctgctca

SEQ ID NO: 7819036 - DNA, 22 bp, Homo sapiens
ctggctgtgtccacagagtaag

SEQ ID NO: 7819037 - DNA, 22 bp, Homo sapiens
ctggctgtgtccacagagtaag

SEQ ID NO: 7819038 - DNA, 22 bp, Homo sapiens
ctggctgtgtccacagagtaag

SEQ ID NO: 7819039 - DNA, 22 bp, Homo sapiens
ctggcttcagctgccatcaatg

SEQ ID NO: 7819040 - DNA, 19 bp, Homo sapiens
ctggcttcaagcagtcctc

SEQ ID NO: 7819041 - DNA, 19 bp, Homo sapiens
ctggcttcaagcagtcctc

SEQ ID NO: 7819042 - DNA, 22 bp, Homo sapiens
ctggctgttttcaatgttgatg

SEQ ID NO: 7819043 - DNA, 19 bp, Homo sapiens
ctggcttcaagcagtcctc

SEQ ID NO: 7819044 - DNA, 19 bp, Homo sapiens
ctggcttcaagcagtcctc

SEQ ID NO: 7819045 - DNA, 22 bp, Homo sapiens
ctggctgtttctcctttgtcta

SEQ ID NO: 7819046 - DNA, 22 bp, Homo sapiens
ctggctgttttcaatgttgatg

SEQ ID NO: 7819047 - DNA, 22 bp, Homo sapiens
ctggctgtttcaggcagtgtcc

SEQ ID NO: 7819048 - DNA, 22 bp, Homo sapiens
ctggctgtttcaaatgtataga

SEQ ID NO: 7819049 - DNA, 22 bp, Homo sapiens
ctggctgtgtgtcttcattcag

SEQ ID NO: 7819050 - DNA, 22 bp, Homo sapiens
ctggctgtgtcttggaggagct

SEQ ID NO: 7819051 - DNA, 22 bp, Homo sapiens
ctggctgtgtcttggaggagct

SEQ ID NO: 7819052 - DNA, 22 bp, Homo sapiens
ctggcttccaccatggcccctg

SEQ ID NO: 7819053 - DNA, 22 bp, Homo sapiens
ctggcttccaccatggcccctg

SEQ ID NO: 7819054 - DNA, 22 bp, Homo sapiens
ctggcttccaccatggcccctg

SEQ ID NO: 7819055 - DNA, 22 bp, Homo sapiens
ctggcttccatgctgtagtggc

SEQ ID NO: 7819056 - DNA, 22 bp, Homo sapiens
ctggcttccatgctgtagtggc

SEQ ID NO: 7819057 - DNA, 22 bp, Homo sapiens
ctggcttccatgctgtagtggc

SEQ ID NO: 7819058 - DNA, 22 bp, Homo sapiens
ctggcttcctgagtccattacc

SEQ ID NO: 7819059 - DNA, 22 bp, Homo sapiens
ctggcttcctcaggagcagtgg

SEQ ID NO: 7819060 - DNA, 22 bp, Homo sapiens
ctggcttcctcaggagcagtgg

SEQ ID NO: 7819061 - DNA, 22 bp, Homo sapiens
ctggcttcctcaggagcagtgg

SEQ ID NO: 7819062 - DNA, 22 bp, Homo sapiens
ctggcttccctgtcttatggaa

SEQ ID NO: 7819063 - DNA, 22 bp, Homo sapiens
ctggcttccctgtcttatggaa

SEQ ID NO: 7819064 - DNA, 22 bp, Homo sapiens
atattatagacagagtcttctg

SEQ ID NO: 7819065 - DNA, 22 bp, Homo sapiens
atattataagttatttcaagtt

SEQ ID NO: 7819066 - DNA, 22 bp, Homo sapiens
atattataagttatttcaagtt

SEQ ID NO: 7819067 - DNA, 22 bp, Homo sapiens
atattatagacagagtcttctg

SEQ ID NO: 7819068 - DNA, 22 bp, Homo sapiens
atattatagacagagtcttctg

SEQ ID NO: 7819069 - DNA, 22 bp, Homo sapiens
ctgggctctgcggtgtcgctct

SEQ ID NO: 7819070 - DNA, 22 bp, Homo sapiens
atattatgctaagggaaataag

SEQ ID NO: 7819071 - DNA, 22 bp, Homo sapiens
atattatggccccatctaagct

SEQ ID NO: 7819072 - DNA, 22 bp, Homo sapiens
atattatggccccatctaagct

SEQ ID NO: 7819073 - DNA, 22 bp, Homo sapiens
ctgggctctgcggtgtcgctct

SEQ ID NO: 7819074 - DNA, 22 bp, Homo sapiens
ctgggctctggggtcccggtgc

SEQ ID NO: 7819075 - DNA, 22 bp, Homo sapiens
ctgggctctgcggtgtcgctct

SEQ ID NO: 7819076 - DNA, 22 bp, Homo sapiens
ctgggctctgcggtgtcgctct

SEQ ID NO: 7819077 - DNA, 22 bp, Homo sapiens
ctgggctctgtgtttcagtttc

SEQ ID NO: 7819078 - DNA, 22 bp, Homo sapiens
ctgggctcttcccagatccaga

SEQ ID NO: 7819079 - DNA, 22 bp, Homo sapiens
ctgggctctgtgtttcagtttc

SEQ ID NO: 7819080 - DNA, 22 bp, Homo sapiens
ctgggctctgtgtttcagtttc

SEQ ID NO: 7819081 - DNA, 22 bp, Homo sapiens
ctgggctcttcccagatccaga

SEQ ID NO: 7819082 - DNA, 22 bp, Homo sapiens
ctgggctcttcccagatccaga

SEQ ID NO: 7819083 - DNA, 22 bp, Homo sapiens
ctgggctctggggtcccggtgc

SEQ ID NO: 7819084 - DNA, 22 bp, Homo sapiens
ctgggctctgcggtgtcgctct

SEQ ID NO: 7819085 - DNA, 22 bp, Homo sapiens
ctgggctctggggtcccggtgc

SEQ ID NO: 7819086 - DNA, 22 bp, Homo sapiens
ctgggctctgtgtttcagtttc

SEQ ID NO: 7819087 - DNA, 22 bp, Homo sapiens
ctgggctctgtgtttcagtttc

SEQ ID NO: 7819088 - DNA, 22 bp, Homo sapiens
ctgggctctgtgtttcagtttc

SEQ ID NO: 7819089 - DNA, 22 bp, Homo sapiens
ctgggctcttctcaccctgttt

SEQ ID NO: 7819090 - DNA, 22 bp, Homo sapiens
ctgggctcttctcaccctgttt

SEQ ID NO: 7819091 - DNA, 22 bp, Homo sapiens
ctgggctcttctcaccctgttt

SEQ ID NO: 7819092 - DNA, 22 bp, Homo sapiens
ctgggctcttcccagatccaga

SEQ ID NO: 7819093 - DNA, 22 bp, Homo sapiens
ctgggctcttcccagatccaga

SEQ ID NO: 7819094 - DNA, 22 bp, Homo sapiens
ctgggctcttctcaccctgttt

SEQ ID NO: 7819095 - DNA, 22 bp, Homo sapiens
ctgggctgaaggctccccacac

SEQ ID NO: 7819096 - DNA, 22 bp, Homo sapiens
ctgggctgaaagtgttccttga

SEQ ID NO: 7819097 - DNA, 22 bp, Homo sapiens
ctgggctgaaagtgttccttga

SEQ ID NO: 7819098 - DNA, 22 bp, Homo sapiens
ctgggctgaaagtgttccttga

SEQ ID NO: 7819099 - DNA, 22 bp, Homo sapiens
ctgggctgagcctgggctgtgt

SEQ ID NO: 7819100 - DNA, 22 bp, Homo sapiens
ctgggctgagcctgggctgtgt

SEQ ID NO: 7819101 - DNA, 22 bp, Homo sapiens
ctgggctgagcctgggctgtgt

SEQ ID NO: 7819102 - DNA, 22 bp, Homo sapiens
ctgggctgagcctgggctgtgt

SEQ ID NO: 7819103 - DNA, 22 bp, Homo sapiens
ctgggctgaaggctccccacac

SEQ ID NO: 7819104 - DNA, 22 bp, Homo sapiens
ctgggctgagcctgggctgtgt

SEQ ID NO: 7819105 - DNA, 22 bp, Homo sapiens
ctgggctgagcctgggctgtgt

SEQ ID NO: 7819106 - DNA, 22 bp, Homo sapiens
ctgggctgagcctgggctgtgt

SEQ ID NO: 7819107 - DNA, 22 bp, Homo sapiens
ctgggctgagcctgggctgtgt

SEQ ID NO: 7819108 - DNA, 22 bp, Homo sapiens
ctgggctgagctgtggaaactc

SEQ ID NO: 7819109 - DNA, 22 bp, Homo sapiens
ctgggctgagctgtggaaactc

SEQ ID NO: 7819110 - DNA, 22 bp, Homo sapiens
ctgggctgagcctgggctgtgt

SEQ ID NO: 7819111 - DNA, 22 bp, Homo sapiens
ctgggctgagcctgggctgtgt

SEQ ID NO: 7819112 - DNA, 19 bp, Homo sapiens
ctgggctgaggtctgcctt

SEQ ID NO: 7819113 - DNA, 22 bp, Homo sapiens
ctgggctgagctgtggaaactc

SEQ ID NO: 7819114 - DNA, 19 bp, Homo sapiens
ctgggctgaggtctgcctt

SEQ ID NO: 7819115 - DNA, 19 bp, Homo sapiens
ctgggctgaggtctgcctt

SEQ ID NO: 7819116 - DNA, 19 bp, Homo sapiens
ctgggctgaggtctgcctt

SEQ ID NO: 7819117 - DNA, 19 bp, Homo sapiens
ctgggctgaggtctgcctt

SEQ ID NO: 7819118 - DNA, 19 bp, Homo sapiens
ctgggctgaggtctgcctt

SEQ ID NO: 7819119 - DNA, 19 bp, Homo sapiens
ctgggctgaggtctgcctt

SEQ ID NO: 7819120 - DNA, 19 bp, Homo sapiens
ctgggctgaggtctgcctt

SEQ ID NO: 7819121 - DNA, 19 bp, Homo sapiens
ctgggctgaggtctgcctt

SEQ ID NO: 7819122 - DNA, 22 bp, Homo sapiens
atattcactgggtactaaaaag

SEQ ID NO: 7819123 - DNA, 22 bp, Homo sapiens
atattcttcttgttcagactat

SEQ ID NO: 7819124 - DNA, 22 bp, Homo sapiens
atattcttgaaagatcctggta

SEQ ID NO: 7819125 - DNA, 22 bp, Homo sapiens
atattcttgaagggagattata

SEQ ID NO: 7819126 - DNA, 22 bp, Homo sapiens
atattcactgggtactaaaaag

SEQ ID NO: 7819127 - DNA, 22 bp, Homo sapiens
ctgggctgatttagtcacgttt

SEQ ID NO: 7819128 - DNA, 19 bp, Homo sapiens
ctgggctgaggtctgcctt

SEQ ID NO: 7819129 - DNA, 19 bp, Homo sapiens
ctgggctgaggtctgcctt

SEQ ID NO: 7819130 - DNA, 19 bp, Homo sapiens
ctgggctgaggtctgcctt

SEQ ID NO: 7819131 - DNA, 22 bp, Homo sapiens
atatgcatttacctggcatata

SEQ ID NO: 7819132 - DNA, 22 bp, Homo sapiens
atatgcattcatacttagtgga

SEQ ID NO: 7819133 - DNA, 22 bp, Homo sapiens
atatgcatttacctggcatata

SEQ ID NO: 7819134 - DNA, 22 bp, Homo sapiens
atatgccatactgtacaatact

SEQ ID NO: 7819135 - DNA, 22 bp, Homo sapiens
atatgcatctgtgtgcgtgtct

SEQ ID NO: 7819136 - DNA, 22 bp, Homo sapiens
atatgcatgcatgcttgtgaga

SEQ ID NO: 7819137 - DNA, 22 bp, Homo sapiens
atatgcatgcatgcttgtgaga

SEQ ID NO: 7819138 - DNA, 22 bp, Homo sapiens
atatgccattagctagaaataa

SEQ ID NO: 7819139 - DNA, 22 bp, Homo sapiens
atatgctacaaataaactttta

SEQ ID NO: 7819140 - DNA, 22 bp, Homo sapiens
atatgctatgttgaataatttg

SEQ ID NO: 7819141 - DNA, 22 bp, Homo sapiens
atattaaaactatggttttcag

SEQ ID NO: 7819142 - DNA, 22 bp, Homo sapiens
atatgtttttggaaagaacaca

SEQ ID NO: 7819143 - DNA, 22 bp, Homo sapiens
atattacataaacatgagtgaa

SEQ ID NO: 7819144 - DNA, 22 bp, Homo sapiens
atattaaaactatggttttcag

SEQ ID NO: 7819145 - DNA, 22 bp, Homo sapiens
atattaaaactatggttttcag

SEQ ID NO: 7819146 - DNA, 22 bp, Homo sapiens
atattacataaacatgagtgaa

SEQ ID NO: 7819147 - DNA, 22 bp, Homo sapiens
atattacataaacatgagtgaa

SEQ ID NO: 7819148 - DNA, 22 bp, Homo sapiens
atattacataaacatgagtgaa

SEQ ID NO: 7819149 - DNA, 22 bp, Homo sapiens
atattaggagttaaatgtatta

SEQ ID NO: 7819150 - DNA, 22 bp, Homo sapiens
atattactctgatttagtaaat

SEQ ID NO: 7819151 - DNA, 22 bp, Homo sapiens
atattactctgatttagtaaat

SEQ ID NO: 7819152 - DNA, 22 bp, Homo sapiens
atattagggtctctaaattcta

SEQ ID NO: 7819153 - DNA, 22 bp, Homo sapiens
atattaggcaaggagattattt

SEQ ID NO: 7819154 - DNA, 22 bp, Homo sapiens
atattaggtgctcaatacatgc

SEQ ID NO: 7819155 - DNA, 22 bp, Homo sapiens
atattagtttggagactacaat

SEQ ID NO: 7819156 - DNA, 22 bp, Homo sapiens
atattataagttatttcaagtt

SEQ ID NO: 7819157 - DNA, 22 bp, Homo sapiens
atattataagttatttcaagtt

SEQ ID NO: 7819158 - DNA, 22 bp, Homo sapiens
atattataagttatttcaagtt

SEQ ID NO: 7819159 - DNA, 22 bp, Homo sapiens
atattataagttatttcaagtt

SEQ ID NO: 7819160 - DNA, 22 bp, Homo sapiens
atattataagttatttcaagtt

SEQ ID NO: 7819161 - DNA, 22 bp, Homo sapiens
atattataagttatttcaagtt

SEQ ID NO: 7819162 - DNA, 22 bp, Homo sapiens
atattagtttggagactacaat

SEQ ID NO: 7819163 - DNA, 22 bp, Homo sapiens
aggctctgtcaggcggagcagc

SEQ ID NO: 7819164 - DNA, 22 bp, Homo sapiens
aggctctgtatgaaggtttggg

SEQ ID NO: 7819165 - DNA, 22 bp, Homo sapiens
aggctctgtcaggcggagcagc

SEQ ID NO: 7819166 - DNA, 22 bp, Homo sapiens
aggctctgtcaggcggagcagc

SEQ ID NO: 7819167 - DNA, 22 bp, Homo sapiens
aggctctgtcaggcggagcagc

SEQ ID NO: 7819168 - DNA, 22 bp, Homo sapiens
ccagggcacttaggcccagccc

SEQ ID NO: 7819169 - DNA, 22 bp, Homo sapiens
ccagggcacttaggcccagccc

SEQ ID NO: 7819170 - DNA, 22 bp, Homo sapiens
ccagggcacttaggcccagccc

SEQ ID NO: 7819171 - DNA, 22 bp, Homo sapiens
ccagggcacttaggcccagccc

SEQ ID NO: 7819172 - DNA, 19 bp, Homo sapiens
aggctctgtaggagagggc

SEQ ID NO: 7819173 - DNA, 22 bp, Homo sapiens
aggctctggttggcaagtaaag

SEQ ID NO: 7819174 - DNA, 22 bp, Homo sapiens
aggctctgtatgaaggtttggg

SEQ ID NO: 7819175 - DNA, 19 bp, Homo sapiens
aggctctgtaggagagggc

SEQ ID NO: 7819176 - DNA, 22 bp, Homo sapiens
aggctctgtatgaaggtttggg

SEQ ID NO: 7819177 - DNA, 22 bp, Homo sapiens
ccagggcagaaaaagagggaat

SEQ ID NO: 7819178 - DNA, 22 bp, Homo sapiens
ccagggcagaaaaagagggaat

SEQ ID NO: 7819179 - DNA, 22 bp, Homo sapiens
ccagggcagaaaaagagggaat

SEQ ID NO: 7819180 - DNA, 22 bp, Homo sapiens
ccagggcacttaggcccagccc

SEQ ID NO: 7819181 - DNA, 22 bp, Homo sapiens
ccagggcacttaggcccagccc

SEQ ID NO: 7819182 - DNA, 22 bp, Homo sapiens
ccagggcacttaggcccagccc

SEQ ID NO: 7819183 - DNA, 22 bp, Homo sapiens
ccagggcagcagaattggggca

SEQ ID NO: 7819184 - DNA, 22 bp, Homo sapiens
ccagggcagaaaaagagggaat

SEQ ID NO: 7819185 - DNA, 22 bp, Homo sapiens
ccagggcagaaaaagagggaat

SEQ ID NO: 7819186 - DNA, 22 bp, Homo sapiens
ccagggcagaaaaagagggaat

SEQ ID NO: 7819187 - DNA, 22 bp, Homo sapiens
ccagggcagaaaaagagggaat

SEQ ID NO: 7819188 - DNA, 22 bp, Homo sapiens
ccaggtgctagcaatcactgtc

SEQ ID NO: 7819189 - DNA, 22 bp, Homo sapiens
ccaggtgggcgtgtcttcacct

SEQ ID NO: 7819190 - DNA, 22 bp, Homo sapiens
ccaggtgcctccagtcacagtg

SEQ ID NO: 7819191 - DNA, 22 bp, Homo sapiens
ccaggtgctagcaatcactgtc

SEQ ID NO: 7819192 - DNA, 22 bp, Homo sapiens
ccaggtgcctccagtcacagtg

SEQ ID NO: 7819193 - DNA, 22 bp, Homo sapiens
ccaggtgcctccagtcacagtg

SEQ ID NO: 7819194 - DNA, 22 bp, Homo sapiens
ccaggtgcactcaagacctgct

SEQ ID NO: 7819195 - DNA, 16 bp, Homo sapiens
ccaggtggggctgtga

SEQ ID NO: 7819196 - DNA, 22 bp, Homo sapiens
ccaggtggtgaaagtgggccct

SEQ ID NO: 7819197 - DNA, 16 bp, Homo sapiens
ccaggtggggctgtga

SEQ ID NO: 7819198 - DNA, 22 bp, Homo sapiens
ccaggtggtgaaagtgggccct

SEQ ID NO: 7819199 - DNA, 22 bp, Homo sapiens
ccagggcagcagaattggggca

SEQ ID NO: 7819200 - DNA, 22 bp, Homo sapiens
ccagggcagccaacccagatgc

SEQ ID NO: 7819201 - DNA, 22 bp, Homo sapiens
ccagggcagccaacccagatgc

SEQ ID NO: 7819202 - DNA, 22 bp, Homo sapiens
ccagggcagccaacccagatgc

SEQ ID NO: 7819203 - DNA, 22 bp, Homo sapiens
ccagggcagccaacccagatgc

SEQ ID NO: 7819204 - DNA, 22 bp, Homo sapiens
ccagggcagccaacccagatgc

SEQ ID NO: 7819205 - DNA, 22 bp, Homo sapiens
ccagggcagcgcccctccacgc

SEQ ID NO: 7819206 - DNA, 22 bp, Homo sapiens
ccagggcagcgcccctccacgc

SEQ ID NO: 7819207 - DNA, 22 bp, Homo sapiens
ccagggcagcgcccctccacgc

SEQ ID NO: 7819208 - DNA, 22 bp, Homo sapiens
ccaggtgcaaactcccagcagg

SEQ ID NO: 7819209 - DNA, 22 bp, Homo sapiens
ccaggtgttctttgtccctgtt

SEQ ID NO: 7819210 - DNA, 22 bp, Homo sapiens
ccaggtgttctttgtccctgtt

SEQ ID NO: 7819211 - DNA, 22 bp, Homo sapiens
ccaggtgttctttgtccctgtt

SEQ ID NO: 7819212 - DNA, 22 bp, Homo sapiens
ccaggtgttctttgtccctgtt

SEQ ID NO: 7819213 - DNA, 22 bp, Homo sapiens
ccaggtggttcaggtcaccata

SEQ ID NO: 7819214 - DNA, 22 bp, Homo sapiens
ccaggtggttcaggtcaccata

SEQ ID NO: 7819215 - DNA, 20 bp, Homo sapiens
ccaggtggtgcctggagagg

SEQ ID NO: 7819216 - DNA, 18 bp, Homo sapiens
ccaggtggtgacagagat

SEQ ID NO: 7819217 - DNA, 22 bp, Homo sapiens
ccaggtggtgaaagtgggccct

SEQ ID NO: 7819218 - DNA, 18 bp, Homo sapiens
ccaggtggtgacagagat

SEQ ID NO: 7819219 - DNA, 18 bp, Homo sapiens
ccaggtggtgacagagat

SEQ ID NO: 7819220 - DNA, 18 bp, Homo sapiens
ccaggtggtgacagagat

SEQ ID NO: 7819221 - DNA, 20 bp, Homo sapiens
ccaggtggtgcctggagagg

SEQ ID NO: 7819222 - DNA, 20 bp, Homo sapiens
ccaggtggtgcctggagagg

SEQ ID NO: 7819223 - DNA, 22 bp, Homo sapiens
ccaggtggtgcctctgttcgca

SEQ ID NO: 7819224 - DNA, 20 bp, Homo sapiens
ccaggtggtgcctggagagg

SEQ ID NO: 7819225 - DNA, 22 bp, Homo sapiens
ccagtaaattacttgatgtcat

SEQ ID NO: 7819226 - DNA, 23 bp, Homo sapiens
ccagtaaacccttcctcagtgtc

SEQ ID NO: 7819227 - DNA, 22 bp, Homo sapiens
ccagtaatggaaatagcagttc

SEQ ID NO: 7819228 - DNA, 22 bp, Homo sapiens
ccagtacatcgcatggtgacca

SEQ ID NO: 7819229 - DNA, 22 bp, Homo sapiens
ccagtactgtctccaatattcc

SEQ ID NO: 7819230 - DNA, 18 bp, Homo sapiens
ccagtacctcctcctctc

SEQ ID NO: 7819231 - DNA, 22 bp, Homo sapiens
ccaggttcaaatagctgtgtga

SEQ ID NO: 7819232 - DNA, 22 bp, Homo sapiens
ccaggttggagttcagtggcgc

SEQ ID NO: 7819233 - DNA, 22 bp, Homo sapiens
ccaggtgtttggcctgcatgat

SEQ ID NO: 7819234 - DNA, 22 bp, Homo sapiens
ccaggtgtttggcctgcatgat

SEQ ID NO: 7819235 - DNA, 22 bp, Homo sapiens
ccaggttcaaatagctgtgtga

SEQ ID NO: 7819236 - DNA, 22 bp, Homo sapiens
ccagtaaaaagcgacaggaagt

SEQ ID NO: 7819237 - DNA, 22 bp, Homo sapiens
ccagtaaaaagcgacaggaagt

SEQ ID NO: 7819238 - DNA, 22 bp, Homo sapiens
ccagtaaaccaagtgtttacta

SEQ ID NO: 7819239 - DNA, 19 bp, Homo sapiens
ccagtagagacagctgcag

SEQ ID NO: 7819240 - DNA, 22 bp, Homo sapiens
ccagtagaaagcaacgtggcat

SEQ ID NO: 7819241 - DNA, 23 bp, Homo sapiens
ccagtagcacagttacccagtgg

SEQ ID NO: 7819242 - DNA, 19 bp, Homo sapiens
ccagtagtatagcacagtc

SEQ ID NO: 7819243 - DNA, 19 bp, Homo sapiens
ccagtagtatagcacagtc

SEQ ID NO: 7819244 - DNA, 22 bp, Homo sapiens
ccagtagttccaggaacctcct

SEQ ID NO: 7819245 - DNA, 22 bp, Homo sapiens
ccagtagttggacaaatagatt

SEQ ID NO: 7819246 - DNA, 22 bp, Homo sapiens
ccagtagttggacaaatagatt

SEQ ID NO: 7819247 - DNA, 22 bp, Homo sapiens
ccagtcacaggtgtgtttatat

SEQ ID NO: 7819248 - DNA, 22 bp, Homo sapiens
aggctgagtgctcccctagatg

SEQ ID NO: 7819249 - DNA, 17 bp, Homo sapiens
ccagtcacaccaccctt

SEQ ID NO: 7819250 - DNA, 17 bp, Homo sapiens
ccagtcacaccaccctt

SEQ ID NO: 7819251 - DNA, 22 bp, Homo sapiens
aggctgagtcgggaggatcact

SEQ ID NO: 7819252 - DNA, 22 bp, Homo sapiens
ccagtattgtgaaattgatgtc

SEQ ID NO: 7819253 - DNA, 22 bp, Homo sapiens
ccagtattgtgaaattgatgtc

SEQ ID NO: 7819254 - DNA, 22 bp, Homo sapiens
ccagtattcgatctggccagtt

SEQ ID NO: 7819255 - DNA, 21 bp, Homo sapiens
ccagtattatttctctatgta

SEQ ID NO: 7819256 - DNA, 22 bp, Homo sapiens
aggctctgcttttctggatata

SEQ ID NO: 7819257 - DNA, 22 bp, Homo sapiens
aggctctgcttttctggatata

SEQ ID NO: 7819258 - DNA, 20 bp, Homo sapiens
aggctctgcctgcaggccca

SEQ ID NO: 7819259 - DNA, 20 bp, Homo sapiens
aggctctgcctgcaggccca

SEQ ID NO: 7819260 - DNA, 20 bp, Homo sapiens
aggctctgcctgcaggccca

SEQ ID NO: 7819261 - DNA, 20 bp, Homo sapiens
aggctctgcctgcaggccca

SEQ ID NO: 7819262 - DNA, 22 bp, Homo sapiens
aggctcagcctgggcctagagc

SEQ ID NO: 7819263 - DNA, 22 bp, Homo sapiens
aggctcagcctgggcctagagc

SEQ ID NO: 7819264 - DNA, 22 bp, Homo sapiens
aggctcagcccctgggaggaga

SEQ ID NO: 7819265 - DNA, 22 bp, Homo sapiens
aggctcagcccctgggaggaga

SEQ ID NO: 7819266 - DNA, 22 bp, Homo sapiens
aggctcagcccctgggaggaga

SEQ ID NO: 7819267 - DNA, 22 bp, Homo sapiens
aggctcagcccctgggaggaga

SEQ ID NO: 7819268 - DNA, 22 bp, Homo sapiens
aggctcagattcacatttggtt

SEQ ID NO: 7819269 - DNA, 21 bp, Homo sapiens
aggctcagcaggtgtataaag

SEQ ID NO: 7819270 - DNA, 21 bp, Homo sapiens
aggctcagcaggtgtataaag

SEQ ID NO: 7819271 - DNA, 21 bp, Homo sapiens
aggctcagcaggtgtataaag

SEQ ID NO: 7819272 - DNA, 22 bp, Homo sapiens
aggctcagcatctgattcatat

SEQ ID NO: 7819273 - DNA, 22 bp, Homo sapiens
aggctcagcccaaggtggagag

SEQ ID NO: 7819274 - DNA, 22 bp, Homo sapiens
aggctcagcccaaggtggagag

SEQ ID NO: 7819275 - DNA, 22 bp, Homo sapiens
aggctcagcccaaggtggagag

SEQ ID NO: 7819276 - DNA, 22 bp, Homo sapiens
aggctcagcccaaggtggagag

SEQ ID NO: 7819277 - DNA, 22 bp, Homo sapiens
aggctcagcatctgattcatat

SEQ ID NO: 7819278 - DNA, 22 bp, Homo sapiens
aggctcagcccaaggtggagag

SEQ ID NO: 7819279 - DNA, 19 bp, Homo sapiens
aggctctgtaggagagggc

SEQ ID NO: 7819280 - DNA, 19 bp, Homo sapiens
aggctctgtaggagagggc

SEQ ID NO: 7819281 - DNA, 22 bp, Homo sapiens
aggctctggttcatcatgatgg

SEQ ID NO: 7819282 - DNA, 22 bp, Homo sapiens
aggctctggttggcaagtaaag

SEQ ID NO: 7819283 - DNA, 22 bp, Homo sapiens
aggctctggttggcaagtaaag

SEQ ID NO: 7819284 - DNA, 22 bp, Homo sapiens
aggctctggtgcagctgtaact

SEQ ID NO: 7819285 - DNA, 22 bp, Homo sapiens
aggctctggttcatcatgatgg

SEQ ID NO: 7819286 - DNA, 22 bp, Homo sapiens
aggctctggttggcaagtaaag

SEQ ID NO: 7819287 - DNA, 22 bp, Homo sapiens
aggctctggttggcaagtaaag

SEQ ID NO: 7819288 - DNA, 22 bp, Homo sapiens
aggctctgggaagcagtgagtt

SEQ ID NO: 7819289 - DNA, 22 bp, Homo sapiens
aggctctgggctctagattttg

SEQ ID NO: 7819290 - DNA, 22 bp, Homo sapiens
aggctctgggaagcagtgagtt

SEQ ID NO: 7819291 - DNA, 22 bp, Homo sapiens
aggctctgggctctagattttg

SEQ ID NO: 7819292 - DNA, 22 bp, Homo sapiens
aggctctgggctctagattttg

SEQ ID NO: 7819293 - DNA, 22 bp, Homo sapiens
aggctctgggctctagattttg

SEQ ID NO: 7819294 - DNA, 22 bp, Homo sapiens
aggctctggtgcagctgtaact

SEQ ID NO: 7819295 - DNA, 22 bp, Homo sapiens
aggctctgggctctagattttg

SEQ ID NO: 7819296 - DNA, 22 bp, Homo sapiens
aggctctggtgcagctgtaact

SEQ ID NO: 7819297 - DNA, 22 bp, Homo sapiens
aggctctggtgcagctgtaact

SEQ ID NO: 7819298 - DNA, 22 bp, Homo sapiens
aggctctggtgcagctgtaact

SEQ ID NO: 7819299 - DNA, 22 bp, Homo sapiens
aggctctgggaagcagtgagtt

SEQ ID NO: 7819300 - DNA, 22 bp, Homo sapiens
aggctctgggaagcagtgagtt

SEQ ID NO: 7819301 - DNA, 22 bp, Homo sapiens
aggctctgggaagcagtgagtt

SEQ ID NO: 7819302 - DNA, 22 bp, Homo sapiens
aggctctgggaagcagtgagtt

SEQ ID NO: 7819303 - DNA, 22 bp, Homo sapiens
aggctctgggaagcagtgagtt

SEQ ID NO: 7819304 - DNA, 22 bp, Homo sapiens
aggctctgcttttctggatata

SEQ ID NO: 7819305 - DNA, 22 bp, Homo sapiens
aggctctgcttttctggatata

SEQ ID NO: 7819306 - DNA, 22 bp, Homo sapiens
aggctctgcttttctggatata

SEQ ID NO: 7819307 - DNA, 22 bp, Homo sapiens
aggctctgggaacagacgggtg

SEQ ID NO: 7819308 - DNA, 22 bp, Homo sapiens
aggctctgggaacagacgggtg

SEQ ID NO: 7819309 - DNA, 22 bp, Homo sapiens
aggctctgggaagcagtgagtt

SEQ ID NO: 7819310 - DNA, 22 bp, Homo sapiens
aggctctgggaagcagtgagtt

SEQ ID NO: 7819311 - DNA, 22 bp, Homo sapiens
aggctctgggaacagacgggtg

SEQ ID NO: 7819312 - DNA, 22 bp, Homo sapiens
ccaggccttctgaggacactct

SEQ ID NO: 7819313 - DNA, 22 bp, Homo sapiens
ccaggccttctgaggacactct

SEQ ID NO: 7819314 - DNA, 22 bp, Homo sapiens
ccaggccttctgaggacactct

SEQ ID NO: 7819315 - DNA, 22 bp, Homo sapiens
ccaggccttctgaggacactct

SEQ ID NO: 7819316 - DNA, 22 bp, Homo sapiens
ccaggccttctgaggacactct

SEQ ID NO: 7819317 - DNA, 22 bp, Homo sapiens
ccaggccttctgaggacactct

SEQ ID NO: 7819318 - DNA, 22 bp, Homo sapiens
ccaggccttctgaggacactct

SEQ ID NO: 7819319 - DNA, 22 bp, Homo sapiens
ccaggccttctgaggacactct

SEQ ID NO: 7819320 - DNA, 22 bp, Homo sapiens
ccaggcctttcttcttggtctg

SEQ ID NO: 7819321 - DNA, 22 bp, Homo sapiens
ccaggcctttcttcttggtctg

SEQ ID NO: 7819322 - DNA, 22 bp, Homo sapiens
ccaggcctttcttcttggtctg

SEQ ID NO: 7819323 - DNA, 22 bp, Homo sapiens
ccaggcctttcttcttggtctg

SEQ ID NO: 7819324 - DNA, 22 bp, Homo sapiens
ccaggcctttcttcttggtctg

SEQ ID NO: 7819325 - DNA, 22 bp, Homo sapiens
ccaggcgtggcttcagcagccc

SEQ ID NO: 7819326 - DNA, 22 bp, Homo sapiens
ccaggcctttcttcttggtctg

SEQ ID NO: 7819327 - DNA, 20 bp, Homo sapiens
aggctcagatacccagggaa

SEQ ID NO: 7819328 - DNA, 22 bp, Homo sapiens
aggctcagatccttgtgtcctg

SEQ ID NO: 7819329 - DNA, 22 bp, Homo sapiens
aggctcagatccttgtgtcctg

SEQ ID NO: 7819330 - DNA, 22 bp, Homo sapiens
aggctcagatccttgtgtcctg

SEQ ID NO: 7819331 - DNA, 22 bp, Homo sapiens
aggctcagatccttgtgtcctg

SEQ ID NO: 7819332 - DNA, 22 bp, Homo sapiens
aggctcagattcacatttggtt

SEQ ID NO: 7819333 - DNA, 22 bp, Homo sapiens
aggctcagattcacatttggtt

SEQ ID NO: 7819334 - DNA, 22 bp, Homo sapiens
aggctcagattcacatttggtt

SEQ ID NO: 7819335 - DNA, 20 bp, Homo sapiens
ccaggcctgggcctgctcta

SEQ ID NO: 7819336 - DNA, 20 bp, Homo sapiens
ccaggcctgggcctgctcta

SEQ ID NO: 7819337 - DNA, 20 bp, Homo sapiens
ccaggcctgggcctgctcta

SEQ ID NO: 7819338 - DNA, 20 bp, Homo sapiens
ccaggcctgggcctgctcta

SEQ ID NO: 7819339 - DNA, 20 bp, Homo sapiens
ccaggcctgggcctgctcta

SEQ ID NO: 7819340 - DNA, 20 bp, Homo sapiens
ccaggcctgggcctgctcta

SEQ ID NO: 7819341 - DNA, 20 bp, Homo sapiens
ccaggcctgggcctgctcta

SEQ ID NO: 7819342 - DNA, 22 bp, Homo sapiens
ccaggcctcccttttccagcca

SEQ ID NO: 7819343 - DNA, 22 bp, Homo sapiens
ccaggcctcccttttccagcca

SEQ ID NO: 7819344 - DNA, 22 bp, Homo sapiens
ccaggcctcccttttccagcca

SEQ ID NO: 7819345 - DNA, 20 bp, Homo sapiens
ccaggcctgggcctgctcta

SEQ ID NO: 7819346 - DNA, 22 bp, Homo sapiens
ccaggcctcacctgcccaccta

SEQ ID NO: 7819347 - DNA, 22 bp, Homo sapiens
ccaggcctcccttttccagcca

SEQ ID NO: 7819348 - DNA, 22 bp, Homo sapiens
ccaggccttccagtacgcagaa

SEQ ID NO: 7819349 - DNA, 22 bp, Homo sapiens
ccaggcctgtgttgtgtggagg

SEQ ID NO: 7819350 - DNA, 22 bp, Homo sapiens
ccaggccttccagtacgcagaa

SEQ ID NO: 7819351 - DNA, 22 bp, Homo sapiens
ccaggcctgtgttgtgtggagg

SEQ ID NO: 7819352 - DNA, 22 bp, Homo sapiens
ccaggcctgtgttgtgtggagg

SEQ ID NO: 7819353 - DNA, 22 bp, Homo sapiens
ccaggcctgtgttgtgtggagg

SEQ ID NO: 7819354 - DNA, 22 bp, Homo sapiens
ccaggcctgtgcaaggagggag

SEQ ID NO: 7819355 - DNA, 22 bp, Homo sapiens
ccaggcctgtgcaaggagggag

SEQ ID NO: 7819356 - DNA, 20 bp, Homo sapiens
ccaggcctgggcctgctcta

SEQ ID NO: 7819357 - DNA, 22 bp, Homo sapiens
ccaggcctgtgcaaggagggag

SEQ ID NO: 7819358 - DNA, 22 bp, Homo sapiens
ccaggcctgtgcaaggagggag

SEQ ID NO: 7819359 - DNA, 22 bp, Homo sapiens
ccaggcctgtgcaaggagggag

SEQ ID NO: 7819360 - DNA, 22 bp, Homo sapiens
ccaggcctgtgttgtgtggagg

SEQ ID NO: 7819361 - DNA, 22 bp, Homo sapiens
cccactccctgcacgcctgccg

SEQ ID NO: 7819362 - DNA, 22 bp, Homo sapiens
cccacgttgaaccgcttacaga

SEQ ID NO: 7819363 - DNA, 22 bp, Homo sapiens
cccactccctacgacacgctcc

SEQ ID NO: 7819364 - DNA, 22 bp, Homo sapiens
cccactccctacgacacgctcc

SEQ ID NO: 7819365 - DNA, 22 bp, Homo sapiens
cccacgtcgaacttgctccaga

SEQ ID NO: 7819366 - DNA, 22 bp, Homo sapiens
cccacgttgaaccgcttacaga

SEQ ID NO: 7819367 - DNA, 22 bp, Homo sapiens
cccacgtcgaacttgctccaga

SEQ ID NO: 7819368 - DNA, 22 bp, Homo sapiens
cccacgtcgaacttgctccaga

SEQ ID NO: 7819369 - DNA, 22 bp, Homo sapiens
cccacgtcgaacttgctccaga

SEQ ID NO: 7819370 - DNA, 22 bp, Homo sapiens
cccaccctgggctacacatcca

SEQ ID NO: 7819371 - DNA, 22 bp, Homo sapiens
cccaccctgggctacacatcca

SEQ ID NO: 7819372 - DNA, 22 bp, Homo sapiens
cccaccctgggctacacatcca

SEQ ID NO: 7819373 - DNA, 22 bp, Homo sapiens
cccaccctgggctacacatcca

SEQ ID NO: 7819374 - DNA, 22 bp, Homo sapiens
cccacgacttgtctgcatttgg

SEQ ID NO: 7819375 - DNA, 22 bp, Homo sapiens
cccaccctgggaagctaggcag

SEQ ID NO: 7819376 - DNA, 22 bp, Homo sapiens
cccaccctgggaagctaggcag

SEQ ID NO: 7819377 - DNA, 22 bp, Homo sapiens
cccaccctgggaagctaggcag

SEQ ID NO: 7819378 - DNA, 22 bp, Homo sapiens
cccaccctgggaagctaggcag

SEQ ID NO: 7819379 - DNA, 18 bp, Homo sapiens
cccaccctggctcttagt

SEQ ID NO: 7819380 - DNA, 22 bp, Homo sapiens
cccacactctgagaaatgctga

SEQ ID NO: 7819381 - DNA, 22 bp, Homo sapiens
cccacactcagttccccttggg

SEQ ID NO: 7819382 - DNA, 22 bp, Homo sapiens
cccactgctgcgccgggcgccg

SEQ ID NO: 7819383 - DNA, 22 bp, Homo sapiens
cccactgctgctctccatggca

SEQ ID NO: 7819384 - DNA, 22 bp, Homo sapiens
cccactgagggttaatgcctgc

SEQ ID NO: 7819385 - DNA, 22 bp, Homo sapiens
cccactctggctcccttctagt

SEQ ID NO: 7819386 - DNA, 22 bp, Homo sapiens
cccactctggctcccttctagt

SEQ ID NO: 7819387 - DNA, 22 bp, Homo sapiens
cccactctggctcccttctagt

SEQ ID NO: 7819388 - DNA, 22 bp, Homo sapiens
cccactctggctcccttctagt

SEQ ID NO: 7819389 - DNA, 22 bp, Homo sapiens
cccactctccatgaggttccca

SEQ ID NO: 7819390 - DNA, 22 bp, Homo sapiens
aggctgtgcattttggagggcc

SEQ ID NO: 7819391 - DNA, 22 bp, Homo sapiens
aggctgtgcattttggagggcc

SEQ ID NO: 7819392 - DNA, 22 bp, Homo sapiens
aggctgtgcattttggagggcc

SEQ ID NO: 7819393 - DNA, 22 bp, Homo sapiens
aggctgtgcattttggagggcc

SEQ ID NO: 7819394 - DNA, 22 bp, Homo sapiens
aggctgtgcacagggcacctgc

SEQ ID NO: 7819395 - DNA, 22 bp, Homo sapiens
aggctgtgcacagggcacctgc

SEQ ID NO: 7819396 - DNA, 22 bp, Homo sapiens
aggctgtgcacagggcacctgc

SEQ ID NO: 7819397 - DNA, 22 bp, Homo sapiens
aggctgtgcacagggcacctgc

SEQ ID NO: 7819398 - DNA, 21 bp, Homo sapiens
aggctgtgacttacactatct

SEQ ID NO: 7819399 - DNA, 22 bp, Homo sapiens
aggctgtgcacagggcacctgc

SEQ ID NO: 7819400 - DNA, 22 bp, Homo sapiens
aggctgtgactacgcagggaag

SEQ ID NO: 7819401 - DNA, 21 bp, Homo sapiens
aggctgtgacttacactatct

SEQ ID NO: 7819402 - DNA, 22 bp, Homo sapiens
aggctgtgactacgcagggaag

SEQ ID NO: 7819403 - DNA, 22 bp, Homo sapiens
aggctgtgactacgcagggaag

SEQ ID NO: 7819404 - DNA, 22 bp, Homo sapiens
aggctgtgacagggtcatggag

SEQ ID NO: 7819405 - DNA, 22 bp, Homo sapiens
cccagaggttccttagggacca

SEQ ID NO: 7819406 - DNA, 22 bp, Homo sapiens
cccagaggttccttagggacca

SEQ ID NO: 7819407 - DNA, 22 bp, Homo sapiens
cccagaggttccttagggacca

SEQ ID NO: 7819408 - DNA, 20 bp, Homo sapiens
cccagaggttgcggcaggag

SEQ ID NO: 7819409 - DNA, 20 bp, Homo sapiens
cccagaggttgcggcaggag

SEQ ID NO: 7819410 - DNA, 20 bp, Homo sapiens
cccagaggttgcggcaggag

SEQ ID NO: 7819411 - DNA, 22 bp, Homo sapiens
cccagaggtgcttcagaggtgc

SEQ ID NO: 7819412 - DNA, 22 bp, Homo sapiens
cccagaggtgcttcagaggtgc

SEQ ID NO: 7819413 - DNA, 22 bp, Homo sapiens
cccagaggtgcttcagaggtgc

SEQ ID NO: 7819414 - DNA, 22 bp, Homo sapiens
cccagaggtgcttcagaggtgc

SEQ ID NO: 7819415 - DNA, 22 bp, Homo sapiens
cccagaggttccttagggacca

SEQ ID NO: 7819416 - DNA, 22 bp, Homo sapiens
cccagaggttccttagggacca

SEQ ID NO: 7819417 - DNA, 22 bp, Homo sapiens
cccagaggttccttagggacca

SEQ ID NO: 7819418 - DNA, 22 bp, Homo sapiens
cccagaggttccttagggacca

SEQ ID NO: 7819419 - DNA, 22 bp, Homo sapiens
cccagaggttccttagggacca

SEQ ID NO: 7819420 - DNA, 22 bp, Homo sapiens
aggctgtggtgctgaaggaggg

SEQ ID NO: 7819421 - DNA, 22 bp, Homo sapiens
aggctgtgggtgatttactgtg

SEQ ID NO: 7819422 - DNA, 22 bp, Homo sapiens
aggctgtggtgatgattgggtc

SEQ ID NO: 7819423 - DNA, 22 bp, Homo sapiens
aggctgtggtgatgattgggtc

SEQ ID NO: 7819424 - DNA, 22 bp, Homo sapiens
aggctgtggtgctgaaggaggg

SEQ ID NO: 7819425 - DNA, 22 bp, Homo sapiens
cccagaggtgcttcagaggtgc

SEQ ID NO: 7819426 - DNA, 22 bp, Homo sapiens
cccagaggtgacatcccattct

SEQ ID NO: 7819427 - DNA, 22 bp, Homo sapiens
cccagaggtgacatcccattct

SEQ ID NO: 7819428 - DNA, 22 bp, Homo sapiens
cccagaggtgaaggaggtggga

SEQ ID NO: 7819429 - DNA, 22 bp, Homo sapiens
cccagaggtgacatcccattct

SEQ ID NO: 7819430 - DNA, 22 bp, Homo sapiens
cccagaggtgaaggaggtggga

SEQ ID NO: 7819431 - DNA, 22 bp, Homo sapiens
aggctgtgggaatggctgcttg

SEQ ID NO: 7819432 - DNA, 22 bp, Homo sapiens
aggctgtgggaatggctgcttg

SEQ ID NO: 7819433 - DNA, 22 bp, Homo sapiens
aggctgtgggaatggctgcttg

SEQ ID NO: 7819434 - DNA, 22 bp, Homo sapiens
aggctgtggccctggtctagca

SEQ ID NO: 7819435 - DNA, 22 bp, Homo sapiens
aggctgtgggagttgagagtct

SEQ ID NO: 7819436 - DNA, 22 bp, Homo sapiens
aggctgtgggagttgagagtct

SEQ ID NO: 7819437 - DNA, 22 bp, Homo sapiens
aggctgtgggacagttaggaga

SEQ ID NO: 7819438 - DNA, 22 bp, Homo sapiens
aggctgtggccctggtctagca

SEQ ID NO: 7819439 - DNA, 22 bp, Homo sapiens
aggctgtggccctggtctagca

SEQ ID NO: 7819440 - DNA, 22 bp, Homo sapiens
aggctgtggcatcacatcagga

SEQ ID NO: 7819441 - DNA, 22 bp, Homo sapiens
aggctgtgcgaggtctcagagt

SEQ ID NO: 7819442 - DNA, 22 bp, Homo sapiens
aggctgtgcgaggtctcagagt

SEQ ID NO: 7819443 - DNA, 22 bp, Homo sapiens
aggctgtgcgaggtctcagagt

SEQ ID NO: 7819444 - DNA, 22 bp, Homo sapiens
aggctgcagaggtgctgccaga

SEQ ID NO: 7819445 - DNA, 22 bp, Homo sapiens
aggctgcagaggtgctgccaga

SEQ ID NO: 7819446 - DNA, 22 bp, Homo sapiens
aggctgcagcttgtctcgtggg

SEQ ID NO: 7819447 - DNA, 23 bp, Homo sapiens
aggctgcagaagaatagggtcat

SEQ ID NO: 7819448 - DNA, 22 bp, Homo sapiens
aggctgcagtgcaggtaggatt

SEQ ID NO: 7819449 - DNA, 22 bp, Homo sapiens
aggctgcagtgcaggtaggatt

SEQ ID NO: 7819450 - DNA, 22 bp, Homo sapiens
aggctgcagtgcaggtaggatt

SEQ ID NO: 7819451 - DNA, 22 bp, Homo sapiens
aggctgcaggtctgggtcatgt

SEQ ID NO: 7819452 - DNA, 22 bp, Homo sapiens
aggctgcaggtctgggtcatgt

SEQ ID NO: 7819453 - DNA, 22 bp, Homo sapiens
aggctgcatcccactttgtgta

SEQ ID NO: 7819454 - DNA, 21 bp, Homo sapiens
aggctgcatgcatgagtgtgg

SEQ ID NO: 7819455 - DNA, 21 bp, Homo sapiens
aggctgcatgcatgagtgtgg

SEQ ID NO: 7819456 - DNA, 22 bp, Homo sapiens
aggctgccaaagcttctgtctc

SEQ ID NO: 7819457 - DNA, 22 bp, Homo sapiens
aggctgccaaagcttctgtctc

SEQ ID NO: 7819458 - DNA, 23 bp, Homo sapiens
aggctgccagaaattgggtaagg

SEQ ID NO: 7819459 - DNA, 22 bp, Homo sapiens
aggctgccagaagccttcagga

SEQ ID NO: 7819460 - DNA, 23 bp, Homo sapiens
aggctgccagaaattgggtaagg

SEQ ID NO: 7819461 - DNA, 22 bp, Homo sapiens
aggctgccagaagccttcagga

SEQ ID NO: 7819462 - DNA, 22 bp, Homo sapiens
aggctgccagaagccttcagga

SEQ ID NO: 7819463 - DNA, 20 bp, Homo sapiens
aggctgccaggtctcacatc

SEQ ID NO: 7819464 - DNA, 20 bp, Homo sapiens
aggctgccaggtctcacatc

SEQ ID NO: 7819465 - DNA, 20 bp, Homo sapiens
aggctgccaggtctcacatc

SEQ ID NO: 7819466 - DNA, 20 bp, Homo sapiens
aggctgccaggtctcacatc

SEQ ID NO: 7819467 - DNA, 22 bp, Homo sapiens
aggctgccagaagccttcagga

SEQ ID NO: 7819468 - DNA, 22 bp, Homo sapiens
ccagtgtattatttgagaaatt

SEQ ID NO: 7819469 - DNA, 22 bp, Homo sapiens
ccagtggtgaatccagggatgt

SEQ ID NO: 7819470 - DNA, 22 bp, Homo sapiens
ccagtgggtaggccatggtgag

SEQ ID NO: 7819471 - DNA, 22 bp, Homo sapiens
ccagtgggtgctgggctctgcc

SEQ ID NO: 7819472 - DNA, 22 bp, Homo sapiens
ccagtgggagggagctaggcca

SEQ ID NO: 7819473 - DNA, 22 bp, Homo sapiens
ccagtgggtaggccatggtgag

SEQ ID NO: 7819474 - DNA, 22 bp, Homo sapiens
aggctgccgcagccaatggttg

SEQ ID NO: 7819475 - DNA, 22 bp, Homo sapiens
ccagtgggagggagctaggcca

SEQ ID NO: 7819476 - DNA, 22 bp, Homo sapiens
aggctgccctgccgccagtggg

SEQ ID NO: 7819477 - DNA, 22 bp, Homo sapiens
aggctgccctgccgccagtggg

SEQ ID NO: 7819478 - DNA, 22 bp, Homo sapiens
aggctgccctgccgccagtggg

SEQ ID NO: 7819479 - DNA, 22 bp, Homo sapiens
aggctgccgcagccaatggttg

SEQ ID NO: 7819480 - DNA, 22 bp, Homo sapiens
aggctgccgcagccaatggttg

SEQ ID NO: 7819481 - DNA, 22 bp, Homo sapiens
aggctgccgcagccaatggttg

SEQ ID NO: 7819482 - DNA, 22 bp, Homo sapiens
aggctgccctgccgccagtggg

SEQ ID NO: 7819483 - DNA, 19 bp, Homo sapiens
aggctgcccagtctctgcc

SEQ ID NO: 7819484 - DNA, 19 bp, Homo sapiens
aggctgcccagtctctgcc

SEQ ID NO: 7819485 - DNA, 19 bp, Homo sapiens
aggctgcccagtctctgcc

SEQ ID NO: 7819486 - DNA, 22 bp, Homo sapiens
aggctgccatagggaactgcat

SEQ ID NO: 7819487 - DNA, 22 bp, Homo sapiens
aggctgccatagggaactgcat

SEQ ID NO: 7819488 - DNA, 22 bp, Homo sapiens
ccagtgtctgtggtatagaaag

SEQ ID NO: 7819489 - DNA, 22 bp, Homo sapiens
ccagtgtctagtcacaggtact

SEQ ID NO: 7819490 - DNA, 19 bp, Homo sapiens
ccagtgtctagcgcacagc

SEQ ID NO: 7819491 - DNA, 22 bp, Homo sapiens
ccagtgtgaaaggtcatttatc

SEQ ID NO: 7819492 - DNA, 22 bp, Homo sapiens
ccagtgtgaaaggtcatttatc

SEQ ID NO: 7819493 - DNA, 22 bp, Homo sapiens
ccagtgtcttcagagtaaatct

SEQ ID NO: 7819494 - DNA, 22 bp, Homo sapiens
ccagtgtgaaaggtcatttatc

SEQ ID NO: 7819495 - DNA, 22 bp, Homo sapiens
ccagtgtctactgtggcatatc

SEQ ID NO: 7819496 - DNA, 22 bp, Homo sapiens
ccagtgtctagcagatgacagg

SEQ ID NO: 7819497 - DNA, 22 bp, Homo sapiens
ccagtgtcagaaagattatcct

SEQ ID NO: 7819498 - DNA, 22 bp, Homo sapiens
ccagtgtccttcctttccatgg

SEQ ID NO: 7819499 - DNA, 22 bp, Homo sapiens
ccagtgtatttttgggacctgc

SEQ ID NO: 7819500 - DNA, 22 bp, Homo sapiens
ccagtgtagctcaggactgggc

SEQ ID NO: 7819501 - DNA, 22 bp, Homo sapiens
ccattttgtctgacttcttgct

SEQ ID NO: 7819502 - DNA, 22 bp, Homo sapiens
cccaagttaaaattcagtgctc

SEQ ID NO: 7819503 - DNA, 22 bp, Homo sapiens
cccaagttaatttgtagctgaa

SEQ ID NO: 7819504 - DNA, 22 bp, Homo sapiens
cccaagttgcttgttccaagac

SEQ ID NO: 7819505 - DNA, 22 bp, Homo sapiens
ccagtgtgaacctcaccaccct

SEQ ID NO: 7819506 - DNA, 22 bp, Homo sapiens
ccagtgtgaacctcaccaccct

SEQ ID NO: 7819507 - DNA, 22 bp, Homo sapiens
ccagtgtgaccatctgttagct

SEQ ID NO: 7819508 - DNA, 22 bp, Homo sapiens
ccagtgtgattgttgcaagaat

SEQ ID NO: 7819509 - DNA, 22 bp, Homo sapiens
ccagtgtgcaatctctggctta

SEQ ID NO: 7819510 - DNA, 22 bp, Homo sapiens
ccagtgtgattgttgcaagaat

SEQ ID NO: 7819511 - DNA, 22 bp, Homo sapiens
ccagtgtgattgttgcaagaat

SEQ ID NO: 7819512 - DNA, 22 bp, Homo sapiens
ccagtgtgcaatctctggctta

SEQ ID NO: 7819513 - DNA, 18 bp, Homo sapiens
cccacacagcagtagctc

SEQ ID NO: 7819514 - DNA, 22 bp, Homo sapiens
cccacacatttttcacttaccg

SEQ ID NO: 7819515 - DNA, 18 bp, Homo sapiens
cccacacagcagtagctc

SEQ ID NO: 7819516 - DNA, 18 bp, Homo sapiens
cccacacagcagtagctc

SEQ ID NO: 7819517 - DNA, 18 bp, Homo sapiens
cccacacagcagtagctc

SEQ ID NO: 7819518 - DNA, 18 bp, Homo sapiens
cccacacagcagtagctc

SEQ ID NO: 7819519 - DNA, 22 bp, Homo sapiens
cccacacatttttcacttaccg

SEQ ID NO: 7819520 - DNA, 20 bp, Homo sapiens
cccacacccttcccacttgg

SEQ ID NO: 7819521 - DNA, 20 bp, Homo sapiens
cccacacccttcccacttgg

SEQ ID NO: 7819522 - DNA, 20 bp, Homo sapiens
cccacacccttcccacttgg

SEQ ID NO: 7819523 - DNA, 22 bp, Homo sapiens
cccacacatttttcacttaccg

SEQ ID NO: 7819524 - DNA, 22 bp, Homo sapiens
cccacacatttttcacttaccg

SEQ ID NO: 7819525 - DNA, 22 bp, Homo sapiens
cccacacactggctgctgccaa

SEQ ID NO: 7819526 - DNA, 22 bp, Homo sapiens
cccacacactggctgctgccaa

SEQ ID NO: 7819527 - DNA, 22 bp, Homo sapiens
cccacacactggctgctgccaa

SEQ ID NO: 7819528 - DNA, 22 bp, Homo sapiens
cccacacacatttatgatagga

SEQ ID NO: 7819529 - DNA, 22 bp, Homo sapiens
cccacacacatttatgatagga

SEQ ID NO: 7819530 - DNA, 22 bp, Homo sapiens
cccacacacatttatgatagga

SEQ ID NO: 7819531 - DNA, 22 bp, Homo sapiens
cccacacaaatcatggggagaa

SEQ ID NO: 7819532 - DNA, 22 bp, Homo sapiens
cccacacaaatcatggggagaa

SEQ ID NO: 7819533 - DNA, 22 bp, Homo sapiens
cccacacacatttatgatagga

SEQ ID NO: 7819534 - DNA, 22 bp, Homo sapiens
cccaatggctggatggagggat

SEQ ID NO: 7819535 - DNA, 22 bp, Homo sapiens
ccagccagtatattccaaagcc

SEQ ID NO: 7819536 - DNA, 22 bp, Homo sapiens
ccagccagtatattccaaagcc

SEQ ID NO: 7819537 - DNA, 22 bp, Homo sapiens
ccagccagtatattccaaagcc

SEQ ID NO: 7819538 - DNA, 22 bp, Homo sapiens
ccagccagtatattccaaagcc

SEQ ID NO: 7819539 - DNA, 22 bp, Homo sapiens
ccagccagtatattccaaagcc

SEQ ID NO: 7819540 - DNA, 22 bp, Homo sapiens
ccagccaggctggctgtggagg

SEQ ID NO: 7819541 - DNA, 22 bp, Homo sapiens
ccagccaggctggctgtggagg

SEQ ID NO: 7819542 - DNA, 22 bp, Homo sapiens
ccagccaggctggctgtggagg

SEQ ID NO: 7819543 - DNA, 22 bp, Homo sapiens
ccagccagggaaactttttctt

SEQ ID NO: 7819544 - DNA, 22 bp, Homo sapiens
ccagccagggaaactttttctt

SEQ ID NO: 7819545 - DNA, 22 bp, Homo sapiens
ccagccaggcattgcaaactga

SEQ ID NO: 7819546 - DNA, 22 bp, Homo sapiens
ccagccaggctggctgtggagg

SEQ ID NO: 7819547 - DNA, 22 bp, Homo sapiens
ccagccagccttgatctgagta

SEQ ID NO: 7819548 - DNA, 22 bp, Homo sapiens
ccagccagctgcccttggggcc

SEQ ID NO: 7819549 - DNA, 22 bp, Homo sapiens
ccagccagcaagctcccagttc

SEQ ID NO: 7819550 - DNA, 22 bp, Homo sapiens
ccagccagccttgatctgagta

SEQ ID NO: 7819551 - DNA, 22 bp, Homo sapiens
ccagccagctggttggacgcct

SEQ ID NO: 7819552 - DNA, 22 bp, Homo sapiens
ccagccagctggttggacgcct

SEQ ID NO: 7819553 - DNA, 22 bp, Homo sapiens
ccagccagctggttggacgcct

SEQ ID NO: 7819554 - DNA, 22 bp, Homo sapiens
ccagcagggaaaaacccaccaa

SEQ ID NO: 7819555 - DNA, 22 bp, Homo sapiens
ccagagtctatgagtcctcatt

SEQ ID NO: 7819556 - DNA, 22 bp, Homo sapiens
ccagagtctatgagtcctcatt

SEQ ID NO: 7819557 - DNA, 22 bp, Homo sapiens
ccagagtctttatattcctgaa

SEQ ID NO: 7819558 - DNA, 22 bp, Homo sapiens
ccagagtcccttgcagctcagt

SEQ ID NO: 7819559 - DNA, 22 bp, Homo sapiens
ccagccagcaagctcccagttc

SEQ ID NO: 7819560 - DNA, 22 bp, Homo sapiens
ccagccagcaagctcccagttc

SEQ ID NO: 7819561 - DNA, 22 bp, Homo sapiens
ccagccagcaagctcccagttc

SEQ ID NO: 7819562 - DNA, 22 bp, Homo sapiens
ccagccagcaagctcccagttc

SEQ ID NO: 7819563 - DNA, 22 bp, Homo sapiens
ccagccagatgataagctctat

SEQ ID NO: 7819564 - DNA, 22 bp, Homo sapiens
ccagccagatgataagctctat

SEQ ID NO: 7819565 - DNA, 22 bp, Homo sapiens
ccagccagatgataagctctat

SEQ ID NO: 7819566 - DNA, 22 bp, Homo sapiens
ccagccagatgataagctctat

SEQ ID NO: 7819567 - DNA, 22 bp, Homo sapiens
ccagccagaagtccgggcttct

SEQ ID NO: 7819568 - DNA, 22 bp, Homo sapiens
ccagccagaagtccgggcttct

SEQ ID NO: 7819569 - DNA, 22 bp, Homo sapiens
ccagccagaagtccgggcttct

SEQ ID NO: 7819570 - DNA, 22 bp, Homo sapiens
ccagccactgggccactgccag

SEQ ID NO: 7819571 - DNA, 22 bp, Homo sapiens
ccagccactgggccactgccag

SEQ ID NO: 7819572 - DNA, 22 bp, Homo sapiens
ccagcagggaaaaacccaccaa

SEQ ID NO: 7819573 - DNA, 22 bp, Homo sapiens
aggccctgcccagtgccacaag

SEQ ID NO: 7819574 - DNA, 22 bp, Homo sapiens
aggccctgcccagtgccacaag

SEQ ID NO: 7819575 - DNA, 22 bp, Homo sapiens
aggccctgcccagtgccacaag

SEQ ID NO: 7819576 - DNA, 22 bp, Homo sapiens
aggccctgcccagtgccacaag

SEQ ID NO: 7819577 - DNA, 22 bp, Homo sapiens
aggccctgcccagtgccacaag

SEQ ID NO: 7819578 - DNA, 22 bp, Homo sapiens
aggccctgctgaggcctccctc

SEQ ID NO: 7819579 - DNA, 22 bp, Homo sapiens
aggccctgcggaaatgatcatt

SEQ ID NO: 7819580 - DNA, 22 bp, Homo sapiens
aggccctgcccagagctcctcg

SEQ ID NO: 7819581 - DNA, 22 bp, Homo sapiens
aggccctgcccagagctcctcg

SEQ ID NO: 7819582 - DNA, 22 bp, Homo sapiens
aggccctgagaaaatccctgca

SEQ ID NO: 7819583 - DNA, 22 bp, Homo sapiens
aggccctgacctgggagatcta

SEQ ID NO: 7819584 - DNA, 22 bp, Homo sapiens
aggccctgacctgggagatcta

SEQ ID NO: 7819585 - DNA, 22 bp, Homo sapiens
aggccctgacctgggagatcta

SEQ ID NO: 7819586 - DNA, 18 bp, Homo sapiens
ccagccctgcagcacctg

SEQ ID NO: 7819587 - DNA, 22 bp, Homo sapiens
ccagccctgattagagaatgtc

SEQ ID NO: 7819588 - DNA, 18 bp, Homo sapiens
ccagccctgcagcacctg

SEQ ID NO: 7819589 - DNA, 18 bp, Homo sapiens
ccagccctgcagcacctg

SEQ ID NO: 7819590 - DNA, 18 bp, Homo sapiens
ccagccctgcagcacctg

SEQ ID NO: 7819591 - DNA, 22 bp, Homo sapiens
ccagccctgccagagagagctg

SEQ ID NO: 7819592 - DNA, 22 bp, Homo sapiens
aggccctgacctgggagatcta

SEQ ID NO: 7819593 - DNA, 18 bp, Homo sapiens
ccagccctgcagcacctg

SEQ ID NO: 7819594 - DNA, 22 bp, Homo sapiens
ccagccctcggtagtcccatag

SEQ ID NO: 7819595 - DNA, 22 bp, Homo sapiens
ccagccctcggtagtcccatag

SEQ ID NO: 7819596 - DNA, 22 bp, Homo sapiens
ccagccctgaaccctgctgcat

SEQ ID NO: 7819597 - DNA, 22 bp, Homo sapiens
ccagccctgaaccctgctgcat

SEQ ID NO: 7819598 - DNA, 22 bp, Homo sapiens
ccagccctgaaccctgctgcat

SEQ ID NO: 7819599 - DNA, 22 bp, Homo sapiens
ccagccctcggtagtcccatag

SEQ ID NO: 7819600 - DNA, 22 bp, Homo sapiens
ccagccctcggtagtcccatag

SEQ ID NO: 7819601 - DNA, 22 bp, Homo sapiens
ccagccctcggtagtcccatag

SEQ ID NO: 7819602 - DNA, 22 bp, Homo sapiens
ccagccctgaaccctgctgcat

SEQ ID NO: 7819603 - DNA, 22 bp, Homo sapiens
ccagccctgaaccctgctgcat

SEQ ID NO: 7819604 - DNA, 22 bp, Homo sapiens
ccagccctgaaccctgctgcat

SEQ ID NO: 7819605 - DNA, 22 bp, Homo sapiens
ccagccctgattagagaatgtc

SEQ ID NO: 7819606 - DNA, 22 bp, Homo sapiens
ccagccctgattagagaatgtc

SEQ ID NO: 7819607 - DNA, 23 bp, Homo sapiens
ccagccctccaccagctctaggc

SEQ ID NO: 7819608 - DNA, 23 bp, Homo sapiens
ccagccctccaccagctctaggc

SEQ ID NO: 7819609 - DNA, 23 bp, Homo sapiens
ccagccctccaccagctctaggc

SEQ ID NO: 7819610 - DNA, 22 bp, Homo sapiens
ccagccctcctccatcagagga

SEQ ID NO: 7819611 - DNA, 17 bp, Homo sapiens
ccagccctcgcgctttt

SEQ ID NO: 7819612 - DNA, 22 bp, Homo sapiens
ccagccctcggtagtcccatag

SEQ ID NO: 7819613 - DNA, 22 bp, Homo sapiens
ccagccctcctccatcagagga

SEQ ID NO: 7819614 - DNA, 22 bp, Homo sapiens
ccagccctcctccatcagagga

SEQ ID NO: 7819615 - DNA, 22 bp, Homo sapiens
ccagccctcctccatcagagga

SEQ ID NO: 7819616 - DNA, 22 bp, Homo sapiens
ccagaggttccaggctagggag

SEQ ID NO: 7819617 - DNA, 22 bp, Homo sapiens
ccagaggtggtggtgtctagaa

SEQ ID NO: 7819618 - DNA, 22 bp, Homo sapiens
ccagaggtggtgggtgctacag

SEQ ID NO: 7819619 - DNA, 22 bp, Homo sapiens
ccagaggtggtgggtgctacag

SEQ ID NO: 7819620 - DNA, 19 bp, Homo sapiens
ccagaggtttgctgggcct

SEQ ID NO: 7819621 - DNA, 19 bp, Homo sapiens
ccagaggtttgctgggcct

SEQ ID NO: 7819622 - DNA, 19 bp, Homo sapiens
ccagaggtttgctgggcct

SEQ ID NO: 7819623 - DNA, 21 bp, Homo sapiens
ccagaggttctgggcctccct

SEQ ID NO: 7819624 - DNA, 22 bp, Homo sapiens
ccagaggttccaggctagggag

SEQ ID NO: 7819625 - DNA, 21 bp, Homo sapiens
ccagaggttctgggcctccct

SEQ ID NO: 7819626 - DNA, 19 bp, Homo sapiens
ccagagtcatgtctccccc

SEQ ID NO: 7819627 - DNA, 22 bp, Homo sapiens
ccagagtcaggagctcatgtga

SEQ ID NO: 7819628 - DNA, 22 bp, Homo sapiens
ccagagtcaggagctcatgtga

SEQ ID NO: 7819629 - DNA, 16 bp, Homo sapiens
ccagaggcctggcctc

SEQ ID NO: 7819630 - DNA, 21 bp, Homo sapiens
ccagaggcctctcttggccac

SEQ ID NO: 7819631 - DNA, 21 bp, Homo sapiens
ccagaggcctctcttggccac

SEQ ID NO: 7819632 - DNA, 21 bp, Homo sapiens
ccagaggcctctcttggccac

SEQ ID NO: 7819633 - DNA, 16 bp, Homo sapiens
ccagaggcctggcctc

SEQ ID NO: 7819634 - DNA, 22 bp, Homo sapiens
ccagaggcggaggtttgcagtg

SEQ ID NO: 7819635 - DNA, 22 bp, Homo sapiens
ccagaggcggaggtttgcagtg

SEQ ID NO: 7819636 - DNA, 21 bp, Homo sapiens
ccagaggcctctcttggccac

SEQ ID NO: 7819637 - DNA, 21 bp, Homo sapiens
ccagaggcctctcttggccac

SEQ ID NO: 7819638 - DNA, 21 bp, Homo sapiens
ccagaggcctctcttggccac

SEQ ID NO: 7819639 - DNA, 18 bp, Homo sapiens
ccagaggcccgggcaggc

SEQ ID NO: 7819640 - DNA, 18 bp, Homo sapiens
ccagaggcccgggcaggc

SEQ ID NO: 7819641 - DNA, 18 bp, Homo sapiens
ccagaggcccgggcaggc

SEQ ID NO: 7819642 - DNA, 18 bp, Homo sapiens
ccagaggcccgggcaggc

SEQ ID NO: 7819643 - DNA, 22 bp, Homo sapiens
ccagaggctggcaagggctcct

SEQ ID NO: 7819644 - DNA, 22 bp, Homo sapiens
ccagaggctggcaagggctcct

SEQ ID NO: 7819645 - DNA, 22 bp, Homo sapiens
ccagaggctggcaagggctcct

SEQ ID NO: 7819646 - DNA, 22 bp, Homo sapiens
ccagaggctggcaagggctcct

SEQ ID NO: 7819647 - DNA, 22 bp, Homo sapiens
ccagaggctggcaagggctcct

SEQ ID NO: 7819648 - DNA, 22 bp, Homo sapiens
ccagaggctggcaagggctcct

SEQ ID NO: 7819649 - DNA, 22 bp, Homo sapiens
ccagaggtgggagtgatctggt

SEQ ID NO: 7819650 - DNA, 20 bp, Homo sapiens
ccagaggctgacagactttg

SEQ ID NO: 7819651 - DNA, 20 bp, Homo sapiens
ccagaggctgacagactttg

SEQ ID NO: 7819652 - DNA, 22 bp, Homo sapiens
ccagaggctggcaagggctcct

SEQ ID NO: 7819653 - DNA, 20 bp, Homo sapiens
ccagaggctgacagactttg

SEQ ID NO: 7819654 - DNA, 20 bp, Homo sapiens
ccagaggctgacagactttg

SEQ ID NO: 7819655 - DNA, 22 bp, Homo sapiens
ccagaggcggaggtttgcagtg

SEQ ID NO: 7819656 - DNA, 20 bp, Homo sapiens
ccagaggctgacagactttg

SEQ ID NO: 7819657 - DNA, 20 bp, Homo sapiens
ccagaggctgacagactttg

SEQ ID NO: 7819658 - DNA, 20 bp, Homo sapiens
ccagaggctgacagactttg

SEQ ID NO: 7819659 - DNA, 22 bp, Homo sapiens
ccagaggcagacttacactcca

SEQ ID NO: 7819660 - DNA, 19 bp, Homo sapiens
ccagaggcagcttctgtaa

SEQ ID NO: 7819661 - DNA, 19 bp, Homo sapiens
ccagaggcagcttctgtaa

SEQ ID NO: 7819662 - DNA, 19 bp, Homo sapiens
ccagaggcagcttctgtaa

SEQ ID NO: 7819663 - DNA, 22 bp, Homo sapiens
ccagaggcagacttacactcca

SEQ ID NO: 7819664 - DNA, 22 bp, Homo sapiens
ccagaggcagacttacactcca

SEQ ID NO: 7819665 - DNA, 18 bp, Homo sapiens
ccagaggcccgggcaggc

SEQ ID NO: 7819666 - DNA, 18 bp, Homo sapiens
ccagaggcccgggcaggc

SEQ ID NO: 7819667 - DNA, 22 bp, Homo sapiens
ccagaggcatgttcaaagcaat

SEQ ID NO: 7819668 - DNA, 19 bp, Homo sapiens
ccagaggcagcttctgtaa

SEQ ID NO: 7819669 - DNA, 19 bp, Homo sapiens
ccagaggcagcttctgtaa

SEQ ID NO: 7819670 - DNA, 22 bp, Homo sapiens
ccagaggcatgttcaaagcaat

SEQ ID NO: 7819671 - DNA, 22 bp, Homo sapiens
ccagaggcatgttcaaagcaat

SEQ ID NO: 7819672 - DNA, 22 bp, Homo sapiens
ccagaggatgctggtcagcctc

SEQ ID NO: 7819673 - DNA, 22 bp, Homo sapiens
ccagaggatgctggtcagcctc

SEQ ID NO: 7819674 - DNA, 22 bp, Homo sapiens
ccagaggatgctggtcagcctc

SEQ ID NO: 7819675 - DNA, 20 bp, Homo sapiens
ccagagctgatggctgcccg

SEQ ID NO: 7819676 - DNA, 19 bp, Homo sapiens
aggcaggtgcagaggtccc

SEQ ID NO: 7819677 - DNA, 19 bp, Homo sapiens
aggcaggtgcagaggtccc

SEQ ID NO: 7819678 - DNA, 19 bp, Homo sapiens
aggcaggtgcagaggtccc

SEQ ID NO: 7819679 - DNA, 22 bp, Homo sapiens
aggcaggtgagtcaaaacagac

SEQ ID NO: 7819680 - DNA, 20 bp, Homo sapiens
ccagagctgatggctgcccg

SEQ ID NO: 7819681 - DNA, 19 bp, Homo sapiens
aggcaggtgcagaggtccc

SEQ ID NO: 7819682 - DNA, 22 bp, Homo sapiens
aggcaggtagaaggatctttat

SEQ ID NO: 7819683 - DNA, 22 bp, Homo sapiens
aggcaggtagaaggatctttat

SEQ ID NO: 7819684 - DNA, 20 bp, Homo sapiens
ccactccgcccccagagggc

SEQ ID NO: 7819685 - DNA, 22 bp, Homo sapiens
aggcaggtcacatgcttggcga

SEQ ID NO: 7819686 - DNA, 22 bp, Homo sapiens
aggcaggtcacatgcttggcga

SEQ ID NO: 7819687 - DNA, 22 bp, Homo sapiens
aggcaggtagaaggatctttat

SEQ ID NO: 7819688 - DNA, 22 bp, Homo sapiens
ccactcccttccggtccagggc

SEQ ID NO: 7819689 - DNA, 22 bp, Homo sapiens
ccactcccttccggtccagggc

SEQ ID NO: 7819690 - DNA, 22 bp, Homo sapiens
ccactccccacgtgctgtcaga

SEQ ID NO: 7819691 - DNA, 22 bp, Homo sapiens
ccactccccacgtgctgtcaga

SEQ ID NO: 7819692 - DNA, 20 bp, Homo sapiens
ccactccaggtgattctgat

SEQ ID NO: 7819693 - DNA, 20 bp, Homo sapiens
ccactccaggtgattctgat

SEQ ID NO: 7819694 - DNA, 20 bp, Homo sapiens
ccactccaggtgattctgat

SEQ ID NO: 7819695 - DNA, 22 bp, Homo sapiens
aggcaggtcccctggaaggcac

SEQ ID NO: 7819696 - DNA, 22 bp, Homo sapiens
aggcaggtcacatgcttggcga

SEQ ID NO: 7819697 - DNA, 22 bp, Homo sapiens
aggcaggtcccctggaaggcac

SEQ ID NO: 7819698 - DNA, 22 bp, Homo sapiens
aggcaggtcccctggaaggcac

SEQ ID NO: 7819699 - DNA, 22 bp, Homo sapiens
aggcaggtcccctggaaggcac

SEQ ID NO: 7819700 - DNA, 22 bp, Homo sapiens
aggcaggtcccctggaaggcac

SEQ ID NO: 7819701 - DNA, 22 bp, Homo sapiens
aggcaggtctgtatctagtctc

SEQ ID NO: 7819702 - DNA, 22 bp, Homo sapiens
aggcaggtgagtcaaaacagac

SEQ ID NO: 7819703 - DNA, 22 bp, Homo sapiens
aggcaggtcccctggaaggcac

SEQ ID NO: 7819704 - DNA, 22 bp, Homo sapiens
aggcaggtcccctggaaggcac

SEQ ID NO: 7819705 - DNA, 22 bp, Homo sapiens
aggcaggtcccctggaaggcac

SEQ ID NO: 7819706 - DNA, 22 bp, Homo sapiens
aggctcagaggtgagcatctgc

SEQ ID NO: 7819707 - DNA, 20 bp, Homo sapiens
aggctcagatacccagggaa

SEQ ID NO: 7819708 - DNA, 20 bp, Homo sapiens
aggctcagatacccagggaa

SEQ ID NO: 7819709 - DNA, 22 bp, Homo sapiens
ccaggcacaggtgggcctcaga

SEQ ID NO: 7819710 - DNA, 22 bp, Homo sapiens
ccaggcacaggtgggcctcaga

SEQ ID NO: 7819711 - DNA, 22 bp, Homo sapiens
ccaggcacaggtgggcctcaga

SEQ ID NO: 7819712 - DNA, 22 bp, Homo sapiens
ccaggcacaggtgggcctcaga

SEQ ID NO: 7819713 - DNA, 20 bp, Homo sapiens
aggctcagatacccagggaa

SEQ ID NO: 7819714 - DNA, 20 bp, Homo sapiens
aggctcagatacccagggaa

SEQ ID NO: 7819715 - DNA, 22 bp, Homo sapiens
ccaggcacaggtgggcctcaga

SEQ ID NO: 7819716 - DNA, 22 bp, Homo sapiens
ccaggcacaggtgggcctcaga

SEQ ID NO: 7819717 - DNA, 20 bp, Homo sapiens
aggctcagagcagtagtaca

SEQ ID NO: 7819718 - DNA, 20 bp, Homo sapiens
aggctcagagcagtagtaca

SEQ ID NO: 7819719 - DNA, 16 bp, Homo sapiens
aggctcagaggctgga

SEQ ID NO: 7819720 - DNA, 16 bp, Homo sapiens
aggctcagaggctgga

SEQ ID NO: 7819721 - DNA, 20 bp, Homo sapiens
aggctcagagcagtagtaca

SEQ ID NO: 7819722 - DNA, 20 bp, Homo sapiens
aggctcagagcagtagtaca

SEQ ID NO: 7819723 - DNA, 20 bp, Homo sapiens
aggctcagagcagtagtaca

SEQ ID NO: 7819724 - DNA, 20 bp, Homo sapiens
aggctcagagcagtagtaca

SEQ ID NO: 7819725 - DNA, 16 bp, Homo sapiens
aggctcagaggctgga

SEQ ID NO: 7819726 - DNA, 16 bp, Homo sapiens
aggctcagaggctgga

SEQ ID NO: 7819727 - DNA, 22 bp, Homo sapiens
aggctcagaggtgagcatctgc

SEQ ID NO: 7819728 - DNA, 22 bp, Homo sapiens
aggctcagaggtgagcatctgc

SEQ ID NO: 7819729 - DNA, 22 bp, Homo sapiens
ccaggcactgctcgaggtgcta

SEQ ID NO: 7819730 - DNA, 22 bp, Homo sapiens
ccaggcactggctgggttcttt

SEQ ID NO: 7819731 - DNA, 22 bp, Homo sapiens
ccaggcactggctgggttcttt

SEQ ID NO: 7819732 - DNA, 22 bp, Homo sapiens
ccaggcactggctgggttcttt

SEQ ID NO: 7819733 - DNA, 20 bp, Homo sapiens
ccaggcactgtcccatgcag

SEQ ID NO: 7819734 - DNA, 20 bp, Homo sapiens
ccaggcactgtcccatgcag

SEQ ID NO: 7819735 - DNA, 22 bp, Homo sapiens
ccaggcactcagagactgggac

SEQ ID NO: 7819736 - DNA, 22 bp, Homo sapiens
ccaggcactcagagactgggac

SEQ ID NO: 7819737 - DNA, 22 bp, Homo sapiens
ccaggcactcagagactgggac

SEQ ID NO: 7819738 - DNA, 22 bp, Homo sapiens
ccaggcactcagagactgggac

SEQ ID NO: 7819739 - DNA, 22 bp, Homo sapiens
ccaggcactgctcgaggtgcta

SEQ ID NO: 7819740 - DNA, 22 bp, Homo sapiens
ccaggcactgctcgaggtgcta

SEQ ID NO: 7819741 - DNA, 22 bp, Homo sapiens
ccaggcactgctcgaggtgcta

SEQ ID NO: 7819742 - DNA, 22 bp, Homo sapiens
ccaggcactgctcgaggtgcta

SEQ ID NO: 7819743 - DNA, 22 bp, Homo sapiens
ccaggcactgctcgaggtgcta

SEQ ID NO: 7819744 - DNA, 22 bp, Homo sapiens
ccaggcactcacggggcactgg

SEQ ID NO: 7819745 - DNA, 22 bp, Homo sapiens
ccaggcacggtggctcatgcct

SEQ ID NO: 7819746 - DNA, 22 bp, Homo sapiens
ccaggcactcacggggcactgg

SEQ ID NO: 7819747 - DNA, 22 bp, Homo sapiens
ccaggcactcacggggcactgg

SEQ ID NO: 7819748 - DNA, 22 bp, Homo sapiens
ccaggcactcacggggcactgg

SEQ ID NO: 7819749 - DNA, 22 bp, Homo sapiens
ccaggcactcacggggcactgg

SEQ ID NO: 7819750 - DNA, 22 bp, Homo sapiens
ccaggcacggtggctcatgcct

SEQ ID NO: 7819751 - DNA, 22 bp, Homo sapiens
ccaggcacggtggctcatgcct

SEQ ID NO: 7819752 - DNA, 22 bp, Homo sapiens
ccaggcacggtggctcatgcct

SEQ ID NO: 7819753 - DNA, 22 bp, Homo sapiens
ccaggcaccaaagtatgcttta

SEQ ID NO: 7819754 - DNA, 22 bp, Homo sapiens
ccaggcaccatgttcttaggac

SEQ ID NO: 7819755 - DNA, 22 bp, Homo sapiens
ccaggcaccatgttcttaggac

SEQ ID NO: 7819756 - DNA, 22 bp, Homo sapiens
ccaggcaccatgttcttaggac

SEQ ID NO: 7819757 - DNA, 18 bp, Homo sapiens
ccaggcacctttaaatat

SEQ ID NO: 7819758 - DNA, 22 bp, Homo sapiens
aggcctgggcaagaaggggcgt

SEQ ID NO: 7819759 - DNA, 22 bp, Homo sapiens
aggcctgggcaagaaggggcgt

SEQ ID NO: 7819760 - DNA, 22 bp, Homo sapiens
aggcctgggcaagaaggggcgt

SEQ ID NO: 7819761 - DNA, 22 bp, Homo sapiens
aggcctgggcaagaaggggcgt

SEQ ID NO: 7819762 - DNA, 19 bp, Homo sapiens
aggcctggggttttgcact

SEQ ID NO: 7819763 - DNA, 22 bp, Homo sapiens
aggcctgggtctcgtgcctacc

SEQ ID NO: 7819764 - DNA, 22 bp, Homo sapiens
aggcctgggtctcgtgcctacc

SEQ ID NO: 7819765 - DNA, 22 bp, Homo sapiens
aggcctgggtctcgtgcctacc

SEQ ID NO: 7819766 - DNA, 22 bp, Homo sapiens
aggcctgggtctcgtgcctacc

SEQ ID NO: 7819767 - DNA, 22 bp, Homo sapiens
aggcctgggtctcgtgcctacc

SEQ ID NO: 7819768 - DNA, 22 bp, Homo sapiens
aggcctggtgaatgaagtatct

SEQ ID NO: 7819769 - DNA, 22 bp, Homo sapiens
aggcctggtgaatgaagtatct

SEQ ID NO: 7819770 - DNA, 22 bp, Homo sapiens
aggcctggtgaatgaagtatct

SEQ ID NO: 7819771 - DNA, 22 bp, Homo sapiens
aggcctggtgaatgaagtatct

SEQ ID NO: 7819772 - DNA, 22 bp, Homo sapiens
aggcctgggtgttcaccagaag

SEQ ID NO: 7819773 - DNA, 22 bp, Homo sapiens
aggcctggtgaatgaagtatct

SEQ ID NO: 7819774 - DNA, 22 bp, Homo sapiens
aggcctgggtctcgtgcctacc

SEQ ID NO: 7819775 - DNA, 22 bp, Homo sapiens
aggcctgggtctcgtgcctacc

SEQ ID NO: 7819776 - DNA, 22 bp, Homo sapiens
aggcctgggtgttcaccagaag

SEQ ID NO: 7819777 - DNA, 22 bp, Homo sapiens
aggcctgggtgttcaccagaag

SEQ ID NO: 7819778 - DNA, 22 bp, Homo sapiens
aggcctgggtgttcaccagaag

SEQ ID NO: 7819779 - DNA, 22 bp, Homo sapiens
aggctagaggcttctggcttca

SEQ ID NO: 7819780 - DNA, 22 bp, Homo sapiens
aggctagaggcttctggcttca

SEQ ID NO: 7819781 - DNA, 22 bp, Homo sapiens
aggcctggtgtgccggatgcag

SEQ ID NO: 7819782 - DNA, 22 bp, Homo sapiens
aggcctggtgaatgaagtatct

SEQ ID NO: 7819783 - DNA, 22 bp, Homo sapiens
aggcctggtgaatgaagtatct

SEQ ID NO: 7819784 - DNA, 21 bp, Homo sapiens
aggctcagagagaaactcttg

SEQ ID NO: 7819785 - DNA, 22 bp, Homo sapiens
aggctagatagagggtcatctt

SEQ ID NO: 7819786 - DNA, 21 bp, Homo sapiens
aggctcagagagaaactcttg

SEQ ID NO: 7819787 - DNA, 22 bp, Homo sapiens
aggctcagagagctgtgtccat

SEQ ID NO: 7819788 - DNA, 22 bp, Homo sapiens
aggctcagagagctgtgtccat

SEQ ID NO: 7819789 - DNA, 22 bp, Homo sapiens
aggctcagagatgagtaagcac

SEQ ID NO: 7819790 - DNA, 22 bp, Homo sapiens
aggctcagagatgagtaagcac

SEQ ID NO: 7819791 - DNA, 22 bp, Homo sapiens
aggctcagagatgagtaagcac

SEQ ID NO: 7819792 - DNA, 22 bp, Homo sapiens
aggctcagagatgagtaagcac

SEQ ID NO: 7819793 - DNA, 22 bp, Homo sapiens
aggctcagagatgagtaagcac

SEQ ID NO: 7819794 - DNA, 22 bp, Homo sapiens
aggctcagagagctgtgtccat

SEQ ID NO: 7819795 - DNA, 22 bp, Homo sapiens
aggctcagagagctgtgtccat

SEQ ID NO: 7819796 - DNA, 21 bp, Homo sapiens
aggctcagagatcaaacagta

SEQ ID NO: 7819797 - DNA, 21 bp, Homo sapiens
aggctcagagatcaaacagta

SEQ ID NO: 7819798 - DNA, 21 bp, Homo sapiens
aggctcagagatcaaacagta

SEQ ID NO: 7819799 - DNA, 21 bp, Homo sapiens
aggctcagagatcaaacagta

SEQ ID NO: 7819800 - DNA, 22 bp, Homo sapiens
ccaggaggtggcaggacttgcc

SEQ ID NO: 7819801 - DNA, 22 bp, Homo sapiens
ccaggaggtggcaggacttgcc

SEQ ID NO: 7819802 - DNA, 22 bp, Homo sapiens
ccaggaggtggcaggacttgcc

SEQ ID NO: 7819803 - DNA, 22 bp, Homo sapiens
ccaggaggtggcaggacttgcc

SEQ ID NO: 7819804 - DNA, 22 bp, Homo sapiens
ccaggaggtggcaggacttgcc

SEQ ID NO: 7819805 - DNA, 22 bp, Homo sapiens
ccaggaggtggcaggacttgcc

SEQ ID NO: 7819806 - DNA, 22 bp, Homo sapiens
aggcctgggcaagaaggggcgt

SEQ ID NO: 7819807 - DNA, 22 bp, Homo sapiens
aggcctgggacgggagccgtga

SEQ ID NO: 7819808 - DNA, 22 bp, Homo sapiens
ccaggaggtggcaggacttgcc

SEQ ID NO: 7819809 - DNA, 22 bp, Homo sapiens
ccaggaggttgaggctgcagtg

SEQ ID NO: 7819810 - DNA, 22 bp, Homo sapiens
ccaggaggttgaggctgcagtg

SEQ ID NO: 7819811 - DNA, 22 bp, Homo sapiens
ccaggaggtggaggttgcggtg

SEQ ID NO: 7819812 - DNA, 22 bp, Homo sapiens
ccaggaggtggaggttgcggtg

SEQ ID NO: 7819813 - DNA, 22 bp, Homo sapiens
ccaggaggtggaggttgcggtg

SEQ ID NO: 7819814 - DNA, 22 bp, Homo sapiens
ccaggaggtggaggttgcggtg

SEQ ID NO: 7819815 - DNA, 22 bp, Homo sapiens
ccaggaggtggagattgcagtg

SEQ ID NO: 7819816 - DNA, 22 bp, Homo sapiens
ccaggaggtggagattgcagtg

SEQ ID NO: 7819817 - DNA, 22 bp, Homo sapiens
ccaggaggtggagattgcagtg

SEQ ID NO: 7819818 - DNA, 22 bp, Homo sapiens
ccaggaggtggagattgcagtg

SEQ ID NO: 7819819 - DNA, 22 bp, Homo sapiens
ccaggaggtgctggaagaaagc

SEQ ID NO: 7819820 - DNA, 22 bp, Homo sapiens
ccaggaggtggagattgcagtg

SEQ ID NO: 7819821 - DNA, 22 bp, Homo sapiens
ccaggaggtgctggaagaaagc

SEQ ID NO: 7819822 - DNA, 22 bp, Homo sapiens
ccaggaggtgctggaagaaagc

SEQ ID NO: 7819823 - DNA, 22 bp, Homo sapiens
ccaggaggtctgagtgtggaca

SEQ ID NO: 7819824 - DNA, 22 bp, Homo sapiens
ccaggaggtctgagtgtggaca

SEQ ID NO: 7819825 - DNA, 22 bp, Homo sapiens
ccaggaggtgaaacttcaccag

SEQ ID NO: 7819826 - DNA, 22 bp, Homo sapiens
ccaggaggtgaaacttcaccag

SEQ ID NO: 7819827 - DNA, 22 bp, Homo sapiens
ccaggaggtgaaacttcaccag

SEQ ID NO: 7819828 - DNA, 22 bp, Homo sapiens
ccaggaggtctgagtgtggaca

SEQ ID NO: 7819829 - DNA, 22 bp, Homo sapiens
ccaggagggtggttactcaatc

SEQ ID NO: 7819830 - DNA, 22 bp, Homo sapiens
ccaggagggtggttactcaatc

SEQ ID NO: 7819831 - DNA, 22 bp, Homo sapiens
ccaggaggggtctctgtctccc

SEQ ID NO: 7819832 - DNA, 22 bp, Homo sapiens
ccaggagggtggttactcaatc

SEQ ID NO: 7819833 - DNA, 22 bp, Homo sapiens
ccaggaggggtctctgtctccc

SEQ ID NO: 7819834 - DNA, 22 bp, Homo sapiens
ccaggaggggtctctgtctccc

SEQ ID NO: 7819835 - DNA, 22 bp, Homo sapiens
ccaggaggggtctctgtctccc

SEQ ID NO: 7819836 - DNA, 22 bp, Homo sapiens
ccaggaggggtctctgtctccc

SEQ ID NO: 7819837 - DNA, 22 bp, Homo sapiens
ccaggaggggtctctgtctccc

SEQ ID NO: 7819838 - DNA, 22 bp, Homo sapiens
ccaggagggaggagttcctgag

SEQ ID NO: 7819839 - DNA, 22 bp, Homo sapiens
ccaggagggaggagttcctgag

SEQ ID NO: 7819840 - DNA, 22 bp, Homo sapiens
ccaggagggaggagttcctgag

SEQ ID NO: 7819841 - DNA, 22 bp, Homo sapiens
ccaggagggaggagttcctgag

SEQ ID NO: 7819842 - DNA, 22 bp, Homo sapiens
ccaggaggatgaggggcataga

SEQ ID NO: 7819843 - DNA, 22 bp, Homo sapiens
ccaggaggatgaggggcataga

SEQ ID NO: 7819844 - DNA, 22 bp, Homo sapiens
ccaggaggatgaggggcataga

SEQ ID NO: 7819845 - DNA, 22 bp, Homo sapiens
ccaggaggatgaggggcataga

SEQ ID NO: 7819846 - DNA, 22 bp, Homo sapiens
ccaggaggatgaggggcataga

SEQ ID NO: 7819847 - DNA, 22 bp, Homo sapiens
ccaggaggatcatcctgttttc

SEQ ID NO: 7819848 - DNA, 22 bp, Homo sapiens
ccagctccgggagttgctgctg

SEQ ID NO: 7819849 - DNA, 21 bp, Homo sapiens
aggccctggaggtcagagaaa

SEQ ID NO: 7819850 - DNA, 21 bp, Homo sapiens
aggccctggaggtcagagaaa

SEQ ID NO: 7819851 - DNA, 21 bp, Homo sapiens
aggccctggaggtcagagaaa

SEQ ID NO: 7819852 - DNA, 21 bp, Homo sapiens
aggccctggaggtcagagaaa

SEQ ID NO: 7819853 - DNA, 21 bp, Homo sapiens
aggccctggaggtcagagaaa

SEQ ID NO: 7819854 - DNA, 21 bp, Homo sapiens
aggccctggaggtcagagaaa

SEQ ID NO: 7819855 - DNA, 22 bp, Homo sapiens
aggccctggcactgcctgggag

SEQ ID NO: 7819856 - DNA, 22 bp, Homo sapiens
ccagctccaggactgggagctg

SEQ ID NO: 7819857 - DNA, 22 bp, Homo sapiens
ccagctccaggactgggagctg

SEQ ID NO: 7819858 - DNA, 22 bp, Homo sapiens
ccagctccaggtagatgggcag

SEQ ID NO: 7819859 - DNA, 22 bp, Homo sapiens
ccagctccaggtagatgggcag

SEQ ID NO: 7819860 - DNA, 22 bp, Homo sapiens
ccagctccattgcttagtgtaa

SEQ ID NO: 7819861 - DNA, 22 bp, Homo sapiens
ccagctccaggtagatgggcag

SEQ ID NO: 7819862 - DNA, 22 bp, Homo sapiens
ccagctccaggtagatgggcag

SEQ ID NO: 7819863 - DNA, 22 bp, Homo sapiens
aggccctggacactcaagccgg

SEQ ID NO: 7819864 - DNA, 22 bp, Homo sapiens
aggccctggacactcaagccgg

SEQ ID NO: 7819865 - DNA, 22 bp, Homo sapiens
aggccctggacactcaagccgg

SEQ ID NO: 7819866 - DNA, 22 bp, Homo sapiens
aggccctgctttccagagctca

SEQ ID NO: 7819867 - DNA, 22 bp, Homo sapiens
aggccctgctttccagagctca

SEQ ID NO: 7819868 - DNA, 22 bp, Homo sapiens
aggccctgctttccagagctca

SEQ ID NO: 7819869 - DNA, 22 bp, Homo sapiens
aggccctgctgaggcctccctc

SEQ ID NO: 7819870 - DNA, 22 bp, Homo sapiens
aggccctgctttccagagctca

SEQ ID NO: 7819871 - DNA, 22 bp, Homo sapiens
aggccctgctttccagagctca

SEQ ID NO: 7819872 - DNA, 22 bp, Homo sapiens
aggccctgctttccagagctca

SEQ ID NO: 7819873 - DNA, 22 bp, Homo sapiens
aggccctgctttccagagctca

SEQ ID NO: 7819874 - DNA, 22 bp, Homo sapiens
aggccctgctttccagagctca

SEQ ID NO: 7819875 - DNA, 22 bp, Homo sapiens
aggccctgctttccagagctca

SEQ ID NO: 7819876 - DNA, 22 bp, Homo sapiens
ccagctcccctcagcaggtaat

SEQ ID NO: 7819877 - DNA, 22 bp, Homo sapiens
ccagctcccgcaggctgcacag

SEQ ID NO: 7819878 - DNA, 22 bp, Homo sapiens
ccagctcccctcagcaggtaat

SEQ ID NO: 7819879 - DNA, 23 bp, Homo sapiens
ccagctcccaggtctgaggactg

SEQ ID NO: 7819880 - DNA, 22 bp, Homo sapiens
ccagctcccattcttcacctgt

SEQ ID NO: 7819881 - DNA, 23 bp, Homo sapiens
ccagctcccaggtctgaggactg

SEQ ID NO: 7819882 - DNA, 23 bp, Homo sapiens
ccagctcccaggtctgaggactg

SEQ ID NO: 7819883 - DNA, 23 bp, Homo sapiens
ccagctcccaggtctgaggactg

SEQ ID NO: 7819884 - DNA, 23 bp, Homo sapiens
ccagctcccaggtctgaggactg

SEQ ID NO: 7819885 - DNA, 23 bp, Homo sapiens
ccagctcccaggtctgaggactg

SEQ ID NO: 7819886 - DNA, 22 bp, Homo sapiens
ccagctccctgaagcctggtct

SEQ ID NO: 7819887 - DNA, 22 bp, Homo sapiens
ccagctccctgaagcctggtct

SEQ ID NO: 7819888 - DNA, 22 bp, Homo sapiens
ccagctccctgaagcctggtct

SEQ ID NO: 7819889 - DNA, 22 bp, Homo sapiens
ccagctccgggagttgctgctg

SEQ ID NO: 7819890 - DNA, 22 bp, Homo sapiens
ccagctccgggagttgctgctg

SEQ ID NO: 7819891 - DNA, 22 bp, Homo sapiens
ccagctccgggagttgctgctg

SEQ ID NO: 7819892 - DNA, 22 bp, Homo sapiens
ccagctcccgcaggctgcacag

SEQ ID NO: 7819893 - DNA, 22 bp, Homo sapiens
ccagctcccgcaggctgcacag

SEQ ID NO: 7819894 - DNA, 22 bp, Homo sapiens
ccagctccctgaagcctggtct

SEQ ID NO: 7819895 - DNA, 22 bp, Homo sapiens
ccagctcccgcaggctgcacag

SEQ ID NO: 7819896 - DNA, 22 bp, Homo sapiens
ccagctccctgaagcctggtct

SEQ ID NO: 7819897 - DNA, 22 bp, Homo sapiens
cccaggaagtggaggttgcagt

SEQ ID NO: 7819898 - DNA, 22 bp, Homo sapiens
cccaggaagttgagactgcagt

SEQ ID NO: 7819899 - DNA, 22 bp, Homo sapiens
cccaggaagggatgccaaggaa

SEQ ID NO: 7819900 - DNA, 22 bp, Homo sapiens
cccaggaagggatgccaaggaa

SEQ ID NO: 7819901 - DNA, 22 bp, Homo sapiens
cccaggaagttgatgcagagga

SEQ ID NO: 7819902 - DNA, 22 bp, Homo sapiens
cccaggaagttgatgcagagga

SEQ ID NO: 7819903 - DNA, 22 bp, Homo sapiens
cccaggaagttgatgcagagga

SEQ ID NO: 7819904 - DNA, 22 bp, Homo sapiens
cccaggaagttgatgcagagga

SEQ ID NO: 7819905 - DNA, 22 bp, Homo sapiens
cccaggaagttgagactgcagt

SEQ ID NO: 7819906 - DNA, 22 bp, Homo sapiens
cccaggaagttgagactgcagt

SEQ ID NO: 7819907 - DNA, 22 bp, Homo sapiens
cccaggaatgagcaggcagggg

SEQ ID NO: 7819908 - DNA, 22 bp, Homo sapiens
cccaggaatgagcaggcagggg

SEQ ID NO: 7819909 - DNA, 22 bp, Homo sapiens
cccaggaagttgatgcagagga

SEQ ID NO: 7819910 - DNA, 22 bp, Homo sapiens
cccaggaagttgatgcagagga

SEQ ID NO: 7819911 - DNA, 22 bp, Homo sapiens
cccaggaagttgatgcagagga

SEQ ID NO: 7819912 - DNA, 22 bp, Homo sapiens
cccaggaagggatgccaaggaa

SEQ ID NO: 7819913 - DNA, 22 bp, Homo sapiens
cccaggaagggatgccaaggaa

SEQ ID NO: 7819914 - DNA, 22 bp, Homo sapiens
cccaggaaggagctgtgtattt

SEQ ID NO: 7819915 - DNA, 22 bp, Homo sapiens
cccaggaagggatgccaaggaa

SEQ ID NO: 7819916 - DNA, 19 bp, Homo sapiens
cccaggaagcggaggttgc

SEQ ID NO: 7819917 - DNA, 22 bp, Homo sapiens
cccaggaagcggagattgcaga

SEQ ID NO: 7819918 - DNA, 22 bp, Homo sapiens
cccaggaagcggagattgcaga

SEQ ID NO: 7819919 - DNA, 22 bp, Homo sapiens
cccaggaagcccagaattctgg

SEQ ID NO: 7819920 - DNA, 22 bp, Homo sapiens
cccaggaagcccagaattctgg

SEQ ID NO: 7819921 - DNA, 22 bp, Homo sapiens
cccaggaagagtgagtggcatt

SEQ ID NO: 7819922 - DNA, 22 bp, Homo sapiens
cccaggaagagtgagtggcatt

SEQ ID NO: 7819923 - DNA, 22 bp, Homo sapiens
cccaggaagagtgagtggcatt

SEQ ID NO: 7819924 - DNA, 22 bp, Homo sapiens
cccaggaagaggggtcaggtgt

SEQ ID NO: 7819925 - DNA, 22 bp, Homo sapiens
cccaggaagaggggtcaggtgt

SEQ ID NO: 7819926 - DNA, 22 bp, Homo sapiens
cccaggaagagtgagtggcatt

SEQ ID NO: 7819927 - DNA, 22 bp, Homo sapiens
cccaggaacctaccagctcgag

SEQ ID NO: 7819928 - DNA, 22 bp, Homo sapiens
cccaggaacagggctcagaccc

SEQ ID NO: 7819929 - DNA, 22 bp, Homo sapiens
cccaggaacagggctcagaccc

SEQ ID NO: 7819930 - DNA, 22 bp, Homo sapiens
cccaggaacagggctcagaccc

SEQ ID NO: 7819931 - DNA, 22 bp, Homo sapiens
cccaggaagaaattctgatttg

SEQ ID NO: 7819932 - DNA, 22 bp, Homo sapiens
cccaggaactccagagctcctc

SEQ ID NO: 7819933 - DNA, 22 bp, Homo sapiens
cccaggaactccagagctcctc

SEQ ID NO: 7819934 - DNA, 22 bp, Homo sapiens
cccaggaactccagagctcctc

SEQ ID NO: 7819935 - DNA, 22 bp, Homo sapiens
cccaggaacagcacagaacagc

SEQ ID NO: 7819936 - DNA, 22 bp, Homo sapiens
cccaggaacagcacagaacagc

SEQ ID NO: 7819937 - DNA, 22 bp, Homo sapiens
cccaggaacagcacagaacagc

SEQ ID NO: 7819938 - DNA, 22 bp, Homo sapiens
cccaggaacagcacagaacagc

SEQ ID NO: 7819939 - DNA, 22 bp, Homo sapiens
cccaggaacagcacagaacagc

SEQ ID NO: 7819940 - DNA, 22 bp, Homo sapiens
cccaggaaatgaacttctgatt

SEQ ID NO: 7819941 - DNA, 22 bp, Homo sapiens
cccaggaaatgaacttctgatt

SEQ ID NO: 7819942 - DNA, 22 bp, Homo sapiens
cccaggaaatgggctcttgcct

SEQ ID NO: 7819943 - DNA, 22 bp, Homo sapiens
cccaggaaatgggctcttgcct

SEQ ID NO: 7819944 - DNA, 22 bp, Homo sapiens
cccaggaaatgggctcttgcct

SEQ ID NO: 7819945 - DNA, 22 bp, Homo sapiens
agggaaagtaagcatttcatta

SEQ ID NO: 7819946 - DNA, 23 bp, Homo sapiens
agggaaagtagtaatggcctttg

SEQ ID NO: 7819947 - DNA, 23 bp, Homo sapiens
agggaaagtagtaatggcctttg

SEQ ID NO: 7819948 - DNA, 23 bp, Homo sapiens
agggaaagtagtaatggcctttg

SEQ ID NO: 7819949 - DNA, 22 bp, Homo sapiens
agggaaagtaagcatttcatta

SEQ ID NO: 7819950 - DNA, 23 bp, Homo sapiens
agggaaagtagtaatggcctttg

SEQ ID NO: 7819951 - DNA, 23 bp, Homo sapiens
agggaaagtagtaatggcctttg

SEQ ID NO: 7819952 - DNA, 22 bp, Homo sapiens
cccaggaaatcaggctttctag

SEQ ID NO: 7819953 - DNA, 22 bp, Homo sapiens
cccaggaaatcaggctttctag

SEQ ID NO: 7819954 - DNA, 22 bp, Homo sapiens
cccaggaaatatgtttcttaac

SEQ ID NO: 7819955 - DNA, 22 bp, Homo sapiens
cccaggaaatagccaggaggtg

SEQ ID NO: 7819956 - DNA, 22 bp, Homo sapiens
cccagagttggtcaggggaccc

SEQ ID NO: 7819957 - DNA, 22 bp, Homo sapiens
cccagatgcaggttcaagagta

SEQ ID NO: 7819958 - DNA, 22 bp, Homo sapiens
aggcttggctctcctatgagaa

SEQ ID NO: 7819959 - DNA, 22 bp, Homo sapiens
aggcttggctggcagccctggg

SEQ ID NO: 7819960 - DNA, 22 bp, Homo sapiens
aggctttcctgtcactcatgct

SEQ ID NO: 7819961 - DNA, 22 bp, Homo sapiens
aggcttggctggcagccctggg

SEQ ID NO: 7819962 - DNA, 22 bp, Homo sapiens
aggcttggctggcagccctggg

SEQ ID NO: 7819963 - DNA, 22 bp, Homo sapiens
aggctttgcaaaaaagctcata

SEQ ID NO: 7819964 - DNA, 22 bp, Homo sapiens
aggctttgcaaaaaagctcata

SEQ ID NO: 7819965 - DNA, 22 bp, Homo sapiens
aggctttgcaaaaaagctcata

SEQ ID NO: 7819966 - DNA, 21 bp, Homo sapiens
aggctttgaatcatccttcga

SEQ ID NO: 7819967 - DNA, 22 bp, Homo sapiens
aggctttcgatgaacgcttgct

SEQ ID NO: 7819968 - DNA, 22 bp, Homo sapiens
aggctttggaatcagagttctg

SEQ ID NO: 7819969 - DNA, 22 bp, Homo sapiens
aggctttgcaaaaaagctcata

SEQ ID NO: 7819970 - DNA, 22 bp, Homo sapiens
aggctttggaatcagagttctg

SEQ ID NO: 7819971 - DNA, 22 bp, Homo sapiens
cccagagtctctgctcttgcct

SEQ ID NO: 7819972 - DNA, 22 bp, Homo sapiens
cccagagtcacatggggtgttc

SEQ ID NO: 7819973 - DNA, 23 bp, Homo sapiens
cccagagtcatctgtagctgtgg

SEQ ID NO: 7819974 - DNA, 22 bp, Homo sapiens
cccagagtcaagcttaccatta

SEQ ID NO: 7819975 - DNA, 22 bp, Homo sapiens
cccagagtatttgtgatgttag

SEQ ID NO: 7819976 - DNA, 22 bp, Homo sapiens
cccagagttggtcaggggaccc

SEQ ID NO: 7819977 - DNA, 22 bp, Homo sapiens
cccagagttggtcaggggaccc

SEQ ID NO: 7819978 - DNA, 22 bp, Homo sapiens
cccagagttcaaaccctgcgtc

SEQ ID NO: 7819979 - DNA, 22 bp, Homo sapiens
cccagagtggacggtggcccct

SEQ ID NO: 7819980 - DNA, 22 bp, Homo sapiens
cccagagtggagggtgcagaat

SEQ ID NO: 7819981 - DNA, 21 bp, Homo sapiens
agggaaagaaaatgagctaat

SEQ ID NO: 7819982 - DNA, 21 bp, Homo sapiens
agggaaagaaaatgagctaat

SEQ ID NO: 7819983 - DNA, 21 bp, Homo sapiens
agggaaagaaaatgagctaat

SEQ ID NO: 7819984 - DNA, 22 bp, Homo sapiens
agggaaaggctgatgctgtggg

SEQ ID NO: 7819985 - DNA, 22 bp, Homo sapiens
agggaaaggctgatgctgtggg

SEQ ID NO: 7819986 - DNA, 22 bp, Homo sapiens
agggaaaggctgatgctgtggg

SEQ ID NO: 7819987 - DNA, 22 bp, Homo sapiens
agggaaaggtagtgaggtcaca

SEQ ID NO: 7819988 - DNA, 22 bp, Homo sapiens
agggaaaggtagtgaggtcaca

SEQ ID NO: 7819989 - DNA, 22 bp, Homo sapiens
agggaaaggctgatgctgtggg

SEQ ID NO: 7819990 - DNA, 22 bp, Homo sapiens
agggaaaggtagtgaggtcaca

SEQ ID NO: 7819991 - DNA, 22 bp, Homo sapiens
agggaaaggtagtgaggtcaca

SEQ ID NO: 7819992 - DNA, 22 bp, Homo sapiens
agggaaaggtagtgaggtcaca

SEQ ID NO: 7819993 - DNA, 21 bp, Homo sapiens
agggaaagaaaatgagctaat

SEQ ID NO: 7819994 - DNA, 21 bp, Homo sapiens
agggaaaaggctgagtgaggg

SEQ ID NO: 7819995 - DNA, 22 bp, Homo sapiens
aggcttttgtggtgtggaatgg

SEQ ID NO: 7819996 - DNA, 22 bp, Homo sapiens
aggcttttggagaagcatatgc

SEQ ID NO: 7819997 - DNA, 21 bp, Homo sapiens
agggaaaaggctgagtgaggg

SEQ ID NO: 7819998 - DNA, 21 bp, Homo sapiens
agggaaaaggctgagtgaggg

SEQ ID NO: 7819999 - DNA, 22 bp, Homo sapiens
aggcttttggagaagcatatgc

SEQ ID NO: 7820000 - DNA, 22 bp, Homo sapiens
aggcttttgctctggctcctct

SEQ ID NO: 7820001 - DNA, 22 bp, Homo sapiens
aggcttttgctctggctcctct

SEQ ID NO: 7820002 - DNA, 22 bp, Homo sapiens
aggctttgttttatctcattta

SEQ ID NO: 7820003 - DNA, 22 bp, Homo sapiens
aggctttgttttatctcattta

SEQ ID NO: 7820004 - DNA, 22 bp, Homo sapiens
aggcttttagaatcttatttct

SEQ ID NO: 7820005 - DNA, 22 bp, Homo sapiens
aggcttttagaatcttatttct

SEQ ID NO: 7820006 - DNA, 22 bp, Homo sapiens
aggcttttagaatcttatttct

SEQ ID NO: 7820007 - DNA, 22 bp, Homo sapiens
aggcttttatacattgctgacc

SEQ ID NO: 7820008 - DNA, 22 bp, Homo sapiens
aggcttttctccagaatgtact

SEQ ID NO: 7820009 - DNA, 22 bp, Homo sapiens
aggcttttgctctggctcctct

SEQ ID NO: 7820010 - DNA, 22 bp, Homo sapiens
aggcttttatacattgctgacc

SEQ ID NO: 7820011 - DNA, 22 bp, Homo sapiens
agggaccagcgtgagtctgagg

SEQ ID NO: 7820012 - DNA, 22 bp, Homo sapiens
agggaccagcgtgagtctgagg

SEQ ID NO: 7820013 - DNA, 22 bp, Homo sapiens
agggaccacatcccctctgtgg

SEQ ID NO: 7820014 - DNA, 22 bp, Homo sapiens
agggaccagcctgcccagggct

SEQ ID NO: 7820015 - DNA, 22 bp, Homo sapiens
agggaccaatcaccgacaggct

SEQ ID NO: 7820016 - DNA, 22 bp, Homo sapiens
agggaccaatcaccgacaggct

SEQ ID NO: 7820017 - DNA, 22 bp, Homo sapiens
agggaccaatcaccgacaggct

SEQ ID NO: 7820018 - DNA, 22 bp, Homo sapiens
agggaccacatcccctctgtgg

SEQ ID NO: 7820019 - DNA, 22 bp, Homo sapiens
agggaccacatcccctctgtgg

SEQ ID NO: 7820020 - DNA, 22 bp, Homo sapiens
agggacagttacatcatcagac

SEQ ID NO: 7820021 - DNA, 22 bp, Homo sapiens
agggacagttacatcatcagac

SEQ ID NO: 7820022 - DNA, 22 bp, Homo sapiens
agggacagttacatcatcagac

SEQ ID NO: 7820023 - DNA, 22 bp, Homo sapiens
agggacatctcacaaacaactt

SEQ ID NO: 7820024 - DNA, 22 bp, Homo sapiens
agggacatgaggatgatctaga

SEQ ID NO: 7820025 - DNA, 22 bp, Homo sapiens
cccaggaatgagcaggcagggg

SEQ ID NO: 7820026 - DNA, 22 bp, Homo sapiens
agggaatggatgatggcaggtt

SEQ ID NO: 7820027 - DNA, 22 bp, Homo sapiens
agggaatggatgatggcaggtt

SEQ ID NO: 7820028 - DNA, 22 bp, Homo sapiens
agggacagtctactgttcactg

SEQ ID NO: 7820029 - DNA, 22 bp, Homo sapiens
agggacagtctactgttcactg

SEQ ID NO: 7820030 - DNA, 22 bp, Homo sapiens
agggacagtctactgttcactg

SEQ ID NO: 7820031 - DNA, 22 bp, Homo sapiens
agggacagttacatcatcagac

SEQ ID NO: 7820032 - DNA, 22 bp, Homo sapiens
agggacagttacatcatcagac

SEQ ID NO: 7820033 - DNA, 22 bp, Homo sapiens
agggacagttacatcatcagac

SEQ ID NO: 7820034 - DNA, 22 bp, Homo sapiens
cccaggccagaacttggttgct

SEQ ID NO: 7820035 - DNA, 22 bp, Homo sapiens
agggacgccgtgcgggaccgtg

SEQ ID NO: 7820036 - DNA, 22 bp, Homo sapiens
cccaggccccagggcttgtcag

SEQ ID NO: 7820037 - DNA, 22 bp, Homo sapiens
cccaggcattttcaactttagt

SEQ ID NO: 7820038 - DNA, 22 bp, Homo sapiens
cccaggcatcccattaaggagc

SEQ ID NO: 7820039 - DNA, 22 bp, Homo sapiens
cccaggcattttcaactttagt

SEQ ID NO: 7820040 - DNA, 22 bp, Homo sapiens
cccaggccagaacttggttgct

SEQ ID NO: 7820041 - DNA, 22 bp, Homo sapiens
agggactatttacccatctcac

SEQ ID NO: 7820042 - DNA, 22 bp, Homo sapiens
agggactatttacccatctcac

SEQ ID NO: 7820043 - DNA, 22 bp, Homo sapiens
agggactatttacccatctcac

SEQ ID NO: 7820044 - DNA, 22 bp, Homo sapiens
agggacgccgtgcgggaccgtg

SEQ ID NO: 7820045 - DNA, 22 bp, Homo sapiens
agggactatttacccatctcac

SEQ ID NO: 7820046 - DNA, 22 bp, Homo sapiens
agggacccatagagagaccagt

SEQ ID NO: 7820047 - DNA, 22 bp, Homo sapiens
agggaccctgatgactgaggag

SEQ ID NO: 7820048 - DNA, 22 bp, Homo sapiens
agggaccaggggtagctgagat

SEQ ID NO: 7820049 - DNA, 22 bp, Homo sapiens
agggaccaggggtagctgagat

SEQ ID NO: 7820050 - DNA, 22 bp, Homo sapiens
agggaccaggggtagctgagat

SEQ ID NO: 7820051 - DNA, 22 bp, Homo sapiens
agggacccatagagagaccagt

SEQ ID NO: 7820052 - DNA, 22 bp, Homo sapiens
agggacccatagagagaccagt

SEQ ID NO: 7820053 - DNA, 17 bp, Homo sapiens
cccaggccgccgggagc

SEQ ID NO: 7820054 - DNA, 17 bp, Homo sapiens
cccaggccgccgggagc

SEQ ID NO: 7820055 - DNA, 17 bp, Homo sapiens
cccaggccgccgggagc

SEQ ID NO: 7820056 - DNA, 22 bp, Homo sapiens
cccaggcctggtctgggccagt

SEQ ID NO: 7820057 - DNA, 22 bp, Homo sapiens
cccaggcctggtctgggccagt

SEQ ID NO: 7820058 - DNA, 22 bp, Homo sapiens
cccaggcctggtctgggccagt

SEQ ID NO: 7820059 - DNA, 22 bp, Homo sapiens
cccaggcctggtctgggccagt

SEQ ID NO: 7820060 - DNA, 17 bp, Homo sapiens
cccaggccgccgggagc

SEQ ID NO: 7820061 - DNA, 22 bp, Homo sapiens
cccaggccccagggcttgtcag

SEQ ID NO: 7820062 - DNA, 22 bp, Homo sapiens
cccaggccccagggcttgtcag

SEQ ID NO: 7820063 - DNA, 22 bp, Homo sapiens
cccaggccctggcagagcttgt

SEQ ID NO: 7820064 - DNA, 22 bp, Homo sapiens
cccaggccctggcagagcttgt

SEQ ID NO: 7820065 - DNA, 22 bp, Homo sapiens
cccaggccctggcagagcttgt

SEQ ID NO: 7820066 - DNA, 22 bp, Homo sapiens
cccaggcctggtctgggccagt

SEQ ID NO: 7820067 - DNA, 22 bp, Homo sapiens
agggagccctgaaccagagggt

SEQ ID NO: 7820068 - DNA, 22 bp, Homo sapiens
cccaggcctggtctgggccagt

SEQ ID NO: 7820069 - DNA, 22 bp, Homo sapiens
cccaggcctggtctgggccagt

SEQ ID NO: 7820070 - DNA, 22 bp, Homo sapiens
cccaggcctggtctgggccagt

SEQ ID NO: 7820071 - DNA, 22 bp, Homo sapiens
agggagccttcctggctgtggt

SEQ ID NO: 7820072 - DNA, 22 bp, Homo sapiens
agggagccctgaaccagagggt

SEQ ID NO: 7820073 - DNA, 22 bp, Homo sapiens
agggagccttcctggctgtggt

SEQ ID NO: 7820074 - DNA, 22 bp, Homo sapiens
agggagctgagagctactattt

SEQ ID NO: 7820075 - DNA, 22 bp, Homo sapiens
agggagctgagctgtgagcagc

SEQ ID NO: 7820076 - DNA, 22 bp, Homo sapiens
agggagctgagctgtgagcagc

SEQ ID NO: 7820077 - DNA, 22 bp, Homo sapiens
agggagctgagctgtgagcagc

SEQ ID NO: 7820078 - DNA, 22 bp, Homo sapiens
agggagcttccgaactacagct

SEQ ID NO: 7820079 - DNA, 22 bp, Homo sapiens
agggagcttctggcctcagcct

SEQ ID NO: 7820080 - DNA, 22 bp, Homo sapiens
agggagcttctggcctcagcct

SEQ ID NO: 7820081 - DNA, 22 bp, Homo sapiens
agggagcttctggcctcagcct

SEQ ID NO: 7820082 - DNA, 22 bp, Homo sapiens
agggagcttctacttcaaggca

SEQ ID NO: 7820083 - DNA, 22 bp, Homo sapiens
agggagcttctggcctcagcct

SEQ ID NO: 7820084 - DNA, 22 bp, Homo sapiens
agggagcttccgaactacagct

SEQ ID NO: 7820085 - DNA, 22 bp, Homo sapiens
agggagctgtggtcagctcagt

SEQ ID NO: 7820086 - DNA, 22 bp, Homo sapiens
agggagctgtggtcagctcagt

SEQ ID NO: 7820087 - DNA, 22 bp, Homo sapiens
agggagctgtggtcagctcagt

SEQ ID NO: 7820088 - DNA, 22 bp, Homo sapiens
agggagctgtggtcagctcagt

SEQ ID NO: 7820089 - DNA, 22 bp, Homo sapiens
agggagctgtggtcagctcagt

SEQ ID NO: 7820090 - DNA, 22 bp, Homo sapiens
agggagctgtggtcagctcagt

SEQ ID NO: 7820091 - DNA, 22 bp, Homo sapiens
agggagctggtatttataatga

SEQ ID NO: 7820092 - DNA, 21 bp, Homo sapiens
agggagctggccacacagcct

SEQ ID NO: 7820093 - DNA, 21 bp, Homo sapiens
agggagctggccacacagcct

SEQ ID NO: 7820094 - DNA, 21 bp, Homo sapiens
agggagctggccacacagcct

SEQ ID NO: 7820095 - DNA, 22 bp, Homo sapiens
agggagctgagctgtgagcagc

SEQ ID NO: 7820096 - DNA, 21 bp, Homo sapiens
agggagctggccacacagcct

SEQ ID NO: 7820097 - DNA, 22 bp, Homo sapiens
agggagctgctctgcttccgtg

SEQ ID NO: 7820098 - DNA, 22 bp, Homo sapiens
agggagctgctctgcttccgtg

SEQ ID NO: 7820099 - DNA, 21 bp, Homo sapiens
agggagctttaggtagaagtt

SEQ ID NO: 7820100 - DNA, 22 bp, Homo sapiens
agggagctttcaggtagcttaa

SEQ ID NO: 7820101 - DNA, 22 bp, Homo sapiens
agggagctttaccccagatcac

SEQ ID NO: 7820102 - DNA, 22 bp, Homo sapiens
agggagctttaccccagatcac

SEQ ID NO: 7820103 - DNA, 22 bp, Homo sapiens
agggagcttgtgtttcttttag

SEQ ID NO: 7820104 - DNA, 22 bp, Homo sapiens
agggagctttaccccagatcac

SEQ ID NO: 7820105 - DNA, 22 bp, Homo sapiens
cccaggtgctgaaggaggccgc

SEQ ID NO: 7820106 - DNA, 22 bp, Homo sapiens
cccaggtgctgaaggaggccgc

SEQ ID NO: 7820107 - DNA, 22 bp, Homo sapiens
cccaggtgctgcgtgaagcctc

SEQ ID NO: 7820108 - DNA, 22 bp, Homo sapiens
cccaggtgctgaaggaggccgc

SEQ ID NO: 7820109 - DNA, 22 bp, Homo sapiens
cccaggtgctgaaggaggccgc

SEQ ID NO: 7820110 - DNA, 22 bp, Homo sapiens
cccaggtggcagaagctgcagt

SEQ ID NO: 7820111 - DNA, 22 bp, Homo sapiens
cccaggtggcagaagctgcagt

SEQ ID NO: 7820112 - DNA, 22 bp, Homo sapiens
cccaggtggcagaagctgcagt

SEQ ID NO: 7820113 - DNA, 21 bp, Homo sapiens
cccaggtgggatggttgcctc

SEQ ID NO: 7820114 - DNA, 21 bp, Homo sapiens
cccaggtgggatggttgcctc

SEQ ID NO: 7820115 - DNA, 22 bp, Homo sapiens
cccaggtgggttggcctctgtc

SEQ ID NO: 7820116 - DNA, 22 bp, Homo sapiens
cccaggtgggcacctcgaggaa

SEQ ID NO: 7820117 - DNA, 22 bp, Homo sapiens
cccaggtgggttggcctctgtc

SEQ ID NO: 7820118 - DNA, 21 bp, Homo sapiens
cccaggtgggatggttgcctc

SEQ ID NO: 7820119 - DNA, 22 bp, Homo sapiens
cccaggtgggcacctcgaggaa

SEQ ID NO: 7820120 - DNA, 22 bp, Homo sapiens
cccaggtgggcacctcgaggaa

SEQ ID NO: 7820121 - DNA, 22 bp, Homo sapiens
agggatggtggaggaatttcaa

SEQ ID NO: 7820122 - DNA, 22 bp, Homo sapiens
agggatgggtctaacccagaac

SEQ ID NO: 7820123 - DNA, 22 bp, Homo sapiens
agggatgggtctaacccagaac

SEQ ID NO: 7820124 - DNA, 22 bp, Homo sapiens
agggatggtggaggttgcaagt

SEQ ID NO: 7820125 - DNA, 22 bp, Homo sapiens
agggatggtggaggttgcaagt

SEQ ID NO: 7820126 - DNA, 22 bp, Homo sapiens
agggcactttacccatagcttg

SEQ ID NO: 7820127 - DNA, 20 bp, Homo sapiens
agggcacttttgctggagca

SEQ ID NO: 7820128 - DNA, 20 bp, Homo sapiens
agggcacttttgctggagca

SEQ ID NO: 7820129 - DNA, 20 bp, Homo sapiens
agggcacttttgctggagca

SEQ ID NO: 7820130 - DNA, 20 bp, Homo sapiens
agggcacttttgctggagca

SEQ ID NO: 7820131 - DNA, 22 bp, Homo sapiens
agggcagaaaccaccttgatgg

SEQ ID NO: 7820132 - DNA, 22 bp, Homo sapiens
agggcagaaaccaccttgatgg

SEQ ID NO: 7820133 - DNA, 22 bp, Homo sapiens
agggcagaaatattgatactgt

SEQ ID NO: 7820134 - DNA, 22 bp, Homo sapiens
cccaggtgtttgtggcagaggt

SEQ ID NO: 7820135 - DNA, 22 bp, Homo sapiens
cccagtaacttgcctaagttgc

SEQ ID NO: 7820136 - DNA, 19 bp, Homo sapiens
cccaggtgtttgaggctgc

SEQ ID NO: 7820137 - DNA, 19 bp, Homo sapiens
cccaggtgtttgaggctgc

SEQ ID NO: 7820138 - DNA, 22 bp, Homo sapiens
cccaggtgtttgtggcagaggt

SEQ ID NO: 7820139 - DNA, 19 bp, Homo sapiens
cccaggtgtttgaggctgc

SEQ ID NO: 7820140 - DNA, 23 bp, Homo sapiens
cccaggtgtggaggcggtggcag

SEQ ID NO: 7820141 - DNA, 19 bp, Homo sapiens
cccaggtgtttgaggctgc

SEQ ID NO: 7820142 - DNA, 23 bp, Homo sapiens
cccaggtgtggaggcggtggcag

SEQ ID NO: 7820143 - DNA, 20 bp, Homo sapiens
cccaggtgtctgaagctctg

SEQ ID NO: 7820144 - DNA, 20 bp, Homo sapiens
cccaggtgtctgaagctctg

SEQ ID NO: 7820145 - DNA, 21 bp, Homo sapiens
cccctgggagccctgtcagta

SEQ ID NO: 7820146 - DNA, 21 bp, Homo sapiens
cccctgggagccctgtcagta

SEQ ID NO: 7820147 - DNA, 21 bp, Homo sapiens
cccctgggagccctgtcagta

SEQ ID NO: 7820148 - DNA, 22 bp, Homo sapiens
cccctgccatagtcaaatctaa

SEQ ID NO: 7820149 - DNA, 22 bp, Homo sapiens
cccctgccatagtcaaatctaa

SEQ ID NO: 7820150 - DNA, 22 bp, Homo sapiens
cccctgccatagtcaaatctaa

SEQ ID NO: 7820151 - DNA, 22 bp, Homo sapiens
cccctgccagctatccctgaac

SEQ ID NO: 7820152 - DNA, 22 bp, Homo sapiens
cccctgccagctatccctgaac

SEQ ID NO: 7820153 - DNA, 22 bp, Homo sapiens
cccctgccatagtcaaatctaa

SEQ ID NO: 7820154 - DNA, 22 bp, Homo sapiens
cccctgcgaggacagtgggaca

SEQ ID NO: 7820155 - DNA, 22 bp, Homo sapiens
agggcagagaaatgtagttgag

SEQ ID NO: 7820156 - DNA, 22 bp, Homo sapiens
agggcagagaaatgtagttgag

SEQ ID NO: 7820157 - DNA, 22 bp, Homo sapiens
agggcagagaaatgtagttgag

SEQ ID NO: 7820158 - DNA, 22 bp, Homo sapiens
agggcagagaaatgtagttgag

SEQ ID NO: 7820159 - DNA, 22 bp, Homo sapiens
cccctgccagctatccctgaac

SEQ ID NO: 7820160 - DNA, 22 bp, Homo sapiens
cccctgccagctatccctgaac

SEQ ID NO: 7820161 - DNA, 22 bp, Homo sapiens
cccctgccagctatccctgaac

SEQ ID NO: 7820162 - DNA, 22 bp, Homo sapiens
cccctgccagctatccctgaac

SEQ ID NO: 7820163 - DNA, 22 bp, Homo sapiens
cccctgccagctatccctgaac

SEQ ID NO: 7820164 - DNA, 22 bp, Homo sapiens
cccctgagattctggcttggga

SEQ ID NO: 7820165 - DNA, 22 bp, Homo sapiens
cccctgagattctggcttggga

SEQ ID NO: 7820166 - DNA, 22 bp, Homo sapiens
cccctgagattctggcttggga

SEQ ID NO: 7820167 - DNA, 22 bp, Homo sapiens
agggcagactaggatggaagtg

SEQ ID NO: 7820168 - DNA, 22 bp, Homo sapiens
agggcagactaggatggaagtg

SEQ ID NO: 7820169 - DNA, 22 bp, Homo sapiens
agggcagactaggatggaagtg

SEQ ID NO: 7820170 - DNA, 22 bp, Homo sapiens
agggcagactaggatggaagtg

SEQ ID NO: 7820171 - DNA, 22 bp, Homo sapiens
agggcagaccacgtgcaaggat

SEQ ID NO: 7820172 - DNA, 22 bp, Homo sapiens
agggcagaccacgtgcaaggat

SEQ ID NO: 7820173 - DNA, 22 bp, Homo sapiens
agggcagactaggatggaagtg

SEQ ID NO: 7820174 - DNA, 22 bp, Homo sapiens
agggcagactaggatggaagtg

SEQ ID NO: 7820175 - DNA, 22 bp, Homo sapiens
agggcagactaggatggaagtg

SEQ ID NO: 7820176 - DNA, 22 bp, Homo sapiens
agggcagactaggatggaagtg

SEQ ID NO: 7820177 - DNA, 22 bp, Homo sapiens
agggcagactaggatggaagtg

SEQ ID NO: 7820178 - DNA, 22 bp, Homo sapiens
agggcagaccacgtgcaaggat

SEQ ID NO: 7820179 - DNA, 22 bp, Homo sapiens
agggcagaccacgtgcaaggat

SEQ ID NO: 7820180 - DNA, 22 bp, Homo sapiens
agggcagaccacgtgcaaggat

SEQ ID NO: 7820181 - DNA, 22 bp, Homo sapiens
agggcagaagtacagacactta

SEQ ID NO: 7820182 - DNA, 22 bp, Homo sapiens
agggcagaagtacagacactta

SEQ ID NO: 7820183 - DNA, 22 bp, Homo sapiens
agggcagaagtacagacactta

SEQ ID NO: 7820184 - DNA, 22 bp, Homo sapiens
agggcagaaatcgattacacct

SEQ ID NO: 7820185 - DNA, 22 bp, Homo sapiens
agggcagaaatattgatactgt

SEQ ID NO: 7820186 - DNA, 22 bp, Homo sapiens
agggcagaaatattgatactgt

SEQ ID NO: 7820187 - DNA, 22 bp, Homo sapiens
agggcagaaatattgatactgt

SEQ ID NO: 7820188 - DNA, 22 bp, Homo sapiens
agggcagaaatcgattacacct

SEQ ID NO: 7820189 - DNA, 22 bp, Homo sapiens
agggcagaagtacagacactta

SEQ ID NO: 7820190 - DNA, 22 bp, Homo sapiens
agggcagaagtacagacactta

SEQ ID NO: 7820191 - DNA, 22 bp, Homo sapiens
agggcagaagtacagacactta

SEQ ID NO: 7820192 - DNA, 22 bp, Homo sapiens
agggcagaagtacagacactta

SEQ ID NO: 7820193 - DNA, 22 bp, Homo sapiens
agggcatgtgggagaggagcct

SEQ ID NO: 7820194 - DNA, 22 bp, Homo sapiens
agggcatgtgggagaggagcct

SEQ ID NO: 7820195 - DNA, 22 bp, Homo sapiens
agggcatgtgggagaggagcct

SEQ ID NO: 7820196 - DNA, 22 bp, Homo sapiens
agggcatgtgggagaggagcct

SEQ ID NO: 7820197 - DNA, 22 bp, Homo sapiens
agggcatgtgggagaggagcct

SEQ ID NO: 7820198 - DNA, 22 bp, Homo sapiens
agggcatgtgggagaggagcct

SEQ ID NO: 7820199 - DNA, 22 bp, Homo sapiens
agggcatgtgggagaggagcct

SEQ ID NO: 7820200 - DNA, 22 bp, Homo sapiens
agggcatgtgggagaggagcct

SEQ ID NO: 7820201 - DNA, 22 bp, Homo sapiens
agggcatggggttaacctggga

SEQ ID NO: 7820202 - DNA, 22 bp, Homo sapiens
agggcatggggttaacctggga

SEQ ID NO: 7820203 - DNA, 22 bp, Homo sapiens
agggcatggggttaacctggga

SEQ ID NO: 7820204 - DNA, 22 bp, Homo sapiens
agggcagcttccatagtctggc

SEQ ID NO: 7820205 - DNA, 22 bp, Homo sapiens
agggcagctgtgagccactgtg

SEQ ID NO: 7820206 - DNA, 22 bp, Homo sapiens
agggcagctgtgagccactgtg

SEQ ID NO: 7820207 - DNA, 22 bp, Homo sapiens
cccctgggtccaggcttctctg

SEQ ID NO: 7820208 - DNA, 21 bp, Homo sapiens
cccctgggagccctgtcagta

SEQ ID NO: 7820209 - DNA, 22 bp, Homo sapiens
cccctggggatcagctggaatt

SEQ ID NO: 7820210 - DNA, 22 bp, Homo sapiens
ccccttcagagtagccacatta

SEQ ID NO: 7820211 - DNA, 22 bp, Homo sapiens
ccccttcagagtagccacatta

SEQ ID NO: 7820212 - DNA, 20 bp, Homo sapiens
ccccttcatctacagcctga

SEQ ID NO: 7820213 - DNA, 20 bp, Homo sapiens
ccccttcatctacagcctga

SEQ ID NO: 7820214 - DNA, 20 bp, Homo sapiens
ccccttcatctacagcctga

SEQ ID NO: 7820215 - DNA, 22 bp, Homo sapiens
agggccaagtccaggacctcgg

SEQ ID NO: 7820216 - DNA, 22 bp, Homo sapiens
agggccaagtccaggacctcgg

SEQ ID NO: 7820217 - DNA, 22 bp, Homo sapiens
agggcattggcacagatctgct

SEQ ID NO: 7820218 - DNA, 22 bp, Homo sapiens
agggccaaagcaagcccaactg

SEQ ID NO: 7820219 - DNA, 22 bp, Homo sapiens
agggccacagtggggcctgaga

SEQ ID NO: 7820220 - DNA, 22 bp, Homo sapiens
agggccacagtggggcctgaga

SEQ ID NO: 7820221 - DNA, 22 bp, Homo sapiens
agggccaccagagcagggcagt

SEQ ID NO: 7820222 - DNA, 22 bp, Homo sapiens
agggccaccagagcagggcagt

SEQ ID NO: 7820223 - DNA, 22 bp, Homo sapiens
agggccaccagggagtctcagg

SEQ ID NO: 7820224 - DNA, 22 bp, Homo sapiens
agggccaccagagcagggcagt

SEQ ID NO: 7820225 - DNA, 22 bp, Homo sapiens
agggccaccagggagtctcagg

SEQ ID NO: 7820226 - DNA, 22 bp, Homo sapiens
agggccacctctctgggttccc

SEQ ID NO: 7820227 - DNA, 22 bp, Homo sapiens
agggccacctctctgggttccc

SEQ ID NO: 7820228 - DNA, 23 bp, Homo sapiens
agggccactgggaaggattactg

SEQ ID NO: 7820229 - DNA, 19 bp, Homo sapiens
agggccacggggaggtatt

SEQ ID NO: 7820230 - DNA, 22 bp, Homo sapiens
ccctgaggatagggcaggaccc

SEQ ID NO: 7820231 - DNA, 22 bp, Homo sapiens
ccctgaggatagggcaggaccc

SEQ ID NO: 7820232 - DNA, 22 bp, Homo sapiens
ccctgaggatagggcaggaccc

SEQ ID NO: 7820233 - DNA, 22 bp, Homo sapiens
ccctgaggatagggcaggaccc

SEQ ID NO: 7820234 - DNA, 22 bp, Homo sapiens
ccctgaggatagggcaggaccc

SEQ ID NO: 7820235 - DNA, 22 bp, Homo sapiens
ccctgaggatagggcaggaccc

SEQ ID NO: 7820236 - DNA, 22 bp, Homo sapiens
ccctgaggatagggcaggaccc

SEQ ID NO: 7820237 - DNA, 22 bp, Homo sapiens
ccctgaggatagggcaggaccc

SEQ ID NO: 7820238 - DNA, 22 bp, Homo sapiens
ccctgaggcaaaggctagagtt

SEQ ID NO: 7820239 - DNA, 22 bp, Homo sapiens
ccctgaggcaaaggctagagtt

SEQ ID NO: 7820240 - DNA, 22 bp, Homo sapiens
ccctgaggcacaggccacgtat

SEQ ID NO: 7820241 - DNA, 22 bp, Homo sapiens
ccctgaggcacaggccacgtat

SEQ ID NO: 7820242 - DNA, 22 bp, Homo sapiens
ccctgaggcaaaggctagagtt

SEQ ID NO: 7820243 - DNA, 22 bp, Homo sapiens
ccctgaggcaaaggctagagtt

SEQ ID NO: 7820244 - DNA, 18 bp, Homo sapiens
ccctgaggctagcatgct

SEQ ID NO: 7820245 - DNA, 22 bp, Homo sapiens
ccctgaggccctcctggggtct

SEQ ID NO: 7820246 - DNA, 22 bp, Homo sapiens
ccctgaggccctcctggggtct

SEQ ID NO: 7820247 - DNA, 22 bp, Homo sapiens
ccctgaggccctcctggggtct

SEQ ID NO: 7820248 - DNA, 22 bp, Homo sapiens
ccctgaggccctcctggggtct

SEQ ID NO: 7820249 - DNA, 22 bp, Homo sapiens
ccctgaggcagtaggagctttt

SEQ ID NO: 7820250 - DNA, 22 bp, Homo sapiens
ccctgaggcagtaggagctttt

SEQ ID NO: 7820251 - DNA, 22 bp, Homo sapiens
ccctgaggcagtaggagctttt

SEQ ID NO: 7820252 - DNA, 22 bp, Homo sapiens
ccctgaggggagtggtgaggtg

SEQ ID NO: 7820253 - DNA, 18 bp, Homo sapiens
ccctgaggctagcatgct

SEQ ID NO: 7820254 - DNA, 22 bp, Homo sapiens
ccctgaggctgaggataggtgg

SEQ ID NO: 7820255 - DNA, 22 bp, Homo sapiens
ccctgaggggagtggtgaggtg

SEQ ID NO: 7820256 - DNA, 22 bp, Homo sapiens
ccctgaggctgaggataggtgg

SEQ ID NO: 7820257 - DNA, 18 bp, Homo sapiens
ccctgaggctagcatgct

SEQ ID NO: 7820258 - DNA, 22 bp, Homo sapiens
ccctgaggctgaggataggtgg

SEQ ID NO: 7820259 - DNA, 22 bp, Homo sapiens
ccctgaggggcttactttgccc

SEQ ID NO: 7820260 - DNA, 22 bp, Homo sapiens
ccctgagtcatcattgcggaag

SEQ ID NO: 7820261 - DNA, 22 bp, Homo sapiens
ccctgatggcacagtggcaggc

SEQ ID NO: 7820262 - DNA, 23 bp, Homo sapiens
agggccaggtgcggaaacagctc

SEQ ID NO: 7820263 - DNA, 23 bp, Homo sapiens
agggccaggtgcggaaacagctc

SEQ ID NO: 7820264 - DNA, 23 bp, Homo sapiens
agggccaggtgcggaaacagctc

SEQ ID NO: 7820265 - DNA, 23 bp, Homo sapiens
agggcccaagcctggacagcagg

SEQ ID NO: 7820266 - DNA, 22 bp, Homo sapiens
agggcccacagttcctatggcc

SEQ ID NO: 7820267 - DNA, 23 bp, Homo sapiens
agggcccaagcctggacagcagg

SEQ ID NO: 7820268 - DNA, 20 bp, Homo sapiens
agggcccaggaagagagtta

SEQ ID NO: 7820269 - DNA, 22 bp, Homo sapiens
agggcccaggacagcatcaggg

SEQ ID NO: 7820270 - DNA, 22 bp, Homo sapiens
agggcccaggacagcatcaggg

SEQ ID NO: 7820271 - DNA, 22 bp, Homo sapiens
agggcccagcccttgctggtct

SEQ ID NO: 7820272 - DNA, 22 bp, Homo sapiens
agggcccaccttggtgctgagg

SEQ ID NO: 7820273 - DNA, 22 bp, Homo sapiens
agggcctgtctgtagaactgaa

SEQ ID NO: 7820274 - DNA, 22 bp, Homo sapiens
agggcctgtctgtagaactgaa

SEQ ID NO: 7820275 - DNA, 22 bp, Homo sapiens
agggcctgtccgctcccgcccg

SEQ ID NO: 7820276 - DNA, 22 bp, Homo sapiens
agggcctgtctgtagaactgaa

SEQ ID NO: 7820277 - DNA, 22 bp, Homo sapiens
agggcctgtccgctcccgcccg

SEQ ID NO: 7820278 - DNA, 22 bp, Homo sapiens
agggcctgtcagcggtgtcctg

SEQ ID NO: 7820279 - DNA, 22 bp, Homo sapiens
agggcctggcttcactttctca

SEQ ID NO: 7820280 - DNA, 21 bp, Homo sapiens
agggcctgtgctctccaggtc

SEQ ID NO: 7820281 - DNA, 21 bp, Homo sapiens
agggcctgtgctctccaggtc

SEQ ID NO: 7820282 - DNA, 21 bp, Homo sapiens
agggcctgtgctctccaggtc

SEQ ID NO: 7820283 - DNA, 22 bp, Homo sapiens
agggcctgtgctgagtagacga

SEQ ID NO: 7820284 - DNA, 22 bp, Homo sapiens
agggcctgtctgtagaactgaa

SEQ ID NO: 7820285 - DNA, 22 bp, Homo sapiens
agggcctgtgaattctccctgc

SEQ ID NO: 7820286 - DNA, 22 bp, Homo sapiens
agggcctgtgaattctccctgc

SEQ ID NO: 7820287 - DNA, 22 bp, Homo sapiens
agggcctgtgaattctccctgc

SEQ ID NO: 7820288 - DNA, 22 bp, Homo sapiens
agggcctgtgaattctccctgc

SEQ ID NO: 7820289 - DNA, 22 bp, Homo sapiens
agggcctgtgaattctccctgc

SEQ ID NO: 7820290 - DNA, 21 bp, Homo sapiens
agggcctgtgctctccaggtc

SEQ ID NO: 7820291 - DNA, 22 bp, Homo sapiens
agggcctgtgcttcctgagata

SEQ ID NO: 7820292 - DNA, 22 bp, Homo sapiens
agggcctgtgctgagtagacga

SEQ ID NO: 7820293 - DNA, 22 bp, Homo sapiens
agggcctgtgctgagtagacga

SEQ ID NO: 7820294 - DNA, 21 bp, Homo sapiens
agggcctgtgctctccaggtc

SEQ ID NO: 7820295 - DNA, 22 bp, Homo sapiens
agggcctgtgctgagtagacga

SEQ ID NO: 7820296 - DNA, 22 bp, Homo sapiens
agggcctgtgctgagtagacga

SEQ ID NO: 7820297 - DNA, 22 bp, Homo sapiens
agggcctgtgcttcctgagata

SEQ ID NO: 7820298 - DNA, 20 bp, Homo sapiens
agggcctgttgcaagcgttt

SEQ ID NO: 7820299 - DNA, 22 bp, Homo sapiens
agggcctgtgcttcctgagata

SEQ ID NO: 7820300 - DNA, 20 bp, Homo sapiens
agggcctgttgcaagcgttt

SEQ ID NO: 7820301 - DNA, 20 bp, Homo sapiens
agggcctgttgcaagcgttt

SEQ ID NO: 7820302 - DNA, 22 bp, Homo sapiens
cctaattatctcccaaagatcc

SEQ ID NO: 7820303 - DNA, 22 bp, Homo sapiens
cctaagtattttcagtgttaac

SEQ ID NO: 7820304 - DNA, 22 bp, Homo sapiens
cctacagacaaaccagtgacta

SEQ ID NO: 7820305 - DNA, 21 bp, Homo sapiens
cctacagatggatatatattc

SEQ ID NO: 7820306 - DNA, 22 bp, Homo sapiens
cctacaggaaattgtatcaaaa

SEQ ID NO: 7820307 - DNA, 22 bp, Homo sapiens
cctacagttatattcttgattg

SEQ ID NO: 7820308 - DNA, 22 bp, Homo sapiens
cctacagttatattcttgattg

SEQ ID NO: 7820309 - DNA, 22 bp, Homo sapiens
cctacagttatattcttgattg

SEQ ID NO: 7820310 - DNA, 22 bp, Homo sapiens
cctacagttatattcttgattg

SEQ ID NO: 7820311 - DNA, 22 bp, Homo sapiens
ccctggcagagggggcaggtgc

SEQ ID NO: 7820312 - DNA, 22 bp, Homo sapiens
ccctggcagaatgtctctgggc

SEQ ID NO: 7820313 - DNA, 22 bp, Homo sapiens
ccctggcagagggggcaggtgc

SEQ ID NO: 7820314 - DNA, 19 bp, Homo sapiens
ccctggcaggcaagcctgg

SEQ ID NO: 7820315 - DNA, 19 bp, Homo sapiens
ccctggcaggcaagcctgg

SEQ ID NO: 7820316 - DNA, 22 bp, Homo sapiens
ccctggcagcaatcactggtgt

SEQ ID NO: 7820317 - DNA, 19 bp, Homo sapiens
ccctggcaggcaagcctgg

SEQ ID NO: 7820318 - DNA, 22 bp, Homo sapiens
ccctggccagggcacagggagg

SEQ ID NO: 7820319 - DNA, 22 bp, Homo sapiens
agggcctggcttcactttctca

SEQ ID NO: 7820320 - DNA, 22 bp, Homo sapiens
agggcctggcttcactttctca

SEQ ID NO: 7820321 - DNA, 22 bp, Homo sapiens
ccctggccagggcacagggagg

SEQ ID NO: 7820322 - DNA, 22 bp, Homo sapiens
ccctggccagggcacagggagg

SEQ ID NO: 7820323 - DNA, 22 bp, Homo sapiens
ccctggccagctcatgtctgag

SEQ ID NO: 7820324 - DNA, 22 bp, Homo sapiens
ccctggcataaaacttctccag

SEQ ID NO: 7820325 - DNA, 22 bp, Homo sapiens
ccctggcatgcatgtccctggc

SEQ ID NO: 7820326 - DNA, 22 bp, Homo sapiens
ccctggccagctcatgtctgag

SEQ ID NO: 7820327 - DNA, 22 bp, Homo sapiens
ccctggccagctcatgtctgag

SEQ ID NO: 7820328 - DNA, 22 bp, Homo sapiens
ccctggccagctcatgtctgag

SEQ ID NO: 7820329 - DNA, 22 bp, Homo sapiens
ccctggccagctcatgtctgag

SEQ ID NO: 7820330 - DNA, 22 bp, Homo sapiens
agggcccatgtgggagcacttg

SEQ ID NO: 7820331 - DNA, 22 bp, Homo sapiens
agggccccagtaagattacatg

SEQ ID NO: 7820332 - DNA, 22 bp, Homo sapiens
agggccccatagtcactgcccg

SEQ ID NO: 7820333 - DNA, 22 bp, Homo sapiens
agggccccatagtcactgcccg

SEQ ID NO: 7820334 - DNA, 22 bp, Homo sapiens
agggcccatgtgggagcacttg

SEQ ID NO: 7820335 - DNA, 22 bp, Homo sapiens
agggcccatgtgggagcacttg

SEQ ID NO: 7820336 - DNA, 22 bp, Homo sapiens
ccctggcactagcgacggccat

SEQ ID NO: 7820337 - DNA, 22 bp, Homo sapiens
ccctggcactagcgacggccat

SEQ ID NO: 7820338 - DNA, 22 bp, Homo sapiens
ccctggcactagcgacggccat

SEQ ID NO: 7820339 - DNA, 22 bp, Homo sapiens
ccctggcacatgcgctgtgtgg

SEQ ID NO: 7820340 - DNA, 22 bp, Homo sapiens
ccctggcacatgcgctgtgtgg

SEQ ID NO: 7820341 - DNA, 22 bp, Homo sapiens
ccctggcacatgcgctgtgtgg

SEQ ID NO: 7820342 - DNA, 22 bp, Homo sapiens
agggcccatgtgggagcacttg

SEQ ID NO: 7820343 - DNA, 22 bp, Homo sapiens
agggcccatagatcgtcagctt

SEQ ID NO: 7820344 - DNA, 22 bp, Homo sapiens
agggcccagtggagagctgagc

SEQ ID NO: 7820345 - DNA, 22 bp, Homo sapiens
agggcccagtggagagctgagc

SEQ ID NO: 7820346 - DNA, 22 bp, Homo sapiens
agggcccagtggagagctgagc

SEQ ID NO: 7820347 - DNA, 22 bp, Homo sapiens
agggctgagaatgacagggccg

SEQ ID NO: 7820348 - DNA, 22 bp, Homo sapiens
agggctgagaatgacagggccg

SEQ ID NO: 7820349 - DNA, 22 bp, Homo sapiens
agggctgagactaaggccagat

SEQ ID NO: 7820350 - DNA, 22 bp, Homo sapiens
agggctgagactaaggccagat

SEQ ID NO: 7820351 - DNA, 22 bp, Homo sapiens
agggctgagactaaggccagat

SEQ ID NO: 7820352 - DNA, 22 bp, Homo sapiens
agggctgagactaaggccagat

SEQ ID NO: 7820353 - DNA, 20 bp, Homo sapiens
agggctgagaagggactagc

SEQ ID NO: 7820354 - DNA, 20 bp, Homo sapiens
agggctgagaagggactagc

SEQ ID NO: 7820355 - DNA, 22 bp, Homo sapiens
agggctgacctaagctccactt

SEQ ID NO: 7820356 - DNA, 22 bp, Homo sapiens
agggctgagaatgacagggccg

SEQ ID NO: 7820357 - DNA, 20 bp, Homo sapiens
agggctgagaagggactagc

SEQ ID NO: 7820358 - DNA, 20 bp, Homo sapiens
agggctgagaagggactagc

SEQ ID NO: 7820359 - DNA, 22 bp, Homo sapiens
agggctgagcccaggcatgtag

SEQ ID NO: 7820360 - DNA, 22 bp, Homo sapiens
agggctgagcccaggcatgtag

SEQ ID NO: 7820361 - DNA, 22 bp, Homo sapiens
agggctgagcccaggcatgtag

SEQ ID NO: 7820362 - DNA, 22 bp, Homo sapiens
agggctgagcccaggcatgtag

SEQ ID NO: 7820363 - DNA, 22 bp, Homo sapiens
agggctgagcccaggcatgtag

SEQ ID NO: 7820364 - DNA, 22 bp, Homo sapiens
agggctgagcccaggcatgtag

SEQ ID NO: 7820365 - DNA, 22 bp, Homo sapiens
agggctgagactaaggccagat

SEQ ID NO: 7820366 - DNA, 22 bp, Homo sapiens
agggctgaggcgagggagatgc

SEQ ID NO: 7820367 - DNA, 22 bp, Homo sapiens
agggctgaggcgagggagatgc

SEQ ID NO: 7820368 - DNA, 22 bp, Homo sapiens
agggctgaggcgagggagatgc

SEQ ID NO: 7820369 - DNA, 22 bp, Homo sapiens
cctcagggaggcctctgtggct

SEQ ID NO: 7820370 - DNA, 18 bp, Homo sapiens
cctcagggagatccagtg

SEQ ID NO: 7820371 - DNA, 18 bp, Homo sapiens
cctcagggagatccagtg

SEQ ID NO: 7820372 - DNA, 22 bp, Homo sapiens
agggctgacagtggcgtggcgt

SEQ ID NO: 7820373 - DNA, 22 bp, Homo sapiens
agggctgacagtggcgtggcgt

SEQ ID NO: 7820374 - DNA, 22 bp, Homo sapiens
agggctgacctaagctccactt

SEQ ID NO: 7820375 - DNA, 22 bp, Homo sapiens
agggctgacagtggcgtggcgt

SEQ ID NO: 7820376 - DNA, 22 bp, Homo sapiens
agggctgacagtggcgtggcgt

SEQ ID NO: 7820377 - DNA, 22 bp, Homo sapiens
agggctgacagtggcgtggcgt

SEQ ID NO: 7820378 - DNA, 22 bp, Homo sapiens
agggctgacagtggcgtggcgt

SEQ ID NO: 7820379 - DNA, 22 bp, Homo sapiens
agggctctttaggccgaggcca

SEQ ID NO: 7820380 - DNA, 22 bp, Homo sapiens
agggctctttaggccgaggcca

SEQ ID NO: 7820381 - DNA, 22 bp, Homo sapiens
agggctcttcctttgcctctca

SEQ ID NO: 7820382 - DNA, 22 bp, Homo sapiens
agggctcttcctttgcctctca

SEQ ID NO: 7820383 - DNA, 22 bp, Homo sapiens
cctagaacacaacctatattag

SEQ ID NO: 7820384 - DNA, 22 bp, Homo sapiens
cctagaacacaacctatattag

SEQ ID NO: 7820385 - DNA, 22 bp, Homo sapiens
cctactctgagcgcctccgcat

SEQ ID NO: 7820386 - DNA, 22 bp, Homo sapiens
cctactctgagcgcctccgcat

SEQ ID NO: 7820387 - DNA, 22 bp, Homo sapiens
cctactgcccttcagtccagca

SEQ ID NO: 7820388 - DNA, 19 bp, Homo sapiens
cctacatgagtaagcttgg

SEQ ID NO: 7820389 - DNA, 22 bp, Homo sapiens
cctacagttatattcttgattg

SEQ ID NO: 7820390 - DNA, 22 bp, Homo sapiens
cctacagttatattcttgattg

SEQ ID NO: 7820391 - DNA, 22 bp, Homo sapiens
cctacagttatattcttgattg

SEQ ID NO: 7820392 - DNA, 22 bp, Homo sapiens
cctaccagtaggaggccagaga

SEQ ID NO: 7820393 - DNA, 22 bp, Homo sapiens
cctaccagtaggaggccagaga

SEQ ID NO: 7820394 - DNA, 22 bp, Homo sapiens
cctacctggggcaggcctcggg

SEQ ID NO: 7820395 - DNA, 22 bp, Homo sapiens
cctactctgagcgcctccgcat

SEQ ID NO: 7820396 - DNA, 22 bp, Homo sapiens
cctactctgagcgcctccgcat

SEQ ID NO: 7820397 - DNA, 22 bp, Homo sapiens
cctactctgagcgcctccgcat

SEQ ID NO: 7820398 - DNA, 22 bp, Homo sapiens
agggctttgcaatgcacagtgg

SEQ ID NO: 7820399 - DNA, 22 bp, Homo sapiens
aggggaaaagtgttgtctctag

SEQ ID NO: 7820400 - DNA, 22 bp, Homo sapiens
aggggaaaatgagttagtgtgt

SEQ ID NO: 7820401 - DNA, 22 bp, Homo sapiens
agggctgggctgcttgttgtca

SEQ ID NO: 7820402 - DNA, 22 bp, Homo sapiens
agggctggtatgtccatgaaag

SEQ ID NO: 7820403 - DNA, 22 bp, Homo sapiens
agggctgggctgcttgttgtca

SEQ ID NO: 7820404 - DNA, 22 bp, Homo sapiens
agggctgggctgcttgttgtca

SEQ ID NO: 7820405 - DNA, 21 bp, Homo sapiens
cctcagtctccctgctccact

SEQ ID NO: 7820406 - DNA, 22 bp, Homo sapiens
cctcaggtgtgggccagctgtc

SEQ ID NO: 7820407 - DNA, 22 bp, Homo sapiens
cctcagggttcggatgagaaca

SEQ ID NO: 7820408 - DNA, 22 bp, Homo sapiens
cctcagtcattggcctacactt

SEQ ID NO: 7820409 - DNA, 22 bp, Homo sapiens
cctcagtctatttccagcaggt

SEQ ID NO: 7820410 - DNA, 22 bp, Homo sapiens
cctcagtctatttccagcaggt

SEQ ID NO: 7820411 - DNA, 22 bp, Homo sapiens
agggctgggctgcttgttgtca

SEQ ID NO: 7820412 - DNA, 22 bp, Homo sapiens
cctcagtcattggcctacactt

SEQ ID NO: 7820413 - DNA, 23 bp, Homo sapiens
cctcaggggacctgtgagcctga

SEQ ID NO: 7820414 - DNA, 22 bp, Homo sapiens
cctcaggggtcactgtgaggag

SEQ ID NO: 7820415 - DNA, 22 bp, Homo sapiens
cctcaggggcttttcgttgttg

SEQ ID NO: 7820416 - DNA, 23 bp, Homo sapiens
cctcaggggacctgtgagcctga

SEQ ID NO: 7820417 - DNA, 22 bp, Homo sapiens
cctcaggggtcactgtgaggag

SEQ ID NO: 7820418 - DNA, 22 bp, Homo sapiens
cctcaggggtgcccacagctgc

SEQ ID NO: 7820419 - DNA, 18 bp, Homo sapiens
cctcaggggacctggcag

SEQ ID NO: 7820420 - DNA, 18 bp, Homo sapiens
cctcaggggacctggcag

SEQ ID NO: 7820421 - DNA, 18 bp, Homo sapiens
cctcaggggacctggcag

SEQ ID NO: 7820422 - DNA, 18 bp, Homo sapiens
cctcaggggacctggcag

SEQ ID NO: 7820423 - DNA, 22 bp, Homo sapiens
cctcagggtctctcacagcacc

SEQ ID NO: 7820424 - DNA, 22 bp, Homo sapiens
cctcagggtcatcctagtaata

SEQ ID NO: 7820425 - DNA, 23 bp, Homo sapiens
cctcagggtctagcagagagaag

SEQ ID NO: 7820426 - DNA, 22 bp, Homo sapiens
cctcagggtctgaggagaccgt

SEQ ID NO: 7820427 - DNA, 22 bp, Homo sapiens
cctcagggtctgaggagaccgt

SEQ ID NO: 7820428 - DNA, 22 bp, Homo sapiens
cctcagggtggcatcagatctt

SEQ ID NO: 7820429 - DNA, 22 bp, Homo sapiens
cctcagggtctgaggagaccgt

SEQ ID NO: 7820430 - DNA, 18 bp, Homo sapiens
aggggcagcttgtgtgga

SEQ ID NO: 7820431 - DNA, 18 bp, Homo sapiens
aggggcagcttgtgtgga

SEQ ID NO: 7820432 - DNA, 18 bp, Homo sapiens
aggggcagcttgtgtgga

SEQ ID NO: 7820433 - DNA, 18 bp, Homo sapiens
aggggcagcttgtgtgga

SEQ ID NO: 7820434 - DNA, 18 bp, Homo sapiens
aggggcagcttgtgtgga

SEQ ID NO: 7820435 - DNA, 22 bp, Homo sapiens
aggggcctggttggcctctgtt

SEQ ID NO: 7820436 - DNA, 22 bp, Homo sapiens
aggggcctggttggcctctgtt

SEQ ID NO: 7820437 - DNA, 22 bp, Homo sapiens
aggggcctggttggcctctgtt

SEQ ID NO: 7820438 - DNA, 22 bp, Homo sapiens
aggggcgctgcggtcctcagcc

SEQ ID NO: 7820439 - DNA, 22 bp, Homo sapiens
aggggcctggttggcctctgtt

SEQ ID NO: 7820440 - DNA, 22 bp, Homo sapiens
aggggcggcctgcctgaagcag

SEQ ID NO: 7820441 - DNA, 22 bp, Homo sapiens
aggggcctggttggcctctgtt

SEQ ID NO: 7820442 - DNA, 22 bp, Homo sapiens
aggggcgggacatgcactgagc

SEQ ID NO: 7820443 - DNA, 22 bp, Homo sapiens
aggggcgtctgtaggcagtggg

SEQ ID NO: 7820444 - DNA, 22 bp, Homo sapiens
aggggctcaaagtgtgcaggga

SEQ ID NO: 7820445 - DNA, 22 bp, Homo sapiens
aggggctcaaagtgtgcaggga

SEQ ID NO: 7820446 - DNA, 22 bp, Homo sapiens
aggggctcaaagtgtgcaggga

SEQ ID NO: 7820447 - DNA, 22 bp, Homo sapiens
aggggctcaaagtgtgcaggga

SEQ ID NO: 7820448 - DNA, 22 bp, Homo sapiens
aggggcgtctgtaggcagtggg

SEQ ID NO: 7820449 - DNA, 22 bp, Homo sapiens
aggggcgtgctcttccccgacg

SEQ ID NO: 7820450 - DNA, 22 bp, Homo sapiens
aggggctcagttactttggcag

SEQ ID NO: 7820451 - DNA, 22 bp, Homo sapiens
aggggctcaagcagtgtggtct

SEQ ID NO: 7820452 - DNA, 22 bp, Homo sapiens
aggggctcagttactttggcag

SEQ ID NO: 7820453 - DNA, 22 bp, Homo sapiens
aggggctcagttactttggcag

SEQ ID NO: 7820454 - DNA, 22 bp, Homo sapiens
aggggctcagttactttggcag

SEQ ID NO: 7820455 - DNA, 22 bp, Homo sapiens
aggggctctgagtgggccagga

SEQ ID NO: 7820456 - DNA, 22 bp, Homo sapiens
aggggctctgagtgggccagga

SEQ ID NO: 7820457 - DNA, 22 bp, Homo sapiens
aggggctctgagtgggccagga

SEQ ID NO: 7820458 - DNA, 22 bp, Homo sapiens
aggggctctgagtgggccagga

SEQ ID NO: 7820459 - DNA, 22 bp, Homo sapiens
aggggctgactggaaagtgcca

SEQ ID NO: 7820460 - DNA, 22 bp, Homo sapiens
aggggctgactggaaagtgcca

SEQ ID NO: 7820461 - DNA, 22 bp, Homo sapiens
cctctgtgggccgggcctgctg

SEQ ID NO: 7820462 - DNA, 22 bp, Homo sapiens
cctctgtgggccgggcctgctg

SEQ ID NO: 7820463 - DNA, 22 bp, Homo sapiens
aggggctgcctggcttggcact

SEQ ID NO: 7820464 - DNA, 22 bp, Homo sapiens
aggggctgcctggcttggcact

SEQ ID NO: 7820465 - DNA, 22 bp, Homo sapiens
aggggctgcctggcttggcact

SEQ ID NO: 7820466 - DNA, 22 bp, Homo sapiens
aggggctgcctggcttggcact

SEQ ID NO: 7820467 - DNA, 22 bp, Homo sapiens
aggggctgcctggcttggcact

SEQ ID NO: 7820468 - DNA, 22 bp, Homo sapiens
aggggctcctttgtgctgcgtc

SEQ ID NO: 7820469 - DNA, 22 bp, Homo sapiens
aggggctcctttgtgctgcgtc

SEQ ID NO: 7820470 - DNA, 22 bp, Homo sapiens
aggggctcctttgtgctgcgtc

SEQ ID NO: 7820471 - DNA, 22 bp, Homo sapiens
aggggctctaaagatcatggaa

SEQ ID NO: 7820472 - DNA, 22 bp, Homo sapiens
aggggctctaaagatcatggaa

SEQ ID NO: 7820473 - DNA, 22 bp, Homo sapiens
aggggctctaaagatcatggaa

SEQ ID NO: 7820474 - DNA, 22 bp, Homo sapiens
aggggctcctctctgagagtag

SEQ ID NO: 7820475 - DNA, 22 bp, Homo sapiens
aggggctcctctctgagagtag

SEQ ID NO: 7820476 - DNA, 22 bp, Homo sapiens
aggggctcctggcctggagagc

SEQ ID NO: 7820477 - DNA, 22 bp, Homo sapiens
aggggctcctggcctggagagc

SEQ ID NO: 7820478 - DNA, 22 bp, Homo sapiens
aggggctcctggcctggagagc

SEQ ID NO: 7820479 - DNA, 22 bp, Homo sapiens
aggggctcctggcctggagagc

SEQ ID NO: 7820480 - DNA, 22 bp, Homo sapiens
aggggctcctggcctggagagc

SEQ ID NO: 7820481 - DNA, 22 bp, Homo sapiens
cctcctggtccagcatctcttt

SEQ ID NO: 7820482 - DNA, 22 bp, Homo sapiens
cctcctggtgacaaggcaaagc

SEQ ID NO: 7820483 - DNA, 22 bp, Homo sapiens
cctcctggtgacaaggcaaagc

SEQ ID NO: 7820484 - DNA, 22 bp, Homo sapiens
aggggaatgggtagactgttga

SEQ ID NO: 7820485 - DNA, 22 bp, Homo sapiens
aggggaatgggtagactgttga

SEQ ID NO: 7820486 - DNA, 22 bp, Homo sapiens
aggggaatgggtagactgttga

SEQ ID NO: 7820487 - DNA, 21 bp, Homo sapiens
aggggaagtagagttttgatt

SEQ ID NO: 7820488 - DNA, 21 bp, Homo sapiens
aggggaagtagagttttgatt

SEQ ID NO: 7820489 - DNA, 22 bp, Homo sapiens
aggggaaatgccttggtggtac

SEQ ID NO: 7820490 - DNA, 22 bp, Homo sapiens
aggggaaagaacagtcttcagg

SEQ ID NO: 7820491 - DNA, 22 bp, Homo sapiens
aggggaagagccctttacatgg

SEQ ID NO: 7820492 - DNA, 22 bp, Homo sapiens
aggggaaggccagcctgtagag

SEQ ID NO: 7820493 - DNA, 22 bp, Homo sapiens
aggggaaggccagcctgtagag

SEQ ID NO: 7820494 - DNA, 22 bp, Homo sapiens
aggggaaggccagcctgtagag

SEQ ID NO: 7820495 - DNA, 22 bp, Homo sapiens
aggggaaggccagcctgtagag

SEQ ID NO: 7820496 - DNA, 22 bp, Homo sapiens
aggggaaggccagcctgtagag

SEQ ID NO: 7820497 - DNA, 22 bp, Homo sapiens
aggggaagattatacttttgaa

SEQ ID NO: 7820498 - DNA, 22 bp, Homo sapiens
aggggaaggccagcctgtagag

SEQ ID NO: 7820499 - DNA, 22 bp, Homo sapiens
cctcctggttgcaatgaaatgg

SEQ ID NO: 7820500 - DNA, 22 bp, Homo sapiens
cctcctggtgggcgcttctggc

SEQ ID NO: 7820501 - DNA, 19 bp, Homo sapiens
cctcctgtggcgggtgggg

SEQ ID NO: 7820502 - DNA, 22 bp, Homo sapiens
cctcctgtctccttcctatatt

SEQ ID NO: 7820503 - DNA, 22 bp, Homo sapiens
cctcctgttgtcctgctggggc

SEQ ID NO: 7820504 - DNA, 22 bp, Homo sapiens
cctcctgttgtcaccaggcgtg

SEQ ID NO: 7820505 - DNA, 22 bp, Homo sapiens
cctcctggtgggcgcttctggc

SEQ ID NO: 7820506 - DNA, 22 bp, Homo sapiens
cctcctggtgggcgcttctggc

SEQ ID NO: 7820507 - DNA, 22 bp, Homo sapiens
cctcctggtgggcgcttctggc

SEQ ID NO: 7820508 - DNA, 22 bp, Homo sapiens
cctcctggtgggcgcttctggc

SEQ ID NO: 7820509 - DNA, 22 bp, Homo sapiens
cctcctggtgggcgcttctggc

SEQ ID NO: 7820510 - DNA, 22 bp, Homo sapiens
cctcctggtgggcgcttctggc

SEQ ID NO: 7820511 - DNA, 22 bp, Homo sapiens
cctcctggtgggcgcttctggc

SEQ ID NO: 7820512 - DNA, 22 bp, Homo sapiens
cctcgacctccccaggctcagg

SEQ ID NO: 7820513 - DNA, 22 bp, Homo sapiens
cctccttcctgggacagagctg

SEQ ID NO: 7820514 - DNA, 22 bp, Homo sapiens
cctcctgttgtcctgctggggc

SEQ ID NO: 7820515 - DNA, 22 bp, Homo sapiens
cctccttcctgggacagagctg

SEQ ID NO: 7820516 - DNA, 22 bp, Homo sapiens
cctccttcctgggacagagctg

SEQ ID NO: 7820517 - DNA, 22 bp, Homo sapiens
cctccttctggggccttctgct

SEQ ID NO: 7820518 - DNA, 22 bp, Homo sapiens
cctccttctggggccttctgct

SEQ ID NO: 7820519 - DNA, 22 bp, Homo sapiens
cctcttaattgtactccttcag

SEQ ID NO: 7820520 - DNA, 22 bp, Homo sapiens
cctctgtgtgtgcatgcatgcg

SEQ ID NO: 7820521 - DNA, 22 bp, Homo sapiens
cctctgtgtgtgcatgcatgcg

SEQ ID NO: 7820522 - DNA, 22 bp, Homo sapiens
cctctgtgtgtgcatgcatgcg

SEQ ID NO: 7820523 - DNA, 22 bp, Homo sapiens
cctctgtgtgatgcgcaaagta

SEQ ID NO: 7820524 - DNA, 22 bp, Homo sapiens
cctctgtgtgatgcgcaaagta

SEQ ID NO: 7820525 - DNA, 22 bp, Homo sapiens
cctctgtgtcttggtttcaaga

SEQ ID NO: 7820526 - DNA, 22 bp, Homo sapiens
cctctgtgtctccaagaggcct

SEQ ID NO: 7820527 - DNA, 22 bp, Homo sapiens
cctctgtgtctccaagaggcct

SEQ ID NO: 7820528 - DNA, 22 bp, Homo sapiens
cctctgtgtctccaagaggcct

SEQ ID NO: 7820529 - DNA, 20 bp, Homo sapiens
cctctgtgtcctgtgtcata

SEQ ID NO: 7820530 - DNA, 20 bp, Homo sapiens
cctctgtgtcctgtgtcata

SEQ ID NO: 7820531 - DNA, 20 bp, Homo sapiens
cctctgtgtcctgtgtcata

SEQ ID NO: 7820532 - DNA, 20 bp, Homo sapiens
cctctgtgtcctgtgtcata

SEQ ID NO: 7820533 - DNA, 22 bp, Homo sapiens
cctctgtgtcctggtcattgaa

SEQ ID NO: 7820534 - DNA, 22 bp, Homo sapiens
cctctgtgtcctggtcattgaa

SEQ ID NO: 7820535 - DNA, 22 bp, Homo sapiens
cctctgtgtcagggaagagact

SEQ ID NO: 7820536 - DNA, 22 bp, Homo sapiens
cctctgtgtcctggtcattgaa

SEQ ID NO: 7820537 - DNA, 22 bp, Homo sapiens
cctctgtgtcagggaagagact

SEQ ID NO: 7820538 - DNA, 22 bp, Homo sapiens
cctctgtgtcagggaagagact

SEQ ID NO: 7820539 - DNA, 22 bp, Homo sapiens
cctctgtgggccgggcctgctg

SEQ ID NO: 7820540 - DNA, 22 bp, Homo sapiens
cctctgtggtctgtctaatgca

SEQ ID NO: 7820541 - DNA, 22 bp, Homo sapiens
cctctgtggtctgtctaatgca

SEQ ID NO: 7820542 - DNA, 22 bp, Homo sapiens
agggggagacatgtgtgtgttt

SEQ ID NO: 7820543 - DNA, 22 bp, Homo sapiens
cctcttcacctcgggcacactg

SEQ ID NO: 7820544 - DNA, 22 bp, Homo sapiens
cctcttcagcaaagttcggccc

SEQ ID NO: 7820545 - DNA, 22 bp, Homo sapiens
cctcttcacctcgggcacactg

SEQ ID NO: 7820546 - DNA, 22 bp, Homo sapiens
agggggagcttggctactcctg

SEQ ID NO: 7820547 - DNA, 22 bp, Homo sapiens
agggggagcttggctactcctg

SEQ ID NO: 7820548 - DNA, 22 bp, Homo sapiens
agggggagcttggctactcctg

SEQ ID NO: 7820549 - DNA, 22 bp, Homo sapiens
agggggctgccaaggaatgtaa

SEQ ID NO: 7820550 - DNA, 22 bp, Homo sapiens
agggggctgccaaggaatgtaa

SEQ ID NO: 7820551 - DNA, 22 bp, Homo sapiens
agggggtgaatgtctgtctaca

SEQ ID NO: 7820552 - DNA, 22 bp, Homo sapiens
agggggtgaatgtctgtctaca

SEQ ID NO: 7820553 - DNA, 22 bp, Homo sapiens
agggggtgaatgtctgtctaca

SEQ ID NO: 7820554 - DNA, 22 bp, Homo sapiens
agggggtgaatgtctgtctaca

SEQ ID NO: 7820555 - DNA, 22 bp, Homo sapiens
agggggtgaatgtctgtctaca

SEQ ID NO: 7820556 - DNA, 22 bp, Homo sapiens
agggggtgatcaaggtgcggcg

SEQ ID NO: 7820557 - DNA, 22 bp, Homo sapiens
aggggggtggatcacctgaggt

SEQ ID NO: 7820558 - DNA, 22 bp, Homo sapiens
agggggctggagacacctcctc

SEQ ID NO: 7820559 - DNA, 22 bp, Homo sapiens
agggggtcgtccggaagacctg

SEQ ID NO: 7820560 - DNA, 22 bp, Homo sapiens
agggggtcgtccggaagacctg

SEQ ID NO: 7820561 - DNA, 22 bp, Homo sapiens
agggggtcgtccggaagacctg

SEQ ID NO: 7820562 - DNA, 22 bp, Homo sapiens
agggggtctcctatcatggaag

SEQ ID NO: 7820563 - DNA, 22 bp, Homo sapiens
agggggtctcctatcatggaag

SEQ ID NO: 7820564 - DNA, 22 bp, Homo sapiens
agggggtgtctctgattgggtt

SEQ ID NO: 7820565 - DNA, 22 bp, Homo sapiens
agggggtgtctctgattgggtt

SEQ ID NO: 7820566 - DNA, 22 bp, Homo sapiens
agggggtgtctctgattgggtt

SEQ ID NO: 7820567 - DNA, 22 bp, Homo sapiens
agggggtgtctctgattgggtt

SEQ ID NO: 7820568 - DNA, 22 bp, Homo sapiens
agggggtgctacttccagagtt

SEQ ID NO: 7820569 - DNA, 22 bp, Homo sapiens
agggggtgtctctgattgggtt

SEQ ID NO: 7820570 - DNA, 22 bp, Homo sapiens
agggggtgggaagtctagaatc

SEQ ID NO: 7820571 - DNA, 22 bp, Homo sapiens
agggggtgggaagtctagaatc

SEQ ID NO: 7820572 - DNA, 22 bp, Homo sapiens
agggggtgggaagtctagaatc

SEQ ID NO: 7820573 - DNA, 22 bp, Homo sapiens
agggggtgggaagtctagaatc

SEQ ID NO: 7820574 - DNA, 22 bp, Homo sapiens
agggggtgcccagatgaaggat

SEQ ID NO: 7820575 - DNA, 22 bp, Homo sapiens
agggggtgctacttccagagtt

SEQ ID NO: 7820576 - DNA, 22 bp, Homo sapiens
agggggtgcatttgtgaatgaa

SEQ ID NO: 7820577 - DNA, 22 bp, Homo sapiens
agggggtgatcaaggtgcggcg

SEQ ID NO: 7820578 - DNA, 22 bp, Homo sapiens
agggggtgatcaaggtgcggcg

SEQ ID NO: 7820579 - DNA, 22 bp, Homo sapiens
agggggtgatcaaggtgcggcg

SEQ ID NO: 7820580 - DNA, 22 bp, Homo sapiens
agggggtgatcaaggtgcggcg

SEQ ID NO: 7820581 - DNA, 22 bp, Homo sapiens
agggggtgcccagatgaaggat

SEQ ID NO: 7820582 - DNA, 22 bp, Homo sapiens
agggggtgcccagatgaaggat

SEQ ID NO: 7820583 - DNA, 22 bp, Homo sapiens
agggggtgcccagatgaaggat

SEQ ID NO: 7820584 - DNA, 22 bp, Homo sapiens
agggggtgcatttgtgaatgaa

SEQ ID NO: 7820585 - DNA, 22 bp, Homo sapiens
agggggtgcatttgtgaatgaa

SEQ ID NO: 7820586 - DNA, 22 bp, Homo sapiens
agggggtgcatttgtgaatgaa

SEQ ID NO: 7820587 - DNA, 22 bp, Homo sapiens
agggggtgcatttgtgaatgaa

SEQ ID NO: 7820588 - DNA, 22 bp, Homo sapiens
aggggtctttaggaacgtcggg

SEQ ID NO: 7820589 - DNA, 22 bp, Homo sapiens
aggggtctttaggaacgtcggg

SEQ ID NO: 7820590 - DNA, 22 bp, Homo sapiens
aggggtcttgggagtcctggct

SEQ ID NO: 7820591 - DNA, 22 bp, Homo sapiens
aggggtcttgggagtcctggct

SEQ ID NO: 7820592 - DNA, 22 bp, Homo sapiens
aggggtcttgggagtcctggct

SEQ ID NO: 7820593 - DNA, 22 bp, Homo sapiens
aggggtcttgaggactccagca

SEQ ID NO: 7820594 - DNA, 22 bp, Homo sapiens
cctgagtctgtgttttcctaag

SEQ ID NO: 7820595 - DNA, 21 bp, Homo sapiens
cctgagtccctgttacagaca

SEQ ID NO: 7820596 - DNA, 21 bp, Homo sapiens
cctgagtccctgttacagaca

SEQ ID NO: 7820597 - DNA, 22 bp, Homo sapiens
cctgcagaccacactcagtcct

SEQ ID NO: 7820598 - DNA, 22 bp, Homo sapiens
cctgagtcccctcattcactct

SEQ ID NO: 7820599 - DNA, 22 bp, Homo sapiens
cctgagtcccctcattcactct

SEQ ID NO: 7820600 - DNA, 22 bp, Homo sapiens
cctgagtcccctcattcactct

SEQ ID NO: 7820601 - DNA, 22 bp, Homo sapiens
aggggtgaaggcccgataggag

SEQ ID NO: 7820602 - DNA, 22 bp, Homo sapiens
aggggtagagattgctggtgta

SEQ ID NO: 7820603 - DNA, 22 bp, Homo sapiens
aggggtagagattgctggtgta

SEQ ID NO: 7820604 - DNA, 22 bp, Homo sapiens
aggggtcagtgaccattgagga

SEQ ID NO: 7820605 - DNA, 22 bp, Homo sapiens
aggggtcagtgaccattgagga

SEQ ID NO: 7820606 - DNA, 20 bp, Homo sapiens
aggggtctagcagcagtgct

SEQ ID NO: 7820607 - DNA, 22 bp, Homo sapiens
aggggtcagtgaccattgagga

SEQ ID NO: 7820608 - DNA, 22 bp, Homo sapiens
aggggtctatcctgagatggtc

SEQ ID NO: 7820609 - DNA, 22 bp, Homo sapiens
aggggtctatcctgagatggtc

SEQ ID NO: 7820610 - DNA, 20 bp, Homo sapiens
aggggtctagcagcagtgct

SEQ ID NO: 7820611 - DNA, 22 bp, Homo sapiens
aggggtctatcctgagatggtc

SEQ ID NO: 7820612 - DNA, 22 bp, Homo sapiens
aggggtctatcctgagatggtc

SEQ ID NO: 7820613 - DNA, 22 bp, Homo sapiens
cagctggtcaactgaatgaaca

SEQ ID NO: 7820614 - DNA, 22 bp, Homo sapiens
cagctggtactcagttcttgtc

SEQ ID NO: 7820615 - DNA, 22 bp, Homo sapiens
cagctggtactcagttcttgtc

SEQ ID NO: 7820616 - DNA, 22 bp, Homo sapiens
cagctggtaggtagcagatttg

SEQ ID NO: 7820617 - DNA, 22 bp, Homo sapiens
cagctggtgagcttagtagggt

SEQ ID NO: 7820618 - DNA, 22 bp, Homo sapiens
cagctggtgagcttagtagggt

SEQ ID NO: 7820619 - DNA, 22 bp, Homo sapiens
cagctggtgaactagtttttca

SEQ ID NO: 7820620 - DNA, 22 bp, Homo sapiens
cagctggtgtcaggcactgcag

SEQ ID NO: 7820621 - DNA, 22 bp, Homo sapiens
cagctggtggctgatgaccgtc

SEQ ID NO: 7820622 - DNA, 22 bp, Homo sapiens
cagctgggtttagtggggtgtg

SEQ ID NO: 7820623 - DNA, 22 bp, Homo sapiens
cagctgggtttagtggggtgtg

SEQ ID NO: 7820624 - DNA, 22 bp, Homo sapiens
cagctgggtttagtggggtgtg

SEQ ID NO: 7820625 - DNA, 22 bp, Homo sapiens
cagctgggtttagtggggtgtg

SEQ ID NO: 7820626 - DNA, 22 bp, Homo sapiens
cagctgggtggctcttctgctc

SEQ ID NO: 7820627 - DNA, 22 bp, Homo sapiens
cagctgggtttagtggggtgtg

SEQ ID NO: 7820628 - DNA, 22 bp, Homo sapiens
cagctggtactcagttcttgtc

SEQ ID NO: 7820629 - DNA, 23 bp, Homo sapiens
cagctggttgtgggagtggctgc

SEQ ID NO: 7820630 - DNA, 22 bp, Homo sapiens
cagctggttggaagggagctga

SEQ ID NO: 7820631 - DNA, 22 bp, Homo sapiens
cagctggttggaagggagctga

SEQ ID NO: 7820632 - DNA, 23 bp, Homo sapiens
cagctggttgtgggagtggctgc

SEQ ID NO: 7820633 - DNA, 22 bp, Homo sapiens
cagctggttgaagaggagctgg

SEQ ID NO: 7820634 - DNA, 22 bp, Homo sapiens
cagctggttggaagggagctga

SEQ ID NO: 7820635 - DNA, 22 bp, Homo sapiens
cagctggttgaagaggagctgg

SEQ ID NO: 7820636 - DNA, 22 bp, Homo sapiens
cagctggttatcagagaggcct

SEQ ID NO: 7820637 - DNA, 22 bp, Homo sapiens
cagctggttatcagagaggcct

SEQ ID NO: 7820638 - DNA, 22 bp, Homo sapiens
cagctggttatcagagaggcct

SEQ ID NO: 7820639 - DNA, 22 bp, Homo sapiens
cagctggttatcagagaggcct

SEQ ID NO: 7820640 - DNA, 22 bp, Homo sapiens
cagctggtgtcaggcactgcag

SEQ ID NO: 7820641 - DNA, 22 bp, Homo sapiens
cagctggtgtcaggcactgcag

SEQ ID NO: 7820642 - DNA, 22 bp, Homo sapiens
cagctggtgtcaggcactgcag

SEQ ID NO: 7820643 - DNA, 22 bp, Homo sapiens
cagctggtgtccagggaagtgg

SEQ ID NO: 7820644 - DNA, 22 bp, Homo sapiens
cagctggtgtccagggaagtgg

SEQ ID NO: 7820645 - DNA, 22 bp, Homo sapiens
cagctgtcagccggtgcaggct

SEQ ID NO: 7820646 - DNA, 22 bp, Homo sapiens
cagctgtccaaacacattaact

SEQ ID NO: 7820647 - DNA, 22 bp, Homo sapiens
cagctgtccaaacacattaact

SEQ ID NO: 7820648 - DNA, 22 bp, Homo sapiens
cagctgtccttcctggtgggcg

SEQ ID NO: 7820649 - DNA, 22 bp, Homo sapiens
cagctgtctaagttgagcagga

SEQ ID NO: 7820650 - DNA, 22 bp, Homo sapiens
cagctgtgtatgagagcatgct

SEQ ID NO: 7820651 - DNA, 22 bp, Homo sapiens
cagctgtccttcctggtgggcg

SEQ ID NO: 7820652 - DNA, 22 bp, Homo sapiens
cagctgtcacttctaagttttg

SEQ ID NO: 7820653 - DNA, 22 bp, Homo sapiens
cagctgtgtctaattatggctg

SEQ ID NO: 7820654 - DNA, 22 bp, Homo sapiens
cagctgtgtctaattatggctg

SEQ ID NO: 7820655 - DNA, 22 bp, Homo sapiens
cagctgtgtctaattatggctg

SEQ ID NO: 7820656 - DNA, 22 bp, Homo sapiens
cagctgtgtatgagagcatgct

SEQ ID NO: 7820657 - DNA, 22 bp, Homo sapiens
cagctgtgtatgagagcatgct

SEQ ID NO: 7820658 - DNA, 22 bp, Homo sapiens
cagctgtgtatgagagcatgct

SEQ ID NO: 7820659 - DNA, 22 bp, Homo sapiens
cagctgtgtatgagagcatgct

SEQ ID NO: 7820660 - DNA, 22 bp, Homo sapiens
cagctgtgtatgagagcatgct

SEQ ID NO: 7820661 - DNA, 22 bp, Homo sapiens
cagctgtgtctaattatggctg

SEQ ID NO: 7820662 - DNA, 22 bp, Homo sapiens
cagctgttcagcaactcgcaga

SEQ ID NO: 7820663 - DNA, 22 bp, Homo sapiens
cagctgttcattgttgccaccc

SEQ ID NO: 7820664 - DNA, 22 bp, Homo sapiens
cagctgttcctggaaggagacc

SEQ ID NO: 7820665 - DNA, 22 bp, Homo sapiens
cagctgttcctggaaggagacc

SEQ ID NO: 7820666 - DNA, 22 bp, Homo sapiens
cagctgttatgaggtgtacatg

SEQ ID NO: 7820667 - DNA, 22 bp, Homo sapiens
cagctgttatgaggtgtacatg

SEQ ID NO: 7820668 - DNA, 22 bp, Homo sapiens
cagctgttcacatttccaaaac

SEQ ID NO: 7820669 - DNA, 22 bp, Homo sapiens
cagctgttactctgagtaaatg

SEQ ID NO: 7820670 - DNA, 22 bp, Homo sapiens
cagctgttactgaagtaaaatg

SEQ ID NO: 7820671 - DNA, 22 bp, Homo sapiens
caggactgatgttcctccagcc

SEQ ID NO: 7820672 - DNA, 22 bp, Homo sapiens
caggactgatgttcctccagcc

SEQ ID NO: 7820673 - DNA, 22 bp, Homo sapiens
caggactgatgttcctccagcc

SEQ ID NO: 7820674 - DNA, 22 bp, Homo sapiens
caggactgaagggcacagggaa

SEQ ID NO: 7820675 - DNA, 22 bp, Homo sapiens
caggactgaagggcacagggaa

SEQ ID NO: 7820676 - DNA, 22 bp, Homo sapiens
caggactgaagggcacagggaa

SEQ ID NO: 7820677 - DNA, 22 bp, Homo sapiens
caggactggaagtctcaagaga

SEQ ID NO: 7820678 - DNA, 22 bp, Homo sapiens
caggactggaagtctcaagaga

SEQ ID NO: 7820679 - DNA, 22 bp, Homo sapiens
caggactggctcgcagtgggtg

SEQ ID NO: 7820680 - DNA, 22 bp, Homo sapiens
caggactggctcgcagtgggtg

SEQ ID NO: 7820681 - DNA, 22 bp, Homo sapiens
caggactggctcgcagtgggtg

SEQ ID NO: 7820682 - DNA, 22 bp, Homo sapiens
caggactggctcgcagtgggtg

SEQ ID NO: 7820683 - DNA, 22 bp, Homo sapiens
caggactggctcgcagtgggtg

SEQ ID NO: 7820684 - DNA, 22 bp, Homo sapiens
caggactgtatccttggagaaa

SEQ ID NO: 7820685 - DNA, 22 bp, Homo sapiens
caggactgtatccttggagaaa

SEQ ID NO: 7820686 - DNA, 22 bp, Homo sapiens
caggactggctcgcagtgggtg

SEQ ID NO: 7820687 - DNA, 22 bp, Homo sapiens
caggactggctcgcagtgggtg

SEQ ID NO: 7820688 - DNA, 22 bp, Homo sapiens
caggagaaacataattttctgg

SEQ ID NO: 7820689 - DNA, 22 bp, Homo sapiens
caggagaaatgtggctgctacc

SEQ ID NO: 7820690 - DNA, 22 bp, Homo sapiens
caggagaaggtttggagtgcag

SEQ ID NO: 7820691 - DNA, 22 bp, Homo sapiens
caggagaaggtttggagtgcag

SEQ ID NO: 7820692 - DNA, 22 bp, Homo sapiens
caggagcaaggagcagtgggat

SEQ ID NO: 7820693 - DNA, 22 bp, Homo sapiens
caggagcaaggagcagtgggat

SEQ ID NO: 7820694 - DNA, 20 bp, Homo sapiens
caggacagcgcaatcggagg

SEQ ID NO: 7820695 - DNA, 22 bp, Homo sapiens
caggacagctcaacacctcctc

SEQ ID NO: 7820696 - DNA, 22 bp, Homo sapiens
caggaccccatattcactgaac

SEQ ID NO: 7820697 - DNA, 22 bp, Homo sapiens
caggacctgaagacaggcaggt

SEQ ID NO: 7820698 - DNA, 22 bp, Homo sapiens
caggacctgaagacaggcaggt

SEQ ID NO: 7820699 - DNA, 22 bp, Homo sapiens
caggacctaactcacctgtctc

SEQ ID NO: 7820700 - DNA, 22 bp, Homo sapiens
caggactatgttcaacagatag

SEQ ID NO: 7820701 - DNA, 22 bp, Homo sapiens
caggacctggaatgcttgtgaa

SEQ ID NO: 7820702 - DNA, 22 bp, Homo sapiens
caggactgaagggcacagggaa

SEQ ID NO: 7820703 - DNA, 22 bp, Homo sapiens
caggactcttgtcatcatcagt

SEQ ID NO: 7820704 - DNA, 22 bp, Homo sapiens
caggactcttgtcatcatcagt

SEQ ID NO: 7820705 - DNA, 22 bp, Homo sapiens
caggactcacttctcacatccc

SEQ ID NO: 7820706 - DNA, 22 bp, Homo sapiens
caggacagagcccagactgtgt

SEQ ID NO: 7820707 - DNA, 22 bp, Homo sapiens
cagctgttgtcacctcacatcc

SEQ ID NO: 7820708 - DNA, 20 bp, Homo sapiens
caggacagcgcaatcggagg

SEQ ID NO: 7820709 - DNA, 20 bp, Homo sapiens
caggacagcgcaatcggagg

SEQ ID NO: 7820710 - DNA, 20 bp, Homo sapiens
caggacagcgcaatcggagg

SEQ ID NO: 7820711 - DNA, 22 bp, Homo sapiens
cagctgttgcagcactgagaga

SEQ ID NO: 7820712 - DNA, 22 bp, Homo sapiens
cagctgttgatctcttaagcct

SEQ ID NO: 7820713 - DNA, 22 bp, Homo sapiens
cagctgttcctggttggtggga

SEQ ID NO: 7820714 - DNA, 22 bp, Homo sapiens
cagctgttcttgggacagacag

SEQ ID NO: 7820715 - DNA, 22 bp, Homo sapiens
cagctgttcggggctggcatgt

SEQ ID NO: 7820716 - DNA, 22 bp, Homo sapiens
cagctgttgactggtacatgaa

SEQ ID NO: 7820717 - DNA, 22 bp, Homo sapiens
cagctgttgactggtacatgaa

SEQ ID NO: 7820718 - DNA, 22 bp, Homo sapiens
cagctgttcttgggacagacag

SEQ ID NO: 7820719 - DNA, 20 bp, Homo sapiens
caggcacactcattcctgct

SEQ ID NO: 7820720 - DNA, 22 bp, Homo sapiens
caggcagagtgaggtggtctaa

SEQ ID NO: 7820721 - DNA, 20 bp, Homo sapiens
caggcacactcattcctgct

SEQ ID NO: 7820722 - DNA, 20 bp, Homo sapiens
caggcacactcattcctgct

SEQ ID NO: 7820723 - DNA, 22 bp, Homo sapiens
caggcagagtgaggtggtctaa

SEQ ID NO: 7820724 - DNA, 22 bp, Homo sapiens
caggcagagtgaggtggtctaa

SEQ ID NO: 7820725 - DNA, 22 bp, Homo sapiens
caggcagagttagagcaactgg

SEQ ID NO: 7820726 - DNA, 22 bp, Homo sapiens
caggcacacccactggtgcaga

SEQ ID NO: 7820727 - DNA, 20 bp, Homo sapiens
caggcacactcattcctgct

SEQ ID NO: 7820728 - DNA, 22 bp, Homo sapiens
caggcacacccactggtgcaga

SEQ ID NO: 7820729 - DNA, 22 bp, Homo sapiens
caggcacacccactggtgcaga

SEQ ID NO: 7820730 - DNA, 22 bp, Homo sapiens
caggcacacccactggtgcaga

SEQ ID NO: 7820731 - DNA, 22 bp, Homo sapiens
caggcacacccactggtgcaga

SEQ ID NO: 7820732 - DNA, 22 bp, Homo sapiens
caggcacacatccgtgagagat

SEQ ID NO: 7820733 - DNA, 22 bp, Homo sapiens
caggcacacatccgtgagagat

SEQ ID NO: 7820734 - DNA, 22 bp, Homo sapiens
caggcacacatccgtgagagat

SEQ ID NO: 7820735 - DNA, 22 bp, Homo sapiens
caggcacacatccgtgagagat

SEQ ID NO: 7820736 - DNA, 22 bp, Homo sapiens
caggcacacatccgtgagagat

SEQ ID NO: 7820737 - DNA, 22 bp, Homo sapiens
caggcacacatccgtgagagat

SEQ ID NO: 7820738 - DNA, 22 bp, Homo sapiens
caggcacacatccgtgagagat

SEQ ID NO: 7820739 - DNA, 22 bp, Homo sapiens
caggcacacagggaatttggct

SEQ ID NO: 7820740 - DNA, 22 bp, Homo sapiens
caggcacacaggctccctgggc

SEQ ID NO: 7820741 - DNA, 22 bp, Homo sapiens
caggcacacagcacatggcctg

SEQ ID NO: 7820742 - DNA, 22 bp, Homo sapiens
caggcacacaggctccctgggc

SEQ ID NO: 7820743 - DNA, 22 bp, Homo sapiens
caggcacaattatttccctttc

SEQ ID NO: 7820744 - DNA, 22 bp, Homo sapiens
caggcacacagcacatggcctg

SEQ ID NO: 7820745 - DNA, 22 bp, Homo sapiens
caggcacacagcacatggcctg

SEQ ID NO: 7820746 - DNA, 22 bp, Homo sapiens
caggcacacagcacatggcctg

SEQ ID NO: 7820747 - DNA, 22 bp, Homo sapiens
caggcacacagcacatggcctg

SEQ ID NO: 7820748 - DNA, 22 bp, Homo sapiens
caggatggtctcgatctcctga

SEQ ID NO: 7820749 - DNA, 22 bp, Homo sapiens
caggatggtcagatgcattgtc

SEQ ID NO: 7820750 - DNA, 22 bp, Homo sapiens
caggatgggtgtcggccagcac

SEQ ID NO: 7820751 - DNA, 22 bp, Homo sapiens
caggatgggtgtcggccagcac

SEQ ID NO: 7820752 - DNA, 22 bp, Homo sapiens
caggatgggtgtcggccagcac

SEQ ID NO: 7820753 - DNA, 22 bp, Homo sapiens
caggatgggtgtcggccagcac

SEQ ID NO: 7820754 - DNA, 22 bp, Homo sapiens
caggatgggtgtcggccagcac

SEQ ID NO: 7820755 - DNA, 22 bp, Homo sapiens
caggatgggatgtagtgggccc

SEQ ID NO: 7820756 - DNA, 22 bp, Homo sapiens
caggatgggatgtagtgggccc

SEQ ID NO: 7820757 - DNA, 22 bp, Homo sapiens
caggatgggatgtagtgggccc

SEQ ID NO: 7820758 - DNA, 22 bp, Homo sapiens
caggatgggatgtagtgggccc

SEQ ID NO: 7820759 - DNA, 22 bp, Homo sapiens
caggatgggatgtagtgggccc

SEQ ID NO: 7820760 - DNA, 22 bp, Homo sapiens
caggatgggatgtagtgggccc

SEQ ID NO: 7820761 - DNA, 22 bp, Homo sapiens
caggatgggatgtagtgggccc

SEQ ID NO: 7820762 - DNA, 22 bp, Homo sapiens
caggagtgaaatgaggcccagg

SEQ ID NO: 7820763 - DNA, 22 bp, Homo sapiens
caggagtctgttcctcatttgt

SEQ ID NO: 7820764 - DNA, 22 bp, Homo sapiens
caggagtgaaatgaggcccagg

SEQ ID NO: 7820765 - DNA, 22 bp, Homo sapiens
caggagtctgttcctcatttgt

SEQ ID NO: 7820766 - DNA, 22 bp, Homo sapiens
caggagcccagagtcctcagct

SEQ ID NO: 7820767 - DNA, 22 bp, Homo sapiens
caggagcccagagtcctcagct

SEQ ID NO: 7820768 - DNA, 22 bp, Homo sapiens
caggatggagggagggctgtta

SEQ ID NO: 7820769 - DNA, 22 bp, Homo sapiens
caggatggagggagggctgtta

SEQ ID NO: 7820770 - DNA, 22 bp, Homo sapiens
caggatggagggagggctgtta

SEQ ID NO: 7820771 - DNA, 22 bp, Homo sapiens
caggatggagagttgttggttg

SEQ ID NO: 7820772 - DNA, 22 bp, Homo sapiens
caggatggagagttgttggttg

SEQ ID NO: 7820773 - DNA, 22 bp, Homo sapiens
caggatggagggagggctgtta

SEQ ID NO: 7820774 - DNA, 22 bp, Homo sapiens
caggatggccccggggctgtgc

SEQ ID NO: 7820775 - DNA, 22 bp, Homo sapiens
caggatggccccggggctgtgc

SEQ ID NO: 7820776 - DNA, 22 bp, Homo sapiens
caggatggccccggggctgtgc

SEQ ID NO: 7820777 - DNA, 22 bp, Homo sapiens
caggatggccccggggctgtgc

SEQ ID NO: 7820778 - DNA, 22 bp, Homo sapiens
caggagcagagggtggtcagca

SEQ ID NO: 7820779 - DNA, 22 bp, Homo sapiens
caggagcagagggtggtcagca

SEQ ID NO: 7820780 - DNA, 22 bp, Homo sapiens
caggagcagagggtggtcagca

SEQ ID NO: 7820781 - DNA, 22 bp, Homo sapiens
caggagcagagggtggtcagca

SEQ ID NO: 7820782 - DNA, 22 bp, Homo sapiens
caggagcagagggtggtcagca

SEQ ID NO: 7820783 - DNA, 22 bp, Homo sapiens
caggagcagagggtggtcagca

SEQ ID NO: 7820784 - DNA, 22 bp, Homo sapiens
caggagcaaggagcagtgggat

SEQ ID NO: 7820785 - DNA, 18 bp, Homo sapiens
caggagcaggagttgaac

SEQ ID NO: 7820786 - DNA, 22 bp, Homo sapiens
caggagcaggcccaaggacaca

SEQ ID NO: 7820787 - DNA, 22 bp, Homo sapiens
caggagcaggcccaaggacaca

SEQ ID NO: 7820788 - DNA, 18 bp, Homo sapiens
caggagcaggagttgaac

SEQ ID NO: 7820789 - DNA, 22 bp, Homo sapiens
caggagcatgctgatgccagaa

SEQ ID NO: 7820790 - DNA, 22 bp, Homo sapiens
caggagcatgctgatgccagaa

SEQ ID NO: 7820791 - DNA, 22 bp, Homo sapiens
caggagcatgctgatgccagaa

SEQ ID NO: 7820792 - DNA, 22 bp, Homo sapiens
caggagcagttagaagcccact

SEQ ID NO: 7820793 - DNA, 22 bp, Homo sapiens
caggagcatgctgatgccagaa

SEQ ID NO: 7820794 - DNA, 22 bp, Homo sapiens
caggagcaggcccaaggacaca

SEQ ID NO: 7820795 - DNA, 22 bp, Homo sapiens
caggagcagttagaagcccact

SEQ ID NO: 7820796 - DNA, 22 bp, Homo sapiens
caggagccagaggcggatggag

SEQ ID NO: 7820797 - DNA, 22 bp, Homo sapiens
caggagccacattccaccttga

SEQ ID NO: 7820798 - DNA, 22 bp, Homo sapiens
caggcaggtcagtgaagaagga

SEQ ID NO: 7820799 - DNA, 22 bp, Homo sapiens
caggcaggtcagtgaagaagga

SEQ ID NO: 7820800 - DNA, 22 bp, Homo sapiens
caggcaggtcagtgaagaagga

SEQ ID NO: 7820801 - DNA, 22 bp, Homo sapiens
caggcaggtcagtgaagaagga

SEQ ID NO: 7820802 - DNA, 22 bp, Homo sapiens
caggcaggtcagtgaagaagga

SEQ ID NO: 7820803 - DNA, 22 bp, Homo sapiens
caggcaggtcagtgaagaagga

SEQ ID NO: 7820804 - DNA, 22 bp, Homo sapiens
caggcaggtcagtgaagaagga

SEQ ID NO: 7820805 - DNA, 22 bp, Homo sapiens
caggcaggtcagtgaagaagga

SEQ ID NO: 7820806 - DNA, 22 bp, Homo sapiens
caggcagggagctggaaaggat

SEQ ID NO: 7820807 - DNA, 22 bp, Homo sapiens
caggcaggtcagtgaagaagga

SEQ ID NO: 7820808 - DNA, 22 bp, Homo sapiens
caggcagggagctggaaaggat

SEQ ID NO: 7820809 - DNA, 22 bp, Homo sapiens
caggcagggagctggaaaggat

SEQ ID NO: 7820810 - DNA, 22 bp, Homo sapiens
caggcagggagctggaaaggat

SEQ ID NO: 7820811 - DNA, 22 bp, Homo sapiens
caggcagctcaaccttgggagc

SEQ ID NO: 7820812 - DNA, 22 bp, Homo sapiens
caggcagctcaaccttgggagc

SEQ ID NO: 7820813 - DNA, 22 bp, Homo sapiens
caggcagctcaaccttgggagc

SEQ ID NO: 7820814 - DNA, 22 bp, Homo sapiens
caggcagctcgatgccttgttg

SEQ ID NO: 7820815 - DNA, 22 bp, Homo sapiens
caggcagctcgatgccttgttg

SEQ ID NO: 7820816 - DNA, 22 bp, Homo sapiens
caggcagctcgatgccttgttg

SEQ ID NO: 7820817 - DNA, 22 bp, Homo sapiens
caggcagctcaaccttgggagc

SEQ ID NO: 7820818 - DNA, 22 bp, Homo sapiens
caggcagcctgcggtctgcaca

SEQ ID NO: 7820819 - DNA, 22 bp, Homo sapiens
caggcagccttctcgtctcaca

SEQ ID NO: 7820820 - DNA, 22 bp, Homo sapiens
caggcagccttctcgtctcaca

SEQ ID NO: 7820821 - DNA, 22 bp, Homo sapiens
caggcagcgctcgtggcctggc

SEQ ID NO: 7820822 - DNA, 22 bp, Homo sapiens
caggcagcgctcgtggcctggc

SEQ ID NO: 7820823 - DNA, 22 bp, Homo sapiens
caggcagcgctcgtggcctggc

SEQ ID NO: 7820824 - DNA, 22 bp, Homo sapiens
caggcagcgctcgtggcctggc

SEQ ID NO: 7820825 - DNA, 22 bp, Homo sapiens
caggcagcgctcgtggcctggc

SEQ ID NO: 7820826 - DNA, 22 bp, Homo sapiens
caggcagccttctcgtctcaca

SEQ ID NO: 7820827 - DNA, 22 bp, Homo sapiens
caggcagcctgcggtctgcaca

SEQ ID NO: 7820828 - DNA, 22 bp, Homo sapiens
caggcagcctgcggtctgcaca

SEQ ID NO: 7820829 - DNA, 22 bp, Homo sapiens
caggcagcctgcggtctgcaca

SEQ ID NO: 7820830 - DNA, 22 bp, Homo sapiens
caggcagcctgcggtctgcaca

SEQ ID NO: 7820831 - DNA, 22 bp, Homo sapiens
caggcagcctgcggtctgcaca

SEQ ID NO: 7820832 - DNA, 22 bp, Homo sapiens
caggcagcctgcggtctgcaca

SEQ ID NO: 7820833 - DNA, 22 bp, Homo sapiens
caggcagcctgcggtctgcaca

SEQ ID NO: 7820834 - DNA, 22 bp, Homo sapiens
caggcagcctgcggtctgcaca

SEQ ID NO: 7820835 - DNA, 22 bp, Homo sapiens
caggcagctagatttataacaa

SEQ ID NO: 7820836 - DNA, 22 bp, Homo sapiens
caggcagctagatttataacaa

SEQ ID NO: 7820837 - DNA, 22 bp, Homo sapiens
caggcagcgtcctgcttcctgt

SEQ ID NO: 7820838 - DNA, 22 bp, Homo sapiens
caggcagcgtcctgcttcctgt

SEQ ID NO: 7820839 - DNA, 22 bp, Homo sapiens
caggcagcgtcctgcttcctgt

SEQ ID NO: 7820840 - DNA, 22 bp, Homo sapiens
caggcagcgtcctgcttcctgt

SEQ ID NO: 7820841 - DNA, 22 bp, Homo sapiens
caggcagcgtcctgcttcctgt

SEQ ID NO: 7820842 - DNA, 22 bp, Homo sapiens
caggcagcgtcctgcttcctgt

SEQ ID NO: 7820843 - DNA, 22 bp, Homo sapiens
caggcagcgtcctgcttcctgt

SEQ ID NO: 7820844 - DNA, 22 bp, Homo sapiens
caggcagcgtcctgcttcctgt

SEQ ID NO: 7820845 - DNA, 22 bp, Homo sapiens
caggcagcgctcgtggcctggc

SEQ ID NO: 7820846 - DNA, 22 bp, Homo sapiens
caggcagcgctcgtggcctggc

SEQ ID NO: 7820847 - DNA, 22 bp, Homo sapiens
caggcagcgtcctgcttcctgt

SEQ ID NO: 7820848 - DNA, 22 bp, Homo sapiens
caggcagcgctcgtggcctggc

SEQ ID NO: 7820849 - DNA, 22 bp, Homo sapiens
caggcagcgctcgtggcctggc

SEQ ID NO: 7820850 - DNA, 22 bp, Homo sapiens
caggcagcgctcgtggcctggc

SEQ ID NO: 7820851 - DNA, 22 bp, Homo sapiens
agctgtcaggcagaactgagct

SEQ ID NO: 7820852 - DNA, 22 bp, Homo sapiens
agctgtcctggctcaggctgtg

SEQ ID NO: 7820853 - DNA, 22 bp, Homo sapiens
agctgtcctggctcaggctgtg

SEQ ID NO: 7820854 - DNA, 22 bp, Homo sapiens
agctgtcagtgctgtgcctgta

SEQ ID NO: 7820855 - DNA, 22 bp, Homo sapiens
agctgtctacagcaataaagga

SEQ ID NO: 7820856 - DNA, 22 bp, Homo sapiens
agctgtcctgtgggagggagtg

SEQ ID NO: 7820857 - DNA, 22 bp, Homo sapiens
agctgtctacctgcagagtcct

SEQ ID NO: 7820858 - DNA, 22 bp, Homo sapiens
agctgtctacctgcagagtcct

SEQ ID NO: 7820859 - DNA, 22 bp, Homo sapiens
agctgtctccagatacaggatt

SEQ ID NO: 7820860 - DNA, 22 bp, Homo sapiens
agctgtctctctggtgtccata

SEQ ID NO: 7820861 - DNA, 22 bp, Homo sapiens
agctgtctccagatacaggatt

SEQ ID NO: 7820862 - DNA, 22 bp, Homo sapiens
agctgtctctggtattatgtga

SEQ ID NO: 7820863 - DNA, 22 bp, Homo sapiens
agctgtatgcccaagatgctat

SEQ ID NO: 7820864 - DNA, 22 bp, Homo sapiens
agctgtagggtattatcatttt

SEQ ID NO: 7820865 - DNA, 22 bp, Homo sapiens
agctgtaatataagcaatgaaa

SEQ ID NO: 7820866 - DNA, 22 bp, Homo sapiens
agctggtttggggtagaggaca

SEQ ID NO: 7820867 - DNA, 22 bp, Homo sapiens
agctggtttggggtagaggaca

SEQ ID NO: 7820868 - DNA, 22 bp, Homo sapiens
agctgtatttgtgaatatttaa

SEQ ID NO: 7820869 - DNA, 22 bp, Homo sapiens
agctgtagggtattatcatttt

SEQ ID NO: 7820870 - DNA, 22 bp, Homo sapiens
agctgtcaggcagaactgagct

SEQ ID NO: 7820871 - DNA, 22 bp, Homo sapiens
agctgtcaggcagaactgagct

SEQ ID NO: 7820872 - DNA, 22 bp, Homo sapiens
agctgtcaccaggagccggacc

SEQ ID NO: 7820873 - DNA, 22 bp, Homo sapiens
agctggttgcttaacctctctg

SEQ ID NO: 7820874 - DNA, 22 bp, Homo sapiens
agctggttgacttcaggcaagt

SEQ ID NO: 7820875 - DNA, 22 bp, Homo sapiens
agctggttcattcattcatggt

SEQ ID NO: 7820876 - DNA, 22 bp, Homo sapiens
agctggttcccactgggcctgt

SEQ ID NO: 7820877 - DNA, 22 bp, Homo sapiens
agctggtttgcaagtataatca

SEQ ID NO: 7820878 - DNA, 22 bp, Homo sapiens
agctggtttatttctcacaaca

SEQ ID NO: 7820879 - DNA, 23 bp, Homo sapiens
agctggtttcaatgtgttatttc

SEQ ID NO: 7820880 - DNA, 22 bp, Homo sapiens
agctggtttaggaaaaggtagg

SEQ ID NO: 7820881 - DNA, 22 bp, Homo sapiens
agctggtttaggatggtctcca

SEQ ID NO: 7820882 - DNA, 22 bp, Homo sapiens
caggcagtggctcacagcaacc

SEQ ID NO: 7820883 - DNA, 22 bp, Homo sapiens
caggcagtggctcacagcaacc

SEQ ID NO: 7820884 - DNA, 22 bp, Homo sapiens
caggcagtggctcacagcaacc

SEQ ID NO: 7820885 - DNA, 22 bp, Homo sapiens
caggcaggtgcagattcctctt

SEQ ID NO: 7820886 - DNA, 22 bp, Homo sapiens
caggcagtggccatgttgggag

SEQ ID NO: 7820887 - DNA, 22 bp, Homo sapiens
caggcagtggccatgttgggag

SEQ ID NO: 7820888 - DNA, 22 bp, Homo sapiens
caggcagtggctcacagcaacc

SEQ ID NO: 7820889 - DNA, 22 bp, Homo sapiens
caggcagtggctcacagcaacc

SEQ ID NO: 7820890 - DNA, 22 bp, Homo sapiens
caggcaggtgcagattcctctt

SEQ ID NO: 7820891 - DNA, 22 bp, Homo sapiens
caggcaggtgcagattcctctt

SEQ ID NO: 7820892 - DNA, 22 bp, Homo sapiens
caggcaggtgcagattcctctt

SEQ ID NO: 7820893 - DNA, 22 bp, Homo sapiens
caggcaggtgcagattcctctt

SEQ ID NO: 7820894 - DNA, 22 bp, Homo sapiens
caggcaggtgcagattcctctt

SEQ ID NO: 7820895 - DNA, 22 bp, Homo sapiens
caggcaggtgcagattcctctt

SEQ ID NO: 7820896 - DNA, 22 bp, Homo sapiens
caggcaggtcagtgaagaagga

SEQ ID NO: 7820897 - DNA, 22 bp, Homo sapiens
caggcaggtcagtgaagaagga

SEQ ID NO: 7820898 - DNA, 22 bp, Homo sapiens
caggcagtgtgacgctagggtt

SEQ ID NO: 7820899 - DNA, 22 bp, Homo sapiens
caggcagtgtcccaggaagcca

SEQ ID NO: 7820900 - DNA, 22 bp, Homo sapiens
caggcagtgtgacgctagggtt

SEQ ID NO: 7820901 - DNA, 22 bp, Homo sapiens
caggcagtgtcccaggaagcca

SEQ ID NO: 7820902 - DNA, 22 bp, Homo sapiens
caggcagtgtcccaggaagcca

SEQ ID NO: 7820903 - DNA, 22 bp, Homo sapiens
caggcagtgtcccaggaagcca

SEQ ID NO: 7820904 - DNA, 22 bp, Homo sapiens
caggcagtgtcccaggaagcca

SEQ ID NO: 7820905 - DNA, 22 bp, Homo sapiens
caggcagtgtcccaggaagcca

SEQ ID NO: 7820906 - DNA, 22 bp, Homo sapiens
caggcagtgtcccaggaagcca

SEQ ID NO: 7820907 - DNA, 22 bp, Homo sapiens
agctggtggaagggagcccaaa

SEQ ID NO: 7820908 - DNA, 22 bp, Homo sapiens
agctggtggaagggagcccaaa

SEQ ID NO: 7820909 - DNA, 22 bp, Homo sapiens
agctggtggaagggagcccaaa

SEQ ID NO: 7820910 - DNA, 22 bp, Homo sapiens
agctggtggaagggagcccaaa

SEQ ID NO: 7820911 - DNA, 20 bp, Homo sapiens
caggcagtttgtggttaggg

SEQ ID NO: 7820912 - DNA, 22 bp, Homo sapiens
agctggtggaagggagcccaaa

SEQ ID NO: 7820913 - DNA, 22 bp, Homo sapiens
agctggttcatggactgcctgg

SEQ ID NO: 7820914 - DNA, 22 bp, Homo sapiens
agctggtggagaagcagacctc

SEQ ID NO: 7820915 - DNA, 22 bp, Homo sapiens
agctggtggaagggagcccaaa

SEQ ID NO: 7820916 - DNA, 22 bp, Homo sapiens
agctggtggagaagcagacctc

SEQ ID NO: 7820917 - DNA, 22 bp, Homo sapiens
agctggtggagaagcagacctc

SEQ ID NO: 7820918 - DNA, 22 bp, Homo sapiens
agcttagaagtgtgctgagagg

SEQ ID NO: 7820919 - DNA, 22 bp, Homo sapiens
agcttactgtaattaaaagact

SEQ ID NO: 7820920 - DNA, 22 bp, Homo sapiens
agcttagaagtgtgctgagagg

SEQ ID NO: 7820921 - DNA, 22 bp, Homo sapiens
agcttactgggcagtaaagatt

SEQ ID NO: 7820922 - DNA, 22 bp, Homo sapiens
agcttccattaactgctacact

SEQ ID NO: 7820923 - DNA, 22 bp, Homo sapiens
agcttccattaactgctacact

SEQ ID NO: 7820924 - DNA, 22 bp, Homo sapiens
agcttagaatgtgttaggaaag

SEQ ID NO: 7820925 - DNA, 22 bp, Homo sapiens
caggcccattctaggcttgcta

SEQ ID NO: 7820926 - DNA, 22 bp, Homo sapiens
caggcccattctaggcttgcta

SEQ ID NO: 7820927 - DNA, 22 bp, Homo sapiens
caggcccatttgtagccacttt

SEQ ID NO: 7820928 - DNA, 22 bp, Homo sapiens
caggcccatttgtagccacttt

SEQ ID NO: 7820929 - DNA, 22 bp, Homo sapiens
caggcccatttgtagccacttt

SEQ ID NO: 7820930 - DNA, 22 bp, Homo sapiens
caggcccatttgtagccacttt

SEQ ID NO: 7820931 - DNA, 22 bp, Homo sapiens
caggcccatttgtagccacttt

SEQ ID NO: 7820932 - DNA, 22 bp, Homo sapiens
caggcccatttgtagccacttt

SEQ ID NO: 7820933 - DNA, 22 bp, Homo sapiens
caggcccatttgtagccacttt

SEQ ID NO: 7820934 - DNA, 22 bp, Homo sapiens
caggcccatctgctcccaggct

SEQ ID NO: 7820935 - DNA, 22 bp, Homo sapiens
caggcccatgagggcagccaca

SEQ ID NO: 7820936 - DNA, 22 bp, Homo sapiens
caggcccatgagggcagccaca

SEQ ID NO: 7820937 - DNA, 22 bp, Homo sapiens
caggcccatctgctcccaggct

SEQ ID NO: 7820938 - DNA, 22 bp, Homo sapiens
caggcccatctgctcccaggct

SEQ ID NO: 7820939 - DNA, 22 bp, Homo sapiens
caggcccatctgctcccaggct

SEQ ID NO: 7820940 - DNA, 22 bp, Homo sapiens
caggcccatctgctcccaggct

SEQ ID NO: 7820941 - DNA, 22 bp, Homo sapiens
caggcccatctgctcccaggct

SEQ ID NO: 7820942 - DNA, 22 bp, Homo sapiens
caggcccatctgctcccaggct

SEQ ID NO: 7820943 - DNA, 22 bp, Homo sapiens
caggcccatgagggcagccaca

SEQ ID NO: 7820944 - DNA, 22 bp, Homo sapiens
caggcccattctaggcttgcta

SEQ ID NO: 7820945 - DNA, 22 bp, Homo sapiens
caggcccattctaggcttgcta

SEQ ID NO: 7820946 - DNA, 22 bp, Homo sapiens
caggcccattctaggcttgcta

SEQ ID NO: 7820947 - DNA, 22 bp, Homo sapiens
caggcccattctaggcttgcta

SEQ ID NO: 7820948 - DNA, 22 bp, Homo sapiens
caggcccatgagggcagccaca

SEQ ID NO: 7820949 - DNA, 22 bp, Homo sapiens
caggcccatgagggcagccaca

SEQ ID NO: 7820950 - DNA, 22 bp, Homo sapiens
caggcccatgagggcagccaca

SEQ ID NO: 7820951 - DNA, 22 bp, Homo sapiens
caggcccatgagggcagccaca

SEQ ID NO: 7820952 - DNA, 22 bp, Homo sapiens
caggcccagtgatcagggctct

SEQ ID NO: 7820953 - DNA, 22 bp, Homo sapiens
caggcccataatgcaaatattt

SEQ ID NO: 7820954 - DNA, 22 bp, Homo sapiens
caggcccataatgcaaatattt

SEQ ID NO: 7820955 - DNA, 22 bp, Homo sapiens
caggcccatctgctcccaggct

SEQ ID NO: 7820956 - DNA, 22 bp, Homo sapiens
caggcccagtgatcagggctct

SEQ ID NO: 7820957 - DNA, 22 bp, Homo sapiens
caggcccagtgatcagggctct

SEQ ID NO: 7820958 - DNA, 22 bp, Homo sapiens
caggcccaggtgtcgatgttcc

SEQ ID NO: 7820959 - DNA, 22 bp, Homo sapiens
caggcccagtgatcagggctct

SEQ ID NO: 7820960 - DNA, 22 bp, Homo sapiens
caggcccagtgatcagggctct

SEQ ID NO: 7820961 - DNA, 22 bp, Homo sapiens
caggcccagtgatcagggctct

SEQ ID NO: 7820962 - DNA, 22 bp, Homo sapiens
caggcccagtgatcagggctct

SEQ ID NO: 7820963 - DNA, 22 bp, Homo sapiens
caggcccagtgatcagggctct

SEQ ID NO: 7820964 - DNA, 22 bp, Homo sapiens
caggcccagtgatcagggctct

SEQ ID NO: 7820965 - DNA, 22 bp, Homo sapiens
caggcccaggggtctggcccac

SEQ ID NO: 7820966 - DNA, 22 bp, Homo sapiens
caggcccagggttattgggaaa

SEQ ID NO: 7820967 - DNA, 22 bp, Homo sapiens
caggcccagggttattgggaaa

SEQ ID NO: 7820968 - DNA, 22 bp, Homo sapiens
caggcccaggtgtcgatgttcc

SEQ ID NO: 7820969 - DNA, 22 bp, Homo sapiens
caggcccaggtgtcgatgttcc

SEQ ID NO: 7820970 - DNA, 22 bp, Homo sapiens
caggcccaggtgtcgatgttcc

SEQ ID NO: 7820971 - DNA, 22 bp, Homo sapiens
agctgtctttctgcctcctgat

SEQ ID NO: 7820972 - DNA, 22 bp, Homo sapiens
agctgtctttggagagggagag

SEQ ID NO: 7820973 - DNA, 22 bp, Homo sapiens
agctgtctttctgcctcctgat

SEQ ID NO: 7820974 - DNA, 22 bp, Homo sapiens
agctgtctttctgcctcctgat

SEQ ID NO: 7820975 - DNA, 22 bp, Homo sapiens
agctgtctttctgcctcctgat

SEQ ID NO: 7820976 - DNA, 22 bp, Homo sapiens
agctgtctttcattacctcatt

SEQ ID NO: 7820977 - DNA, 22 bp, Homo sapiens
agctgtctttcattacctcatt

SEQ ID NO: 7820978 - DNA, 22 bp, Homo sapiens
agctgtctgtctcctgaggaga

SEQ ID NO: 7820979 - DNA, 22 bp, Homo sapiens
agctgtctggaagttcctcatg

SEQ ID NO: 7820980 - DNA, 22 bp, Homo sapiens
agctgtctggaagttcctcatg

SEQ ID NO: 7820981 - DNA, 22 bp, Homo sapiens
agctgtctgtctcctgaggaga

SEQ ID NO: 7820982 - DNA, 22 bp, Homo sapiens
agctgtctgtctcctgaggaga

SEQ ID NO: 7820983 - DNA, 22 bp, Homo sapiens
agctgtctgtctcctgaggaga

SEQ ID NO: 7820984 - DNA, 22 bp, Homo sapiens
agctgtctgtgaacacagcatt

SEQ ID NO: 7820985 - DNA, 22 bp, Homo sapiens
agctgtctgtgaacacagcatt

SEQ ID NO: 7820986 - DNA, 22 bp, Homo sapiens
agcttcctgttgagagagggag

SEQ ID NO: 7820987 - DNA, 22 bp, Homo sapiens
agcttccttgaattctgtagaa

SEQ ID NO: 7820988 - DNA, 22 bp, Homo sapiens
agcttccttggcgctgaggcct

SEQ ID NO: 7820989 - DNA, 22 bp, Homo sapiens
agcttccttggcgctgaggcct

SEQ ID NO: 7820990 - DNA, 22 bp, Homo sapiens
agcttccttggcgctgaggcct

SEQ ID NO: 7820991 - DNA, 21 bp, Homo sapiens
agcttcctgcagtgggaggtc

SEQ ID NO: 7820992 - DNA, 21 bp, Homo sapiens
agcttcctgcagtgggaggtc

SEQ ID NO: 7820993 - DNA, 23 bp, Homo sapiens
agcttcctagtgacctggagtct

SEQ ID NO: 7820994 - DNA, 22 bp, Homo sapiens
agcttcctcacctcagaggtct

SEQ ID NO: 7820995 - DNA, 23 bp, Homo sapiens
agcttcctagtgacctggagtct

SEQ ID NO: 7820996 - DNA, 22 bp, Homo sapiens
agcttcctgactggtgctctta

SEQ ID NO: 7820997 - DNA, 22 bp, Homo sapiens
agcttcctcacctcagaggtct

SEQ ID NO: 7820998 - DNA, 22 bp, Homo sapiens
agcttcccaggagaatcaggga

SEQ ID NO: 7820999 - DNA, 18 bp, Homo sapiens
agcttccctctgagaggg

SEQ ID NO: 7821000 - DNA, 21 bp, Homo sapiens
caggctctgctgggtgctggg

SEQ ID NO: 7821001 - DNA, 21 bp, Homo sapiens
caggctctgctgggtgctggg

SEQ ID NO: 7821002 - DNA, 22 bp, Homo sapiens
caggctcttccatcctgctgag

SEQ ID NO: 7821003 - DNA, 22 bp, Homo sapiens
caggctcttccatcctgctgag

SEQ ID NO: 7821004 - DNA, 22 bp, Homo sapiens
caggctcttccatcctgctgag

SEQ ID NO: 7821005 - DNA, 22 bp, Homo sapiens
caggctcttccatcctgctgag

SEQ ID NO: 7821006 - DNA, 22 bp, Homo sapiens
caggctcttccatcctgctgag

SEQ ID NO: 7821007 - DNA, 21 bp, Homo sapiens
caggctctgctgggtgctggg

SEQ ID NO: 7821008 - DNA, 22 bp, Homo sapiens
caggctctgctgctacagctgt

SEQ ID NO: 7821009 - DNA, 22 bp, Homo sapiens
caggctctgctgctacagctgt

SEQ ID NO: 7821010 - DNA, 21 bp, Homo sapiens
caggctctgctagaggagcct

SEQ ID NO: 7821011 - DNA, 22 bp, Homo sapiens
caggctctgctgctacagctgt

SEQ ID NO: 7821012 - DNA, 21 bp, Homo sapiens
caggctctgctagaggagcct

SEQ ID NO: 7821013 - DNA, 22 bp, Homo sapiens
agcttctcagcttcagaactgt

SEQ ID NO: 7821014 - DNA, 21 bp, Homo sapiens
caggctctgctagaggagcct

SEQ ID NO: 7821015 - DNA, 21 bp, Homo sapiens
caggctctgctagaggagcct

SEQ ID NO: 7821016 - DNA, 22 bp, Homo sapiens
agcttctcagaagagtcctgta

SEQ ID NO: 7821017 - DNA, 22 bp, Homo sapiens
agcttctcagaagagtcctgta

SEQ ID NO: 7821018 - DNA, 22 bp, Homo sapiens
agcttctcagaagagtcctgta

SEQ ID NO: 7821019 - DNA, 22 bp, Homo sapiens
agcttctcagaagagtcctgta

SEQ ID NO: 7821020 - DNA, 22 bp, Homo sapiens
agcttctcagaagagtcctgta

SEQ ID NO: 7821021 - DNA, 22 bp, Homo sapiens
agcttctcagatggactgttag

SEQ ID NO: 7821022 - DNA, 22 bp, Homo sapiens
agcttctcaagtgtttgcgggg

SEQ ID NO: 7821023 - DNA, 22 bp, Homo sapiens
aggaagagctggaccagaggac

SEQ ID NO: 7821024 - DNA, 22 bp, Homo sapiens
aggaagagctggaccagaggac

SEQ ID NO: 7821025 - DNA, 22 bp, Homo sapiens
aggaagagctggaccagaggac

SEQ ID NO: 7821026 - DNA, 22 bp, Homo sapiens
aggaagagctggaccagaggac

SEQ ID NO: 7821027 - DNA, 22 bp, Homo sapiens
aggaagagctggaccagaggac

SEQ ID NO: 7821028 - DNA, 22 bp, Homo sapiens
aggaagagctggaccagaggac

SEQ ID NO: 7821029 - DNA, 22 bp, Homo sapiens
aggaagagctggaccagaggac

SEQ ID NO: 7821030 - DNA, 22 bp, Homo sapiens
aggaagagctggaccagaggac

SEQ ID NO: 7821031 - DNA, 22 bp, Homo sapiens
aggaagagctggaccagaggac

SEQ ID NO: 7821032 - DNA, 22 bp, Homo sapiens
aggaagagctggaccagaggac

SEQ ID NO: 7821033 - DNA, 22 bp, Homo sapiens
aggaagagctggaccagaggac

SEQ ID NO: 7821034 - DNA, 22 bp, Homo sapiens
aggaagagcccgggtgacataa

SEQ ID NO: 7821035 - DNA, 22 bp, Homo sapiens
aggaagagctggaccagaggac

SEQ ID NO: 7821036 - DNA, 22 bp, Homo sapiens
aggaagagctggaccagaggac

SEQ ID NO: 7821037 - DNA, 22 bp, Homo sapiens
aggaagagcccgggtgacataa

SEQ ID NO: 7821038 - DNA, 22 bp, Homo sapiens
aggaagagcccgggtgacataa

SEQ ID NO: 7821039 - DNA, 22 bp, Homo sapiens
aggaagagcattcacatggtag

SEQ ID NO: 7821040 - DNA, 22 bp, Homo sapiens
aggaagagcccgggtgacataa

SEQ ID NO: 7821041 - DNA, 22 bp, Homo sapiens
aggaagagcccgggtgacataa

SEQ ID NO: 7821042 - DNA, 22 bp, Homo sapiens
aggaagagcccgggtgacataa

SEQ ID NO: 7821043 - DNA, 22 bp, Homo sapiens
aggaagagctggaccagaggac

SEQ ID NO: 7821044 - DNA, 22 bp, Homo sapiens
aggaagagctggaccagaggac

SEQ ID NO: 7821045 - DNA, 22 bp, Homo sapiens
aggaagagctggaccagaggac

SEQ ID NO: 7821046 - DNA, 23 bp, Homo sapiens
aggaagaggcaatttctcttaga

SEQ ID NO: 7821047 - DNA, 23 bp, Homo sapiens
aggaagaggcaatttctcttaga

SEQ ID NO: 7821048 - DNA, 22 bp, Homo sapiens
aggaagagggtggcagataatc

SEQ ID NO: 7821049 - DNA, 18 bp, Homo sapiens
cagggctgtggggtcact

SEQ ID NO: 7821050 - DNA, 18 bp, Homo sapiens
cagggctgtggggtcact

SEQ ID NO: 7821051 - DNA, 18 bp, Homo sapiens
cagggctgtggggtcact

SEQ ID NO: 7821052 - DNA, 18 bp, Homo sapiens
cagggctgtggggtcact

SEQ ID NO: 7821053 - DNA, 18 bp, Homo sapiens
cagggctgtggggtcact

SEQ ID NO: 7821054 - DNA, 23 bp, Homo sapiens
aggaagaggcaatttctcttaga

SEQ ID NO: 7821055 - DNA, 23 bp, Homo sapiens
aggaagaggcaatttctcttaga

SEQ ID NO: 7821056 - DNA, 23 bp, Homo sapiens
aggaagaggcaatttctcttaga

SEQ ID NO: 7821057 - DNA, 22 bp, Homo sapiens
cagggctgttagctgctgctct

SEQ ID NO: 7821058 - DNA, 22 bp, Homo sapiens
cagggctgttagctgctgctct

SEQ ID NO: 7821059 - DNA, 18 bp, Homo sapiens
cagggctgtggggtcact

SEQ ID NO: 7821060 - DNA, 22 bp, Homo sapiens
cagggctgttagctgctgctct

SEQ ID NO: 7821061 - DNA, 22 bp, Homo sapiens
cagggctgttagctgctgctct

SEQ ID NO: 7821062 - DNA, 22 bp, Homo sapiens
cagggctgttagctgctgctct

SEQ ID NO: 7821063 - DNA, 22 bp, Homo sapiens
cagggctgttagctgctgctct

SEQ ID NO: 7821064 - DNA, 22 bp, Homo sapiens
cagggctgttagctgctgctct

SEQ ID NO: 7821065 - DNA, 18 bp, Homo sapiens
cagggctgtggggtcact

SEQ ID NO: 7821066 - DNA, 18 bp, Homo sapiens
cagggctgtggggtcact

SEQ ID NO: 7821067 - DNA, 18 bp, Homo sapiens
cagggctgtggggtcact

SEQ ID NO: 7821068 - DNA, 18 bp, Homo sapiens
cagggctgtggggtcact

SEQ ID NO: 7821069 - DNA, 18 bp, Homo sapiens
cagggctgtggggtcact

SEQ ID NO: 7821070 - DNA, 22 bp, Homo sapiens
cagggctggcttccaagttgtt

SEQ ID NO: 7821071 - DNA, 22 bp, Homo sapiens
cagggctggcttccaagttgtt

SEQ ID NO: 7821072 - DNA, 22 bp, Homo sapiens
cagggctggctgtggcaatctc

SEQ ID NO: 7821073 - DNA, 22 bp, Homo sapiens
cagggctggctgtggcaatctc

SEQ ID NO: 7821074 - DNA, 22 bp, Homo sapiens
cagggctggctgtggcaatctc

SEQ ID NO: 7821075 - DNA, 22 bp, Homo sapiens
cagggctggcttccaagttgtt

SEQ ID NO: 7821076 - DNA, 23 bp, Homo sapiens
cagggctgggcttggtgttaggc

SEQ ID NO: 7821077 - DNA, 22 bp, Homo sapiens
cagggctgggttaaaagcaggg

SEQ ID NO: 7821078 - DNA, 23 bp, Homo sapiens
cagggctgggcttggtgttaggc

SEQ ID NO: 7821079 - DNA, 23 bp, Homo sapiens
cagggctgggcttggtgttaggc

SEQ ID NO: 7821080 - DNA, 23 bp, Homo sapiens
cagggctgggcttggtgttaggc

SEQ ID NO: 7821081 - DNA, 23 bp, Homo sapiens
cagggctgggcttggtgttaggc

SEQ ID NO: 7821082 - DNA, 22 bp, Homo sapiens
cagggctgggttaaaagcaggg

SEQ ID NO: 7821083 - DNA, 22 bp, Homo sapiens
cagggctgggttaaaagcaggg

SEQ ID NO: 7821084 - DNA, 22 bp, Homo sapiens
cagggctgggttaaaagcaggg

SEQ ID NO: 7821085 - DNA, 19 bp, Homo sapiens
aggaaaggatcaaaatagc

SEQ ID NO: 7821086 - DNA, 21 bp, Homo sapiens
aggaaaggaagtccccagggt

SEQ ID NO: 7821087 - DNA, 19 bp, Homo sapiens
aggaaaggatcaaaatagc

SEQ ID NO: 7821088 - DNA, 22 bp, Homo sapiens
aggaaaggattggcttctctgt

SEQ ID NO: 7821089 - DNA, 19 bp, Homo sapiens
aggaaaggatcaaaatagc

SEQ ID NO: 7821090 - DNA, 22 bp, Homo sapiens
aggaaaggattggcttctctgt

SEQ ID NO: 7821091 - DNA, 22 bp, Homo sapiens
aggaaaggattggcttctctgt

SEQ ID NO: 7821092 - DNA, 22 bp, Homo sapiens
aggaaaggcctcagcagaaacc

SEQ ID NO: 7821093 - DNA, 22 bp, Homo sapiens
aggaaaggcctcagcagaaacc

SEQ ID NO: 7821094 - DNA, 22 bp, Homo sapiens
aggaaaggcctcagcagaaacc

SEQ ID NO: 7821095 - DNA, 22 bp, Homo sapiens
aggaaaggcctcagcagaaacc

SEQ ID NO: 7821096 - DNA, 22 bp, Homo sapiens
aggaaaggcctcagcagaaacc

SEQ ID NO: 7821097 - DNA, 21 bp, Homo sapiens
aggaaaggccagcacgtaggg

SEQ ID NO: 7821098 - DNA, 21 bp, Homo sapiens
aggaaaggccagcacgtaggg

SEQ ID NO: 7821099 - DNA, 21 bp, Homo sapiens
aggaaaggccagcacgtaggg

SEQ ID NO: 7821100 - DNA, 21 bp, Homo sapiens
aggaaaggccagcacgtaggg

SEQ ID NO: 7821101 - DNA, 21 bp, Homo sapiens
aggaaaggccagcacgtaggg

SEQ ID NO: 7821102 - DNA, 22 bp, Homo sapiens
aggaaaggattggcttctctgt

SEQ ID NO: 7821103 - DNA, 22 bp, Homo sapiens
aggaagaaaactaattagatgg

SEQ ID NO: 7821104 - DNA, 22 bp, Homo sapiens
aggaagaaaactaattagatgg

SEQ ID NO: 7821105 - DNA, 22 bp, Homo sapiens
aggaagaaaactaattagatgg

SEQ ID NO: 7821106 - DNA, 22 bp, Homo sapiens
aggaagaaacctactagagttt

SEQ ID NO: 7821107 - DNA, 22 bp, Homo sapiens
aggaagaaacctactagagttt

SEQ ID NO: 7821108 - DNA, 22 bp, Homo sapiens
aggaaaggcctcagcagaaacc

SEQ ID NO: 7821109 - DNA, 22 bp, Homo sapiens
aggaaaggcctttgcatttggt

SEQ ID NO: 7821110 - DNA, 22 bp, Homo sapiens
aggaaaggcctttgcatttggt

SEQ ID NO: 7821111 - DNA, 22 bp, Homo sapiens
aggaaaggcctcagcagaaacc

SEQ ID NO: 7821112 - DNA, 22 bp, Homo sapiens
aggaaaggcctttgcatttggt

SEQ ID NO: 7821113 - DNA, 22 bp, Homo sapiens
aggaaaggcctttgcatttggt

SEQ ID NO: 7821114 - DNA, 22 bp, Homo sapiens
agctttctgtcacctgtgcttg

SEQ ID NO: 7821115 - DNA, 22 bp, Homo sapiens
agctttcttctagttgtacagt

SEQ ID NO: 7821116 - DNA, 22 bp, Homo sapiens
agctttcttctagttgtacagt

SEQ ID NO: 7821117 - DNA, 22 bp, Homo sapiens
agctttcttctagttgtacagt

SEQ ID NO: 7821118 - DNA, 22 bp, Homo sapiens
agctttcttctagttgtacagt

SEQ ID NO: 7821119 - DNA, 22 bp, Homo sapiens
agctttctggttacagtcttca

SEQ ID NO: 7821120 - DNA, 22 bp, Homo sapiens
agctttcttctagttgtacagt

SEQ ID NO: 7821121 - DNA, 22 bp, Homo sapiens
agctttcttgattttgcctgta

SEQ ID NO: 7821122 - DNA, 22 bp, Homo sapiens
agctttgaaaatccaaattaca

SEQ ID NO: 7821123 - DNA, 22 bp, Homo sapiens
agctttgaaaatccaaattaca

SEQ ID NO: 7821124 - DNA, 22 bp, Homo sapiens
agctttgaatctggtgtttgca

SEQ ID NO: 7821125 - DNA, 22 bp, Homo sapiens
agctttgaagtatttggtctcc

SEQ ID NO: 7821126 - DNA, 22 bp, Homo sapiens
agctttgaagtatttggtctcc

SEQ ID NO: 7821127 - DNA, 22 bp, Homo sapiens
agctttgcattcaaactgatgt

SEQ ID NO: 7821128 - DNA, 22 bp, Homo sapiens
agctttgcttctgggagccaag

SEQ ID NO: 7821129 - DNA, 22 bp, Homo sapiens
agctttggatgatctttgatac

SEQ ID NO: 7821130 - DNA, 19 bp, Homo sapiens
agctttggacttgcatttc

SEQ ID NO: 7821131 - DNA, 22 bp, Homo sapiens
agctttgcacaacagagaggtg

SEQ ID NO: 7821132 - DNA, 22 bp, Homo sapiens
agctttgcaacctgaggccagt

SEQ ID NO: 7821133 - DNA, 22 bp, Homo sapiens
agctttgcaacctgaggccagt

SEQ ID NO: 7821134 - DNA, 22 bp, Homo sapiens
agctttgcactgagacagctca

SEQ ID NO: 7821135 - DNA, 22 bp, Homo sapiens
agctttgatagtacaggggctt

SEQ ID NO: 7821136 - DNA, 23 bp, Homo sapiens
agctttgaggactttaaaagata

SEQ ID NO: 7821137 - DNA, 23 bp, Homo sapiens
agctttgaggactttaaaagata

SEQ ID NO: 7821138 - DNA, 22 bp, Homo sapiens
agctttgaatgagtgcattgca

SEQ ID NO: 7821139 - DNA, 22 bp, Homo sapiens
agctttgggattcaggcaggaa

SEQ ID NO: 7821140 - DNA, 22 bp, Homo sapiens
agctttgggattcaggcaggaa

SEQ ID NO: 7821141 - DNA, 22 bp, Homo sapiens
agctttggcttctgttgaacct

SEQ ID NO: 7821142 - DNA, 22 bp, Homo sapiens
agctttggcttctgttgaacct

SEQ ID NO: 7821143 - DNA, 22 bp, Homo sapiens
agctttggctgtgttgctctgt

SEQ ID NO: 7821144 - DNA, 22 bp, Homo sapiens
agctttggccctggaggttact

SEQ ID NO: 7821145 - DNA, 22 bp, Homo sapiens
agctttggccctggaggttact

SEQ ID NO: 7821146 - DNA, 22 bp, Homo sapiens
agctttggccctggaggttact

SEQ ID NO: 7821147 - DNA, 22 bp, Homo sapiens
agctttggatgatctttgatac

SEQ ID NO: 7821148 - DNA, 22 bp, Homo sapiens
agctttggatttcttatagccc

SEQ ID NO: 7821149 - DNA, 20 bp, Homo sapiens
cagggctctgggcctggcct

SEQ ID NO: 7821150 - DNA, 22 bp, Homo sapiens
cagggctctgccttgagggatg

SEQ ID NO: 7821151 - DNA, 22 bp, Homo sapiens
cagggctctgccttgagggatg

SEQ ID NO: 7821152 - DNA, 22 bp, Homo sapiens
agctttgggcagaagaggattc

SEQ ID NO: 7821153 - DNA, 22 bp, Homo sapiens
agctttgggcaaaggcttgtga

SEQ ID NO: 7821154 - DNA, 22 bp, Homo sapiens
cagggctggatttcatttctag

SEQ ID NO: 7821155 - DNA, 22 bp, Homo sapiens
cagggctggctcatgaaaagtt

SEQ ID NO: 7821156 - DNA, 22 bp, Homo sapiens
cagggctggctcatgaaaagtt

SEQ ID NO: 7821157 - DNA, 20 bp, Homo sapiens
cagggctctgggcctggcct

SEQ ID NO: 7821158 - DNA, 20 bp, Homo sapiens
cagggctctgggcctggcct

SEQ ID NO: 7821159 - DNA, 20 bp, Homo sapiens
cagggctctgggcctggcct

SEQ ID NO: 7821160 - DNA, 22 bp, Homo sapiens
cagggctggctcatgaaaagtt

SEQ ID NO: 7821161 - DNA, 22 bp, Homo sapiens
cagggctggctgtggcaatctc

SEQ ID NO: 7821162 - DNA, 22 bp, Homo sapiens
cagggctggctgtggcaatctc

SEQ ID NO: 7821163 - DNA, 22 bp, Homo sapiens
cagggctggctgtggcaatctc

SEQ ID NO: 7821164 - DNA, 22 bp, Homo sapiens
cagggctggctgtggcaatctc

SEQ ID NO: 7821165 - DNA, 22 bp, Homo sapiens
cagggctggctgtggcaatctc

SEQ ID NO: 7821166 - DNA, 22 bp, Homo sapiens
cagggctggctgtggcaatctc

SEQ ID NO: 7821167 - DNA, 22 bp, Homo sapiens
cagggctggctgtggcaatctc

SEQ ID NO: 7821168 - DNA, 22 bp, Homo sapiens
cagggatgtgatgagctgagcc

SEQ ID NO: 7821169 - DNA, 22 bp, Homo sapiens
cagggatgtgatgagctgagcc

SEQ ID NO: 7821170 - DNA, 22 bp, Homo sapiens
caggctgagctctggcctgggc

SEQ ID NO: 7821171 - DNA, 22 bp, Homo sapiens
caggctgacaactgagcatttt

SEQ ID NO: 7821172 - DNA, 22 bp, Homo sapiens
cagggcaggatgctgtgattat

SEQ ID NO: 7821173 - DNA, 22 bp, Homo sapiens
cagggcaggatgctgtgattat

SEQ ID NO: 7821174 - DNA, 22 bp, Homo sapiens
cagggcaggatgctgtgattat

SEQ ID NO: 7821175 - DNA, 22 bp, Homo sapiens
cagggcaggatgctgtgattat

SEQ ID NO: 7821176 - DNA, 22 bp, Homo sapiens
cagggcaaagagagcacatgct

SEQ ID NO: 7821177 - DNA, 22 bp, Homo sapiens
cagggcaggatgctgtgattat

SEQ ID NO: 7821178 - DNA, 22 bp, Homo sapiens
caggctcttttggtggcaagga

SEQ ID NO: 7821179 - DNA, 22 bp, Homo sapiens
caggctcttttggtggcaagga

SEQ ID NO: 7821180 - DNA, 22 bp, Homo sapiens
caggctcttttggtggcaagga

SEQ ID NO: 7821181 - DNA, 22 bp, Homo sapiens
caggctcttttggtggcaagga

SEQ ID NO: 7821182 - DNA, 22 bp, Homo sapiens
caggctcttttggtggcaagga

SEQ ID NO: 7821183 - DNA, 22 bp, Homo sapiens
caggctcttccatcctgctgag

SEQ ID NO: 7821184 - DNA, 22 bp, Homo sapiens
caggctcttccatcctgctgag

SEQ ID NO: 7821185 - DNA, 22 bp, Homo sapiens
caggctcttttggtggcaagga

SEQ ID NO: 7821186 - DNA, 22 bp, Homo sapiens
caggctgacaactgagcatttt

SEQ ID NO: 7821187 - DNA, 22 bp, Homo sapiens
caggctgacaactgagcatttt

SEQ ID NO: 7821188 - DNA, 22 bp, Homo sapiens
caggctgaagtgcagtggtgtg

SEQ ID NO: 7821189 - DNA, 22 bp, Homo sapiens
caggctgaagtgcagtggtgtg

SEQ ID NO: 7821190 - DNA, 22 bp, Homo sapiens
cagggcagtaacgggaacatct

SEQ ID NO: 7821191 - DNA, 22 bp, Homo sapiens
cagggcagtaacgggaacatct

SEQ ID NO: 7821192 - DNA, 22 bp, Homo sapiens
cagggcagtaacgggaacatct

SEQ ID NO: 7821193 - DNA, 22 bp, Homo sapiens
cagggcagtaacgggaacatct

SEQ ID NO: 7821194 - DNA, 22 bp, Homo sapiens
cagggcagtaacgggaacatct

SEQ ID NO: 7821195 - DNA, 22 bp, Homo sapiens
cagggcagtaacgggaacatct

SEQ ID NO: 7821196 - DNA, 22 bp, Homo sapiens
cagggcagggccacaccccctg

SEQ ID NO: 7821197 - DNA, 22 bp, Homo sapiens
cagggcagggccacaccccctg

SEQ ID NO: 7821198 - DNA, 22 bp, Homo sapiens
cagggcagggccacaccccctg

SEQ ID NO: 7821199 - DNA, 22 bp, Homo sapiens
cagggcagtaacgggaacatct

SEQ ID NO: 7821200 - DNA, 22 bp, Homo sapiens
cagggcagggccacaccccctg

SEQ ID NO: 7821201 - DNA, 22 bp, Homo sapiens
cagggcagggatgttgcggcag

SEQ ID NO: 7821202 - DNA, 22 bp, Homo sapiens
cagggcagggatgttgcggcag

SEQ ID NO: 7821203 - DNA, 22 bp, Homo sapiens
cagggcagggatgttgcggcag

SEQ ID NO: 7821204 - DNA, 22 bp, Homo sapiens
cagggcagggatgttgcggcag

SEQ ID NO: 7821205 - DNA, 22 bp, Homo sapiens
cagggcagggatgttgcggcag

SEQ ID NO: 7821206 - DNA, 22 bp, Homo sapiens
cagggcaggatgctgtgattat

SEQ ID NO: 7821207 - DNA, 22 bp, Homo sapiens
cagggcagggagcttagaatga

SEQ ID NO: 7821208 - DNA, 22 bp, Homo sapiens
cagggcagggagcttagaatga

SEQ ID NO: 7821209 - DNA, 22 bp, Homo sapiens
cagggcagggagcttagaatga

SEQ ID NO: 7821210 - DNA, 22 bp, Homo sapiens
cagtatgtgatgcaacggaata

SEQ ID NO: 7821211 - DNA, 22 bp, Homo sapiens
cagtatgtctactggacaaagt

SEQ ID NO: 7821212 - DNA, 22 bp, Homo sapiens
cagtatgtctactggacaaagt

SEQ ID NO: 7821213 - DNA, 22 bp, Homo sapiens
cagtatgcagttgaaaataagc

SEQ ID NO: 7821214 - DNA, 22 bp, Homo sapiens
cagtatgtactcttatcatgta

SEQ ID NO: 7821215 - DNA, 22 bp, Homo sapiens
cagtatgactacaaacagcttt

SEQ ID NO: 7821216 - DNA, 22 bp, Homo sapiens
cagtatcttatgaaccctgatc

SEQ ID NO: 7821217 - DNA, 22 bp, Homo sapiens
cagtatcttgcttatagacaca

SEQ ID NO: 7821218 - DNA, 22 bp, Homo sapiens
cagtatgagagttgaatcaagg

SEQ ID NO: 7821219 - DNA, 22 bp, Homo sapiens
cagtatgactacaaacagcttt

SEQ ID NO: 7821220 - DNA, 22 bp, Homo sapiens
cagtatgagagttgaatcaagg

SEQ ID NO: 7821221 - DNA, 22 bp, Homo sapiens
cagtaagtattcgagtctccat

SEQ ID NO: 7821222 - DNA, 22 bp, Homo sapiens
cagtaagtattcgagtctccat

SEQ ID NO: 7821223 - DNA, 22 bp, Homo sapiens
cagtaataaagctaagtatttc

SEQ ID NO: 7821224 - DNA, 22 bp, Homo sapiens
cagtaataaagctaagtatttc

SEQ ID NO: 7821225 - DNA, 22 bp, Homo sapiens
cagtaaggatgcacataactag

SEQ ID NO: 7821226 - DNA, 22 bp, Homo sapiens
cagtaagagttgacaatggcca

SEQ ID NO: 7821227 - DNA, 22 bp, Homo sapiens
cagtaagaatatgaatcaggat

SEQ ID NO: 7821228 - DNA, 22 bp, Homo sapiens
cagtatctgtcagtaatcaggt

SEQ ID NO: 7821229 - DNA, 22 bp, Homo sapiens
cagtaatacccctggctcaggt

SEQ ID NO: 7821230 - DNA, 20 bp, Homo sapiens
cagtattgatccattgtctg

SEQ ID NO: 7821231 - DNA, 22 bp, Homo sapiens
cagtatttaggattaggagaga

SEQ ID NO: 7821232 - DNA, 22 bp, Homo sapiens
cagtatttaggattaggagaga

SEQ ID NO: 7821233 - DNA, 22 bp, Homo sapiens
cagtatgtttgggagacatgac

SEQ ID NO: 7821234 - DNA, 22 bp, Homo sapiens
cagtatgtttgggagacatgac

SEQ ID NO: 7821235 - DNA, 22 bp, Homo sapiens
cagtatgtttattagaactgca

SEQ ID NO: 7821236 - DNA, 22 bp, Homo sapiens
cagtatgtttgggagacatgac

SEQ ID NO: 7821237 - DNA, 22 bp, Homo sapiens
cagtatttcattcagaattgtt

SEQ ID NO: 7821238 - DNA, 22 bp, Homo sapiens
cagtatttcattcagaattgtt

SEQ ID NO: 7821239 - DNA, 22 bp, Homo sapiens
cagtatttcattcagaattgtt

SEQ ID NO: 7821240 - DNA, 22 bp, Homo sapiens
cagtatttatggcttgagtatt

SEQ ID NO: 7821241 - DNA, 22 bp, Homo sapiens
cagtatttatggcttgagtatt

SEQ ID NO: 7821242 - DNA, 22 bp, Homo sapiens
cagtatttaggattaggagaga

SEQ ID NO: 7821243 - DNA, 22 bp, Homo sapiens
cagtatttatggcttgagtatt

SEQ ID NO: 7821244 - DNA, 22 bp, Homo sapiens
cagtatttatggcttgagtatt

SEQ ID NO: 7821245 - DNA, 22 bp, Homo sapiens
cagtatttgttacagcattagc

SEQ ID NO: 7821246 - DNA, 22 bp, Homo sapiens
cagtatttgttacagcattagc

SEQ ID NO: 7821247 - DNA, 22 bp, Homo sapiens
cagtatttggtaattggctacc

SEQ ID NO: 7821248 - DNA, 22 bp, Homo sapiens
cagtatttgttacagcattagc

SEQ ID NO: 7821249 - DNA, 22 bp, Homo sapiens
cagtatttgttccctatcaatg

SEQ ID NO: 7821250 - DNA, 22 bp, Homo sapiens
cagtatttgttacagcattagc

SEQ ID NO: 7821251 - DNA, 22 bp, Homo sapiens
cagtatttgttacagcattagc

SEQ ID NO: 7821252 - DNA, 22 bp, Homo sapiens
cagtatttcctcttcttaactt

SEQ ID NO: 7821253 - DNA, 22 bp, Homo sapiens
cagtatttcctcttcttaactt

SEQ ID NO: 7821254 - DNA, 22 bp, Homo sapiens
cagtatttcctcttcttaactt

SEQ ID NO: 7821255 - DNA, 22 bp, Homo sapiens
cagtatttggaatatagctaag

SEQ ID NO: 7821256 - DNA, 22 bp, Homo sapiens
cagtaactaggacaaggaggaa

SEQ ID NO: 7821257 - DNA, 22 bp, Homo sapiens
cagtaacacaaccactccgtga

SEQ ID NO: 7821258 - DNA, 22 bp, Homo sapiens
cagtaacatttcaaggtagagg

SEQ ID NO: 7821259 - DNA, 22 bp, Homo sapiens
cagtaacatgaagagacatgga

SEQ ID NO: 7821260 - DNA, 22 bp, Homo sapiens
cagtaacatgaagagacatgga

SEQ ID NO: 7821261 - DNA, 22 bp, Homo sapiens
cagtaacatgtctgttaagaaa

SEQ ID NO: 7821262 - DNA, 22 bp, Homo sapiens
cagtaacatgtctgttaagaaa

SEQ ID NO: 7821263 - DNA, 22 bp, Homo sapiens
cagtaacatgaagagacatgga

SEQ ID NO: 7821264 - DNA, 22 bp, Homo sapiens
cagtaacagtgatcacctgtgg

SEQ ID NO: 7821265 - DNA, 22 bp, Homo sapiens
cagtaacatgaagagacatgga

SEQ ID NO: 7821266 - DNA, 22 bp, Homo sapiens
cagtaacaggctctgtggtata

SEQ ID NO: 7821267 - DNA, 22 bp, Homo sapiens
cagtaacaggctctgtggtata

SEQ ID NO: 7821268 - DNA, 22 bp, Homo sapiens
cagtaacagtgatcacctgtgg

SEQ ID NO: 7821269 - DNA, 22 bp, Homo sapiens
cagtaacaggctctgtggtata

SEQ ID NO: 7821270 - DNA, 22 bp, Homo sapiens
cagtaaatgatgatagtgcctt

SEQ ID NO: 7821271 - DNA, 22 bp, Homo sapiens
cagtaaatgcagatatagatac

SEQ ID NO: 7821272 - DNA, 22 bp, Homo sapiens
cagtaaatgcagatatagatac

SEQ ID NO: 7821273 - DNA, 22 bp, Homo sapiens
cagtaaatctctatctgccatt

SEQ ID NO: 7821274 - DNA, 22 bp, Homo sapiens
cagtaaatcctagagccctcat

SEQ ID NO: 7821275 - DNA, 22 bp, Homo sapiens
cagtaaatgtgatttttcttgt

SEQ ID NO: 7821276 - DNA, 22 bp, Homo sapiens
cagtaaattatctcatctctgt

SEQ ID NO: 7821277 - DNA, 22 bp, Homo sapiens
cagtaaacagttactaagaaga

SEQ ID NO: 7821278 - DNA, 22 bp, Homo sapiens
cagtaaacactagcattcttgg

SEQ ID NO: 7821279 - DNA, 22 bp, Homo sapiens
aggacagcaaccgttattcaca

SEQ ID NO: 7821280 - DNA, 22 bp, Homo sapiens
aggacagcaaccgttattcaca

SEQ ID NO: 7821281 - DNA, 23 bp, Homo sapiens
aggacagcaaaccccgcctcccc

SEQ ID NO: 7821282 - DNA, 22 bp, Homo sapiens
cagtaaagagccttcattaaat

SEQ ID NO: 7821283 - DNA, 22 bp, Homo sapiens
cagtaaacagttactaagaaga

SEQ ID NO: 7821284 - DNA, 22 bp, Homo sapiens
cagtaaacagttactaagaaga

SEQ ID NO: 7821285 - DNA, 22 bp, Homo sapiens
cagtaaacagttactaagaaga

SEQ ID NO: 7821286 - DNA, 22 bp, Homo sapiens
cagtaaagagccttcattaaat

SEQ ID NO: 7821287 - DNA, 22 bp, Homo sapiens
cagtaaagcatgtatgtcttca

SEQ ID NO: 7821288 - DNA, 22 bp, Homo sapiens
cagtaaagcatgtatgtcttca

SEQ ID NO: 7821289 - DNA, 22 bp, Homo sapiens
cagtaaagcatgtatgtcttca

SEQ ID NO: 7821290 - DNA, 22 bp, Homo sapiens
cagtaaaggttttatggggctt

SEQ ID NO: 7821291 - DNA, 22 bp, Homo sapiens
cagtaaatataggaacgtggaa

SEQ ID NO: 7821292 - DNA, 22 bp, Homo sapiens
cagtaaatacatatcagagaag

SEQ ID NO: 7821293 - DNA, 22 bp, Homo sapiens
aggacagagggaccagagccca

SEQ ID NO: 7821294 - DNA, 22 bp, Homo sapiens
aggacagagggaccagagccca

SEQ ID NO: 7821295 - DNA, 22 bp, Homo sapiens
aggacagagggaccagagccca

SEQ ID NO: 7821296 - DNA, 22 bp, Homo sapiens
aggacagagggaccagagccca

SEQ ID NO: 7821297 - DNA, 22 bp, Homo sapiens
aggacagagggaccagagccca

SEQ ID NO: 7821298 - DNA, 22 bp, Homo sapiens
aggacagagggaccagagccca

SEQ ID NO: 7821299 - DNA, 22 bp, Homo sapiens
aggacagagggaccagagccca

SEQ ID NO: 7821300 - DNA, 22 bp, Homo sapiens
aggacagagggaccagagccca

SEQ ID NO: 7821301 - DNA, 22 bp, Homo sapiens
aggacagagggaccagagccca

SEQ ID NO: 7821302 - DNA, 22 bp, Homo sapiens
aggacagagggaccagagccca

SEQ ID NO: 7821303 - DNA, 22 bp, Homo sapiens
aggacagatttttggccaccag

SEQ ID NO: 7821304 - DNA, 21 bp, Homo sapiens
aggacagatgtaggaataaag

SEQ ID NO: 7821305 - DNA, 22 bp, Homo sapiens
aggacaagacaaggaccagaga

SEQ ID NO: 7821306 - DNA, 22 bp, Homo sapiens
aggaatctgggcccaactgtgc

SEQ ID NO: 7821307 - DNA, 22 bp, Homo sapiens
aggaatctgtggttttaacagg

SEQ ID NO: 7821308 - DNA, 22 bp, Homo sapiens
aggaatctgtggttttaacagg

SEQ ID NO: 7821309 - DNA, 22 bp, Homo sapiens
aggaatgaactcgagtgatctg

SEQ ID NO: 7821310 - DNA, 22 bp, Homo sapiens
aggaatcccgcaccagctgctg

SEQ ID NO: 7821311 - DNA, 22 bp, Homo sapiens
aggaatcaggagatgagcacgg

SEQ ID NO: 7821312 - DNA, 22 bp, Homo sapiens
aggaatcagaattcttagaatt

SEQ ID NO: 7821313 - DNA, 22 bp, Homo sapiens
aggaatcaggagatgagcacgg

SEQ ID NO: 7821314 - DNA, 22 bp, Homo sapiens
aggaatattctcaagtggtcgt

SEQ ID NO: 7821315 - DNA, 22 bp, Homo sapiens
aggaatattctcaagtggtcgt

SEQ ID NO: 7821316 - DNA, 18 bp, Homo sapiens
aggaatattcaaggtgct

SEQ ID NO: 7821317 - DNA, 18 bp, Homo sapiens
aggaatattcaaggtgct

SEQ ID NO: 7821318 - DNA, 22 bp, Homo sapiens
aggaatatggatttgctcagct

SEQ ID NO: 7821319 - DNA, 22 bp, Homo sapiens
aggaatagaccacttcactgag

SEQ ID NO: 7821320 - DNA, 22 bp, Homo sapiens
aggaatagctgttaaagtcaat

SEQ ID NO: 7821321 - DNA, 22 bp, Homo sapiens
aggaatatagttggaatgtagg

SEQ ID NO: 7821322 - DNA, 22 bp, Homo sapiens
aggaatatagttggaatgtagg

SEQ ID NO: 7821323 - DNA, 22 bp, Homo sapiens
aggaatatgagctgctgcagtg

SEQ ID NO: 7821324 - DNA, 22 bp, Homo sapiens
aggaatatgagctgctgcagtg

SEQ ID NO: 7821325 - DNA, 22 bp, Homo sapiens
aggaatatgagctgctgcagtg

SEQ ID NO: 7821326 - DNA, 21 bp, Homo sapiens
aggaagtggccagattgggaa

SEQ ID NO: 7821327 - DNA, 22 bp, Homo sapiens
aggaagtggggttctctcactg

SEQ ID NO: 7821328 - DNA, 22 bp, Homo sapiens
aggaagtggggttctctcactg

SEQ ID NO: 7821329 - DNA, 23 bp, Homo sapiens
aggaagttatgaagggagaatag

SEQ ID NO: 7821330 - DNA, 22 bp, Homo sapiens
aggaagttagtaaattatgtgc

SEQ ID NO: 7821331 - DNA, 22 bp, Homo sapiens
aggacactgctgaggatcagat

SEQ ID NO: 7821332 - DNA, 18 bp, Homo sapiens
aggacacattcttccctc

SEQ ID NO: 7821333 - DNA, 22 bp, Homo sapiens
aggacacatgcacaccctgcgt

SEQ ID NO: 7821334 - DNA, 22 bp, Homo sapiens
aggacacatgcacaccctgcgt

SEQ ID NO: 7821335 - DNA, 22 bp, Homo sapiens
aggacagacctaggactggagc

SEQ ID NO: 7821336 - DNA, 22 bp, Homo sapiens
aggacagacctaggactggagc

SEQ ID NO: 7821337 - DNA, 22 bp, Homo sapiens
aggacagacctaggactggagc

SEQ ID NO: 7821338 - DNA, 22 bp, Homo sapiens
aggacagacctaggactggagc

SEQ ID NO: 7821339 - DNA, 22 bp, Homo sapiens
aggacagagcctgtgcagaccg

SEQ ID NO: 7821340 - DNA, 22 bp, Homo sapiens
aggacagagcctgtgcagaccg

SEQ ID NO: 7821341 - DNA, 22 bp, Homo sapiens
aggacagagcctgtgcagaccg

SEQ ID NO: 7821342 - DNA, 22 bp, Homo sapiens
aggacagagcctgtgcagaccg

SEQ ID NO: 7821343 - DNA, 22 bp, Homo sapiens
aggacagagcctgtgcagaccg

SEQ ID NO: 7821344 - DNA, 22 bp, Homo sapiens
aggacagagggaccagagccca

SEQ ID NO: 7821345 - DNA, 22 bp, Homo sapiens
aggacagacctaggactggagc

SEQ ID NO: 7821346 - DNA, 22 bp, Homo sapiens
aggacagagccctagtttcata

SEQ ID NO: 7821347 - DNA, 22 bp, Homo sapiens
caggtgtcaaaatactaagtgg

SEQ ID NO: 7821348 - DNA, 22 bp, Homo sapiens
caggtgtataaactcagtgact

SEQ ID NO: 7821349 - DNA, 22 bp, Homo sapiens
caggtgtcaaaatactaagtgg

SEQ ID NO: 7821350 - DNA, 22 bp, Homo sapiens
caggtgtcaaaatactaagtgg

SEQ ID NO: 7821351 - DNA, 20 bp, Homo sapiens
caggtgtacagtgagctgag

SEQ ID NO: 7821352 - DNA, 22 bp, Homo sapiens
caggtgtataaactcagtgact

SEQ ID NO: 7821353 - DNA, 22 bp, Homo sapiens
caggtgtacacattgtgtttat

SEQ ID NO: 7821354 - DNA, 22 bp, Homo sapiens
caggtggttgtttggattctaa

SEQ ID NO: 7821355 - DNA, 22 bp, Homo sapiens
caggtggttatgaggaaggtga

SEQ ID NO: 7821356 - DNA, 22 bp, Homo sapiens
caggtggttgagagctgtaggc

SEQ ID NO: 7821357 - DNA, 22 bp, Homo sapiens
caggtggttgagagctgtaggc

SEQ ID NO: 7821358 - DNA, 22 bp, Homo sapiens
caggtgtctaattctcaccccc

SEQ ID NO: 7821359 - DNA, 20 bp, Homo sapiens
aggaagtgatgttttatctg

SEQ ID NO: 7821360 - DNA, 22 bp, Homo sapiens
aggaagtggataaaatagcttt

SEQ ID NO: 7821361 - DNA, 21 bp, Homo sapiens
aggaagtggccagattgggaa

SEQ ID NO: 7821362 - DNA, 21 bp, Homo sapiens
aggaagtggccagattgggaa

SEQ ID NO: 7821363 - DNA, 22 bp, Homo sapiens
aggaagtggataaaatagcttt

SEQ ID NO: 7821364 - DNA, 22 bp, Homo sapiens
cagggcttcgctcctggtgcac

SEQ ID NO: 7821365 - DNA, 22 bp, Homo sapiens
cagggcttcgtgtctcagtgct

SEQ ID NO: 7821366 - DNA, 22 bp, Homo sapiens
cagggcttcgctcctggtgcac

SEQ ID NO: 7821367 - DNA, 22 bp, Homo sapiens
cagggcttcgtgtctcagtgct

SEQ ID NO: 7821368 - DNA, 22 bp, Homo sapiens
cagggcttcgctcctggtgcac

SEQ ID NO: 7821369 - DNA, 22 bp, Homo sapiens
cagggcttactggaggctgctt

SEQ ID NO: 7821370 - DNA, 22 bp, Homo sapiens
cagggcttcgatggatggatgg

SEQ ID NO: 7821371 - DNA, 22 bp, Homo sapiens
cagggcttactggaggctgctt

SEQ ID NO: 7821372 - DNA, 22 bp, Homo sapiens
cagggcttactggaggctgctt

SEQ ID NO: 7821373 - DNA, 22 bp, Homo sapiens
cagggctgttagctgctgctct

SEQ ID NO: 7821374 - DNA, 22 bp, Homo sapiens
caggtgggattttgctgcttga

SEQ ID NO: 7821375 - DNA, 22 bp, Homo sapiens
caggtgggattttgctgcttga

SEQ ID NO: 7821376 - DNA, 22 bp, Homo sapiens
caggtgggccatgaaaaatgac

SEQ ID NO: 7821377 - DNA, 22 bp, Homo sapiens
caggtggtgcctccaggctggt

SEQ ID NO: 7821378 - DNA, 22 bp, Homo sapiens
caggtgggccggggtttgttct

SEQ ID NO: 7821379 - DNA, 22 bp, Homo sapiens
caggtggtgcctccaggctggt

SEQ ID NO: 7821380 - DNA, 22 bp, Homo sapiens
caggtggttatgaggaaggtga

SEQ ID NO: 7821381 - DNA, 22 bp, Homo sapiens
caggtggtgcctcctcccttcc

SEQ ID NO: 7821382 - DNA, 22 bp, Homo sapiens
caggtggttatgaggaaggtga

SEQ ID NO: 7821383 - DNA, 22 bp, Homo sapiens
aggcaaggtgctcttgctctat

SEQ ID NO: 7821384 - DNA, 22 bp, Homo sapiens
aggcaaggtgctcttgctctat

SEQ ID NO: 7821385 - DNA, 22 bp, Homo sapiens
aggcaaggtgctcttgctctat

SEQ ID NO: 7821386 - DNA, 22 bp, Homo sapiens
aggcaaggtgctcttgctctat

SEQ ID NO: 7821387 - DNA, 22 bp, Homo sapiens
aggcaagtgcattagaagagca

SEQ ID NO: 7821388 - DNA, 22 bp, Homo sapiens
aggcaagttattggctcagagc

SEQ ID NO: 7821389 - DNA, 22 bp, Homo sapiens
aggcaagtgcattagaagagca

SEQ ID NO: 7821390 - DNA, 22 bp, Homo sapiens
aggcaaggtgctacagacagtg

SEQ ID NO: 7821391 - DNA, 22 bp, Homo sapiens
aggcaaggtgctacagacagtg

SEQ ID NO: 7821392 - DNA, 22 bp, Homo sapiens
aggcaaggtgctacagacagtg

SEQ ID NO: 7821393 - DNA, 22 bp, Homo sapiens
aggcaaggtgctacagacagtg

SEQ ID NO: 7821394 - DNA, 22 bp, Homo sapiens
aggcaaggtgctacagacagtg

SEQ ID NO: 7821395 - DNA, 22 bp, Homo sapiens
aggcaaggtgctacagacagtg

SEQ ID NO: 7821396 - DNA, 22 bp, Homo sapiens
aggcaaggtgctacagacagtg

SEQ ID NO: 7821397 - DNA, 22 bp, Homo sapiens
aggcaaggtgctacagacagtg

SEQ ID NO: 7821398 - DNA, 22 bp, Homo sapiens
aggcaatcctcttacagatggg

SEQ ID NO: 7821399 - DNA, 17 bp, Homo sapiens
aggcaatgactgtggtt

SEQ ID NO: 7821400 - DNA, 22 bp, Homo sapiens
aggcaatgcagatagatgaatg

SEQ ID NO: 7821401 - DNA, 17 bp, Homo sapiens
aggcaatgactgtggtt

SEQ ID NO: 7821402 - DNA, 22 bp, Homo sapiens
cattccttaacgtggggagtct

SEQ ID NO: 7821403 - DNA, 23 bp, Homo sapiens
aggcaatacaaggcatctctgga

SEQ ID NO: 7821404 - DNA, 22 bp, Homo sapiens
aggcaatagaatatgcctgagg

SEQ ID NO: 7821405 - DNA, 22 bp, Homo sapiens
cattctaaagtgttttatacct

SEQ ID NO: 7821406 - DNA, 19 bp, Homo sapiens
cattcctttgtctgccaaa

SEQ ID NO: 7821407 - DNA, 22 bp, Homo sapiens
cattgcagtaatctggtgaaat

SEQ ID NO: 7821408 - DNA, 21 bp, Homo sapiens
cattgcagttttctctaagtt

SEQ ID NO: 7821409 - DNA, 20 bp, Homo sapiens
cattgcatatttcattgagg

SEQ ID NO: 7821410 - DNA, 20 bp, Homo sapiens
cattgcaggcagagtaagtg

SEQ ID NO: 7821411 - DNA, 22 bp, Homo sapiens
cattgcagtaatctggtgaaat

SEQ ID NO: 7821412 - DNA, 22 bp, Homo sapiens
cattgcattggattgtacttgt

SEQ ID NO: 7821413 - DNA, 22 bp, Homo sapiens
cattgcctcggagcctgttatg

SEQ ID NO: 7821414 - DNA, 22 bp, Homo sapiens
cattgcttgatagctgaaaatt

SEQ ID NO: 7821415 - DNA, 22 bp, Homo sapiens
cattgctttgtgcatatttaaa

SEQ ID NO: 7821416 - DNA, 22 bp, Homo sapiens
cattgctttgtgcatatttaaa

SEQ ID NO: 7821417 - DNA, 22 bp, Homo sapiens
cattggaaaatgcatgcttttt

SEQ ID NO: 7821418 - DNA, 22 bp, Homo sapiens
cattgcttatttcagctaaagt

SEQ ID NO: 7821419 - DNA, 22 bp, Homo sapiens
cattgcttcctatgtcccttct

SEQ ID NO: 7821420 - DNA, 22 bp, Homo sapiens
cattgcttgatagctgaaaatt

SEQ ID NO: 7821421 - DNA, 22 bp, Homo sapiens
cattgcttatctagttcacata

SEQ ID NO: 7821422 - DNA, 22 bp, Homo sapiens
cattgcttatttcagctaaagt

SEQ ID NO: 7821423 - DNA, 22 bp, Homo sapiens
cattgctgttaattgtctctag

SEQ ID NO: 7821424 - DNA, 22 bp, Homo sapiens
aggcaagattaggaccagaaga

SEQ ID NO: 7821425 - DNA, 22 bp, Homo sapiens
aggcaagattaggaccagaaga

SEQ ID NO: 7821426 - DNA, 22 bp, Homo sapiens
aggcaagattaggaccagaaga

SEQ ID NO: 7821427 - DNA, 22 bp, Homo sapiens
aggcaagcagtcagtctatgag

SEQ ID NO: 7821428 - DNA, 22 bp, Homo sapiens
aggcaagcaccgggggcctttt

SEQ ID NO: 7821429 - DNA, 22 bp, Homo sapiens
aggcaagcattgggaacagggc

SEQ ID NO: 7821430 - DNA, 22 bp, Homo sapiens
aggcaagcccccagtgaggctc

SEQ ID NO: 7821431 - DNA, 22 bp, Homo sapiens
aggcaagccgtgcctgtctcaa

SEQ ID NO: 7821432 - DNA, 22 bp, Homo sapiens
aggcaagcattgggaacagggc

SEQ ID NO: 7821433 - DNA, 22 bp, Homo sapiens
aggcaagcatttaaccactcat

SEQ ID NO: 7821434 - DNA, 22 bp, Homo sapiens
aggcaagcccaggcacttggag

SEQ ID NO: 7821435 - DNA, 23 bp, Homo sapiens
aggcaagggtgtaaaggaaatga

SEQ ID NO: 7821436 - DNA, 23 bp, Homo sapiens
aggcaagggtgtaaaggaaatga

SEQ ID NO: 7821437 - DNA, 22 bp, Homo sapiens
aggcaagggggcgccaccttcc

SEQ ID NO: 7821438 - DNA, 22 bp, Homo sapiens
aggcaagggggcgccaccttcc

SEQ ID NO: 7821439 - DNA, 22 bp, Homo sapiens
aggcaaggaagaattctcccct

SEQ ID NO: 7821440 - DNA, 22 bp, Homo sapiens
aggcaagcttgaaattggctct

SEQ ID NO: 7821441 - DNA, 22 bp, Homo sapiens
aggcaaggtgctacagacagtg

SEQ ID NO: 7821442 - DNA, 22 bp, Homo sapiens
aggcaaggtgctacagacagtg

SEQ ID NO: 7821443 - DNA, 20 bp, Homo sapiens
aggcaaggtagatgtctgct

SEQ ID NO: 7821444 - DNA, 20 bp, Homo sapiens
aggcaaggtagatgtctgct

SEQ ID NO: 7821445 - DNA, 20 bp, Homo sapiens
aggcaaggtagatgtctgct

SEQ ID NO: 7821446 - DNA, 20 bp, Homo sapiens
aggcaaggtagatgtctgct

SEQ ID NO: 7821447 - DNA, 23 bp, Homo sapiens
aggcaagggtgtaaaggaaatga

SEQ ID NO: 7821448 - DNA, 22 bp, Homo sapiens
aggcaagaccagaaagggctga

SEQ ID NO: 7821449 - DNA, 22 bp, Homo sapiens
aggcaagaccagaaagggctga

SEQ ID NO: 7821450 - DNA, 22 bp, Homo sapiens
aggcaagattaggaccagaaga

SEQ ID NO: 7821451 - DNA, 22 bp, Homo sapiens
aggcaagaacagacatgggagt

SEQ ID NO: 7821452 - DNA, 22 bp, Homo sapiens
aggcaagaacagacatgggagt

SEQ ID NO: 7821453 - DNA, 22 bp, Homo sapiens
aggcaagaaactttctgggaga

SEQ ID NO: 7821454 - DNA, 22 bp, Homo sapiens
aggcaagaacagacatgggagt

SEQ ID NO: 7821455 - DNA, 22 bp, Homo sapiens
aggcaagaacagacatgggagt

SEQ ID NO: 7821456 - DNA, 22 bp, Homo sapiens
aggcaagaacagacatgggagt

SEQ ID NO: 7821457 - DNA, 22 bp, Homo sapiens
aggcaagaacagacatgggagt

SEQ ID NO: 7821458 - DNA, 22 bp, Homo sapiens
aggcaagaacagacatgggagt

SEQ ID NO: 7821459 - DNA, 22 bp, Homo sapiens
aggcaagaacagacatgggagt

SEQ ID NO: 7821460 - DNA, 22 bp, Homo sapiens
aggcaactcatcatgaaagact

SEQ ID NO: 7821461 - DNA, 22 bp, Homo sapiens
aggcaactcatcatgaaagact

SEQ ID NO: 7821462 - DNA, 20 bp, Homo sapiens
aggcaactcaagtttttgcc

SEQ ID NO: 7821463 - DNA, 17 bp, Homo sapiens
aggcaactagttccctc

SEQ ID NO: 7821464 - DNA, 22 bp, Homo sapiens
aggcaactgacagtttctgctt

SEQ ID NO: 7821465 - DNA, 22 bp, Homo sapiens
aggcaactgacagcatatcctg

SEQ ID NO: 7821466 - DNA, 22 bp, Homo sapiens
aggcaactctgaccttatgaag

SEQ ID NO: 7821467 - DNA, 22 bp, Homo sapiens
aggcaactggttaagtaaattg

SEQ ID NO: 7821468 - DNA, 22 bp, Homo sapiens
aggcaactgtttgataatgttg

SEQ ID NO: 7821469 - DNA, 22 bp, Homo sapiens
aggcaagaaactttctgggaga

SEQ ID NO: 7821470 - DNA, 22 bp, Homo sapiens
aggcaacttttggggatgatgg

SEQ ID NO: 7821471 - DNA, 22 bp, Homo sapiens
aggcaacttgaccaggctttct

SEQ ID NO: 7821472 - DNA, 22 bp, Homo sapiens
catttcaatgccttcaacatag

SEQ ID NO: 7821473 - DNA, 22 bp, Homo sapiens
catttcaatgccttcaacatag

SEQ ID NO: 7821474 - DNA, 22 bp, Homo sapiens
catttcaatgccttcaacatag

SEQ ID NO: 7821475 - DNA, 22 bp, Homo sapiens
catttcaattatttgctcttct

SEQ ID NO: 7821476 - DNA, 22 bp, Homo sapiens
catttcaattatttgctcttct

SEQ ID NO: 7821477 - DNA, 22 bp, Homo sapiens
catttcaatgccttcaacatag

SEQ ID NO: 7821478 - DNA, 22 bp, Homo sapiens
catttcaatgccttcaacatag

SEQ ID NO: 7821479 - DNA, 22 bp, Homo sapiens
catttcaatgccttcaacatag

SEQ ID NO: 7821480 - DNA, 22 bp, Homo sapiens
catttcaatgccttcaacatag

SEQ ID NO: 7821481 - DNA, 22 bp, Homo sapiens
catttcaatactatctgagaat

SEQ ID NO: 7821482 - DNA, 22 bp, Homo sapiens
catttcaatactatctgagaat

SEQ ID NO: 7821483 - DNA, 22 bp, Homo sapiens
catttcaatacagtttgtaaat

SEQ ID NO: 7821484 - DNA, 22 bp, Homo sapiens
catttctcataatattagcact

SEQ ID NO: 7821485 - DNA, 22 bp, Homo sapiens
catttctccgccgagatcactg

SEQ ID NO: 7821486 - DNA, 22 bp, Homo sapiens
catttctcataatattagcact

SEQ ID NO: 7821487 - DNA, 22 bp, Homo sapiens
catttctcataatattagcact

SEQ ID NO: 7821488 - DNA, 22 bp, Homo sapiens
catttcacaaatggccacatca

SEQ ID NO: 7821489 - DNA, 22 bp, Homo sapiens
catttctgattacagaatacta

SEQ ID NO: 7821490 - DNA, 22 bp, Homo sapiens
catttctgcagaattgctcttc

SEQ ID NO: 7821491 - DNA, 22 bp, Homo sapiens
catttctccgccgagatcactg

SEQ ID NO: 7821492 - DNA, 22 bp, Homo sapiens
catttctcctgggtgataaatt

SEQ ID NO: 7821493 - DNA, 22 bp, Homo sapiens
catttctcctgggtgataaatt

SEQ ID NO: 7821494 - DNA, 22 bp, Homo sapiens
catttattggttaggccagcag

SEQ ID NO: 7821495 - DNA, 22 bp, Homo sapiens
catttattggttaggccagcag

SEQ ID NO: 7821496 - DNA, 22 bp, Homo sapiens
catttattggttaggccagcag

SEQ ID NO: 7821497 - DNA, 22 bp, Homo sapiens
catttattggcatgtagtaggt

SEQ ID NO: 7821498 - DNA, 22 bp, Homo sapiens
catttattggttaggccagcag

SEQ ID NO: 7821499 - DNA, 22 bp, Homo sapiens
catttattggttaggccagcag

SEQ ID NO: 7821500 - DNA, 22 bp, Homo sapiens
catttcaaaagaattgccagaa

SEQ ID NO: 7821501 - DNA, 22 bp, Homo sapiens
catttcaaaagaattgccagaa

SEQ ID NO: 7821502 - DNA, 22 bp, Homo sapiens
catttcaaaagaattgccagaa

SEQ ID NO: 7821503 - DNA, 22 bp, Homo sapiens
catttcaaacagttacagctgc

SEQ ID NO: 7821504 - DNA, 22 bp, Homo sapiens
catttcaaacagttacagctgc

SEQ ID NO: 7821505 - DNA, 22 bp, Homo sapiens
catttcaagcattgacttctat

SEQ ID NO: 7821506 - DNA, 22 bp, Homo sapiens
catttcaagcattgacttctat

SEQ ID NO: 7821507 - DNA, 23 bp, Homo sapiens
catttcaacgaattttccttctg

SEQ ID NO: 7821508 - DNA, 21 bp, Homo sapiens
catttcaaagagctggaaatc

SEQ ID NO: 7821509 - DNA, 21 bp, Homo sapiens
catttcaaagagctggaaatc

SEQ ID NO: 7821510 - DNA, 22 bp, Homo sapiens
catttcaatacagtttgtaaat

SEQ ID NO: 7821511 - DNA, 22 bp, Homo sapiens
catttcaatacagtttgtaaat

SEQ ID NO: 7821512 - DNA, 22 bp, Homo sapiens
catttcaagtaacagattgctt

SEQ ID NO: 7821513 - DNA, 22 bp, Homo sapiens
catttcaagtaacagattgctt

SEQ ID NO: 7821514 - DNA, 22 bp, Homo sapiens
catttcaaggaccaccctggga

SEQ ID NO: 7821515 - DNA, 22 bp, Homo sapiens
catttcaagtaacagattgctt

SEQ ID NO: 7821516 - DNA, 22 bp, Homo sapiens
catttcaagtaacagattgctt

SEQ ID NO: 7821517 - DNA, 20 bp, Homo sapiens
aggcactgttgtctgtatcc

SEQ ID NO: 7821518 - DNA, 21 bp, Homo sapiens
aggcactgtttgtggtttggg

SEQ ID NO: 7821519 - DNA, 20 bp, Homo sapiens
aggcactgttgtctgtatcc

SEQ ID NO: 7821520 - DNA, 21 bp, Homo sapiens
aggcacttaaccaatgttagc

SEQ ID NO: 7821521 - DNA, 21 bp, Homo sapiens
aggcactgtttgtggtttggg

SEQ ID NO: 7821522 - DNA, 21 bp, Homo sapiens
aggcacttaaccaatgttagc

SEQ ID NO: 7821523 - DNA, 21 bp, Homo sapiens
aggcactgtttgtggtttggg

SEQ ID NO: 7821524 - DNA, 21 bp, Homo sapiens
aggcactgtttgtggtttggg

SEQ ID NO: 7821525 - DNA, 22 bp, Homo sapiens
aggcactgttcccagttatcct

SEQ ID NO: 7821526 - DNA, 20 bp, Homo sapiens
aggcactgttgtctgtatcc

SEQ ID NO: 7821527 - DNA, 22 bp, Homo sapiens
aggcactgttcccagttatcct

SEQ ID NO: 7821528 - DNA, 18 bp, Homo sapiens
cattgtacaatgctttat

SEQ ID NO: 7821529 - DNA, 18 bp, Homo sapiens
cattgtacaatgctttat

SEQ ID NO: 7821530 - DNA, 22 bp, Homo sapiens
aggcactgtgggtgtggccgga

SEQ ID NO: 7821531 - DNA, 22 bp, Homo sapiens
aggcactgtgggtgtggccgga

SEQ ID NO: 7821532 - DNA, 22 bp, Homo sapiens
cattggtttgatattgccatgg

SEQ ID NO: 7821533 - DNA, 22 bp, Homo sapiens
cattgtaagctgttgaatcctc

SEQ ID NO: 7821534 - DNA, 22 bp, Homo sapiens
cattgggccacaagaagaaaat

SEQ ID NO: 7821535 - DNA, 22 bp, Homo sapiens
cattgggcttctcctggaccca

SEQ ID NO: 7821536 - DNA, 22 bp, Homo sapiens
cattgggcggggacctcggctg

SEQ ID NO: 7821537 - DNA, 22 bp, Homo sapiens
cattggccttttatcctagagg

SEQ ID NO: 7821538 - DNA, 20 bp, Homo sapiens
cattggcattcacagaagct

SEQ ID NO: 7821539 - DNA, 22 bp, Homo sapiens
cattggcacctcacaggataga

SEQ ID NO: 7821540 - DNA, 22 bp, Homo sapiens
cattggaatgcatttgaagaga

SEQ ID NO: 7821541 - DNA, 22 bp, Homo sapiens
cattggaatgatcgttttgctg

SEQ ID NO: 7821542 - DNA, 22 bp, Homo sapiens
cattggcacaagtagcttcatc

SEQ ID NO: 7821543 - DNA, 22 bp, Homo sapiens
cattggaatgatcgttttgctg

SEQ ID NO: 7821544 - DNA, 22 bp, Homo sapiens
aggcacttgaattgatgatgtt

SEQ ID NO: 7821545 - DNA, 22 bp, Homo sapiens
aggcacttgattaatgtgaatt

SEQ ID NO: 7821546 - DNA, 22 bp, Homo sapiens
aggcacttgattaatgtgaatt

SEQ ID NO: 7821547 - DNA, 22 bp, Homo sapiens
aggcacttgattaatgtgaatt

SEQ ID NO: 7821548 - DNA, 22 bp, Homo sapiens
aggcacttgcattgatgaggtc

SEQ ID NO: 7821549 - DNA, 22 bp, Homo sapiens
aggcacttgcattgatgaggtc

SEQ ID NO: 7821550 - DNA, 22 bp, Homo sapiens
aggcacttgcattgatgaggtc

SEQ ID NO: 7821551 - DNA, 22 bp, Homo sapiens
aggcacttgcattgatgaggtc

SEQ ID NO: 7821552 - DNA, 22 bp, Homo sapiens
aggcacttggaggtctctgccc

SEQ ID NO: 7821553 - DNA, 22 bp, Homo sapiens
aggcacttcatgggttcaagga

SEQ ID NO: 7821554 - DNA, 22 bp, Homo sapiens
aggcacttcatgggttcaagga

SEQ ID NO: 7821555 - DNA, 22 bp, Homo sapiens
aggcacttctcaaattcatgcc

SEQ ID NO: 7821556 - DNA, 22 bp, Homo sapiens
aggcacttaataaggattcaat

SEQ ID NO: 7821557 - DNA, 22 bp, Homo sapiens
aggcacttaacctactaactga

SEQ ID NO: 7821558 - DNA, 22 bp, Homo sapiens
aggcacttaacctactaactga

SEQ ID NO: 7821559 - DNA, 22 bp, Homo sapiens
aggcacttcatgggttcaagga

SEQ ID NO: 7821560 - DNA, 22 bp, Homo sapiens
aggcacttaataaggattcaat

SEQ ID NO: 7821561 - DNA, 22 bp, Homo sapiens
aggcacttaataaggattcaat

SEQ ID NO: 7821562 - DNA, 22 bp, Homo sapiens
aggcacttaataaggattcaat

SEQ ID NO: 7821563 - DNA, 22 bp, Homo sapiens
catttacctttaattaaaacac

SEQ ID NO: 7821564 - DNA, 22 bp, Homo sapiens
aggcactttaggatcaggttga

SEQ ID NO: 7821565 - DNA, 22 bp, Homo sapiens
catttactgtaaaagattctct

SEQ ID NO: 7821566 - DNA, 22 bp, Homo sapiens
catttactgttgaatccctagc

SEQ ID NO: 7821567 - DNA, 22 bp, Homo sapiens
catttacttaaatctttacaag

SEQ ID NO: 7821568 - DNA, 22 bp, Homo sapiens
aggcactttacaatgtgtgaca

SEQ ID NO: 7821569 - DNA, 22 bp, Homo sapiens
aggcactttacaatgtgtgaca

SEQ ID NO: 7821570 - DNA, 22 bp, Homo sapiens
aggcacttgtgactgtctgcat

SEQ ID NO: 7821571 - DNA, 22 bp, Homo sapiens
aggcacttgtaattgcagtcat

SEQ ID NO: 7821572 - DNA, 22 bp, Homo sapiens
aggcacttggagttctttgccc

SEQ ID NO: 7821573 - DNA, 22 bp, Homo sapiens
aggcacttggaggtctctgccc

SEQ ID NO: 7821574 - DNA, 22 bp, Homo sapiens
aggcacttggaggtctctgccc

SEQ ID NO: 7821575 - DNA, 22 bp, Homo sapiens
catttctgttctcttcctgtac

SEQ ID NO: 7821576 - DNA, 22 bp, Homo sapiens
catttctgttctcttcctgtac

SEQ ID NO: 7821577 - DNA, 22 bp, Homo sapiens
catttgaaacctggaatctacc

SEQ ID NO: 7821578 - DNA, 22 bp, Homo sapiens
catttgaaacctggaatctacc

SEQ ID NO: 7821579 - DNA, 22 bp, Homo sapiens
catttgaaacctggaatctacc

SEQ ID NO: 7821580 - DNA, 22 bp, Homo sapiens
catttgaaacctggaatctacc

SEQ ID NO: 7821581 - DNA, 22 bp, Homo sapiens
ccaatgaaaggtcaattctata

SEQ ID NO: 7821582 - DNA, 22 bp, Homo sapiens
ccaatgaatatatttcatatga

SEQ ID NO: 7821583 - DNA, 22 bp, Homo sapiens
ccaatgaaaggtcaattctata

SEQ ID NO: 7821584 - DNA, 22 bp, Homo sapiens
ccaatgatggtgcccacgatga

SEQ ID NO: 7821585 - DNA, 22 bp, Homo sapiens
catttctgtcacgttcttttat

SEQ ID NO: 7821586 - DNA, 22 bp, Homo sapiens
catttctgtcacgttcttttat

SEQ ID NO: 7821587 - DNA, 22 bp, Homo sapiens
catttctgtcacgttcttttat

SEQ ID NO: 7821588 - DNA, 22 bp, Homo sapiens
catttctgtgacacttccatct

SEQ ID NO: 7821589 - DNA, 22 bp, Homo sapiens
catttctgtgacacttccatct

SEQ ID NO: 7821590 - DNA, 22 bp, Homo sapiens
catttctgttctcttcctgtac

SEQ ID NO: 7821591 - DNA, 23 bp, Homo sapiens
catttctgggagatttataaaat

SEQ ID NO: 7821592 - DNA, 23 bp, Homo sapiens
catttctgggagatttataaaat

SEQ ID NO: 7821593 - DNA, 23 bp, Homo sapiens
catttctgggagatttataaaat

SEQ ID NO: 7821594 - DNA, 22 bp, Homo sapiens
catttctgtacatgttttggtg

SEQ ID NO: 7821595 - DNA, 22 bp, Homo sapiens
catttctgggagacatgctaga

SEQ ID NO: 7821596 - DNA, 22 bp, Homo sapiens
catttctgggagacatgctaga

SEQ ID NO: 7821597 - DNA, 22 bp, Homo sapiens
catttctgggagacatgctaga

SEQ ID NO: 7821598 - DNA, 22 bp, Homo sapiens
catttctgggagacatgctaga

SEQ ID NO: 7821599 - DNA, 22 bp, Homo sapiens
catttctgcagaattgctcttc

SEQ ID NO: 7821600 - DNA, 22 bp, Homo sapiens
ccacagagacagggtccttgct

SEQ ID NO: 7821601 - DNA, 22 bp, Homo sapiens
ccacagagacagggtccttgct

SEQ ID NO: 7821602 - DNA, 22 bp, Homo sapiens
ccacagagacagggtccttgct

SEQ ID NO: 7821603 - DNA, 22 bp, Homo sapiens
ccacagagacagagcccagggt

SEQ ID NO: 7821604 - DNA, 22 bp, Homo sapiens
ccacagagacagagcccagggt

SEQ ID NO: 7821605 - DNA, 22 bp, Homo sapiens
ccacagaattctgtctccagga

SEQ ID NO: 7821606 - DNA, 22 bp, Homo sapiens
ccacagaattctgtctccagga

SEQ ID NO: 7821607 - DNA, 22 bp, Homo sapiens
ccacagaatgatgacacttcag

SEQ ID NO: 7821608 - DNA, 22 bp, Homo sapiens
ccacagaccttggcttccacct

SEQ ID NO: 7821609 - DNA, 22 bp, Homo sapiens
ccacagagacagagcccagggt

SEQ ID NO: 7821610 - DNA, 22 bp, Homo sapiens
ccacagagactctgcaggactg

SEQ ID NO: 7821611 - DNA, 22 bp, Homo sapiens
ccacagagactctgcaggactg

SEQ ID NO: 7821612 - DNA, 22 bp, Homo sapiens
ccacagagagtgtcagcctttg

SEQ ID NO: 7821613 - DNA, 19 bp, Homo sapiens
ccacagagcatgctgaggc

SEQ ID NO: 7821614 - DNA, 19 bp, Homo sapiens
ccacagagcatgctgaggc

SEQ ID NO: 7821615 - DNA, 19 bp, Homo sapiens
ccacagagcatgctgaggc

SEQ ID NO: 7821616 - DNA, 22 bp, Homo sapiens
ccacagagactctgcaggactg

SEQ ID NO: 7821617 - DNA, 22 bp, Homo sapiens
ccacagagactctgcaggactg

SEQ ID NO: 7821618 - DNA, 22 bp, Homo sapiens
ccacagagactctgcaggactg

SEQ ID NO: 7821619 - DNA, 22 bp, Homo sapiens
ccacagagactctgcaggactg

SEQ ID NO: 7821620 - DNA, 22 bp, Homo sapiens
ccacagagactctgcaggactg

SEQ ID NO: 7821621 - DNA, 22 bp, Homo sapiens
ccacagagacagggtccttgct

SEQ ID NO: 7821622 - DNA, 19 bp, Homo sapiens
ccacagagactagaagaca

SEQ ID NO: 7821623 - DNA, 19 bp, Homo sapiens
ccacagagactagaagaca

SEQ ID NO: 7821624 - DNA, 22 bp, Homo sapiens
ccacagagactctgcaggactg

SEQ ID NO: 7821625 - DNA, 19 bp, Homo sapiens
ccacagagactagaagaca

SEQ ID NO: 7821626 - DNA, 17 bp, Homo sapiens
aggcaggagattggaga

SEQ ID NO: 7821627 - DNA, 17 bp, Homo sapiens
aggcaggagattggaga

SEQ ID NO: 7821628 - DNA, 17 bp, Homo sapiens
aggcaggagattggaga

SEQ ID NO: 7821629 - DNA, 17 bp, Homo sapiens
aggcaggagattggaga

SEQ ID NO: 7821630 - DNA, 22 bp, Homo sapiens
aggcaggaaccctgtgtgcgcc

SEQ ID NO: 7821631 - DNA, 22 bp, Homo sapiens
aggcaggaaccctgtgtgcgcc

SEQ ID NO: 7821632 - DNA, 22 bp, Homo sapiens
aggcaggaaccctgtgtgcgcc

SEQ ID NO: 7821633 - DNA, 22 bp, Homo sapiens
aggcaggagcaagccctacaag

SEQ ID NO: 7821634 - DNA, 17 bp, Homo sapiens
aggcaggagattggaga

SEQ ID NO: 7821635 - DNA, 17 bp, Homo sapiens
aggcaggagattggaga

SEQ ID NO: 7821636 - DNA, 17 bp, Homo sapiens
aggcaggagattggaga

SEQ ID NO: 7821637 - DNA, 22 bp, Homo sapiens
aggcaggaggatcatggatgca

SEQ ID NO: 7821638 - DNA, 22 bp, Homo sapiens
aggcaggagcaagccctacaag

SEQ ID NO: 7821639 - DNA, 22 bp, Homo sapiens
aggcaggagcaagccctacaag

SEQ ID NO: 7821640 - DNA, 22 bp, Homo sapiens
aggcaggagcaagccctacaag

SEQ ID NO: 7821641 - DNA, 22 bp, Homo sapiens
aggcaggaaaatcgcttgaacc

SEQ ID NO: 7821642 - DNA, 22 bp, Homo sapiens
aggcaggaaaatcgcttgaacc

SEQ ID NO: 7821643 - DNA, 23 bp, Homo sapiens
ccacagagctgccaattcctgtg

SEQ ID NO: 7821644 - DNA, 22 bp, Homo sapiens
aggcaggaaaatcgcttgaacc

SEQ ID NO: 7821645 - DNA, 22 bp, Homo sapiens
aggcaggaaccctgtgtgcgcc

SEQ ID NO: 7821646 - DNA, 22 bp, Homo sapiens
aggcaggaaccctgtgtgcgcc

SEQ ID NO: 7821647 - DNA, 22 bp, Homo sapiens
aggcaggaaccctgtgtgcgcc

SEQ ID NO: 7821648 - DNA, 23 bp, Homo sapiens
ccacagagctgccaattcctgtg

SEQ ID NO: 7821649 - DNA, 22 bp, Homo sapiens
ccacagagcattagatttcaga

SEQ ID NO: 7821650 - DNA, 22 bp, Homo sapiens
ccacagagcattagatttcaga

SEQ ID NO: 7821651 - DNA, 19 bp, Homo sapiens
ccacagagcatgctgaggc

SEQ ID NO: 7821652 - DNA, 22 bp, Homo sapiens
aggcaggagtgaccctgacagg

SEQ ID NO: 7821653 - DNA, 22 bp, Homo sapiens
aggcaggagtgaccctgacagg

SEQ ID NO: 7821654 - DNA, 22 bp, Homo sapiens
aggcaggagtgaccctgacagg

SEQ ID NO: 7821655 - DNA, 22 bp, Homo sapiens
aggcaggagtgaccctgacagg

SEQ ID NO: 7821656 - DNA, 22 bp, Homo sapiens
aggcaggagtgaccctgacagg

SEQ ID NO: 7821657 - DNA, 22 bp, Homo sapiens
aggcaggagtgaccctgacagg

SEQ ID NO: 7821658 - DNA, 22 bp, Homo sapiens
aggcaggagtgaccctgacagg

SEQ ID NO: 7821659 - DNA, 22 bp, Homo sapiens
aggcaggagtgaccctgacagg

SEQ ID NO: 7821660 - DNA, 22 bp, Homo sapiens
aggcaggagtgaccctgacagg

SEQ ID NO: 7821661 - DNA, 22 bp, Homo sapiens
aggcaggagtgaccctgacagg

SEQ ID NO: 7821662 - DNA, 22 bp, Homo sapiens
aggcaggagtgaccctgacagg

SEQ ID NO: 7821663 - DNA, 22 bp, Homo sapiens
aggcaggaggatcatggatgca

SEQ ID NO: 7821664 - DNA, 22 bp, Homo sapiens
aggcaggaggatcatggatgca

SEQ ID NO: 7821665 - DNA, 22 bp, Homo sapiens
aggcaggaggatcatggatgca

SEQ ID NO: 7821666 - DNA, 22 bp, Homo sapiens
aggcaggaggatcatggatgca

SEQ ID NO: 7821667 - DNA, 22 bp, Homo sapiens
aggcaggaggatcatggatgca

SEQ ID NO: 7821668 - DNA, 22 bp, Homo sapiens
aggcaggaggatcatggatgca

SEQ ID NO: 7821669 - DNA, 22 bp, Homo sapiens
aggcaggaggatcatggatgca

SEQ ID NO: 7821670 - DNA, 22 bp, Homo sapiens
aggcaggaggatcatggatgca

SEQ ID NO: 7821671 - DNA, 18 bp, Homo sapiens
aggcaggatcctggcctc

SEQ ID NO: 7821672 - DNA, 18 bp, Homo sapiens
aggcaggatcctggcctc

SEQ ID NO: 7821673 - DNA, 18 bp, Homo sapiens
aggcaggatcctggcctc

SEQ ID NO: 7821674 - DNA, 18 bp, Homo sapiens
aggcaggatcctggcctc

SEQ ID NO: 7821675 - DNA, 18 bp, Homo sapiens
aggcaggatcctggcctc

SEQ ID NO: 7821676 - DNA, 18 bp, Homo sapiens
aggcaggatcctggcctc

SEQ ID NO: 7821677 - DNA, 18 bp, Homo sapiens
aggcaggatcctggcctc

SEQ ID NO: 7821678 - DNA, 18 bp, Homo sapiens
aggcaggatcctggcctc

SEQ ID NO: 7821679 - DNA, 18 bp, Homo sapiens
aggcaggatcctggcctc

SEQ ID NO: 7821680 - DNA, 23 bp, Homo sapiens
ccacaggcacagaggcttgcatc

SEQ ID NO: 7821681 - DNA, 23 bp, Homo sapiens
ccacaggcacagaggcttgcatc

SEQ ID NO: 7821682 - DNA, 23 bp, Homo sapiens
ccacaggcacagaggcttgcatc

SEQ ID NO: 7821683 - DNA, 23 bp, Homo sapiens
ccacaggcacagaggcttgcatc

SEQ ID NO: 7821684 - DNA, 23 bp, Homo sapiens
ccacaggcacagaggcttgcatc

SEQ ID NO: 7821685 - DNA, 20 bp, Homo sapiens
ccacagtggagactggagac

SEQ ID NO: 7821686 - DNA, 22 bp, Homo sapiens
ccacagtgcctggaattctgca

SEQ ID NO: 7821687 - DNA, 22 bp, Homo sapiens
ccacaggcggagtggcgggcag

SEQ ID NO: 7821688 - DNA, 22 bp, Homo sapiens
ccacaggcggagtggcgggcag

SEQ ID NO: 7821689 - DNA, 22 bp, Homo sapiens
ccacgacgagtcatcagggcga

SEQ ID NO: 7821690 - DNA, 22 bp, Homo sapiens
ccacctggggctgtggcccctt

SEQ ID NO: 7821691 - DNA, 22 bp, Homo sapiens
ccacctgtgcttggtactccat

SEQ ID NO: 7821692 - DNA, 22 bp, Homo sapiens
ccacctgtgcttggtactccat

SEQ ID NO: 7821693 - DNA, 22 bp, Homo sapiens
ccacctggggcctctgagtctc

SEQ ID NO: 7821694 - DNA, 20 bp, Homo sapiens
ccacctggccaaggctgtgc

SEQ ID NO: 7821695 - DNA, 22 bp, Homo sapiens
ccacctggggcctctgagtctc

SEQ ID NO: 7821696 - DNA, 22 bp, Homo sapiens
ccacctggggcctctgagtctc

SEQ ID NO: 7821697 - DNA, 22 bp, Homo sapiens
ccacccagccagatgcaggaag

SEQ ID NO: 7821698 - DNA, 22 bp, Homo sapiens
ccacccagccagatgcaggaag

SEQ ID NO: 7821699 - DNA, 22 bp, Homo sapiens
ccacccagccagatgcaggaag

SEQ ID NO: 7821700 - DNA, 20 bp, Homo sapiens
ccacctggccaaggctgtgc

SEQ ID NO: 7821701 - DNA, 23 bp, Homo sapiens
ccacctggactctgggcaggtgc

SEQ ID NO: 7821702 - DNA, 20 bp, Homo sapiens
ccacctggccaaggctgtgc

SEQ ID NO: 7821703 - DNA, 22 bp, Homo sapiens
ccacccagaccagggatctggg

SEQ ID NO: 7821704 - DNA, 22 bp, Homo sapiens
ccacccagaccagggatctggg

SEQ ID NO: 7821705 - DNA, 22 bp, Homo sapiens
ccacccagaccagggatctggg

SEQ ID NO: 7821706 - DNA, 22 bp, Homo sapiens
ccacccagaccagggatctggg

SEQ ID NO: 7821707 - DNA, 22 bp, Homo sapiens
ccacccagcagaggaggcaaga

SEQ ID NO: 7821708 - DNA, 22 bp, Homo sapiens
ccacccagcagaggaggcaaga

SEQ ID NO: 7821709 - DNA, 22 bp, Homo sapiens
ccacccagccagatgcaggaag

SEQ ID NO: 7821710 - DNA, 22 bp, Homo sapiens
ccacgggcagatgtggttggtt

SEQ ID NO: 7821711 - DNA, 22 bp, Homo sapiens
ccacgtccagctaattttcgta

SEQ ID NO: 7821712 - DNA, 22 bp, Homo sapiens
ccacgtgtaggtggacaggatc

SEQ ID NO: 7821713 - DNA, 23 bp, Homo sapiens
ccacgtctgcactgtagctgttg

SEQ ID NO: 7821714 - DNA, 22 bp, Homo sapiens
ccactaccacggcatgcctccc

SEQ ID NO: 7821715 - DNA, 22 bp, Homo sapiens
ccacggccacccgctcatgggc

SEQ ID NO: 7821716 - DNA, 22 bp, Homo sapiens
ccacggccacccgctcatgggc

SEQ ID NO: 7821717 - DNA, 22 bp, Homo sapiens
ccacggccacccgctcatgggc

SEQ ID NO: 7821718 - DNA, 22 bp, Homo sapiens
ccacggccacccgctcatgggc

SEQ ID NO: 7821719 - DNA, 22 bp, Homo sapiens
ccacgagggaaccaggtggggt

SEQ ID NO: 7821720 - DNA, 22 bp, Homo sapiens
ccacgacgagtcatcagggcga

SEQ ID NO: 7821721 - DNA, 22 bp, Homo sapiens
ccacgaggctatcctgctaggg

SEQ ID NO: 7821722 - DNA, 22 bp, Homo sapiens
ccacgctcatcctctctgagag

SEQ ID NO: 7821723 - DNA, 19 bp, Homo sapiens
ccacgaggttagcagccac

SEQ ID NO: 7821724 - DNA, 22 bp, Homo sapiens
ccacgcatccctccacagagag

SEQ ID NO: 7821725 - DNA, 19 bp, Homo sapiens
ccacgaggttagcagccac

SEQ ID NO: 7821726 - DNA, 22 bp, Homo sapiens
ccacgagggaaccaggtggggt

SEQ ID NO: 7821727 - DNA, 22 bp, Homo sapiens
ccactattactgtgtggcagtc

SEQ ID NO: 7821728 - DNA, 22 bp, Homo sapiens
ccacggaaagtcaccctaagga

SEQ ID NO: 7821729 - DNA, 23 bp, Homo sapiens
ccactagcacctgttcaacttct

SEQ ID NO: 7821730 - DNA, 22 bp, Homo sapiens
ccactcagaccaacgacccttc

SEQ ID NO: 7821731 - DNA, 22 bp, Homo sapiens
ccactcagaccaacgacccttc

SEQ ID NO: 7821732 - DNA, 22 bp, Homo sapiens
ccactcagcacagtggatgcag

SEQ ID NO: 7821733 - DNA, 22 bp, Homo sapiens
ccactattactgtgtggcagtc

SEQ ID NO: 7821734 - DNA, 22 bp, Homo sapiens
ccactcagaccaacgacccttc

SEQ ID NO: 7821735 - DNA, 22 bp, Homo sapiens
ccactcagaccaacgacccttc

SEQ ID NO: 7821736 - DNA, 21 bp, Homo sapiens
ccactcatgactccactcacc

SEQ ID NO: 7821737 - DNA, 22 bp, Homo sapiens
ccactcagttgctctctgtttt

SEQ ID NO: 7821738 - DNA, 22 bp, Homo sapiens
ccactcagttgctctctgtttt

SEQ ID NO: 7821739 - DNA, 17 bp, Homo sapiens
ccactcagtaatttctc

SEQ ID NO: 7821740 - DNA, 22 bp, Homo sapiens
ccactcaggcctcctgctctcc

SEQ ID NO: 7821741 - DNA, 20 bp, Homo sapiens
ccactcagctgtattctcag

SEQ ID NO: 7821742 - DNA, 22 bp, Homo sapiens
ccactcaggagcttatctatgc

SEQ ID NO: 7821743 - DNA, 22 bp, Homo sapiens
ccactcaggcctcctgctctcc

SEQ ID NO: 7821744 - DNA, 22 bp, Homo sapiens
ccacagtggttctcaaccaggg

SEQ ID NO: 7821745 - DNA, 22 bp, Homo sapiens
ccacagtggttctcaaccaggg

SEQ ID NO: 7821746 - DNA, 22 bp, Homo sapiens
ccacagtgggcacagcaggact

SEQ ID NO: 7821747 - DNA, 22 bp, Homo sapiens
ccacagtgggcacagcaggact

SEQ ID NO: 7821748 - DNA, 22 bp, Homo sapiens
ccacagtgggcacagcaggact

SEQ ID NO: 7821749 - DNA, 20 bp, Homo sapiens
ccacagtggagactggagac

SEQ ID NO: 7821750 - DNA, 22 bp, Homo sapiens
ccacagtgggcacagcaggact

SEQ ID NO: 7821751 - DNA, 22 bp, Homo sapiens
ccacagtgggcacagcaggact

SEQ ID NO: 7821752 - DNA, 20 bp, Homo sapiens
ccacagtggagactggagac

SEQ ID NO: 7821753 - DNA, 22 bp, Homo sapiens
ccacagtggttgtggcatgtgg

SEQ ID NO: 7821754 - DNA, 22 bp, Homo sapiens
ccacagtggttctcaaccaggg

SEQ ID NO: 7821755 - DNA, 22 bp, Homo sapiens
ccacagtggttgtggcatgtgg

SEQ ID NO: 7821756 - DNA, 22 bp, Homo sapiens
ccacagtggttgtggcatgtgg

SEQ ID NO: 7821757 - DNA, 22 bp, Homo sapiens
ccacagtggttgtggcatgtgg

SEQ ID NO: 7821758 - DNA, 22 bp, Homo sapiens
ccacagtgtggcataaactgta

SEQ ID NO: 7821759 - DNA, 22 bp, Homo sapiens
ccacagtgtggcataaactgta

SEQ ID NO: 7821760 - DNA, 22 bp, Homo sapiens
ccacagtggttgtggcatgtgg

SEQ ID NO: 7821761 - DNA, 22 bp, Homo sapiens
ccacagtgttctttttaaaatt

SEQ ID NO: 7821762 - DNA, 22 bp, Homo sapiens
ccacagtgtggcataaactgta

SEQ ID NO: 7821763 - DNA, 22 bp, Homo sapiens
ccacagtttcttcatctataaa

SEQ ID NO: 7821764 - DNA, 23 bp, Homo sapiens
ccacagttcatcgttcactcacc

SEQ ID NO: 7821765 - DNA, 22 bp, Homo sapiens
ccacagttattcatttgtgaca

SEQ ID NO: 7821766 - DNA, 22 bp, Homo sapiens
ccacagtgttttgtcacattag

SEQ ID NO: 7821767 - DNA, 22 bp, Homo sapiens
ccacagtgttttgtcacattag

SEQ ID NO: 7821768 - DNA, 22 bp, Homo sapiens
ccaccatgggaagagagactaa

SEQ ID NO: 7821769 - DNA, 19 bp, Homo sapiens
ccaccagtgtgatctaaga

SEQ ID NO: 7821770 - DNA, 21 bp, Homo sapiens
ccaccaggtcttctgctcggg

SEQ ID NO: 7821771 - DNA, 21 bp, Homo sapiens
ccaccaggtcttctgctcggg

SEQ ID NO: 7821772 - DNA, 21 bp, Homo sapiens
ccaccaggtcttctgctcggg

SEQ ID NO: 7821773 - DNA, 21 bp, Homo sapiens
ccaccaggtcttctgctcggg

SEQ ID NO: 7821774 - DNA, 20 bp, Homo sapiens
ccacccacgcgggctctgcc

SEQ ID NO: 7821775 - DNA, 20 bp, Homo sapiens
ccacccacgcgggctctgcc

SEQ ID NO: 7821776 - DNA, 20 bp, Homo sapiens
ccacccacgcgggctctgcc

SEQ ID NO: 7821777 - DNA, 22 bp, Homo sapiens
ccaccattatatctcccatgcc

SEQ ID NO: 7821778 - DNA, 22 bp, Homo sapiens
ccaccatgggaagagagactaa

SEQ ID NO: 7821779 - DNA, 22 bp, Homo sapiens
ccaccatgggaagagagactaa

SEQ ID NO: 7821780 - DNA, 22 bp, Homo sapiens
ccaccattcaaggtcttcacag

SEQ ID NO: 7821781 - DNA, 22 bp, Homo sapiens
ccaccatgggaagagagactaa

SEQ ID NO: 7821782 - DNA, 22 bp, Homo sapiens
ccaccattcaaggtcttcacag

SEQ ID NO: 7821783 - DNA, 22 bp, Homo sapiens
ccaccaggcactcacagggaag

SEQ ID NO: 7821784 - DNA, 22 bp, Homo sapiens
ccaccaggcactcacagggaag

SEQ ID NO: 7821785 - DNA, 22 bp, Homo sapiens
ccacatctcggtcccctctttg

SEQ ID NO: 7821786 - DNA, 22 bp, Homo sapiens
ccaccaggctctgtccgagcgg

SEQ ID NO: 7821787 - DNA, 21 bp, Homo sapiens
ccaccaggtcttctgctcggg

SEQ ID NO: 7821788 - DNA, 22 bp, Homo sapiens
ccacatacaaatggggtgctgt

SEQ ID NO: 7821789 - DNA, 22 bp, Homo sapiens
ccacatcagaaatgtttactca

SEQ ID NO: 7821790 - DNA, 22 bp, Homo sapiens
ccacatcatggatacagttatg

SEQ ID NO: 7821791 - DNA, 22 bp, Homo sapiens
ccacatcatggatacagttatg

SEQ ID NO: 7821792 - DNA, 22 bp, Homo sapiens
ccacatctaagccttcatgata

SEQ ID NO: 7821793 - DNA, 22 bp, Homo sapiens
ccacatctaagccttcatgata

SEQ ID NO: 7821794 - DNA, 22 bp, Homo sapiens
ccacatctatctttagtatgaa

SEQ ID NO: 7821795 - DNA, 22 bp, Homo sapiens
ccacatctccctattgctcttt

SEQ ID NO: 7821796 - DNA, 22 bp, Homo sapiens
cagtccaggcctggaggagcca

SEQ ID NO: 7821797 - DNA, 22 bp, Homo sapiens
cagtccaggcctggaggagcca

SEQ ID NO: 7821798 - DNA, 22 bp, Homo sapiens
cagtccaggcctggaggagcca

SEQ ID NO: 7821799 - DNA, 22 bp, Homo sapiens
cagtccagctcatcagtggcac

SEQ ID NO: 7821800 - DNA, 22 bp, Homo sapiens
cagtccaggcctggaggagcca

SEQ ID NO: 7821801 - DNA, 22 bp, Homo sapiens
cagtccaggcctggaggagcca

SEQ ID NO: 7821802 - DNA, 22 bp, Homo sapiens
cagtccaggcctggaggagcca

SEQ ID NO: 7821803 - DNA, 22 bp, Homo sapiens
cagtccagctcatcagtggcac

SEQ ID NO: 7821804 - DNA, 22 bp, Homo sapiens
cagtccagctcatcagtggcac

SEQ ID NO: 7821805 - DNA, 22 bp, Homo sapiens
cagtccagccccctgctaaaag

SEQ ID NO: 7821806 - DNA, 22 bp, Homo sapiens
cagtccagccccctgctaaaag

SEQ ID NO: 7821807 - DNA, 22 bp, Homo sapiens
cagtccagctcatcagtggcac

SEQ ID NO: 7821808 - DNA, 22 bp, Homo sapiens
cagtccagctcatcagtggcac

SEQ ID NO: 7821809 - DNA, 22 bp, Homo sapiens
cagtccagctcatcagtggcac

SEQ ID NO: 7821810 - DNA, 22 bp, Homo sapiens
cagtccaggcctggaggagcca

SEQ ID NO: 7821811 - DNA, 21 bp, Homo sapiens
cagtattttaagcagtgagtt

SEQ ID NO: 7821812 - DNA, 22 bp, Homo sapiens
cagtccagagcccaccagagga

SEQ ID NO: 7821813 - DNA, 22 bp, Homo sapiens
cagtatttgttccctatcaatg

SEQ ID NO: 7821814 - DNA, 22 bp, Homo sapiens
cagtccagagcccaccagagga

SEQ ID NO: 7821815 - DNA, 22 bp, Homo sapiens
cagtccagagcccaccagagga

SEQ ID NO: 7821816 - DNA, 22 bp, Homo sapiens
cagtccagagcccaccagagga

SEQ ID NO: 7821817 - DNA, 22 bp, Homo sapiens
cagtccagagtaccccaagaag

SEQ ID NO: 7821818 - DNA, 22 bp, Homo sapiens
cagtccagccccctgctaaaag

SEQ ID NO: 7821819 - DNA, 22 bp, Homo sapiens
cagtccagccccctgctaaaag

SEQ ID NO: 7821820 - DNA, 22 bp, Homo sapiens
cagtccagccccctgctaaaag

SEQ ID NO: 7821821 - DNA, 22 bp, Homo sapiens
cagtccagccagtagggtgtgg

SEQ ID NO: 7821822 - DNA, 22 bp, Homo sapiens
cagtccagccagtagggtgtgg

SEQ ID NO: 7821823 - DNA, 22 bp, Homo sapiens
cagtccagccagtagggtgtgg

SEQ ID NO: 7821824 - DNA, 22 bp, Homo sapiens
cagtccagcaaagaactttcac

SEQ ID NO: 7821825 - DNA, 22 bp, Homo sapiens
cagtccagcaaagaactttcac

SEQ ID NO: 7821826 - DNA, 22 bp, Homo sapiens
cagtccagagtatatccgcttt

SEQ ID NO: 7821827 - DNA, 22 bp, Homo sapiens
cagtccagagtatatccgcttt

SEQ ID NO: 7821828 - DNA, 22 bp, Homo sapiens
cagtccagagtaccccaagaag

SEQ ID NO: 7821829 - DNA, 22 bp, Homo sapiens
cagtgtggagggagagagcctg

SEQ ID NO: 7821830 - DNA, 22 bp, Homo sapiens
cagtgtgctatctggaagtctc

SEQ ID NO: 7821831 - DNA, 21 bp, Homo sapiens
cagtggttgctgaattagtgg

SEQ ID NO: 7821832 - DNA, 22 bp, Homo sapiens
cagtggttgaacccaaatactt

SEQ ID NO: 7821833 - DNA, 22 bp, Homo sapiens
cagtggttctcaatcaggaatg

SEQ ID NO: 7821834 - DNA, 22 bp, Homo sapiens
cagtgtgctatctggaagtctc

SEQ ID NO: 7821835 - DNA, 22 bp, Homo sapiens
cagtggttcctgttcttctggg

SEQ ID NO: 7821836 - DNA, 22 bp, Homo sapiens
cagtccagtccaatcctcaatg

SEQ ID NO: 7821837 - DNA, 22 bp, Homo sapiens
cagtggttcctgttcttctggg

SEQ ID NO: 7821838 - DNA, 22 bp, Homo sapiens
cagtggttctcaatcaggaatg

SEQ ID NO: 7821839 - DNA, 22 bp, Homo sapiens
cagtccagtccaatcctcaatg

SEQ ID NO: 7821840 - DNA, 22 bp, Homo sapiens
cagtccagtccaatcctcaatg

SEQ ID NO: 7821841 - DNA, 22 bp, Homo sapiens
cagtccaggttctttctctaaa

SEQ ID NO: 7821842 - DNA, 22 bp, Homo sapiens
cagtccaggttctttctctaaa

SEQ ID NO: 7821843 - DNA, 22 bp, Homo sapiens
cagtccaggttctttctctaaa

SEQ ID NO: 7821844 - DNA, 20 bp, Homo sapiens
cagtccaggctagaaaacaa

SEQ ID NO: 7821845 - DNA, 20 bp, Homo sapiens
cagtccaggctagaaaacaa

SEQ ID NO: 7821846 - DNA, 20 bp, Homo sapiens
cagtccaggctagaaaacaa

SEQ ID NO: 7821847 - DNA, 20 bp, Homo sapiens
cagtccaggctagaaaacaa

SEQ ID NO: 7821848 - DNA, 20 bp, Homo sapiens
cagtccaggctgcagcatct

SEQ ID NO: 7821849 - DNA, 22 bp, Homo sapiens
cagtgtggctgagacagaggct

SEQ ID NO: 7821850 - DNA, 22 bp, Homo sapiens
cagtgtggctgagacagaggct

SEQ ID NO: 7821851 - DNA, 22 bp, Homo sapiens
cagtgtggcttagggaataggc

SEQ ID NO: 7821852 - DNA, 22 bp, Homo sapiens
cagtgtggctgagacagaggct

SEQ ID NO: 7821853 - DNA, 22 bp, Homo sapiens
cagtgtggagggagagagcctg

SEQ ID NO: 7821854 - DNA, 22 bp, Homo sapiens
cagtgtggagggagagagcctg

SEQ ID NO: 7821855 - DNA, 22 bp, Homo sapiens
cagtgtgggtttgggaggagta

SEQ ID NO: 7821856 - DNA, 22 bp, Homo sapiens
cagtgtgggtttgggaggagta

SEQ ID NO: 7821857 - DNA, 22 bp, Homo sapiens
cagtgtgggtttgggaggagta

SEQ ID NO: 7821858 - DNA, 22 bp, Homo sapiens
cagtgtggcttagggaataggc

SEQ ID NO: 7821859 - DNA, 22 bp, Homo sapiens
cagtgtgggtgaaatacaaagt

SEQ ID NO: 7821860 - DNA, 22 bp, Homo sapiens
cagtgtggcttagggaataggc

SEQ ID NO: 7821861 - DNA, 22 bp, Homo sapiens
cagtgtgggtttgggaggagta

SEQ ID NO: 7821862 - DNA, 22 bp, Homo sapiens
cagtgtgggtgaaatacaaagt

SEQ ID NO: 7821863 - DNA, 22 bp, Homo sapiens
cagtgtgggtttgggaggagta

SEQ ID NO: 7821864 - DNA, 22 bp, Homo sapiens
cagtgtttagcacagtgcttgg

SEQ ID NO: 7821865 - DNA, 22 bp, Homo sapiens
cagtgtttagatcaagaaggcc

SEQ ID NO: 7821866 - DNA, 22 bp, Homo sapiens
aggagccacttaggtgagataa

SEQ ID NO: 7821867 - DNA, 22 bp, Homo sapiens
aggagccacttaggtgagataa

SEQ ID NO: 7821868 - DNA, 22 bp, Homo sapiens
aggagccacctaggagctgttt

SEQ ID NO: 7821869 - DNA, 22 bp, Homo sapiens
cagtgtgtggatcctcccagga

SEQ ID NO: 7821870 - DNA, 22 bp, Homo sapiens
cagtgttccctgaacatatgtt

SEQ ID NO: 7821871 - DNA, 22 bp, Homo sapiens
cagtgttccctgaacatatgtt

SEQ ID NO: 7821872 - DNA, 21 bp, Homo sapiens
cagtgtggtgaccagggtctc

SEQ ID NO: 7821873 - DNA, 21 bp, Homo sapiens
cagtgtggtgaccagggtctc

SEQ ID NO: 7821874 - DNA, 22 bp, Homo sapiens
cagtgtgggtttgggaggagta

SEQ ID NO: 7821875 - DNA, 22 bp, Homo sapiens
cagtgtggtgagattccaggtg

SEQ ID NO: 7821876 - DNA, 22 bp, Homo sapiens
cagtgtgtgactctgggggtac

SEQ ID NO: 7821877 - DNA, 22 bp, Homo sapiens
aggagccaggaaacctgctctg

SEQ ID NO: 7821878 - DNA, 22 bp, Homo sapiens
aggagccaggaaacctgctctg

SEQ ID NO: 7821879 - DNA, 22 bp, Homo sapiens
aggagccaggccccatggggct

SEQ ID NO: 7821880 - DNA, 22 bp, Homo sapiens
aggagccaggccccatggggct

SEQ ID NO: 7821881 - DNA, 22 bp, Homo sapiens
aggagccaggccccatggggct

SEQ ID NO: 7821882 - DNA, 22 bp, Homo sapiens
aggagccaggccccatggggct

SEQ ID NO: 7821883 - DNA, 22 bp, Homo sapiens
aggagccaggccccatggggct

SEQ ID NO: 7821884 - DNA, 22 bp, Homo sapiens
aggagccagcgttcctcaggat

SEQ ID NO: 7821885 - DNA, 22 bp, Homo sapiens
aggagccagcgttcctcaggat

SEQ ID NO: 7821886 - DNA, 22 bp, Homo sapiens
aggagccagcgttcctcaggat

SEQ ID NO: 7821887 - DNA, 22 bp, Homo sapiens
aggagccagcgttcctcaggat

SEQ ID NO: 7821888 - DNA, 22 bp, Homo sapiens
aggagccagaatccagactcgg

SEQ ID NO: 7821889 - DNA, 22 bp, Homo sapiens
aggagccagaatccagactcgg

SEQ ID NO: 7821890 - DNA, 22 bp, Homo sapiens
cataagaatcttccagggcatg

SEQ ID NO: 7821891 - DNA, 22 bp, Homo sapiens
cataaggtcaaaagaggctcaa

SEQ ID NO: 7821892 - DNA, 22 bp, Homo sapiens
cataagaatcttccagggcatg

SEQ ID NO: 7821893 - DNA, 22 bp, Homo sapiens
cataagaatatttagtggcagc

SEQ ID NO: 7821894 - DNA, 22 bp, Homo sapiens
cataagaatatttagtggcagc

SEQ ID NO: 7821895 - DNA, 22 bp, Homo sapiens
cataagaatatttagtggcagc

SEQ ID NO: 7821896 - DNA, 22 bp, Homo sapiens
cataagaatatttagtggcagc

SEQ ID NO: 7821897 - DNA, 22 bp, Homo sapiens
cataagaatattccatcctttg

SEQ ID NO: 7821898 - DNA, 22 bp, Homo sapiens
cataagaaggtaacatccttaa

SEQ ID NO: 7821899 - DNA, 22 bp, Homo sapiens
cataatatactacattgatgaa

SEQ ID NO: 7821900 - DNA, 22 bp, Homo sapiens
cataatatactacattgatgaa

SEQ ID NO: 7821901 - DNA, 17 bp, Homo sapiens
aggagctgggggtggtg

SEQ ID NO: 7821902 - DNA, 17 bp, Homo sapiens
aggagctgggggtggtg

SEQ ID NO: 7821903 - DNA, 17 bp, Homo sapiens
aggagctgggggtggtg

SEQ ID NO: 7821904 - DNA, 22 bp, Homo sapiens
cataacattattttctgaagat

SEQ ID NO: 7821905 - DNA, 22 bp, Homo sapiens
cataacattgagcagcattcct

SEQ ID NO: 7821906 - DNA, 22 bp, Homo sapiens
cataactgggagatccaagggt

SEQ ID NO: 7821907 - DNA, 22 bp, Homo sapiens
cataactggggacacttctcta

SEQ ID NO: 7821908 - DNA, 22 bp, Homo sapiens
cataagaaataatgatgatgac

SEQ ID NO: 7821909 - DNA, 22 bp, Homo sapiens
cataagaaatttaacagaactt

SEQ ID NO: 7821910 - DNA, 22 bp, Homo sapiens
cataagaaatttaacagaactt

SEQ ID NO: 7821911 - DNA, 22 bp, Homo sapiens
cataagaaataatgatgatgac

SEQ ID NO: 7821912 - DNA, 22 bp, Homo sapiens
cataagaaataatgatgatgac

SEQ ID NO: 7821913 - DNA, 22 bp, Homo sapiens
cataacatgtacatataaatgc

SEQ ID NO: 7821914 - DNA, 22 bp, Homo sapiens
cataacatgtacatataaatgc

SEQ ID NO: 7821915 - DNA, 22 bp, Homo sapiens
cataacatgtacatataaatgc

SEQ ID NO: 7821916 - DNA, 22 bp, Homo sapiens
cagttttattggttgaaatctg

SEQ ID NO: 7821917 - DNA, 22 bp, Homo sapiens
cataacatccttgctactttga

SEQ ID NO: 7821918 - DNA, 22 bp, Homo sapiens
cataacattattttctgaagat

SEQ ID NO: 7821919 - DNA, 22 bp, Homo sapiens
cataacatgtacatataaatgc

SEQ ID NO: 7821920 - DNA, 22 bp, Homo sapiens
cataacattaagcctctatttc

SEQ ID NO: 7821921 - DNA, 22 bp, Homo sapiens
cataacatgtacatataaatgc

SEQ ID NO: 7821922 - DNA, 22 bp, Homo sapiens
cataacatgtacatataaatgc

SEQ ID NO: 7821923 - DNA, 22 bp, Homo sapiens
aggagccatgagcaggaggcaa

SEQ ID NO: 7821924 - DNA, 22 bp, Homo sapiens
cagttttattggttgaaatctg

SEQ ID NO: 7821925 - DNA, 22 bp, Homo sapiens
cagttttattggttgaaatctg

SEQ ID NO: 7821926 - DNA, 22 bp, Homo sapiens
aggagccagtggagttcctgcc

SEQ ID NO: 7821927 - DNA, 22 bp, Homo sapiens
aggagccagttccaccccagga

SEQ ID NO: 7821928 - DNA, 22 bp, Homo sapiens
aggagccatccccatgagaggt

SEQ ID NO: 7821929 - DNA, 22 bp, Homo sapiens
aggagccatccccatgagaggt

SEQ ID NO: 7821930 - DNA, 22 bp, Homo sapiens
aggagccatccccatgagaggt

SEQ ID NO: 7821931 - DNA, 22 bp, Homo sapiens
aggagctggtagtctcattggg

SEQ ID NO: 7821932 - DNA, 22 bp, Homo sapiens
aggagctgggttcctttggtgg

SEQ ID NO: 7821933 - DNA, 22 bp, Homo sapiens
aggagctgggttcctttggtgg

SEQ ID NO: 7821934 - DNA, 22 bp, Homo sapiens
aggagctggtagtctcattggg

SEQ ID NO: 7821935 - DNA, 22 bp, Homo sapiens
aggagctgtcagagtgccagag

SEQ ID NO: 7821936 - DNA, 22 bp, Homo sapiens
aggagctggtagtctcattggg

SEQ ID NO: 7821937 - DNA, 22 bp, Homo sapiens
aggagctggtagtctcattggg

SEQ ID NO: 7821938 - DNA, 22 bp, Homo sapiens
aggagctggtagtctcattggg

SEQ ID NO: 7821939 - DNA, 22 bp, Homo sapiens
aggagctgggttcctttggtgg

SEQ ID NO: 7821940 - DNA, 16 bp, Homo sapiens
aggagctgggtaggag

SEQ ID NO: 7821941 - DNA, 22 bp, Homo sapiens
aggagctgggttcctttggtgg

SEQ ID NO: 7821942 - DNA, 16 bp, Homo sapiens
aggagctgggtaggag

SEQ ID NO: 7821943 - DNA, 16 bp, Homo sapiens
aggagctgggtaggag

SEQ ID NO: 7821944 - DNA, 22 bp, Homo sapiens
aggagctgtcagagtgccagag

SEQ ID NO: 7821945 - DNA, 22 bp, Homo sapiens
aggagctgtcagagtgccagag

SEQ ID NO: 7821946 - DNA, 22 bp, Homo sapiens
aggagctgtcagagtgccagag

SEQ ID NO: 7821947 - DNA, 22 bp, Homo sapiens
aggagctgtcagagtgccagag

SEQ ID NO: 7821948 - DNA, 22 bp, Homo sapiens
aggagctgtcagagtgccagag

SEQ ID NO: 7821949 - DNA, 22 bp, Homo sapiens
aggagctgtcatttgattcaca

SEQ ID NO: 7821950 - DNA, 22 bp, Homo sapiens
aggagctgtgaatgggaggggt

SEQ ID NO: 7821951 - DNA, 22 bp, Homo sapiens
aggagctgtgaatgggaggggt

SEQ ID NO: 7821952 - DNA, 22 bp, Homo sapiens
aggagctgtcagagtgccagag

SEQ ID NO: 7821953 - DNA, 22 bp, Homo sapiens
aggagctgtcagagtgccagag

SEQ ID NO: 7821954 - DNA, 22 bp, Homo sapiens
aggagctgtcatttgattcaca

SEQ ID NO: 7821955 - DNA, 23 bp, Homo sapiens
aggaggcctgaaactgaggctga

SEQ ID NO: 7821956 - DNA, 23 bp, Homo sapiens
aggaggcctgaaactgaggctga

SEQ ID NO: 7821957 - DNA, 23 bp, Homo sapiens
aggaggcctgaaactgaggctga

SEQ ID NO: 7821958 - DNA, 22 bp, Homo sapiens
aggaggcctctatccagagaga

SEQ ID NO: 7821959 - DNA, 22 bp, Homo sapiens
aggaggcctctatccagagaga

SEQ ID NO: 7821960 - DNA, 23 bp, Homo sapiens
aggaggcctgaaactgaggctga

SEQ ID NO: 7821961 - DNA, 22 bp, Homo sapiens
aggaggcctacgcacatgtcta

SEQ ID NO: 7821962 - DNA, 22 bp, Homo sapiens
aggaggcctacgcacatgtcta

SEQ ID NO: 7821963 - DNA, 22 bp, Homo sapiens
aggaggcctacgcacatgtcta

SEQ ID NO: 7821964 - DNA, 22 bp, Homo sapiens
aggaggccgggattctggagat

SEQ ID NO: 7821965 - DNA, 22 bp, Homo sapiens
aggaggccgggattctggagat

SEQ ID NO: 7821966 - DNA, 22 bp, Homo sapiens
aggaggccgctgatgggctccc

SEQ ID NO: 7821967 - DNA, 22 bp, Homo sapiens
aggaggccgctgatgggctccc

SEQ ID NO: 7821968 - DNA, 22 bp, Homo sapiens
aggaggcaggaagtctatggga

SEQ ID NO: 7821969 - DNA, 22 bp, Homo sapiens
aggaggcaggaagtctatggga

SEQ ID NO: 7821970 - DNA, 22 bp, Homo sapiens
aggaggcagatgcttggctgta

SEQ ID NO: 7821971 - DNA, 22 bp, Homo sapiens
aggaggcagatgcttggctgta

SEQ ID NO: 7821972 - DNA, 22 bp, Homo sapiens
aggagctgtgaatgggaggggt

SEQ ID NO: 7821973 - DNA, 22 bp, Homo sapiens
aggaggcagatgcttggctgta

SEQ ID NO: 7821974 - DNA, 22 bp, Homo sapiens
aggagctgtgaatgggaggggt

SEQ ID NO: 7821975 - DNA, 22 bp, Homo sapiens
aggagctgtgaatgggaggggt

SEQ ID NO: 7821976 - DNA, 22 bp, Homo sapiens
catctcttcattagcattattg

SEQ ID NO: 7821977 - DNA, 22 bp, Homo sapiens
catcttaatttctaacaggcac

SEQ ID NO: 7821978 - DNA, 21 bp, Homo sapiens
catcttaggttgtacatatat

SEQ ID NO: 7821979 - DNA, 21 bp, Homo sapiens
catcttaggttgtacatatat

SEQ ID NO: 7821980 - DNA, 22 bp, Homo sapiens
catcttcaccagagacaagcaa

SEQ ID NO: 7821981 - DNA, 22 bp, Homo sapiens
catcttaatttctaacaggcac

SEQ ID NO: 7821982 - DNA, 22 bp, Homo sapiens
catcttataggcagagttcagt

SEQ ID NO: 7821983 - DNA, 22 bp, Homo sapiens
catcttattttcttctagtgct

SEQ ID NO: 7821984 - DNA, 22 bp, Homo sapiens
catcttcaccagagacaagcaa

SEQ ID NO: 7821985 - DNA, 22 bp, Homo sapiens
catcttcaggggctacatctgt

SEQ ID NO: 7821986 - DNA, 22 bp, Homo sapiens
catctctgtgtccccagagctt

SEQ ID NO: 7821987 - DNA, 22 bp, Homo sapiens
catctctgtgtccccagagctt

SEQ ID NO: 7821988 - DNA, 22 bp, Homo sapiens
catctctgtgtccccagagctt

SEQ ID NO: 7821989 - DNA, 22 bp, Homo sapiens
catctctgtgtccccagagctt

SEQ ID NO: 7821990 - DNA, 19 bp, Homo sapiens
catctctgcaaggagctgc

SEQ ID NO: 7821991 - DNA, 19 bp, Homo sapiens
catctctgcaaggagctgc

SEQ ID NO: 7821992 - DNA, 19 bp, Homo sapiens
catctctgcaaggagctgc

SEQ ID NO: 7821993 - DNA, 22 bp, Homo sapiens
catctctgagacctcagctggg

SEQ ID NO: 7821994 - DNA, 22 bp, Homo sapiens
catctctccacggcagctctcg

SEQ ID NO: 7821995 - DNA, 19 bp, Homo sapiens
catctctgcaaggagctgc

SEQ ID NO: 7821996 - DNA, 22 bp, Homo sapiens
catctctgagacctcagctggg

SEQ ID NO: 7821997 - DNA, 22 bp, Homo sapiens
catctctccacggcagctctcg

SEQ ID NO: 7821998 - DNA, 20 bp, Homo sapiens
catctcctgcctccatgttc

SEQ ID NO: 7821999 - DNA, 20 bp, Homo sapiens
catctcctgcctccatgttc

SEQ ID NO: 7822000 - DNA, 22 bp, Homo sapiens
catctcctggcagctgttagga

SEQ ID NO: 7822001 - DNA, 22 bp, Homo sapiens
catctcatttattccaactcag

SEQ ID NO: 7822002 - DNA, 22 bp, Homo sapiens
catctcatcctgccctaaaaca

SEQ ID NO: 7822003 - DNA, 22 bp, Homo sapiens
catctcatcctgccctaaaaca

SEQ ID NO: 7822004 - DNA, 22 bp, Homo sapiens
catctccaggagttctactcat

SEQ ID NO: 7822005 - DNA, 19 bp, Homo sapiens
catctcccacagccacaca

SEQ ID NO: 7822006 - DNA, 22 bp, Homo sapiens
catctccaggtttagggagcac

SEQ ID NO: 7822007 - DNA, 22 bp, Homo sapiens
catctcatcctgccctaaaaca

SEQ ID NO: 7822008 - DNA, 22 bp, Homo sapiens
catctcatcagtgagagtcagc

SEQ ID NO: 7822009 - DNA, 22 bp, Homo sapiens
catctcatagtgcagtgctgta

SEQ ID NO: 7822010 - DNA, 22 bp, Homo sapiens
catccaagaaaattttctctct

SEQ ID NO: 7822011 - DNA, 22 bp, Homo sapiens
catccaataccagtttgcaggc

SEQ ID NO: 7822012 - DNA, 22 bp, Homo sapiens
catctcagtgtacagggagtct

SEQ ID NO: 7822013 - DNA, 22 bp, Homo sapiens
catacatatgtggatgtcatat

SEQ ID NO: 7822014 - DNA, 22 bp, Homo sapiens
catacatatgtggatgtcatat

SEQ ID NO: 7822015 - DNA, 22 bp, Homo sapiens
catacatatgtggatgtcatat

SEQ ID NO: 7822016 - DNA, 22 bp, Homo sapiens
catccaaactctcattatctgt

SEQ ID NO: 7822017 - DNA, 22 bp, Homo sapiens
catccaaactctcattatctgt

SEQ ID NO: 7822018 - DNA, 22 bp, Homo sapiens
catccaaagcaaatatcttaaa

SEQ ID NO: 7822019 - DNA, 22 bp, Homo sapiens
catccaaagcaaatatcttaaa

SEQ ID NO: 7822020 - DNA, 22 bp, Homo sapiens
catacataccactgctgtcttt

SEQ ID NO: 7822021 - DNA, 22 bp, Homo sapiens
catacagttttccctagatgtg

SEQ ID NO: 7822022 - DNA, 22 bp, Homo sapiens
catacatactgagtggactgat

SEQ ID NO: 7822023 - DNA, 22 bp, Homo sapiens
catacatactgagtggactgat

SEQ ID NO: 7822024 - DNA, 22 bp, Homo sapiens
catacatatgcatgtgtgtata

SEQ ID NO: 7822025 - DNA, 22 bp, Homo sapiens
catacagttttccctagatgtg

SEQ ID NO: 7822026 - DNA, 22 bp, Homo sapiens
catacagtgtggcatgtagtct

SEQ ID NO: 7822027 - DNA, 22 bp, Homo sapiens
catacagagaaggataataaag

SEQ ID NO: 7822028 - DNA, 22 bp, Homo sapiens
catacagagaaggataataaag

SEQ ID NO: 7822029 - DNA, 22 bp, Homo sapiens
catacagatggccaggcctcac

SEQ ID NO: 7822030 - DNA, 22 bp, Homo sapiens
catacagagaaggataataaag

SEQ ID NO: 7822031 - DNA, 22 bp, Homo sapiens
catacaagcgttcaatagatgt

SEQ ID NO: 7822032 - DNA, 22 bp, Homo sapiens
catacaagcgttcaatagatgt

SEQ ID NO: 7822033 - DNA, 22 bp, Homo sapiens
catacaagcgttcaatagatgt

SEQ ID NO: 7822034 - DNA, 22 bp, Homo sapiens
catacaagcgttcaatagatgt

SEQ ID NO: 7822035 - DNA, 22 bp, Homo sapiens
catacaagcgttcaatagatgt

SEQ ID NO: 7822036 - DNA, 22 bp, Homo sapiens
catacaaatgtgtccaggctct

SEQ ID NO: 7822037 - DNA, 22 bp, Homo sapiens
catacaaatgtgtccaggctct

SEQ ID NO: 7822038 - DNA, 22 bp, Homo sapiens
catacaaatgtgtccaggctct

SEQ ID NO: 7822039 - DNA, 22 bp, Homo sapiens
catacaagcgtgcatgtgcttg

SEQ ID NO: 7822040 - DNA, 22 bp, Homo sapiens
catacaagcgtgcatgtgcttg

SEQ ID NO: 7822041 - DNA, 22 bp, Homo sapiens
catacaaatgtgtccaggctct

SEQ ID NO: 7822042 - DNA, 22 bp, Homo sapiens
catacaatcaagttctttatta

SEQ ID NO: 7822043 - DNA, 20 bp, Homo sapiens
catacactattctgtatagt

SEQ ID NO: 7822044 - DNA, 20 bp, Homo sapiens
catacactattctgtatagt

SEQ ID NO: 7822045 - DNA, 22 bp, Homo sapiens
catacagaaaatatattttgat

SEQ ID NO: 7822046 - DNA, 22 bp, Homo sapiens
aggaggctgaactagggtctgg

SEQ ID NO: 7822047 - DNA, 22 bp, Homo sapiens
aggaggctgaactagggtctgg

SEQ ID NO: 7822048 - DNA, 22 bp, Homo sapiens
aggaggctgaactagggtctgg

SEQ ID NO: 7822049 - DNA, 22 bp, Homo sapiens
aggaggctgaactagggtctgg

SEQ ID NO: 7822050 - DNA, 22 bp, Homo sapiens
aggaggctgaactagggtctgg

SEQ ID NO: 7822051 - DNA, 22 bp, Homo sapiens
aggaggctctcaggtcctcccc

SEQ ID NO: 7822052 - DNA, 22 bp, Homo sapiens
catacaaatgtgtccaggctct

SEQ ID NO: 7822053 - DNA, 22 bp, Homo sapiens
catacaaatgtgtccaggctct

SEQ ID NO: 7822054 - DNA, 22 bp, Homo sapiens
catacaaatgtgtccaggctct

SEQ ID NO: 7822055 - DNA, 22 bp, Homo sapiens
catacaaatgtgtccaggctct

SEQ ID NO: 7822056 - DNA, 22 bp, Homo sapiens
catacaaatgtgtccaggctct

SEQ ID NO: 7822057 - DNA, 22 bp, Homo sapiens
aggaggctgcaaccctgaggcc

SEQ ID NO: 7822058 - DNA, 22 bp, Homo sapiens
catacaaatgtgtccaggctct

SEQ ID NO: 7822059 - DNA, 22 bp, Homo sapiens
aggaggcctgtgtttgtctgta

SEQ ID NO: 7822060 - DNA, 22 bp, Homo sapiens
aggaggcctgttttctcctgga

SEQ ID NO: 7822061 - DNA, 22 bp, Homo sapiens
aggaggcctgtgtttgtctgta

SEQ ID NO: 7822062 - DNA, 22 bp, Homo sapiens
aggaggcctgttttctcctgga

SEQ ID NO: 7822063 - DNA, 22 bp, Homo sapiens
aggaggccttggggcttagagc

SEQ ID NO: 7822064 - DNA, 22 bp, Homo sapiens
aggaggctctcaggtcctcccc

SEQ ID NO: 7822065 - DNA, 22 bp, Homo sapiens
aggaggctctcaggtcctcccc

SEQ ID NO: 7822066 - DNA, 22 bp, Homo sapiens
aggaggcctgcagctgccattc

SEQ ID NO: 7822067 - DNA, 20 bp, Homo sapiens
aggaggcctgcagatagttc

SEQ ID NO: 7822068 - DNA, 20 bp, Homo sapiens
aggaggcctgcagatagttc

SEQ ID NO: 7822069 - DNA, 22 bp, Homo sapiens
aggaggcctggctggggagatc

SEQ ID NO: 7822070 - DNA, 22 bp, Homo sapiens
aggaggcctggctggggagatc

SEQ ID NO: 7822071 - DNA, 22 bp, Homo sapiens
aggaggcctggctggggagatc

SEQ ID NO: 7822072 - DNA, 22 bp, Homo sapiens
aggaggcctgcagctgccattc

SEQ ID NO: 7822073 - DNA, 22 bp, Homo sapiens
aggaggcctgcagctgccattc

SEQ ID NO: 7822074 - DNA, 22 bp, Homo sapiens
aggaggcctgcagctgccattc

SEQ ID NO: 7822075 - DNA, 23 bp, Homo sapiens
aggatgtaggatgtatggcagag

SEQ ID NO: 7822076 - DNA, 20 bp, Homo sapiens
aggatgtccccgagggcctg

SEQ ID NO: 7822077 - DNA, 22 bp, Homo sapiens
aggatgtcagcattggctagag

SEQ ID NO: 7822078 - DNA, 22 bp, Homo sapiens
aggatgtcagcattggctagag

SEQ ID NO: 7822079 - DNA, 22 bp, Homo sapiens
aggatgtctctccagcctggag

SEQ ID NO: 7822080 - DNA, 23 bp, Homo sapiens
aggatgtcgaatgttagagtgag

SEQ ID NO: 7822081 - DNA, 22 bp, Homo sapiens
aggatgtctctccagcctggag

SEQ ID NO: 7822082 - DNA, 22 bp, Homo sapiens
aggatgtctgctgctgtgggct

SEQ ID NO: 7822083 - DNA, 22 bp, Homo sapiens
aggatgtgagtggacacagtcc

SEQ ID NO: 7822084 - DNA, 22 bp, Homo sapiens
aggatgtgagccagcctggcct

SEQ ID NO: 7822085 - DNA, 22 bp, Homo sapiens
aggatgtgagtggacacagtcc

SEQ ID NO: 7822086 - DNA, 22 bp, Homo sapiens
aggatgtgccaccagctttgca

SEQ ID NO: 7822087 - DNA, 23 bp, Homo sapiens
aggatgtgcatatgacctaatca

SEQ ID NO: 7822088 - DNA, 22 bp, Homo sapiens
aggatgtgccaccagctttgca

SEQ ID NO: 7822089 - DNA, 22 bp, Homo sapiens
catgagataatttttctccagt

SEQ ID NO: 7822090 - DNA, 22 bp, Homo sapiens
catgagataatttttctccagt

SEQ ID NO: 7822091 - DNA, 22 bp, Homo sapiens
catgagataatttttctccagt

SEQ ID NO: 7822092 - DNA, 22 bp, Homo sapiens
catgagataatttttctccagt

SEQ ID NO: 7822093 - DNA, 22 bp, Homo sapiens
catgagatttgggaggggccag

SEQ ID NO: 7822094 - DNA, 22 bp, Homo sapiens
catgagaatgaagaagacttaa

SEQ ID NO: 7822095 - DNA, 22 bp, Homo sapiens
catgagagacattctgtgtgaa

SEQ ID NO: 7822096 - DNA, 22 bp, Homo sapiens
catgagagacattctgtgtgaa

SEQ ID NO: 7822097 - DNA, 22 bp, Homo sapiens
aggatgtgggttttcacattgt

SEQ ID NO: 7822098 - DNA, 17 bp, Homo sapiens
aggatgtggagaaaatt

SEQ ID NO: 7822099 - DNA, 22 bp, Homo sapiens
aggatgtggctgagacttctgg

SEQ ID NO: 7822100 - DNA, 22 bp, Homo sapiens
catgagctgctgggagcctgtc

SEQ ID NO: 7822101 - DNA, 22 bp, Homo sapiens
catgagcattttggtctagttt

SEQ ID NO: 7822102 - DNA, 22 bp, Homo sapiens
catgaggatgggcagctgggga

SEQ ID NO: 7822103 - DNA, 22 bp, Homo sapiens
catgaggatccaggtgacaggc

SEQ ID NO: 7822104 - DNA, 22 bp, Homo sapiens
catgaggatccaggtgacaggc

SEQ ID NO: 7822105 - DNA, 22 bp, Homo sapiens
catgagatttgggaggggccag

SEQ ID NO: 7822106 - DNA, 22 bp, Homo sapiens
catgagatttgggaggggccag

SEQ ID NO: 7822107 - DNA, 22 bp, Homo sapiens
catgagatttgggaggggccag

SEQ ID NO: 7822108 - DNA, 22 bp, Homo sapiens
catgagatttgggaggggccag

SEQ ID NO: 7822109 - DNA, 22 bp, Homo sapiens
catgaggtgataaagctgggat

SEQ ID NO: 7822110 - DNA, 22 bp, Homo sapiens
catgaggtcagggggagccggt

SEQ ID NO: 7822111 - DNA, 22 bp, Homo sapiens
catgaggtcagggggagccggt

SEQ ID NO: 7822112 - DNA, 22 bp, Homo sapiens
catgaggtcagggggagccggt

SEQ ID NO: 7822113 - DNA, 22 bp, Homo sapiens
catgaggatgggcagctgggga

SEQ ID NO: 7822114 - DNA, 22 bp, Homo sapiens
catgagggttggggtggagctt

SEQ ID NO: 7822115 - DNA, 19 bp, Homo sapiens
catgaggcagctgcacccc

SEQ ID NO: 7822116 - DNA, 22 bp, Homo sapiens
aggatttgtttataggtcttaa

SEQ ID NO: 7822117 - DNA, 22 bp, Homo sapiens
aggattttgacttattcaggga

SEQ ID NO: 7822118 - DNA, 22 bp, Homo sapiens
aggatttgtggctctgagtctg

SEQ ID NO: 7822119 - DNA, 22 bp, Homo sapiens
aggatttgttgagttttagtgg

SEQ ID NO: 7822120 - DNA, 22 bp, Homo sapiens
aggatttgaacctgcatccagt

SEQ ID NO: 7822121 - DNA, 20 bp, Homo sapiens
aggatttgagaaggcgtctt

SEQ ID NO: 7822122 - DNA, 22 bp, Homo sapiens
aggatttgcactggtgtttgag

SEQ ID NO: 7822123 - DNA, 22 bp, Homo sapiens
aggatttggccatggcttcggg

SEQ ID NO: 7822124 - DNA, 22 bp, Homo sapiens
aggatttggggaagaaaacact

SEQ ID NO: 7822125 - DNA, 22 bp, Homo sapiens
aggatttgtatagctttctttt

SEQ ID NO: 7822126 - DNA, 22 bp, Homo sapiens
catcttcaggttcatggtcata

SEQ ID NO: 7822127 - DNA, 22 bp, Homo sapiens
catcttcaggttcatggtcata

SEQ ID NO: 7822128 - DNA, 22 bp, Homo sapiens
catcttcaggttcatggtcata

SEQ ID NO: 7822129 - DNA, 22 bp, Homo sapiens
catcttctgggacttctcagtt

SEQ ID NO: 7822130 - DNA, 22 bp, Homo sapiens
catcttggatgacataactgtg

SEQ ID NO: 7822131 - DNA, 19 bp, Homo sapiens
catcttggagtactccttt

SEQ ID NO: 7822132 - DNA, 19 bp, Homo sapiens
catcttggagtactccttt

SEQ ID NO: 7822133 - DNA, 22 bp, Homo sapiens
catcttgcttgtctttagtaag

SEQ ID NO: 7822134 - DNA, 22 bp, Homo sapiens
catcttgcttgtctttagtaag

SEQ ID NO: 7822135 - DNA, 22 bp, Homo sapiens
catcttgcttcatctgctgtgt

SEQ ID NO: 7822136 - DNA, 22 bp, Homo sapiens
catcttgcttcatctgctgtgt

SEQ ID NO: 7822137 - DNA, 22 bp, Homo sapiens
catcttgcttcatctgctgtgt

SEQ ID NO: 7822138 - DNA, 17 bp, Homo sapiens
catctttaaaatcctga

SEQ ID NO: 7822139 - DNA, 17 bp, Homo sapiens
catctttaaaatcctga

SEQ ID NO: 7822140 - DNA, 17 bp, Homo sapiens
catctttaaaatcctga

SEQ ID NO: 7822141 - DNA, 22 bp, Homo sapiens
catcttgtgaatttctgattct

SEQ ID NO: 7822142 - DNA, 22 bp, Homo sapiens
catcttgtgaatttctgattct

SEQ ID NO: 7822143 - DNA, 22 bp, Homo sapiens
catcttgccctacacatttatc

SEQ ID NO: 7822144 - DNA, 22 bp, Homo sapiens
catcttgatgctttgacaggtt

SEQ ID NO: 7822145 - DNA, 22 bp, Homo sapiens
catcttgctgttatgtttatgt

SEQ ID NO: 7822146 - DNA, 22 bp, Homo sapiens
catcttgccctacacatttatc

SEQ ID NO: 7822147 - DNA, 22 bp, Homo sapiens
catcttgctgggttttatcata

SEQ ID NO: 7822148 - DNA, 22 bp, Homo sapiens
catcttgctgggttttatcata

SEQ ID NO: 7822149 - DNA, 22 bp, Homo sapiens
catcttgctgacttgcattatt

SEQ ID NO: 7822150 - DNA, 22 bp, Homo sapiens
catcttgcctgctattctgttg

SEQ ID NO: 7822151 - DNA, 22 bp, Homo sapiens
catcttgcctgctattctgttg

SEQ ID NO: 7822152 - DNA, 22 bp, Homo sapiens
aggatggcttgcaggaggctgt

SEQ ID NO: 7822153 - DNA, 22 bp, Homo sapiens
aggatggcttgcaggaggctgt

SEQ ID NO: 7822154 - DNA, 22 bp, Homo sapiens
aggatgagagatacatggagca

SEQ ID NO: 7822155 - DNA, 22 bp, Homo sapiens
aggatggcttgcaggaggctgt

SEQ ID NO: 7822156 - DNA, 22 bp, Homo sapiens
aggatgagagatacatggagca

SEQ ID NO: 7822157 - DNA, 17 bp, Homo sapiens
catctttaaaatcctga

SEQ ID NO: 7822158 - DNA, 22 bp, Homo sapiens
aggatggcttgcaggaggctgt

SEQ ID NO: 7822159 - DNA, 22 bp, Homo sapiens
aggatgggcctgggatatgctt

SEQ ID NO: 7822160 - DNA, 22 bp, Homo sapiens
aggatgagagatacatggagca

SEQ ID NO: 7822161 - DNA, 22 bp, Homo sapiens
aggatggggtctgcagcctggt

SEQ ID NO: 7822162 - DNA, 22 bp, Homo sapiens
aggatggggtctgcagcctggt

SEQ ID NO: 7822163 - DNA, 22 bp, Homo sapiens
aggatggggtctgcagcctggt

SEQ ID NO: 7822164 - DNA, 22 bp, Homo sapiens
aggatgggtcagctagagtcca

SEQ ID NO: 7822165 - DNA, 22 bp, Homo sapiens
aggatgggtcagctagagtcca

SEQ ID NO: 7822166 - DNA, 22 bp, Homo sapiens
aggatggggtctgcagcctggt

SEQ ID NO: 7822167 - DNA, 22 bp, Homo sapiens
aggatggggtctgcagcctggt

SEQ ID NO: 7822168 - DNA, 23 bp, Homo sapiens
aggatgggtggcaatagaaagac

SEQ ID NO: 7822169 - DNA, 22 bp, Homo sapiens
aggatgggtcagctagagtcca

SEQ ID NO: 7822170 - DNA, 23 bp, Homo sapiens
aggatgggtggcaatagaaagac

SEQ ID NO: 7822171 - DNA, 23 bp, Homo sapiens
aggatgtaggatgtatggcagag

SEQ ID NO: 7822172 - DNA, 23 bp, Homo sapiens
aggatgtaggatgtatggcagag

SEQ ID NO: 7822173 - DNA, 23 bp, Homo sapiens
aggatgtaggatgtatggcagag

SEQ ID NO: 7822174 - DNA, 23 bp, Homo sapiens
aggatgggtggcaatagaaagac

SEQ ID NO: 7822175 - DNA, 23 bp, Homo sapiens
aggatgtaggatgtatggcagag

SEQ ID NO: 7822176 - DNA, 22 bp, Homo sapiens
aggctctggcaacagctggtgt

SEQ ID NO: 7822177 - DNA, 22 bp, Homo sapiens
aggctctggcaacagctggtgt

SEQ ID NO: 7822178 - DNA, 22 bp, Homo sapiens
aggctctggagttagccaggca

SEQ ID NO: 7822179 - DNA, 22 bp, Homo sapiens
aggctctggagttagccaggca

SEQ ID NO: 7822180 - DNA, 22 bp, Homo sapiens
aggctctggcaacagctggtgt

SEQ ID NO: 7822181 - DNA, 22 bp, Homo sapiens
aggctctggcaacagctggtgt

SEQ ID NO: 7822182 - DNA, 22 bp, Homo sapiens
aggctctggctactacagagct

SEQ ID NO: 7822183 - DNA, 22 bp, Homo sapiens
aggctctggctactacagagct

SEQ ID NO: 7822184 - DNA, 22 bp, Homo sapiens
aggctctggcaacagctggtgt

SEQ ID NO: 7822185 - DNA, 22 bp, Homo sapiens
aggctctggctactacagagct

SEQ ID NO: 7822186 - DNA, 23 bp, Homo sapiens
aggctgcagaagaatagggtcat

SEQ ID NO: 7822187 - DNA, 23 bp, Homo sapiens
aggctgcagaagaatagggtcat

SEQ ID NO: 7822188 - DNA, 21 bp, Homo sapiens
aggctgctctttcttgtggta

SEQ ID NO: 7822189 - DNA, 22 bp, Homo sapiens
aggctgctctgcgaagtcagct

SEQ ID NO: 7822190 - DNA, 22 bp, Homo sapiens
aggctgctctgcgaagtcagct

SEQ ID NO: 7822191 - DNA, 21 bp, Homo sapiens
aggctgctctttcttgtggta

SEQ ID NO: 7822192 - DNA, 22 bp, Homo sapiens
aggctgctgccttggagagtgt

SEQ ID NO: 7822193 - DNA, 22 bp, Homo sapiens
aggctgctgaggccaccacgct

SEQ ID NO: 7822194 - DNA, 22 bp, Homo sapiens
aggctgctgaggccaccacgct

SEQ ID NO: 7822195 - DNA, 23 bp, Homo sapiens
aggctgctgagatgggtgtgtca

SEQ ID NO: 7822196 - DNA, 23 bp, Homo sapiens
aggctgctgagatgggtgtgtca

SEQ ID NO: 7822197 - DNA, 21 bp, Homo sapiens
aggctgctggctcagggtcct

SEQ ID NO: 7822198 - DNA, 17 bp, Homo sapiens
aggctgctgggccaggg

SEQ ID NO: 7822199 - DNA, 17 bp, Homo sapiens
aggctgctgggccaggg

SEQ ID NO: 7822200 - DNA, 17 bp, Homo sapiens
aggctgctgggccaggg

SEQ ID NO: 7822201 - DNA, 17 bp, Homo sapiens
aggctgctgggccaggg

SEQ ID NO: 7822202 - DNA, 17 bp, Homo sapiens
aggctgctgggccaggg

SEQ ID NO: 7822203 - DNA, 23 bp, Homo sapiens
aggctgcttactggtatcagagc

SEQ ID NO: 7822204 - DNA, 22 bp, Homo sapiens
aggctgcttcaatggataagat

SEQ ID NO: 7822205 - DNA, 22 bp, Homo sapiens
acatttctcagggagttttgct

SEQ ID NO: 7822206 - DNA, 22 bp, Homo sapiens
aggctgcttcagctgcagggag

SEQ ID NO: 7822207 - DNA, 22 bp, Homo sapiens
aggctgcttcagctgcagggag

SEQ ID NO: 7822208 - DNA, 22 bp, Homo sapiens
aggctgctggcaggcgtggacg

SEQ ID NO: 7822209 - DNA, 22 bp, Homo sapiens
aggctgctggcaggcgtggacg

SEQ ID NO: 7822210 - DNA, 22 bp, Homo sapiens
aggctgctggcaggcgtggacg

SEQ ID NO: 7822211 - DNA, 22 bp, Homo sapiens
aggctgctggctaagaataaga

SEQ ID NO: 7822212 - DNA, 21 bp, Homo sapiens
aggctgctggctcagggtcct

SEQ ID NO: 7822213 - DNA, 21 bp, Homo sapiens
aggctgctggctcagggtcct

SEQ ID NO: 7822214 - DNA, 22 bp, Homo sapiens
aggctgctgccttggagagtgt

SEQ ID NO: 7822215 - DNA, 22 bp, Homo sapiens
aggctgctggcaggcgtggacg

SEQ ID NO: 7822216 - DNA, 22 bp, Homo sapiens
aggctgctggcaggcgtggacg

SEQ ID NO: 7822217 - DNA, 22 bp, Homo sapiens
aggctgctggaggatttatgcc

SEQ ID NO: 7822218 - DNA, 22 bp, Homo sapiens
aggctgctggaggatttatgcc

SEQ ID NO: 7822219 - DNA, 22 bp, Homo sapiens
acatttctcaggtaagtcattt

SEQ ID NO: 7822220 - DNA, 22 bp, Homo sapiens
acatttctcaggtaagtcattt

SEQ ID NO: 7822221 - DNA, 22 bp, Homo sapiens
acatttctcaggtaagtcattt

SEQ ID NO: 7822222 - DNA, 22 bp, Homo sapiens
acatttctcaggtaagtcattt

SEQ ID NO: 7822223 - DNA, 22 bp, Homo sapiens
acatttctcaggtaagtcattt

SEQ ID NO: 7822224 - DNA, 22 bp, Homo sapiens
acatttctcatctagtagagta

SEQ ID NO: 7822225 - DNA, 22 bp, Homo sapiens
acatttctcataggagagccac

SEQ ID NO: 7822226 - DNA, 22 bp, Homo sapiens
acatttctcataggagagccac

SEQ ID NO: 7822227 - DNA, 22 bp, Homo sapiens
acatttctcatctagtagagta

SEQ ID NO: 7822228 - DNA, 22 bp, Homo sapiens
acatttctccctgcatgcctgc

SEQ ID NO: 7822229 - DNA, 22 bp, Homo sapiens
acatttctccctgcatgcctgc

SEQ ID NO: 7822230 - DNA, 22 bp, Homo sapiens
acatttctccctgcatgcctgc

SEQ ID NO: 7822231 - DNA, 22 bp, Homo sapiens
acatttctccctgcatgcctgc

SEQ ID NO: 7822232 - DNA, 22 bp, Homo sapiens
acatttctccctgcatgcctgc

SEQ ID NO: 7822233 - DNA, 22 bp, Homo sapiens
acatttctcattctcccctaac

SEQ ID NO: 7822234 - DNA, 18 bp, Homo sapiens
acatttctccttctgacc

SEQ ID NO: 7822235 - DNA, 18 bp, Homo sapiens
acatttctccttctgacc

SEQ ID NO: 7822236 - DNA, 18 bp, Homo sapiens
acatttctccttctgacc

SEQ ID NO: 7822237 - DNA, 22 bp, Homo sapiens
acatttctcctacttgttattt

SEQ ID NO: 7822238 - DNA, 22 bp, Homo sapiens
acatttctcctacttgttattt

SEQ ID NO: 7822239 - DNA, 18 bp, Homo sapiens
acatttctccttctgacc

SEQ ID NO: 7822240 - DNA, 22 bp, Homo sapiens
aggctggcttcccaagcgtcct

SEQ ID NO: 7822241 - DNA, 22 bp, Homo sapiens
aggctggcttcccaagcgtcct

SEQ ID NO: 7822242 - DNA, 23 bp, Homo sapiens
aggctggcttcaggagcctctcc

SEQ ID NO: 7822243 - DNA, 23 bp, Homo sapiens
aggctggcttcaggagcctctcc

SEQ ID NO: 7822244 - DNA, 23 bp, Homo sapiens
aggctggcttcaggagcctctcc

SEQ ID NO: 7822245 - DNA, 23 bp, Homo sapiens
aggctggcttcaggagcctctcc

SEQ ID NO: 7822246 - DNA, 23 bp, Homo sapiens
aggctggcttcaggagcctctcc

SEQ ID NO: 7822247 - DNA, 22 bp, Homo sapiens
aggctggcttggctctcctgtg

SEQ ID NO: 7822248 - DNA, 22 bp, Homo sapiens
aggctggcttggctctcctgtg

SEQ ID NO: 7822249 - DNA, 22 bp, Homo sapiens
aggctggcttggctctcctgtg

SEQ ID NO: 7822250 - DNA, 22 bp, Homo sapiens
aggctggcttcccaagcgtcct

SEQ ID NO: 7822251 - DNA, 22 bp, Homo sapiens
aggctggcttggctctcctgtg

SEQ ID NO: 7822252 - DNA, 23 bp, Homo sapiens
aggctggcttcaggagcctctcc

SEQ ID NO: 7822253 - DNA, 23 bp, Homo sapiens
aggctggcttcaggagcctctcc

SEQ ID NO: 7822254 - DNA, 22 bp, Homo sapiens
aggctggctggggatgcgtctt

SEQ ID NO: 7822255 - DNA, 22 bp, Homo sapiens
aggctggccagtgctgcagtgg

SEQ ID NO: 7822256 - DNA, 22 bp, Homo sapiens
aggctggccagtgctgcagtgg

SEQ ID NO: 7822257 - DNA, 22 bp, Homo sapiens
aggctggccagtgctgcagtgg

SEQ ID NO: 7822258 - DNA, 22 bp, Homo sapiens
aggctggccagtgctgcagtgg

SEQ ID NO: 7822259 - DNA, 22 bp, Homo sapiens
aggctggccagtgctgcagtgg

SEQ ID NO: 7822260 - DNA, 22 bp, Homo sapiens
acatttctccttgcaggagtca

SEQ ID NO: 7822261 - DNA, 22 bp, Homo sapiens
acatttctccttgcaggagtca

SEQ ID NO: 7822262 - DNA, 18 bp, Homo sapiens
acatttctctctgcgtga

SEQ ID NO: 7822263 - DNA, 22 bp, Homo sapiens
accacaggacccatgagtcagt

SEQ ID NO: 7822264 - DNA, 22 bp, Homo sapiens
accacaggacccatgagtcagt

SEQ ID NO: 7822265 - DNA, 22 bp, Homo sapiens
aggctgtgattccaccactctc

SEQ ID NO: 7822266 - DNA, 22 bp, Homo sapiens
aggctgtgattccaccactctc

SEQ ID NO: 7822267 - DNA, 22 bp, Homo sapiens
accacaggacccatgagtcagt

SEQ ID NO: 7822268 - DNA, 22 bp, Homo sapiens
accacaggacccatgagtcagt

SEQ ID NO: 7822269 - DNA, 22 bp, Homo sapiens
accacaggacccatgagtcagt

SEQ ID NO: 7822270 - DNA, 22 bp, Homo sapiens
aggctgtgatgagcctcatgga

SEQ ID NO: 7822271 - DNA, 22 bp, Homo sapiens
aggctgtgatggatgtaaagga

SEQ ID NO: 7822272 - DNA, 22 bp, Homo sapiens
aggctgtgatggatgtaaagga

SEQ ID NO: 7822273 - DNA, 22 bp, Homo sapiens
aggctgtgatgagcctcatgga

SEQ ID NO: 7822274 - DNA, 22 bp, Homo sapiens
aggctgtgatgagcctcatgga

SEQ ID NO: 7822275 - DNA, 22 bp, Homo sapiens
aggctgtgatgagcctcatgga

SEQ ID NO: 7822276 - DNA, 22 bp, Homo sapiens
aggctgtgatgagcctcatgga

SEQ ID NO: 7822277 - DNA, 22 bp, Homo sapiens
accactgcccatggtgaaaact

SEQ ID NO: 7822278 - DNA, 21 bp, Homo sapiens
accactgcctccaaggttcag

SEQ ID NO: 7822279 - DNA, 22 bp, Homo sapiens
accactgcccatggtgaaaact

SEQ ID NO: 7822280 - DNA, 22 bp, Homo sapiens
accactgcccatggtgaaaact

SEQ ID NO: 7822281 - DNA, 22 bp, Homo sapiens
accactgcccatggtgaaaact

SEQ ID NO: 7822282 - DNA, 22 bp, Homo sapiens
accactgcccatggtgaaaact

SEQ ID NO: 7822283 - DNA, 22 bp, Homo sapiens
accactggatatcagagatgta

SEQ ID NO: 7822284 - DNA, 22 bp, Homo sapiens
accactggatatcagagatgta

SEQ ID NO: 7822285 - DNA, 22 bp, Homo sapiens
accactggatatcagagatgta

SEQ ID NO: 7822286 - DNA, 19 bp, Homo sapiens
accactggccacacactcc

SEQ ID NO: 7822287 - DNA, 19 bp, Homo sapiens
accactggccacacactcc

SEQ ID NO: 7822288 - DNA, 22 bp, Homo sapiens
accactggcctggtggggacca

SEQ ID NO: 7822289 - DNA, 22 bp, Homo sapiens
accactggctcaggagctggga

SEQ ID NO: 7822290 - DNA, 22 bp, Homo sapiens
accactggctcaggagctggga

SEQ ID NO: 7822291 - DNA, 22 bp, Homo sapiens
accactgggcgggcagcctgct

SEQ ID NO: 7822292 - DNA, 22 bp, Homo sapiens
accactgggcgggcagcctgct

SEQ ID NO: 7822293 - DNA, 22 bp, Homo sapiens
accactgggcgggcagcctgct

SEQ ID NO: 7822294 - DNA, 22 bp, Homo sapiens
accagacactgtgaagacaggc

SEQ ID NO: 7822295 - DNA, 22 bp, Homo sapiens
accagaagttctccaaaaagat

SEQ ID NO: 7822296 - DNA, 22 bp, Homo sapiens
accagacactgtgaagacaggc

SEQ ID NO: 7822297 - DNA, 22 bp, Homo sapiens
accagacactgtgaagacaggc

SEQ ID NO: 7822298 - DNA, 22 bp, Homo sapiens
accagaagttctccaaaaagat

SEQ ID NO: 7822299 - DNA, 22 bp, Homo sapiens
accagaaggaccagaggcaagg

SEQ ID NO: 7822300 - DNA, 22 bp, Homo sapiens
accagaagttctccaaaaagat

SEQ ID NO: 7822301 - DNA, 22 bp, Homo sapiens
accagaaggaccagaggcaagg

SEQ ID NO: 7822302 - DNA, 22 bp, Homo sapiens
accagaagacagaaatattatt

SEQ ID NO: 7822303 - DNA, 22 bp, Homo sapiens
accagaagctggagcacaagga

SEQ ID NO: 7822304 - DNA, 22 bp, Homo sapiens
accagaaaggaataatagaatt

SEQ ID NO: 7822305 - DNA, 22 bp, Homo sapiens
accagaaaggaataatagaatt

SEQ ID NO: 7822306 - DNA, 22 bp, Homo sapiens
accactttggtatttcaatttt

SEQ ID NO: 7822307 - DNA, 22 bp, Homo sapiens
accagaaaggaataatagaatt

SEQ ID NO: 7822308 - DNA, 22 bp, Homo sapiens
accagaaaggaataatagaatt

SEQ ID NO: 7822309 - DNA, 22 bp, Homo sapiens
accagaaaggatgcctccttcc

SEQ ID NO: 7822310 - DNA, 22 bp, Homo sapiens
accactggttttgcagaggcgc

SEQ ID NO: 7822311 - DNA, 22 bp, Homo sapiens
accactggttttgcagaggcgc

SEQ ID NO: 7822312 - DNA, 22 bp, Homo sapiens
accactggggcaagtcttcaaa

SEQ ID NO: 7822313 - DNA, 22 bp, Homo sapiens
accactggggcaagtcttcaaa

SEQ ID NO: 7822314 - DNA, 22 bp, Homo sapiens
accactgtactatttgagtggc

SEQ ID NO: 7822315 - DNA, 22 bp, Homo sapiens
accactgtatctccagcacatt

SEQ ID NO: 7822316 - DNA, 22 bp, Homo sapiens
accactgtctacacattgactc

SEQ ID NO: 7822317 - DNA, 22 bp, Homo sapiens
accactgtctacacattgactc

SEQ ID NO: 7822318 - DNA, 22 bp, Homo sapiens
accactgtctacacattgactc

SEQ ID NO: 7822319 - DNA, 17 bp, Homo sapiens
accactttgccaagttg

SEQ ID NO: 7822320 - DNA, 22 bp, Homo sapiens
accactttggtatttcaatttt

SEQ ID NO: 7822321 - DNA, 22 bp, Homo sapiens
accactttacagaaatggaaag

SEQ ID NO: 7822322 - DNA, 22 bp, Homo sapiens
accactttacagaaatggaaag

SEQ ID NO: 7822323 - DNA, 22 bp, Homo sapiens
aggctgtgagtagttcttgttg

SEQ ID NO: 7822324 - DNA, 19 bp, Homo sapiens
aggctgtgaggggaaggaa

SEQ ID NO: 7822325 - DNA, 22 bp, Homo sapiens
aggctgtgagttttgtctcaga

SEQ ID NO: 7822326 - DNA, 22 bp, Homo sapiens
aggctgtgagttttgtctcaga

SEQ ID NO: 7822327 - DNA, 19 bp, Homo sapiens
aggctgtgagggaggactc

SEQ ID NO: 7822328 - DNA, 19 bp, Homo sapiens
aggctgtgaggggaaggaa

SEQ ID NO: 7822329 - DNA, 19 bp, Homo sapiens
aggctgtgagggaggactc

SEQ ID NO: 7822330 - DNA, 19 bp, Homo sapiens
aggctgtgagggaggactc

SEQ ID NO: 7822331 - DNA, 19 bp, Homo sapiens
aggctgtgagggaggactc

SEQ ID NO: 7822332 - DNA, 19 bp, Homo sapiens
aggctgtgagggaggactc

SEQ ID NO: 7822333 - DNA, 19 bp, Homo sapiens
aggctgtgagggaggactc

SEQ ID NO: 7822334 - DNA, 22 bp, Homo sapiens
aggctgtgagcaagaacaccta

SEQ ID NO: 7822335 - DNA, 22 bp, Homo sapiens
aggctgtgagcaagaacaccta

SEQ ID NO: 7822336 - DNA, 19 bp, Homo sapiens
aggctgtgagggaggactc

SEQ ID NO: 7822337 - DNA, 22 bp, Homo sapiens
aggctgtgagcaagaacaccta

SEQ ID NO: 7822338 - DNA, 22 bp, Homo sapiens
aggctgtgagcaagaacaccta

SEQ ID NO: 7822339 - DNA, 22 bp, Homo sapiens
aggctgtgagaggtggctccca

SEQ ID NO: 7822340 - DNA, 22 bp, Homo sapiens
aggctgtgagaagtccttcagt

SEQ ID NO: 7822341 - DNA, 22 bp, Homo sapiens
aggctgtgagaggtggctccca

SEQ ID NO: 7822342 - DNA, 22 bp, Homo sapiens
aggctgtgagaggtggctccca

SEQ ID NO: 7822343 - DNA, 22 bp, Homo sapiens
aggctgtgagaggtggctccca

SEQ ID NO: 7822344 - DNA, 22 bp, Homo sapiens
aggctgtgagaagtccttcagt

SEQ ID NO: 7822345 - DNA, 22 bp, Homo sapiens
aggctgtgagaagtccttcagt

SEQ ID NO: 7822346 - DNA, 22 bp, Homo sapiens
aggctgtgagaagtccttcagt

SEQ ID NO: 7822347 - DNA, 22 bp, Homo sapiens
aggctggctttggtagcatggt

SEQ ID NO: 7822348 - DNA, 22 bp, Homo sapiens
aggctggctttggtagcatggt

SEQ ID NO: 7822349 - DNA, 22 bp, Homo sapiens
aggctggctttggtagcatggt

SEQ ID NO: 7822350 - DNA, 22 bp, Homo sapiens
aggctggctttggtagcatggt

SEQ ID NO: 7822351 - DNA, 22 bp, Homo sapiens
aggctggctttggtagcatggt

SEQ ID NO: 7822352 - DNA, 22 bp, Homo sapiens
aggctggcttggctctcctgtg

SEQ ID NO: 7822353 - DNA, 23 bp, Homo sapiens
aggctggcttcaggagcctctcc

SEQ ID NO: 7822354 - DNA, 22 bp, Homo sapiens
aggctgggaaacctgaagttgt

SEQ ID NO: 7822355 - DNA, 22 bp, Homo sapiens
aggctgggaaacctgaagttgt

SEQ ID NO: 7822356 - DNA, 22 bp, Homo sapiens
aggctgggaaacctgaagttgt

SEQ ID NO: 7822357 - DNA, 22 bp, Homo sapiens
aggctgggaaatgtagtcttcc

SEQ ID NO: 7822358 - DNA, 22 bp, Homo sapiens
aggctgggaaatgtagtcttcc

SEQ ID NO: 7822359 - DNA, 22 bp, Homo sapiens
aggctgggaaatgtagtcttcc

SEQ ID NO: 7822360 - DNA, 22 bp, Homo sapiens
aggctgggaaatgtagtcttcc

SEQ ID NO: 7822361 - DNA, 22 bp, Homo sapiens
aggctgggaaacctgaagttgt

SEQ ID NO: 7822362 - DNA, 22 bp, Homo sapiens
aggctgggaaacctgaagttgt

SEQ ID NO: 7822363 - DNA, 22 bp, Homo sapiens
aggctgggaaacctgaagttgt

SEQ ID NO: 7822364 - DNA, 22 bp, Homo sapiens
aggctgggaaatgtattccagc

SEQ ID NO: 7822365 - DNA, 22 bp, Homo sapiens
aggctgggaaatgtagtcttcc

SEQ ID NO: 7822366 - DNA, 22 bp, Homo sapiens
aggctgggaaatgtattccagc

SEQ ID NO: 7822367 - DNA, 22 bp, Homo sapiens
aggctgggaaatgtattccagc

SEQ ID NO: 7822368 - DNA, 22 bp, Homo sapiens
aggctgggaaggtaaagttgta

SEQ ID NO: 7822369 - DNA, 22 bp, Homo sapiens
aggctctgaaggagaacctgtt

SEQ ID NO: 7822370 - DNA, 22 bp, Homo sapiens
aggctctgaaggagaacctgtt

SEQ ID NO: 7822371 - DNA, 22 bp, Homo sapiens
aggctctgaagcaaccctttga

SEQ ID NO: 7822372 - DNA, 22 bp, Homo sapiens
aggctctgaagcaaccctttga

SEQ ID NO: 7822373 - DNA, 22 bp, Homo sapiens
aggctctgacccatgggaccca

SEQ ID NO: 7822374 - DNA, 22 bp, Homo sapiens
aggctctgacccatgggaccca

SEQ ID NO: 7822375 - DNA, 22 bp, Homo sapiens
aggctctgaaggagaacctgtt

SEQ ID NO: 7822376 - DNA, 22 bp, Homo sapiens
aggctctgaagcaaccctttga

SEQ ID NO: 7822377 - DNA, 22 bp, Homo sapiens
aggctctgaaggagaacctgtt

SEQ ID NO: 7822378 - DNA, 22 bp, Homo sapiens
aggctctcaatatgatccagtc

SEQ ID NO: 7822379 - DNA, 22 bp, Homo sapiens
aggctctcagatcagccacatt

SEQ ID NO: 7822380 - DNA, 22 bp, Homo sapiens
aggctctcaccctctgaccaga

SEQ ID NO: 7822381 - DNA, 21 bp, Homo sapiens
aggctctcatccagggaccca

SEQ ID NO: 7822382 - DNA, 22 bp, Homo sapiens
aggctctcctccccaggaccat

SEQ ID NO: 7822383 - DNA, 22 bp, Homo sapiens
aggctctccagagagctgcttt

SEQ ID NO: 7822384 - DNA, 22 bp, Homo sapiens
aggctctgacgtcacacgtggc

SEQ ID NO: 7822385 - DNA, 22 bp, Homo sapiens
aggctctgacgtcacacgtggc

SEQ ID NO: 7822386 - DNA, 22 bp, Homo sapiens
aggctctgacgtcacacgtggc

SEQ ID NO: 7822387 - DNA, 22 bp, Homo sapiens
aggctctgacgtcacacgtggc

SEQ ID NO: 7822388 - DNA, 22 bp, Homo sapiens
aggctctgacccatgggaccca

SEQ ID NO: 7822389 - DNA, 22 bp, Homo sapiens
aggctctgacccatgggaccca

SEQ ID NO: 7822390 - DNA, 22 bp, Homo sapiens
aggctctgacccatgggaccca

SEQ ID NO: 7822391 - DNA, 22 bp, Homo sapiens
aggctctggacagtgaggagtt

SEQ ID NO: 7822392 - DNA, 19 bp, Homo sapiens
aggctctgagctcctggag

SEQ ID NO: 7822393 - DNA, 22 bp, Homo sapiens
aggctctgacgtcacacgtggc

SEQ ID NO: 7822394 - DNA, 22 bp, Homo sapiens
aggctctgcttttctggatata

SEQ ID NO: 7822395 - DNA, 22 bp, Homo sapiens
aggctctggacagtgaggagtt

SEQ ID NO: 7822396 - DNA, 22 bp, Homo sapiens
aggctctggacagtgaggagtt

SEQ ID NO: 7822397 - DNA, 22 bp, Homo sapiens
aggctctggagtgtggtgctgg

SEQ ID NO: 7822398 - DNA, 22 bp, Homo sapiens
aggctctggagtgtggtgctgg

SEQ ID NO: 7822399 - DNA, 22 bp, Homo sapiens
aggctctggagtgtggtgctgg

SEQ ID NO: 7822400 - DNA, 22 bp, Homo sapiens
aggctctggacagtgaggagtt

SEQ ID NO: 7822401 - DNA, 22 bp, Homo sapiens
aggctctggagaagaatccgct

SEQ ID NO: 7822402 - DNA, 22 bp, Homo sapiens
aggctctggagaagaatccgct

SEQ ID NO: 7822403 - DNA, 22 bp, Homo sapiens
aggctctggacagtgaggagtt

SEQ ID NO: 7822404 - DNA, 22 bp, Homo sapiens
aggctctggacagtgaggagtt

SEQ ID NO: 7822405 - DNA, 22 bp, Homo sapiens
aggctctggagttagccaggca

SEQ ID NO: 7822406 - DNA, 22 bp, Homo sapiens
aggctctggagttagccaggca

SEQ ID NO: 7822407 - DNA, 22 bp, Homo sapiens
aggctctggagttagccaggca

SEQ ID NO: 7822408 - DNA, 22 bp, Homo sapiens
aggctctggagttagccaggca

SEQ ID NO: 7822409 - DNA, 22 bp, Homo sapiens
aggctctggagttagccaggca

SEQ ID NO: 7822410 - DNA, 22 bp, Homo sapiens
aggctctggagtgtggtgctgg

SEQ ID NO: 7822411 - DNA, 22 bp, Homo sapiens
aggctctggagttagccaggca

SEQ ID NO: 7822412 - DNA, 22 bp, Homo sapiens
aggctctggagtgtggtgctgg

SEQ ID NO: 7822413 - DNA, 22 bp, Homo sapiens
aggctctggagtgtggtgctgg

SEQ ID NO: 7822414 - DNA, 22 bp, Homo sapiens
acattaaagagtaaggttagtt

SEQ ID NO: 7822415 - DNA, 22 bp, Homo sapiens
acattaaatttcatagtgatta

SEQ ID NO: 7822416 - DNA, 22 bp, Homo sapiens
acattaaagagtaaggttagtt

SEQ ID NO: 7822417 - DNA, 22 bp, Homo sapiens
acattaaaattgggtggggtaa

SEQ ID NO: 7822418 - DNA, 22 bp, Homo sapiens
acattaaagagtaaggttagtt

SEQ ID NO: 7822419 - DNA, 22 bp, Homo sapiens
acattaaacttgcttggctgta

SEQ ID NO: 7822420 - DNA, 22 bp, Homo sapiens
acattaaatttcatagtgatta

SEQ ID NO: 7822421 - DNA, 22 bp, Homo sapiens
acattaaatttcatagtgatta

SEQ ID NO: 7822422 - DNA, 22 bp, Homo sapiens
acattaaatttcatagtgatta

SEQ ID NO: 7822423 - DNA, 22 bp, Homo sapiens
aggctctataccgctgggagtt

SEQ ID NO: 7822424 - DNA, 22 bp, Homo sapiens
aggctccagtctcctctggcag

SEQ ID NO: 7822425 - DNA, 22 bp, Homo sapiens
aggctccagtctcctctggcag

SEQ ID NO: 7822426 - DNA, 22 bp, Homo sapiens
aggctccagtctcctctggcag

SEQ ID NO: 7822427 - DNA, 22 bp, Homo sapiens
aggctccagtctcctctggcag

SEQ ID NO: 7822428 - DNA, 22 bp, Homo sapiens
aggctccagtctcctctggcag

SEQ ID NO: 7822429 - DNA, 22 bp, Homo sapiens
acattaacaccataagtgtgtt

SEQ ID NO: 7822430 - DNA, 22 bp, Homo sapiens
acattaaaaaatgttgcatgaa

SEQ ID NO: 7822431 - DNA, 22 bp, Homo sapiens
acattaaaatggagaattttga

SEQ ID NO: 7822432 - DNA, 22 bp, Homo sapiens
acattaaaaaatgttgcatgaa

SEQ ID NO: 7822433 - DNA, 22 bp, Homo sapiens
acatgttttgtgccttgactag

SEQ ID NO: 7822434 - DNA, 22 bp, Homo sapiens
acatgttttgtgccttgactag

SEQ ID NO: 7822435 - DNA, 22 bp, Homo sapiens
acatgttttgtgccttgactag

SEQ ID NO: 7822436 - DNA, 22 bp, Homo sapiens
acatgttttgtgccttgactag

SEQ ID NO: 7822437 - DNA, 22 bp, Homo sapiens
aggctcaggtctcaggtctggc

SEQ ID NO: 7822438 - DNA, 22 bp, Homo sapiens
aggctcaggtctcaggtctggc

SEQ ID NO: 7822439 - DNA, 22 bp, Homo sapiens
aggctcaggtctcaggtctggc

SEQ ID NO: 7822440 - DNA, 20 bp, Homo sapiens
aggctcagggtgtttaggaa

SEQ ID NO: 7822441 - DNA, 22 bp, Homo sapiens
aggctcagggactccctccctc

SEQ ID NO: 7822442 - DNA, 20 bp, Homo sapiens
aggctcagggtgtttaggaa

SEQ ID NO: 7822443 - DNA, 20 bp, Homo sapiens
aggctcagggtgtttaggaa

SEQ ID NO: 7822444 - DNA, 19 bp, Homo sapiens
acatgttttgcagaacagc

SEQ ID NO: 7822445 - DNA, 22 bp, Homo sapiens
aggctcaggtctcaggtctggc

SEQ ID NO: 7822446 - DNA, 22 bp, Homo sapiens
aggctcaggtctcaggtctggc

SEQ ID NO: 7822447 - DNA, 22 bp, Homo sapiens
aggctcaggtctcaggtctggc

SEQ ID NO: 7822448 - DNA, 22 bp, Homo sapiens
aggctcaggtctcaggtctggc

SEQ ID NO: 7822449 - DNA, 22 bp, Homo sapiens
aggcagtgtgtagctggaagag

SEQ ID NO: 7822450 - DNA, 22 bp, Homo sapiens
aggcagtgtgtagctggaagag

SEQ ID NO: 7822451 - DNA, 22 bp, Homo sapiens
aggcagtgttcttctaagggca

SEQ ID NO: 7822452 - DNA, 22 bp, Homo sapiens
aggcagtgtgtagctggaagag

SEQ ID NO: 7822453 - DNA, 22 bp, Homo sapiens
aggcagtgttcttctaagggca

SEQ ID NO: 7822454 - DNA, 22 bp, Homo sapiens
acatggcgggagtttcagatac

SEQ ID NO: 7822455 - DNA, 22 bp, Homo sapiens
acatggctaaagcaagtctaga

SEQ ID NO: 7822456 - DNA, 22 bp, Homo sapiens
acatgtaaaaggaacatgcatg

SEQ ID NO: 7822457 - DNA, 22 bp, Homo sapiens
acatgtaaaagataaattaaca

SEQ ID NO: 7822458 - DNA, 22 bp, Homo sapiens
acatgtaaacatttacagtatt

SEQ ID NO: 7822459 - DNA, 22 bp, Homo sapiens
acatgtaaacatttacagtatt

SEQ ID NO: 7822460 - DNA, 22 bp, Homo sapiens
acatgtaaacatttacagtatt

SEQ ID NO: 7822461 - DNA, 22 bp, Homo sapiens
acatgtaaacatttacagtatt

SEQ ID NO: 7822462 - DNA, 22 bp, Homo sapiens
acatgtaaacatttacagtatt

SEQ ID NO: 7822463 - DNA, 22 bp, Homo sapiens
acatgtaaaaggaacatgcatg

SEQ ID NO: 7822464 - DNA, 22 bp, Homo sapiens
acatgtaaaaggaacatgcatg

SEQ ID NO: 7822465 - DNA, 22 bp, Homo sapiens
acatgtaaaaggaacatgcatg

SEQ ID NO: 7822466 - DNA, 22 bp, Homo sapiens
acatgtaaaaggaacatgcatg

SEQ ID NO: 7822467 - DNA, 22 bp, Homo sapiens
acatgtaaaaggaacatgcatg

SEQ ID NO: 7822468 - DNA, 21 bp, Homo sapiens
acatgtaagagagtttcaaga

SEQ ID NO: 7822469 - DNA, 22 bp, Homo sapiens
acatgtaacatatatgtagcat

SEQ ID NO: 7822470 - DNA, 22 bp, Homo sapiens
acatgtaacatatatgtagcat

SEQ ID NO: 7822471 - DNA, 22 bp, Homo sapiens
acatgtatacaatgtgtaatga

SEQ ID NO: 7822472 - DNA, 22 bp, Homo sapiens
acatgtatacaatgtgtaatga

SEQ ID NO: 7822473 - DNA, 20 bp, Homo sapiens
acatgtactaatgaatacag

SEQ ID NO: 7822474 - DNA, 20 bp, Homo sapiens
acatgtactaatgaatacag

SEQ ID NO: 7822475 - DNA, 22 bp, Homo sapiens
acatgtaggagagtcacaatgc

SEQ ID NO: 7822476 - DNA, 22 bp, Homo sapiens
acatgtactgttggtgaagagg

SEQ ID NO: 7822477 - DNA, 22 bp, Homo sapiens
acatgtaatacatccagcaata

SEQ ID NO: 7822478 - DNA, 21 bp, Homo sapiens
acatgtacacatgtatgcaca

SEQ ID NO: 7822479 - DNA, 21 bp, Homo sapiens
acatgtacacatgtatgcaca

SEQ ID NO: 7822480 - DNA, 20 bp, Homo sapiens
acatgtacagacaggtttct

SEQ ID NO: 7822481 - DNA, 20 bp, Homo sapiens
acatgtacagacaggtttct

SEQ ID NO: 7822482 - DNA, 22 bp, Homo sapiens
acatgtacatacacatatgtaa

SEQ ID NO: 7822483 - DNA, 22 bp, Homo sapiens
acatgtacatacacatatgtaa

SEQ ID NO: 7822484 - DNA, 22 bp, Homo sapiens
acatgtacatacacatatgtaa

SEQ ID NO: 7822485 - DNA, 22 bp, Homo sapiens
acatgtatctgatctgcaattg

SEQ ID NO: 7822486 - DNA, 22 bp, Homo sapiens
acatgtatgctttatgaagtag

SEQ ID NO: 7822487 - DNA, 22 bp, Homo sapiens
acatgtatgctttatgaagtag

SEQ ID NO: 7822488 - DNA, 22 bp, Homo sapiens
acatgtattgacattatattct

SEQ ID NO: 7822489 - DNA, 22 bp, Homo sapiens
acatgtattgacattatattct

SEQ ID NO: 7822490 - DNA, 22 bp, Homo sapiens
acatgtacatacacatatgtaa

SEQ ID NO: 7822491 - DNA, 22 bp, Homo sapiens
acatgtctacacattctgcaat

SEQ ID NO: 7822492 - DNA, 22 bp, Homo sapiens
acatgtctacacattctgcaat

SEQ ID NO: 7822493 - DNA, 22 bp, Homo sapiens
acatgtctccacccatcttaaa

SEQ ID NO: 7822494 - DNA, 22 bp, Homo sapiens
acatgtctccacccatcttaaa

SEQ ID NO: 7822495 - DNA, 21 bp, Homo sapiens
acatgtcccctatgcttaagg

SEQ ID NO: 7822496 - DNA, 22 bp, Homo sapiens
acatgtcaatttagtactctta

SEQ ID NO: 7822497 - DNA, 22 bp, Homo sapiens
acatgtcttttaaagtctaata

SEQ ID NO: 7822498 - DNA, 22 bp, Homo sapiens
acatgtcttttaaagtctaata

SEQ ID NO: 7822499 - DNA, 22 bp, Homo sapiens
acatgtcttgtggctttgatct

SEQ ID NO: 7822500 - DNA, 21 bp, Homo sapiens
acatgtctctaatctcagtga

SEQ ID NO: 7822501 - DNA, 21 bp, Homo sapiens
acatgtctctaatctcagtga

SEQ ID NO: 7822502 - DNA, 21 bp, Homo sapiens
acatgtctctaatctcagtga

SEQ ID NO: 7822503 - DNA, 21 bp, Homo sapiens
acatgtctctaatctcagtga

SEQ ID NO: 7822504 - DNA, 21 bp, Homo sapiens
acatgtctggtcatttttagc

SEQ ID NO: 7822505 - DNA, 21 bp, Homo sapiens
acatgtctggtcatttttagc

SEQ ID NO: 7822506 - DNA, 22 bp, Homo sapiens
acatgtgggttttattttgcat

SEQ ID NO: 7822507 - DNA, 20 bp, Homo sapiens
aggctcactcaccttgtgga

SEQ ID NO: 7822508 - DNA, 22 bp, Homo sapiens
aggctcagacaggaaaagtaac

SEQ ID NO: 7822509 - DNA, 22 bp, Homo sapiens
aggctcaagcactgatattttt

SEQ ID NO: 7822510 - DNA, 22 bp, Homo sapiens
acatgtgctcttgctgtacagc

SEQ ID NO: 7822511 - DNA, 23 bp, Homo sapiens
acatgtggagagaacagatatct

SEQ ID NO: 7822512 - DNA, 22 bp, Homo sapiens
acatgtgctcttgctgtacagc

SEQ ID NO: 7822513 - DNA, 22 bp, Homo sapiens
acatgtgctcttgctgtacagc

SEQ ID NO: 7822514 - DNA, 22 bp, Homo sapiens
acatgtgcagacagcaagcagg

SEQ ID NO: 7822515 - DNA, 17 bp, Homo sapiens
acatgtgggtgtttttc

SEQ ID NO: 7822516 - DNA, 21 bp, Homo sapiens
acatgtgggcctgctgctcct

SEQ ID NO: 7822517 - DNA, 22 bp, Homo sapiens
aggctcagctggtggtgatcgc

SEQ ID NO: 7822518 - DNA, 22 bp, Homo sapiens
aggctcagctggtggtgatcgc

SEQ ID NO: 7822519 - DNA, 22 bp, Homo sapiens
aggctcagctggtggtgatcgc

SEQ ID NO: 7822520 - DNA, 22 bp, Homo sapiens
aggctcaggaggagctgccgga

SEQ ID NO: 7822521 - DNA, 22 bp, Homo sapiens
aggctcaggaggagctgccgga

SEQ ID NO: 7822522 - DNA, 20 bp, Homo sapiens
aggctcagctgagctcttgg

SEQ ID NO: 7822523 - DNA, 20 bp, Homo sapiens
aggctcagctgagctcttgg

SEQ ID NO: 7822524 - DNA, 22 bp, Homo sapiens
aggctcagacaggaaaagtaac

SEQ ID NO: 7822525 - DNA, 20 bp, Homo sapiens
aggctcagctgagctcttgg

SEQ ID NO: 7822526 - DNA, 22 bp, Homo sapiens
aggctcagacaggaaaagtaac

SEQ ID NO: 7822527 - DNA, 22 bp, Homo sapiens
aggctcagggacggggcccctt

SEQ ID NO: 7822528 - DNA, 22 bp, Homo sapiens
aggctcagggactccctccctc

SEQ ID NO: 7822529 - DNA, 22 bp, Homo sapiens
aggctcagggacggggcccctt

SEQ ID NO: 7822530 - DNA, 22 bp, Homo sapiens
aggctcagggactccctccctc

SEQ ID NO: 7822531 - DNA, 22 bp, Homo sapiens
aggctcaggaggagctgccgga

SEQ ID NO: 7822532 - DNA, 22 bp, Homo sapiens
aggctcaggaggagctgccgga

SEQ ID NO: 7822533 - DNA, 22 bp, Homo sapiens
aggctcaggcaggaatggcgga

SEQ ID NO: 7822534 - DNA, 22 bp, Homo sapiens
aggctcaggcaggaatggcgga

SEQ ID NO: 7822535 - DNA, 22 bp, Homo sapiens
aggctcaggcaggaatggcgga

SEQ ID NO: 7822536 - DNA, 22 bp, Homo sapiens
aggggcagttccaagttttgtg

SEQ ID NO: 7822537 - DNA, 22 bp, Homo sapiens
aggggcagttccaagttttgtg

SEQ ID NO: 7822538 - DNA, 22 bp, Homo sapiens
aggggcagttccaagttttgtg

SEQ ID NO: 7822539 - DNA, 22 bp, Homo sapiens
aggggcaggtgctgcacttaga

SEQ ID NO: 7822540 - DNA, 22 bp, Homo sapiens
aggggcagttccaagttttgtg

SEQ ID NO: 7822541 - DNA, 22 bp, Homo sapiens
aggggaggagcttttcttgcct

SEQ ID NO: 7822542 - DNA, 22 bp, Homo sapiens
aggggaggagcttttcttgcct

SEQ ID NO: 7822543 - DNA, 22 bp, Homo sapiens
aggggcaggtgctgcacttaga

SEQ ID NO: 7822544 - DNA, 22 bp, Homo sapiens
aggggcaggtgctgcacttaga

SEQ ID NO: 7822545 - DNA, 22 bp, Homo sapiens
aggggaggagcttttcttgcct

SEQ ID NO: 7822546 - DNA, 22 bp, Homo sapiens
aggggcaggtgctgcacttaga

SEQ ID NO: 7822547 - DNA, 22 bp, Homo sapiens
aggggcaggtgctgcacttaga

SEQ ID NO: 7822548 - DNA, 22 bp, Homo sapiens
aggggcaggtgctgcacttaga

SEQ ID NO: 7822549 - DNA, 22 bp, Homo sapiens
aggggagcttgcctggtcaccc

SEQ ID NO: 7822550 - DNA, 22 bp, Homo sapiens
aggggagcttgcctggtcaccc

SEQ ID NO: 7822551 - DNA, 22 bp, Homo sapiens
aggggagcttgcctggtcaccc

SEQ ID NO: 7822552 - DNA, 22 bp, Homo sapiens
aggggaggagcttttcttgcct

SEQ ID NO: 7822553 - DNA, 22 bp, Homo sapiens
aggggagcttgcctggtcaccc

SEQ ID NO: 7822554 - DNA, 22 bp, Homo sapiens
aggggagcttgcctggtcaccc

SEQ ID NO: 7822555 - DNA, 22 bp, Homo sapiens
aggggagcttgaggcatggcct

SEQ ID NO: 7822556 - DNA, 22 bp, Homo sapiens
aggggagcttgaggcatggcct

SEQ ID NO: 7822557 - DNA, 22 bp, Homo sapiens
aggggagctaacaccagagccc

SEQ ID NO: 7822558 - DNA, 22 bp, Homo sapiens
aggggagctaacaccagagccc

SEQ ID NO: 7822559 - DNA, 22 bp, Homo sapiens
aggggagcttgaggcatggcct

SEQ ID NO: 7822560 - DNA, 22 bp, Homo sapiens
aggggagctaacaccagagccc

SEQ ID NO: 7822561 - DNA, 22 bp, Homo sapiens
aggggagcaacatagtcactct

SEQ ID NO: 7822562 - DNA, 22 bp, Homo sapiens
aggggagcaaggccgtggtgta

SEQ ID NO: 7822563 - DNA, 22 bp, Homo sapiens
aggggagcaaggccgtggtgta

SEQ ID NO: 7822564 - DNA, 22 bp, Homo sapiens
aggggagcaaggccgtggtgta

SEQ ID NO: 7822565 - DNA, 22 bp, Homo sapiens
aggggagcatctgtgatggtta

SEQ ID NO: 7822566 - DNA, 22 bp, Homo sapiens
aggggagcaaggccgtggtgta

SEQ ID NO: 7822567 - DNA, 22 bp, Homo sapiens
aggggagccagggctgcgagtt

SEQ ID NO: 7822568 - DNA, 22 bp, Homo sapiens
aggggagccagggctgcgagtt

SEQ ID NO: 7822569 - DNA, 22 bp, Homo sapiens
aggggagcccctggtcctggtg

SEQ ID NO: 7822570 - DNA, 22 bp, Homo sapiens
aggggagcccctggtcctggtg

SEQ ID NO: 7822571 - DNA, 22 bp, Homo sapiens
aggggagccgaggggcatctgt

SEQ ID NO: 7822572 - DNA, 22 bp, Homo sapiens
aggggagccgaggggcatctgt

SEQ ID NO: 7822573 - DNA, 22 bp, Homo sapiens
aggggagccgaggggcatctgt

SEQ ID NO: 7822574 - DNA, 22 bp, Homo sapiens
aggggagccgaggggcatctgt

SEQ ID NO: 7822575 - DNA, 22 bp, Homo sapiens
aggggagcgacattccgtgccg

SEQ ID NO: 7822576 - DNA, 22 bp, Homo sapiens
aggggagccgaggggcatctgt

SEQ ID NO: 7822577 - DNA, 22 bp, Homo sapiens
aggggagccgaggggcatctgt

SEQ ID NO: 7822578 - DNA, 23 bp, Homo sapiens
agggctgaatgcagagaagcaga

SEQ ID NO: 7822579 - DNA, 22 bp, Homo sapiens
agggctgaagttatggctgagc

SEQ ID NO: 7822580 - DNA, 22 bp, Homo sapiens
agggctgaagttatggctgagc

SEQ ID NO: 7822581 - DNA, 23 bp, Homo sapiens
agggctgaatgcagagaagcaga

SEQ ID NO: 7822582 - DNA, 22 bp, Homo sapiens
agggctgacaaatggcagtgac

SEQ ID NO: 7822583 - DNA, 22 bp, Homo sapiens
agggctgacaaatggcagtgac

SEQ ID NO: 7822584 - DNA, 22 bp, Homo sapiens
agggctgacaaatggcagtgac

SEQ ID NO: 7822585 - DNA, 22 bp, Homo sapiens
agggctgacagtgaggagtcaa

SEQ ID NO: 7822586 - DNA, 22 bp, Homo sapiens
agggctgacacaccttatcctc

SEQ ID NO: 7822587 - DNA, 22 bp, Homo sapiens
agggctgacagtaaaagtatga

SEQ ID NO: 7822588 - DNA, 22 bp, Homo sapiens
agggctgacaaatggcagtgac

SEQ ID NO: 7822589 - DNA, 22 bp, Homo sapiens
agggctgacaaatggcagtgac

SEQ ID NO: 7822590 - DNA, 22 bp, Homo sapiens
agggctgacaaatggcagtgac

SEQ ID NO: 7822591 - DNA, 22 bp, Homo sapiens
agggctgacacaccttatcctc

SEQ ID NO: 7822592 - DNA, 22 bp, Homo sapiens
agggctcagttgcctggagccc

SEQ ID NO: 7822593 - DNA, 22 bp, Homo sapiens
agggctcagttgcctggagccc

SEQ ID NO: 7822594 - DNA, 22 bp, Homo sapiens
agggctcagtaaacggtggatt

SEQ ID NO: 7822595 - DNA, 22 bp, Homo sapiens
agggctcaggggccccaagctg

SEQ ID NO: 7822596 - DNA, 22 bp, Homo sapiens
agggctcagggtcaccatctgt

SEQ ID NO: 7822597 - DNA, 22 bp, Homo sapiens
agggctgaagggaggtgctcat

SEQ ID NO: 7822598 - DNA, 22 bp, Homo sapiens
agggctgaagggaggtgctcat

SEQ ID NO: 7822599 - DNA, 22 bp, Homo sapiens
agggctgaaacataatccttct

SEQ ID NO: 7822600 - DNA, 22 bp, Homo sapiens
agggctgaagggaggtgctcat

SEQ ID NO: 7822601 - DNA, 22 bp, Homo sapiens
agggctgaagttatggctgagc

SEQ ID NO: 7822602 - DNA, 22 bp, Homo sapiens
agggctgaagttatggctgagc

SEQ ID NO: 7822603 - DNA, 22 bp, Homo sapiens
agggctcagcctcctcctcagc

SEQ ID NO: 7822604 - DNA, 22 bp, Homo sapiens
agggctcagcctcctcctcagc

SEQ ID NO: 7822605 - DNA, 22 bp, Homo sapiens
agggctcagccagcctgtgtgc

SEQ ID NO: 7822606 - DNA, 22 bp, Homo sapiens
agggctcagcatctcattctgt

SEQ ID NO: 7822607 - DNA, 22 bp, Homo sapiens
agggctcagccagcctgtgtgc

SEQ ID NO: 7822608 - DNA, 22 bp, Homo sapiens
agggctcagcctcctcctcagc

SEQ ID NO: 7822609 - DNA, 22 bp, Homo sapiens
agggctcagcctcctcctcagc

SEQ ID NO: 7822610 - DNA, 22 bp, Homo sapiens
agggctcagggcacgtcatcca

SEQ ID NO: 7822611 - DNA, 22 bp, Homo sapiens
agggctcagggcacgtcatcca

SEQ ID NO: 7822612 - DNA, 22 bp, Homo sapiens
agggctcagggcacgtcatcca

SEQ ID NO: 7822613 - DNA, 22 bp, Homo sapiens
agggctcaggggccccaagctg

SEQ ID NO: 7822614 - DNA, 22 bp, Homo sapiens
agggctcagaacaatgagtgta

SEQ ID NO: 7822615 - DNA, 22 bp, Homo sapiens
agggctcagagcaaaagggcac

SEQ ID NO: 7822616 - DNA, 22 bp, Homo sapiens
agggctcagaacaatgagtgta

SEQ ID NO: 7822617 - DNA, 22 bp, Homo sapiens
agggctcagagcaaaagggcac

SEQ ID NO: 7822618 - DNA, 22 bp, Homo sapiens
agggctcagaaatgtctacggg

SEQ ID NO: 7822619 - DNA, 22 bp, Homo sapiens
agggctcagaaatgtctacggg

SEQ ID NO: 7822620 - DNA, 22 bp, Homo sapiens
agggctcactgggaggctataa

SEQ ID NO: 7822621 - DNA, 22 bp, Homo sapiens
aggggtgtgcatcctggaggat

SEQ ID NO: 7822622 - DNA, 22 bp, Homo sapiens
aggggtgtgcatcctggaggat

SEQ ID NO: 7822623 - DNA, 22 bp, Homo sapiens
aggggtgtgcatcctggaggat

SEQ ID NO: 7822624 - DNA, 22 bp, Homo sapiens
aggggttggacataagacagaa

SEQ ID NO: 7822625 - DNA, 23 bp, Homo sapiens
aggggtggtcagtacccgcagtg

SEQ ID NO: 7822626 - DNA, 23 bp, Homo sapiens
aggggtggtcagtacccgcagtg

SEQ ID NO: 7822627 - DNA, 23 bp, Homo sapiens
aggggtggtcagtacccgcagtg

SEQ ID NO: 7822628 - DNA, 23 bp, Homo sapiens
aggggtggtcagtacccgcagtg

SEQ ID NO: 7822629 - DNA, 23 bp, Homo sapiens
aggggtggtcagtacccgcagtg

SEQ ID NO: 7822630 - DNA, 23 bp, Homo sapiens
aggggtggtcagtacccgcagtg

SEQ ID NO: 7822631 - DNA, 22 bp, Homo sapiens
agggtaagtttcatgtggctaa

SEQ ID NO: 7822632 - DNA, 19 bp, Homo sapiens
agggtacacgagagaagag

SEQ ID NO: 7822633 - DNA, 22 bp, Homo sapiens
agggtaatagcaaacaaaaggt

SEQ ID NO: 7822634 - DNA, 22 bp, Homo sapiens
agggtagctacccaactccaga

SEQ ID NO: 7822635 - DNA, 22 bp, Homo sapiens
agggtagctacccaactccaga

SEQ ID NO: 7822636 - DNA, 22 bp, Homo sapiens
agggtagctacccaactccaga

SEQ ID NO: 7822637 - DNA, 20 bp, Homo sapiens
agggtcagtagcacagagct

SEQ ID NO: 7822638 - DNA, 22 bp, Homo sapiens
agggtcagtagtgatgcgtgaa

SEQ ID NO: 7822639 - DNA, 22 bp, Homo sapiens
agggtcagtagtgatgcgtgaa

SEQ ID NO: 7822640 - DNA, 22 bp, Homo sapiens
agggtcagtagtgatgcgtgaa

SEQ ID NO: 7822641 - DNA, 22 bp, Homo sapiens
agggtcagtgatgagggagccc

SEQ ID NO: 7822642 - DNA, 22 bp, Homo sapiens
agggtcagtgatgagggagccc

SEQ ID NO: 7822643 - DNA, 22 bp, Homo sapiens
agggtcagtgatgagggagccc

SEQ ID NO: 7822644 - DNA, 22 bp, Homo sapiens
agggtcagtgatgagggagccc

SEQ ID NO: 7822645 - DNA, 22 bp, Homo sapiens
agggtcagtgatgagggagccc

SEQ ID NO: 7822646 - DNA, 22 bp, Homo sapiens
acctcccagaaagttttgcagg

SEQ ID NO: 7822647 - DNA, 16 bp, Homo sapiens
acctccagtcaagggt

SEQ ID NO: 7822648 - DNA, 22 bp, Homo sapiens
acctccagctttttagagacat

SEQ ID NO: 7822649 - DNA, 16 bp, Homo sapiens
acctccagtcaagggt

SEQ ID NO: 7822650 - DNA, 22 bp, Homo sapiens
acctcccagaaagttttgcagg

SEQ ID NO: 7822651 - DNA, 20 bp, Homo sapiens
aggggtgatcgggtgacact

SEQ ID NO: 7822652 - DNA, 22 bp, Homo sapiens
acctcccagctctgagcttggg

SEQ ID NO: 7822653 - DNA, 22 bp, Homo sapiens
aggggtgatttgggacaggaca

SEQ ID NO: 7822654 - DNA, 22 bp, Homo sapiens
aggggtgatttgggacaggaca

SEQ ID NO: 7822655 - DNA, 22 bp, Homo sapiens
aggggtgatttgggacaggaca

SEQ ID NO: 7822656 - DNA, 22 bp, Homo sapiens
aggggtgatttgggacaggaca

SEQ ID NO: 7822657 - DNA, 22 bp, Homo sapiens
aggggtggagagtgttgccagt

SEQ ID NO: 7822658 - DNA, 22 bp, Homo sapiens
aggggtggagagtgttgccagt

SEQ ID NO: 7822659 - DNA, 22 bp, Homo sapiens
aggggtggagagtgttgccagt

SEQ ID NO: 7822660 - DNA, 22 bp, Homo sapiens
aggggtggagagtgttgccagt

SEQ ID NO: 7822661 - DNA, 22 bp, Homo sapiens
aggggtggagagtgttgccagt

SEQ ID NO: 7822662 - DNA, 22 bp, Homo sapiens
aggggtggagagtgttgccagt

SEQ ID NO: 7822663 - DNA, 22 bp, Homo sapiens
aggggtggagagtgttgccagt

SEQ ID NO: 7822664 - DNA, 22 bp, Homo sapiens
aggggtggcctgccttactccc

SEQ ID NO: 7822665 - DNA, 22 bp, Homo sapiens
aggggtggcctgccttactccc

SEQ ID NO: 7822666 - DNA, 22 bp, Homo sapiens
aggggtggcctgccttactccc

SEQ ID NO: 7822667 - DNA, 22 bp, Homo sapiens
aggggtggcctgccttactccc

SEQ ID NO: 7822668 - DNA, 22 bp, Homo sapiens
aggggtggcctgccttactccc

SEQ ID NO: 7822669 - DNA, 22 bp, Homo sapiens
aggggccacctgtggcaccctg

SEQ ID NO: 7822670 - DNA, 22 bp, Homo sapiens
aggggcatcagttgcacatttt

SEQ ID NO: 7822671 - DNA, 22 bp, Homo sapiens
aggggccacctgtggcaccctg

SEQ ID NO: 7822672 - DNA, 22 bp, Homo sapiens
aggggccacctgtggcaccctg

SEQ ID NO: 7822673 - DNA, 21 bp, Homo sapiens
aggggcccttgccaggacgcc

SEQ ID NO: 7822674 - DNA, 22 bp, Homo sapiens
aggggcctcgcaggaccgctcc

SEQ ID NO: 7822675 - DNA, 22 bp, Homo sapiens
aggggcctcgcaggaccgctcc

SEQ ID NO: 7822676 - DNA, 20 bp, Homo sapiens
aggggcctggaacaggcctt

SEQ ID NO: 7822677 - DNA, 20 bp, Homo sapiens
aggggcctggaacaggcctt

SEQ ID NO: 7822678 - DNA, 22 bp, Homo sapiens
accctttcttactcacacgctc

SEQ ID NO: 7822679 - DNA, 18 bp, Homo sapiens
accctttattggtagaga

SEQ ID NO: 7822680 - DNA, 18 bp, Homo sapiens
accctttccaaactgcag

SEQ ID NO: 7822681 - DNA, 22 bp, Homo sapiens
accctttgttggataagttggc

SEQ ID NO: 7822682 - DNA, 22 bp, Homo sapiens
accctttgtccaatagaaatga

SEQ ID NO: 7822683 - DNA, 22 bp, Homo sapiens
accctttgtcaagcacagaaga

SEQ ID NO: 7822684 - DNA, 22 bp, Homo sapiens
accctttgcctagaggggcttt

SEQ ID NO: 7822685 - DNA, 22 bp, Homo sapiens
acctcagaggaggctcctggct

SEQ ID NO: 7822686 - DNA, 22 bp, Homo sapiens
acctcacaagtctctgtcagct

SEQ ID NO: 7822687 - DNA, 22 bp, Homo sapiens
acctcaagtgatccactcacct

SEQ ID NO: 7822688 - DNA, 22 bp, Homo sapiens
acctcacaagtctctgtcagct

SEQ ID NO: 7822689 - DNA, 22 bp, Homo sapiens
acctcagattgtggctccgctg

SEQ ID NO: 7822690 - DNA, 22 bp, Homo sapiens
acctcagagggatgttacaggc

SEQ ID NO: 7822691 - DNA, 22 bp, Homo sapiens
acctcagctatttcaaaacaga

SEQ ID NO: 7822692 - DNA, 22 bp, Homo sapiens
acctcaggatgtggacacagaa

SEQ ID NO: 7822693 - DNA, 22 bp, Homo sapiens
acctcaggatgtggacacagaa

SEQ ID NO: 7822694 - DNA, 22 bp, Homo sapiens
acctcaggatgtggacacagaa

SEQ ID NO: 7822695 - DNA, 22 bp, Homo sapiens
acctcagttcaattcagttaga

SEQ ID NO: 7822696 - DNA, 22 bp, Homo sapiens
acctcaggatgtggacacagaa

SEQ ID NO: 7822697 - DNA, 22 bp, Homo sapiens
acctccagctttttagagacat

SEQ ID NO: 7822698 - DNA, 22 bp, Homo sapiens
acctccaggaagctcttggtac

SEQ ID NO: 7822699 - DNA, 22 bp, Homo sapiens
accagagctcttcagcacagga

SEQ ID NO: 7822700 - DNA, 22 bp, Homo sapiens
accagagctcttcagcacagga

SEQ ID NO: 7822701 - DNA, 20 bp, Homo sapiens
accagagctctcagtatgtg

SEQ ID NO: 7822702 - DNA, 22 bp, Homo sapiens
agggagctgactggctgccatt

SEQ ID NO: 7822703 - DNA, 22 bp, Homo sapiens
agggagctgactggctgccatt

SEQ ID NO: 7822704 - DNA, 22 bp, Homo sapiens
agggagctgactggctgccatt

SEQ ID NO: 7822705 - DNA, 22 bp, Homo sapiens
agggagctgactggctgccatt

SEQ ID NO: 7822706 - DNA, 22 bp, Homo sapiens
agggagctgactggctgccatt

SEQ ID NO: 7822707 - DNA, 22 bp, Homo sapiens
agggagctgactggctgccatt

SEQ ID NO: 7822708 - DNA, 22 bp, Homo sapiens
accagagcagactactggaggt

SEQ ID NO: 7822709 - DNA, 22 bp, Homo sapiens
accagagcagactactggaggt

SEQ ID NO: 7822710 - DNA, 22 bp, Homo sapiens
accagagcgctcaagccttccc

SEQ ID NO: 7822711 - DNA, 22 bp, Homo sapiens
accagagcgctcaagccttccc

SEQ ID NO: 7822712 - DNA, 20 bp, Homo sapiens
accagagctctcagtatgtg

SEQ ID NO: 7822713 - DNA, 20 bp, Homo sapiens
accagagctctcagtatgtg

SEQ ID NO: 7822714 - DNA, 22 bp, Homo sapiens
agggaggatagtagtcagttta

SEQ ID NO: 7822715 - DNA, 22 bp, Homo sapiens
agggaggatagtagtcagttta

SEQ ID NO: 7822716 - DNA, 22 bp, Homo sapiens
agggaggagtcctcaaagtcat

SEQ ID NO: 7822717 - DNA, 22 bp, Homo sapiens
agggaggatagtagtcagttta

SEQ ID NO: 7822718 - DNA, 22 bp, Homo sapiens
agggaggagtcctcaaagtcat

SEQ ID NO: 7822719 - DNA, 22 bp, Homo sapiens
agggaggcaggaaagttgtctg

SEQ ID NO: 7822720 - DNA, 22 bp, Homo sapiens
agggaggcaggaaagttgtctg

SEQ ID NO: 7822721 - DNA, 22 bp, Homo sapiens
agggaggcaggaaagttgtctg

SEQ ID NO: 7822722 - DNA, 22 bp, Homo sapiens
agggaggatctgctccttgtct

SEQ ID NO: 7822723 - DNA, 22 bp, Homo sapiens
agggaggatctgctccttgtct

SEQ ID NO: 7822724 - DNA, 22 bp, Homo sapiens
agggaggatctgctccttgtct

SEQ ID NO: 7822725 - DNA, 22 bp, Homo sapiens
accagagaaaacacagcaggct

SEQ ID NO: 7822726 - DNA, 22 bp, Homo sapiens
accagagaaaacacagcaggct

SEQ ID NO: 7822727 - DNA, 22 bp, Homo sapiens
accagagaaaacacagcaggct

SEQ ID NO: 7822728 - DNA, 22 bp, Homo sapiens
accagagaatttagccaagaaa

SEQ ID NO: 7822729 - DNA, 22 bp, Homo sapiens
accagagaatttagccaagaaa

SEQ ID NO: 7822730 - DNA, 22 bp, Homo sapiens
accagagaaaacacagcaggct

SEQ ID NO: 7822731 - DNA, 22 bp, Homo sapiens
accagagaaaacacagcaggct

SEQ ID NO: 7822732 - DNA, 20 bp, Homo sapiens
accagagactggggacaagt

SEQ ID NO: 7822733 - DNA, 20 bp, Homo sapiens
accagagactggggacaagt

SEQ ID NO: 7822734 - DNA, 22 bp, Homo sapiens
accagagactgcatttctctga

SEQ ID NO: 7822735 - DNA, 22 bp, Homo sapiens
accagagactgcatttctctga

SEQ ID NO: 7822736 - DNA, 22 bp, Homo sapiens
accagagaatttagccaagaaa

SEQ ID NO: 7822737 - DNA, 20 bp, Homo sapiens
accagagacctgaatcagtt

SEQ ID NO: 7822738 - DNA, 20 bp, Homo sapiens
accagagacctgaatcagtt

SEQ ID NO: 7822739 - DNA, 20 bp, Homo sapiens
accagagatagcaatagtgc

SEQ ID NO: 7822740 - DNA, 22 bp, Homo sapiens
accagagaggctgcagtgtgtg

SEQ ID NO: 7822741 - DNA, 22 bp, Homo sapiens
accagagatggggcttctctgt

SEQ ID NO: 7822742 - DNA, 20 bp, Homo sapiens
accagagatagcaatagtgc

SEQ ID NO: 7822743 - DNA, 22 bp, Homo sapiens
accagagatggggcttctctgt

SEQ ID NO: 7822744 - DNA, 22 bp, Homo sapiens
accagagcagactactggaggt

SEQ ID NO: 7822745 - DNA, 22 bp, Homo sapiens
accagagatgtctaataggggc

SEQ ID NO: 7822746 - DNA, 22 bp, Homo sapiens
accagagagagacagggttgtg

SEQ ID NO: 7822747 - DNA, 22 bp, Homo sapiens
accagagagagacagggttgtg

SEQ ID NO: 7822748 - DNA, 22 bp, Homo sapiens
accagagagcctaggctgggca

SEQ ID NO: 7822749 - DNA, 22 bp, Homo sapiens
accagagagcctaggctgggca

SEQ ID NO: 7822750 - DNA, 22 bp, Homo sapiens
accagagagcctaggctgggca

SEQ ID NO: 7822751 - DNA, 22 bp, Homo sapiens
accagagaggctgcagtgtgtg

SEQ ID NO: 7822752 - DNA, 22 bp, Homo sapiens
accagagaggctgcagtgtgtg

SEQ ID NO: 7822753 - DNA, 22 bp, Homo sapiens
accagagagcctaggctgggca

SEQ ID NO: 7822754 - DNA, 22 bp, Homo sapiens
accagagagcctaggctgggca

SEQ ID NO: 7822755 - DNA, 22 bp, Homo sapiens
agggatgttgtcaaggatgtgg

SEQ ID NO: 7822756 - DNA, 20 bp, Homo sapiens
agggcaaaatccaaaagtct

SEQ ID NO: 7822757 - DNA, 22 bp, Homo sapiens
agggcaagggttgaagataaga

SEQ ID NO: 7822758 - DNA, 22 bp, Homo sapiens
agggatgttcattttgtggctg

SEQ ID NO: 7822759 - DNA, 22 bp, Homo sapiens
agggatgttagttgtgagctca

SEQ ID NO: 7822760 - DNA, 22 bp, Homo sapiens
agggatgttcattttgtggctg

SEQ ID NO: 7822761 - DNA, 22 bp, Homo sapiens
agggatgttagttgtgagctca

SEQ ID NO: 7822762 - DNA, 22 bp, Homo sapiens
agggatgttagttgtgagctca

SEQ ID NO: 7822763 - DNA, 22 bp, Homo sapiens
agggatgtggtgggagagaaag

SEQ ID NO: 7822764 - DNA, 22 bp, Homo sapiens
agggatgtgggaactgcaggtt

SEQ ID NO: 7822765 - DNA, 22 bp, Homo sapiens
agggatgtgcagcatccagaca

SEQ ID NO: 7822766 - DNA, 22 bp, Homo sapiens
agggatgtgggaactgcaggtt

SEQ ID NO: 7822767 - DNA, 22 bp, Homo sapiens
agggatgtgggaactgcaggtt

SEQ ID NO: 7822768 - DNA, 22 bp, Homo sapiens
agggatgtggtgggagagaaag

SEQ ID NO: 7822769 - DNA, 22 bp, Homo sapiens
agggcaccctctctgcagtacc

SEQ ID NO: 7822770 - DNA, 21 bp, Homo sapiens
agggcacccccgctgcctacc

SEQ ID NO: 7822771 - DNA, 21 bp, Homo sapiens
agggcacccccgctgcctacc

SEQ ID NO: 7822772 - DNA, 22 bp, Homo sapiens
agggcacatctgctgggaatgg

SEQ ID NO: 7822773 - DNA, 22 bp, Homo sapiens
agggcacaggctccgggtccag

SEQ ID NO: 7822774 - DNA, 22 bp, Homo sapiens
agggcacaagactctgagcccc

SEQ ID NO: 7822775 - DNA, 22 bp, Homo sapiens
agggcacaagactctgagcccc

SEQ ID NO: 7822776 - DNA, 19 bp, Homo sapiens
agggaggtagcattggaaa

SEQ ID NO: 7822777 - DNA, 19 bp, Homo sapiens
agggaggtagcattggaaa

SEQ ID NO: 7822778 - DNA, 22 bp, Homo sapiens
agggaggcattagctactgcga

SEQ ID NO: 7822779 - DNA, 22 bp, Homo sapiens
agggaggcattagctactgcga

SEQ ID NO: 7822780 - DNA, 22 bp, Homo sapiens
agggaggcattagctactgcga

SEQ ID NO: 7822781 - DNA, 22 bp, Homo sapiens
agggaggcattagctactgcga

SEQ ID NO: 7822782 - DNA, 22 bp, Homo sapiens
agggaggcattagctactgcga

SEQ ID NO: 7822783 - DNA, 22 bp, Homo sapiens
agggaggcattagctactgcga

SEQ ID NO: 7822784 - DNA, 22 bp, Homo sapiens
agggaggtaggagcttctagct

SEQ ID NO: 7822785 - DNA, 22 bp, Homo sapiens
agggaggtccatccctgcagag

SEQ ID NO: 7822786 - DNA, 19 bp, Homo sapiens
agggaggtagcattggaaa

SEQ ID NO: 7822787 - DNA, 22 bp, Homo sapiens
agggaggtctggctgccctgag

SEQ ID NO: 7822788 - DNA, 22 bp, Homo sapiens
agggaggtggttccccagtgga

SEQ ID NO: 7822789 - DNA, 22 bp, Homo sapiens
agggatgtgacattacagaagc

SEQ ID NO: 7822790 - DNA, 18 bp, Homo sapiens
agggatgtatgctggtgg

SEQ ID NO: 7822791 - DNA, 20 bp, Homo sapiens
agggaggtgctgggcctgag

SEQ ID NO: 7822792 - DNA, 20 bp, Homo sapiens
agggaggtgctgggcctgag

SEQ ID NO: 7822793 - DNA, 22 bp, Homo sapiens
agggaggtctggctgccctgag

SEQ ID NO: 7822794 - DNA, 22 bp, Homo sapiens
agggaggtctttgaggggctta

SEQ ID NO: 7822795 - DNA, 20 bp, Homo sapiens
agggaggtgctgggcctgag

SEQ ID NO: 7822796 - DNA, 20 bp, Homo sapiens
agggaggtgctgggcctgag

SEQ ID NO: 7822797 - DNA, 22 bp, Homo sapiens
agggaggtctttgaggggctta

SEQ ID NO: 7822798 - DNA, 21 bp, Homo sapiens
agggccagatcaccaaggagc

SEQ ID NO: 7822799 - DNA, 22 bp, Homo sapiens
agggccagatgaagccacaagc

SEQ ID NO: 7822800 - DNA, 22 bp, Homo sapiens
agggccagatgaagccacaagc

SEQ ID NO: 7822801 - DNA, 21 bp, Homo sapiens
agggccagatcaccaaggagc

SEQ ID NO: 7822802 - DNA, 22 bp, Homo sapiens
agggccagatgaagccacaagc

SEQ ID NO: 7822803 - DNA, 22 bp, Homo sapiens
agggccagatgaagccacaagc

SEQ ID NO: 7822804 - DNA, 22 bp, Homo sapiens
agggccagatgaagccacaagc

SEQ ID NO: 7822805 - DNA, 22 bp, Homo sapiens
agggccagcactcctggcagga

SEQ ID NO: 7822806 - DNA, 22 bp, Homo sapiens
agggccagcactcctggcagga

SEQ ID NO: 7822807 - DNA, 22 bp, Homo sapiens
agggccagcactcctggcagga

SEQ ID NO: 7822808 - DNA, 22 bp, Homo sapiens
agggccagcactcctggcagga

SEQ ID NO: 7822809 - DNA, 22 bp, Homo sapiens
agggccagcactcctggcagga

SEQ ID NO: 7822810 - DNA, 22 bp, Homo sapiens
agggccagcactcctggcagga

SEQ ID NO: 7822811 - DNA, 22 bp, Homo sapiens
agggccagcactcctggcagga

SEQ ID NO: 7822812 - DNA, 22 bp, Homo sapiens
agggccagatgaagccacaagc

SEQ ID NO: 7822813 - DNA, 23 bp, Homo sapiens
agggcactgttgggtgttgagga

SEQ ID NO: 7822814 - DNA, 23 bp, Homo sapiens
agggcactgttgggtgttgagga

SEQ ID NO: 7822815 - DNA, 22 bp, Homo sapiens
agggcatgctggaggagagaca

SEQ ID NO: 7822816 - DNA, 22 bp, Homo sapiens
agggcatgctggaggagagaca

SEQ ID NO: 7822817 - DNA, 22 bp, Homo sapiens
agggcatgctggaggagagaca

SEQ ID NO: 7822818 - DNA, 23 bp, Homo sapiens
agggcactgaagctggaattggg

SEQ ID NO: 7822819 - DNA, 23 bp, Homo sapiens
agggcactgaagctggaattggg

SEQ ID NO: 7822820 - DNA, 22 bp, Homo sapiens
agggcactgcaagggttgaagg

SEQ ID NO: 7822821 - DNA, 22 bp, Homo sapiens
agggcactgaacagctgtagca

SEQ ID NO: 7822822 - DNA, 22 bp, Homo sapiens
agggcactgaacagctgtagca

SEQ ID NO: 7822823 - DNA, 22 bp, Homo sapiens
agggcactgaacagctgtagca

SEQ ID NO: 7822824 - DNA, 23 bp, Homo sapiens
agggcactgaagctggaattggg

SEQ ID NO: 7822825 - DNA, 22 bp, Homo sapiens
agggcactccttggcagctctg

SEQ ID NO: 7822826 - DNA, 22 bp, Homo sapiens
agggcactccttggcagctctg

SEQ ID NO: 7822827 - DNA, 22 bp, Homo sapiens
agggcactccttggcagctctg

SEQ ID NO: 7822828 - DNA, 22 bp, Homo sapiens
agggccagcactcctggcagga

SEQ ID NO: 7822829 - DNA, 22 bp, Homo sapiens
agggccagcactcctggcagga

SEQ ID NO: 7822830 - DNA, 22 bp, Homo sapiens
agggccagcactcctggcagga

SEQ ID NO: 7822831 - DNA, 22 bp, Homo sapiens
agggccagcactcctggcagga

SEQ ID NO: 7822832 - DNA, 22 bp, Homo sapiens
agggccagcactcctggcagga

SEQ ID NO: 7822833 - DNA, 22 bp, Homo sapiens
agggccagcactcctggcagga

SEQ ID NO: 7822834 - DNA, 22 bp, Homo sapiens
agggccagcagcttggccaacc

SEQ ID NO: 7822835 - DNA, 22 bp, Homo sapiens
agggccagcagcttggccaacc

SEQ ID NO: 7822836 - DNA, 22 bp, Homo sapiens
agggccagcagcttggccaacc

SEQ ID NO: 7822837 - DNA, 22 bp, Homo sapiens
agggccagcactcctggcagga

SEQ ID NO: 7822838 - DNA, 22 bp, Homo sapiens
agggccagcccataatgccaaa

SEQ ID NO: 7822839 - DNA, 22 bp, Homo sapiens
agggccagcccataatgccaaa

SEQ ID NO: 7822840 - DNA, 22 bp, Homo sapiens
agggccagcccataatgccaaa

SEQ ID NO: 7822841 - DNA, 22 bp, Homo sapiens
agggccagcccataatgccaaa

SEQ ID NO: 7822842 - DNA, 22 bp, Homo sapiens
agggccagccaggccctacaaa

SEQ ID NO: 7822843 - DNA, 22 bp, Homo sapiens
agggccagccaggccctacaaa

SEQ ID NO: 7822844 - DNA, 22 bp, Homo sapiens
agggccagccaggccctacaaa

SEQ ID NO: 7822845 - DNA, 22 bp, Homo sapiens
agggccagccaggccctacaaa

SEQ ID NO: 7822846 - DNA, 22 bp, Homo sapiens
agggccagccaggccctacaaa

SEQ ID NO: 7822847 - DNA, 22 bp, Homo sapiens
agggccagcccataatgccaaa

SEQ ID NO: 7822848 - DNA, 22 bp, Homo sapiens
agggccagccaggccctacaaa

SEQ ID NO: 7822849 - DNA, 22 bp, Homo sapiens
agggccagttctacctctgaat

SEQ ID NO: 7822850 - DNA, 22 bp, Homo sapiens
agggccagttctacctctgaat

SEQ ID NO: 7822851 - DNA, 22 bp, Homo sapiens
agggccagttctacctctgaat

SEQ ID NO: 7822852 - DNA, 22 bp, Homo sapiens
agggccagttctacctctgaat

SEQ ID NO: 7822853 - DNA, 22 bp, Homo sapiens
agggccagttctacctctgaat

SEQ ID NO: 7822854 - DNA, 22 bp, Homo sapiens
agggccagttcagaggacatgg

SEQ ID NO: 7822855 - DNA, 22 bp, Homo sapiens
agggcctgtcagcggtgtcctg

SEQ ID NO: 7822856 - DNA, 22 bp, Homo sapiens
agggcctggttctgtgtaggga

SEQ ID NO: 7822857 - DNA, 22 bp, Homo sapiens
agggcctgtcagcggtgtcctg

SEQ ID NO: 7822858 - DNA, 22 bp, Homo sapiens
agggccagttctacctctgaat

SEQ ID NO: 7822859 - DNA, 22 bp, Homo sapiens
agggccagttctacctctgaat

SEQ ID NO: 7822860 - DNA, 22 bp, Homo sapiens
agggccagttctacctctgaat

SEQ ID NO: 7822861 - DNA, 22 bp, Homo sapiens
agggctcaatggtgggcatgta

SEQ ID NO: 7822862 - DNA, 22 bp, Homo sapiens
agggctcaccactgtgcactcc

SEQ ID NO: 7822863 - DNA, 22 bp, Homo sapiens
agggctcaccactgtgcactcc

SEQ ID NO: 7822864 - DNA, 22 bp, Homo sapiens
agggctcaagggcatgctacgt

SEQ ID NO: 7822865 - DNA, 22 bp, Homo sapiens
agggctcaagggcatgctacgt

SEQ ID NO: 7822866 - DNA, 22 bp, Homo sapiens
agggctcaatggtgggcatgta

SEQ ID NO: 7822867 - DNA, 22 bp, Homo sapiens
agggctcaatggtgggcatgta

SEQ ID NO: 7822868 - DNA, 22 bp, Homo sapiens
agggccagtcgtgtattactgt

SEQ ID NO: 7822869 - DNA, 22 bp, Homo sapiens
agggccagtcgtgtattactgt

SEQ ID NO: 7822870 - DNA, 22 bp, Homo sapiens
agggccagtgggttgaaaggca

SEQ ID NO: 7822871 - DNA, 22 bp, Homo sapiens
agggccagtgggttgaaaggca

SEQ ID NO: 7822872 - DNA, 22 bp, Homo sapiens
agggccagtgggttgaaaggca

SEQ ID NO: 7822873 - DNA, 22 bp, Homo sapiens
agggccagttcagaggacatgg

SEQ ID NO: 7822874 - DNA, 22 bp, Homo sapiens
agggccagttcagaggacatgg

SEQ ID NO: 7822875 - DNA, 22 bp, Homo sapiens
agggccagttcagaggacatgg

SEQ ID NO: 7822876 - DNA, 22 bp, Homo sapiens
agggccagttcagaggacatgg

SEQ ID NO: 7822877 - DNA, 22 bp, Homo sapiens
agggccagttcagaggacatgg

SEQ ID NO: 7822878 - DNA, 22 bp, Homo sapiens
agggccagttcagaggacatgg

SEQ ID NO: 7822879 - DNA, 22 bp, Homo sapiens
agggccagttcagaggacatgg

SEQ ID NO: 7822880 - DNA, 22 bp, Homo sapiens
agggccagttcagaggacatgg

SEQ ID NO: 7822881 - DNA, 22 bp, Homo sapiens
agggccagtattaaggtaatta

SEQ ID NO: 7822882 - DNA, 22 bp, Homo sapiens
agggccagtattaaggtaatta

SEQ ID NO: 7822883 - DNA, 22 bp, Homo sapiens
agggccagtaccaggtgggtgg

SEQ ID NO: 7822884 - DNA, 22 bp, Homo sapiens
agggccagtaccaggtgggtgg

SEQ ID NO: 7822885 - DNA, 22 bp, Homo sapiens
agggccagtaaatgtttcctca

SEQ ID NO: 7822886 - DNA, 22 bp, Homo sapiens
agggccagtaaatgtttcctca

SEQ ID NO: 7822887 - DNA, 22 bp, Homo sapiens
agggccagccccaccctctctg

SEQ ID NO: 7822888 - DNA, 22 bp, Homo sapiens
agggccagtaccaggtgggtgg

SEQ ID NO: 7822889 - DNA, 22 bp, Homo sapiens
agggccagtaccaggtgggtgg

SEQ ID NO: 7822890 - DNA, 22 bp, Homo sapiens
agggccagtaccaggtgggtgg

SEQ ID NO: 7822891 - DNA, 22 bp, Homo sapiens
aggcagcaaagaaatgatgctg

SEQ ID NO: 7822892 - DNA, 22 bp, Homo sapiens
aggcagcaaagaaatgatgctg

SEQ ID NO: 7822893 - DNA, 22 bp, Homo sapiens
aggcagcaaatgtctggaacag

SEQ ID NO: 7822894 - DNA, 22 bp, Homo sapiens
aggcagcaaatgtctggaacag

SEQ ID NO: 7822895 - DNA, 22 bp, Homo sapiens
aggcagcaaatgtctggaacag

SEQ ID NO: 7822896 - DNA, 22 bp, Homo sapiens
aggcagcaagattatttaatcc

SEQ ID NO: 7822897 - DNA, 22 bp, Homo sapiens
aggcagattttctttactcagt

SEQ ID NO: 7822898 - DNA, 22 bp, Homo sapiens
aggcagattttctttactcagt

SEQ ID NO: 7822899 - DNA, 22 bp, Homo sapiens
aggcagcaaagaaatgatgctg

SEQ ID NO: 7822900 - DNA, 22 bp, Homo sapiens
aggcagcaaagaaatgatgctg

SEQ ID NO: 7822901 - DNA, 22 bp, Homo sapiens
aggcagcaaagaaatgatgctg

SEQ ID NO: 7822902 - DNA, 22 bp, Homo sapiens
aggcagcaaagaaatgatgctg

SEQ ID NO: 7822903 - DNA, 22 bp, Homo sapiens
aggcagcaaagaaatgatgctg

SEQ ID NO: 7822904 - DNA, 22 bp, Homo sapiens
aggcaggggagctggaagggta

SEQ ID NO: 7822905 - DNA, 22 bp, Homo sapiens
aggcagcaatgaatgaaatgga

SEQ ID NO: 7822906 - DNA, 22 bp, Homo sapiens
aggcagcaagattatttaatcc

SEQ ID NO: 7822907 - DNA, 22 bp, Homo sapiens
aggcagcaaatgtctggaacag

SEQ ID NO: 7822908 - DNA, 22 bp, Homo sapiens
aggcaggggagctggaagggta

SEQ ID NO: 7822909 - DNA, 22 bp, Homo sapiens
aggcaggggagctggaagggta

SEQ ID NO: 7822910 - DNA, 22 bp, Homo sapiens
aggcaggggagctggaagggta

SEQ ID NO: 7822911 - DNA, 22 bp, Homo sapiens
aggcaggggagctggaagggta

SEQ ID NO: 7822912 - DNA, 22 bp, Homo sapiens
aggcaggggagctggaagggta

SEQ ID NO: 7822913 - DNA, 22 bp, Homo sapiens
aggcaggggagctggaagggta

SEQ ID NO: 7822914 - DNA, 18 bp, Homo sapiens
aggcaggtgctggaagtc

SEQ ID NO: 7822915 - DNA, 18 bp, Homo sapiens
aggcaggtgctggaagtc

SEQ ID NO: 7822916 - DNA, 18 bp, Homo sapiens
aggcaggtgctggaagtc

SEQ ID NO: 7822917 - DNA, 18 bp, Homo sapiens
aggcaggtgctggaagtc

SEQ ID NO: 7822918 - DNA, 18 bp, Homo sapiens
aggcaggtgctggaagtc

SEQ ID NO: 7822919 - DNA, 22 bp, Homo sapiens
aggcaggggagctggaagggta

SEQ ID NO: 7822920 - DNA, 22 bp, Homo sapiens
aggcaggggagctggaagggta

SEQ ID NO: 7822921 - DNA, 22 bp, Homo sapiens
aggcaggggagctggaagggta

SEQ ID NO: 7822922 - DNA, 22 bp, Homo sapiens
aggcaggggagctggaagggta

SEQ ID NO: 7822923 - DNA, 22 bp, Homo sapiens
aggcaggggagctggaagggta

SEQ ID NO: 7822924 - DNA, 18 bp, Homo sapiens
aggcaggtgctggaagtc

SEQ ID NO: 7822925 - DNA, 22 bp, Homo sapiens
aggcaggttggggaaaagcact

SEQ ID NO: 7822926 - DNA, 22 bp, Homo sapiens
aggcaggttggtgagaagactg

SEQ ID NO: 7822927 - DNA, 22 bp, Homo sapiens
aggcaggtgttgggagacacca

SEQ ID NO: 7822928 - DNA, 22 bp, Homo sapiens
aggcaggttacaaaaactttat

SEQ ID NO: 7822929 - DNA, 22 bp, Homo sapiens
aggcaggtgttgggagacacca

SEQ ID NO: 7822930 - DNA, 22 bp, Homo sapiens
aggcaggtgttgggagacacca

SEQ ID NO: 7822931 - DNA, 22 bp, Homo sapiens
aggcaggtgttgggagacacca

SEQ ID NO: 7822932 - DNA, 22 bp, Homo sapiens
aggcaggtgttgggagacacca

SEQ ID NO: 7822933 - DNA, 22 bp, Homo sapiens
aggcaggtgttacctctggttt

SEQ ID NO: 7822934 - DNA, 22 bp, Homo sapiens
aggcaggtgttacctctggttt

SEQ ID NO: 7822935 - DNA, 22 bp, Homo sapiens
aggcaggtgttacctctggttt

SEQ ID NO: 7822936 - DNA, 22 bp, Homo sapiens
aggcaggtgttgggagacacca

SEQ ID NO: 7822937 - DNA, 22 bp, Homo sapiens
aggcaggtgggtcacttgagtc

SEQ ID NO: 7822938 - DNA, 22 bp, Homo sapiens
aggcaggtgggtcacttgagtc

SEQ ID NO: 7822939 - DNA, 22 bp, Homo sapiens
aggcaggtgggtcacttgagtc

SEQ ID NO: 7822940 - DNA, 22 bp, Homo sapiens
aggcaggtgggtcacttgagtc

SEQ ID NO: 7822941 - DNA, 22 bp, Homo sapiens
aggcaggtgttaaccctctgag

SEQ ID NO: 7822942 - DNA, 22 bp, Homo sapiens
aggcaggtgggtcacttgagtc

SEQ ID NO: 7822943 - DNA, 22 bp, Homo sapiens
aggcaggtgggagtgattcctt

SEQ ID NO: 7822944 - DNA, 22 bp, Homo sapiens
aggcaggtgcttatgacttgct

SEQ ID NO: 7822945 - DNA, 22 bp, Homo sapiens
aggcaggtgcttatgacttgct

SEQ ID NO: 7822946 - DNA, 22 bp, Homo sapiens
aggcagattacttgaggccagg

SEQ ID NO: 7822947 - DNA, 22 bp, Homo sapiens
aggcagatgtttggcattgctt

SEQ ID NO: 7822948 - DNA, 22 bp, Homo sapiens
aggcagatgtttggcattgctt

SEQ ID NO: 7822949 - DNA, 22 bp, Homo sapiens
aggcagatggtaactgtgatat

SEQ ID NO: 7822950 - DNA, 22 bp, Homo sapiens
aggcagatgtgattaatttcct

SEQ ID NO: 7822951 - DNA, 22 bp, Homo sapiens
aggcagatggatgggcatttgt

SEQ ID NO: 7822952 - DNA, 22 bp, Homo sapiens
aggcagatcagtacagggttaa

SEQ ID NO: 7822953 - DNA, 22 bp, Homo sapiens
aggcagatgaacctgggttgag

SEQ ID NO: 7822954 - DNA, 22 bp, Homo sapiens
aggcagatgaacctgggttgag

SEQ ID NO: 7822955 - DNA, 22 bp, Homo sapiens
aggcagatcacttgaggccagg

SEQ ID NO: 7822956 - DNA, 22 bp, Homo sapiens
aggcagatcacaggagggcctg

SEQ ID NO: 7822957 - DNA, 22 bp, Homo sapiens
aggcagatcagtacagggttaa

SEQ ID NO: 7822958 - DNA, 22 bp, Homo sapiens
aggcagatatttcagttcacat

SEQ ID NO: 7822959 - DNA, 22 bp, Homo sapiens
aggcagatatttcagttcacat

SEQ ID NO: 7822960 - DNA, 22 bp, Homo sapiens
aggcagagaaaaaccagatatg

SEQ ID NO: 7822961 - DNA, 22 bp, Homo sapiens
aggcagatattggggtgatgtg

SEQ ID NO: 7822962 - DNA, 22 bp, Homo sapiens
aggcagagaaaaaccagatatg

SEQ ID NO: 7822963 - DNA, 22 bp, Homo sapiens
aggcagagaaaaaccagatatg

SEQ ID NO: 7822964 - DNA, 22 bp, Homo sapiens
aggcagagaaaaaccagatatg

SEQ ID NO: 7822965 - DNA, 22 bp, Homo sapiens
aggcagagaaaaaccagatatg

SEQ ID NO: 7822966 - DNA, 22 bp, Homo sapiens
aggcagaatgttggaaaggaag

SEQ ID NO: 7822967 - DNA, 22 bp, Homo sapiens
aggcagaatgttggaaaggaag

SEQ ID NO: 7822968 - DNA, 22 bp, Homo sapiens
aggcagaatgttggaaaggaag

SEQ ID NO: 7822969 - DNA, 22 bp, Homo sapiens
aggcagaatgttggaaaggaag

SEQ ID NO: 7822970 - DNA, 22 bp, Homo sapiens
aggcagaatgttggaaaggaag

SEQ ID NO: 7822971 - DNA, 22 bp, Homo sapiens
aggcagaagccagccagggtcc

SEQ ID NO: 7822972 - DNA, 22 bp, Homo sapiens
aggcagaagccagccagggtcc

SEQ ID NO: 7822973 - DNA, 22 bp, Homo sapiens
aggcagaagccagccagggtcc

SEQ ID NO: 7822974 - DNA, 22 bp, Homo sapiens
aggcagaagccagccagggtcc

SEQ ID NO: 7822975 - DNA, 22 bp, Homo sapiens
aggcagaagccagccagggtcc

SEQ ID NO: 7822976 - DNA, 22 bp, Homo sapiens
aggcagaaccagctgggacttt

SEQ ID NO: 7822977 - DNA, 22 bp, Homo sapiens
aggcagaaccagctgggacttt

SEQ ID NO: 7822978 - DNA, 21 bp, Homo sapiens
aggcagaaagagcccaggctg

SEQ ID NO: 7822979 - DNA, 21 bp, Homo sapiens
aggcagaaagagcccaggctg

SEQ ID NO: 7822980 - DNA, 22 bp, Homo sapiens
aggcagaaccagctgggacttt

SEQ ID NO: 7822981 - DNA, 21 bp, Homo sapiens
aggcagaaagagcccaggctg

SEQ ID NO: 7822982 - DNA, 18 bp, Homo sapiens
aggcagacactagaggtc

SEQ ID NO: 7822983 - DNA, 22 bp, Homo sapiens
aggcagacaagtccagaactgg

SEQ ID NO: 7822984 - DNA, 20 bp, Homo sapiens
aggcagacaaggagtctgtt

SEQ ID NO: 7822985 - DNA, 20 bp, Homo sapiens
aggcagacaaggagtctgtt

SEQ ID NO: 7822986 - DNA, 20 bp, Homo sapiens
aggcagacaaggagtctgtt

SEQ ID NO: 7822987 - DNA, 20 bp, Homo sapiens
aggcagacaaggagtctgtt

SEQ ID NO: 7822988 - DNA, 22 bp, Homo sapiens
aggcagacaaggacacagtggg

SEQ ID NO: 7822989 - DNA, 22 bp, Homo sapiens
aggcagacaaggacacagtggg

SEQ ID NO: 7822990 - DNA, 22 bp, Homo sapiens
aggcagacaaggacacagtggg

SEQ ID NO: 7822991 - DNA, 22 bp, Homo sapiens
aggcagactgtgcgggaagagt

SEQ ID NO: 7822992 - DNA, 22 bp, Homo sapiens
aggcagactggcagggcctgga

SEQ ID NO: 7822993 - DNA, 22 bp, Homo sapiens
aggcagactcaatggctagata

SEQ ID NO: 7822994 - DNA, 22 bp, Homo sapiens
aggcagagaaaaaccagatatg

SEQ ID NO: 7822995 - DNA, 22 bp, Homo sapiens
aggcagagaaaaaccagatatg

SEQ ID NO: 7822996 - DNA, 22 bp, Homo sapiens
aggcagacttaccttctgggga

SEQ ID NO: 7822997 - DNA, 22 bp, Homo sapiens
aggcagacaaggtccctggtct

SEQ ID NO: 7822998 - DNA, 22 bp, Homo sapiens
acatctctgggtcctccatgca

SEQ ID NO: 7822999 - DNA, 22 bp, Homo sapiens
acatctctgggtcctccatgca

SEQ ID NO: 7823000 - DNA, 22 bp, Homo sapiens
acatccatttgctttatttgct

SEQ ID NO: 7823001 - DNA, 22 bp, Homo sapiens
acatatattactagtaaagaca

SEQ ID NO: 7823002 - DNA, 22 bp, Homo sapiens
acatatattactagtaaagaca

SEQ ID NO: 7823003 - DNA, 22 bp, Homo sapiens
acatatattactagtaaagaca

SEQ ID NO: 7823004 - DNA, 22 bp, Homo sapiens
acatccatgttgtaatgttcct

SEQ ID NO: 7823005 - DNA, 23 bp, Homo sapiens
acatccatgaatcatctgctttc

SEQ ID NO: 7823006 - DNA, 22 bp, Homo sapiens
acatccatgcatgtctgtgcac

SEQ ID NO: 7823007 - DNA, 23 bp, Homo sapiens
acatccatgaatcatctgctttc

SEQ ID NO: 7823008 - DNA, 22 bp, Homo sapiens
acatctgattacatgagaatat

SEQ ID NO: 7823009 - DNA, 22 bp, Homo sapiens
acatctgattacatgagaatat

SEQ ID NO: 7823010 - DNA, 22 bp, Homo sapiens
acatctgaggagaccagcctct

SEQ ID NO: 7823011 - DNA, 22 bp, Homo sapiens
acatctgagcaacagaacacta

SEQ ID NO: 7823012 - DNA, 22 bp, Homo sapiens
acatctgaaagggattgcagaa

SEQ ID NO: 7823013 - DNA, 22 bp, Homo sapiens
acatctcttcttaaggctccag

SEQ ID NO: 7823014 - DNA, 22 bp, Homo sapiens
acatctgaaagggattgcagaa

SEQ ID NO: 7823015 - DNA, 22 bp, Homo sapiens
acatctgacatgatcttcagta

SEQ ID NO: 7823016 - DNA, 22 bp, Homo sapiens
acatctgacatgatcttcagta

SEQ ID NO: 7823017 - DNA, 22 bp, Homo sapiens
acatctgaccattacaagacat

SEQ ID NO: 7823018 - DNA, 22 bp, Homo sapiens
acatctgaccattacaagacat

SEQ ID NO: 7823019 - DNA, 22 bp, Homo sapiens
acatctgaccattacaagacat

SEQ ID NO: 7823020 - DNA, 22 bp, Homo sapiens
acatatatgctgggactgtgac

SEQ ID NO: 7823021 - DNA, 22 bp, Homo sapiens
acatatatgctgggactgtgac

SEQ ID NO: 7823022 - DNA, 22 bp, Homo sapiens
acatatatgctgggactgtgac

SEQ ID NO: 7823023 - DNA, 22 bp, Homo sapiens
acatatatgtaaagtactttgt

SEQ ID NO: 7823024 - DNA, 22 bp, Homo sapiens
acatatatgtaaagtactttgt

SEQ ID NO: 7823025 - DNA, 22 bp, Homo sapiens
acatataagggatcagtgacag

SEQ ID NO: 7823026 - DNA, 22 bp, Homo sapiens
acatataagggatcagtgacag

SEQ ID NO: 7823027 - DNA, 22 bp, Homo sapiens
acatataagggatcagtgacag

SEQ ID NO: 7823028 - DNA, 22 bp, Homo sapiens
acatataagggatcagtgacag

SEQ ID NO: 7823029 - DNA, 22 bp, Homo sapiens
acatataagggatcagtgacag

SEQ ID NO: 7823030 - DNA, 22 bp, Homo sapiens
acatataagggatcagtgacag

SEQ ID NO: 7823031 - DNA, 22 bp, Homo sapiens
acatagttgatgagcgtgtacg

SEQ ID NO: 7823032 - DNA, 22 bp, Homo sapiens
acatagttcagagcagcagacc

SEQ ID NO: 7823033 - DNA, 22 bp, Homo sapiens
acatatatgtgcacatgtgcag

SEQ ID NO: 7823034 - DNA, 22 bp, Homo sapiens
acatatatgtgcacatgtgcag

SEQ ID NO: 7823035 - DNA, 22 bp, Homo sapiens
acatatatgtaaagtactttgt

SEQ ID NO: 7823036 - DNA, 22 bp, Homo sapiens
acatatatgtaaagtactttgt

SEQ ID NO: 7823037 - DNA, 22 bp, Homo sapiens
acatatatgtaaagtactttgt

SEQ ID NO: 7823038 - DNA, 22 bp, Homo sapiens
acatatatgtaaagtactttgt

SEQ ID NO: 7823039 - DNA, 22 bp, Homo sapiens
acatatattactagtaaagaca

SEQ ID NO: 7823040 - DNA, 22 bp, Homo sapiens
acatatattactagtaaagaca

SEQ ID NO: 7823041 - DNA, 22 bp, Homo sapiens
acatatattactagtaaagaca

SEQ ID NO: 7823042 - DNA, 22 bp, Homo sapiens
acatatattactagtaaagaca

SEQ ID NO: 7823043 - DNA, 22 bp, Homo sapiens
acatatattactagtaaagaca

SEQ ID NO: 7823044 - DNA, 22 bp, Homo sapiens
acatatatgtgcacatgtgcag

SEQ ID NO: 7823045 - DNA, 23 bp, Homo sapiens
aggcagtgtctcttatcctgtcc

SEQ ID NO: 7823046 - DNA, 22 bp, Homo sapiens
aggcagtgtattgctagcggct

SEQ ID NO: 7823047 - DNA, 22 bp, Homo sapiens
aggcagtgtattgctagcggct

SEQ ID NO: 7823048 - DNA, 22 bp, Homo sapiens
aggcagtgtattgctagcggct

SEQ ID NO: 7823049 - DNA, 22 bp, Homo sapiens
aggcagtgtattgctagcggct

SEQ ID NO: 7823050 - DNA, 20 bp, Homo sapiens
aggcagtgtagagatgagta

SEQ ID NO: 7823051 - DNA, 22 bp, Homo sapiens
aggcagtgtattgctagcggct

SEQ ID NO: 7823052 - DNA, 20 bp, Homo sapiens
aggcagtgtagagatgagta

SEQ ID NO: 7823053 - DNA, 20 bp, Homo sapiens
aggcagtgtagagatgagta

SEQ ID NO: 7823054 - DNA, 20 bp, Homo sapiens
aggcagtgtagagatgagta

SEQ ID NO: 7823055 - DNA, 20 bp, Homo sapiens
aggcagtgtagagatgagta

SEQ ID NO: 7823056 - DNA, 20 bp, Homo sapiens
aggcagtgtagagatgagta

SEQ ID NO: 7823057 - DNA, 22 bp, Homo sapiens
aggcagtgtgggccaagcttcc

SEQ ID NO: 7823058 - DNA, 22 bp, Homo sapiens
aggcagtgtgggccaagcttcc

SEQ ID NO: 7823059 - DNA, 22 bp, Homo sapiens
aggcagtgtgggccaagcttcc

SEQ ID NO: 7823060 - DNA, 23 bp, Homo sapiens
aggcagtgtctcttatcctgtcc

SEQ ID NO: 7823061 - DNA, 23 bp, Homo sapiens
aggcagtgtctcttatcctgtcc

SEQ ID NO: 7823062 - DNA, 22 bp, Homo sapiens
aggcagtgtggagggctgttgc

SEQ ID NO: 7823063 - DNA, 22 bp, Homo sapiens
aggcagtgtgggccaagcttcc

SEQ ID NO: 7823064 - DNA, 22 bp, Homo sapiens
aggcagtgtgtagctggaagag

SEQ ID NO: 7823065 - DNA, 22 bp, Homo sapiens
aggcagtgtgtagctggaagag

SEQ ID NO: 7823066 - DNA, 22 bp, Homo sapiens
aggcagtgtgtagctggaagag

SEQ ID NO: 7823067 - DNA, 22 bp, Homo sapiens
aggcagtgtgtagctggaagag

SEQ ID NO: 7823068 - DNA, 22 bp, Homo sapiens
aggcagtgtgtagctggaagag

SEQ ID NO: 7823069 - DNA, 22 bp, Homo sapiens
aggcagtgtgtagctggaagag

SEQ ID NO: 7823070 - DNA, 22 bp, Homo sapiens
aggcagtgtgtagctggaagag

SEQ ID NO: 7823071 - DNA, 22 bp, Homo sapiens
aggcagtgtgtagctggaagag

SEQ ID NO: 7823072 - DNA, 22 bp, Homo sapiens
aggcagtgtgtagctggaagag

SEQ ID NO: 7823073 - DNA, 22 bp, Homo sapiens
aggcagtggtgtttgctggtgg

SEQ ID NO: 7823074 - DNA, 22 bp, Homo sapiens
aggcagtggtgtttgctggtgg

SEQ ID NO: 7823075 - DNA, 22 bp, Homo sapiens
aggcagtggtgtttgctggtgg

SEQ ID NO: 7823076 - DNA, 20 bp, Homo sapiens
aggcagtgtagagatgagta

SEQ ID NO: 7823077 - DNA, 20 bp, Homo sapiens
aggcagtgtagagatgagta

SEQ ID NO: 7823078 - DNA, 23 bp, Homo sapiens
aggcagtggtggtaacatgtcaa

SEQ ID NO: 7823079 - DNA, 22 bp, Homo sapiens
aggcagtggtgtttgctggtgg

SEQ ID NO: 7823080 - DNA, 22 bp, Homo sapiens
aggcagtggtgtttgctggtgg

SEQ ID NO: 7823081 - DNA, 22 bp, Homo sapiens
aggcagtggtgtttgctggtgg

SEQ ID NO: 7823082 - DNA, 22 bp, Homo sapiens
acatctttgctcttatagagct

SEQ ID NO: 7823083 - DNA, 22 bp, Homo sapiens
acatctgggcctaaggctatat

SEQ ID NO: 7823084 - DNA, 22 bp, Homo sapiens
acatctttatactagtccttga

SEQ ID NO: 7823085 - DNA, 22 bp, Homo sapiens
acatctttatactagtccttga

SEQ ID NO: 7823086 - DNA, 22 bp, Homo sapiens
acatcttcactggtttctggaa

SEQ ID NO: 7823087 - DNA, 22 bp, Homo sapiens
acatctttatactagtccttga

SEQ ID NO: 7823088 - DNA, 22 bp, Homo sapiens
acatctggagactacagtttgg

SEQ ID NO: 7823089 - DNA, 22 bp, Homo sapiens
acatctggagactacagtttgg

SEQ ID NO: 7823090 - DNA, 22 bp, Homo sapiens
acatctgggcctaaggctatat

SEQ ID NO: 7823091 - DNA, 22 bp, Homo sapiens
acatctgtaatctagtcaaccc

SEQ ID NO: 7823092 - DNA, 22 bp, Homo sapiens
acatctgtaatctagtcaaccc

SEQ ID NO: 7823093 - DNA, 22 bp, Homo sapiens
acatctgttcaaatatgcattt

SEQ ID NO: 7823094 - DNA, 22 bp, Homo sapiens
acatctgttcaaatatgcattt

SEQ ID NO: 7823095 - DNA, 22 bp, Homo sapiens
acatctgttcaaatatgcattt

SEQ ID NO: 7823096 - DNA, 22 bp, Homo sapiens
acatctgtcctctgcagagctc

SEQ ID NO: 7823097 - DNA, 22 bp, Homo sapiens
acatctgtcctctgcagagctc

SEQ ID NO: 7823098 - DNA, 22 bp, Homo sapiens
acatctgtttaacgaaggcatt

SEQ ID NO: 7823099 - DNA, 22 bp, Homo sapiens
acatctgtttgagaaaaagaag

SEQ ID NO: 7823100 - DNA, 22 bp, Homo sapiens
acatctgtttgagaaaaagaag

SEQ ID NO: 7823101 - DNA, 22 bp, Homo sapiens
acatctgttcttctcttgtccc

SEQ ID NO: 7823102 - DNA, 22 bp, Homo sapiens
acatctgttcttctcttgtccc

SEQ ID NO: 7823103 - DNA, 22 bp, Homo sapiens
acatctgtttaacgaaggcatt

SEQ ID NO: 7823104 - DNA, 22 bp, Homo sapiens
acatctgtttaacgaaggcatt

SEQ ID NO: 7823105 - DNA, 22 bp, Homo sapiens
acagtgaatccaaattcctacc

SEQ ID NO: 7823106 - DNA, 22 bp, Homo sapiens
acagtgaataagacatgtgctt

SEQ ID NO: 7823107 - DNA, 23 bp, Homo sapiens
acagtgaaacacgcagtaagagt

SEQ ID NO: 7823108 - DNA, 22 bp, Homo sapiens
acagtgaataagacatgtgctt

SEQ ID NO: 7823109 - DNA, 22 bp, Homo sapiens
acagtgaataagacatgtgctt

SEQ ID NO: 7823110 - DNA, 23 bp, Homo sapiens
acagtgaaacacgcagtaagagt

SEQ ID NO: 7823111 - DNA, 23 bp, Homo sapiens
acagtgaaacacgcagtaagagt

SEQ ID NO: 7823112 - DNA, 22 bp, Homo sapiens
acagtgaaaataatatcttcaa

SEQ ID NO: 7823113 - DNA, 22 bp, Homo sapiens
acagtgaaaataatatcttcaa

SEQ ID NO: 7823114 - DNA, 22 bp, Homo sapiens
acagtgaaaagtagctaacaca

SEQ ID NO: 7823115 - DNA, 22 bp, Homo sapiens
acagtgaaaagtagctaacaca

SEQ ID NO: 7823116 - DNA, 22 bp, Homo sapiens
acagtctggaggctgcttcatt

SEQ ID NO: 7823117 - DNA, 22 bp, Homo sapiens
acagtctggaagcagggggcaa

SEQ ID NO: 7823118 - DNA, 22 bp, Homo sapiens
acagtctggaagcagggggcaa

SEQ ID NO: 7823119 - DNA, 22 bp, Homo sapiens
aggactgttttttcttctaggg

SEQ ID NO: 7823120 - DNA, 22 bp, Homo sapiens
acagtctggaggctgcttcatt

SEQ ID NO: 7823121 - DNA, 22 bp, Homo sapiens
acagtctggaggctgcttcatt

SEQ ID NO: 7823122 - DNA, 22 bp, Homo sapiens
acagtgaaaagaatattagaat

SEQ ID NO: 7823123 - DNA, 22 bp, Homo sapiens
acagtgaaaagaatattagaat

SEQ ID NO: 7823124 - DNA, 22 bp, Homo sapiens
acagtgaaaagaatattagaat

SEQ ID NO: 7823125 - DNA, 22 bp, Homo sapiens
acagtgagcccactccaggaga

SEQ ID NO: 7823126 - DNA, 22 bp, Homo sapiens
acagtgagatccaagggcaggc

SEQ ID NO: 7823127 - DNA, 22 bp, Homo sapiens
acagtgaggaagcagctgtgct

SEQ ID NO: 7823128 - DNA, 22 bp, Homo sapiens
acagtgaggaagcagctgtgct

SEQ ID NO: 7823129 - DNA, 22 bp, Homo sapiens
acagtgaggaagcagctgtgct

SEQ ID NO: 7823130 - DNA, 22 bp, Homo sapiens
aggaggcagtctgtcccttagc

SEQ ID NO: 7823131 - DNA, 22 bp, Homo sapiens
aggaggcaggaagtctatggga

SEQ ID NO: 7823132 - DNA, 22 bp, Homo sapiens
acagtgacgtttatttgagacg

SEQ ID NO: 7823133 - DNA, 22 bp, Homo sapiens
acagtgacgtttatttgagacg

SEQ ID NO: 7823134 - DNA, 21 bp, Homo sapiens
acagtgagaaataaatggaaa

SEQ ID NO: 7823135 - DNA, 17 bp, Homo sapiens
acagtgagaagtcatct

SEQ ID NO: 7823136 - DNA, 17 bp, Homo sapiens
acagtgagaagtcatct

SEQ ID NO: 7823137 - DNA, 22 bp, Homo sapiens
acagtgagatccaagggcaggc

SEQ ID NO: 7823138 - DNA, 17 bp, Homo sapiens
acagtgagaagtcatct

SEQ ID NO: 7823139 - DNA, 22 bp, Homo sapiens
acagtgagatccaagggcaggc

SEQ ID NO: 7823140 - DNA, 22 bp, Homo sapiens
acagtgaatgagaatggagaaa

SEQ ID NO: 7823141 - DNA, 22 bp, Homo sapiens
acagtgaatgagaatggagaaa

SEQ ID NO: 7823142 - DNA, 22 bp, Homo sapiens
acagtgaataagacatgtgctt

SEQ ID NO: 7823143 - DNA, 22 bp, Homo sapiens
acagtgaatgcccaagaaaagt

SEQ ID NO: 7823144 - DNA, 22 bp, Homo sapiens
acagtgaatgcccaagaaaagt

SEQ ID NO: 7823145 - DNA, 22 bp, Homo sapiens
acagtgctgtgcagtctgccct

SEQ ID NO: 7823146 - DNA, 22 bp, Homo sapiens
acagtgcttagcacagagtaga

SEQ ID NO: 7823147 - DNA, 19 bp, Homo sapiens
acagtgcttctgagtgagg

SEQ ID NO: 7823148 - DNA, 22 bp, Homo sapiens
acagtgcttctgatatgatgcc

SEQ ID NO: 7823149 - DNA, 22 bp, Homo sapiens
acagtggaaagaaacgaattag

SEQ ID NO: 7823150 - DNA, 22 bp, Homo sapiens
acagtggaaagaacatggattt

SEQ ID NO: 7823151 - DNA, 22 bp, Homo sapiens
acagtggaaagaaacgaattag

SEQ ID NO: 7823152 - DNA, 22 bp, Homo sapiens
acagtggaaagaacatggattt

SEQ ID NO: 7823153 - DNA, 22 bp, Homo sapiens
acagtggaaagaacatggattt

SEQ ID NO: 7823154 - DNA, 22 bp, Homo sapiens
acagtgcagggtgggaagaagg

SEQ ID NO: 7823155 - DNA, 22 bp, Homo sapiens
acagtgcagggtgggaagaagg

SEQ ID NO: 7823156 - DNA, 22 bp, Homo sapiens
acagtgcagggtgggaagaagg

SEQ ID NO: 7823157 - DNA, 22 bp, Homo sapiens
acagtgcagggtgggaagaagg

SEQ ID NO: 7823158 - DNA, 22 bp, Homo sapiens
acagtgcagggcgggaagaagg

SEQ ID NO: 7823159 - DNA, 22 bp, Homo sapiens
acagtgcagggtgggaagaagg

SEQ ID NO: 7823160 - DNA, 22 bp, Homo sapiens
acagtgcagggcgggaagaagg

SEQ ID NO: 7823161 - DNA, 22 bp, Homo sapiens
acagtgcagggcgggaagaagg

SEQ ID NO: 7823162 - DNA, 22 bp, Homo sapiens
acagtgcagggcgggaagaagg

SEQ ID NO: 7823163 - DNA, 22 bp, Homo sapiens
acagtgcagggcgggaagaagg

SEQ ID NO: 7823164 - DNA, 17 bp, Homo sapiens
aggaggccctggcgttt

SEQ ID NO: 7823165 - DNA, 22 bp, Homo sapiens
aggaggccgatttcagaggtcg

SEQ ID NO: 7823166 - DNA, 22 bp, Homo sapiens
aggaggccgatttcagaggtcg

SEQ ID NO: 7823167 - DNA, 22 bp, Homo sapiens
aggaggccgatttcagaggtcg

SEQ ID NO: 7823168 - DNA, 17 bp, Homo sapiens
aggaggccctggcgttt

SEQ ID NO: 7823169 - DNA, 17 bp, Homo sapiens
aggaggccctggcgttt

SEQ ID NO: 7823170 - DNA, 22 bp, Homo sapiens
aggaggccctggttaatgttta

SEQ ID NO: 7823171 - DNA, 22 bp, Homo sapiens
aggaggccctagagctctagag

SEQ ID NO: 7823172 - DNA, 22 bp, Homo sapiens
aggaggccctagagctctagag

SEQ ID NO: 7823173 - DNA, 22 bp, Homo sapiens
aggaggccctagagctctagag

SEQ ID NO: 7823174 - DNA, 22 bp, Homo sapiens
aggaggcccctcctgggttgct

SEQ ID NO: 7823175 - DNA, 22 bp, Homo sapiens
aggaggcccctcctgggttgct

SEQ ID NO: 7823176 - DNA, 22 bp, Homo sapiens
aggaggccctagagctctagag

SEQ ID NO: 7823177 - DNA, 19 bp, Homo sapiens
aggaggccatgccactaga

SEQ ID NO: 7823178 - DNA, 19 bp, Homo sapiens
aggaggccatgccactaga

SEQ ID NO: 7823179 - DNA, 21 bp, Homo sapiens
aggaggccagtactgctgaac

SEQ ID NO: 7823180 - DNA, 22 bp, Homo sapiens
aggaggccatcagttccttcct

SEQ ID NO: 7823181 - DNA, 22 bp, Homo sapiens
aggaggccattctctcagtagc

SEQ ID NO: 7823182 - DNA, 22 bp, Homo sapiens
aggaggccatgtactaggttcc

SEQ ID NO: 7823183 - DNA, 21 bp, Homo sapiens
aggaggccagtactgctgaac

SEQ ID NO: 7823184 - DNA, 21 bp, Homo sapiens
aggaggccagtactgctgaac

SEQ ID NO: 7823185 - DNA, 22 bp, Homo sapiens
aggaggccaggccctcaagcct

SEQ ID NO: 7823186 - DNA, 22 bp, Homo sapiens
aggaggccaggccctcaagcct

SEQ ID NO: 7823187 - DNA, 22 bp, Homo sapiens
aggaggccaggccctcaagcct

SEQ ID NO: 7823188 - DNA, 22 bp, Homo sapiens
aggaggccaggccctcaagcct

SEQ ID NO: 7823189 - DNA, 20 bp, Homo sapiens
aggaggccaaagtaatgggg

SEQ ID NO: 7823190 - DNA, 20 bp, Homo sapiens
aggaggcatagtctggaaag

SEQ ID NO: 7823191 - DNA, 20 bp, Homo sapiens
aggaggcatagtctggaaag

SEQ ID NO: 7823192 - DNA, 20 bp, Homo sapiens
aggaggcatagtctggaaag

SEQ ID NO: 7823193 - DNA, 22 bp, Homo sapiens
aggaggcagtctgtcccttagc

SEQ ID NO: 7823194 - DNA, 22 bp, Homo sapiens
aggaggcagtctgtcccttagc

SEQ ID NO: 7823195 - DNA, 22 bp, Homo sapiens
aggaggcagtctgtcccttagc

SEQ ID NO: 7823196 - DNA, 22 bp, Homo sapiens
aggcaccttgagagcaggagct

SEQ ID NO: 7823197 - DNA, 22 bp, Homo sapiens
aggcaccttgagagcaggagct

SEQ ID NO: 7823198 - DNA, 22 bp, Homo sapiens
aggcaccttgagagcaggagct

SEQ ID NO: 7823199 - DNA, 22 bp, Homo sapiens
aggcaccttgagagcaggagct

SEQ ID NO: 7823200 - DNA, 19 bp, Homo sapiens
aggcaccttgatggcttcc

SEQ ID NO: 7823201 - DNA, 22 bp, Homo sapiens
aggcaccttgcggtccagtgaa

SEQ ID NO: 7823202 - DNA, 22 bp, Homo sapiens
aggcacctggatcttggaattc

SEQ ID NO: 7823203 - DNA, 22 bp, Homo sapiens
aggcacctgaggtggccagcct

SEQ ID NO: 7823204 - DNA, 22 bp, Homo sapiens
aggcacctgaggtggccagcct

SEQ ID NO: 7823205 - DNA, 20 bp, Homo sapiens
aggcacctgtcacaggtgag

SEQ ID NO: 7823206 - DNA, 22 bp, Homo sapiens
aggcacctggccagttgtcttg

SEQ ID NO: 7823207 - DNA, 20 bp, Homo sapiens
acagtgttaggtttttcctt

SEQ ID NO: 7823208 - DNA, 22 bp, Homo sapiens
aggcactgaaaggtggccagag

SEQ ID NO: 7823209 - DNA, 22 bp, Homo sapiens
aggcacgagcaatggccgagga

SEQ ID NO: 7823210 - DNA, 22 bp, Homo sapiens
aggcaccttgcggtccagtgaa

SEQ ID NO: 7823211 - DNA, 22 bp, Homo sapiens
aggcaccttgcggtccagtgaa

SEQ ID NO: 7823212 - DNA, 22 bp, Homo sapiens
aggcactaatggtagtggactg

SEQ ID NO: 7823213 - DNA, 22 bp, Homo sapiens
aggcactaatccctactatgag

SEQ ID NO: 7823214 - DNA, 22 bp, Homo sapiens
aggcactagagttcaaagatga

SEQ ID NO: 7823215 - DNA, 23 bp, Homo sapiens
aggcactcgacagaaatattgga

SEQ ID NO: 7823216 - DNA, 22 bp, Homo sapiens
acagtgttcacttaacaatgga

SEQ ID NO: 7823217 - DNA, 22 bp, Homo sapiens
acagtgttcacttaacaatgga

SEQ ID NO: 7823218 - DNA, 20 bp, Homo sapiens
acagtgttaggtttttcctt

SEQ ID NO: 7823219 - DNA, 20 bp, Homo sapiens
acagtgttagttatcatctc

SEQ ID NO: 7823220 - DNA, 22 bp, Homo sapiens
aggcagaaaatagtcatccaaa

SEQ ID NO: 7823221 - DNA, 22 bp, Homo sapiens
aggcagaaaatagtcatccaaa

SEQ ID NO: 7823222 - DNA, 22 bp, Homo sapiens
aggcagaaaatagtcatccaaa

SEQ ID NO: 7823223 - DNA, 22 bp, Homo sapiens
aggcagaaaatagtcatccaaa

SEQ ID NO: 7823224 - DNA, 22 bp, Homo sapiens
aggcactttttgcattttagaa

SEQ ID NO: 7823225 - DNA, 22 bp, Homo sapiens
aggcactggtccattttctgca

SEQ ID NO: 7823226 - DNA, 22 bp, Homo sapiens
aggcactggtccattttctgca

SEQ ID NO: 7823227 - DNA, 22 bp, Homo sapiens
aggcactggtccattttctgca

SEQ ID NO: 7823228 - DNA, 22 bp, Homo sapiens
aggcactggtccattttctgca

SEQ ID NO: 7823229 - DNA, 22 bp, Homo sapiens
acagtggcagtattagggcaga

SEQ ID NO: 7823230 - DNA, 22 bp, Homo sapiens
acagtggcagtattagggcaga

SEQ ID NO: 7823231 - DNA, 22 bp, Homo sapiens
acagtggatgtgatgtccaggt

SEQ ID NO: 7823232 - DNA, 22 bp, Homo sapiens
acagtggatgacatccttttgc

SEQ ID NO: 7823233 - DNA, 22 bp, Homo sapiens
acagtggagttggggtagccct

SEQ ID NO: 7823234 - DNA, 22 bp, Homo sapiens
acagtggatgacatccttttgc

SEQ ID NO: 7823235 - DNA, 22 bp, Homo sapiens
acagtggatgtgatgtccaggt

SEQ ID NO: 7823236 - DNA, 22 bp, Homo sapiens
acagtggagttggggtagccct

SEQ ID NO: 7823237 - DNA, 22 bp, Homo sapiens
acagtggagctcagatgaaaat

SEQ ID NO: 7823238 - DNA, 22 bp, Homo sapiens
acagtggagttggggtagccct

SEQ ID NO: 7823239 - DNA, 22 bp, Homo sapiens
acagtggaggccatatggtcct

SEQ ID NO: 7823240 - DNA, 22 bp, Homo sapiens
acagtggatatattaaatgaga

SEQ ID NO: 7823241 - DNA, 22 bp, Homo sapiens
acagtggaggccatatggtcct

SEQ ID NO: 7823242 - DNA, 22 bp, Homo sapiens
acagtggagctcagatgaaaat

SEQ ID NO: 7823243 - DNA, 22 bp, Homo sapiens
acagtggagaaggcatgaggct

SEQ ID NO: 7823244 - DNA, 22 bp, Homo sapiens
acagtggagctcagatgaaaat

SEQ ID NO: 7823245 - DNA, 22 bp, Homo sapiens
acagtggaatggtgggcctgca

SEQ ID NO: 7823246 - DNA, 22 bp, Homo sapiens
acagtggaatggtgggcctgca

SEQ ID NO: 7823247 - DNA, 22 bp, Homo sapiens
acagtggaatggtgggcctgca

SEQ ID NO: 7823248 - DNA, 22 bp, Homo sapiens
acagtggaatttgtagatgtgt

SEQ ID NO: 7823249 - DNA, 22 bp, Homo sapiens
acagtggaatttgtagatgtgt

SEQ ID NO: 7823250 - DNA, 22 bp, Homo sapiens
acagtggaatttgtagatgtgt

SEQ ID NO: 7823251 - DNA, 22 bp, Homo sapiens
acagtggagaagcaaatgcagt

SEQ ID NO: 7823252 - DNA, 22 bp, Homo sapiens
acagtggagaaggcatgaggct

SEQ ID NO: 7823253 - DNA, 22 bp, Homo sapiens
acagtggagaaggcatgaggct

SEQ ID NO: 7823254 - DNA, 22 bp, Homo sapiens
acagtggaagaagcactgaact

SEQ ID NO: 7823255 - DNA, 22 bp, Homo sapiens
acagtggaagcatgatgctatc

SEQ ID NO: 7823256 - DNA, 22 bp, Homo sapiens
acagtggaaagaaacgaattag

SEQ ID NO: 7823257 - DNA, 22 bp, Homo sapiens
acagtggaaatgtgggagggga

SEQ ID NO: 7823258 - DNA, 20 bp, Homo sapiens
acagtggaaattgatgtctg

SEQ ID NO: 7823259 - DNA, 22 bp, Homo sapiens
acagtggaaatgtgggagggga

SEQ ID NO: 7823260 - DNA, 22 bp, Homo sapiens
acagtggaaatgtgggagggga

SEQ ID NO: 7823261 - DNA, 22 bp, Homo sapiens
acagtggcttttgtgtctgcag

SEQ ID NO: 7823262 - DNA, 22 bp, Homo sapiens
acagtggctcatgcctgtcatc

SEQ ID NO: 7823263 - DNA, 22 bp, Homo sapiens
acagtggcttttgtgtctgcag

SEQ ID NO: 7823264 - DNA, 22 bp, Homo sapiens
acagtggcctcaaagaaagaga

SEQ ID NO: 7823265 - DNA, 22 bp, Homo sapiens
acagtggcctcaaagaaagaga

SEQ ID NO: 7823266 - DNA, 22 bp, Homo sapiens
acagtggctcatgcctgtcatc

SEQ ID NO: 7823267 - DNA, 22 bp, Homo sapiens
aggcacagcacacctggccccc

SEQ ID NO: 7823268 - DNA, 22 bp, Homo sapiens
aggcacagcacacctggccccc

SEQ ID NO: 7823269 - DNA, 22 bp, Homo sapiens
aggcacagcacacctggccccc

SEQ ID NO: 7823270 - DNA, 22 bp, Homo sapiens
aggcacagcacacctggccccc

SEQ ID NO: 7823271 - DNA, 22 bp, Homo sapiens
aggcacagcacacctggccccc

SEQ ID NO: 7823272 - DNA, 22 bp, Homo sapiens
aggcacctcagctgagcctggg

SEQ ID NO: 7823273 - DNA, 22 bp, Homo sapiens
aggcaccgctcctcagtccaga

SEQ ID NO: 7823274 - DNA, 19 bp, Homo sapiens
aggcaccgagggccactct

SEQ ID NO: 7823275 - DNA, 22 bp, Homo sapiens
aggcaccaggatcagttagaga

SEQ ID NO: 7823276 - DNA, 22 bp, Homo sapiens
aggcaccagtaagagtagaact

SEQ ID NO: 7823277 - DNA, 22 bp, Homo sapiens
aggcaccagtaagagtagaact

SEQ ID NO: 7823278 - DNA, 17 bp, Homo sapiens
aggcacctcttcctgct

SEQ ID NO: 7823279 - DNA, 22 bp, Homo sapiens
aggcacctcttaggctgctact

SEQ ID NO: 7823280 - DNA, 17 bp, Homo sapiens
aggcacctcttcctgct

SEQ ID NO: 7823281 - DNA, 22 bp, Homo sapiens
aggcacctcatagccagccccc

SEQ ID NO: 7823282 - DNA, 22 bp, Homo sapiens
aggcacctcttaggctgctact

SEQ ID NO: 7823283 - DNA, 22 bp, Homo sapiens
aggcacctcagctgagcctggg

SEQ ID NO: 7823284 - DNA, 22 bp, Homo sapiens
aggcacctcagctgagcctggg

SEQ ID NO: 7823285 - DNA, 22 bp, Homo sapiens
aggcacctcagctgagcctggg

SEQ ID NO: 7823286 - DNA, 22 bp, Homo sapiens
acagcagtttagaggacagcca

SEQ ID NO: 7823287 - DNA, 22 bp, Homo sapiens
acagcagtttagaggacagcca

SEQ ID NO: 7823288 - DNA, 22 bp, Homo sapiens
acagcagttactgaaataaagt

SEQ ID NO: 7823289 - DNA, 22 bp, Homo sapiens
acagcagttactgaaataaagt

SEQ ID NO: 7823290 - DNA, 22 bp, Homo sapiens
acagcagttaacgatcagactc

SEQ ID NO: 7823291 - DNA, 22 bp, Homo sapiens
acagcagttactgaaataaagt

SEQ ID NO: 7823292 - DNA, 22 bp, Homo sapiens
acagcagttaacgatcagactc

SEQ ID NO: 7823293 - DNA, 22 bp, Homo sapiens
acagcagtgtctggtactgagt

SEQ ID NO: 7823294 - DNA, 22 bp, Homo sapiens
acagcagtggtgcactgagcca

SEQ ID NO: 7823295 - DNA, 22 bp, Homo sapiens
acagcagttaacgatcagactc

SEQ ID NO: 7823296 - DNA, 22 bp, Homo sapiens
acagcagtgggttgccagtggg

SEQ ID NO: 7823297 - DNA, 22 bp, Homo sapiens
acagcagtgggttgccagtggg

SEQ ID NO: 7823298 - DNA, 22 bp, Homo sapiens
acagcagtgggttgccagtggg

SEQ ID NO: 7823299 - DNA, 22 bp, Homo sapiens
acagcagtgggttgccagtggg

SEQ ID NO: 7823300 - DNA, 22 bp, Homo sapiens
acagcagtggtgcactgagcca

SEQ ID NO: 7823301 - DNA, 22 bp, Homo sapiens
acagcagtggtgcactgagcca

SEQ ID NO: 7823302 - DNA, 22 bp, Homo sapiens
acagcatctagtacagtctagt

SEQ ID NO: 7823303 - DNA, 22 bp, Homo sapiens
acagcatgagagatgaacattc

SEQ ID NO: 7823304 - DNA, 22 bp, Homo sapiens
acagcatggataacaaggcact

SEQ ID NO: 7823305 - DNA, 22 bp, Homo sapiens
acagcatgagagtagcaaaagg

SEQ ID NO: 7823306 - DNA, 22 bp, Homo sapiens
acagcataatcacttctttctt

SEQ ID NO: 7823307 - DNA, 22 bp, Homo sapiens
acagcatcatatagtggaagaa

SEQ ID NO: 7823308 - DNA, 22 bp, Homo sapiens
acagcatcatatagtggaagaa

SEQ ID NO: 7823309 - DNA, 22 bp, Homo sapiens
acagcatccttctaaagtagct

SEQ ID NO: 7823310 - DNA, 22 bp, Homo sapiens
acagcatctagtacagtctagt

SEQ ID NO: 7823311 - DNA, 22 bp, Homo sapiens
acagcatccctgaagataacca

SEQ ID NO: 7823312 - DNA, 22 bp, Homo sapiens
acagcatttaaagaaaatgaac

SEQ ID NO: 7823313 - DNA, 22 bp, Homo sapiens
acagcatttaaagaaaatgaac

SEQ ID NO: 7823314 - DNA, 22 bp, Homo sapiens
acagcatttaaagaaaatgaac

SEQ ID NO: 7823315 - DNA, 22 bp, Homo sapiens
acagcattcaataaataataac

SEQ ID NO: 7823316 - DNA, 21 bp, Homo sapiens
acagcatgtttgtgtgtttgc

SEQ ID NO: 7823317 - DNA, 22 bp, Homo sapiens
acagccagaggagccaggctgg

SEQ ID NO: 7823318 - DNA, 22 bp, Homo sapiens
acagccagaggagccaggctgg

SEQ ID NO: 7823319 - DNA, 22 bp, Homo sapiens
acagccagaggagccaggctgg

SEQ ID NO: 7823320 - DNA, 22 bp, Homo sapiens
acagccagaggagccaggctgg

SEQ ID NO: 7823321 - DNA, 22 bp, Homo sapiens
acagccagaggagccaggctgg

SEQ ID NO: 7823322 - DNA, 20 bp, Homo sapiens
acagccagaggaggcagaca

SEQ ID NO: 7823323 - DNA, 22 bp, Homo sapiens
acagccagaagtcagggtggga

SEQ ID NO: 7823324 - DNA, 22 bp, Homo sapiens
acagccagaagtcagggtggga

SEQ ID NO: 7823325 - DNA, 22 bp, Homo sapiens
acagccactcaaagggccgaag

SEQ ID NO: 7823326 - DNA, 22 bp, Homo sapiens
acagccactcaaagggccgaag

SEQ ID NO: 7823327 - DNA, 22 bp, Homo sapiens
acagccactcaaagggccgaag

SEQ ID NO: 7823328 - DNA, 22 bp, Homo sapiens
acagccaagtcttctatttcag

SEQ ID NO: 7823329 - DNA, 22 bp, Homo sapiens
acagccaaggaattaggaaggg

SEQ ID NO: 7823330 - DNA, 22 bp, Homo sapiens
acagccaaggaattaggaaggg

SEQ ID NO: 7823331 - DNA, 22 bp, Homo sapiens
acagccaacgtctttcttactt

SEQ ID NO: 7823332 - DNA, 22 bp, Homo sapiens
acaggacaactcagcagccagc

SEQ ID NO: 7823333 - DNA, 22 bp, Homo sapiens
acaggacaactcagcagccagc

SEQ ID NO: 7823334 - DNA, 22 bp, Homo sapiens
acaggacaaaaatctggatggc

SEQ ID NO: 7823335 - DNA, 22 bp, Homo sapiens
acaggacaaaaatctggatggc

SEQ ID NO: 7823336 - DNA, 22 bp, Homo sapiens
acaggacaactcagcagccagc

SEQ ID NO: 7823337 - DNA, 22 bp, Homo sapiens
acaggacaactcagcagccagc

SEQ ID NO: 7823338 - DNA, 22 bp, Homo sapiens
acaggacaactcagcagccagc

SEQ ID NO: 7823339 - DNA, 22 bp, Homo sapiens
acaggacaaggggaagaagata

SEQ ID NO: 7823340 - DNA, 22 bp, Homo sapiens
acaggacaaggggaagaagata

SEQ ID NO: 7823341 - DNA, 22 bp, Homo sapiens
acaggacaaggggaagaagata

SEQ ID NO: 7823342 - DNA, 22 bp, Homo sapiens
acaggacaatttataatgggca

SEQ ID NO: 7823343 - DNA, 22 bp, Homo sapiens
acaggacaggctgggctagact

SEQ ID NO: 7823344 - DNA, 22 bp, Homo sapiens
acaggacaggctgggctagact

SEQ ID NO: 7823345 - DNA, 22 bp, Homo sapiens
acaggaagtttggaaagcctca

SEQ ID NO: 7823346 - DNA, 22 bp, Homo sapiens
acaggaagtttggaaagcctca

SEQ ID NO: 7823347 - DNA, 22 bp, Homo sapiens
acaggaagtttggaaagcctca

SEQ ID NO: 7823348 - DNA, 22 bp, Homo sapiens
acaggaagtttggaaagcctca

SEQ ID NO: 7823349 - DNA, 22 bp, Homo sapiens
acaggaagtgggaagaaacagg

SEQ ID NO: 7823350 - DNA, 22 bp, Homo sapiens
acaggaagtgggaagaaacagg

SEQ ID NO: 7823351 - DNA, 22 bp, Homo sapiens
acaggaagtgggaagaaacagg

SEQ ID NO: 7823352 - DNA, 22 bp, Homo sapiens
acaggacaaaaatctggatggc

SEQ ID NO: 7823353 - DNA, 22 bp, Homo sapiens
acaggacaaaaatctggatggc

SEQ ID NO: 7823354 - DNA, 22 bp, Homo sapiens
acaggaatttcctaatattcga

SEQ ID NO: 7823355 - DNA, 23 bp, Homo sapiens
acaggaatttgtgcaccatgaag

SEQ ID NO: 7823356 - DNA, 22 bp, Homo sapiens
acaggaagtttggaaagcctca

SEQ ID NO: 7823357 - DNA, 22 bp, Homo sapiens
acaggaagtttggaaagcctca

SEQ ID NO: 7823358 - DNA, 22 bp, Homo sapiens
acaggaatttcctaatattcga

SEQ ID NO: 7823359 - DNA, 22 bp, Homo sapiens
acaggaataaaaggaataagga

SEQ ID NO: 7823360 - DNA, 22 bp, Homo sapiens
acaggaagaaagtgcagtagat

SEQ ID NO: 7823361 - DNA, 22 bp, Homo sapiens
acaggaagaaagtgcagtagat

SEQ ID NO: 7823362 - DNA, 22 bp, Homo sapiens
acaggaagaaagtgcagtagat

SEQ ID NO: 7823363 - DNA, 22 bp, Homo sapiens
acaggaagaaagtgcagtagat

SEQ ID NO: 7823364 - DNA, 22 bp, Homo sapiens
acaggaacgaatgtacattgtt

SEQ ID NO: 7823365 - DNA, 22 bp, Homo sapiens
acagcttcttgtttcccaggag

SEQ ID NO: 7823366 - DNA, 22 bp, Homo sapiens
acaggaactgttatctcagatg

SEQ ID NO: 7823367 - DNA, 22 bp, Homo sapiens
acagcttctctgaaattcatgt

SEQ ID NO: 7823368 - DNA, 22 bp, Homo sapiens
acagcttctctgaaattcatgt

SEQ ID NO: 7823369 - DNA, 22 bp, Homo sapiens
acagcttctctgaaattcatgt

SEQ ID NO: 7823370 - DNA, 22 bp, Homo sapiens
acagcttctcctcgatgtcatg

SEQ ID NO: 7823371 - DNA, 22 bp, Homo sapiens
acagcttctatttctctgtact

SEQ ID NO: 7823372 - DNA, 22 bp, Homo sapiens
acaggaagtgggaagaaacagg

SEQ ID NO: 7823373 - DNA, 22 bp, Homo sapiens
acaggaagtgctggcacttaca

SEQ ID NO: 7823374 - DNA, 22 bp, Homo sapiens
acaggaagtgctggcacttaca

SEQ ID NO: 7823375 - DNA, 22 bp, Homo sapiens
acaggaagctggagacccttga

SEQ ID NO: 7823376 - DNA, 22 bp, Homo sapiens
acaggaagaaagtgcagtagat

SEQ ID NO: 7823377 - DNA, 22 bp, Homo sapiens
acaggaagaaagtgcagtagat

SEQ ID NO: 7823378 - DNA, 22 bp, Homo sapiens
acaggaagaaagtgcagtagat

SEQ ID NO: 7823379 - DNA, 22 bp, Homo sapiens
acaggacagggaattcgaaatt

SEQ ID NO: 7823380 - DNA, 22 bp, Homo sapiens
acaggacaggtaggattcgcag

SEQ ID NO: 7823381 - DNA, 22 bp, Homo sapiens
acaggacaggtaggattcgcag

SEQ ID NO: 7823382 - DNA, 22 bp, Homo sapiens
acaggacaggctgggctagact

SEQ ID NO: 7823383 - DNA, 22 bp, Homo sapiens
acaggacaggctgggctagact

SEQ ID NO: 7823384 - DNA, 22 bp, Homo sapiens
acaggacaggctgggctagact

SEQ ID NO: 7823385 - DNA, 22 bp, Homo sapiens
acaggacagtctagtaacagta

SEQ ID NO: 7823386 - DNA, 22 bp, Homo sapiens
acaggacagtctagtaacagta

SEQ ID NO: 7823387 - DNA, 22 bp, Homo sapiens
acaggacatggcttctgtgacg

SEQ ID NO: 7823388 - DNA, 22 bp, Homo sapiens
acaggacatggcttctgtgacg

SEQ ID NO: 7823389 - DNA, 22 bp, Homo sapiens
acaggacatggcttctgtgacg

SEQ ID NO: 7823390 - DNA, 22 bp, Homo sapiens
acaggacagtctagtaacagta

SEQ ID NO: 7823391 - DNA, 22 bp, Homo sapiens
acaggacagtctagtaacagta

SEQ ID NO: 7823392 - DNA, 22 bp, Homo sapiens
acaggacagtctagtaacagta

SEQ ID NO: 7823393 - DNA, 22 bp, Homo sapiens
acaggacagtctagtaacagta

SEQ ID NO: 7823394 - DNA, 22 bp, Homo sapiens
acaggacagtctagtaacagta

SEQ ID NO: 7823395 - DNA, 22 bp, Homo sapiens
acaggacatggcttctgtgacg

SEQ ID NO: 7823396 - DNA, 22 bp, Homo sapiens
acaggacatgtaccaggtggtc

SEQ ID NO: 7823397 - DNA, 22 bp, Homo sapiens
acaggacatgtaccaggtggtc

SEQ ID NO: 7823398 - DNA, 22 bp, Homo sapiens
acaggacatgtaccaggtggtc

SEQ ID NO: 7823399 - DNA, 22 bp, Homo sapiens
acaggactgtggaaggatctct

SEQ ID NO: 7823400 - DNA, 22 bp, Homo sapiens
acaggacatgtaccaggtggtc

SEQ ID NO: 7823401 - DNA, 22 bp, Homo sapiens
acaggacatgtaccaggtggtc

SEQ ID NO: 7823402 - DNA, 22 bp, Homo sapiens
agcttcttcttggtctttccca

SEQ ID NO: 7823403 - DNA, 22 bp, Homo sapiens
agcttcttgaccaagcctgtaa

SEQ ID NO: 7823404 - DNA, 22 bp, Homo sapiens
agcttcttcttggtctttccca

SEQ ID NO: 7823405 - DNA, 22 bp, Homo sapiens
agcttcttcttggtctttccca

SEQ ID NO: 7823406 - DNA, 20 bp, Homo sapiens
agcttcttctgtctaatttt

SEQ ID NO: 7823407 - DNA, 20 bp, Homo sapiens
agcttcttctgtctaatttt

SEQ ID NO: 7823408 - DNA, 22 bp, Homo sapiens
agcttcttgacggatgttctgg

SEQ ID NO: 7823409 - DNA, 22 bp, Homo sapiens
agcttcttgacggatgttctgg

SEQ ID NO: 7823410 - DNA, 22 bp, Homo sapiens
agcttcttgacggatgttctgg

SEQ ID NO: 7823411 - DNA, 22 bp, Homo sapiens
agcttcttgaccaagcctgtaa

SEQ ID NO: 7823412 - DNA, 22 bp, Homo sapiens
agcttcttgaccaagcctgtaa

SEQ ID NO: 7823413 - DNA, 22 bp, Homo sapiens
agcttcttgggctttacacaaa

SEQ ID NO: 7823414 - DNA, 22 bp, Homo sapiens
agcttcttgggctttacacaaa

SEQ ID NO: 7823415 - DNA, 22 bp, Homo sapiens
agcttcttggctcagcacttgg

SEQ ID NO: 7823416 - DNA, 22 bp, Homo sapiens
agcttcttggctcagcacttgg

SEQ ID NO: 7823417 - DNA, 22 bp, Homo sapiens
agcttccatactaagacaaaag

SEQ ID NO: 7823418 - DNA, 22 bp, Homo sapiens
agcttcttcaaagcaggaggcc

SEQ ID NO: 7823419 - DNA, 22 bp, Homo sapiens
agcttcttccaggcagtgactc

SEQ ID NO: 7823420 - DNA, 22 bp, Homo sapiens
agcttcttcaaagcaggaggcc

SEQ ID NO: 7823421 - DNA, 22 bp, Homo sapiens
agcttcttctgatttgtcagtc

SEQ ID NO: 7823422 - DNA, 22 bp, Homo sapiens
agcttcttccaggcagtgactc

SEQ ID NO: 7823423 - DNA, 22 bp, Homo sapiens
agcttcttctgatttgtcagtc

SEQ ID NO: 7823424 - DNA, 22 bp, Homo sapiens
agcttcttctgatttgtcagtc

SEQ ID NO: 7823425 - DNA, 22 bp, Homo sapiens
agcttcttctattttggggcca

SEQ ID NO: 7823426 - DNA, 22 bp, Homo sapiens
agcttcttctattttggggcca

SEQ ID NO: 7823427 - DNA, 22 bp, Homo sapiens
agcttcttcccagcctcacccg

SEQ ID NO: 7823428 - DNA, 22 bp, Homo sapiens
agcttcttccaggcagtgactc

SEQ ID NO: 7823429 - DNA, 22 bp, Homo sapiens
agcttccatactaagacaaaag

SEQ ID NO: 7823430 - DNA, 22 bp, Homo sapiens
agcttccacatctgtcttcagt

SEQ ID NO: 7823431 - DNA, 22 bp, Homo sapiens
agcttccacatctgtcttcagt

SEQ ID NO: 7823432 - DNA, 22 bp, Homo sapiens
acaggagaaatctggtcaaaag

SEQ ID NO: 7823433 - DNA, 22 bp, Homo sapiens
acaggagaaatctggtcaaaag

SEQ ID NO: 7823434 - DNA, 22 bp, Homo sapiens
agcttccaatttctccaagaga

SEQ ID NO: 7823435 - DNA, 22 bp, Homo sapiens
agcttccaatttctccaagaga

SEQ ID NO: 7823436 - DNA, 22 bp, Homo sapiens
agcttccaatttctccaagaga

SEQ ID NO: 7823437 - DNA, 22 bp, Homo sapiens
acaggactctctgaaaatgtac

SEQ ID NO: 7823438 - DNA, 20 bp, Homo sapiens
acaggatgcctgccatttca

SEQ ID NO: 7823439 - DNA, 21 bp, Homo sapiens
acaggatgatttttccttatg

SEQ ID NO: 7823440 - DNA, 22 bp, Homo sapiens
acaggatgataaaggatggcca

SEQ ID NO: 7823441 - DNA, 22 bp, Homo sapiens
acaggatggccagctgatattg

SEQ ID NO: 7823442 - DNA, 22 bp, Homo sapiens
acaggatggagataatagaaaa

SEQ ID NO: 7823443 - DNA, 22 bp, Homo sapiens
acaggatggagataatagaaaa

SEQ ID NO: 7823444 - DNA, 22 bp, Homo sapiens
acaggatggagataatagaaaa

SEQ ID NO: 7823445 - DNA, 22 bp, Homo sapiens
acaggatgggcgcacagagcta

SEQ ID NO: 7823446 - DNA, 22 bp, Homo sapiens
acaggatgggcgcacagagcta

SEQ ID NO: 7823447 - DNA, 22 bp, Homo sapiens
acaggatggagataatagaaaa

SEQ ID NO: 7823448 - DNA, 22 bp, Homo sapiens
acaggatgggcgcacagagcta

SEQ ID NO: 7823449 - DNA, 22 bp, Homo sapiens
acaggatggccagctgatattg

SEQ ID NO: 7823450 - DNA, 22 bp, Homo sapiens
acaggatggccagctgatattg

SEQ ID NO: 7823451 - DNA, 22 bp, Homo sapiens
acaggatgggcgcacagagcta

SEQ ID NO: 7823452 - DNA, 22 bp, Homo sapiens
acaggatgagaatatcatattt

SEQ ID NO: 7823453 - DNA, 22 bp, Homo sapiens
agcttcttttacagctcatgct

SEQ ID NO: 7823454 - DNA, 22 bp, Homo sapiens
acaggatcgccctgttgcccag

SEQ ID NO: 7823455 - DNA, 22 bp, Homo sapiens
acaggatcgccctgttgcccag

SEQ ID NO: 7823456 - DNA, 22 bp, Homo sapiens
acaggatgataaaggatggcca

SEQ ID NO: 7823457 - DNA, 22 bp, Homo sapiens
acaggatgagaatatcatattt

SEQ ID NO: 7823458 - DNA, 22 bp, Homo sapiens
acaggatgataaaggatggcca

SEQ ID NO: 7823459 - DNA, 22 bp, Homo sapiens
agcttctttgtgggctccagaa

SEQ ID NO: 7823460 - DNA, 22 bp, Homo sapiens
agcttctttgtgggctccagaa

SEQ ID NO: 7823461 - DNA, 22 bp, Homo sapiens
acaggatcgccctgttgcccag

SEQ ID NO: 7823462 - DNA, 22 bp, Homo sapiens
agcttcttttacagctcatgct

SEQ ID NO: 7823463 - DNA, 22 bp, Homo sapiens
agcttcttttacagctcatgct

SEQ ID NO: 7823464 - DNA, 22 bp, Homo sapiens
agcttcttgtagaactcaaaag

SEQ ID NO: 7823465 - DNA, 22 bp, Homo sapiens
agcttcttgtagaactcaaaag

SEQ ID NO: 7823466 - DNA, 22 bp, Homo sapiens
agcttctttaattcagcatgat

SEQ ID NO: 7823467 - DNA, 22 bp, Homo sapiens
agcttcttgtatgaagttagag

SEQ ID NO: 7823468 - DNA, 22 bp, Homo sapiens
agcttcttgtatgaagttagag

SEQ ID NO: 7823469 - DNA, 22 bp, Homo sapiens
agcttctttaattcagcatgat

SEQ ID NO: 7823470 - DNA, 22 bp, Homo sapiens
agcttctttaattcagcatgat

SEQ ID NO: 7823471 - DNA, 19 bp, Homo sapiens
agcttctttggaaacattt

SEQ ID NO: 7823472 - DNA, 19 bp, Homo sapiens
agcttctttggaaacattt

SEQ ID NO: 7823473 - DNA, 22 bp, Homo sapiens
acaggcaagtcacacaacttgt

SEQ ID NO: 7823474 - DNA, 22 bp, Homo sapiens
acaggcaagtcacacaacttgt

SEQ ID NO: 7823475 - DNA, 23 bp, Homo sapiens
acaggcaataaagggagtctcca

SEQ ID NO: 7823476 - DNA, 22 bp, Homo sapiens
acaggcaattagcaagctgtta

SEQ ID NO: 7823477 - DNA, 22 bp, Homo sapiens
acaggcacaactgagtagactc

SEQ ID NO: 7823478 - DNA, 22 bp, Homo sapiens
acaggcacaactgagtagactc

SEQ ID NO: 7823479 - DNA, 18 bp, Homo sapiens
aggaaagaaaggcaggtg

SEQ ID NO: 7823480 - DNA, 18 bp, Homo sapiens
aggaaagaaaggcaggtg

SEQ ID NO: 7823481 - DNA, 22 bp, Homo sapiens
acaggcacaccttcctgcaggc

SEQ ID NO: 7823482 - DNA, 22 bp, Homo sapiens
acaggcacaccttcctgcaggc

SEQ ID NO: 7823483 - DNA, 22 bp, Homo sapiens
aggaaagaagtacattctcatg

SEQ ID NO: 7823484 - DNA, 22 bp, Homo sapiens
aggaaagaagtacattctcatg

SEQ ID NO: 7823485 - DNA, 22 bp, Homo sapiens
aggaaagaagtacattctcatg

SEQ ID NO: 7823486 - DNA, 22 bp, Homo sapiens
acaggcaacttcaaatctcact

SEQ ID NO: 7823487 - DNA, 22 bp, Homo sapiens
acaggcaacttcaaatctcact

SEQ ID NO: 7823488 - DNA, 21 bp, Homo sapiens
acaggcaaattttagacaatg

SEQ ID NO: 7823489 - DNA, 22 bp, Homo sapiens
acaggcaaagggtcagtagcag

SEQ ID NO: 7823490 - DNA, 21 bp, Homo sapiens
acaggcaaattttagacaatg

SEQ ID NO: 7823491 - DNA, 21 bp, Homo sapiens
acaggcaaattttagacaatg

SEQ ID NO: 7823492 - DNA, 22 bp, Homo sapiens
acaggcaaacacagaaagtagg

SEQ ID NO: 7823493 - DNA, 22 bp, Homo sapiens
acaggcaaacacagaaagtagg

SEQ ID NO: 7823494 - DNA, 22 bp, Homo sapiens
acaggcaaacacagaaagtagg

SEQ ID NO: 7823495 - DNA, 22 bp, Homo sapiens
acaggattagcaagtaatcagg

SEQ ID NO: 7823496 - DNA, 22 bp, Homo sapiens
acaggcaagtacacaggctcat

SEQ ID NO: 7823497 - DNA, 22 bp, Homo sapiens
acaggcaagaggaaagcaagta

SEQ ID NO: 7823498 - DNA, 22 bp, Homo sapiens
acaggcaagaggaaagcaagta

SEQ ID NO: 7823499 - DNA, 22 bp, Homo sapiens
acaggcaaggccagtgagaaat

SEQ ID NO: 7823500 - DNA, 22 bp, Homo sapiens
acaggcaaggccagtgagaaat

SEQ ID NO: 7823501 - DNA, 22 bp, Homo sapiens
acaggcaaggccagtgagaaat

SEQ ID NO: 7823502 - DNA, 22 bp, Homo sapiens
acaggcaagaggaaagcaagta

SEQ ID NO: 7823503 - DNA, 22 bp, Homo sapiens
aggacaggtgtagtgggctctg

SEQ ID NO: 7823504 - DNA, 22 bp, Homo sapiens
aggacaggtgtagtgggctctg

SEQ ID NO: 7823505 - DNA, 22 bp, Homo sapiens
aggacaggtgtagtgggctctg

SEQ ID NO: 7823506 - DNA, 22 bp, Homo sapiens
aggacaggtgtagtgggctctg

SEQ ID NO: 7823507 - DNA, 22 bp, Homo sapiens
aggacaggtgtagtgggctctg

SEQ ID NO: 7823508 - DNA, 22 bp, Homo sapiens
aggacaggtgtagtgggctctg

SEQ ID NO: 7823509 - DNA, 22 bp, Homo sapiens
aggacaggtgtagtgggctctg

SEQ ID NO: 7823510 - DNA, 22 bp, Homo sapiens
aggacagtggacactagtccct

SEQ ID NO: 7823511 - DNA, 23 bp, Homo sapiens
aggacagtggaatttagggattg

SEQ ID NO: 7823512 - DNA, 22 bp, Homo sapiens
aggacagtccggggtcctccac

SEQ ID NO: 7823513 - DNA, 22 bp, Homo sapiens
aggacagtccggggtcctccac

SEQ ID NO: 7823514 - DNA, 22 bp, Homo sapiens
aggacaggtgtagtgggctctg

SEQ ID NO: 7823515 - DNA, 22 bp, Homo sapiens
aggacagtataggctttaggag

SEQ ID NO: 7823516 - DNA, 22 bp, Homo sapiens
aggacaggtgtagtgggctctg

SEQ ID NO: 7823517 - DNA, 22 bp, Homo sapiens
aggacagtgtggaagagggtgc

SEQ ID NO: 7823518 - DNA, 22 bp, Homo sapiens
aggacagttaaaaatagatggc

SEQ ID NO: 7823519 - DNA, 22 bp, Homo sapiens
aggacagttagttaggaagttt

SEQ ID NO: 7823520 - DNA, 22 bp, Homo sapiens
aggacatgaagaaagggcaagg

SEQ ID NO: 7823521 - DNA, 22 bp, Homo sapiens
aggacatgaagaaagggcaagg

SEQ ID NO: 7823522 - DNA, 22 bp, Homo sapiens
aggacagtggcaaggcaggaca

SEQ ID NO: 7823523 - DNA, 22 bp, Homo sapiens
aggacagtggacactagtccct

SEQ ID NO: 7823524 - DNA, 22 bp, Homo sapiens
aggacagtggcaaggcaggaca

SEQ ID NO: 7823525 - DNA, 22 bp, Homo sapiens
aggactgttttttcttctaggg

SEQ ID NO: 7823526 - DNA, 22 bp, Homo sapiens
aggactgttttttcttctaggg

SEQ ID NO: 7823527 - DNA, 22 bp, Homo sapiens
aggactggtgtgtgatcagcat

SEQ ID NO: 7823528 - DNA, 22 bp, Homo sapiens
aggactggtgccagacaaggta

SEQ ID NO: 7823529 - DNA, 22 bp, Homo sapiens
aggactggtgccagacaaggta

SEQ ID NO: 7823530 - DNA, 22 bp, Homo sapiens
aggactggtgccagacaaggta

SEQ ID NO: 7823531 - DNA, 22 bp, Homo sapiens
aggactgggtgcagagggcatc

SEQ ID NO: 7823532 - DNA, 22 bp, Homo sapiens
aggactgggtgcagagggcatc

SEQ ID NO: 7823533 - DNA, 22 bp, Homo sapiens
aggactgggtgcagagggcatc

SEQ ID NO: 7823534 - DNA, 22 bp, Homo sapiens
aggactgggtgcagagggcatc

SEQ ID NO: 7823535 - DNA, 22 bp, Homo sapiens
aggactggcggtcggtggggat

SEQ ID NO: 7823536 - DNA, 22 bp, Homo sapiens
aggactgggtgcagagggcatc

SEQ ID NO: 7823537 - DNA, 22 bp, Homo sapiens
aggactgggtgcagagggcatc

SEQ ID NO: 7823538 - DNA, 22 bp, Homo sapiens
aggactggcagtgtgaggggtc

SEQ ID NO: 7823539 - DNA, 22 bp, Homo sapiens
aggactggcagtgtgaggggtc

SEQ ID NO: 7823540 - DNA, 22 bp, Homo sapiens
aggactggcagtgtgaggggtc

SEQ ID NO: 7823541 - DNA, 22 bp, Homo sapiens
aggactggcagtgtgaggggtc

SEQ ID NO: 7823542 - DNA, 22 bp, Homo sapiens
aggactgatgatggtgctgaca

SEQ ID NO: 7823543 - DNA, 22 bp, Homo sapiens
aggactgatgatggtgctgaca

SEQ ID NO: 7823544 - DNA, 22 bp, Homo sapiens
aggactggccctgaggggaggc

SEQ ID NO: 7823545 - DNA, 22 bp, Homo sapiens
aggactggccctgaggggaggc

SEQ ID NO: 7823546 - DNA, 22 bp, Homo sapiens
aggactggccctgaggggaggc

SEQ ID NO: 7823547 - DNA, 22 bp, Homo sapiens
aggactggcggtcggtggggat

SEQ ID NO: 7823548 - DNA, 22 bp, Homo sapiens
aggacaggattgagctgaactg

SEQ ID NO: 7823549 - DNA, 22 bp, Homo sapiens
aggacagggattcaaactccca

SEQ ID NO: 7823550 - DNA, 22 bp, Homo sapiens
aggacagggattcaaactccca

SEQ ID NO: 7823551 - DNA, 22 bp, Homo sapiens
aggacagggattcaaactccca

SEQ ID NO: 7823552 - DNA, 22 bp, Homo sapiens
aggacaggtgtagtgggctctg

SEQ ID NO: 7823553 - DNA, 22 bp, Homo sapiens
aggacaggtgtagtgggctctg

SEQ ID NO: 7823554 - DNA, 22 bp, Homo sapiens
aggacacaggtaagccagtgga

SEQ ID NO: 7823555 - DNA, 22 bp, Homo sapiens
acagggctatattcctcagagt

SEQ ID NO: 7823556 - DNA, 22 bp, Homo sapiens
aggacacaggtaagccagtgga

SEQ ID NO: 7823557 - DNA, 22 bp, Homo sapiens
acagggccttatatccagaagg

SEQ ID NO: 7823558 - DNA, 22 bp, Homo sapiens
acagggccttatatccagaagg

SEQ ID NO: 7823559 - DNA, 22 bp, Homo sapiens
acagggccttatatccagaagg

SEQ ID NO: 7823560 - DNA, 22 bp, Homo sapiens
acagggccttatatccagaagg

SEQ ID NO: 7823561 - DNA, 23 bp, Homo sapiens
acagggctagctgacagtggtat

SEQ ID NO: 7823562 - DNA, 22 bp, Homo sapiens
acagggcctttgatggattata

SEQ ID NO: 7823563 - DNA, 22 bp, Homo sapiens
acagggcctttgatggattata

SEQ ID NO: 7823564 - DNA, 22 bp, Homo sapiens
acagggctatattcctcagagc

SEQ ID NO: 7823565 - DNA, 22 bp, Homo sapiens
acagggctatattcctcagagc

SEQ ID NO: 7823566 - DNA, 22 bp, Homo sapiens
acagggctatattcctcagagc

SEQ ID NO: 7823567 - DNA, 22 bp, Homo sapiens
acagggctatattcctcagagc

SEQ ID NO: 7823568 - DNA, 23 bp, Homo sapiens
acagggctagctgacagtggtat

SEQ ID NO: 7823569 - DNA, 23 bp, Homo sapiens
acagggctagctgacagtggtat

SEQ ID NO: 7823570 - DNA, 23 bp, Homo sapiens
acagggctagctgacagtggtat

SEQ ID NO: 7823571 - DNA, 22 bp, Homo sapiens
acagggccaggtgagaggtgct

SEQ ID NO: 7823572 - DNA, 22 bp, Homo sapiens
acagggccaggtgagaggtgct

SEQ ID NO: 7823573 - DNA, 22 bp, Homo sapiens
acagggccagcctgggacctgg

SEQ ID NO: 7823574 - DNA, 22 bp, Homo sapiens
acagggccagcctgggacctgg

SEQ ID NO: 7823575 - DNA, 22 bp, Homo sapiens
acagggccaggtgagaggtgct

SEQ ID NO: 7823576 - DNA, 22 bp, Homo sapiens
acagggccctgtgggccccact

SEQ ID NO: 7823577 - DNA, 22 bp, Homo sapiens
acagggccctgtgggccccact

SEQ ID NO: 7823578 - DNA, 22 bp, Homo sapiens
acagggccctgtgggccccact

SEQ ID NO: 7823579 - DNA, 22 bp, Homo sapiens
acagggccattatctgttctag

SEQ ID NO: 7823580 - DNA, 22 bp, Homo sapiens
acagggccattggaggattata

SEQ ID NO: 7823581 - DNA, 22 bp, Homo sapiens
acagggccattggaggattata

SEQ ID NO: 7823582 - DNA, 22 bp, Homo sapiens
acagggcctcagccagggcaga

SEQ ID NO: 7823583 - DNA, 22 bp, Homo sapiens
acagggcctcagccagggcaga

SEQ ID NO: 7823584 - DNA, 22 bp, Homo sapiens
acagggcctcagccagggcaga

SEQ ID NO: 7823585 - DNA, 22 bp, Homo sapiens
acagggcctggctccaaaagat

SEQ ID NO: 7823586 - DNA, 22 bp, Homo sapiens
acagggcctggctccaaaagat

SEQ ID NO: 7823587 - DNA, 22 bp, Homo sapiens
acagggcctggctccaaaagat

SEQ ID NO: 7823588 - DNA, 22 bp, Homo sapiens
acagggcctcagctgattctgg

SEQ ID NO: 7823589 - DNA, 22 bp, Homo sapiens
acagggcctcagccagggcaga

SEQ ID NO: 7823590 - DNA, 22 bp, Homo sapiens
acagggcctcagccagggcaga

SEQ ID NO: 7823591 - DNA, 22 bp, Homo sapiens
acagggcccttgccagcacaag

SEQ ID NO: 7823592 - DNA, 22 bp, Homo sapiens
acagggcccttagatcctttta

SEQ ID NO: 7823593 - DNA, 22 bp, Homo sapiens
acagggccctgtgggccccact

SEQ ID NO: 7823594 - DNA, 22 bp, Homo sapiens
aggaaaggtgagagcggccgcg

SEQ ID NO: 7823595 - DNA, 22 bp, Homo sapiens
aggaaaggtgagagcggccgcg

SEQ ID NO: 7823596 - DNA, 19 bp, Homo sapiens
aggaaaggtggccttagca

SEQ ID NO: 7823597 - DNA, 19 bp, Homo sapiens
aggaaaggtggccttagca

SEQ ID NO: 7823598 - DNA, 19 bp, Homo sapiens
aggaaaggtggccttagca

SEQ ID NO: 7823599 - DNA, 19 bp, Homo sapiens
aggaaaggtggccttagca

SEQ ID NO: 7823600 - DNA, 19 bp, Homo sapiens
aggaaaggtggccttagca

SEQ ID NO: 7823601 - DNA, 19 bp, Homo sapiens
aggaaaggtggccttagca

SEQ ID NO: 7823602 - DNA, 19 bp, Homo sapiens
aggaaaggtggccttagca

SEQ ID NO: 7823603 - DNA, 22 bp, Homo sapiens
aggaaaggttcagtgattgaaa

SEQ ID NO: 7823604 - DNA, 22 bp, Homo sapiens
aggaaaggttcagtgattgaaa

SEQ ID NO: 7823605 - DNA, 22 bp, Homo sapiens
aggaaaggttcagtgattgaaa

SEQ ID NO: 7823606 - DNA, 22 bp, Homo sapiens
aggaaaggttcagtgattgaaa

SEQ ID NO: 7823607 - DNA, 22 bp, Homo sapiens
aggaaaggttcagtgattgaaa

SEQ ID NO: 7823608 - DNA, 17 bp, Homo sapiens
aggaaagtctgctgtcc

SEQ ID NO: 7823609 - DNA, 22 bp, Homo sapiens
aggaaaggtagcgtgccagcag

SEQ ID NO: 7823610 - DNA, 22 bp, Homo sapiens
aggaaaggtagcgtgccagcag

SEQ ID NO: 7823611 - DNA, 22 bp, Homo sapiens
aggaaaggtagcgtgccagcag

SEQ ID NO: 7823612 - DNA, 22 bp, Homo sapiens
aggaaaggtagcgtgccagcag

SEQ ID NO: 7823613 - DNA, 22 bp, Homo sapiens
aggaaaggtagcgtgccagcag

SEQ ID NO: 7823614 - DNA, 22 bp, Homo sapiens
aggaaaggtgagagcggccgcg

SEQ ID NO: 7823615 - DNA, 22 bp, Homo sapiens
aggaaaggtgagagcggccgcg

SEQ ID NO: 7823616 - DNA, 22 bp, Homo sapiens
aggaaaggggtaggtgtggacg

SEQ ID NO: 7823617 - DNA, 22 bp, Homo sapiens
aggaaaggtagcgtgccagcag

SEQ ID NO: 7823618 - DNA, 22 bp, Homo sapiens
aggaaaggtagcgtgccagcag

SEQ ID NO: 7823619 - DNA, 22 bp, Homo sapiens
aggaaaggtagcgtgccagcag

SEQ ID NO: 7823620 - DNA, 22 bp, Homo sapiens
aggaaaggtagcgtgccagcag

SEQ ID NO: 7823621 - DNA, 22 bp, Homo sapiens
aggaaaggtagcgtgccagcag

SEQ ID NO: 7823622 - DNA, 22 bp, Homo sapiens
aggaaaggggtaggtgtggacg

SEQ ID NO: 7823623 - DNA, 22 bp, Homo sapiens
aggaaaggggtaggtgtggacg

SEQ ID NO: 7823624 - DNA, 22 bp, Homo sapiens
aggaaagtggtgggaaatcagg

SEQ ID NO: 7823625 - DNA, 22 bp, Homo sapiens
aggaaagtggtgggaaatcagg

SEQ ID NO: 7823626 - DNA, 22 bp, Homo sapiens
aggaaagtgaatgttattttgc

SEQ ID NO: 7823627 - DNA, 22 bp, Homo sapiens
aggaaataagggacaagacaaa

SEQ ID NO: 7823628 - DNA, 22 bp, Homo sapiens
aggaaataagggacaagacaaa

SEQ ID NO: 7823629 - DNA, 22 bp, Homo sapiens
aggaaataagggacaagacaaa

SEQ ID NO: 7823630 - DNA, 22 bp, Homo sapiens
aggaaataagggcacttcagat

SEQ ID NO: 7823631 - DNA, 22 bp, Homo sapiens
aggaaataagggcacttcagat

SEQ ID NO: 7823632 - DNA, 22 bp, Homo sapiens
aggaaataagggcacttcagat

SEQ ID NO: 7823633 - DNA, 22 bp, Homo sapiens
aggaaataagggacaagacaaa

SEQ ID NO: 7823634 - DNA, 22 bp, Homo sapiens
aggaaataagggcacttcagat

SEQ ID NO: 7823635 - DNA, 22 bp, Homo sapiens
aggaaataagggacaagacaaa

SEQ ID NO: 7823636 - DNA, 22 bp, Homo sapiens
acaggcctggtgctgctgacag

SEQ ID NO: 7823637 - DNA, 22 bp, Homo sapiens
aggaaataggaccagacaaagc

SEQ ID NO: 7823638 - DNA, 22 bp, Homo sapiens
acaggcctggtgctgctgacag

SEQ ID NO: 7823639 - DNA, 22 bp, Homo sapiens
acaggcctgtgtgcacacgagg

SEQ ID NO: 7823640 - DNA, 22 bp, Homo sapiens
aggaaataagggcacttcagat

SEQ ID NO: 7823641 - DNA, 22 bp, Homo sapiens
acaggccttggtcctgacctaa

SEQ ID NO: 7823642 - DNA, 22 bp, Homo sapiens
acaggccttggcaggcatgtga

SEQ ID NO: 7823643 - DNA, 22 bp, Homo sapiens
acaggccttggcaggcatgtga

SEQ ID NO: 7823644 - DNA, 22 bp, Homo sapiens
acaggccttggtcctgacctaa

SEQ ID NO: 7823645 - DNA, 22 bp, Homo sapiens
acaggccttggtcctgacctaa

SEQ ID NO: 7823646 - DNA, 21 bp, Homo sapiens
acaggctacatgcaggagctg

SEQ ID NO: 7823647 - DNA, 22 bp, Homo sapiens
acaggccttggtcctgacctaa

SEQ ID NO: 7823648 - DNA, 20 bp, Homo sapiens
acaggcgctggggagatggc

SEQ ID NO: 7823649 - DNA, 20 bp, Homo sapiens
acaggcgctggggagatggc

SEQ ID NO: 7823650 - DNA, 22 bp, Homo sapiens
acaggcgctggcagagagaaaa

SEQ ID NO: 7823651 - DNA, 21 bp, Homo sapiens
acaggccttaggggccattca

SEQ ID NO: 7823652 - DNA, 22 bp, Homo sapiens
acaggcctggtgctgctgacag

SEQ ID NO: 7823653 - DNA, 21 bp, Homo sapiens
acaggccttaggggccattca

SEQ ID NO: 7823654 - DNA, 22 bp, Homo sapiens
acaggccttggcaggcatgtga

SEQ ID NO: 7823655 - DNA, 22 bp, Homo sapiens
acaggccttggcaggcatgtga

SEQ ID NO: 7823656 - DNA, 22 bp, Homo sapiens
acaggccttaggagagatgggg

SEQ ID NO: 7823657 - DNA, 22 bp, Homo sapiens
acaggcctgtgtgcacacgagg

SEQ ID NO: 7823658 - DNA, 22 bp, Homo sapiens
acaggccttaggagagatgggg

SEQ ID NO: 7823659 - DNA, 22 bp, Homo sapiens
acaggccttaggagagatgggg

SEQ ID NO: 7823660 - DNA, 22 bp, Homo sapiens
acaggccttaggagagatgggg

SEQ ID NO: 7823661 - DNA, 23 bp, Homo sapiens
acagggcattgctggcctcgagg

SEQ ID NO: 7823662 - DNA, 23 bp, Homo sapiens
acagggcattgctggcctcgagg

SEQ ID NO: 7823663 - DNA, 23 bp, Homo sapiens
acagggcattgctggcctcgagg

SEQ ID NO: 7823664 - DNA, 22 bp, Homo sapiens
acagggccacatgtaaacagat

SEQ ID NO: 7823665 - DNA, 22 bp, Homo sapiens
acagggccagcctgggacctgg

SEQ ID NO: 7823666 - DNA, 22 bp, Homo sapiens
acagggccacatgtaaacagat

SEQ ID NO: 7823667 - DNA, 22 bp, Homo sapiens
acagggccaatgttagcattga

SEQ ID NO: 7823668 - DNA, 22 bp, Homo sapiens
acagggccaagtaaaccctacc

SEQ ID NO: 7823669 - DNA, 21 bp, Homo sapiens
acagggcatgcagctggctgt

SEQ ID NO: 7823670 - DNA, 21 bp, Homo sapiens
acagggcatgcagctggctgt

SEQ ID NO: 7823671 - DNA, 21 bp, Homo sapiens
acagggcatgcagctggctgt

SEQ ID NO: 7823672 - DNA, 21 bp, Homo sapiens
acagggcatgcagctggctgt

SEQ ID NO: 7823673 - DNA, 22 bp, Homo sapiens
acagggcatgtgcaagagacat

SEQ ID NO: 7823674 - DNA, 22 bp, Homo sapiens
acagggcatgtgcaagagacat

SEQ ID NO: 7823675 - DNA, 22 bp, Homo sapiens
acagggcatgtgcaagagacat

SEQ ID NO: 7823676 - DNA, 22 bp, Homo sapiens
acagggcatgtgcaagagacat

SEQ ID NO: 7823677 - DNA, 22 bp, Homo sapiens
acagggcatgtgcaagagacat

SEQ ID NO: 7823678 - DNA, 21 bp, Homo sapiens
acagggcatgcagctggctgt

SEQ ID NO: 7823679 - DNA, 22 bp, Homo sapiens
acaggctctctattgagtgcag

SEQ ID NO: 7823680 - DNA, 22 bp, Homo sapiens
acaggctctctattgagtgcag

SEQ ID NO: 7823681 - DNA, 22 bp, Homo sapiens
acaggctctctattgagtgcag

SEQ ID NO: 7823682 - DNA, 21 bp, Homo sapiens
acaggctctggggatgctggg

SEQ ID NO: 7823683 - DNA, 22 bp, Homo sapiens
acaggctctcagccagttggca

SEQ ID NO: 7823684 - DNA, 22 bp, Homo sapiens
acaggctctctattgagtgcag

SEQ ID NO: 7823685 - DNA, 22 bp, Homo sapiens
acaggctcagttcactggattt

SEQ ID NO: 7823686 - DNA, 22 bp, Homo sapiens
acagggcacctgaggtaggaag

SEQ ID NO: 7823687 - DNA, 22 bp, Homo sapiens
acagggcaggtggctactggtc

SEQ ID NO: 7823688 - DNA, 22 bp, Homo sapiens
acagggcaggtggctactggtc

SEQ ID NO: 7823689 - DNA, 22 bp, Homo sapiens
acagggcagtgtcttgaaaaat

SEQ ID NO: 7823690 - DNA, 17 bp, Homo sapiens
agtgtgtgaaatggtgg

SEQ ID NO: 7823691 - DNA, 17 bp, Homo sapiens
agtgtgtgaaatggtgg

SEQ ID NO: 7823692 - DNA, 22 bp, Homo sapiens
agtgtgtcttatcctgggagaa

SEQ ID NO: 7823693 - DNA, 17 bp, Homo sapiens
agtgtgtgaaatggtgg

SEQ ID NO: 7823694 - DNA, 22 bp, Homo sapiens
agtgtgtctgatcacttgtgag

SEQ ID NO: 7823695 - DNA, 22 bp, Homo sapiens
agtgtgtcttatcctgggagaa

SEQ ID NO: 7823696 - DNA, 23 bp, Homo sapiens
actgggctgaaatttttcatggc

SEQ ID NO: 7823697 - DNA, 23 bp, Homo sapiens
actgggctgaaattaaaggtgtc

SEQ ID NO: 7823698 - DNA, 23 bp, Homo sapiens
actgggctgaaattaaaggtgtc

SEQ ID NO: 7823699 - DNA, 23 bp, Homo sapiens
actgggctgaaattaaaggtgtc

SEQ ID NO: 7823700 - DNA, 22 bp, Homo sapiens
agtgtgtgaccttttaatttaa

SEQ ID NO: 7823701 - DNA, 23 bp, Homo sapiens
actgggctgaaattaaaggtgtc

SEQ ID NO: 7823702 - DNA, 22 bp, Homo sapiens
agtgtgtgaccttttaatttaa

SEQ ID NO: 7823703 - DNA, 22 bp, Homo sapiens
agtgtgtcagttgaaagagatt

SEQ ID NO: 7823704 - DNA, 22 bp, Homo sapiens
agtgtgtcgagggagggtccag

SEQ ID NO: 7823705 - DNA, 22 bp, Homo sapiens
agtgtgtctgatcacttgtgag

SEQ ID NO: 7823706 - DNA, 20 bp, Homo sapiens
agtgtgtctcggaggtaagt

SEQ ID NO: 7823707 - DNA, 22 bp, Homo sapiens
agtgtgtccagaaatctgtatt

SEQ ID NO: 7823708 - DNA, 22 bp, Homo sapiens
agtgtgtcgagggagggtccag

SEQ ID NO: 7823709 - DNA, 22 bp, Homo sapiens
agtgtgtccaggaagcagatgg

SEQ ID NO: 7823710 - DNA, 20 bp, Homo sapiens
agtgtggttttcaggaatat

SEQ ID NO: 7823711 - DNA, 22 bp, Homo sapiens
agtgtggtcgggagcgcggggc

SEQ ID NO: 7823712 - DNA, 22 bp, Homo sapiens
agtgtgggttttatggagccct

SEQ ID NO: 7823713 - DNA, 22 bp, Homo sapiens
agtgtgtacataattgtacgcc

SEQ ID NO: 7823714 - DNA, 22 bp, Homo sapiens
agtgtgggttttatggagccct

SEQ ID NO: 7823715 - DNA, 22 bp, Homo sapiens
agtgtgggttttatggagccct

SEQ ID NO: 7823716 - DNA, 22 bp, Homo sapiens
agtgtgggttttatggagccct

SEQ ID NO: 7823717 - DNA, 22 bp, Homo sapiens
agtgtgggtgagggaggccctc

SEQ ID NO: 7823718 - DNA, 22 bp, Homo sapiens
agtgtctgttgagtttcaaaag

SEQ ID NO: 7823719 - DNA, 22 bp, Homo sapiens
agtgtctgttgcttttgcagtg

SEQ ID NO: 7823720 - DNA, 22 bp, Homo sapiens
agtgtctgttgcttttgcagtg

SEQ ID NO: 7823721 - DNA, 22 bp, Homo sapiens
agtgtctgttgttcagaactct

SEQ ID NO: 7823722 - DNA, 22 bp, Homo sapiens
agtgtctgttgttcagaactct

SEQ ID NO: 7823723 - DNA, 22 bp, Homo sapiens
agtgtcttacatgaattgattt

SEQ ID NO: 7823724 - DNA, 22 bp, Homo sapiens
agtgtcttactccctcaggcac

SEQ ID NO: 7823725 - DNA, 22 bp, Homo sapiens
agtgtcttacatgaattgattt

SEQ ID NO: 7823726 - DNA, 22 bp, Homo sapiens
agtgtcttagtccatttgggct

SEQ ID NO: 7823727 - DNA, 22 bp, Homo sapiens
agtgtcttcatgatgtggcagc

SEQ ID NO: 7823728 - DNA, 22 bp, Homo sapiens
agtgtctttagcaagtttagtc

SEQ ID NO: 7823729 - DNA, 22 bp, Homo sapiens
agtgtctgtgatgaggtcagga

SEQ ID NO: 7823730 - DNA, 22 bp, Homo sapiens
agtgtctgtgatgaggtcagga

SEQ ID NO: 7823731 - DNA, 22 bp, Homo sapiens
agtgtctgtgatgaggtcagga

SEQ ID NO: 7823732 - DNA, 22 bp, Homo sapiens
agtgtctgtgatgaggtcagga

SEQ ID NO: 7823733 - DNA, 22 bp, Homo sapiens
agtgtctgtgctttgcagcaaa

SEQ ID NO: 7823734 - DNA, 22 bp, Homo sapiens
agtgtctgtgctttgcagcaaa

SEQ ID NO: 7823735 - DNA, 22 bp, Homo sapiens
agtgtctgtgctttgcagcaaa

SEQ ID NO: 7823736 - DNA, 22 bp, Homo sapiens
agtgtctgtgctttgcagcaaa

SEQ ID NO: 7823737 - DNA, 22 bp, Homo sapiens
agtgtctgtgttttctattgct

SEQ ID NO: 7823738 - DNA, 22 bp, Homo sapiens
agtgtctgtgttttctattgct

SEQ ID NO: 7823739 - DNA, 22 bp, Homo sapiens
agtgtctgttacgcttgcagaa

SEQ ID NO: 7823740 - DNA, 22 bp, Homo sapiens
agtgtctgttacgcttgcagaa

SEQ ID NO: 7823741 - DNA, 22 bp, Homo sapiens
agtgtctgttacgcttgcagaa

SEQ ID NO: 7823742 - DNA, 22 bp, Homo sapiens
agtgtctgttacgcttgcagaa

SEQ ID NO: 7823743 - DNA, 22 bp, Homo sapiens
agtgtctgttacgcttgcagaa

SEQ ID NO: 7823744 - DNA, 22 bp, Homo sapiens
agtgtctgttgagtttcaaaag

SEQ ID NO: 7823745 - DNA, 22 bp, Homo sapiens
agtgtctgaaccaccggggcat

SEQ ID NO: 7823746 - DNA, 22 bp, Homo sapiens
agtgtctgaaccaccggggcat

SEQ ID NO: 7823747 - DNA, 22 bp, Homo sapiens
agtgtctgaacctgcagtggga

SEQ ID NO: 7823748 - DNA, 22 bp, Homo sapiens
agtgtctgaacctgcagtggga

SEQ ID NO: 7823749 - DNA, 22 bp, Homo sapiens
agtgtctgaacctgcagtggga

SEQ ID NO: 7823750 - DNA, 22 bp, Homo sapiens
agtgtctggtgagggctctctc

SEQ ID NO: 7823751 - DNA, 22 bp, Homo sapiens
agtgtctggtgagggctctctc

SEQ ID NO: 7823752 - DNA, 22 bp, Homo sapiens
agtgtctggtgagggctctctc

SEQ ID NO: 7823753 - DNA, 20 bp, Homo sapiens
agtgtctggtgcagggcctc

SEQ ID NO: 7823754 - DNA, 20 bp, Homo sapiens
agtgtctggtgcagggcctc

SEQ ID NO: 7823755 - DNA, 20 bp, Homo sapiens
agtgtctggtgcagggcctc

SEQ ID NO: 7823756 - DNA, 22 bp, Homo sapiens
agtgtctgtgatgaggtcagga

SEQ ID NO: 7823757 - DNA, 22 bp, Homo sapiens
agtgtctgtgaggggaattcct

SEQ ID NO: 7823758 - DNA, 22 bp, Homo sapiens
agtggggcggacaggaccagga

SEQ ID NO: 7823759 - DNA, 22 bp, Homo sapiens
agtggggccggtgaggccgagg

SEQ ID NO: 7823760 - DNA, 22 bp, Homo sapiens
agtggggccggtgaggccgagg

SEQ ID NO: 7823761 - DNA, 22 bp, Homo sapiens
agtggggccggtgaggccgagg

SEQ ID NO: 7823762 - DNA, 22 bp, Homo sapiens
agtggggccggtgaggccgagg

SEQ ID NO: 7823763 - DNA, 22 bp, Homo sapiens
agtgggggcagagcctctctcg

SEQ ID NO: 7823764 - DNA, 22 bp, Homo sapiens
agtgggggcagagcctctctcg

SEQ ID NO: 7823765 - DNA, 22 bp, Homo sapiens
agtgggggccaacgagggcagc

SEQ ID NO: 7823766 - DNA, 22 bp, Homo sapiens
agtggggcggacaggaccagga

SEQ ID NO: 7823767 - DNA, 22 bp, Homo sapiens
agtggggcggacaggaccagga

SEQ ID NO: 7823768 - DNA, 22 bp, Homo sapiens
agtggggcggacaggaccagga

SEQ ID NO: 7823769 - DNA, 22 bp, Homo sapiens
agtggggcggacaggaccagga

SEQ ID NO: 7823770 - DNA, 22 bp, Homo sapiens
agtggggcggacaggaccagga

SEQ ID NO: 7823771 - DNA, 22 bp, Homo sapiens
agtgggggccaacgagggcagc

SEQ ID NO: 7823772 - DNA, 22 bp, Homo sapiens
agtgggggccaacgagggcagc

SEQ ID NO: 7823773 - DNA, 22 bp, Homo sapiens
agtgggggccaacgagggcagc

SEQ ID NO: 7823774 - DNA, 22 bp, Homo sapiens
agtgggggccaacgagggcagc

SEQ ID NO: 7823775 - DNA, 22 bp, Homo sapiens
agtgggggccaacgagggcagc

SEQ ID NO: 7823776 - DNA, 22 bp, Homo sapiens
agtgggggccaacgagggcagc

SEQ ID NO: 7823777 - DNA, 22 bp, Homo sapiens
agtgggggccaacgagggcagc

SEQ ID NO: 7823778 - DNA, 22 bp, Homo sapiens
agtggggtcctcagtatggttc

SEQ ID NO: 7823779 - DNA, 22 bp, Homo sapiens
agtggggtcctcagtatggttc

SEQ ID NO: 7823780 - DNA, 21 bp, Homo sapiens
agtggggtctctgtggaggcc

SEQ ID NO: 7823781 - DNA, 22 bp, Homo sapiens
agtgggggctggctctgtctgt

SEQ ID NO: 7823782 - DNA, 22 bp, Homo sapiens
agtgggggctggctctgtctgt

SEQ ID NO: 7823783 - DNA, 21 bp, Homo sapiens
agttacatgtatagataaagt

SEQ ID NO: 7823784 - DNA, 22 bp, Homo sapiens
agttacatgtgaatagaaagta

SEQ ID NO: 7823785 - DNA, 22 bp, Homo sapiens
agttacatataagaagacagac

SEQ ID NO: 7823786 - DNA, 22 bp, Homo sapiens
agttacatgactgccggcggtg

SEQ ID NO: 7823787 - DNA, 22 bp, Homo sapiens
agttacatctgttatgtgtgtt

SEQ ID NO: 7823788 - DNA, 22 bp, Homo sapiens
agttacagcactcaaagttttc

SEQ ID NO: 7823789 - DNA, 22 bp, Homo sapiens
agttacaggaaagggccaggaa

SEQ ID NO: 7823790 - DNA, 22 bp, Homo sapiens
agttacaggaaagggccaggaa

SEQ ID NO: 7823791 - DNA, 22 bp, Homo sapiens
agttacagtgaccatttattta

SEQ ID NO: 7823792 - DNA, 22 bp, Homo sapiens
agttacagtgaccatttattta

SEQ ID NO: 7823793 - DNA, 22 bp, Homo sapiens
agttacagtgttctattactct

SEQ ID NO: 7823794 - DNA, 22 bp, Homo sapiens
agttacataatctgtgaatttt

SEQ ID NO: 7823795 - DNA, 22 bp, Homo sapiens
agttacaactgtttgaatgtca

SEQ ID NO: 7823796 - DNA, 22 bp, Homo sapiens
agttacaaccatgacacaagca

SEQ ID NO: 7823797 - DNA, 22 bp, Homo sapiens
agttacaagctattttacttaa

SEQ ID NO: 7823798 - DNA, 22 bp, Homo sapiens
agttacaagctattttacttaa

SEQ ID NO: 7823799 - DNA, 21 bp, Homo sapiens
agttacaagtttattcagagg

SEQ ID NO: 7823800 - DNA, 21 bp, Homo sapiens
agttacaagtttattcagagg

SEQ ID NO: 7823801 - DNA, 21 bp, Homo sapiens
agttacaagtttattcagagg

SEQ ID NO: 7823802 - DNA, 22 bp, Homo sapiens
agttcaaactctataagaactt

SEQ ID NO: 7823803 - DNA, 22 bp, Homo sapiens
agttcaaaaaggtaaagtttat

SEQ ID NO: 7823804 - DNA, 22 bp, Homo sapiens
agttcaaaaaggtaaagtttat

SEQ ID NO: 7823805 - DNA, 22 bp, Homo sapiens
agttcaaaaaggtaaagtttat

SEQ ID NO: 7823806 - DNA, 22 bp, Homo sapiens
agttcaaaaaggtaaagtttat

SEQ ID NO: 7823807 - DNA, 22 bp, Homo sapiens
agttcaaactctataagaactt

SEQ ID NO: 7823808 - DNA, 22 bp, Homo sapiens
agttcaaactctataagaactt

SEQ ID NO: 7823809 - DNA, 22 bp, Homo sapiens
agttcaaactctataagaactt

SEQ ID NO: 7823810 - DNA, 22 bp, Homo sapiens
agttcaaactctataagaactt

SEQ ID NO: 7823811 - DNA, 22 bp, Homo sapiens
agttcaaagctgcagtaatgga

SEQ ID NO: 7823812 - DNA, 22 bp, Homo sapiens
agttcaaagtcaaggaaactgt

SEQ ID NO: 7823813 - DNA, 22 bp, Homo sapiens
agttcaaagtcaaggaaactgt

SEQ ID NO: 7823814 - DNA, 22 bp, Homo sapiens
agttcaacaccagcctgaccaa

SEQ ID NO: 7823815 - DNA, 22 bp, Homo sapiens
agttcaaagtcaaggaaactgt

SEQ ID NO: 7823816 - DNA, 22 bp, Homo sapiens
agttcacaagcgtaggtgctga

SEQ ID NO: 7823817 - DNA, 20 bp, Homo sapiens
agttacgctattactctcct

SEQ ID NO: 7823818 - DNA, 22 bp, Homo sapiens
agttaccccacacactgagaaa

SEQ ID NO: 7823819 - DNA, 22 bp, Homo sapiens
agttaccatatatcaaacatgg

SEQ ID NO: 7823820 - DNA, 22 bp, Homo sapiens
agttacattctgagctgagtag

SEQ ID NO: 7823821 - DNA, 22 bp, Homo sapiens
agttaccagccgtaagaagcat

SEQ ID NO: 7823822 - DNA, 22 bp, Homo sapiens
agttatttggctatagatggta

SEQ ID NO: 7823823 - DNA, 22 bp, Homo sapiens
agttatttggctatagatggta

SEQ ID NO: 7823824 - DNA, 22 bp, Homo sapiens
agttattttacatggaagtttg

SEQ ID NO: 7823825 - DNA, 19 bp, Homo sapiens
agttatttctaaatttacc

SEQ ID NO: 7823826 - DNA, 22 bp, Homo sapiens
agttattttggaaaatgagtca

SEQ ID NO: 7823827 - DNA, 22 bp, Homo sapiens
agttattttggaaaatgagtca

SEQ ID NO: 7823828 - DNA, 22 bp, Homo sapiens
agttattttggaaaatgagtca

SEQ ID NO: 7823829 - DNA, 22 bp, Homo sapiens
agttattttggaaaatgagtca

SEQ ID NO: 7823830 - DNA, 22 bp, Homo sapiens
actggtggtttctccccagaga

SEQ ID NO: 7823831 - DNA, 22 bp, Homo sapiens
actggtggtttctccccagaga

SEQ ID NO: 7823832 - DNA, 22 bp, Homo sapiens
actggtgttgatttggaagggg

SEQ ID NO: 7823833 - DNA, 22 bp, Homo sapiens
actggttgaagaaaagctagta

SEQ ID NO: 7823834 - DNA, 22 bp, Homo sapiens
actggtcctctgccagcagctg

SEQ ID NO: 7823835 - DNA, 22 bp, Homo sapiens
actggtcctctgccagcagctg

SEQ ID NO: 7823836 - DNA, 22 bp, Homo sapiens
actggtggctttcagacagaaa

SEQ ID NO: 7823837 - DNA, 22 bp, Homo sapiens
actggtggctttcagacagaaa

SEQ ID NO: 7823838 - DNA, 22 bp, Homo sapiens
actggtggccctcagtgttctc

SEQ ID NO: 7823839 - DNA, 22 bp, Homo sapiens
actggtggctttcagacagaaa

SEQ ID NO: 7823840 - DNA, 22 bp, Homo sapiens
actggtggccctcagtgttctc

SEQ ID NO: 7823841 - DNA, 20 bp, Homo sapiens
actggtggactgttcattga

SEQ ID NO: 7823842 - DNA, 20 bp, Homo sapiens
actggtggactgttcattga

SEQ ID NO: 7823843 - DNA, 22 bp, Homo sapiens
agttaatataagttttactgtt

SEQ ID NO: 7823844 - DNA, 22 bp, Homo sapiens
agttaataatggaaagacacat

SEQ ID NO: 7823845 - DNA, 22 bp, Homo sapiens
agttaatgagcattttggaatg

SEQ ID NO: 7823846 - DNA, 23 bp, Homo sapiens
agttaatgtgcatgaagtgctgc

SEQ ID NO: 7823847 - DNA, 22 bp, Homo sapiens
agttaagggggttcatctgtaa

SEQ ID NO: 7823848 - DNA, 22 bp, Homo sapiens
agttaagggtattcttttaaat

SEQ ID NO: 7823849 - DNA, 22 bp, Homo sapiens
agttaaggttcaattaaagtta

SEQ ID NO: 7823850 - DNA, 17 bp, Homo sapiens
agttaaggctctttgct

SEQ ID NO: 7823851 - DNA, 22 bp, Homo sapiens
agttacaaacactatcagttct

SEQ ID NO: 7823852 - DNA, 22 bp, Homo sapiens
agttacaaccatgacacaagca

SEQ ID NO: 7823853 - DNA, 22 bp, Homo sapiens
agttacaaccatgacacaagca

SEQ ID NO: 7823854 - DNA, 22 bp, Homo sapiens
agttacaaacactatcagttct

SEQ ID NO: 7823855 - DNA, 22 bp, Homo sapiens
agttacaaacactatcagttct

SEQ ID NO: 7823856 - DNA, 22 bp, Homo sapiens
agttacaaacactatcagttct

SEQ ID NO: 7823857 - DNA, 22 bp, Homo sapiens
actggggtgaaattggagtgtc

SEQ ID NO: 7823858 - DNA, 22 bp, Homo sapiens
actggggtttaggcctgggcaa

SEQ ID NO: 7823859 - DNA, 23 bp, Homo sapiens
actgggtctatctccagagaaga

SEQ ID NO: 7823860 - DNA, 22 bp, Homo sapiens
actgggtgtaaaggacttaagc

SEQ ID NO: 7823861 - DNA, 22 bp, Homo sapiens
actgggtggctgcctccttctc

SEQ ID NO: 7823862 - DNA, 22 bp, Homo sapiens
actgggtgtattagtggtgttt

SEQ ID NO: 7823863 - DNA, 22 bp, Homo sapiens
actgggtgtaaaggacttaagc

SEQ ID NO: 7823864 - DNA, 22 bp, Homo sapiens
actgggtgtattagtggtgttt

SEQ ID NO: 7823865 - DNA, 22 bp, Homo sapiens
actggggcctcctccatgctct

SEQ ID NO: 7823866 - DNA, 22 bp, Homo sapiens
actggggcctcctccatgctct

SEQ ID NO: 7823867 - DNA, 22 bp, Homo sapiens
actggggcagtgggcagtggtt

SEQ ID NO: 7823868 - DNA, 22 bp, Homo sapiens
actggggcagtgggcagtggtt

SEQ ID NO: 7823869 - DNA, 22 bp, Homo sapiens
actgggctgcctggttcttcta

SEQ ID NO: 7823870 - DNA, 22 bp, Homo sapiens
actggggagtggttttgggaag

SEQ ID NO: 7823871 - DNA, 22 bp, Homo sapiens
actggggagttgaagcactttc

SEQ ID NO: 7823872 - DNA, 22 bp, Homo sapiens
actggggagttgaagcactttc

SEQ ID NO: 7823873 - DNA, 22 bp, Homo sapiens
actggggattagggactcagtg

SEQ ID NO: 7823874 - DNA, 22 bp, Homo sapiens
actggggcaggaaagtatgctg

SEQ ID NO: 7823875 - DNA, 22 bp, Homo sapiens
actggggcaggaaagtatgctg

SEQ ID NO: 7823876 - DNA, 22 bp, Homo sapiens
agtggcagacacaatgtgggca

SEQ ID NO: 7823877 - DNA, 22 bp, Homo sapiens
agtggcagacacaatgtgggca

SEQ ID NO: 7823878 - DNA, 22 bp, Homo sapiens
agtggcagacacaatgtgggca

SEQ ID NO: 7823879 - DNA, 22 bp, Homo sapiens
agtggcagacagagacagtacc

SEQ ID NO: 7823880 - DNA, 22 bp, Homo sapiens
agtggcagacagagacagtacc

SEQ ID NO: 7823881 - DNA, 22 bp, Homo sapiens
agtggcagacagagacagtacc

SEQ ID NO: 7823882 - DNA, 22 bp, Homo sapiens
agtggcagacagagacagtacc

SEQ ID NO: 7823883 - DNA, 22 bp, Homo sapiens
agtggcagacagagacagtacc

SEQ ID NO: 7823884 - DNA, 22 bp, Homo sapiens
agtggcagagaccccagccagc

SEQ ID NO: 7823885 - DNA, 22 bp, Homo sapiens
agtggcagagaccccagccagc

SEQ ID NO: 7823886 - DNA, 22 bp, Homo sapiens
agtggcagacagagacagtacc

SEQ ID NO: 7823887 - DNA, 22 bp, Homo sapiens
agtggcagagaccccagccagc

SEQ ID NO: 7823888 - DNA, 22 bp, Homo sapiens
agtggcagagaccccagccagc

SEQ ID NO: 7823889 - DNA, 22 bp, Homo sapiens
agtggcagagaccccagccagc

SEQ ID NO: 7823890 - DNA, 22 bp, Homo sapiens
agtggcagagcaggtgctggaa

SEQ ID NO: 7823891 - DNA, 22 bp, Homo sapiens
agtggcagagcaggtgctggaa

SEQ ID NO: 7823892 - DNA, 22 bp, Homo sapiens
agtggcagagcaggtgctggaa

SEQ ID NO: 7823893 - DNA, 22 bp, Homo sapiens
agtggcagagcaggtgctggaa

SEQ ID NO: 7823894 - DNA, 22 bp, Homo sapiens
agtggcagagcaggtgctggaa

SEQ ID NO: 7823895 - DNA, 22 bp, Homo sapiens
agtggcagagcaggtgctggaa

SEQ ID NO: 7823896 - DNA, 22 bp, Homo sapiens
agtggcagagcaggtgctggaa

SEQ ID NO: 7823897 - DNA, 22 bp, Homo sapiens
agtgctttgaacgaaaggctga

SEQ ID NO: 7823898 - DNA, 22 bp, Homo sapiens
agtgctttgaacgaaaggctga

SEQ ID NO: 7823899 - DNA, 22 bp, Homo sapiens
agtgctttcttgctccatcagt

SEQ ID NO: 7823900 - DNA, 22 bp, Homo sapiens
agtgctttgagcgtttgaaaag

SEQ ID NO: 7823901 - DNA, 22 bp, Homo sapiens
agtgctttgagcgtttgaaaag

SEQ ID NO: 7823902 - DNA, 22 bp, Homo sapiens
agtgctttggtatagaactatt

SEQ ID NO: 7823903 - DNA, 22 bp, Homo sapiens
agtgctttggtatagaactatt

SEQ ID NO: 7823904 - DNA, 22 bp, Homo sapiens
agtggcagaagtcactgggtag

SEQ ID NO: 7823905 - DNA, 22 bp, Homo sapiens
agtggcagacacaatgtgggca

SEQ ID NO: 7823906 - DNA, 22 bp, Homo sapiens
agtggcagacacaatgtgggca

SEQ ID NO: 7823907 - DNA, 22 bp, Homo sapiens
agtggcagacacaatgtgggca

SEQ ID NO: 7823908 - DNA, 22 bp, Homo sapiens
agtggcagacacaatgtgggca

SEQ ID NO: 7823909 - DNA, 22 bp, Homo sapiens
agtggcagacacaatgtgggca

SEQ ID NO: 7823910 - DNA, 22 bp, Homo sapiens
agtggcagaagtcactgggtag

SEQ ID NO: 7823911 - DNA, 22 bp, Homo sapiens
agtgctttccttcttgtgacat

SEQ ID NO: 7823912 - DNA, 22 bp, Homo sapiens
agtgctttcttgctccatcagt

SEQ ID NO: 7823913 - DNA, 22 bp, Homo sapiens
agtgctttccctgaaaccttcc

SEQ ID NO: 7823914 - DNA, 22 bp, Homo sapiens
agtgctttccctgaaaccttcc

SEQ ID NO: 7823915 - DNA, 22 bp, Homo sapiens
agtgctttcagtgtgctctttt

SEQ ID NO: 7823916 - DNA, 22 bp, Homo sapiens
agtgctttatgttgttgtgcaa

SEQ ID NO: 7823917 - DNA, 22 bp, Homo sapiens
agtgctttcagtgtgctctttt

SEQ ID NO: 7823918 - DNA, 22 bp, Homo sapiens
agtgctttagcatccaactgtc

SEQ ID NO: 7823919 - DNA, 22 bp, Homo sapiens
agtgctttagcatccaactgtc

SEQ ID NO: 7823920 - DNA, 22 bp, Homo sapiens
agtgctttagagaaatggtgct

SEQ ID NO: 7823921 - DNA, 22 bp, Homo sapiens
agtgcttctggtgggcgtgagg

SEQ ID NO: 7823922 - DNA, 22 bp, Homo sapiens
agtgcttctggtgggcgtgagg

SEQ ID NO: 7823923 - DNA, 20 bp, Homo sapiens
agtgcttattttcatggctg

SEQ ID NO: 7823924 - DNA, 22 bp, Homo sapiens
agtgcttggcaaccttctgacc

SEQ ID NO: 7823925 - DNA, 22 bp, Homo sapiens
agtgcttcttaaacctttctac

SEQ ID NO: 7823926 - DNA, 22 bp, Homo sapiens
agtgcttgtgaaatactagagg

SEQ ID NO: 7823927 - DNA, 22 bp, Homo sapiens
agtgctttacctagataatgtt

SEQ ID NO: 7823928 - DNA, 22 bp, Homo sapiens
agtgctttacctagataatgtt

SEQ ID NO: 7823929 - DNA, 22 bp, Homo sapiens
agtgcttggcaaccttctgacc

SEQ ID NO: 7823930 - DNA, 22 bp, Homo sapiens
agtgcttaaaaccctgcactag

SEQ ID NO: 7823931 - DNA, 22 bp, Homo sapiens
agtgcttaaaaccctgcactag

SEQ ID NO: 7823932 - DNA, 22 bp, Homo sapiens
agtgctgttggataatgctgtc

SEQ ID NO: 7823933 - DNA, 22 bp, Homo sapiens
agtgctgttaggttaatatagt

SEQ ID NO: 7823934 - DNA, 22 bp, Homo sapiens
agtgctgttaggttaatatagt

SEQ ID NO: 7823935 - DNA, 22 bp, Homo sapiens
agtgctgttaggttaatatagt

SEQ ID NO: 7823936 - DNA, 16 bp, Homo sapiens
agtgggaggagaaaga

SEQ ID NO: 7823937 - DNA, 22 bp, Homo sapiens
agtgggaggaagtggtgatatt

SEQ ID NO: 7823938 - DNA, 22 bp, Homo sapiens
agtgggaggcggctgacgggcg

SEQ ID NO: 7823939 - DNA, 22 bp, Homo sapiens
agtgggaggcggctgacgggcg

SEQ ID NO: 7823940 - DNA, 22 bp, Homo sapiens
agtgggaggcggctgacgggcg

SEQ ID NO: 7823941 - DNA, 22 bp, Homo sapiens
agtgggaggcggctgacgggcg

SEQ ID NO: 7823942 - DNA, 22 bp, Homo sapiens
agtgggaggcggctgacgggcg

SEQ ID NO: 7823943 - DNA, 22 bp, Homo sapiens
agtggggccgcggtcctgccct

SEQ ID NO: 7823944 - DNA, 22 bp, Homo sapiens
agtgggagggccatatggtgaa

SEQ ID NO: 7823945 - DNA, 22 bp, Homo sapiens
agtggggccgcggtcctgccct

SEQ ID NO: 7823946 - DNA, 22 bp, Homo sapiens
agtggggccgcggtcctgccct

SEQ ID NO: 7823947 - DNA, 22 bp, Homo sapiens
agtgggagcggcagtcggggac

SEQ ID NO: 7823948 - DNA, 22 bp, Homo sapiens
agtgggagcggcagtcggggac

SEQ ID NO: 7823949 - DNA, 22 bp, Homo sapiens
agtgggagcggcagtcggggac

SEQ ID NO: 7823950 - DNA, 22 bp, Homo sapiens
agtgggagccagcagcttgggg

SEQ ID NO: 7823951 - DNA, 22 bp, Homo sapiens
agtgggagccagcagcttgggg

SEQ ID NO: 7823952 - DNA, 22 bp, Homo sapiens
agtgggagcggcagtcggggac

SEQ ID NO: 7823953 - DNA, 22 bp, Homo sapiens
agtgggagcggcagtcggggac

SEQ ID NO: 7823954 - DNA, 22 bp, Homo sapiens
agtgggaggaagtggtgatatt

SEQ ID NO: 7823955 - DNA, 22 bp, Homo sapiens
agtgggaggaagtggtgatatt

SEQ ID NO: 7823956 - DNA, 22 bp, Homo sapiens
agtgggaggaagtggtgatatt

SEQ ID NO: 7823957 - DNA, 22 bp, Homo sapiens
agtgggagcggcagtcggggac

SEQ ID NO: 7823958 - DNA, 20 bp, Homo sapiens
agtgggagagggcagactgc

SEQ ID NO: 7823959 - DNA, 20 bp, Homo sapiens
agtgggagagggcagactgc

SEQ ID NO: 7823960 - DNA, 20 bp, Homo sapiens
agtgggagagggcagactgc

SEQ ID NO: 7823961 - DNA, 22 bp, Homo sapiens
agtgggagccagcagcttgggg

SEQ ID NO: 7823962 - DNA, 22 bp, Homo sapiens
agtgggagccagcagcttgggg

SEQ ID NO: 7823963 - DNA, 22 bp, Homo sapiens
agtggctggaattgcaggtgcg

SEQ ID NO: 7823964 - DNA, 22 bp, Homo sapiens
agtggctggaattgcaggtgcg

SEQ ID NO: 7823965 - DNA, 20 bp, Homo sapiens
agtgggagagggcagactgc

SEQ ID NO: 7823966 - DNA, 23 bp, Homo sapiens
agtggctggacagactttcctgg

SEQ ID NO: 7823967 - DNA, 23 bp, Homo sapiens
agtggctggacagactttcctgg

SEQ ID NO: 7823968 - DNA, 22 bp, Homo sapiens
agtggcagagccagggttggga

SEQ ID NO: 7823969 - DNA, 22 bp, Homo sapiens
agtggcagagccagggttggga

SEQ ID NO: 7823970 - DNA, 22 bp, Homo sapiens
agtggcagagccagggttggga

SEQ ID NO: 7823971 - DNA, 22 bp, Homo sapiens
agtggcagagccaagtagagcc

SEQ ID NO: 7823972 - DNA, 22 bp, Homo sapiens
agtggcagagccaagtagagcc

SEQ ID NO: 7823973 - DNA, 22 bp, Homo sapiens
agtggcagagccaagtagagcc

SEQ ID NO: 7823974 - DNA, 22 bp, Homo sapiens
agtggctggaattgcaggtgcg

SEQ ID NO: 7823975 - DNA, 22 bp, Homo sapiens
agtggctggaattgcaggtgcg

SEQ ID NO: 7823976 - DNA, 22 bp, Homo sapiens
agtggcagagccagggttggga

SEQ ID NO: 7823977 - DNA, 22 bp, Homo sapiens
agtggctggaattgcaggtgcg

SEQ ID NO: 7823978 - DNA, 22 bp, Homo sapiens
agtggcagagccaagtagagcc

SEQ ID NO: 7823979 - DNA, 22 bp, Homo sapiens
agtggcagagccaagtagagcc

SEQ ID NO: 7823980 - DNA, 22 bp, Homo sapiens
agtggcagagccaagtagagcc

SEQ ID NO: 7823981 - DNA, 22 bp, Homo sapiens
agtggcagagccaagtagagcc

SEQ ID NO: 7823982 - DNA, 22 bp, Homo sapiens
agtggcagagccaagatatgat

SEQ ID NO: 7823983 - DNA, 22 bp, Homo sapiens
agtggcagagccaagatatgat

SEQ ID NO: 7823984 - DNA, 22 bp, Homo sapiens
agtggcagagccaagatatgat

SEQ ID NO: 7823985 - DNA, 22 bp, Homo sapiens
agtggcagagccaagtagagcc

SEQ ID NO: 7823986 - DNA, 22 bp, Homo sapiens
agtggcagagcaggtgctggaa

SEQ ID NO: 7823987 - DNA, 22 bp, Homo sapiens
agtggcagagcaggtgctggaa

SEQ ID NO: 7823988 - DNA, 22 bp, Homo sapiens
agtggcagagccaagatatgat

SEQ ID NO: 7823989 - DNA, 22 bp, Homo sapiens
agtggcagagccaagatatgat

SEQ ID NO: 7823990 - DNA, 22 bp, Homo sapiens
agtggcagagccaagatatgat

SEQ ID NO: 7823991 - DNA, 22 bp, Homo sapiens
agtgaggcaaagtgagaggcag

SEQ ID NO: 7823992 - DNA, 22 bp, Homo sapiens
agtgaggcaaagtgagaggcag

SEQ ID NO: 7823993 - DNA, 19 bp, Homo sapiens
agtgagcatggcttgactg

SEQ ID NO: 7823994 - DNA, 19 bp, Homo sapiens
agtgagcatggcttgactg

SEQ ID NO: 7823995 - DNA, 20 bp, Homo sapiens
agtgaggcagttcagtgggc

SEQ ID NO: 7823996 - DNA, 20 bp, Homo sapiens
agtgaggcagttcagtgggc

SEQ ID NO: 7823997 - DNA, 22 bp, Homo sapiens
agtgaggcaaagtgagaggcag

SEQ ID NO: 7823998 - DNA, 20 bp, Homo sapiens
agtgagattgctgctctagc

SEQ ID NO: 7823999 - DNA, 22 bp, Homo sapiens
agtgagcaacagaagcgtgggt

SEQ ID NO: 7824000 - DNA, 22 bp, Homo sapiens
agtgagcaacagaagcgtgggt

SEQ ID NO: 7824001 - DNA, 23 bp, Homo sapiens
agtgagcagctgtagggcaagga

SEQ ID NO: 7824002 - DNA, 23 bp, Homo sapiens
agtgagcagctgtagggcaagga

SEQ ID NO: 7824003 - DNA, 23 bp, Homo sapiens
agtgagcagctgtagggcaagga

SEQ ID NO: 7824004 - DNA, 19 bp, Homo sapiens
agtgagcatccagagaggt

SEQ ID NO: 7824005 - DNA, 19 bp, Homo sapiens
agtgagcatccagagaggt

SEQ ID NO: 7824006 - DNA, 22 bp, Homo sapiens
agtgagcattcgtttggaaccc

SEQ ID NO: 7824007 - DNA, 19 bp, Homo sapiens
agtgagcatggcttgactg

SEQ ID NO: 7824008 - DNA, 22 bp, Homo sapiens
agtgagcatcttcaggagccaa

SEQ ID NO: 7824009 - DNA, 17 bp, Homo sapiens
agtgagaatgtcatgta

SEQ ID NO: 7824010 - DNA, 22 bp, Homo sapiens
agtgagacagtatactgagcag

SEQ ID NO: 7824011 - DNA, 22 bp, Homo sapiens
agtgagagtattaatgtgaact

SEQ ID NO: 7824012 - DNA, 17 bp, Homo sapiens
agtgagaatgtcatgta

SEQ ID NO: 7824013 - DNA, 19 bp, Homo sapiens
agtgagaacatgtgcacac

SEQ ID NO: 7824014 - DNA, 22 bp, Homo sapiens
agtgaattagcctatttgtaaa

SEQ ID NO: 7824015 - DNA, 22 bp, Homo sapiens
agtgagagtattaatgtgaact

SEQ ID NO: 7824016 - DNA, 22 bp, Homo sapiens
agtgagagtattaatgtgaact

SEQ ID NO: 7824017 - DNA, 22 bp, Homo sapiens
agtgagagtattaatgtgaact

SEQ ID NO: 7824018 - DNA, 22 bp, Homo sapiens
agtgagagtattaatgtgaact

SEQ ID NO: 7824019 - DNA, 22 bp, Homo sapiens
agtgaatgtccccgcgggtcag

SEQ ID NO: 7824020 - DNA, 22 bp, Homo sapiens
agtgaatgtccccgcgggtcag

SEQ ID NO: 7824021 - DNA, 22 bp, Homo sapiens
agtcctttgggaaaaatgacta

SEQ ID NO: 7824022 - DNA, 22 bp, Homo sapiens
agtccttttgttttgagatgag

SEQ ID NO: 7824023 - DNA, 22 bp, Homo sapiens
agtgaatgagaggtgagtattg

SEQ ID NO: 7824024 - DNA, 22 bp, Homo sapiens
agtccttgaatgttttgaaatc

SEQ ID NO: 7824025 - DNA, 21 bp, Homo sapiens
agtccttgaaactctttcttg

SEQ ID NO: 7824026 - DNA, 22 bp, Homo sapiens
agtcctttgctgaactgtcaca

SEQ ID NO: 7824027 - DNA, 21 bp, Homo sapiens
agtccttgaaactctttcttg

SEQ ID NO: 7824028 - DNA, 20 bp, Homo sapiens
agtgatttgttagtacattg

SEQ ID NO: 7824029 - DNA, 22 bp, Homo sapiens
agtgattttaacttccagcaat

SEQ ID NO: 7824030 - DNA, 22 bp, Homo sapiens
agtgattttatcaatttactca

SEQ ID NO: 7824031 - DNA, 22 bp, Homo sapiens
agtgattttatcaatttactca

SEQ ID NO: 7824032 - DNA, 22 bp, Homo sapiens
agtgatttgggtgtcagaaagt

SEQ ID NO: 7824033 - DNA, 22 bp, Homo sapiens
agtgatttggcggcagagttag

SEQ ID NO: 7824034 - DNA, 22 bp, Homo sapiens
agtgatttgggtgtcagaaagt

SEQ ID NO: 7824035 - DNA, 22 bp, Homo sapiens
agtgatttggttcatacttcca

SEQ ID NO: 7824036 - DNA, 20 bp, Homo sapiens
agtgatttgttagtacattg

SEQ ID NO: 7824037 - DNA, 22 bp, Homo sapiens
agtgcaaactttattgtgacct

SEQ ID NO: 7824038 - DNA, 22 bp, Homo sapiens
agtgcaaactttattgtgacct

SEQ ID NO: 7824039 - DNA, 22 bp, Homo sapiens
agtgcaaactttattgtgacct

SEQ ID NO: 7824040 - DNA, 22 bp, Homo sapiens
agtgcaaaattcagaagcaatt

SEQ ID NO: 7824041 - DNA, 22 bp, Homo sapiens
agtgcaaaattcagaagcaatt

SEQ ID NO: 7824042 - DNA, 22 bp, Homo sapiens
agtgcaaaattcagaagcaatt

SEQ ID NO: 7824043 - DNA, 22 bp, Homo sapiens
agtgattttgtcagcttctgca

SEQ ID NO: 7824044 - DNA, 22 bp, Homo sapiens
agtgcaaaaaagtgttgtgaca

SEQ ID NO: 7824045 - DNA, 22 bp, Homo sapiens
agtgcaaaaaagtgttgtgaca

SEQ ID NO: 7824046 - DNA, 22 bp, Homo sapiens
agtgcaaaattcagaagcaatt

SEQ ID NO: 7824047 - DNA, 22 bp, Homo sapiens
agtgcaaaagtaattggagttt

SEQ ID NO: 7824048 - DNA, 22 bp, Homo sapiens
agtgcaaaagtaattggagttt

SEQ ID NO: 7824049 - DNA, 22 bp, Homo sapiens
agtgattttgctttgaagtgac

SEQ ID NO: 7824050 - DNA, 22 bp, Homo sapiens
agtgattttgctttgaagtgac

SEQ ID NO: 7824051 - DNA, 20 bp, Homo sapiens
agtgattttgatatggtctt

SEQ ID NO: 7824052 - DNA, 22 bp, Homo sapiens
agtgattttcaagtggagcaca

SEQ ID NO: 7824053 - DNA, 22 bp, Homo sapiens
agtgattttgtagctatgagat

SEQ ID NO: 7824054 - DNA, 22 bp, Homo sapiens
agtgcaaagggatcagattggg

SEQ ID NO: 7824055 - DNA, 22 bp, Homo sapiens
agtgcaaagggatcagattggg

SEQ ID NO: 7824056 - DNA, 22 bp, Homo sapiens
agtgcaaagctgctgctgtggt

SEQ ID NO: 7824057 - DNA, 22 bp, Homo sapiens
agtgcaaagctgctgctgtggt

SEQ ID NO: 7824058 - DNA, 22 bp, Homo sapiens
agtgcaaagccgaggtttcttg

SEQ ID NO: 7824059 - DNA, 22 bp, Homo sapiens
agtgcaaagccgaggtttcttg

SEQ ID NO: 7824060 - DNA, 22 bp, Homo sapiens
agtgcaaagcagcctgtacacc

SEQ ID NO: 7824061 - DNA, 22 bp, Homo sapiens
agtgcaaagaaatcagctttgt

SEQ ID NO: 7824062 - DNA, 22 bp, Homo sapiens
agtgcaaactttattgtgacct

SEQ ID NO: 7824063 - DNA, 22 bp, Homo sapiens
agtgcaaagaaatcagctttgt

SEQ ID NO: 7824064 - DNA, 22 bp, Homo sapiens
agtgcaaagaaatcagctttgt

SEQ ID NO: 7824065 - DNA, 22 bp, Homo sapiens
agtgcaaagaaatcagctttgt

SEQ ID NO: 7824066 - DNA, 22 bp, Homo sapiens
agtgcaaagcagcctgtacacc

SEQ ID NO: 7824067 - DNA, 22 bp, Homo sapiens
agtgcaaagcagcctgtacacc

SEQ ID NO: 7824068 - DNA, 20 bp, Homo sapiens
agtgcaagaaagcacagctg

SEQ ID NO: 7824069 - DNA, 22 bp, Homo sapiens
agtgcaaagggctgttgagaag

SEQ ID NO: 7824070 - DNA, 20 bp, Homo sapiens
agtgcaagaaagcacagctg

SEQ ID NO: 7824071 - DNA, 22 bp, Homo sapiens
agtgcaacttcacgtagagtac

SEQ ID NO: 7824072 - DNA, 22 bp, Homo sapiens
agtgcaaagggatcagattggg

SEQ ID NO: 7824073 - DNA, 22 bp, Homo sapiens
agtgcaaagggatcagattggg

SEQ ID NO: 7824074 - DNA, 22 bp, Homo sapiens
agtgcaaagggctgttgagaag

SEQ ID NO: 7824075 - DNA, 22 bp, Homo sapiens
agtgcaaatatctacgcggtga

SEQ ID NO: 7824076 - DNA, 22 bp, Homo sapiens
agtgcaaatatctacgcggtga

SEQ ID NO: 7824077 - DNA, 22 bp, Homo sapiens
agtgcaaagggctgttgagaag

SEQ ID NO: 7824078 - DNA, 22 bp, Homo sapiens
agtgcaaattatttacctgatt

SEQ ID NO: 7824079 - DNA, 22 bp, Homo sapiens
agtgcaaattatttacctgatt

SEQ ID NO: 7824080 - DNA, 22 bp, Homo sapiens
agtgcaagctccataatcttca

SEQ ID NO: 7824081 - DNA, 22 bp, Homo sapiens
agtgctgaagactggctaggga

SEQ ID NO: 7824082 - DNA, 23 bp, Homo sapiens
agtgctgaattgaaagctccagg

SEQ ID NO: 7824083 - DNA, 22 bp, Homo sapiens
agtgctgtcccgacaactgagg

SEQ ID NO: 7824084 - DNA, 22 bp, Homo sapiens
agtgctgtccagtttcacaggt

SEQ ID NO: 7824085 - DNA, 20 bp, Homo sapiens
agtgctgtggctgaataaga

SEQ ID NO: 7824086 - DNA, 22 bp, Homo sapiens
agtgctgtctccttcccccggg

SEQ ID NO: 7824087 - DNA, 22 bp, Homo sapiens
agtgctgtctccttcccccggg

SEQ ID NO: 7824088 - DNA, 22 bp, Homo sapiens
agggtgcaaaagcaaggacagt

SEQ ID NO: 7824089 - DNA, 22 bp, Homo sapiens
agggtgcagaacaaattaagac

SEQ ID NO: 7824090 - DNA, 22 bp, Homo sapiens
agggtgcagaaggagcctagga

SEQ ID NO: 7824091 - DNA, 22 bp, Homo sapiens
agggtgcaaaagcaaggacagt

SEQ ID NO: 7824092 - DNA, 22 bp, Homo sapiens
agggtgcaaaagcaaggacagt

SEQ ID NO: 7824093 - DNA, 22 bp, Homo sapiens
agggtgagggtctggccttgag

SEQ ID NO: 7824094 - DNA, 22 bp, Homo sapiens
agggtcccgtccctctgcaccc

SEQ ID NO: 7824095 - DNA, 22 bp, Homo sapiens
agggtcctaagcctcagataag

SEQ ID NO: 7824096 - DNA, 22 bp, Homo sapiens
agggtcctaagcctcagataag

SEQ ID NO: 7824097 - DNA, 21 bp, Homo sapiens
agggtcctacagggctcagga

SEQ ID NO: 7824098 - DNA, 21 bp, Homo sapiens
agggtcctacagggctcagga

SEQ ID NO: 7824099 - DNA, 22 bp, Homo sapiens
agggtgagggtctggccttgag

SEQ ID NO: 7824100 - DNA, 22 bp, Homo sapiens
agggtgcagaaggagcctagga

SEQ ID NO: 7824101 - DNA, 22 bp, Homo sapiens
agggtgcagaaggagcctagga

SEQ ID NO: 7824102 - DNA, 22 bp, Homo sapiens
agggtgcagaaggagcctagga

SEQ ID NO: 7824103 - DNA, 22 bp, Homo sapiens
agggtgcagaaggagcctagga

SEQ ID NO: 7824104 - DNA, 22 bp, Homo sapiens
agggtgcagggacaggtgtgca

SEQ ID NO: 7824105 - DNA, 22 bp, Homo sapiens
agggtgcagggacaggtgtgca

SEQ ID NO: 7824106 - DNA, 22 bp, Homo sapiens
agggtgcaggtgtggagtctag

SEQ ID NO: 7824107 - DNA, 22 bp, Homo sapiens
agggtgcaggtgtggagtctag

SEQ ID NO: 7824108 - DNA, 22 bp, Homo sapiens
agggtgcaggtgtggagtctag

SEQ ID NO: 7824109 - DNA, 22 bp, Homo sapiens
agggtgcagtcacaggaaatgt

SEQ ID NO: 7824110 - DNA, 22 bp, Homo sapiens
agggtgcaggtgtggagtctag

SEQ ID NO: 7824111 - DNA, 22 bp, Homo sapiens
agggtgcaggggaagctgccct

SEQ ID NO: 7824112 - DNA, 22 bp, Homo sapiens
agggtgcaggggaagctgccct

SEQ ID NO: 7824113 - DNA, 22 bp, Homo sapiens
agggtgcaggggaagctgccct

SEQ ID NO: 7824114 - DNA, 22 bp, Homo sapiens
agggtcccgaaggagacagcaa

SEQ ID NO: 7824115 - DNA, 22 bp, Homo sapiens
agggtcccgtccctctgcaccc

SEQ ID NO: 7824116 - DNA, 22 bp, Homo sapiens
agggtccattctttgccttttc

SEQ ID NO: 7824117 - DNA, 22 bp, Homo sapiens
agggtcccgaaggagacagcaa

SEQ ID NO: 7824118 - DNA, 22 bp, Homo sapiens
agggtcccgaaggagacagcaa

SEQ ID NO: 7824119 - DNA, 22 bp, Homo sapiens
agggtccatgtttccagttaat

SEQ ID NO: 7824120 - DNA, 22 bp, Homo sapiens
agggtccatgtttccagttaat

SEQ ID NO: 7824121 - DNA, 22 bp, Homo sapiens
agggtccattctttgccttttc

SEQ ID NO: 7824122 - DNA, 19 bp, Homo sapiens
agggtccagggagcggctc

SEQ ID NO: 7824123 - DNA, 22 bp, Homo sapiens
agggtccagtaacagatgccag

SEQ ID NO: 7824124 - DNA, 23 bp, Homo sapiens
agggtccagggatcaccaggtgt

SEQ ID NO: 7824125 - DNA, 19 bp, Homo sapiens
agggtccaggccctgtgga

SEQ ID NO: 7824126 - DNA, 19 bp, Homo sapiens
agggtccaggccctgtgga

SEQ ID NO: 7824127 - DNA, 19 bp, Homo sapiens
agggtccaggccctgtgga

SEQ ID NO: 7824128 - DNA, 22 bp, Homo sapiens
agggtcagttctgtgaggtgtt

SEQ ID NO: 7824129 - DNA, 22 bp, Homo sapiens
agggtcagttctgtgaggtgtt

SEQ ID NO: 7824130 - DNA, 22 bp, Homo sapiens
agggtcagttctgtgaggtgtt

SEQ ID NO: 7824131 - DNA, 18 bp, Homo sapiens
agggtcagtgtcactggc

SEQ ID NO: 7824132 - DNA, 18 bp, Homo sapiens
agggtcagtgtcactggc

SEQ ID NO: 7824133 - DNA, 22 bp, Homo sapiens
agggtcagtgatgagggagccc

SEQ ID NO: 7824134 - DNA, 22 bp, Homo sapiens
agggtgccaggattcgctgcag

SEQ ID NO: 7824135 - DNA, 23 bp, Homo sapiens
agggtgcatttcacttacagacc

SEQ ID NO: 7824136 - DNA, 22 bp, Homo sapiens
agggtgccctggagccagttcc

SEQ ID NO: 7824137 - DNA, 22 bp, Homo sapiens
agggtgcccaccgcttctgccc

SEQ ID NO: 7824138 - DNA, 22 bp, Homo sapiens
agggtgcctgctgcaggttcag

SEQ ID NO: 7824139 - DNA, 22 bp, Homo sapiens
agggtgccctggagccagttcc

SEQ ID NO: 7824140 - DNA, 22 bp, Homo sapiens
agggtgcagtcacaggaaatgt

SEQ ID NO: 7824141 - DNA, 22 bp, Homo sapiens
agggtgcatgtttgcaagagtg

SEQ ID NO: 7824142 - DNA, 22 bp, Homo sapiens
aggtgcaggagctgtgcaggga

SEQ ID NO: 7824143 - DNA, 19 bp, Homo sapiens
aggtgaggggcaccatgtc

SEQ ID NO: 7824144 - DNA, 19 bp, Homo sapiens
aggtgaggggcaccatgtc

SEQ ID NO: 7824145 - DNA, 22 bp, Homo sapiens
aggtgaggataggtggccaagg

SEQ ID NO: 7824146 - DNA, 22 bp, Homo sapiens
aggtgaggataggtggccaagg

SEQ ID NO: 7824147 - DNA, 22 bp, Homo sapiens
aggtgcaggagctgtgcaggga

SEQ ID NO: 7824148 - DNA, 22 bp, Homo sapiens
aggtgcaggagctgtgcaggga

SEQ ID NO: 7824149 - DNA, 22 bp, Homo sapiens
aggtgcaggagctgtgcaggga

SEQ ID NO: 7824150 - DNA, 21 bp, Homo sapiens
aggtgcaggcctcaagcccca

SEQ ID NO: 7824151 - DNA, 21 bp, Homo sapiens
aggtgcaggcctcaagcccca

SEQ ID NO: 7824152 - DNA, 21 bp, Homo sapiens
aggtgcaggcctcaagcccca

SEQ ID NO: 7824153 - DNA, 21 bp, Homo sapiens
aggtgcaggcctcaagcccca

SEQ ID NO: 7824154 - DNA, 19 bp, Homo sapiens
aggtgcaggtcacagggga

SEQ ID NO: 7824155 - DNA, 19 bp, Homo sapiens
aggtgcaggtcacagggga

SEQ ID NO: 7824156 - DNA, 19 bp, Homo sapiens
aggtgcaggtcacagggga

SEQ ID NO: 7824157 - DNA, 22 bp, Homo sapiens
aggtgcagtgaaggaaaaggaa

SEQ ID NO: 7824158 - DNA, 19 bp, Homo sapiens
aggtgcaggtcacagggga

SEQ ID NO: 7824159 - DNA, 19 bp, Homo sapiens
aggtgcaggtcacagggga

SEQ ID NO: 7824160 - DNA, 19 bp, Homo sapiens
aggtgcaggtcacagggga

SEQ ID NO: 7824161 - DNA, 19 bp, Homo sapiens
aggtgcaggtcacagggga

SEQ ID NO: 7824162 - DNA, 22 bp, Homo sapiens
aggtgccaaagcctgcgggtgt

SEQ ID NO: 7824163 - DNA, 23 bp, Homo sapiens
aggtgccaactgagagctgagag

SEQ ID NO: 7824164 - DNA, 22 bp, Homo sapiens
aggtgccaacagtatttctgcc

SEQ ID NO: 7824165 - DNA, 22 bp, Homo sapiens
aggtgccaagaagaataggttc

SEQ ID NO: 7824166 - DNA, 23 bp, Homo sapiens
aggtgccaactgagagctgagag

SEQ ID NO: 7824167 - DNA, 21 bp, Homo sapiens
aggtgccaaggagaagcaggc

SEQ ID NO: 7824168 - DNA, 22 bp, Homo sapiens
aggtgccaagatgtcacagaca

SEQ ID NO: 7824169 - DNA, 22 bp, Homo sapiens
aggtgccaagatgtcacagaca

SEQ ID NO: 7824170 - DNA, 22 bp, Homo sapiens
aggtgcagtggctcatgcctgt

SEQ ID NO: 7824171 - DNA, 22 bp, Homo sapiens
aggtgcagtggctcatgcctgt

SEQ ID NO: 7824172 - DNA, 22 bp, Homo sapiens
aggtgcagtgaaggaaaaggaa

SEQ ID NO: 7824173 - DNA, 22 bp, Homo sapiens
aggtgcagtgaaggaaaaggaa

SEQ ID NO: 7824174 - DNA, 22 bp, Homo sapiens
aggtgcagtggctcatgcctgt

SEQ ID NO: 7824175 - DNA, 22 bp, Homo sapiens
aggtgcagtggctcatgcctgt

SEQ ID NO: 7824176 - DNA, 22 bp, Homo sapiens
aggtgcagtggctcatgcctgt

SEQ ID NO: 7824177 - DNA, 22 bp, Homo sapiens
aggtgcagtgtttaaaagtagc

SEQ ID NO: 7824178 - DNA, 22 bp, Homo sapiens
aggtgcagtgtttaaaagtagc

SEQ ID NO: 7824179 - DNA, 21 bp, Homo sapiens
aggtgccaaggagaagcaggc

SEQ ID NO: 7824180 - DNA, 21 bp, Homo sapiens
aggtgccaaggagaagcaggc

SEQ ID NO: 7824181 - DNA, 22 bp, Homo sapiens
aggtgccaattttcagtgaaca

SEQ ID NO: 7824182 - DNA, 22 bp, Homo sapiens
aggtgccacctctggtgctgtc

SEQ ID NO: 7824183 - DNA, 22 bp, Homo sapiens
aggtgccacctctggtgctgtc

SEQ ID NO: 7824184 - DNA, 22 bp, Homo sapiens
aggtgccactctcatgggctac

SEQ ID NO: 7824185 - DNA, 22 bp, Homo sapiens
aggtgccactctcatgggctac

SEQ ID NO: 7824186 - DNA, 22 bp, Homo sapiens
aggtgccagatgcacagctgaa

SEQ ID NO: 7824187 - DNA, 22 bp, Homo sapiens
aggtgccagatgcacagctgaa

SEQ ID NO: 7824188 - DNA, 22 bp, Homo sapiens
aggtgccagcagggttgatgac

SEQ ID NO: 7824189 - DNA, 22 bp, Homo sapiens
aggtgccagctctcaggcagga

SEQ ID NO: 7824190 - DNA, 22 bp, Homo sapiens
aggtgccagatgcacagctgaa

SEQ ID NO: 7824191 - DNA, 22 bp, Homo sapiens
aggtgccagatgcacagctgaa

SEQ ID NO: 7824192 - DNA, 22 bp, Homo sapiens
aggtggaaatggctttcctagg

SEQ ID NO: 7824193 - DNA, 22 bp, Homo sapiens
aggtggaaatggctttcctagg

SEQ ID NO: 7824194 - DNA, 22 bp, Homo sapiens
aggtgccagcagggttgatgac

SEQ ID NO: 7824195 - DNA, 22 bp, Homo sapiens
aggtggaaatggctttcctagg

SEQ ID NO: 7824196 - DNA, 22 bp, Homo sapiens
aggtggggttcagtctcagccg

SEQ ID NO: 7824197 - DNA, 22 bp, Homo sapiens
aggtggggaggagtgtctcttt

SEQ ID NO: 7824198 - DNA, 22 bp, Homo sapiens
aggtggggaaaccagcgatccc

SEQ ID NO: 7824199 - DNA, 22 bp, Homo sapiens
aggtgggtatcatgagagatta

SEQ ID NO: 7824200 - DNA, 22 bp, Homo sapiens
aggtgggtatcatgagagatta

SEQ ID NO: 7824201 - DNA, 19 bp, Homo sapiens
aggtgggtaagcagttctc

SEQ ID NO: 7824202 - DNA, 22 bp, Homo sapiens
aggtgggtgccgtctgtcctct

SEQ ID NO: 7824203 - DNA, 22 bp, Homo sapiens
aggtgggttcccgactctggct

SEQ ID NO: 7824204 - DNA, 22 bp, Homo sapiens
aggtgggttccgcggcggcccg

SEQ ID NO: 7824205 - DNA, 22 bp, Homo sapiens
aggtggtcactaactgccaaga

SEQ ID NO: 7824206 - DNA, 22 bp, Homo sapiens
aggtggtcttggcccacccagg

SEQ ID NO: 7824207 - DNA, 22 bp, Homo sapiens
aggtggagacccagagaaggcg

SEQ ID NO: 7824208 - DNA, 22 bp, Homo sapiens
aggtggagacccagagaaggcg

SEQ ID NO: 7824209 - DNA, 22 bp, Homo sapiens
aggtggagacccagagaaggcg

SEQ ID NO: 7824210 - DNA, 22 bp, Homo sapiens
aggtggagacccagagaaggcg

SEQ ID NO: 7824211 - DNA, 22 bp, Homo sapiens
aggtggagacccagagaaggcg

SEQ ID NO: 7824212 - DNA, 22 bp, Homo sapiens
aggtggagacccagagaaggcg

SEQ ID NO: 7824213 - DNA, 22 bp, Homo sapiens
aggtggagacccagagaaggcg

SEQ ID NO: 7824214 - DNA, 22 bp, Homo sapiens
aggtggagacccagagaaggcg

SEQ ID NO: 7824215 - DNA, 22 bp, Homo sapiens
aggtggagacccagagaaggcg

SEQ ID NO: 7824216 - DNA, 22 bp, Homo sapiens
aggtggagacccagagaaggcg

SEQ ID NO: 7824217 - DNA, 22 bp, Homo sapiens
aggtggagacccagagaaggcg

SEQ ID NO: 7824218 - DNA, 22 bp, Homo sapiens
aggtggagacccagagaaggcg

SEQ ID NO: 7824219 - DNA, 16 bp, Homo sapiens
aggtggagaagttcac

SEQ ID NO: 7824220 - DNA, 22 bp, Homo sapiens
aggtggagaagagatgggcagt

SEQ ID NO: 7824221 - DNA, 22 bp, Homo sapiens
aggtggagaagagatgggcagt

SEQ ID NO: 7824222 - DNA, 22 bp, Homo sapiens
aggtggagaagagatgggcagt

SEQ ID NO: 7824223 - DNA, 22 bp, Homo sapiens
aggtggagaagagatgggcagt

SEQ ID NO: 7824224 - DNA, 22 bp, Homo sapiens
aggtggagaagagatgggcagt

SEQ ID NO: 7824225 - DNA, 22 bp, Homo sapiens
aggtggagaagagatgggcagt

SEQ ID NO: 7824226 - DNA, 22 bp, Homo sapiens
aggtggagaagagatgggcagt

SEQ ID NO: 7824227 - DNA, 22 bp, Homo sapiens
aggtggagaagagatgggcagt

SEQ ID NO: 7824228 - DNA, 22 bp, Homo sapiens
aggtggagaagagatgggcagt

SEQ ID NO: 7824229 - DNA, 22 bp, Homo sapiens
aggtggaacgttcaggtgctag

SEQ ID NO: 7824230 - DNA, 22 bp, Homo sapiens
aggtggaaatggctttcctagg

SEQ ID NO: 7824231 - DNA, 22 bp, Homo sapiens
aggtggagaagagatgggcagt

SEQ ID NO: 7824232 - DNA, 22 bp, Homo sapiens
aggtggaacgttcaggtgctag

SEQ ID NO: 7824233 - DNA, 22 bp, Homo sapiens
aggtggagaagagatgggcagt

SEQ ID NO: 7824234 - DNA, 23 bp, Homo sapiens
aggttctcttatcatctctgccc

SEQ ID NO: 7824235 - DNA, 22 bp, Homo sapiens
aggttctgatttgttggggagg

SEQ ID NO: 7824236 - DNA, 22 bp, Homo sapiens
aggttctggcattgctcagtaa

SEQ ID NO: 7824237 - DNA, 22 bp, Homo sapiens
aggttccttatggggatggcta

SEQ ID NO: 7824238 - DNA, 20 bp, Homo sapiens
aggttcctttgtggagaatt

SEQ ID NO: 7824239 - DNA, 22 bp, Homo sapiens
aggttctcacacgtctacaccc

SEQ ID NO: 7824240 - DNA, 22 bp, Homo sapiens
aggttcttggtgagcatttggt

SEQ ID NO: 7824241 - DNA, 22 bp, Homo sapiens
aggttcttgactctaccttcca

SEQ ID NO: 7824242 - DNA, 22 bp, Homo sapiens
aggttcttgactctaccttcca

SEQ ID NO: 7824243 - DNA, 22 bp, Homo sapiens
actcacagggcctcagttttcc

SEQ ID NO: 7824244 - DNA, 22 bp, Homo sapiens
aggttcttggtgagcatttggt

SEQ ID NO: 7824245 - DNA, 22 bp, Homo sapiens
aggttcttggtgtccagatttc

SEQ ID NO: 7824246 - DNA, 22 bp, Homo sapiens
actcagagcctcgagggactgc

SEQ ID NO: 7824247 - DNA, 22 bp, Homo sapiens
actcaccacacccttgcacttg

SEQ ID NO: 7824248 - DNA, 22 bp, Homo sapiens
actcaccacacccttgcacttg

SEQ ID NO: 7824249 - DNA, 22 bp, Homo sapiens
actcacagtccctgtaggagtg

SEQ ID NO: 7824250 - DNA, 22 bp, Homo sapiens
actcacagtgaagccagaatca

SEQ ID NO: 7824251 - DNA, 22 bp, Homo sapiens
actcacagtccctgtaggagtg

SEQ ID NO: 7824252 - DNA, 22 bp, Homo sapiens
aggtgtcactttatgttcagtg

SEQ ID NO: 7824253 - DNA, 22 bp, Homo sapiens
aggtgtcatttctctgcaggtg

SEQ ID NO: 7824254 - DNA, 22 bp, Homo sapiens
aggtggtgatgacagaagacag

SEQ ID NO: 7824255 - DNA, 22 bp, Homo sapiens
aggtggtgatgacagaagacag

SEQ ID NO: 7824256 - DNA, 23 bp, Homo sapiens
aggtggtcttgtggatgctgcaa

SEQ ID NO: 7824257 - DNA, 22 bp, Homo sapiens
aggtggtcttgtggatgccgca

SEQ ID NO: 7824258 - DNA, 20 bp, Homo sapiens
aggtgtccacgtggcagggt

SEQ ID NO: 7824259 - DNA, 22 bp, Homo sapiens
aggttccaggtctgggttatgt

SEQ ID NO: 7824260 - DNA, 22 bp, Homo sapiens
aggttccagggattaggatgtg

SEQ ID NO: 7824261 - DNA, 20 bp, Homo sapiens
aggttccagccacaaccagc

SEQ ID NO: 7824262 - DNA, 21 bp, Homo sapiens
aggttccagcagccagagaat

SEQ ID NO: 7824263 - DNA, 22 bp, Homo sapiens
aggttcccagagatagagctgt

SEQ ID NO: 7824264 - DNA, 22 bp, Homo sapiens
aggttcccagagatagagctgt

SEQ ID NO: 7824265 - DNA, 22 bp, Homo sapiens
aggttccaggttcgaatcccat

SEQ ID NO: 7824266 - DNA, 22 bp, Homo sapiens
aggttccatcacctgcagtgga

SEQ ID NO: 7824267 - DNA, 22 bp, Homo sapiens
aggttcctcttcctctggcctg

SEQ ID NO: 7824268 - DNA, 22 bp, Homo sapiens
aggttcccaggatctgtctggg

SEQ ID NO: 7824269 - DNA, 23 bp, Homo sapiens
aggttcccccgccaggaccctgc

SEQ ID NO: 7824270 - DNA, 22 bp, Homo sapiens
aggttcccaggatctgtctggg

SEQ ID NO: 7824271 - DNA, 22 bp, Homo sapiens
agtcacttctattctattaagt

SEQ ID NO: 7824272 - DNA, 22 bp, Homo sapiens
agtcacttcgtgagcactgact

SEQ ID NO: 7824273 - DNA, 22 bp, Homo sapiens
agtaataatagctgtaaagtgc

SEQ ID NO: 7824274 - DNA, 22 bp, Homo sapiens
agtaaggcatttttcatgttta

SEQ ID NO: 7824275 - DNA, 21 bp, Homo sapiens
agtaagggaggaaagaaattg

SEQ ID NO: 7824276 - DNA, 22 bp, Homo sapiens
agtaagtgagtcactgtgctgg

SEQ ID NO: 7824277 - DNA, 17 bp, Homo sapiens
agtaagtgtgtcacttc

SEQ ID NO: 7824278 - DNA, 22 bp, Homo sapiens
agtaagttccagtttcattatg

SEQ ID NO: 7824279 - DNA, 22 bp, Homo sapiens
agtcaggggatctagacttgaa

SEQ ID NO: 7824280 - DNA, 22 bp, Homo sapiens
agtcaggggttggacggggcca

SEQ ID NO: 7824281 - DNA, 19 bp, Homo sapiens
agtcaggtggctggtgcca

SEQ ID NO: 7824282 - DNA, 19 bp, Homo sapiens
agtcaggtggctggtgcca

SEQ ID NO: 7824283 - DNA, 22 bp, Homo sapiens
agtcaggtgggggctgcagtgg

SEQ ID NO: 7824284 - DNA, 22 bp, Homo sapiens
agtcaggtggttctgctccact

SEQ ID NO: 7824285 - DNA, 22 bp, Homo sapiens
agtcaggtgggggctgcagtgg

SEQ ID NO: 7824286 - DNA, 22 bp, Homo sapiens
agtcaggttctcacagctcttc

SEQ ID NO: 7824287 - DNA, 22 bp, Homo sapiens
agtcaggttgcattttaagtaa

SEQ ID NO: 7824288 - DNA, 19 bp, Homo sapiens
agtcaggtggctggtgcca

SEQ ID NO: 7824289 - DNA, 22 bp, Homo sapiens
agtcaggtactccgagggcatg

SEQ ID NO: 7824290 - DNA, 22 bp, Homo sapiens
agtcagtatttattacttagct

SEQ ID NO: 7824291 - DNA, 22 bp, Homo sapiens
agtcagtatttattacttagct

SEQ ID NO: 7824292 - DNA, 22 bp, Homo sapiens
agtcagtcaaaatataaattgt

SEQ ID NO: 7824293 - DNA, 22 bp, Homo sapiens
agtcagtcacaaaggaccacat

SEQ ID NO: 7824294 - DNA, 22 bp, Homo sapiens
agtcagtcaccatttaagaaca

SEQ ID NO: 7824295 - DNA, 23 bp, Homo sapiens
agtcagtcatggtaaccatttga

SEQ ID NO: 7824296 - DNA, 18 bp, Homo sapiens
agtcagtcattgatagat

SEQ ID NO: 7824297 - DNA, 22 bp, Homo sapiens
agtcagtgaaaactagaatgtt

SEQ ID NO: 7824298 - DNA, 22 bp, Homo sapiens
agtcagtctgctagcctgtgga

SEQ ID NO: 7824299 - DNA, 22 bp, Homo sapiens
agtcagtgaaaactagaatgtt

SEQ ID NO: 7824300 - DNA, 22 bp, Homo sapiens
agtcagtgacttttgctgagag

SEQ ID NO: 7824301 - DNA, 22 bp, Homo sapiens
agtcagtgacttttgctgagag

SEQ ID NO: 7824302 - DNA, 23 bp, Homo sapiens
agtcagtgcgggatggtcagggg

SEQ ID NO: 7824303 - DNA, 23 bp, Homo sapiens
agtcagtgcgggatggtcagggg

SEQ ID NO: 7824304 - DNA, 23 bp, Homo sapiens
agtcagtgcgggatggtcagggg

SEQ ID NO: 7824305 - DNA, 22 bp, Homo sapiens
agtcagtgaatggtgtatgcta

SEQ ID NO: 7824306 - DNA, 22 bp, Homo sapiens
agtcagtgaatggtgtatgcta

SEQ ID NO: 7824307 - DNA, 22 bp, Homo sapiens
agtcagtgaatggtgtatgcta

SEQ ID NO: 7824308 - DNA, 22 bp, Homo sapiens
agtcagtgaatctgaaggctaa

SEQ ID NO: 7824309 - DNA, 22 bp, Homo sapiens
agtcagtgggagaagtgtgaag

SEQ ID NO: 7824310 - DNA, 22 bp, Homo sapiens
agtcagtggctccgagcctggt

SEQ ID NO: 7824311 - DNA, 22 bp, Homo sapiens
agtcagtggctccgagcctggt

SEQ ID NO: 7824312 - DNA, 22 bp, Homo sapiens
agtcagtgggagaagtgtgaag

SEQ ID NO: 7824313 - DNA, 22 bp, Homo sapiens
agtcagtgggagaagtgtgaag

SEQ ID NO: 7824314 - DNA, 22 bp, Homo sapiens
agtcagtgggagaagtgtgaag

SEQ ID NO: 7824315 - DNA, 22 bp, Homo sapiens
agtcagtggatttaccatgcgt

SEQ ID NO: 7824316 - DNA, 22 bp, Homo sapiens
agtcagtggatttaccatgcgt

SEQ ID NO: 7824317 - DNA, 22 bp, Homo sapiens
agtcagtggctccgagcctggt

SEQ ID NO: 7824318 - DNA, 22 bp, Homo sapiens
agtcagtggtatttaggggaat

SEQ ID NO: 7824319 - DNA, 22 bp, Homo sapiens
agtcagtgggcttggcacagaa

SEQ ID NO: 7824320 - DNA, 22 bp, Homo sapiens
agtcagtgggcttggcacagaa

SEQ ID NO: 7824321 - DNA, 22 bp, Homo sapiens
agtcagtgggcttggcacagaa

SEQ ID NO: 7824322 - DNA, 22 bp, Homo sapiens
agtcagtgggcttggcacagaa

SEQ ID NO: 7824323 - DNA, 22 bp, Homo sapiens
agtcagtgtagaaagcccaggc

SEQ ID NO: 7824324 - DNA, 22 bp, Homo sapiens
agtcagtggtatttaggggaat

SEQ ID NO: 7824325 - DNA, 23 bp, Homo sapiens
agtcagtgtaagtttggaatgca

SEQ ID NO: 7824326 - DNA, 22 bp, Homo sapiens
agtcagtgtagaaagcccaggc

SEQ ID NO: 7824327 - DNA, 22 bp, Homo sapiens
agtcagtgtagaaagcccaggc

SEQ ID NO: 7824328 - DNA, 22 bp, Homo sapiens
agtcagtgtagaaagcccaggc

SEQ ID NO: 7824329 - DNA, 22 bp, Homo sapiens
agtccagaacttcagctagttt

SEQ ID NO: 7824330 - DNA, 22 bp, Homo sapiens
agtaactctcctttgacatatt

SEQ ID NO: 7824331 - DNA, 22 bp, Homo sapiens
agtaacttaagcaattgtgtat

SEQ ID NO: 7824332 - DNA, 22 bp, Homo sapiens
agtaactctcctttgacatatt

SEQ ID NO: 7824333 - DNA, 22 bp, Homo sapiens
agtaactcatgtaaacctcaca

SEQ ID NO: 7824334 - DNA, 21 bp, Homo sapiens
agtaacattttgttgtttaca

SEQ ID NO: 7824335 - DNA, 22 bp, Homo sapiens
agtaaggcaatgccactaagat

SEQ ID NO: 7824336 - DNA, 22 bp, Homo sapiens
agtaaggcaatgccactaagat

SEQ ID NO: 7824337 - DNA, 22 bp, Homo sapiens
agtaagcaccgggatggtcaag

SEQ ID NO: 7824338 - DNA, 22 bp, Homo sapiens
agtaagcaatagagtgagaatt

SEQ ID NO: 7824339 - DNA, 22 bp, Homo sapiens
agtaagattcttctgaaaaatt

SEQ ID NO: 7824340 - DNA, 22 bp, Homo sapiens
agtaacatgagtttttctaatg

SEQ ID NO: 7824341 - DNA, 23 bp, Homo sapiens
agtaacatgcaaataacagtctg

SEQ ID NO: 7824342 - DNA, 23 bp, Homo sapiens
agtaacatgcaaataacagtctg

SEQ ID NO: 7824343 - DNA, 22 bp, Homo sapiens
agtaacatgagtttttctaatg

SEQ ID NO: 7824344 - DNA, 22 bp, Homo sapiens
agtaacatctttgacatttgtt

SEQ ID NO: 7824345 - DNA, 22 bp, Homo sapiens
agtaacatgagtttttctaatg

SEQ ID NO: 7824346 - DNA, 22 bp, Homo sapiens
agtaacatctttgacatttgtt

SEQ ID NO: 7824347 - DNA, 22 bp, Homo sapiens
agtaacatgagtttttctaatg

SEQ ID NO: 7824348 - DNA, 22 bp, Homo sapiens
actcagcttcctacagctagaa

SEQ ID NO: 7824349 - DNA, 22 bp, Homo sapiens
agtaacagtaacatcttcctag

SEQ ID NO: 7824350 - DNA, 22 bp, Homo sapiens
agtaacatctttgacatttgtt

SEQ ID NO: 7824351 - DNA, 22 bp, Homo sapiens
agtaacatctttgacatttgtt

SEQ ID NO: 7824352 - DNA, 22 bp, Homo sapiens
agtaacatctttgacatttgtt

SEQ ID NO: 7824353 - DNA, 22 bp, Homo sapiens
agtaacatatagcacttttgga

SEQ ID NO: 7824354 - DNA, 22 bp, Homo sapiens
agtaacatatagcacttttgga

SEQ ID NO: 7824355 - DNA, 22 bp, Homo sapiens
agtaacagtaacatcttcctag

SEQ ID NO: 7824356 - DNA, 22 bp, Homo sapiens
actcagaggaaagttgagattg

SEQ ID NO: 7824357 - DNA, 22 bp, Homo sapiens
actcagaggaaagttgagattg

SEQ ID NO: 7824358 - DNA, 22 bp, Homo sapiens
actcagaggaaagttgagattg

SEQ ID NO: 7824359 - DNA, 22 bp, Homo sapiens
actcagagcttggctccttgct

SEQ ID NO: 7824360 - DNA, 22 bp, Homo sapiens
actcagagcttggctccttgct

SEQ ID NO: 7824361 - DNA, 22 bp, Homo sapiens
actcagaggaaaccctcctagg

SEQ ID NO: 7824362 - DNA, 22 bp, Homo sapiens
actcagagtagaaaataggttc

SEQ ID NO: 7824363 - DNA, 22 bp, Homo sapiens
actcagaggcagctgctcaccc

SEQ ID NO: 7824364 - DNA, 22 bp, Homo sapiens
actcagagttttacccagagac

SEQ ID NO: 7824365 - DNA, 22 bp, Homo sapiens
actcagagttttacccagagac

SEQ ID NO: 7824366 - DNA, 22 bp, Homo sapiens
actcagagtctgtttggtacct

SEQ ID NO: 7824367 - DNA, 22 bp, Homo sapiens
actcagagtgcatctcctattt

SEQ ID NO: 7824368 - DNA, 22 bp, Homo sapiens
actcagctcaggagctggctgg

SEQ ID NO: 7824369 - DNA, 22 bp, Homo sapiens
actcagctaaactcagtctatg

SEQ ID NO: 7824370 - DNA, 22 bp, Homo sapiens
agtcctgggtgtgcaaggcaga

SEQ ID NO: 7824371 - DNA, 22 bp, Homo sapiens
agtcctgggtgtgcaaggcaga

SEQ ID NO: 7824372 - DNA, 22 bp, Homo sapiens
agtcctgggtgtgcaaggcaga

SEQ ID NO: 7824373 - DNA, 22 bp, Homo sapiens
agtcctgggtgtgcaaggcaga

SEQ ID NO: 7824374 - DNA, 22 bp, Homo sapiens
agtcctgggttctggtgttttg

SEQ ID NO: 7824375 - DNA, 22 bp, Homo sapiens
agtcctgggttctggtgttttg

SEQ ID NO: 7824376 - DNA, 22 bp, Homo sapiens
agtcctggtgacactcctcttc

SEQ ID NO: 7824377 - DNA, 22 bp, Homo sapiens
agtcctggtgacactcctcttc

SEQ ID NO: 7824378 - DNA, 22 bp, Homo sapiens
agtcctgggttctggtgttttg

SEQ ID NO: 7824379 - DNA, 22 bp, Homo sapiens
agtcctggtgacactcctcttc

SEQ ID NO: 7824380 - DNA, 22 bp, Homo sapiens
agtcctggtgacactcctcttc

SEQ ID NO: 7824381 - DNA, 22 bp, Homo sapiens
agtcctggttctgattctgaca

SEQ ID NO: 7824382 - DNA, 22 bp, Homo sapiens
agtcctgtatctgagctgagtc

SEQ ID NO: 7824383 - DNA, 22 bp, Homo sapiens
agtcctggttctgattctgaca

SEQ ID NO: 7824384 - DNA, 22 bp, Homo sapiens
agtcctggttctgattctgaca

SEQ ID NO: 7824385 - DNA, 22 bp, Homo sapiens
agtcctgtgcaaatgcatctga

SEQ ID NO: 7824386 - DNA, 22 bp, Homo sapiens
agtcctgtgggtgggctggcca

SEQ ID NO: 7824387 - DNA, 22 bp, Homo sapiens
agtcctgtgcaaatgcatctga

SEQ ID NO: 7824388 - DNA, 22 bp, Homo sapiens
agtcctgtgaggggtgcagctt

SEQ ID NO: 7824389 - DNA, 22 bp, Homo sapiens
agtcctgtgaggggtgcagctt

SEQ ID NO: 7824390 - DNA, 22 bp, Homo sapiens
agtccttagaacactgtatctg

SEQ ID NO: 7824391 - DNA, 22 bp, Homo sapiens
agtccttagaacactgtatctg

SEQ ID NO: 7824392 - DNA, 22 bp, Homo sapiens
actctgggctgttaggagctgt

SEQ ID NO: 7824393 - DNA, 22 bp, Homo sapiens
actctgggctgttaggagctgt

SEQ ID NO: 7824394 - DNA, 22 bp, Homo sapiens
actctgggccccaggtggagct

SEQ ID NO: 7824395 - DNA, 22 bp, Homo sapiens
actctgggccccaggtggagct

SEQ ID NO: 7824396 - DNA, 22 bp, Homo sapiens
actctgggccccaggtggagct

SEQ ID NO: 7824397 - DNA, 22 bp, Homo sapiens
actctgggccccaggtggagct

SEQ ID NO: 7824398 - DNA, 22 bp, Homo sapiens
actctggggcgctactccaact

SEQ ID NO: 7824399 - DNA, 22 bp, Homo sapiens
actctgggctgttaggagctgt

SEQ ID NO: 7824400 - DNA, 22 bp, Homo sapiens
actctgggctttgatttgttac

SEQ ID NO: 7824401 - DNA, 22 bp, Homo sapiens
actctgggctttgatttgttac

SEQ ID NO: 7824402 - DNA, 20 bp, Homo sapiens
actctggggctcattagggg

SEQ ID NO: 7824403 - DNA, 20 bp, Homo sapiens
actctggggctcattagggg

SEQ ID NO: 7824404 - DNA, 22 bp, Homo sapiens
actctggggtgatgtctctgag

SEQ ID NO: 7824405 - DNA, 22 bp, Homo sapiens
actctgggtcctgccattcact

SEQ ID NO: 7824406 - DNA, 22 bp, Homo sapiens
actctggggtgatgtctctgag

SEQ ID NO: 7824407 - DNA, 22 bp, Homo sapiens
actctgggttctttcacttgac

SEQ ID NO: 7824408 - DNA, 22 bp, Homo sapiens
actctgggttctttcacttgac

SEQ ID NO: 7824409 - DNA, 22 bp, Homo sapiens
actctggtctttctgaaagcaa

SEQ ID NO: 7824410 - DNA, 22 bp, Homo sapiens
agtcctgggtgtgcaaggcaga

SEQ ID NO: 7824411 - DNA, 22 bp, Homo sapiens
agtcctgggtgtgcaaggcaga

SEQ ID NO: 7824412 - DNA, 22 bp, Homo sapiens
actctgtaattctatatgcagt

SEQ ID NO: 7824413 - DNA, 22 bp, Homo sapiens
agtccaggcattccagccattc

SEQ ID NO: 7824414 - DNA, 22 bp, Homo sapiens
agtccaggcctccctctcctgc

SEQ ID NO: 7824415 - DNA, 22 bp, Homo sapiens
agtccaggcattccagccattc

SEQ ID NO: 7824416 - DNA, 22 bp, Homo sapiens
agtccaggcctccctctcctgc

SEQ ID NO: 7824417 - DNA, 22 bp, Homo sapiens
agtccaggcctccctctcctgc

SEQ ID NO: 7824418 - DNA, 22 bp, Homo sapiens
agtccaggcctcctcttttcct

SEQ ID NO: 7824419 - DNA, 22 bp, Homo sapiens
agtccaggcctccctctcctgc

SEQ ID NO: 7824420 - DNA, 22 bp, Homo sapiens
agtccaggcctcctcttttcct

SEQ ID NO: 7824421 - DNA, 22 bp, Homo sapiens
agtccaggcctcctcttttcct

SEQ ID NO: 7824422 - DNA, 22 bp, Homo sapiens
actctgctcaaagtcctgaggc

SEQ ID NO: 7824423 - DNA, 22 bp, Homo sapiens
actctgctcaaagtcctgaggc

SEQ ID NO: 7824424 - DNA, 21 bp, Homo sapiens
agtccaggcctgcccacttcc

SEQ ID NO: 7824425 - DNA, 22 bp, Homo sapiens
actctgctaaatgtgtaggctc

SEQ ID NO: 7824426 - DNA, 22 bp, Homo sapiens
actctgggatcttgaaaagagt

SEQ ID NO: 7824427 - DNA, 22 bp, Homo sapiens
actctgggagaggacaaacaaa

SEQ ID NO: 7824428 - DNA, 22 bp, Homo sapiens
actctgggagaggacaaacaaa

SEQ ID NO: 7824429 - DNA, 22 bp, Homo sapiens
actctgggcccaccctcagagt

SEQ ID NO: 7824430 - DNA, 22 bp, Homo sapiens
actctgggcccaccctcagagt

SEQ ID NO: 7824431 - DNA, 22 bp, Homo sapiens
actctgggatgagaaaagggtt

SEQ ID NO: 7824432 - DNA, 22 bp, Homo sapiens
actctgggattgtttctggtat

SEQ ID NO: 7824433 - DNA, 22 bp, Homo sapiens
actctgggattgtttctggtat

SEQ ID NO: 7824434 - DNA, 21 bp, Homo sapiens
agtccaggaggaggccaggtt

SEQ ID NO: 7824435 - DNA, 21 bp, Homo sapiens
agtccaggaggaggccaggtt

SEQ ID NO: 7824436 - DNA, 21 bp, Homo sapiens
agtccaggaggaggccaggtt

SEQ ID NO: 7824437 - DNA, 22 bp, Homo sapiens
agtccaggactgtttcagctga

SEQ ID NO: 7824438 - DNA, 21 bp, Homo sapiens
agtccaggaggaggccaggtt

SEQ ID NO: 7824439 - DNA, 21 bp, Homo sapiens
agtccaggaggaggccaggtt

SEQ ID NO: 7824440 - DNA, 21 bp, Homo sapiens
agtccaggaggaggccaggtt

SEQ ID NO: 7824441 - DNA, 22 bp, Homo sapiens
agtccaggcattccagccattc

SEQ ID NO: 7824442 - DNA, 22 bp, Homo sapiens
agtccaggcattccagccattc

SEQ ID NO: 7824443 - DNA, 22 bp, Homo sapiens
agtccaggcattccagccattc

SEQ ID NO: 7824444 - DNA, 22 bp, Homo sapiens
agtccaggcaagttgttgtgta

SEQ ID NO: 7824445 - DNA, 22 bp, Homo sapiens
agtccaggcattccagccattc

SEQ ID NO: 7824446 - DNA, 22 bp, Homo sapiens
agtccaggcaagttgttgtgta

SEQ ID NO: 7824447 - DNA, 22 bp, Homo sapiens
agtccaggagttgggtgacatt

SEQ ID NO: 7824448 - DNA, 22 bp, Homo sapiens
agtccaggagttgggtgacatt

SEQ ID NO: 7824449 - DNA, 22 bp, Homo sapiens
agtccaggagttgggtgacatt

SEQ ID NO: 7824450 - DNA, 22 bp, Homo sapiens
agtccaggagttgggtgacatt

SEQ ID NO: 7824451 - DNA, 22 bp, Homo sapiens
agtccaggagttgggtgacatt

SEQ ID NO: 7824452 - DNA, 22 bp, Homo sapiens
agtccaggagttgggtgacatt

SEQ ID NO: 7824453 - DNA, 21 bp, Homo sapiens
agtccaggagtcacccaagcc

SEQ ID NO: 7824454 - DNA, 22 bp, Homo sapiens
agtccagaccccggcagctggt

SEQ ID NO: 7824455 - DNA, 22 bp, Homo sapiens
agtccagaccccggcagctggt

SEQ ID NO: 7824456 - DNA, 22 bp, Homo sapiens
agtccagaccccggcagctggt

SEQ ID NO: 7824457 - DNA, 22 bp, Homo sapiens
agtccagaccccggcagctggt

SEQ ID NO: 7824458 - DNA, 22 bp, Homo sapiens
agtccagaccccggcagctggt

SEQ ID NO: 7824459 - DNA, 22 bp, Homo sapiens
agtccagaccccggcagctggt

SEQ ID NO: 7824460 - DNA, 22 bp, Homo sapiens
agtccagccttcaatcttagtg

SEQ ID NO: 7824461 - DNA, 22 bp, Homo sapiens
agtccagatcatgcagcaaacc

SEQ ID NO: 7824462 - DNA, 22 bp, Homo sapiens
agtccagagaggaggctgtgtg

SEQ ID NO: 7824463 - DNA, 22 bp, Homo sapiens
agtccagagaggaggctgtgtg

SEQ ID NO: 7824464 - DNA, 22 bp, Homo sapiens
agtccagagaggaggctgtgtg

SEQ ID NO: 7824465 - DNA, 22 bp, Homo sapiens
agtccagagaggaggctgtgtg

SEQ ID NO: 7824466 - DNA, 22 bp, Homo sapiens
agtccagagaggaggctgtgtg

SEQ ID NO: 7824467 - DNA, 22 bp, Homo sapiens
agtccaggaagcatcatggtct

SEQ ID NO: 7824468 - DNA, 22 bp, Homo sapiens
agtccaggaaaataagctaggt

SEQ ID NO: 7824469 - DNA, 22 bp, Homo sapiens
agtccaggaaaataagctaggt

SEQ ID NO: 7824470 - DNA, 22 bp, Homo sapiens
agtccaggaaaataagctaggt

SEQ ID NO: 7824471 - DNA, 22 bp, Homo sapiens
agtccaggaaaataagctaggt

SEQ ID NO: 7824472 - DNA, 22 bp, Homo sapiens
agtccaggaaaataagctaggt

SEQ ID NO: 7824473 - DNA, 22 bp, Homo sapiens
agtccaggaagcatcatggtct

SEQ ID NO: 7824474 - DNA, 22 bp, Homo sapiens
agtccaggaagcatcatggtct

SEQ ID NO: 7824475 - DNA, 22 bp, Homo sapiens
agtccaggaagcatcatggtct

SEQ ID NO: 7824476 - DNA, 22 bp, Homo sapiens
agtccaggaagcatcatggtct

SEQ ID NO: 7824477 - DNA, 21 bp, Homo sapiens
agtccaggaggaggccaggtt

SEQ ID NO: 7824478 - DNA, 22 bp, Homo sapiens
agtccaggactgtttcagctga

SEQ ID NO: 7824479 - DNA, 22 bp, Homo sapiens
atacacaattgtgtttttatga

SEQ ID NO: 7824480 - DNA, 22 bp, Homo sapiens
atacaatgggtgcaaagatgtg

SEQ ID NO: 7824481 - DNA, 22 bp, Homo sapiens
atacaatgggtgcaaagatgtg

SEQ ID NO: 7824482 - DNA, 22 bp, Homo sapiens
atacaatgattggttctcaccc

SEQ ID NO: 7824483 - DNA, 22 bp, Homo sapiens
atacaatgattggttctcaccc

SEQ ID NO: 7824484 - DNA, 22 bp, Homo sapiens
atacaattattctgcagatatt

SEQ ID NO: 7824485 - DNA, 22 bp, Homo sapiens
atacaatcatcattatattccc

SEQ ID NO: 7824486 - DNA, 22 bp, Homo sapiens
atacaatcatcattatattccc

SEQ ID NO: 7824487 - DNA, 22 bp, Homo sapiens
atacaatagtgtttgttttgag

SEQ ID NO: 7824488 - DNA, 22 bp, Homo sapiens
atacaatagtgtttgttttgag

SEQ ID NO: 7824489 - DNA, 22 bp, Homo sapiens
atacaatagtgtttgttttgag

SEQ ID NO: 7824490 - DNA, 22 bp, Homo sapiens
atacaatgaagtatagatgaaa

SEQ ID NO: 7824491 - DNA, 22 bp, Homo sapiens
atacaatgaagtatagatgaaa

SEQ ID NO: 7824492 - DNA, 22 bp, Homo sapiens
atacaatgataatagtacttta

SEQ ID NO: 7824493 - DNA, 22 bp, Homo sapiens
atacaatgataatagtacttta

SEQ ID NO: 7824494 - DNA, 22 bp, Homo sapiens
atacaatgacccgggtccaagg

SEQ ID NO: 7824495 - DNA, 22 bp, Homo sapiens
atacactactaagcacagattg

SEQ ID NO: 7824496 - DNA, 22 bp, Homo sapiens
atacactactaagcacagattg

SEQ ID NO: 7824497 - DNA, 22 bp, Homo sapiens
atacactactaagcacagattg

SEQ ID NO: 7824498 - DNA, 22 bp, Homo sapiens
atacactgagtccttttctcat

SEQ ID NO: 7824499 - DNA, 19 bp, Homo sapiens
atacactaatataaaccac

SEQ ID NO: 7824500 - DNA, 19 bp, Homo sapiens
atacactaatataaaccac

SEQ ID NO: 7824501 - DNA, 22 bp, Homo sapiens
atacactactaagcacagattg

SEQ ID NO: 7824502 - DNA, 22 bp, Homo sapiens
atacacgtgtgtgtacatgcac

SEQ ID NO: 7824503 - DNA, 19 bp, Homo sapiens
atacactaatataaaccac

SEQ ID NO: 7824504 - DNA, 22 bp, Homo sapiens
atacacagctacattgaacaat

SEQ ID NO: 7824505 - DNA, 22 bp, Homo sapiens
atacacatttgctagagatggg

SEQ ID NO: 7824506 - DNA, 22 bp, Homo sapiens
atacacatttgctagagatggg

SEQ ID NO: 7824507 - DNA, 22 bp, Homo sapiens
atacacagctacattgaacaat

SEQ ID NO: 7824508 - DNA, 22 bp, Homo sapiens
atacacagcgatgagaggaggc

SEQ ID NO: 7824509 - DNA, 22 bp, Homo sapiens
atacacagctacattgaacaat

SEQ ID NO: 7824510 - DNA, 22 bp, Homo sapiens
atacacactgctatcctttttt

SEQ ID NO: 7824511 - DNA, 22 bp, Homo sapiens
atacacactgctatcctttttt

SEQ ID NO: 7824512 - DNA, 22 bp, Homo sapiens
atacacagccattatgaattag

SEQ ID NO: 7824513 - DNA, 22 bp, Homo sapiens
atacacagccattatgaattag

SEQ ID NO: 7824514 - DNA, 22 bp, Homo sapiens
atacacagccattatgaattag

SEQ ID NO: 7824515 - DNA, 22 bp, Homo sapiens
atacacagccattatgaattag

SEQ ID NO: 7824516 - DNA, 22 bp, Homo sapiens
atacacagcgatgagaggaggc

SEQ ID NO: 7824517 - DNA, 22 bp, Homo sapiens
atacacagcgatgagaggaggc

SEQ ID NO: 7824518 - DNA, 22 bp, Homo sapiens
atacaagttgtgataatgtaaa

SEQ ID NO: 7824519 - DNA, 22 bp, Homo sapiens
atacaagttgcccaaatgatta

SEQ ID NO: 7824520 - DNA, 22 bp, Homo sapiens
atacaagttgtgataatgtaaa

SEQ ID NO: 7824521 - DNA, 22 bp, Homo sapiens
atacaagttgtgataatgtaaa

SEQ ID NO: 7824522 - DNA, 22 bp, Homo sapiens
atacaaagacaaatctcaatct

SEQ ID NO: 7824523 - DNA, 20 bp, Homo sapiens
atacaaagagattgatgtat

SEQ ID NO: 7824524 - DNA, 20 bp, Homo sapiens
atacaaagagattgatgtat

SEQ ID NO: 7824525 - DNA, 22 bp, Homo sapiens
ataaggtataaggcctattttt

SEQ ID NO: 7824526 - DNA, 22 bp, Homo sapiens
ataaggtagcaagcacagtcct

SEQ ID NO: 7824527 - DNA, 22 bp, Homo sapiens
ataaggctgaaagcagggagct

SEQ ID NO: 7824528 - DNA, 22 bp, Homo sapiens
ataaggcatatagtcacttttt

SEQ ID NO: 7824529 - DNA, 23 bp, Homo sapiens
ataaggcataaaggtacattgga

SEQ ID NO: 7824530 - DNA, 23 bp, Homo sapiens
ataaggcataaaggtacattgga

SEQ ID NO: 7824531 - DNA, 23 bp, Homo sapiens
ataaggcataaaggtacattgga

SEQ ID NO: 7824532 - DNA, 22 bp, Homo sapiens
ataaggcagtgacttcatctat

SEQ ID NO: 7824533 - DNA, 19 bp, Homo sapiens
ataaggcaggaggaaattt

SEQ ID NO: 7824534 - DNA, 22 bp, Homo sapiens
ataaggcagtcactggaatgtt

SEQ ID NO: 7824535 - DNA, 22 bp, Homo sapiens
ataaggcagtcccttaacaagg

SEQ ID NO: 7824536 - DNA, 22 bp, Homo sapiens
ataaggacacccttctctttac

SEQ ID NO: 7824537 - DNA, 22 bp, Homo sapiens
ataaggaatttagaatagggaa

SEQ ID NO: 7824538 - DNA, 22 bp, Homo sapiens
ataaggaagttgcagaagtgga

SEQ ID NO: 7824539 - DNA, 22 bp, Homo sapiens
ataaggaagttgcagaagtgga

SEQ ID NO: 7824540 - DNA, 22 bp, Homo sapiens
ataaggaagatgtcctcatctg

SEQ ID NO: 7824541 - DNA, 22 bp, Homo sapiens
ataaggaatgatgtatcagttt

SEQ ID NO: 7824542 - DNA, 22 bp, Homo sapiens
ataaggaatgatgtatcagttt

SEQ ID NO: 7824543 - DNA, 22 bp, Homo sapiens
ataaggaatgatgtatcagttt

SEQ ID NO: 7824544 - DNA, 22 bp, Homo sapiens
ataaggcacacatagatagggt

SEQ ID NO: 7824545 - DNA, 22 bp, Homo sapiens
ataaggcagaaatagggaaagt

SEQ ID NO: 7824546 - DNA, 22 bp, Homo sapiens
ataaggcagaaatagggaaagt

SEQ ID NO: 7824547 - DNA, 22 bp, Homo sapiens
ataaggcagaaatagggaaagt

SEQ ID NO: 7824548 - DNA, 22 bp, Homo sapiens
ataaggcagaaatgattctagt

SEQ ID NO: 7824549 - DNA, 22 bp, Homo sapiens
ataaggcagaaatgattctagt

SEQ ID NO: 7824550 - DNA, 22 bp, Homo sapiens
ataaggcacacatagatagggt

SEQ ID NO: 7824551 - DNA, 22 bp, Homo sapiens
ataaggcacacatagatagggt

SEQ ID NO: 7824552 - DNA, 22 bp, Homo sapiens
ataaggacttgaattagacatt

SEQ ID NO: 7824553 - DNA, 22 bp, Homo sapiens
ataaggacttgaattagacatt

SEQ ID NO: 7824554 - DNA, 22 bp, Homo sapiens
ataaggcaagctgtcagtttgt

SEQ ID NO: 7824555 - DNA, 22 bp, Homo sapiens
ataaggaacctgggcttaagag

SEQ ID NO: 7824556 - DNA, 22 bp, Homo sapiens
ataaggaagatgtcctcatctg

SEQ ID NO: 7824557 - DNA, 22 bp, Homo sapiens
ataaggaacctgggcttaagag

SEQ ID NO: 7824558 - DNA, 22 bp, Homo sapiens
ataaggaagatgtcctcatctg

SEQ ID NO: 7824559 - DNA, 22 bp, Homo sapiens
ataaggaaatgaaactctaata

SEQ ID NO: 7824560 - DNA, 22 bp, Homo sapiens
ataaggaaaattggagaaattg

SEQ ID NO: 7824561 - DNA, 22 bp, Homo sapiens
ataaggaaaattggagaaattg

SEQ ID NO: 7824562 - DNA, 22 bp, Homo sapiens
ataaggaaaattggagaaattg

SEQ ID NO: 7824563 - DNA, 22 bp, Homo sapiens
ataaggaaatgaaactctaata

SEQ ID NO: 7824564 - DNA, 22 bp, Homo sapiens
ataaggaaaattggagaaattg

SEQ ID NO: 7824565 - DNA, 22 bp, Homo sapiens
ataacagagagctactgaactg

SEQ ID NO: 7824566 - DNA, 22 bp, Homo sapiens
ataacagagagctactgaactg

SEQ ID NO: 7824567 - DNA, 22 bp, Homo sapiens
ataagctttgctggagagacct

SEQ ID NO: 7824568 - DNA, 22 bp, Homo sapiens
agttgaatgttacagttctaaa

SEQ ID NO: 7824569 - DNA, 20 bp, Homo sapiens
agttgaatcctaaggtattg

SEQ ID NO: 7824570 - DNA, 22 bp, Homo sapiens
agttgaaattaagagagagttt

SEQ ID NO: 7824571 - DNA, 22 bp, Homo sapiens
agttgaaggttggctgatccat

SEQ ID NO: 7824572 - DNA, 22 bp, Homo sapiens
agttgaagtcttcaataagctt

SEQ ID NO: 7824573 - DNA, 22 bp, Homo sapiens
agttgaagtcttcaataagctt

SEQ ID NO: 7824574 - DNA, 22 bp, Homo sapiens
agttcttttgtgaacatatgct

SEQ ID NO: 7824575 - DNA, 22 bp, Homo sapiens
agttcttttgtgaacatatgct

SEQ ID NO: 7824576 - DNA, 22 bp, Homo sapiens
agttcttttgtgaacatatgct

SEQ ID NO: 7824577 - DNA, 22 bp, Homo sapiens
agttcttttctagattctggat

SEQ ID NO: 7824578 - DNA, 22 bp, Homo sapiens
agttctttgtaaaaggtctcta

SEQ ID NO: 7824579 - DNA, 23 bp, Homo sapiens
agttcataatttcttatttgtgt

SEQ ID NO: 7824580 - DNA, 22 bp, Homo sapiens
agttcagtagtccttcattgta

SEQ ID NO: 7824581 - DNA, 22 bp, Homo sapiens
agttctttgtcatctctggagt

SEQ ID NO: 7824582 - DNA, 22 bp, Homo sapiens
agttctttgtcatctctggagt

SEQ ID NO: 7824583 - DNA, 22 bp, Homo sapiens
agttctttgtgagtaatacaga

SEQ ID NO: 7824584 - DNA, 22 bp, Homo sapiens
agttcagtagtccttcattgta

SEQ ID NO: 7824585 - DNA, 22 bp, Homo sapiens
agttcagtagtccttcattgta

SEQ ID NO: 7824586 - DNA, 22 bp, Homo sapiens
agttcaggcataaggcatgaac

SEQ ID NO: 7824587 - DNA, 22 bp, Homo sapiens
agttcagaggttaatttatttg

SEQ ID NO: 7824588 - DNA, 22 bp, Homo sapiens
agttcagcaaataaaacatagt

SEQ ID NO: 7824589 - DNA, 22 bp, Homo sapiens
agttcactccagatgttctgac

SEQ ID NO: 7824590 - DNA, 22 bp, Homo sapiens
agttcactttctgtagtggaag

SEQ ID NO: 7824591 - DNA, 22 bp, Homo sapiens
agttcagagtaaatgttgaagg

SEQ ID NO: 7824592 - DNA, 22 bp, Homo sapiens
agttcacatatctgttttattt

SEQ ID NO: 7824593 - DNA, 22 bp, Homo sapiens
agttcacatatctgttttattt

SEQ ID NO: 7824594 - DNA, 22 bp, Homo sapiens
agttcacattccgaggtactgg

SEQ ID NO: 7824595 - DNA, 22 bp, Homo sapiens
agttcacagccatgttcatgtg

SEQ ID NO: 7824596 - DNA, 20 bp, Homo sapiens
agttcacaggccaaatttct

SEQ ID NO: 7824597 - DNA, 22 bp, Homo sapiens
agttcacaatagaagaggtggc

SEQ ID NO: 7824598 - DNA, 22 bp, Homo sapiens
agttcacaagcgtaggtgctga

SEQ ID NO: 7824599 - DNA, 22 bp, Homo sapiens
agttcacaagtgcatttcagga

SEQ ID NO: 7824600 - DNA, 22 bp, Homo sapiens
ataaattttcttgctgtactta

SEQ ID NO: 7824601 - DNA, 22 bp, Homo sapiens
ataaatttataattgtttcctg

SEQ ID NO: 7824602 - DNA, 22 bp, Homo sapiens
ataaatttataattgtttcctg

SEQ ID NO: 7824603 - DNA, 22 bp, Homo sapiens
ataacaatagtggtagtgctgg

SEQ ID NO: 7824604 - DNA, 22 bp, Homo sapiens
ataacaatagtggtagtgctgg

SEQ ID NO: 7824605 - DNA, 22 bp, Homo sapiens
ataacaatagtggtagtgctgg

SEQ ID NO: 7824606 - DNA, 22 bp, Homo sapiens
ataacaatagtggtagtgctgg

SEQ ID NO: 7824607 - DNA, 22 bp, Homo sapiens
ataacaatagtggtagtgctgg

SEQ ID NO: 7824608 - DNA, 22 bp, Homo sapiens
ataacaagtatttattgagcat

SEQ ID NO: 7824609 - DNA, 20 bp, Homo sapiens
ataacaaggctctgcaagct

SEQ ID NO: 7824610 - DNA, 22 bp, Homo sapiens
ataacaagtatttattgagcat

SEQ ID NO: 7824611 - DNA, 22 bp, Homo sapiens
ataacagacttagagttacaag

SEQ ID NO: 7824612 - DNA, 22 bp, Homo sapiens
ataacagacttagagttacaag

SEQ ID NO: 7824613 - DNA, 22 bp, Homo sapiens
ataacagagagctactgaactg

SEQ ID NO: 7824614 - DNA, 22 bp, Homo sapiens
ataacactaaatgtatgtaaca

SEQ ID NO: 7824615 - DNA, 22 bp, Homo sapiens
ataacactaaatgtatgtaaca

SEQ ID NO: 7824616 - DNA, 22 bp, Homo sapiens
ataacactaaatgtatgtaaca

SEQ ID NO: 7824617 - DNA, 22 bp, Homo sapiens
ataacactaaatgtatgtaaca

SEQ ID NO: 7824618 - DNA, 22 bp, Homo sapiens
ataacagactgatttttaaatg

SEQ ID NO: 7824619 - DNA, 22 bp, Homo sapiens
agttgcagacgcagagatgttg

SEQ ID NO: 7824620 - DNA, 22 bp, Homo sapiens
agttgcagacgcagagatgttg

SEQ ID NO: 7824621 - DNA, 22 bp, Homo sapiens
agttgcagacgcagagatgttg

SEQ ID NO: 7824622 - DNA, 22 bp, Homo sapiens
agttgcagacgcagagatgttg

SEQ ID NO: 7824623 - DNA, 19 bp, Homo sapiens
ataaataaaaagtgggaga

SEQ ID NO: 7824624 - DNA, 22 bp, Homo sapiens
agttgcagacgcagagatgttg

SEQ ID NO: 7824625 - DNA, 22 bp, Homo sapiens
agttgagggtgggagagaaatg

SEQ ID NO: 7824626 - DNA, 22 bp, Homo sapiens
agttgcagacgcagagatgttg

SEQ ID NO: 7824627 - DNA, 22 bp, Homo sapiens
agttgcagacgcagagatgttg

SEQ ID NO: 7824628 - DNA, 22 bp, Homo sapiens
agttgcagacgcagagatgttg

SEQ ID NO: 7824629 - DNA, 22 bp, Homo sapiens
agttgcagacgcagagatgttg

SEQ ID NO: 7824630 - DNA, 22 bp, Homo sapiens
agttgcagacgcagagatgttg

SEQ ID NO: 7824631 - DNA, 22 bp, Homo sapiens
ataaattatgaatggccctttt

SEQ ID NO: 7824632 - DNA, 22 bp, Homo sapiens
ataaattatgaatggccctttt

SEQ ID NO: 7824633 - DNA, 22 bp, Homo sapiens
ataaattctctgatgtatagta

SEQ ID NO: 7824634 - DNA, 22 bp, Homo sapiens
ataaattcaaagcatttaggac

SEQ ID NO: 7824635 - DNA, 22 bp, Homo sapiens
ataaattctctgatgtatagta

SEQ ID NO: 7824636 - DNA, 21 bp, Homo sapiens
ataaattctgagaggctctgc

SEQ ID NO: 7824637 - DNA, 22 bp, Homo sapiens
ataaatttataattgtttcctg

SEQ ID NO: 7824638 - DNA, 22 bp, Homo sapiens
ataaattgtgcttttgacatct

SEQ ID NO: 7824639 - DNA, 22 bp, Homo sapiens
ataaattgtgcttttgacatct

SEQ ID NO: 7824640 - DNA, 23 bp, Homo sapiens
atagttatgctgcatgcatgtac

SEQ ID NO: 7824641 - DNA, 23 bp, Homo sapiens
atagttatgctgcatgcatgtac

SEQ ID NO: 7824642 - DNA, 23 bp, Homo sapiens
atagttatgctgcatgcatgtac

SEQ ID NO: 7824643 - DNA, 22 bp, Homo sapiens
atagttatttctgtcactgtca

SEQ ID NO: 7824644 - DNA, 22 bp, Homo sapiens
atagttcactaatagcaaaagc

SEQ ID NO: 7824645 - DNA, 22 bp, Homo sapiens
atagttctagacctatagttct

SEQ ID NO: 7824646 - DNA, 22 bp, Homo sapiens
atagttctagacctatagttct

SEQ ID NO: 7824647 - DNA, 22 bp, Homo sapiens
atagttccagcatctttggtaa

SEQ ID NO: 7824648 - DNA, 22 bp, Homo sapiens
atagttcctactttgcactaat

SEQ ID NO: 7824649 - DNA, 22 bp, Homo sapiens
atagttggtccatgaaaaaagt

SEQ ID NO: 7824650 - DNA, 22 bp, Homo sapiens
atagttgagatcagattcaact

SEQ ID NO: 7824651 - DNA, 22 bp, Homo sapiens
atagttctcactcagaatttga

SEQ ID NO: 7824652 - DNA, 22 bp, Homo sapiens
atagttctggatgtacttatag

SEQ ID NO: 7824653 - DNA, 22 bp, Homo sapiens
agaaaacttgtcacagctctca

SEQ ID NO: 7824654 - DNA, 22 bp, Homo sapiens
agaaaacttgtcacagctctca

SEQ ID NO: 7824655 - DNA, 22 bp, Homo sapiens
agaaaacttgtcacagctctca

SEQ ID NO: 7824656 - DNA, 17 bp, Homo sapiens
agaaaagagaccagcag

SEQ ID NO: 7824657 - DNA, 22 bp, Homo sapiens
agaaaacttgtcacagctctca

SEQ ID NO: 7824658 - DNA, 22 bp, Homo sapiens
agaaaacttgtcacagctctca

SEQ ID NO: 7824659 - DNA, 22 bp, Homo sapiens
agaaaacttgctcgagcctgtt

SEQ ID NO: 7824660 - DNA, 22 bp, Homo sapiens
agaaaactgggaggagagcttc

SEQ ID NO: 7824661 - DNA, 22 bp, Homo sapiens
agaaaacttgctcgagcctgtt

SEQ ID NO: 7824662 - DNA, 20 bp, Homo sapiens
agaaaaagtgtggaaatttc

SEQ ID NO: 7824663 - DNA, 20 bp, Homo sapiens
agaaaaagtgtggaaatttc

SEQ ID NO: 7824664 - DNA, 20 bp, Homo sapiens
agaaaaagtgtggaaatttc

SEQ ID NO: 7824665 - DNA, 20 bp, Homo sapiens
agaaaaagtgtggaaatttc

SEQ ID NO: 7824666 - DNA, 20 bp, Homo sapiens
agaaaaagtgtggaaatttc

SEQ ID NO: 7824667 - DNA, 20 bp, Homo sapiens
agaaaaagtgtggaaatttc

SEQ ID NO: 7824668 - DNA, 20 bp, Homo sapiens
agaaaaagtgtggaaatttc

SEQ ID NO: 7824669 - DNA, 20 bp, Homo sapiens
agaaaaagtgtggaaatttc

SEQ ID NO: 7824670 - DNA, 20 bp, Homo sapiens
agaaaaagtgtggaaatttc

SEQ ID NO: 7824671 - DNA, 22 bp, Homo sapiens
agaaaaggcttgaagaggtttt

SEQ ID NO: 7824672 - DNA, 22 bp, Homo sapiens
agaaaaggattgatggatcaga

SEQ ID NO: 7824673 - DNA, 22 bp, Homo sapiens
agaaaaggattgatggatcaga

SEQ ID NO: 7824674 - DNA, 22 bp, Homo sapiens
agaaaaggattgatggatcaga

SEQ ID NO: 7824675 - DNA, 23 bp, Homo sapiens
agaaaagcttggacacatggcct

SEQ ID NO: 7824676 - DNA, 23 bp, Homo sapiens
agaaaagcttggacacatggcct

SEQ ID NO: 7824677 - DNA, 23 bp, Homo sapiens
agaaaagcttggacacatggcct

SEQ ID NO: 7824678 - DNA, 22 bp, Homo sapiens
agaaaagcggtcaggaccctca

SEQ ID NO: 7824679 - DNA, 22 bp, Homo sapiens
agaaaagcggtcaggaccctca

SEQ ID NO: 7824680 - DNA, 22 bp, Homo sapiens
agaaaagcggtcaggaccctca

SEQ ID NO: 7824681 - DNA, 23 bp, Homo sapiens
agaaaagcttggacacatggcct

SEQ ID NO: 7824682 - DNA, 22 bp, Homo sapiens
agaaaagaggctttctaagcat

SEQ ID NO: 7824683 - DNA, 22 bp, Homo sapiens
agaaaagaggctttctaagcat

SEQ ID NO: 7824684 - DNA, 22 bp, Homo sapiens
agaaaagaggctttctaagcat

SEQ ID NO: 7824685 - DNA, 22 bp, Homo sapiens
agaaaagaggctttctaagcat

SEQ ID NO: 7824686 - DNA, 22 bp, Homo sapiens
agaaaagaggctttctaagcat

SEQ ID NO: 7824687 - DNA, 22 bp, Homo sapiens
agaaaagaggctttctaagcat

SEQ ID NO: 7824688 - DNA, 22 bp, Homo sapiens
agaaaagaggctttctaagcat

SEQ ID NO: 7824689 - DNA, 17 bp, Homo sapiens
agaaaagagaccagcag

SEQ ID NO: 7824690 - DNA, 17 bp, Homo sapiens
agaaaagagaccagcag

SEQ ID NO: 7824691 - DNA, 17 bp, Homo sapiens
agaaaagagaccagcag

SEQ ID NO: 7824692 - DNA, 22 bp, Homo sapiens
atagctgtagaatgtatacaca

SEQ ID NO: 7824693 - DNA, 22 bp, Homo sapiens
atagctactgatgacacacaca

SEQ ID NO: 7824694 - DNA, 22 bp, Homo sapiens
atagctgtagaatgtatacaca

SEQ ID NO: 7824695 - DNA, 22 bp, Homo sapiens
atagccagcatatagcagggag

SEQ ID NO: 7824696 - DNA, 22 bp, Homo sapiens
atagccagcatatagcagggag

SEQ ID NO: 7824697 - DNA, 22 bp, Homo sapiens
atagccaggagatgatggggga

SEQ ID NO: 7824698 - DNA, 22 bp, Homo sapiens
atagccaggagatgatggggga

SEQ ID NO: 7824699 - DNA, 22 bp, Homo sapiens
atagccaggtcacagagctagc

SEQ ID NO: 7824700 - DNA, 22 bp, Homo sapiens
atagctgttgccaatttccatg

SEQ ID NO: 7824701 - DNA, 22 bp, Homo sapiens
atagctgttgccaatttccatg

SEQ ID NO: 7824702 - DNA, 22 bp, Homo sapiens
atagctgtgggctatttgtggg

SEQ ID NO: 7824703 - DNA, 22 bp, Homo sapiens
atagctttttgtcatagagtct

SEQ ID NO: 7824704 - DNA, 22 bp, Homo sapiens
atagctttcttaaatatataaa

SEQ ID NO: 7824705 - DNA, 22 bp, Homo sapiens
atagctttcttaaatatataaa

SEQ ID NO: 7824706 - DNA, 22 bp, Homo sapiens
atagctttcttaaatatataaa

SEQ ID NO: 7824707 - DNA, 22 bp, Homo sapiens
atagctttcttaaatatataaa

SEQ ID NO: 7824708 - DNA, 22 bp, Homo sapiens
atagctttttgtcatagagtct

SEQ ID NO: 7824709 - DNA, 22 bp, Homo sapiens
ataggaaagaaaattatgtagg

SEQ ID NO: 7824710 - DNA, 22 bp, Homo sapiens
ataggaaagaaaattatgtagg

SEQ ID NO: 7824711 - DNA, 22 bp, Homo sapiens
ataggaaagaatggagggtggg

SEQ ID NO: 7824712 - DNA, 22 bp, Homo sapiens
ataggaaagaatggagggtggg

SEQ ID NO: 7824713 - DNA, 20 bp, Homo sapiens
ataggaaagggaggggcttt

SEQ ID NO: 7824714 - DNA, 22 bp, Homo sapiens
atagtgttagagccagtatgtt

SEQ ID NO: 7824715 - DNA, 22 bp, Homo sapiens
atagtgttgatagcagtggagt

SEQ ID NO: 7824716 - DNA, 22 bp, Homo sapiens
atagtgttgatagcagtggagt

SEQ ID NO: 7824717 - DNA, 22 bp, Homo sapiens
atagtgtgtggtataggtagag

SEQ ID NO: 7824718 - DNA, 22 bp, Homo sapiens
atagtgttacccttcttaaagt

SEQ ID NO: 7824719 - DNA, 22 bp, Homo sapiens
atagtgtgttagtgacataggc

SEQ ID NO: 7824720 - DNA, 22 bp, Homo sapiens
atagtgtgtggtataggtagag

SEQ ID NO: 7824721 - DNA, 22 bp, Homo sapiens
atagtgtgttagtgacataggc

SEQ ID NO: 7824722 - DNA, 22 bp, Homo sapiens
atagtgttgtatgtacagtctg

SEQ ID NO: 7824723 - DNA, 22 bp, Homo sapiens
atagtgttgtatgtacagtctg

SEQ ID NO: 7824724 - DNA, 22 bp, Homo sapiens
atagttacaaagactttttaaa

SEQ ID NO: 7824725 - DNA, 22 bp, Homo sapiens
atagttacaaagactttttaaa

SEQ ID NO: 7824726 - DNA, 22 bp, Homo sapiens
atagttacatacagaaatattt

SEQ ID NO: 7824727 - DNA, 22 bp, Homo sapiens
atagttacatacagaaatattt

SEQ ID NO: 7824728 - DNA, 23 bp, Homo sapiens
atagttagcacacttacaactgc

SEQ ID NO: 7824729 - DNA, 22 bp, Homo sapiens
atagttatgctctagacaagaa

SEQ ID NO: 7824730 - DNA, 22 bp, Homo sapiens
atagttatgctctagacaagaa

SEQ ID NO: 7824731 - DNA, 22 bp, Homo sapiens
atagtgtgactgaggagttgaa

SEQ ID NO: 7824732 - DNA, 22 bp, Homo sapiens
atagtgtcagaaaatcataaga

SEQ ID NO: 7824733 - DNA, 22 bp, Homo sapiens
atagtgtgactgaggagttgaa

SEQ ID NO: 7824734 - DNA, 22 bp, Homo sapiens
atagtgtgtaaagtgcagtgat

SEQ ID NO: 7824735 - DNA, 22 bp, Homo sapiens
atagtgtgtgattgcttcctca

SEQ ID NO: 7824736 - DNA, 22 bp, Homo sapiens
atagtgtgtaaagtgcagtgat

SEQ ID NO: 7824737 - DNA, 22 bp, Homo sapiens
atagtgtctttcttcacaggca

SEQ ID NO: 7824738 - DNA, 22 bp, Homo sapiens
ataggcaaattaataagtcata

SEQ ID NO: 7824739 - DNA, 22 bp, Homo sapiens
ataggcaagcacaaagtcagga

SEQ ID NO: 7824740 - DNA, 22 bp, Homo sapiens
ataggagatcaatatgcaattt

SEQ ID NO: 7824741 - DNA, 22 bp, Homo sapiens
ataggacaagactgaccctggt

SEQ ID NO: 7824742 - DNA, 20 bp, Homo sapiens
actttactgagctgtaattc

SEQ ID NO: 7824743 - DNA, 22 bp, Homo sapiens
actttagaaaagcatccataga

SEQ ID NO: 7824744 - DNA, 22 bp, Homo sapiens
actttagaaaagcatccataga

SEQ ID NO: 7824745 - DNA, 22 bp, Homo sapiens
actttactccccaacataaatg

SEQ ID NO: 7824746 - DNA, 22 bp, Homo sapiens
actttactcttcatatgtgaca

SEQ ID NO: 7824747 - DNA, 22 bp, Homo sapiens
actttagagaaatgtagaagta

SEQ ID NO: 7824748 - DNA, 22 bp, Homo sapiens
actttagagaaatgtagaagta

SEQ ID NO: 7824749 - DNA, 22 bp, Homo sapiens
actttagaccatcttccacagt

SEQ ID NO: 7824750 - DNA, 22 bp, Homo sapiens
actttagaagtaaggatgagtt

SEQ ID NO: 7824751 - DNA, 22 bp, Homo sapiens
actttagaaaaggaacagagga

SEQ ID NO: 7824752 - DNA, 22 bp, Homo sapiens
atagcatggcctgtgacacttt

SEQ ID NO: 7824753 - DNA, 22 bp, Homo sapiens
atagatgtcattgtcatccatc

SEQ ID NO: 7824754 - DNA, 22 bp, Homo sapiens
atagcatataagttataaaact

SEQ ID NO: 7824755 - DNA, 22 bp, Homo sapiens
atagatgtgtgtaagtacataa

SEQ ID NO: 7824756 - DNA, 22 bp, Homo sapiens
actttagatattcctctgtaca

SEQ ID NO: 7824757 - DNA, 22 bp, Homo sapiens
atagatccagaaaatttattat

SEQ ID NO: 7824758 - DNA, 23 bp, Homo sapiens
actttagataaattatgtgcaca

SEQ ID NO: 7824759 - DNA, 23 bp, Homo sapiens
actttagataaattatgtgcaca

SEQ ID NO: 7824760 - DNA, 22 bp, Homo sapiens
actttagatattcctctgtaca

SEQ ID NO: 7824761 - DNA, 22 bp, Homo sapiens
actttagatattcctctgtaca

SEQ ID NO: 7824762 - DNA, 22 bp, Homo sapiens
actttacaggcacttcaagtat

SEQ ID NO: 7824763 - DNA, 22 bp, Homo sapiens
actttacaggcacttcaagtat

SEQ ID NO: 7824764 - DNA, 22 bp, Homo sapiens
actttacaggcacttcaagtat

SEQ ID NO: 7824765 - DNA, 22 bp, Homo sapiens
actttacaggcacttcaagtat

SEQ ID NO: 7824766 - DNA, 22 bp, Homo sapiens
actttacatttgatctctctaa

SEQ ID NO: 7824767 - DNA, 22 bp, Homo sapiens
actttactacatccacagatgg

SEQ ID NO: 7824768 - DNA, 22 bp, Homo sapiens
actttactcaacaaatatttat

SEQ ID NO: 7824769 - DNA, 22 bp, Homo sapiens
actttactacatccacagatgg

SEQ ID NO: 7824770 - DNA, 22 bp, Homo sapiens
atagaatagcatagaaaattga

SEQ ID NO: 7824771 - DNA, 22 bp, Homo sapiens
atagaatagcatagaaaattga

SEQ ID NO: 7824772 - DNA, 22 bp, Homo sapiens
atagaatagcatagaaaattga

SEQ ID NO: 7824773 - DNA, 22 bp, Homo sapiens
atagaatagcatagaaaattga

SEQ ID NO: 7824774 - DNA, 22 bp, Homo sapiens
atagaataatggttgtcaggag

SEQ ID NO: 7824775 - DNA, 22 bp, Homo sapiens
atagaatacatttcatggagat

SEQ ID NO: 7824776 - DNA, 22 bp, Homo sapiens
atagaatacatttcatggagat

SEQ ID NO: 7824777 - DNA, 22 bp, Homo sapiens
atagaataaggcacagattctt

SEQ ID NO: 7824778 - DNA, 22 bp, Homo sapiens
atagaataaggcacagattctt

SEQ ID NO: 7824779 - DNA, 22 bp, Homo sapiens
atacacttccaaatattgatta

SEQ ID NO: 7824780 - DNA, 22 bp, Homo sapiens
atacacttccaaatattgatta

SEQ ID NO: 7824781 - DNA, 22 bp, Homo sapiens
atacacttccaaatattgatta

SEQ ID NO: 7824782 - DNA, 22 bp, Homo sapiens
atacactgttcactagatcttc

SEQ ID NO: 7824783 - DNA, 22 bp, Homo sapiens
atacactgttcactagatcttc

SEQ ID NO: 7824784 - DNA, 22 bp, Homo sapiens
atacacttcatgttttcatctg

SEQ ID NO: 7824785 - DNA, 22 bp, Homo sapiens
atacacttcatgttttcatctg

SEQ ID NO: 7824786 - DNA, 22 bp, Homo sapiens
atacactgttcactagatcttc

SEQ ID NO: 7824787 - DNA, 22 bp, Homo sapiens
atacactgttcactagatcttc

SEQ ID NO: 7824788 - DNA, 22 bp, Homo sapiens
atacactggacatcattgcatt

SEQ ID NO: 7824789 - DNA, 22 bp, Homo sapiens
atacactggtttatgatattgt

SEQ ID NO: 7824790 - DNA, 22 bp, Homo sapiens
atacactggtttatgatattgt

SEQ ID NO: 7824791 - DNA, 22 bp, Homo sapiens
atacactggtttatgatattgt

SEQ ID NO: 7824792 - DNA, 22 bp, Homo sapiens
atacactggtttatgatattgt

SEQ ID NO: 7824793 - DNA, 22 bp, Homo sapiens
atacactggacatcattgcatt

SEQ ID NO: 7824794 - DNA, 22 bp, Homo sapiens
atacactgctgccacacagctg

SEQ ID NO: 7824795 - DNA, 22 bp, Homo sapiens
atacactgatctttttatgggg

SEQ ID NO: 7824796 - DNA, 22 bp, Homo sapiens
atagaaatgtattttggactag

SEQ ID NO: 7824797 - DNA, 22 bp, Homo sapiens
atagaacaaggtagacagcttt

SEQ ID NO: 7824798 - DNA, 22 bp, Homo sapiens
atacttacttttcttcagacta

SEQ ID NO: 7824799 - DNA, 22 bp, Homo sapiens
atagaaatgtattttggactag

SEQ ID NO: 7824800 - DNA, 22 bp, Homo sapiens
atactgttttgtgacttatctt

SEQ ID NO: 7824801 - DNA, 22 bp, Homo sapiens
atacttaactgtggagtcattg

SEQ ID NO: 7824802 - DNA, 22 bp, Homo sapiens
atacacttgacctggagtgaag

SEQ ID NO: 7824803 - DNA, 22 bp, Homo sapiens
atacacttgacctggagtgaag

SEQ ID NO: 7824804 - DNA, 20 bp, Homo sapiens
atacacttgcccagcttgtg

SEQ ID NO: 7824805 - DNA, 22 bp, Homo sapiens
atacacttgacctggagtgaag

SEQ ID NO: 7824806 - DNA, 22 bp, Homo sapiens
atactgttggctttggtgatgg

SEQ ID NO: 7824807 - DNA, 22 bp, Homo sapiens
atactgtttctcttctacatga

SEQ ID NO: 7824808 - DNA, 22 bp, Homo sapiens
atagaagatagcttttgtttct

SEQ ID NO: 7824809 - DNA, 22 bp, Homo sapiens
atagaagatagcttttgtttct

SEQ ID NO: 7824810 - DNA, 23 bp, Homo sapiens
atagaagattattgcaacagtcc

SEQ ID NO: 7824811 - DNA, 23 bp, Homo sapiens
atagaagattattgcaacagtcc

SEQ ID NO: 7824812 - DNA, 22 bp, Homo sapiens
atagaagcaagaacagaatgga

SEQ ID NO: 7824813 - DNA, 22 bp, Homo sapiens
atagaagaggaaactgaggttg

SEQ ID NO: 7824814 - DNA, 22 bp, Homo sapiens
atagaagaggaaactgaggttg

SEQ ID NO: 7824815 - DNA, 22 bp, Homo sapiens
atagaagcaagaacagaatgga

SEQ ID NO: 7824816 - DNA, 22 bp, Homo sapiens
atagaagcaagaacagaatgga

SEQ ID NO: 7824817 - DNA, 22 bp, Homo sapiens
atagaagctgataaactacttc

SEQ ID NO: 7824818 - DNA, 22 bp, Homo sapiens
atagaagctgataaactacttc

SEQ ID NO: 7824819 - DNA, 22 bp, Homo sapiens
atagaagtatcaagatcttgaa

SEQ ID NO: 7824820 - DNA, 20 bp, Homo sapiens
atagaagtattatgtaatgt

SEQ ID NO: 7824821 - DNA, 20 bp, Homo sapiens
atagaagtattatgtaatgt

SEQ ID NO: 7824822 - DNA, 22 bp, Homo sapiens
atagaacaaggtagacagcttt

SEQ ID NO: 7824823 - DNA, 22 bp, Homo sapiens
atagaacaaggtagacagcttt

SEQ ID NO: 7824824 - DNA, 21 bp, Homo sapiens
atagaacaccaggcatatata

SEQ ID NO: 7824825 - DNA, 22 bp, Homo sapiens
atagaacagaaacagatgcaca

SEQ ID NO: 7824826 - DNA, 22 bp, Homo sapiens
atagaacagaaacagatgcaca

SEQ ID NO: 7824827 - DNA, 22 bp, Homo sapiens
atagaacagaaacagatgcaca

SEQ ID NO: 7824828 - DNA, 22 bp, Homo sapiens
atagaacagaaacagatgcaca

SEQ ID NO: 7824829 - DNA, 22 bp, Homo sapiens
atagaacaggggcaggagcatt

SEQ ID NO: 7824830 - DNA, 22 bp, Homo sapiens
atagaacaggggcaggagcatt

SEQ ID NO: 7824831 - DNA, 22 bp, Homo sapiens
atagaacagggcactgtcatga

SEQ ID NO: 7824832 - DNA, 22 bp, Homo sapiens
atagaactccatccctctgacc

SEQ ID NO: 7824833 - DNA, 22 bp, Homo sapiens
atagaactccatccctctgacc

SEQ ID NO: 7824834 - DNA, 19 bp, Homo sapiens
atagaacctgcagtttcaa

SEQ ID NO: 7824835 - DNA, 22 bp, Homo sapiens
atagaacctgttgtgaaattca

SEQ ID NO: 7824836 - DNA, 19 bp, Homo sapiens
atagaacctgcagtttcaa

SEQ ID NO: 7824837 - DNA, 22 bp, Homo sapiens
atagaaccacccagagcctttt

SEQ ID NO: 7824838 - DNA, 22 bp, Homo sapiens
atagaacataattctcagccct

SEQ ID NO: 7824839 - DNA, 22 bp, Homo sapiens
atagaacataattctcagccct

SEQ ID NO: 7824840 - DNA, 22 bp, Homo sapiens
atatagatcaaatgatgctaat

SEQ ID NO: 7824841 - DNA, 22 bp, Homo sapiens
atatagcacttgttttgcatgt

SEQ ID NO: 7824842 - DNA, 22 bp, Homo sapiens
atatagcacttgttttgcatgt

SEQ ID NO: 7824843 - DNA, 19 bp, Homo sapiens
atatagcattattcaattt

SEQ ID NO: 7824844 - DNA, 21 bp, Homo sapiens
atatagcgtgtctacatgtta

SEQ ID NO: 7824845 - DNA, 19 bp, Homo sapiens
atatagcattattcaattt

SEQ ID NO: 7824846 - DNA, 22 bp, Homo sapiens
atatagtaagcagtctgtaaat

SEQ ID NO: 7824847 - DNA, 22 bp, Homo sapiens
atatagtaagcagtctgtaaat

SEQ ID NO: 7824848 - DNA, 22 bp, Homo sapiens
atatagtaagcagtctgtaaat

SEQ ID NO: 7824849 - DNA, 22 bp, Homo sapiens
atatagtatgtcctccagaatt

SEQ ID NO: 7824850 - DNA, 22 bp, Homo sapiens
atatagtaagcagtctgtaaat

SEQ ID NO: 7824851 - DNA, 19 bp, Homo sapiens
atataggctgaaccatgct

SEQ ID NO: 7824852 - DNA, 22 bp, Homo sapiens
atatagaaggtgctatttacat

SEQ ID NO: 7824853 - DNA, 22 bp, Homo sapiens
atatagaaggtgctatttacat

SEQ ID NO: 7824854 - DNA, 22 bp, Homo sapiens
atatagaaggtgctatttacat

SEQ ID NO: 7824855 - DNA, 22 bp, Homo sapiens
agaaaagggcaggagggataca

SEQ ID NO: 7824856 - DNA, 22 bp, Homo sapiens
agaaaagggcaggagggataca

SEQ ID NO: 7824857 - DNA, 22 bp, Homo sapiens
atatagaaggtgctatttacat

SEQ ID NO: 7824858 - DNA, 22 bp, Homo sapiens
atatagaaggtgctatttacat

SEQ ID NO: 7824859 - DNA, 22 bp, Homo sapiens
atatagatcaaatgatgctaat

SEQ ID NO: 7824860 - DNA, 22 bp, Homo sapiens
atatagaatacacagggaaagt

SEQ ID NO: 7824861 - DNA, 22 bp, Homo sapiens
atatagaatacacagggaaagt

SEQ ID NO: 7824862 - DNA, 20 bp, Homo sapiens
agaaacatttcttgagaact

SEQ ID NO: 7824863 - DNA, 20 bp, Homo sapiens
agaaacatttcttgagaact

SEQ ID NO: 7824864 - DNA, 20 bp, Homo sapiens
agaaacatttcttgagaact

SEQ ID NO: 7824865 - DNA, 21 bp, Homo sapiens
agaaactgactcctagaggca

SEQ ID NO: 7824866 - DNA, 22 bp, Homo sapiens
atatagtttaggttcgaatggg

SEQ ID NO: 7824867 - DNA, 22 bp, Homo sapiens
atatagtttaagaaagtacagt

SEQ ID NO: 7824868 - DNA, 22 bp, Homo sapiens
atatagtttaagaaagtacagt

SEQ ID NO: 7824869 - DNA, 20 bp, Homo sapiens
agaaacatttcttgagaact

SEQ ID NO: 7824870 - DNA, 22 bp, Homo sapiens
atatagttgggtttcattctac

SEQ ID NO: 7824871 - DNA, 22 bp, Homo sapiens
atatagtttaagaaagtacagt

SEQ ID NO: 7824872 - DNA, 22 bp, Homo sapiens
atatagtttaagaaagtacagt

SEQ ID NO: 7824873 - DNA, 22 bp, Homo sapiens
atatagtcacactttgcaggca

SEQ ID NO: 7824874 - DNA, 22 bp, Homo sapiens
agaaagaacgcacttgtgctgc

SEQ ID NO: 7824875 - DNA, 22 bp, Homo sapiens
agaaagaacgcacttgtgctgc

SEQ ID NO: 7824876 - DNA, 22 bp, Homo sapiens
agaaactttctagggcttcagg

SEQ ID NO: 7824877 - DNA, 22 bp, Homo sapiens
agaaagaacgcacttgtgctgc

SEQ ID NO: 7824878 - DNA, 22 bp, Homo sapiens
agaaacttcagctattcttttg

SEQ ID NO: 7824879 - DNA, 22 bp, Homo sapiens
agaaacttcagctattcttttg

SEQ ID NO: 7824880 - DNA, 22 bp, Homo sapiens
agaaacttcagctattcttttg

SEQ ID NO: 7824881 - DNA, 17 bp, Homo sapiens
agaaactgaggctcagt

SEQ ID NO: 7824882 - DNA, 17 bp, Homo sapiens
agaaactgaggctcagt

SEQ ID NO: 7824883 - DNA, 17 bp, Homo sapiens
agaaactgaggctcagt

SEQ ID NO: 7824884 - DNA, 22 bp, Homo sapiens
agaaactgcagctcagagaagt

SEQ ID NO: 7824885 - DNA, 22 bp, Homo sapiens
agaaactgtgttactagaatgt

SEQ ID NO: 7824886 - DNA, 22 bp, Homo sapiens
atattaaatggattttgggagc

SEQ ID NO: 7824887 - DNA, 22 bp, Homo sapiens
atattaaatggattttgggagc

SEQ ID NO: 7824888 - DNA, 22 bp, Homo sapiens
atattaaatggattttgggagc

SEQ ID NO: 7824889 - DNA, 22 bp, Homo sapiens
atattaagatgctattggtttt

SEQ ID NO: 7824890 - DNA, 22 bp, Homo sapiens
atattaaatggattttgggagc

SEQ ID NO: 7824891 - DNA, 22 bp, Homo sapiens
atattaatgagcaagtaagtga

SEQ ID NO: 7824892 - DNA, 22 bp, Homo sapiens
atattaatgagcaagtaagtga

SEQ ID NO: 7824893 - DNA, 22 bp, Homo sapiens
agaaagaggatgcagatctcat

SEQ ID NO: 7824894 - DNA, 22 bp, Homo sapiens
atattaaatggattttgggagc

SEQ ID NO: 7824895 - DNA, 22 bp, Homo sapiens
atattaaatggattttgggagc

SEQ ID NO: 7824896 - DNA, 22 bp, Homo sapiens
atattaaaactatggttttcag

SEQ ID NO: 7824897 - DNA, 22 bp, Homo sapiens
atattaaaactatggttttcag

SEQ ID NO: 7824898 - DNA, 22 bp, Homo sapiens
atattaatgggatttagtcagg

SEQ ID NO: 7824899 - DNA, 22 bp, Homo sapiens
atattaatgggatttagtcagg

SEQ ID NO: 7824900 - DNA, 22 bp, Homo sapiens
atattaattatttacacatgag

SEQ ID NO: 7824901 - DNA, 22 bp, Homo sapiens
atattaatgagcaagtaagtga

SEQ ID NO: 7824902 - DNA, 22 bp, Homo sapiens
atattaatgggatttagtcagg

SEQ ID NO: 7824903 - DNA, 22 bp, Homo sapiens
atattaatgggatttagtcagg

SEQ ID NO: 7824904 - DNA, 22 bp, Homo sapiens
atattaatgggatttagtcagg

SEQ ID NO: 7824905 - DNA, 22 bp, Homo sapiens
atattaatgagcaagtaagtga

SEQ ID NO: 7824906 - DNA, 22 bp, Homo sapiens
agaaagacaaaatgcagtggct

SEQ ID NO: 7824907 - DNA, 22 bp, Homo sapiens
agaaagacgtgatgaagaagta

SEQ ID NO: 7824908 - DNA, 22 bp, Homo sapiens
agaaagacgtgatgaagaagta

SEQ ID NO: 7824909 - DNA, 22 bp, Homo sapiens
agaaagacgtgatgaagaagta

SEQ ID NO: 7824910 - DNA, 22 bp, Homo sapiens
agaaagacgtgatgaagaagta

SEQ ID NO: 7824911 - DNA, 22 bp, Homo sapiens
agaaagacaaaatgcagtggct

SEQ ID NO: 7824912 - DNA, 22 bp, Homo sapiens
agaaagaacgttggttatctta

SEQ ID NO: 7824913 - DNA, 22 bp, Homo sapiens
agaaagaacgttggttatctta

SEQ ID NO: 7824914 - DNA, 22 bp, Homo sapiens
agaaagaacgttggttatctta

SEQ ID NO: 7824915 - DNA, 22 bp, Homo sapiens
agaaagagatgaatgctttaag

SEQ ID NO: 7824916 - DNA, 22 bp, Homo sapiens
agaaagacgtgatgaagaagta

SEQ ID NO: 7824917 - DNA, 22 bp, Homo sapiens
agaaagagctcgggattaacag

SEQ ID NO: 7824918 - DNA, 22 bp, Homo sapiens
agaaagagctcgggattaacag

SEQ ID NO: 7824919 - DNA, 22 bp, Homo sapiens
agaaagagctcgggattaacag

SEQ ID NO: 7824920 - DNA, 17 bp, Homo sapiens
agaaagaggatccacag

SEQ ID NO: 7824921 - DNA, 22 bp, Homo sapiens
agaaagaggatgcagatctcat

SEQ ID NO: 7824922 - DNA, 22 bp, Homo sapiens
agaaagaggatgcagatctcat

SEQ ID NO: 7824923 - DNA, 17 bp, Homo sapiens
agaaagaggatccacag

SEQ ID NO: 7824924 - DNA, 17 bp, Homo sapiens
agaaagaggatccacag

SEQ ID NO: 7824925 - DNA, 17 bp, Homo sapiens
agaaagaggatccacag

SEQ ID NO: 7824926 - DNA, 22 bp, Homo sapiens
agaaagttttgtgctatatatg

SEQ ID NO: 7824927 - DNA, 22 bp, Homo sapiens
agaaagtttgtttttatccata

SEQ ID NO: 7824928 - DNA, 22 bp, Homo sapiens
agaaagtttgtttttatccata

SEQ ID NO: 7824929 - DNA, 19 bp, Homo sapiens
agaaatagccttccttgtc

SEQ ID NO: 7824930 - DNA, 22 bp, Homo sapiens
agaaatagcagagtcaggcggg

SEQ ID NO: 7824931 - DNA, 22 bp, Homo sapiens
atattaattatttacacatgag

SEQ ID NO: 7824932 - DNA, 22 bp, Homo sapiens
atattaattatttacacatgag

SEQ ID NO: 7824933 - DNA, 22 bp, Homo sapiens
atattaattatttacacatgag

SEQ ID NO: 7824934 - DNA, 22 bp, Homo sapiens
atattaattatttacacatgag

SEQ ID NO: 7824935 - DNA, 22 bp, Homo sapiens
atattacacacggtatcacggg

SEQ ID NO: 7824936 - DNA, 22 bp, Homo sapiens
atattacacacggtatcacggg

SEQ ID NO: 7824937 - DNA, 22 bp, Homo sapiens
atattacacacggtatcacggg

SEQ ID NO: 7824938 - DNA, 22 bp, Homo sapiens
atattacacacggtatcacggg

SEQ ID NO: 7824939 - DNA, 22 bp, Homo sapiens
agaaatatgctgattagatgaa

SEQ ID NO: 7824940 - DNA, 22 bp, Homo sapiens
agaaatatgctgattagatgaa

SEQ ID NO: 7824941 - DNA, 22 bp, Homo sapiens
agaaatatgctgattagatgaa

SEQ ID NO: 7824942 - DNA, 22 bp, Homo sapiens
agaaatatgctgattagatgaa

SEQ ID NO: 7824943 - DNA, 22 bp, Homo sapiens
agaaatatgctgattagatgaa

SEQ ID NO: 7824944 - DNA, 22 bp, Homo sapiens
agaaatatgctgattagatgaa

SEQ ID NO: 7824945 - DNA, 22 bp, Homo sapiens
agaaatatgctgattagatgaa

SEQ ID NO: 7824946 - DNA, 22 bp, Homo sapiens
agaaatatgctgattagatgaa

SEQ ID NO: 7824947 - DNA, 22 bp, Homo sapiens
agaaatatgctgattagatgaa

SEQ ID NO: 7824948 - DNA, 22 bp, Homo sapiens
agaaatatgctgattagatgaa

SEQ ID NO: 7824949 - DNA, 22 bp, Homo sapiens
agaaatatgctgattagatgaa

SEQ ID NO: 7824950 - DNA, 22 bp, Homo sapiens
agaaatatgctgattagatgaa

SEQ ID NO: 7824951 - DNA, 19 bp, Homo sapiens
agaaatagccttccttgtc

SEQ ID NO: 7824952 - DNA, 22 bp, Homo sapiens
agaaatagtcacattggaggaa

SEQ ID NO: 7824953 - DNA, 22 bp, Homo sapiens
agaaagttttgtgctatatatg

SEQ ID NO: 7824954 - DNA, 19 bp, Homo sapiens
agaaatagccttccttgtc

SEQ ID NO: 7824955 - DNA, 22 bp, Homo sapiens
agaaatcaatatctatatgttg

SEQ ID NO: 7824956 - DNA, 22 bp, Homo sapiens
agaaatcaatatctatatgttg

SEQ ID NO: 7824957 - DNA, 22 bp, Homo sapiens
agaaatcaatatctatatgttg

SEQ ID NO: 7824958 - DNA, 22 bp, Homo sapiens
agaaatcaatgaagtctgctaa

SEQ ID NO: 7824959 - DNA, 22 bp, Homo sapiens
agaaatcaatgaagtctgctaa

SEQ ID NO: 7824960 - DNA, 20 bp, Homo sapiens
agaaatattgagttcagagg

SEQ ID NO: 7824961 - DNA, 20 bp, Homo sapiens
agaaatattgagttcagagg

SEQ ID NO: 7824962 - DNA, 22 bp, Homo sapiens
agaaatatgctgattagatgaa

SEQ ID NO: 7824963 - DNA, 20 bp, Homo sapiens
agaaatattgagttcagagg

SEQ ID NO: 7824964 - DNA, 20 bp, Homo sapiens
agaaatattgagttcagagg

SEQ ID NO: 7824965 - DNA, 20 bp, Homo sapiens
agaaatattgagttcagagg

SEQ ID NO: 7824966 - DNA, 20 bp, Homo sapiens
agaaatattgagttcagagg

SEQ ID NO: 7824967 - DNA, 22 bp, Homo sapiens
agaaatcagaaccctgaagttc

SEQ ID NO: 7824968 - DNA, 22 bp, Homo sapiens
agaaatcagaaccctgaagttc

SEQ ID NO: 7824969 - DNA, 20 bp, Homo sapiens
agaaatcagcatgtcctctg

SEQ ID NO: 7824970 - DNA, 20 bp, Homo sapiens
agaaatcagaccacacacta

SEQ ID NO: 7824971 - DNA, 22 bp, Homo sapiens
agaaatcacttagaggaagtga

SEQ ID NO: 7824972 - DNA, 22 bp, Homo sapiens
agaaatcacttagaggaagtga

SEQ ID NO: 7824973 - DNA, 22 bp, Homo sapiens
agaaatcacttagaggaagtga

SEQ ID NO: 7824974 - DNA, 22 bp, Homo sapiens
agaaatcacaggaggcagaagg

SEQ ID NO: 7824975 - DNA, 22 bp, Homo sapiens
agaaatcaatgaagtctgctaa

SEQ ID NO: 7824976 - DNA, 22 bp, Homo sapiens
agaaatcacttaatgaacgtag

SEQ ID NO: 7824977 - DNA, 22 bp, Homo sapiens
agaaatcacttaatgaacgtag

SEQ ID NO: 7824978 - DNA, 22 bp, Homo sapiens
atcaagcagtgaaaaatgctag

SEQ ID NO: 7824979 - DNA, 22 bp, Homo sapiens
atcaagcatatataaaactgca

SEQ ID NO: 7824980 - DNA, 22 bp, Homo sapiens
atcaagcatatataaaactgca

SEQ ID NO: 7824981 - DNA, 22 bp, Homo sapiens
atcaagcagtgaaaaatgctag

SEQ ID NO: 7824982 - DNA, 22 bp, Homo sapiens
atcaagcagtgaaaaatgctag

SEQ ID NO: 7824983 - DNA, 22 bp, Homo sapiens
atcaagcacttctacatgacat

SEQ ID NO: 7824984 - DNA, 22 bp, Homo sapiens
atcaagctggcatatgtagttc

SEQ ID NO: 7824985 - DNA, 22 bp, Homo sapiens
atcaagctacttgtcttcgttt

SEQ ID NO: 7824986 - DNA, 22 bp, Homo sapiens
atcaagcatctctctcccaatg

SEQ ID NO: 7824987 - DNA, 22 bp, Homo sapiens
atcaagaattgggagctattga

SEQ ID NO: 7824988 - DNA, 22 bp, Homo sapiens
atcaagagtattgacaagacca

SEQ ID NO: 7824989 - DNA, 22 bp, Homo sapiens
atcaagagcacagtgctggcat

SEQ ID NO: 7824990 - DNA, 22 bp, Homo sapiens
atcaagagcacagtgctggcat

SEQ ID NO: 7824991 - DNA, 22 bp, Homo sapiens
atcaagagaaggggaagatgaa

SEQ ID NO: 7824992 - DNA, 22 bp, Homo sapiens
atcaagagaaggggaagatgaa

SEQ ID NO: 7824993 - DNA, 22 bp, Homo sapiens
atcaagagtattgacaagacca

SEQ ID NO: 7824994 - DNA, 22 bp, Homo sapiens
atcaagagttatatttcatagt

SEQ ID NO: 7824995 - DNA, 22 bp, Homo sapiens
atcaatagtctggaaagttctg

SEQ ID NO: 7824996 - DNA, 22 bp, Homo sapiens
atcaatgacagttgaattctac

SEQ ID NO: 7824997 - DNA, 22 bp, Homo sapiens
atcaatgacagttgaattctac

SEQ ID NO: 7824998 - DNA, 22 bp, Homo sapiens
atcaatgacagttgaattctac

SEQ ID NO: 7824999 - DNA, 22 bp, Homo sapiens
atcaagggcgcgtggttcggcg

SEQ ID NO: 7825000 - DNA, 22 bp, Homo sapiens
atcaaggctttggacatagcaa

SEQ ID NO: 7825001 - DNA, 18 bp, Homo sapiens
atcaaggaggggaaggtc

SEQ ID NO: 7825002 - DNA, 22 bp, Homo sapiens
atcaagtatccaggtagtgcta

SEQ ID NO: 7825003 - DNA, 22 bp, Homo sapiens
atcaatgttgggccaaagcaaa

SEQ ID NO: 7825004 - DNA, 22 bp, Homo sapiens
atcaatgttttgatagcccaga

SEQ ID NO: 7825005 - DNA, 22 bp, Homo sapiens
atcaattttgaggatacaagaa

SEQ ID NO: 7825006 - DNA, 22 bp, Homo sapiens
agaaatctttcctgaagtgttt

SEQ ID NO: 7825007 - DNA, 22 bp, Homo sapiens
agaaatctttcctgaagtgttt

SEQ ID NO: 7825008 - DNA, 22 bp, Homo sapiens
agaaatctttcctgaagtgttt

SEQ ID NO: 7825009 - DNA, 22 bp, Homo sapiens
agaaatcttggagtctgtggta

SEQ ID NO: 7825010 - DNA, 22 bp, Homo sapiens
agaaatcttggagtctgtggta

SEQ ID NO: 7825011 - DNA, 22 bp, Homo sapiens
agaaatcttggagtctgtggta

SEQ ID NO: 7825012 - DNA, 22 bp, Homo sapiens
atcaattttgaggatacaagaa

SEQ ID NO: 7825013 - DNA, 22 bp, Homo sapiens
agaaatgcagtttcaagacaaa

SEQ ID NO: 7825014 - DNA, 22 bp, Homo sapiens
agaaatgcagtttcaagacaaa

SEQ ID NO: 7825015 - DNA, 22 bp, Homo sapiens
agaaatgcagtttcaagacaaa

SEQ ID NO: 7825016 - DNA, 22 bp, Homo sapiens
agaaatgcagtttcaagacaaa

SEQ ID NO: 7825017 - DNA, 22 bp, Homo sapiens
agaaatgcagtttcaagacaaa

SEQ ID NO: 7825018 - DNA, 22 bp, Homo sapiens
agaaatgcagtcattgtatagt

SEQ ID NO: 7825019 - DNA, 22 bp, Homo sapiens
agaaatgcagtttcaagacaaa

SEQ ID NO: 7825020 - DNA, 22 bp, Homo sapiens
agaaatgcaaattttcatagag

SEQ ID NO: 7825021 - DNA, 22 bp, Homo sapiens
agaaatgcaaattttcatagag

SEQ ID NO: 7825022 - DNA, 22 bp, Homo sapiens
agaaatgcaaattttcatagag

SEQ ID NO: 7825023 - DNA, 22 bp, Homo sapiens
agaaatgcagtcattgtatagt

SEQ ID NO: 7825024 - DNA, 22 bp, Homo sapiens
agaaatgcagtcattgtatagt

SEQ ID NO: 7825025 - DNA, 22 bp, Homo sapiens
agaaatgcagtcattgtatagt

SEQ ID NO: 7825026 - DNA, 22 bp, Homo sapiens
agaaatgcagtctcgtcaaaag

SEQ ID NO: 7825027 - DNA, 22 bp, Homo sapiens
agaaatgcctacgagataggga

SEQ ID NO: 7825028 - DNA, 22 bp, Homo sapiens
agaaatgcctacgagataggga

SEQ ID NO: 7825029 - DNA, 22 bp, Homo sapiens
agaaatgcattagcacatatag

SEQ ID NO: 7825030 - DNA, 22 bp, Homo sapiens
agaaatgcattagcacatatag

SEQ ID NO: 7825031 - DNA, 22 bp, Homo sapiens
agaaatgctcttcctgaccaga

SEQ ID NO: 7825032 - DNA, 22 bp, Homo sapiens
agaaatgctcttcctgaccaga

SEQ ID NO: 7825033 - DNA, 22 bp, Homo sapiens
agaaatgctcttcctgaccaga

SEQ ID NO: 7825034 - DNA, 22 bp, Homo sapiens
agaaatgctcaggtcaacttaa

SEQ ID NO: 7825035 - DNA, 22 bp, Homo sapiens
agaaatgtcaggaaagaagtcc

SEQ ID NO: 7825036 - DNA, 22 bp, Homo sapiens
agaaatgtcaggaaagaagtcc

SEQ ID NO: 7825037 - DNA, 22 bp, Homo sapiens
agaaatgtcaagtgttcttgtt

SEQ ID NO: 7825038 - DNA, 22 bp, Homo sapiens
agaaatgtcaagtgttcttgtt

SEQ ID NO: 7825039 - DNA, 22 bp, Homo sapiens
agaaatgtcaagtgttcttgtt

SEQ ID NO: 7825040 - DNA, 22 bp, Homo sapiens
agaaatgtcaagtgttcttgtt

SEQ ID NO: 7825041 - DNA, 22 bp, Homo sapiens
agaaatgtcaggaaagaagtcc

SEQ ID NO: 7825042 - DNA, 22 bp, Homo sapiens
agaaatgtcaggaaagaagtcc

SEQ ID NO: 7825043 - DNA, 22 bp, Homo sapiens
agaaatgtattctgtatgtttt

SEQ ID NO: 7825044 - DNA, 22 bp, Homo sapiens
agaaatgtattctgtatgtttt

SEQ ID NO: 7825045 - DNA, 22 bp, Homo sapiens
agaaatgtattctgtatgtttt

SEQ ID NO: 7825046 - DNA, 22 bp, Homo sapiens
agaaatgtattctgtatgtttt

SEQ ID NO: 7825047 - DNA, 22 bp, Homo sapiens
agaaatgtattctgtatgtttt

SEQ ID NO: 7825048 - DNA, 21 bp, Homo sapiens
agaaatgtatcattcttttcc

SEQ ID NO: 7825049 - DNA, 21 bp, Homo sapiens
agaaatgtatcattcttttcc

SEQ ID NO: 7825050 - DNA, 21 bp, Homo sapiens
agaaatgtatcattcttttcc

SEQ ID NO: 7825051 - DNA, 22 bp, Homo sapiens
agaaatgtaattgcaactgtct

SEQ ID NO: 7825052 - DNA, 22 bp, Homo sapiens
agaaatgtaattgcaactgtct

SEQ ID NO: 7825053 - DNA, 22 bp, Homo sapiens
agaaatgtaattgcaactgtct

SEQ ID NO: 7825054 - DNA, 22 bp, Homo sapiens
agaaatgtaattgcaactgtct

SEQ ID NO: 7825055 - DNA, 22 bp, Homo sapiens
agaaatgtacacgacacccaga

SEQ ID NO: 7825056 - DNA, 22 bp, Homo sapiens
agaaatgtaattgcaactgtct

SEQ ID NO: 7825057 - DNA, 22 bp, Homo sapiens
agaaatggtgagtgagagcccc

SEQ ID NO: 7825058 - DNA, 22 bp, Homo sapiens
agaaatgtacgatgttatgcag

SEQ ID NO: 7825059 - DNA, 22 bp, Homo sapiens
agaaatgtacgatgttatgcag

SEQ ID NO: 7825060 - DNA, 22 bp, Homo sapiens
agaaatgtacacgacacccaga

SEQ ID NO: 7825061 - DNA, 22 bp, Homo sapiens
agaaatgtaggcatataaggaa

SEQ ID NO: 7825062 - DNA, 22 bp, Homo sapiens
agaaatgtatagtgaatttttc

SEQ ID NO: 7825063 - DNA, 22 bp, Homo sapiens
agaaatgtatagtgaatttttc

SEQ ID NO: 7825064 - DNA, 22 bp, Homo sapiens
agaaatgtatagtgaatttttc

SEQ ID NO: 7825065 - DNA, 22 bp, Homo sapiens
agaaatgtatagtgaatttttc

SEQ ID NO: 7825066 - DNA, 22 bp, Homo sapiens
agaaatgtggatcgttttaaaa

SEQ ID NO: 7825067 - DNA, 22 bp, Homo sapiens
agaaatgttacagttgttattt

SEQ ID NO: 7825068 - DNA, 22 bp, Homo sapiens
agaaatgtggatcgttttaaaa

SEQ ID NO: 7825069 - DNA, 22 bp, Homo sapiens
agaaatgtggatcgttttaaaa

SEQ ID NO: 7825070 - DNA, 22 bp, Homo sapiens
agaaatgtggatcgttttaaaa

SEQ ID NO: 7825071 - DNA, 22 bp, Homo sapiens
agaaatgttacagttgttattt

SEQ ID NO: 7825072 - DNA, 22 bp, Homo sapiens
agaaatgttacagttgttattt

SEQ ID NO: 7825073 - DNA, 22 bp, Homo sapiens
agaaatgttacagttgttattt

SEQ ID NO: 7825074 - DNA, 22 bp, Homo sapiens
agaaatgttacagttgttattt

SEQ ID NO: 7825075 - DNA, 22 bp, Homo sapiens
agaaatgttacagttgttattt

SEQ ID NO: 7825076 - DNA, 22 bp, Homo sapiens
agaaatgttcttcatttgccat

SEQ ID NO: 7825077 - DNA, 22 bp, Homo sapiens
agaaatgttgaatacacaaaat

SEQ ID NO: 7825078 - DNA, 22 bp, Homo sapiens
agaaatgttgaatacacaaaat

SEQ ID NO: 7825079 - DNA, 22 bp, Homo sapiens
agaaatgttcttcatttgccat

SEQ ID NO: 7825080 - DNA, 22 bp, Homo sapiens
agaaatgttgaatacacaaaat

SEQ ID NO: 7825081 - DNA, 22 bp, Homo sapiens
agaaatgttgaatacacaaaat

SEQ ID NO: 7825082 - DNA, 22 bp, Homo sapiens
agaaatgttgaatacacaaaat

SEQ ID NO: 7825083 - DNA, 22 bp, Homo sapiens
agaaatgttgaatacacaaaat

SEQ ID NO: 7825084 - DNA, 22 bp, Homo sapiens
agaaatgtccagggctaggatc

SEQ ID NO: 7825085 - DNA, 22 bp, Homo sapiens
agaaatgtccagggctaggatc

SEQ ID NO: 7825086 - DNA, 22 bp, Homo sapiens
agaaatgtccagggctaggatc

SEQ ID NO: 7825087 - DNA, 20 bp, Homo sapiens
agaaatgtgaaaggctgagt

SEQ ID NO: 7825088 - DNA, 20 bp, Homo sapiens
agaaatgtgaaaggctgagt

SEQ ID NO: 7825089 - DNA, 20 bp, Homo sapiens
agaaatgtgaaaggctgagt

SEQ ID NO: 7825090 - DNA, 22 bp, Homo sapiens
agaaatgtgaatttcatttcct

SEQ ID NO: 7825091 - DNA, 22 bp, Homo sapiens
agaaatgtgaatttcatttcct

SEQ ID NO: 7825092 - DNA, 22 bp, Homo sapiens
agaaatgtgaatttcatttcct

SEQ ID NO: 7825093 - DNA, 22 bp, Homo sapiens
agaaatgtggaggaacagggct

SEQ ID NO: 7825094 - DNA, 22 bp, Homo sapiens
agaaatgtggaggaacagggct

SEQ ID NO: 7825095 - DNA, 22 bp, Homo sapiens
agaaatgtgagccccttatcaa

SEQ ID NO: 7825096 - DNA, 22 bp, Homo sapiens
agaaatgtgagccccttatcaa

SEQ ID NO: 7825097 - DNA, 22 bp, Homo sapiens
agaaatgtgaatttcatttcct

SEQ ID NO: 7825098 - DNA, 22 bp, Homo sapiens
agaaattaggaaagtaacactt

SEQ ID NO: 7825099 - DNA, 22 bp, Homo sapiens
agaagcacctgtcagctacatg

SEQ ID NO: 7825100 - DNA, 22 bp, Homo sapiens
agaagcacctgtcagctacatg

SEQ ID NO: 7825101 - DNA, 22 bp, Homo sapiens
agaagcacggttttgtctagca

SEQ ID NO: 7825102 - DNA, 22 bp, Homo sapiens
agaagcacggttttgtctagca

SEQ ID NO: 7825103 - DNA, 22 bp, Homo sapiens
agaagcacggttttgtctagca

SEQ ID NO: 7825104 - DNA, 22 bp, Homo sapiens
agaaatgtttatggctgcctat

SEQ ID NO: 7825105 - DNA, 22 bp, Homo sapiens
agaaattaggaaagtaacactt

SEQ ID NO: 7825106 - DNA, 22 bp, Homo sapiens
agaaatgtttatggctgcctat

SEQ ID NO: 7825107 - DNA, 22 bp, Homo sapiens
agaaatgtttactcaccccctt

SEQ ID NO: 7825108 - DNA, 22 bp, Homo sapiens
agaaatgttgaatacatcagga

SEQ ID NO: 7825109 - DNA, 22 bp, Homo sapiens
agaaatgtttactcaccccctt

SEQ ID NO: 7825110 - DNA, 22 bp, Homo sapiens
agaaatgttgtgggttttgtta

SEQ ID NO: 7825111 - DNA, 22 bp, Homo sapiens
agaaatgttgtgggttttgtta

SEQ ID NO: 7825112 - DNA, 22 bp, Homo sapiens
agaaatgttgtgggttttgtta

SEQ ID NO: 7825113 - DNA, 22 bp, Homo sapiens
agaaatgttgaatacatcagga

SEQ ID NO: 7825114 - DNA, 22 bp, Homo sapiens
agaaatgttgaatacatcagga

SEQ ID NO: 7825115 - DNA, 22 bp, Homo sapiens
agaaatgttgaatacatcagga

SEQ ID NO: 7825116 - DNA, 22 bp, Homo sapiens
agaaatgttgaatacatcagga

SEQ ID NO: 7825117 - DNA, 22 bp, Homo sapiens
agaagcaggcctcacagatctg

SEQ ID NO: 7825118 - DNA, 22 bp, Homo sapiens
agaagcagggcagggaaaagca

SEQ ID NO: 7825119 - DNA, 22 bp, Homo sapiens
agaagcagggcagggaaaagca

SEQ ID NO: 7825120 - DNA, 22 bp, Homo sapiens
agaagcagggcagggaaaagca

SEQ ID NO: 7825121 - DNA, 18 bp, Homo sapiens
agaagcaggtaaaattct

SEQ ID NO: 7825122 - DNA, 22 bp, Homo sapiens
agaagcactagagggtatggaa

SEQ ID NO: 7825123 - DNA, 22 bp, Homo sapiens
agaagcagaaaagggcactttt

SEQ ID NO: 7825124 - DNA, 22 bp, Homo sapiens
agaagcactacgataggtggtc

SEQ ID NO: 7825125 - DNA, 22 bp, Homo sapiens
agaagcaggcctcacagatctg

SEQ ID NO: 7825126 - DNA, 22 bp, Homo sapiens
agaagcaggcagatttcagctc

SEQ ID NO: 7825127 - DNA, 22 bp, Homo sapiens
agaagcaggcagatttcagctc

SEQ ID NO: 7825128 - DNA, 22 bp, Homo sapiens
agaagcagttattttttgcaca

SEQ ID NO: 7825129 - DNA, 22 bp, Homo sapiens
agaagcagttattttttgcaca

SEQ ID NO: 7825130 - DNA, 22 bp, Homo sapiens
agaagcagttattttttgcaca

SEQ ID NO: 7825131 - DNA, 18 bp, Homo sapiens
agaagcaggtaaaattct

SEQ ID NO: 7825132 - DNA, 18 bp, Homo sapiens
agaagcaggtaaaattct

SEQ ID NO: 7825133 - DNA, 18 bp, Homo sapiens
agaagcaggtaaaattct

SEQ ID NO: 7825134 - DNA, 22 bp, Homo sapiens
agaagcattatttaattttact

SEQ ID NO: 7825135 - DNA, 22 bp, Homo sapiens
agaagcattataacatgcaagg

SEQ ID NO: 7825136 - DNA, 20 bp, Homo sapiens
agaagcatcattctgatgtc

SEQ ID NO: 7825137 - DNA, 20 bp, Homo sapiens
agaagcatcattctgatgtc

SEQ ID NO: 7825138 - DNA, 22 bp, Homo sapiens
agaagcattataacatgcaagg

SEQ ID NO: 7825139 - DNA, 22 bp, Homo sapiens
agaagcattataacatgcaagg

SEQ ID NO: 7825140 - DNA, 22 bp, Homo sapiens
agaagcattatttaattttact

SEQ ID NO: 7825141 - DNA, 20 bp, Homo sapiens
agaagcattcaaagaaaact

SEQ ID NO: 7825142 - DNA, 22 bp, Homo sapiens
agaagccaaaggggccagatat

SEQ ID NO: 7825143 - DNA, 22 bp, Homo sapiens
agaagccaaaggggccagatat

SEQ ID NO: 7825144 - DNA, 22 bp, Homo sapiens
agaagccaaatgccagtgacct

SEQ ID NO: 7825145 - DNA, 22 bp, Homo sapiens
agaagccaacagggcaggagag

SEQ ID NO: 7825146 - DNA, 22 bp, Homo sapiens
atcctgaagcatgaatgtcaaa

SEQ ID NO: 7825147 - DNA, 22 bp, Homo sapiens
atcctgaaaattgaatggaagg

SEQ ID NO: 7825148 - DNA, 22 bp, Homo sapiens
agaagccaaatgccagtgacct

SEQ ID NO: 7825149 - DNA, 22 bp, Homo sapiens
agaagccaaaggggccagatat

SEQ ID NO: 7825150 - DNA, 22 bp, Homo sapiens
atcctgagttcctgcctctaaa

SEQ ID NO: 7825151 - DNA, 22 bp, Homo sapiens
atcctgaggaaggtgcagagat

SEQ ID NO: 7825152 - DNA, 22 bp, Homo sapiens
atcctgaggaaggtgcagagat

SEQ ID NO: 7825153 - DNA, 22 bp, Homo sapiens
atcctgagctacacctgctcct

SEQ ID NO: 7825154 - DNA, 22 bp, Homo sapiens
atcctgaagcatgaatgtcaaa

SEQ ID NO: 7825155 - DNA, 22 bp, Homo sapiens
atcctgaggaaggtgcagagat

SEQ ID NO: 7825156 - DNA, 22 bp, Homo sapiens
atcctgagctacacctgctcct

SEQ ID NO: 7825157 - DNA, 22 bp, Homo sapiens
atcctgaagcatgaatgtcaaa

SEQ ID NO: 7825158 - DNA, 22 bp, Homo sapiens
atcctgcagggggttttattca

SEQ ID NO: 7825159 - DNA, 22 bp, Homo sapiens
atcctgagttcctgcctctaaa

SEQ ID NO: 7825160 - DNA, 22 bp, Homo sapiens
atcctgagttctcagagtctcc

SEQ ID NO: 7825161 - DNA, 22 bp, Homo sapiens
atcctggcaagcagaggagaac

SEQ ID NO: 7825162 - DNA, 20 bp, Homo sapiens
atcctggaatccaaatggag

SEQ ID NO: 7825163 - DNA, 22 bp, Homo sapiens
atcctggctttaggtcagaggc

SEQ ID NO: 7825164 - DNA, 22 bp, Homo sapiens
atcctggcgccacacggctcta

SEQ ID NO: 7825165 - DNA, 22 bp, Homo sapiens
atcctggcgccacacggctcta

SEQ ID NO: 7825166 - DNA, 22 bp, Homo sapiens
atcctggcccaggtgtggaggg

SEQ ID NO: 7825167 - DNA, 22 bp, Homo sapiens
atcctggcccaggtgtggaggg

SEQ ID NO: 7825168 - DNA, 22 bp, Homo sapiens
atcctggcccaggtgtggaggg

SEQ ID NO: 7825169 - DNA, 22 bp, Homo sapiens
agaagccaccagctgaggaaga

SEQ ID NO: 7825170 - DNA, 22 bp, Homo sapiens
atcctgggaatgggagggtcat

SEQ ID NO: 7825171 - DNA, 22 bp, Homo sapiens
agaagccatagtatctcagggt

SEQ ID NO: 7825172 - DNA, 22 bp, Homo sapiens
agaagccatagtatctcagggt

SEQ ID NO: 7825173 - DNA, 22 bp, Homo sapiens
agaagccatagtatctcagggt

SEQ ID NO: 7825174 - DNA, 22 bp, Homo sapiens
agaagccatagtatctcagggt

SEQ ID NO: 7825175 - DNA, 22 bp, Homo sapiens
agaagccatagtctgggaggca

SEQ ID NO: 7825176 - DNA, 22 bp, Homo sapiens
agaagccaccagctgaggaaga

SEQ ID NO: 7825177 - DNA, 22 bp, Homo sapiens
agaagccaccagctgaggaaga

SEQ ID NO: 7825178 - DNA, 22 bp, Homo sapiens
agaagccaccagctgaggaaga

SEQ ID NO: 7825179 - DNA, 22 bp, Homo sapiens
agaagccaccagctgaggaaga

SEQ ID NO: 7825180 - DNA, 22 bp, Homo sapiens
agaagccaccagctgaggaaga

SEQ ID NO: 7825181 - DNA, 22 bp, Homo sapiens
agaagccatggggtcaccagag

SEQ ID NO: 7825182 - DNA, 22 bp, Homo sapiens
agaagccatggtatgcaactac

SEQ ID NO: 7825183 - DNA, 21 bp, Homo sapiens
agaagccatgtggtggagaac

SEQ ID NO: 7825184 - DNA, 21 bp, Homo sapiens
agaagccatgtggtggagaac

SEQ ID NO: 7825185 - DNA, 21 bp, Homo sapiens
agaagccatgtggtggagaac

SEQ ID NO: 7825186 - DNA, 21 bp, Homo sapiens
agaagccatgtggtggagaac

SEQ ID NO: 7825187 - DNA, 21 bp, Homo sapiens
agaagccatgccagtaaaatt

SEQ ID NO: 7825188 - DNA, 22 bp, Homo sapiens
agaagccatggggtcaccagag

SEQ ID NO: 7825189 - DNA, 22 bp, Homo sapiens
agaagccatatttagggaggag

SEQ ID NO: 7825190 - DNA, 21 bp, Homo sapiens
agaagccatgccagtaaaatt

SEQ ID NO: 7825191 - DNA, 22 bp, Homo sapiens
agaagccatagtctgggaggca

SEQ ID NO: 7825192 - DNA, 22 bp, Homo sapiens
agaagccatagtctgggaggca

SEQ ID NO: 7825193 - DNA, 22 bp, Homo sapiens
agaagccatagtctgggaggca

SEQ ID NO: 7825194 - DNA, 22 bp, Homo sapiens
agaagccatagtctgggaggca

SEQ ID NO: 7825195 - DNA, 21 bp, Homo sapiens
agaagcctgatgaggtctgct

SEQ ID NO: 7825196 - DNA, 22 bp, Homo sapiens
agaagcctcatcctctctagtg

SEQ ID NO: 7825197 - DNA, 18 bp, Homo sapiens
agaagcctgcctcaatgc

SEQ ID NO: 7825198 - DNA, 21 bp, Homo sapiens
agaagcctgatgaggtctgct

SEQ ID NO: 7825199 - DNA, 21 bp, Homo sapiens
agaagcctggggaatgtggct

SEQ ID NO: 7825200 - DNA, 21 bp, Homo sapiens
agaagcctgggtggaggtggg

SEQ ID NO: 7825201 - DNA, 22 bp, Homo sapiens
agaagcctgttgagagggccgt

SEQ ID NO: 7825202 - DNA, 19 bp, Homo sapiens
agaagcccagatcccagcc

SEQ ID NO: 7825203 - DNA, 19 bp, Homo sapiens
agaagcccagatcccagcc

SEQ ID NO: 7825204 - DNA, 22 bp, Homo sapiens
agaagcctcatcctctctagtg

SEQ ID NO: 7825205 - DNA, 22 bp, Homo sapiens
agaagccattgaagcagacctc

SEQ ID NO: 7825206 - DNA, 21 bp, Homo sapiens
agaagccatttgttaggactt

SEQ ID NO: 7825207 - DNA, 21 bp, Homo sapiens
agaagccatttgttaggactt

SEQ ID NO: 7825208 - DNA, 21 bp, Homo sapiens
agaagccatttgttaggactt

SEQ ID NO: 7825209 - DNA, 22 bp, Homo sapiens
agaagccattccctgtaggctc

SEQ ID NO: 7825210 - DNA, 22 bp, Homo sapiens
agaagccatgtttagtaggatg

SEQ ID NO: 7825211 - DNA, 22 bp, Homo sapiens
agaagccattccctgtaggctc

SEQ ID NO: 7825212 - DNA, 22 bp, Homo sapiens
agaagccatgtttagtaggatg

SEQ ID NO: 7825213 - DNA, 22 bp, Homo sapiens
agaagccatgtttagtaggatg

SEQ ID NO: 7825214 - DNA, 22 bp, Homo sapiens
agaagccatgtttagtaggatg

SEQ ID NO: 7825215 - DNA, 22 bp, Homo sapiens
agaagccatgtttagtaggatg

SEQ ID NO: 7825216 - DNA, 22 bp, Homo sapiens
agaagccattctcagttcctga

SEQ ID NO: 7825217 - DNA, 22 bp, Homo sapiens
agaagccattccctgtaggctc

SEQ ID NO: 7825218 - DNA, 22 bp, Homo sapiens
agaagccattccctgtaggctc

SEQ ID NO: 7825219 - DNA, 22 bp, Homo sapiens
agaagccattctcagttcctga

SEQ ID NO: 7825220 - DNA, 22 bp, Homo sapiens
agaagccattctcagttcctga

SEQ ID NO: 7825221 - DNA, 22 bp, Homo sapiens
agaagctaattcatgtcttatg

SEQ ID NO: 7825222 - DNA, 22 bp, Homo sapiens
agaagctcgggtaagctccatt

SEQ ID NO: 7825223 - DNA, 22 bp, Homo sapiens
agaagctgacagatgcagcagg

SEQ ID NO: 7825224 - DNA, 22 bp, Homo sapiens
agaagctaggctagacaagtga

SEQ ID NO: 7825225 - DNA, 22 bp, Homo sapiens
agaagctgacagatgcagcagg

SEQ ID NO: 7825226 - DNA, 22 bp, Homo sapiens
agaagctgacagatgcagcagg

SEQ ID NO: 7825227 - DNA, 22 bp, Homo sapiens
agaagctgacagatgcagcagg

SEQ ID NO: 7825228 - DNA, 22 bp, Homo sapiens
agaagctgacagatgcagcagg

SEQ ID NO: 7825229 - DNA, 20 bp, Homo sapiens
agaagctgagactgggtttt

SEQ ID NO: 7825230 - DNA, 22 bp, Homo sapiens
agaagctgagaatgaattaaga

SEQ ID NO: 7825231 - DNA, 20 bp, Homo sapiens
atctgcttgcctgtcctcgg

SEQ ID NO: 7825232 - DNA, 20 bp, Homo sapiens
atctgcttgcctgtcctcgg

SEQ ID NO: 7825233 - DNA, 20 bp, Homo sapiens
atctgcttgcctgtcctcgg

SEQ ID NO: 7825234 - DNA, 22 bp, Homo sapiens
agaagctggaggaagactaagc

SEQ ID NO: 7825235 - DNA, 22 bp, Homo sapiens
atctggaaaacacagtgtagac

SEQ ID NO: 7825236 - DNA, 22 bp, Homo sapiens
atctggaaaacacagtgtagac

SEQ ID NO: 7825237 - DNA, 22 bp, Homo sapiens
atctgcttttgagaatttactt

SEQ ID NO: 7825238 - DNA, 22 bp, Homo sapiens
atctgcttttgagaatttactt

SEQ ID NO: 7825239 - DNA, 22 bp, Homo sapiens
atctgcttttgagaatttactt

SEQ ID NO: 7825240 - DNA, 22 bp, Homo sapiens
agaagctgcgtttatttaaatc

SEQ ID NO: 7825241 - DNA, 22 bp, Homo sapiens
agaagctgcgtttatttaaatc

SEQ ID NO: 7825242 - DNA, 20 bp, Homo sapiens
agaagctgatactgatggaa

SEQ ID NO: 7825243 - DNA, 20 bp, Homo sapiens
agaagctgagactgggtttt

SEQ ID NO: 7825244 - DNA, 20 bp, Homo sapiens
agaagctgatactgatggaa

SEQ ID NO: 7825245 - DNA, 20 bp, Homo sapiens
agaagctgatactgatggaa

SEQ ID NO: 7825246 - DNA, 22 bp, Homo sapiens
agagatgggaaggcagacttca

SEQ ID NO: 7825247 - DNA, 22 bp, Homo sapiens
agagatgggaaggcagacttca

SEQ ID NO: 7825248 - DNA, 18 bp, Homo sapiens
agagatgggagttggaaa

SEQ ID NO: 7825249 - DNA, 22 bp, Homo sapiens
agagatgggaaggcagacttca

SEQ ID NO: 7825250 - DNA, 22 bp, Homo sapiens
agagatgggaaggcagacttca

SEQ ID NO: 7825251 - DNA, 18 bp, Homo sapiens
agagatgggagttggaaa

SEQ ID NO: 7825252 - DNA, 18 bp, Homo sapiens
agagatgggagttggaaa

SEQ ID NO: 7825253 - DNA, 18 bp, Homo sapiens
agagatgggagttggaaa

SEQ ID NO: 7825254 - DNA, 22 bp, Homo sapiens
agagatggtagaacagtcataa

SEQ ID NO: 7825255 - DNA, 22 bp, Homo sapiens
agagatggtagaacagtcataa

SEQ ID NO: 7825256 - DNA, 20 bp, Homo sapiens
agagatggggtatcaccgta

SEQ ID NO: 7825257 - DNA, 20 bp, Homo sapiens
agagatggggtatcaccgta

SEQ ID NO: 7825258 - DNA, 20 bp, Homo sapiens
agagatggggtatcaccgta

SEQ ID NO: 7825259 - DNA, 22 bp, Homo sapiens
agagatgggcgggggcttctgc

SEQ ID NO: 7825260 - DNA, 22 bp, Homo sapiens
agagatgggcgggggcttctgc

SEQ ID NO: 7825261 - DNA, 22 bp, Homo sapiens
agagatgggcgggggcttctgc

SEQ ID NO: 7825262 - DNA, 22 bp, Homo sapiens
agagatgggcgggggcttctgc

SEQ ID NO: 7825263 - DNA, 22 bp, Homo sapiens
agagatgggcgggggcttctgc

SEQ ID NO: 7825264 - DNA, 17 bp, Homo sapiens
atgtatattaactctga

SEQ ID NO: 7825265 - DNA, 17 bp, Homo sapiens
atgtatattaactctga

SEQ ID NO: 7825266 - DNA, 22 bp, Homo sapiens
agagatggcgtctcagagcctg

SEQ ID NO: 7825267 - DNA, 22 bp, Homo sapiens
agagatggcgtctcagagcctg

SEQ ID NO: 7825268 - DNA, 22 bp, Homo sapiens
agagatggcgtctcagagcctg

SEQ ID NO: 7825269 - DNA, 22 bp, Homo sapiens
agagatggcgtctcagagcctg

SEQ ID NO: 7825270 - DNA, 22 bp, Homo sapiens
atgtatatgtgaaagatgttta

SEQ ID NO: 7825271 - DNA, 22 bp, Homo sapiens
atgtatatgcatgcattcaaag

SEQ ID NO: 7825272 - DNA, 17 bp, Homo sapiens
atgtatattaactctga

SEQ ID NO: 7825273 - DNA, 17 bp, Homo sapiens
atgtatattaactctga

SEQ ID NO: 7825274 - DNA, 22 bp, Homo sapiens
atgtagttgaagtgctataaag

SEQ ID NO: 7825275 - DNA, 22 bp, Homo sapiens
atgtagttagaagattcaaaca

SEQ ID NO: 7825276 - DNA, 22 bp, Homo sapiens
atgtagttagaagattcaaaca

SEQ ID NO: 7825277 - DNA, 22 bp, Homo sapiens
atgtagtttggggctagattta

SEQ ID NO: 7825278 - DNA, 22 bp, Homo sapiens
atgtagttttggatggttgctg

SEQ ID NO: 7825279 - DNA, 22 bp, Homo sapiens
atgtagtttggggctagattta

SEQ ID NO: 7825280 - DNA, 22 bp, Homo sapiens
atgtataatgctaattagctag

SEQ ID NO: 7825281 - DNA, 21 bp, Homo sapiens
atgtagggtttgccttctcta

SEQ ID NO: 7825282 - DNA, 22 bp, Homo sapiens
atgtagtactgggtatgtttct

SEQ ID NO: 7825283 - DNA, 22 bp, Homo sapiens
atgtagtatctatatttcatgg

SEQ ID NO: 7825284 - DNA, 22 bp, Homo sapiens
atgtagtatttggaaatgtaaa

SEQ ID NO: 7825285 - DNA, 22 bp, Homo sapiens
atgtataatgctaattagctag

SEQ ID NO: 7825286 - DNA, 22 bp, Homo sapiens
atgtataatgctaattagctag

SEQ ID NO: 7825287 - DNA, 22 bp, Homo sapiens
atgtatatgaagctagtatttt

SEQ ID NO: 7825288 - DNA, 22 bp, Homo sapiens
atgtatatgaagctagtatttt

SEQ ID NO: 7825289 - DNA, 22 bp, Homo sapiens
atgtatatacttacatgtgtgg

SEQ ID NO: 7825290 - DNA, 22 bp, Homo sapiens
atgtatatacttacatgtgtgg

SEQ ID NO: 7825291 - DNA, 22 bp, Homo sapiens
atgtatatgaagctagtatttt

SEQ ID NO: 7825292 - DNA, 22 bp, Homo sapiens
atgtacatagcatcatctagga

SEQ ID NO: 7825293 - DNA, 22 bp, Homo sapiens
atgtacatagcatcatctagga

SEQ ID NO: 7825294 - DNA, 22 bp, Homo sapiens
atgtacatactgcattttcaaa

SEQ ID NO: 7825295 - DNA, 21 bp, Homo sapiens
atgtagggtttgccttctcta

SEQ ID NO: 7825296 - DNA, 22 bp, Homo sapiens
agagagaacaccctcggcatgg

SEQ ID NO: 7825297 - DNA, 17 bp, Homo sapiens
agagagaaaagggccat

SEQ ID NO: 7825298 - DNA, 17 bp, Homo sapiens
agagagaaaagggccat

SEQ ID NO: 7825299 - DNA, 17 bp, Homo sapiens
agagagaaaagggccat

SEQ ID NO: 7825300 - DNA, 17 bp, Homo sapiens
agagagaaaagggccat

SEQ ID NO: 7825301 - DNA, 22 bp, Homo sapiens
atgtacatactgcattttcaaa

SEQ ID NO: 7825302 - DNA, 22 bp, Homo sapiens
agagagaagcaatcagtggcca

SEQ ID NO: 7825303 - DNA, 22 bp, Homo sapiens
agagagaagcaatcagtggcca

SEQ ID NO: 7825304 - DNA, 22 bp, Homo sapiens
agagagaagcaatcagtggcca

SEQ ID NO: 7825305 - DNA, 22 bp, Homo sapiens
agagagaacaccctcggcatgg

SEQ ID NO: 7825306 - DNA, 17 bp, Homo sapiens
agagagaaaagggccat

SEQ ID NO: 7825307 - DNA, 17 bp, Homo sapiens
agagagaaaagggccat

SEQ ID NO: 7825308 - DNA, 22 bp, Homo sapiens
agagacttctgccttagcaaga

SEQ ID NO: 7825309 - DNA, 22 bp, Homo sapiens
agagacttctgccttagcaaga

SEQ ID NO: 7825310 - DNA, 22 bp, Homo sapiens
agagacttctgccttagcaaga

SEQ ID NO: 7825311 - DNA, 22 bp, Homo sapiens
agagactttgtctattttgttc

SEQ ID NO: 7825312 - DNA, 22 bp, Homo sapiens
agagacttaaaactgttttcac

SEQ ID NO: 7825313 - DNA, 22 bp, Homo sapiens
agagacttctgccttagcaaga

SEQ ID NO: 7825314 - DNA, 22 bp, Homo sapiens
agagacttaaaactgttttcac

SEQ ID NO: 7825315 - DNA, 22 bp, Homo sapiens
agagactgtacgtggcaagtat

SEQ ID NO: 7825316 - DNA, 22 bp, Homo sapiens
agagactgtacgtggcaagtat

SEQ ID NO: 7825317 - DNA, 21 bp, Homo sapiens
agagactgtcactgcagtacc

SEQ ID NO: 7825318 - DNA, 21 bp, Homo sapiens
agagactgtcactgcagtacc

SEQ ID NO: 7825319 - DNA, 22 bp, Homo sapiens
agagactgtgccagccccatgc

SEQ ID NO: 7825320 - DNA, 22 bp, Homo sapiens
agagactgtgccagccccatgc

SEQ ID NO: 7825321 - DNA, 22 bp, Homo sapiens
atgggccttgacacatggagtg

SEQ ID NO: 7825322 - DNA, 21 bp, Homo sapiens
atgggccagggatacagagag

SEQ ID NO: 7825323 - DNA, 22 bp, Homo sapiens
atgggctcggcgctgctgggat

SEQ ID NO: 7825324 - DNA, 22 bp, Homo sapiens
atgggctctatgtctaggagat

SEQ ID NO: 7825325 - DNA, 22 bp, Homo sapiens
agagactgcaaatcataagaat

SEQ ID NO: 7825326 - DNA, 22 bp, Homo sapiens
agagactgatggagctcactct

SEQ ID NO: 7825327 - DNA, 22 bp, Homo sapiens
atgggctctatgtctaggagat

SEQ ID NO: 7825328 - DNA, 22 bp, Homo sapiens
agagactgcaatgagtggtagg

SEQ ID NO: 7825329 - DNA, 22 bp, Homo sapiens
agagactggagatgggcagtgt

SEQ ID NO: 7825330 - DNA, 22 bp, Homo sapiens
agagactggagatgggcagtgt

SEQ ID NO: 7825331 - DNA, 22 bp, Homo sapiens
agagactggagatgggcagtgt

SEQ ID NO: 7825332 - DNA, 22 bp, Homo sapiens
agagactggagatgggcagtgt

SEQ ID NO: 7825333 - DNA, 19 bp, Homo sapiens
agagactgccaccagctgt

SEQ ID NO: 7825334 - DNA, 19 bp, Homo sapiens
agagactgccaccagctgt

SEQ ID NO: 7825335 - DNA, 19 bp, Homo sapiens
agagactgccaccagctgt

SEQ ID NO: 7825336 - DNA, 22 bp, Homo sapiens
agagactgcgtgtcagcgctgg

SEQ ID NO: 7825337 - DNA, 22 bp, Homo sapiens
agagactgcgtgtcagcgctgg

SEQ ID NO: 7825338 - DNA, 22 bp, Homo sapiens
agagactggcttctaaaatggc

SEQ ID NO: 7825339 - DNA, 22 bp, Homo sapiens
agagactggagttacgagttca

SEQ ID NO: 7825340 - DNA, 22 bp, Homo sapiens
agagactggagttacgagttca

SEQ ID NO: 7825341 - DNA, 22 bp, Homo sapiens
agagactgtaatgagaggtaca

SEQ ID NO: 7825342 - DNA, 18 bp, Homo sapiens
atgggaggggccaagaga

SEQ ID NO: 7825343 - DNA, 22 bp, Homo sapiens
atgggcagtaacagtggcagtc

SEQ ID NO: 7825344 - DNA, 22 bp, Homo sapiens
atgggcagtaacagtggcagtc

SEQ ID NO: 7825345 - DNA, 22 bp, Homo sapiens
atgggcagtaacagtggcagtc

SEQ ID NO: 7825346 - DNA, 22 bp, Homo sapiens
atgggcagtaacagtggcagtc

SEQ ID NO: 7825347 - DNA, 22 bp, Homo sapiens
atgggcagtaacagtggcagtc

SEQ ID NO: 7825348 - DNA, 18 bp, Homo sapiens
atgggaggggccaagaga

SEQ ID NO: 7825349 - DNA, 22 bp, Homo sapiens
atgggaggcaggctcagaaccg

SEQ ID NO: 7825350 - DNA, 18 bp, Homo sapiens
atgggaggggccaagaga

SEQ ID NO: 7825351 - DNA, 22 bp, Homo sapiens
atggacaggtggataggtggat

SEQ ID NO: 7825352 - DNA, 22 bp, Homo sapiens
atggacagggcacaggcgcaga

SEQ ID NO: 7825353 - DNA, 23 bp, Homo sapiens
atggacagggtttcagggtcaca

SEQ ID NO: 7825354 - DNA, 22 bp, Homo sapiens
atggacaggcttataacagcaa

SEQ ID NO: 7825355 - DNA, 22 bp, Homo sapiens
atggacaggtactgcagtgggt

SEQ ID NO: 7825356 - DNA, 22 bp, Homo sapiens
atggacaggtactgcagtgggt

SEQ ID NO: 7825357 - DNA, 22 bp, Homo sapiens
atggacaggtactgcagtgggt

SEQ ID NO: 7825358 - DNA, 22 bp, Homo sapiens
atgggcagttaggaggccagga

SEQ ID NO: 7825359 - DNA, 22 bp, Homo sapiens
atgggcagttaggaggccagga

SEQ ID NO: 7825360 - DNA, 22 bp, Homo sapiens
atgggcagttaggaggccagga

SEQ ID NO: 7825361 - DNA, 22 bp, Homo sapiens
atgggcagtgtattggaaggaa

SEQ ID NO: 7825362 - DNA, 22 bp, Homo sapiens
atgggcagtgtattggaaggaa

SEQ ID NO: 7825363 - DNA, 22 bp, Homo sapiens
atgggcagtgtattggaaggaa

SEQ ID NO: 7825364 - DNA, 22 bp, Homo sapiens
atgggcagtgtattggaaggaa

SEQ ID NO: 7825365 - DNA, 16 bp, Homo sapiens
atgggcagtgaggaag

SEQ ID NO: 7825366 - DNA, 16 bp, Homo sapiens
atgggcagtgaggaag

SEQ ID NO: 7825367 - DNA, 22 bp, Homo sapiens
atgggcagtgtattggaaggaa

SEQ ID NO: 7825368 - DNA, 22 bp, Homo sapiens
atgggcagtaacagtggcagtc

SEQ ID NO: 7825369 - DNA, 22 bp, Homo sapiens
atgggcagtaacagtggcagtc

SEQ ID NO: 7825370 - DNA, 16 bp, Homo sapiens
atgggcagtgaggaag

SEQ ID NO: 7825371 - DNA, 22 bp, Homo sapiens
atgggcagttaggaggccagga

SEQ ID NO: 7825372 - DNA, 22 bp, Homo sapiens
atgggcagttaggaggccagga

SEQ ID NO: 7825373 - DNA, 22 bp, Homo sapiens
atgggcagttaggaggccagga

SEQ ID NO: 7825374 - DNA, 22 bp, Homo sapiens
atgggccacacacgattgggtg

SEQ ID NO: 7825375 - DNA, 21 bp, Homo sapiens
atgggccagggatacagagag

SEQ ID NO: 7825376 - DNA, 22 bp, Homo sapiens
atgggcctgttcctatgctggt

SEQ ID NO: 7825377 - DNA, 22 bp, Homo sapiens
atggacaaatgtaaggcataat

SEQ ID NO: 7825378 - DNA, 22 bp, Homo sapiens
atggaatttctccggctccacc

SEQ ID NO: 7825379 - DNA, 22 bp, Homo sapiens
agagaagacttacagccacagt

SEQ ID NO: 7825380 - DNA, 22 bp, Homo sapiens
agagaagacttacagccacagt

SEQ ID NO: 7825381 - DNA, 22 bp, Homo sapiens
atggaatgtttcctcttttatt

SEQ ID NO: 7825382 - DNA, 22 bp, Homo sapiens
atggaatgtttatacacagttg

SEQ ID NO: 7825383 - DNA, 22 bp, Homo sapiens
atggaattgaagacagcatagg

SEQ ID NO: 7825384 - DNA, 22 bp, Homo sapiens
atggacagctggcctcaaggga

SEQ ID NO: 7825385 - DNA, 22 bp, Homo sapiens
atggacagctggcctcaaggga

SEQ ID NO: 7825386 - DNA, 22 bp, Homo sapiens
atggacagctcttatgtgggca

SEQ ID NO: 7825387 - DNA, 22 bp, Homo sapiens
atggacagaaggtagcacctat

SEQ ID NO: 7825388 - DNA, 22 bp, Homo sapiens
atggacagagctgagctccacc

SEQ ID NO: 7825389 - DNA, 22 bp, Homo sapiens
agagaacatgacgtaatagtgg

SEQ ID NO: 7825390 - DNA, 22 bp, Homo sapiens
agagaacatgacgtaatagtgg

SEQ ID NO: 7825391 - DNA, 22 bp, Homo sapiens
agagaacatgacgtaatagtgg

SEQ ID NO: 7825392 - DNA, 22 bp, Homo sapiens
agagaacatgacgtaatagtgg

SEQ ID NO: 7825393 - DNA, 22 bp, Homo sapiens
agagaacattagcaaaaacagc

SEQ ID NO: 7825394 - DNA, 22 bp, Homo sapiens
agagaacattagcaaaaacagc

SEQ ID NO: 7825395 - DNA, 22 bp, Homo sapiens
agagaacattagcaaaaacagc

SEQ ID NO: 7825396 - DNA, 22 bp, Homo sapiens
agagaacattagcaaaaacagc

SEQ ID NO: 7825397 - DNA, 22 bp, Homo sapiens
agagaagacttacagccacagt

SEQ ID NO: 7825398 - DNA, 22 bp, Homo sapiens
agagaagacttacagccacagt

SEQ ID NO: 7825399 - DNA, 22 bp, Homo sapiens
agagaagacttacagccacagt

SEQ ID NO: 7825400 - DNA, 22 bp, Homo sapiens
agagaactgtttctggggtctt

SEQ ID NO: 7825401 - DNA, 22 bp, Homo sapiens
agagaactgtttctggggtctt

SEQ ID NO: 7825402 - DNA, 22 bp, Homo sapiens
agagaactactttttatatgtg

SEQ ID NO: 7825403 - DNA, 22 bp, Homo sapiens
agagaacttctcctaaatctca

SEQ ID NO: 7825404 - DNA, 22 bp, Homo sapiens
agagaagacttacagccacagt

SEQ ID NO: 7825405 - DNA, 22 bp, Homo sapiens
agagaagacttacagccacagt

SEQ ID NO: 7825406 - DNA, 22 bp, Homo sapiens
agagaacagcctcctagagaaa

SEQ ID NO: 7825407 - DNA, 22 bp, Homo sapiens
agagaacagcctcctagagaaa

SEQ ID NO: 7825408 - DNA, 22 bp, Homo sapiens
agagaacagcctcctagagaaa

SEQ ID NO: 7825409 - DNA, 22 bp, Homo sapiens
agagaacagcattgcagctttg

SEQ ID NO: 7825410 - DNA, 22 bp, Homo sapiens
agagaacagcctcctagagaaa

SEQ ID NO: 7825411 - DNA, 22 bp, Homo sapiens
agagaacagcctcctagagaaa

SEQ ID NO: 7825412 - DNA, 22 bp, Homo sapiens
agagaacagcctcctagagaaa

SEQ ID NO: 7825413 - DNA, 22 bp, Homo sapiens
agagaacatattttgtatgatt

SEQ ID NO: 7825414 - DNA, 22 bp, Homo sapiens
agagaacatattttgtatgatt

SEQ ID NO: 7825415 - DNA, 22 bp, Homo sapiens
agagaacatgacgtaatagtgg

SEQ ID NO: 7825416 - DNA, 22 bp, Homo sapiens
agagaacagtgttttgaaggag

SEQ ID NO: 7825417 - DNA, 22 bp, Homo sapiens
agagaacatattttgtatgatt

SEQ ID NO: 7825418 - DNA, 22 bp, Homo sapiens
atgttcagttagcactgaagtc

SEQ ID NO: 7825419 - DNA, 22 bp, Homo sapiens
atgttcaaactttttacacacc

SEQ ID NO: 7825420 - DNA, 22 bp, Homo sapiens
atgttcaaagatcgtgctatcc

SEQ ID NO: 7825421 - DNA, 22 bp, Homo sapiens
atgttcaagtacctttgtgtct

SEQ ID NO: 7825422 - DNA, 22 bp, Homo sapiens
atgttcacaaagactctgtaag

SEQ ID NO: 7825423 - DNA, 18 bp, Homo sapiens
atgttcctgaggagaggt

SEQ ID NO: 7825424 - DNA, 22 bp, Homo sapiens
atgttcattttcttaatgtgcc

SEQ ID NO: 7825425 - DNA, 22 bp, Homo sapiens
atgttcctggtatatcatgacc

SEQ ID NO: 7825426 - DNA, 22 bp, Homo sapiens
atgttccttccagagagcagaa

SEQ ID NO: 7825427 - DNA, 22 bp, Homo sapiens
atgttccttccagagagcagaa

SEQ ID NO: 7825428 - DNA, 22 bp, Homo sapiens
atgttcattttcttaatgtgcc

SEQ ID NO: 7825429 - DNA, 22 bp, Homo sapiens
atgttcctgatcctcgttctat

SEQ ID NO: 7825430 - DNA, 22 bp, Homo sapiens
atgttcatttgacaagtagtga

SEQ ID NO: 7825431 - DNA, 22 bp, Homo sapiens
atgttcattagtcaacatttct

SEQ ID NO: 7825432 - DNA, 22 bp, Homo sapiens
agagccttgaagatctggaaaa

SEQ ID NO: 7825433 - DNA, 20 bp, Homo sapiens
agagccttgaggaagatgat

SEQ ID NO: 7825434 - DNA, 20 bp, Homo sapiens
agagccttgaggaagatgat

SEQ ID NO: 7825435 - DNA, 22 bp, Homo sapiens
agagccttgcctggggccctgt

SEQ ID NO: 7825436 - DNA, 23 bp, Homo sapiens
agagccttttcacacttcaatgt

SEQ ID NO: 7825437 - DNA, 22 bp, Homo sapiens
agagccttgctctaaatttctc

SEQ ID NO: 7825438 - DNA, 22 bp, Homo sapiens
agagcctttggagctgctatta

SEQ ID NO: 7825439 - DNA, 22 bp, Homo sapiens
agagccttgctctaaatttctc

SEQ ID NO: 7825440 - DNA, 23 bp, Homo sapiens
agagccttttcacacttcaatgt

SEQ ID NO: 7825441 - DNA, 22 bp, Homo sapiens
agagctagcaaatagagcttca

SEQ ID NO: 7825442 - DNA, 22 bp, Homo sapiens
agagctagaaggaagcatttct

SEQ ID NO: 7825443 - DNA, 22 bp, Homo sapiens
agagcggggatagttaatattc

SEQ ID NO: 7825444 - DNA, 22 bp, Homo sapiens
agagcggggatagttaatattc

SEQ ID NO: 7825445 - DNA, 22 bp, Homo sapiens
agagctaagaaacagaattgct

SEQ ID NO: 7825446 - DNA, 22 bp, Homo sapiens
agagcggggatagttaatattc

SEQ ID NO: 7825447 - DNA, 22 bp, Homo sapiens
agagctaaatcagactttcttt

SEQ ID NO: 7825448 - DNA, 22 bp, Homo sapiens
atgttctacagatggaaagggg

SEQ ID NO: 7825449 - DNA, 22 bp, Homo sapiens
atgttctacagatggaaagggg

SEQ ID NO: 7825450 - DNA, 22 bp, Homo sapiens
atgttctacagatggaaagggg

SEQ ID NO: 7825451 - DNA, 22 bp, Homo sapiens
atgttctacagatggaaagggg

SEQ ID NO: 7825452 - DNA, 22 bp, Homo sapiens
atgttccttccagagagcagaa

SEQ ID NO: 7825453 - DNA, 22 bp, Homo sapiens
atgttcctttaaaatatagatt

SEQ ID NO: 7825454 - DNA, 22 bp, Homo sapiens
atgttctaatccctgctatgta

SEQ ID NO: 7825455 - DNA, 22 bp, Homo sapiens
atgttctacagatggaaagggg

SEQ ID NO: 7825456 - DNA, 22 bp, Homo sapiens
atgttctatatcattattgtga

SEQ ID NO: 7825457 - DNA, 22 bp, Homo sapiens
atgttctatatcattattgtga

SEQ ID NO: 7825458 - DNA, 22 bp, Homo sapiens
atgttctatatcattattgtga

SEQ ID NO: 7825459 - DNA, 19 bp, Homo sapiens
atgttctatcctccaagtt

SEQ ID NO: 7825460 - DNA, 22 bp, Homo sapiens
atgttctacagatggaaagggg

SEQ ID NO: 7825461 - DNA, 22 bp, Homo sapiens
atgttctatatcattattgtga

SEQ ID NO: 7825462 - DNA, 22 bp, Homo sapiens
agagccttgaagatctggaaaa

SEQ ID NO: 7825463 - DNA, 22 bp, Homo sapiens
agagcctgttttgtgggagatg

SEQ ID NO: 7825464 - DNA, 22 bp, Homo sapiens
agagcctgttttgtgggagatg

SEQ ID NO: 7825465 - DNA, 22 bp, Homo sapiens
agagctatttcttaaaagctgt

SEQ ID NO: 7825466 - DNA, 22 bp, Homo sapiens
agagctatttcttaaaagctgt

SEQ ID NO: 7825467 - DNA, 22 bp, Homo sapiens
agagctatgatcaaggcagggt

SEQ ID NO: 7825468 - DNA, 22 bp, Homo sapiens
agagctcagtgtgttatggtta

SEQ ID NO: 7825469 - DNA, 21 bp, Homo sapiens
agagctcaaggcaaaaataat

SEQ ID NO: 7825470 - DNA, 21 bp, Homo sapiens
agagctcaaggcaaaaataat

SEQ ID NO: 7825471 - DNA, 22 bp, Homo sapiens
agagctcaagacgctcacagta

SEQ ID NO: 7825472 - DNA, 22 bp, Homo sapiens
agagctcaagacgctcacagta

SEQ ID NO: 7825473 - DNA, 22 bp, Homo sapiens
agagctccgtgcctggctgcca

SEQ ID NO: 7825474 - DNA, 22 bp, Homo sapiens
agagctccgtgcctggctgcca

SEQ ID NO: 7825475 - DNA, 22 bp, Homo sapiens
agagctctcaatggtcaatgct

SEQ ID NO: 7825476 - DNA, 22 bp, Homo sapiens
agagctcccgagacaatgtatt

SEQ ID NO: 7825477 - DNA, 22 bp, Homo sapiens
agagctccaagaagtcctgcag

SEQ ID NO: 7825478 - DNA, 22 bp, Homo sapiens
attaaatactgcaggctaagca

SEQ ID NO: 7825479 - DNA, 17 bp, Homo sapiens
agagctcttcactgtga

SEQ ID NO: 7825480 - DNA, 22 bp, Homo sapiens
attaaatactgcaggctaagca

SEQ ID NO: 7825481 - DNA, 22 bp, Homo sapiens
attaagctctccaggaaatgta

SEQ ID NO: 7825482 - DNA, 22 bp, Homo sapiens
attaagctctccaggaaatgta

SEQ ID NO: 7825483 - DNA, 22 bp, Homo sapiens
attaagctggtccagacaagtt

SEQ ID NO: 7825484 - DNA, 22 bp, Homo sapiens
attaaggaacaaagccttttga

SEQ ID NO: 7825485 - DNA, 22 bp, Homo sapiens
attaaggaagcctattctctcc

SEQ ID NO: 7825486 - DNA, 22 bp, Homo sapiens
agagctctgcagctggcctcag

SEQ ID NO: 7825487 - DNA, 22 bp, Homo sapiens
agagctctgcagctggcctcag

SEQ ID NO: 7825488 - DNA, 22 bp, Homo sapiens
agagctctgcagctggcctcag

SEQ ID NO: 7825489 - DNA, 22 bp, Homo sapiens
agagctcctgcattcttccctg

SEQ ID NO: 7825490 - DNA, 22 bp, Homo sapiens
agagctctgcagctggcctcag

SEQ ID NO: 7825491 - DNA, 22 bp, Homo sapiens
agagctctggcctattggggcc

SEQ ID NO: 7825492 - DNA, 22 bp, Homo sapiens
agagctctggcctattggggcc

SEQ ID NO: 7825493 - DNA, 22 bp, Homo sapiens
agagctctgtgtctctttgggt

SEQ ID NO: 7825494 - DNA, 22 bp, Homo sapiens
attaaggaagcctattctctcc

SEQ ID NO: 7825495 - DNA, 22 bp, Homo sapiens
attaaggaatgtaggcaagaag

SEQ ID NO: 7825496 - DNA, 22 bp, Homo sapiens
attaaggaagcctattctctcc

SEQ ID NO: 7825497 - DNA, 22 bp, Homo sapiens
attaaggaagcctattctctcc

SEQ ID NO: 7825498 - DNA, 18 bp, Homo sapiens
attaaggaattctttaga

SEQ ID NO: 7825499 - DNA, 22 bp, Homo sapiens
attaaggaatgtaggcaagaag

SEQ ID NO: 7825500 - DNA, 22 bp, Homo sapiens
attaaggaatgtaggcaagaag

SEQ ID NO: 7825501 - DNA, 22 bp, Homo sapiens
attaaggaatgtaggcaagaag

SEQ ID NO: 7825502 - DNA, 22 bp, Homo sapiens
attaaggaatgtaggcaagaag

SEQ ID NO: 7825503 - DNA, 22 bp, Homo sapiens
attaaggagggctgggcatgat

SEQ ID NO: 7825504 - DNA, 18 bp, Homo sapiens
attaaggaattctttaga

SEQ ID NO: 7825505 - DNA, 22 bp, Homo sapiens
attaaggaggtaaactatggtt

SEQ ID NO: 7825506 - DNA, 22 bp, Homo sapiens
attaaggaggtaaactatggtt

SEQ ID NO: 7825507 - DNA, 22 bp, Homo sapiens
attaaggcgttggcgtgcttat

SEQ ID NO: 7825508 - DNA, 22 bp, Homo sapiens
attaaggcgttggcgtgcttat

SEQ ID NO: 7825509 - DNA, 22 bp, Homo sapiens
attaaggcacttgagcatgatg

SEQ ID NO: 7825510 - DNA, 22 bp, Homo sapiens
attaaggcacttgagcatgatg

SEQ ID NO: 7825511 - DNA, 22 bp, Homo sapiens
attaaggattatactctccttt

SEQ ID NO: 7825512 - DNA, 22 bp, Homo sapiens
attaaggcacttgagcatgatg

SEQ ID NO: 7825513 - DNA, 18 bp, Homo sapiens
attaaggctttgatagta

SEQ ID NO: 7825514 - DNA, 22 bp, Homo sapiens
attaaggctgcactggccttaa

SEQ ID NO: 7825515 - DNA, 18 bp, Homo sapiens
attaaggctttgatagta

SEQ ID NO: 7825516 - DNA, 18 bp, Homo sapiens
attaaggctttgatagta

SEQ ID NO: 7825517 - DNA, 18 bp, Homo sapiens
attaaggctttgatagta

SEQ ID NO: 7825518 - DNA, 22 bp, Homo sapiens
attaaggctcccatttccaatt

SEQ ID NO: 7825519 - DNA, 22 bp, Homo sapiens
attaaggctcccatttccaatt

SEQ ID NO: 7825520 - DNA, 22 bp, Homo sapiens
attaaggcgttggcgtgcttat

SEQ ID NO: 7825521 - DNA, 22 bp, Homo sapiens
attaaggctgcactggccttaa

SEQ ID NO: 7825522 - DNA, 22 bp, Homo sapiens
attaaggtgtcaatgtatttgg

SEQ ID NO: 7825523 - DNA, 22 bp, Homo sapiens
attaagtgactaaagtaatgct

SEQ ID NO: 7825524 - DNA, 22 bp, Homo sapiens
attaagtgactaaagtaatgct

SEQ ID NO: 7825525 - DNA, 22 bp, Homo sapiens
attaagtgactaaagtaatgct

SEQ ID NO: 7825526 - DNA, 22 bp, Homo sapiens
attaagtgactaaagtaatgct

SEQ ID NO: 7825527 - DNA, 22 bp, Homo sapiens
attaagtgactaaagtaatgct

SEQ ID NO: 7825528 - DNA, 22 bp, Homo sapiens
attaagtgtgacatgctgctct

SEQ ID NO: 7825529 - DNA, 22 bp, Homo sapiens
attaagtgtgacatgctgctct

SEQ ID NO: 7825530 - DNA, 22 bp, Homo sapiens
attaagtgttttacatacatta

SEQ ID NO: 7825531 - DNA, 22 bp, Homo sapiens
atgtgcaaagggacttgcacat

SEQ ID NO: 7825532 - DNA, 22 bp, Homo sapiens
atgtgcaaagtaaagtaatttt

SEQ ID NO: 7825533 - DNA, 23 bp, Homo sapiens
atgtgcaaagtgctacagtatag

SEQ ID NO: 7825534 - DNA, 23 bp, Homo sapiens
atgtgcaaagtgctacagtatag

SEQ ID NO: 7825535 - DNA, 22 bp, Homo sapiens
atgtgcaaattattttgccaga

SEQ ID NO: 7825536 - DNA, 22 bp, Homo sapiens
atgtgcaaatccaatgtgaatg

SEQ ID NO: 7825537 - DNA, 22 bp, Homo sapiens
atgtgcaaatccaatgtgaatg

SEQ ID NO: 7825538 - DNA, 22 bp, Homo sapiens
atgtgcaatggtgtcaccacat

SEQ ID NO: 7825539 - DNA, 22 bp, Homo sapiens
atgtgcacacagtgtcatgcaa

SEQ ID NO: 7825540 - DNA, 18 bp, Homo sapiens
atgtgcaattttgtattt

SEQ ID NO: 7825541 - DNA, 21 bp, Homo sapiens
atgtgcagcaagcagcatgct

SEQ ID NO: 7825542 - DNA, 22 bp, Homo sapiens
atgtgcagcttttctagagaag

SEQ ID NO: 7825543 - DNA, 21 bp, Homo sapiens
atgtgcagcaagcagcatgct

SEQ ID NO: 7825544 - DNA, 21 bp, Homo sapiens
atgtgcagcaagcagcatgct

SEQ ID NO: 7825545 - DNA, 21 bp, Homo sapiens
atgtgcagcaagcagcatgct

SEQ ID NO: 7825546 - DNA, 23 bp, Homo sapiens
atgtgcacatctccttgtccacc

SEQ ID NO: 7825547 - DNA, 23 bp, Homo sapiens
atgtgcacatctccttgtccacc

SEQ ID NO: 7825548 - DNA, 22 bp, Homo sapiens
atgtgcagacctgggttagaac

SEQ ID NO: 7825549 - DNA, 22 bp, Homo sapiens
atgtgcagacctgggttagaac

SEQ ID NO: 7825550 - DNA, 22 bp, Homo sapiens
atgtgcagaggcttccttgact

SEQ ID NO: 7825551 - DNA, 22 bp, Homo sapiens
atgtgcaggatccaggctccta

SEQ ID NO: 7825552 - DNA, 22 bp, Homo sapiens
atgtgcagttggtggccaggag

SEQ ID NO: 7825553 - DNA, 22 bp, Homo sapiens
atgtgcatgcacttacatgtgt

SEQ ID NO: 7825554 - DNA, 22 bp, Homo sapiens
atgtgcatgcacctggactgtg

SEQ ID NO: 7825555 - DNA, 22 bp, Homo sapiens
atgtgcagttggtggccaggag

SEQ ID NO: 7825556 - DNA, 22 bp, Homo sapiens
atgtcttgggtttcagtttact

SEQ ID NO: 7825557 - DNA, 22 bp, Homo sapiens
atgtcttgatattttactgttt

SEQ ID NO: 7825558 - DNA, 22 bp, Homo sapiens
atgtcttctgtggagacaggta

SEQ ID NO: 7825559 - DNA, 22 bp, Homo sapiens
agagattataacagtttggacc

SEQ ID NO: 7825560 - DNA, 22 bp, Homo sapiens
agagattcctttggggaaagca

SEQ ID NO: 7825561 - DNA, 22 bp, Homo sapiens
agagattcatgtttactgtagg

SEQ ID NO: 7825562 - DNA, 22 bp, Homo sapiens
agagattctgtgtcaaaacgaa

SEQ ID NO: 7825563 - DNA, 22 bp, Homo sapiens
agagattctgtgtcaaaacgaa

SEQ ID NO: 7825564 - DNA, 21 bp, Homo sapiens
atgtgattatatgacttttac

SEQ ID NO: 7825565 - DNA, 22 bp, Homo sapiens
atgtgattcccactgaatcact

SEQ ID NO: 7825566 - DNA, 22 bp, Homo sapiens
atgtgattcccactgaatcact

SEQ ID NO: 7825567 - DNA, 22 bp, Homo sapiens
atgtgcaaagggacttgcacat

SEQ ID NO: 7825568 - DNA, 22 bp, Homo sapiens
atgtgagtgctatgatagacag

SEQ ID NO: 7825569 - DNA, 22 bp, Homo sapiens
agagattacagcagggtccagc

SEQ ID NO: 7825570 - DNA, 22 bp, Homo sapiens
agagattagcctggattatgca

SEQ ID NO: 7825571 - DNA, 22 bp, Homo sapiens
agagattaatactctataattt

SEQ ID NO: 7825572 - DNA, 22 bp, Homo sapiens
agagatgtctgaccactagact

SEQ ID NO: 7825573 - DNA, 22 bp, Homo sapiens
agagatgtcgccttgcccaggg

SEQ ID NO: 7825574 - DNA, 18 bp, Homo sapiens
agagatggtgtagagttt

SEQ ID NO: 7825575 - DNA, 18 bp, Homo sapiens
agagatggtgtagagttt

SEQ ID NO: 7825576 - DNA, 18 bp, Homo sapiens
agagatggtgtagagttt

SEQ ID NO: 7825577 - DNA, 18 bp, Homo sapiens
agagatggtgtagagttt

SEQ ID NO: 7825578 - DNA, 18 bp, Homo sapiens
agagatggtgtagagttt

SEQ ID NO: 7825579 - DNA, 18 bp, Homo sapiens
agagatggtgtagagttt

SEQ ID NO: 7825580 - DNA, 22 bp, Homo sapiens
agagatggtagaacagtcataa

SEQ ID NO: 7825581 - DNA, 22 bp, Homo sapiens
agagatggtagaacagtcataa

SEQ ID NO: 7825582 - DNA, 22 bp, Homo sapiens
agagatggtagaacagtcataa

SEQ ID NO: 7825583 - DNA, 22 bp, Homo sapiens
agagccaggatctgttttgggg

SEQ ID NO: 7825584 - DNA, 22 bp, Homo sapiens
agagccaggatctgttttgggg

SEQ ID NO: 7825585 - DNA, 22 bp, Homo sapiens
agagccaggatgtcttctgggg

SEQ ID NO: 7825586 - DNA, 22 bp, Homo sapiens
agagccaggatgtcttctgggg

SEQ ID NO: 7825587 - DNA, 22 bp, Homo sapiens
agagccaggatgtcttctgggg

SEQ ID NO: 7825588 - DNA, 22 bp, Homo sapiens
agagccaggatctgttttgggg

SEQ ID NO: 7825589 - DNA, 22 bp, Homo sapiens
agagccaggactgtgtctcact

SEQ ID NO: 7825590 - DNA, 22 bp, Homo sapiens
agagccaggactgtgtctcact

SEQ ID NO: 7825591 - DNA, 22 bp, Homo sapiens
agagccaggactgtgtctcact

SEQ ID NO: 7825592 - DNA, 22 bp, Homo sapiens
agagccaggactgtgtctcact

SEQ ID NO: 7825593 - DNA, 22 bp, Homo sapiens
agagccaggaagtggcgtgggg

SEQ ID NO: 7825594 - DNA, 22 bp, Homo sapiens
agagccaggactgtgtctcact

SEQ ID NO: 7825595 - DNA, 22 bp, Homo sapiens
agagccaggaagtggcgtgggg

SEQ ID NO: 7825596 - DNA, 22 bp, Homo sapiens
agagccaggcaggcaatgttga

SEQ ID NO: 7825597 - DNA, 22 bp, Homo sapiens
agagccaggatgtcttctgggg

SEQ ID NO: 7825598 - DNA, 22 bp, Homo sapiens
agagccaggatgtcttctgggg

SEQ ID NO: 7825599 - DNA, 22 bp, Homo sapiens
atgttacactgtttcacgttcc

SEQ ID NO: 7825600 - DNA, 22 bp, Homo sapiens
atgttacactgtttcacgttcc

SEQ ID NO: 7825601 - DNA, 22 bp, Homo sapiens
atgttacagaaactaagaggct

SEQ ID NO: 7825602 - DNA, 22 bp, Homo sapiens
atgttacagaaagcaaagatga

SEQ ID NO: 7825603 - DNA, 22 bp, Homo sapiens
agagccaggcaggcaatgttga

SEQ ID NO: 7825604 - DNA, 22 bp, Homo sapiens
atgttacagaaagcaaagatga

SEQ ID NO: 7825605 - DNA, 22 bp, Homo sapiens
atgttacagaaagcaaagatga

SEQ ID NO: 7825606 - DNA, 22 bp, Homo sapiens
atgttacagaaagcaaagatga

SEQ ID NO: 7825607 - DNA, 22 bp, Homo sapiens
agagccagcatttgggccctgc

SEQ ID NO: 7825608 - DNA, 22 bp, Homo sapiens
agagccagcatttgggccctgc

SEQ ID NO: 7825609 - DNA, 22 bp, Homo sapiens
agagccagcatttgggccctgc

SEQ ID NO: 7825610 - DNA, 22 bp, Homo sapiens
agagccagcatttgggccctgc

SEQ ID NO: 7825611 - DNA, 22 bp, Homo sapiens
agagccagcatttgggccctgc

SEQ ID NO: 7825612 - DNA, 22 bp, Homo sapiens
agagccagcatttgacactggc

SEQ ID NO: 7825613 - DNA, 22 bp, Homo sapiens
agagccagccttctcagcttac

SEQ ID NO: 7825614 - DNA, 22 bp, Homo sapiens
agagccagccttctcagcttac

SEQ ID NO: 7825615 - DNA, 22 bp, Homo sapiens
agagccaggaagtggcgtgggg

SEQ ID NO: 7825616 - DNA, 22 bp, Homo sapiens
agagccaggaagtggcgtgggg

SEQ ID NO: 7825617 - DNA, 22 bp, Homo sapiens
agagccaggaagtggcgtgggg

SEQ ID NO: 7825618 - DNA, 22 bp, Homo sapiens
agagccaggaagtggcgtgggg

SEQ ID NO: 7825619 - DNA, 22 bp, Homo sapiens
agagccaggaagtggcgtgggg

SEQ ID NO: 7825620 - DNA, 22 bp, Homo sapiens
agagccagcatttgacactggc

SEQ ID NO: 7825621 - DNA, 22 bp, Homo sapiens
agagccagcatttgacactggc

SEQ ID NO: 7825622 - DNA, 22 bp, Homo sapiens
agagccagcatttgacactggc

SEQ ID NO: 7825623 - DNA, 22 bp, Homo sapiens
agagccagcatttgacactggc

SEQ ID NO: 7825624 - DNA, 22 bp, Homo sapiens
agagccagcatttgacactggc

SEQ ID NO: 7825625 - DNA, 22 bp, Homo sapiens
agagccagcatttgacactggc

SEQ ID NO: 7825626 - DNA, 22 bp, Homo sapiens
agagccagcatttgacactggc

SEQ ID NO: 7825627 - DNA, 22 bp, Homo sapiens
agagccagcatttgacactggc

SEQ ID NO: 7825628 - DNA, 22 bp, Homo sapiens
agagccagcatttgacactggc

SEQ ID NO: 7825629 - DNA, 22 bp, Homo sapiens
atgtgcatgtgcacacatgcgt

SEQ ID NO: 7825630 - DNA, 22 bp, Homo sapiens
atgtgcatgtgcacacatgcgt

SEQ ID NO: 7825631 - DNA, 19 bp, Homo sapiens
atgtgcatttgtgtgaggt

SEQ ID NO: 7825632 - DNA, 22 bp, Homo sapiens
atgtgcattaaatgtcaatgtt

SEQ ID NO: 7825633 - DNA, 22 bp, Homo sapiens
atgtgccaacgtgcaggtttgt

SEQ ID NO: 7825634 - DNA, 22 bp, Homo sapiens
agagccagcaagtgaatagtga

SEQ ID NO: 7825635 - DNA, 22 bp, Homo sapiens
atgactgttatgggactggaac

SEQ ID NO: 7825636 - DNA, 22 bp, Homo sapiens
atgacttattacaagtcatatt

SEQ ID NO: 7825637 - DNA, 22 bp, Homo sapiens
atgacttaatcatacttgcatt

SEQ ID NO: 7825638 - DNA, 22 bp, Homo sapiens
atgactgctctgggctcccatg

SEQ ID NO: 7825639 - DNA, 22 bp, Homo sapiens
atgactgattacccaagcctct

SEQ ID NO: 7825640 - DNA, 19 bp, Homo sapiens
atgactcttattgtctgaa

SEQ ID NO: 7825641 - DNA, 22 bp, Homo sapiens
atgactcttagctaaaggtaag

SEQ ID NO: 7825642 - DNA, 22 bp, Homo sapiens
atgactctccagagctgcagat

SEQ ID NO: 7825643 - DNA, 22 bp, Homo sapiens
atgactctccagagctgcagat

SEQ ID NO: 7825644 - DNA, 22 bp, Homo sapiens
atgactctaagaattctagatg

SEQ ID NO: 7825645 - DNA, 22 bp, Homo sapiens
atgactcaaaattattgttttg

SEQ ID NO: 7825646 - DNA, 22 bp, Homo sapiens
atgacctgaggccttactctag

SEQ ID NO: 7825647 - DNA, 21 bp, Homo sapiens
atgacctgggaagatgctcaa

SEQ ID NO: 7825648 - DNA, 22 bp, Homo sapiens
atgacccccaagggcagcgtga

SEQ ID NO: 7825649 - DNA, 22 bp, Homo sapiens
atgacccttactgcatcataca

SEQ ID NO: 7825650 - DNA, 22 bp, Homo sapiens
atgacccaagctcatggctccc

SEQ ID NO: 7825651 - DNA, 22 bp, Homo sapiens
atgacccaagctcatggctccc

SEQ ID NO: 7825652 - DNA, 22 bp, Homo sapiens
atgaccagtttccccactgtcc

SEQ ID NO: 7825653 - DNA, 22 bp, Homo sapiens
atgaccagtgttgctggccccg

SEQ ID NO: 7825654 - DNA, 22 bp, Homo sapiens
atgaccagtgttgctggccccg

SEQ ID NO: 7825655 - DNA, 22 bp, Homo sapiens
atgaccagccgagataaacaga

SEQ ID NO: 7825656 - DNA, 22 bp, Homo sapiens
atgaccagccgagataaacaga

SEQ ID NO: 7825657 - DNA, 22 bp, Homo sapiens
atgaccagccgagataaacaga

SEQ ID NO: 7825658 - DNA, 22 bp, Homo sapiens
atgacatttatacagtgagctt

SEQ ID NO: 7825659 - DNA, 22 bp, Homo sapiens
atgacattgacagacctgctgc

SEQ ID NO: 7825660 - DNA, 22 bp, Homo sapiens
atgacaatatagctttgatttt

SEQ ID NO: 7825661 - DNA, 22 bp, Homo sapiens
atgacaatatagctttgatttt

SEQ ID NO: 7825662 - DNA, 22 bp, Homo sapiens
atgaccagactctcagtggggt

SEQ ID NO: 7825663 - DNA, 22 bp, Homo sapiens
atgaccagccgagataaacaga

SEQ ID NO: 7825664 - DNA, 22 bp, Homo sapiens
atcttacactgttgggtttctc

SEQ ID NO: 7825665 - DNA, 22 bp, Homo sapiens
atcttacagcagcaaggaagta

SEQ ID NO: 7825666 - DNA, 22 bp, Homo sapiens
atcttacagcagcaaggaagta

SEQ ID NO: 7825667 - DNA, 19 bp, Homo sapiens
atcttacagagcagagtac

SEQ ID NO: 7825668 - DNA, 19 bp, Homo sapiens
atcttacagagcagagtac

SEQ ID NO: 7825669 - DNA, 22 bp, Homo sapiens
atcttacaattacaagacactc

SEQ ID NO: 7825670 - DNA, 22 bp, Homo sapiens
atcttacaattacaagacactc

SEQ ID NO: 7825671 - DNA, 22 bp, Homo sapiens
atcttacaattacaagacactc

SEQ ID NO: 7825672 - DNA, 22 bp, Homo sapiens
atcttacacgataactgttagt

SEQ ID NO: 7825673 - DNA, 22 bp, Homo sapiens
atcttaatcgagtccatgaaaa

SEQ ID NO: 7825674 - DNA, 22 bp, Homo sapiens
atcttacaattacaagacactc

SEQ ID NO: 7825675 - DNA, 23 bp, Homo sapiens
atcttagcatagacttgagtccc

SEQ ID NO: 7825676 - DNA, 22 bp, Homo sapiens
atgacaatacttcaataagctg

SEQ ID NO: 7825677 - DNA, 22 bp, Homo sapiens
atgacaatatagctttgatttt

SEQ ID NO: 7825678 - DNA, 22 bp, Homo sapiens
atcttagaagtttgataaaatc

SEQ ID NO: 7825679 - DNA, 22 bp, Homo sapiens
atcttagaagtttgataaaatc

SEQ ID NO: 7825680 - DNA, 22 bp, Homo sapiens
atcttagacccttggtagaaaa

SEQ ID NO: 7825681 - DNA, 22 bp, Homo sapiens
atcttacattccctcaccattt

SEQ ID NO: 7825682 - DNA, 23 bp, Homo sapiens
atcttacatatttagcacctgaa

SEQ ID NO: 7825683 - DNA, 22 bp, Homo sapiens
atctggctgactttgtgggaca

SEQ ID NO: 7825684 - DNA, 22 bp, Homo sapiens
atctggcttacgaagcactggt

SEQ ID NO: 7825685 - DNA, 22 bp, Homo sapiens
atctggcttacgaagcactggt

SEQ ID NO: 7825686 - DNA, 22 bp, Homo sapiens
atctgggagacccttgcgggaa

SEQ ID NO: 7825687 - DNA, 22 bp, Homo sapiens
atctgggaatggaagccttctg

SEQ ID NO: 7825688 - DNA, 22 bp, Homo sapiens
atctgggagtcttggctctgct

SEQ ID NO: 7825689 - DNA, 22 bp, Homo sapiens
atctgggcagggcagcaaggcg

SEQ ID NO: 7825690 - DNA, 22 bp, Homo sapiens
atctgggcagggcagcaaggcg

SEQ ID NO: 7825691 - DNA, 23 bp, Homo sapiens
atctgggcatctggagtggtcct

SEQ ID NO: 7825692 - DNA, 20 bp, Homo sapiens
atctgggcatcaattttgtg

SEQ ID NO: 7825693 - DNA, 22 bp, Homo sapiens
atctgggcagggcagcaaggcg

SEQ ID NO: 7825694 - DNA, 22 bp, Homo sapiens
atctgggcctgttccctcacct

SEQ ID NO: 7825695 - DNA, 22 bp, Homo sapiens
atctgggcgtataggtgcaagt

SEQ ID NO: 7825696 - DNA, 22 bp, Homo sapiens
atctgggccagccccaagagac

SEQ ID NO: 7825697 - DNA, 22 bp, Homo sapiens
atctgggccagccccaagagac

SEQ ID NO: 7825698 - DNA, 22 bp, Homo sapiens
atctgggccagccccaagagac

SEQ ID NO: 7825699 - DNA, 22 bp, Homo sapiens
atctgggccaatcctagtacca

SEQ ID NO: 7825700 - DNA, 22 bp, Homo sapiens
atctgggcatggaggaaagaga

SEQ ID NO: 7825701 - DNA, 22 bp, Homo sapiens
atctgggccaatcctagtacca

SEQ ID NO: 7825702 - DNA, 22 bp, Homo sapiens
atctgggcatggaggaaagaga

SEQ ID NO: 7825703 - DNA, 23 bp, Homo sapiens
atctgggcatctggagtggtcct

SEQ ID NO: 7825704 - DNA, 23 bp, Homo sapiens
atctgggcatctggagtggtcct

SEQ ID NO: 7825705 - DNA, 22 bp, Homo sapiens
atcttaaacagaggaatgactt

SEQ ID NO: 7825706 - DNA, 22 bp, Homo sapiens
atcttaaacagaggaatgactt

SEQ ID NO: 7825707 - DNA, 22 bp, Homo sapiens
atcttaaacagaggaatgactt

SEQ ID NO: 7825708 - DNA, 21 bp, Homo sapiens
atcttaaaaggtcttaacttt

SEQ ID NO: 7825709 - DNA, 22 bp, Homo sapiens
atctgttttgatacagttttat

SEQ ID NO: 7825710 - DNA, 21 bp, Homo sapiens
atcttaaaaggtcttaacttt

SEQ ID NO: 7825711 - DNA, 22 bp, Homo sapiens
atctgttgtttttcaccaccca

SEQ ID NO: 7825712 - DNA, 22 bp, Homo sapiens
atctgtttaattcattttcaca

SEQ ID NO: 7825713 - DNA, 22 bp, Homo sapiens
atctgtttaattcattttcaca

SEQ ID NO: 7825714 - DNA, 22 bp, Homo sapiens
atctgttgtttttcaccaccca

SEQ ID NO: 7825715 - DNA, 22 bp, Homo sapiens
atctgttgttttctcatatgtt

SEQ ID NO: 7825716 - DNA, 22 bp, Homo sapiens
atctggggcctgggctagccat

SEQ ID NO: 7825717 - DNA, 22 bp, Homo sapiens
atctgggggagctgctcatgga

SEQ ID NO: 7825718 - DNA, 22 bp, Homo sapiens
atctggggtcagacagccctgg

SEQ ID NO: 7825719 - DNA, 22 bp, Homo sapiens
atctgggtcacagtggcatcta

SEQ ID NO: 7825720 - DNA, 22 bp, Homo sapiens
atctgggtaaagtggtatattt

SEQ ID NO: 7825721 - DNA, 22 bp, Homo sapiens
atctgggtagtgcaagacatga

SEQ ID NO: 7825722 - DNA, 22 bp, Homo sapiens
atctgggctcgaatcctagctc

SEQ ID NO: 7825723 - DNA, 22 bp, Homo sapiens
atctgggcgtataggtgcaagt

SEQ ID NO: 7825724 - DNA, 22 bp, Homo sapiens
atctgggctcgaatcctagctc

SEQ ID NO: 7825725 - DNA, 22 bp, Homo sapiens
atctgggcctgttccctcacct

SEQ ID NO: 7825726 - DNA, 22 bp, Homo sapiens
atctggggcctgggctagccat

SEQ ID NO: 7825727 - DNA, 22 bp, Homo sapiens
atgcaaatgtcaccacttctaa

SEQ ID NO: 7825728 - DNA, 22 bp, Homo sapiens
atgcaaatggcaatgagtgacc

SEQ ID NO: 7825729 - DNA, 22 bp, Homo sapiens
atgcaaatggcaatgagtgacc

SEQ ID NO: 7825730 - DNA, 22 bp, Homo sapiens
atgattttctgataaagaactg

SEQ ID NO: 7825731 - DNA, 22 bp, Homo sapiens
atgcaaattaacatatagtaga

SEQ ID NO: 7825732 - DNA, 22 bp, Homo sapiens
atgcaaattaacatatagtaga

SEQ ID NO: 7825733 - DNA, 22 bp, Homo sapiens
atgcaaattcttaggctccatc

SEQ ID NO: 7825734 - DNA, 22 bp, Homo sapiens
atgattttctgataaagaactg

SEQ ID NO: 7825735 - DNA, 22 bp, Homo sapiens
atgattttctgataaagaactg

SEQ ID NO: 7825736 - DNA, 22 bp, Homo sapiens
atgatttgttaacagacttaat

SEQ ID NO: 7825737 - DNA, 22 bp, Homo sapiens
atgattttctgataaagaactg

SEQ ID NO: 7825738 - DNA, 22 bp, Homo sapiens
atgatttaaagtcattgtgaac

SEQ ID NO: 7825739 - DNA, 22 bp, Homo sapiens
atgatttaaagtcattgtgaac

SEQ ID NO: 7825740 - DNA, 22 bp, Homo sapiens
atgatttaaagtcattgtgaac

SEQ ID NO: 7825741 - DNA, 22 bp, Homo sapiens
atgatttaaagtcattgtgaac

SEQ ID NO: 7825742 - DNA, 22 bp, Homo sapiens
atgatttaaagtcattgtgaac

SEQ ID NO: 7825743 - DNA, 22 bp, Homo sapiens
atgatttaaagtcattgtgaac

SEQ ID NO: 7825744 - DNA, 22 bp, Homo sapiens
atgattgaccatctgctgggct

SEQ ID NO: 7825745 - DNA, 22 bp, Homo sapiens
atgattgaaaatgacattgcca

SEQ ID NO: 7825746 - DNA, 22 bp, Homo sapiens
atgattctggtgagaatgagga

SEQ ID NO: 7825747 - DNA, 22 bp, Homo sapiens
atgattgaaaatgacattgcca

SEQ ID NO: 7825748 - DNA, 22 bp, Homo sapiens
atgattgaaaatgacattgcca

SEQ ID NO: 7825749 - DNA, 22 bp, Homo sapiens
atgattgaaaatgacattgcca

SEQ ID NO: 7825750 - DNA, 22 bp, Homo sapiens
atgattgaaaatgacattgcca

SEQ ID NO: 7825751 - DNA, 22 bp, Homo sapiens
atgattgaccatctgctgggct

SEQ ID NO: 7825752 - DNA, 22 bp, Homo sapiens
atgattctggcaaatttattat

SEQ ID NO: 7825753 - DNA, 22 bp, Homo sapiens
atgattctctgctactctaaat

SEQ ID NO: 7825754 - DNA, 22 bp, Homo sapiens
atgattctcattttataaactt

SEQ ID NO: 7825755 - DNA, 20 bp, Homo sapiens
atgattcatgatgatgtctc

SEQ ID NO: 7825756 - DNA, 19 bp, Homo sapiens
atgattcccagggaggggg

SEQ ID NO: 7825757 - DNA, 17 bp, Homo sapiens
atgattccatcaggatt

SEQ ID NO: 7825758 - DNA, 22 bp, Homo sapiens
atgattctaggcattgaagata

SEQ ID NO: 7825759 - DNA, 22 bp, Homo sapiens
atgattccttgaagcctcatga

SEQ ID NO: 7825760 - DNA, 22 bp, Homo sapiens
atgactttcctggcaaaagttg

SEQ ID NO: 7825761 - DNA, 22 bp, Homo sapiens
atgacttattacaagtcatatt

SEQ ID NO: 7825762 - DNA, 22 bp, Homo sapiens
atgacttattacaagtcatatt

SEQ ID NO: 7825763 - DNA, 22 bp, Homo sapiens
atgactttcctggcaaaagttg

SEQ ID NO: 7825764 - DNA, 22 bp, Homo sapiens
atgactttcctggcaaaagttg

SEQ ID NO: 7825765 - DNA, 22 bp, Homo sapiens
atgactttgttgttttccagcg

SEQ ID NO: 7825766 - DNA, 22 bp, Homo sapiens
atgacttttaggagcagtgctc

SEQ ID NO: 7825767 - DNA, 22 bp, Homo sapiens
atgagaaaattgaggcccatag

SEQ ID NO: 7825768 - DNA, 22 bp, Homo sapiens
atgagaaaattgaggcccatag

SEQ ID NO: 7825769 - DNA, 22 bp, Homo sapiens
atgagaaaattcattccatcca

SEQ ID NO: 7825770 - DNA, 22 bp, Homo sapiens
atgagaaaattcattccatcca

SEQ ID NO: 7825771 - DNA, 22 bp, Homo sapiens
atgagaaaattcattccatcca

SEQ ID NO: 7825772 - DNA, 22 bp, Homo sapiens
atgaggagccctcatttaggtt

SEQ ID NO: 7825773 - DNA, 22 bp, Homo sapiens
atgaggacaaagtgtagcagcc

SEQ ID NO: 7825774 - DNA, 22 bp, Homo sapiens
atgaggagaccaaggcctgatg

SEQ ID NO: 7825775 - DNA, 22 bp, Homo sapiens
atgagaaagagttgtatctaga

SEQ ID NO: 7825776 - DNA, 22 bp, Homo sapiens
atgagaaagagttgtatctaga

SEQ ID NO: 7825777 - DNA, 22 bp, Homo sapiens
atgagaaaattcattccatcca

SEQ ID NO: 7825778 - DNA, 22 bp, Homo sapiens
atgagaaagagttgtatctaga

SEQ ID NO: 7825779 - DNA, 22 bp, Homo sapiens
atgagaaagagttgtatctaga

SEQ ID NO: 7825780 - DNA, 22 bp, Homo sapiens
atgaggaagtctgataatggta

SEQ ID NO: 7825781 - DNA, 22 bp, Homo sapiens
atgaggaggccagtaagagcct

SEQ ID NO: 7825782 - DNA, 22 bp, Homo sapiens
atgaggagctccttgaaatgag

SEQ ID NO: 7825783 - DNA, 22 bp, Homo sapiens
atgaggcaaaggtggaggtggg

SEQ ID NO: 7825784 - DNA, 22 bp, Homo sapiens
atgaggcaaaggtggaggtggg

SEQ ID NO: 7825785 - DNA, 22 bp, Homo sapiens
atgaggcaaggctggccgtgtt

SEQ ID NO: 7825786 - DNA, 22 bp, Homo sapiens
atgaggcaaggctggccgtgtt

SEQ ID NO: 7825787 - DNA, 22 bp, Homo sapiens
atgaggcaaaggtggaggtggg

SEQ ID NO: 7825788 - DNA, 22 bp, Homo sapiens
atgaggcaaaggtggaggtggg

SEQ ID NO: 7825789 - DNA, 22 bp, Homo sapiens
atgaggcaaggatcaggtaagg

SEQ ID NO: 7825790 - DNA, 22 bp, Homo sapiens
atgaggcacagagatgttaatg

SEQ ID NO: 7825791 - DNA, 22 bp, Homo sapiens
atgaggcacatcacagccaatg

SEQ ID NO: 7825792 - DNA, 22 bp, Homo sapiens
atgaggcacatcacagccaatg

SEQ ID NO: 7825793 - DNA, 22 bp, Homo sapiens
atgaggcacatcacagccaatg

SEQ ID NO: 7825794 - DNA, 22 bp, Homo sapiens
atgaggcacgtgttactggcct

SEQ ID NO: 7825795 - DNA, 22 bp, Homo sapiens
atgatatagagagtagattaaa

SEQ ID NO: 7825796 - DNA, 22 bp, Homo sapiens
atgaggcacagagatgttaatg

SEQ ID NO: 7825797 - DNA, 22 bp, Homo sapiens
atgaggcaatcatggtccagtt

SEQ ID NO: 7825798 - DNA, 22 bp, Homo sapiens
atgaggcaatcatggtccagtt

SEQ ID NO: 7825799 - DNA, 22 bp, Homo sapiens
atgaggcaatagaatattgaat

SEQ ID NO: 7825800 - DNA, 22 bp, Homo sapiens
atgaggcaatagaatattgaat

SEQ ID NO: 7825801 - DNA, 22 bp, Homo sapiens
atgctgattttatagaataaag

SEQ ID NO: 7825802 - DNA, 22 bp, Homo sapiens
atgctgcacaagccacatgtag

SEQ ID NO: 7825803 - DNA, 22 bp, Homo sapiens
atgctgatctgtaataagattt

SEQ ID NO: 7825804 - DNA, 22 bp, Homo sapiens
atgctgatgaggtcaggaagac

SEQ ID NO: 7825805 - DNA, 22 bp, Homo sapiens
atgcttaggttaaatttgtaat

SEQ ID NO: 7825806 - DNA, 22 bp, Homo sapiens
atgcttaatgagggtatatatg

SEQ ID NO: 7825807 - DNA, 22 bp, Homo sapiens
atgctgcagtcaggccagattg

SEQ ID NO: 7825808 - DNA, 22 bp, Homo sapiens
atgctgcagctgcaggatcaga

SEQ ID NO: 7825809 - DNA, 18 bp, Homo sapiens
atgctgccctctgagggt

SEQ ID NO: 7825810 - DNA, 22 bp, Homo sapiens
atgctgaggacaaagagatcaa

SEQ ID NO: 7825811 - DNA, 22 bp, Homo sapiens
atgctgagatcctcaggccaga

SEQ ID NO: 7825812 - DNA, 22 bp, Homo sapiens
atgctgagatcctcaggccaga

SEQ ID NO: 7825813 - DNA, 22 bp, Homo sapiens
atgctgagataaggctttagtc

SEQ ID NO: 7825814 - DNA, 22 bp, Homo sapiens
atgctgagactggagcagctgg

SEQ ID NO: 7825815 - DNA, 22 bp, Homo sapiens
agacatagggaggcatataaat

SEQ ID NO: 7825816 - DNA, 22 bp, Homo sapiens
agacatagggaggcatataaat

SEQ ID NO: 7825817 - DNA, 22 bp, Homo sapiens
agacataggattccacatagca

SEQ ID NO: 7825818 - DNA, 22 bp, Homo sapiens
agacatatattgcaattcactg

SEQ ID NO: 7825819 - DNA, 22 bp, Homo sapiens
atgcgtgcaggggtcctcctgg

SEQ ID NO: 7825820 - DNA, 22 bp, Homo sapiens
atgcgtgtgtgcaaaccattgc

SEQ ID NO: 7825821 - DNA, 22 bp, Homo sapiens
atgcgtgtaggaacagtgtcta

SEQ ID NO: 7825822 - DNA, 22 bp, Homo sapiens
atgcgtgtttgtatacacacaa

SEQ ID NO: 7825823 - DNA, 22 bp, Homo sapiens
atgctgaaatttattggtaagg

SEQ ID NO: 7825824 - DNA, 22 bp, Homo sapiens
atgctgaactgagatgtaactt

SEQ ID NO: 7825825 - DNA, 22 bp, Homo sapiens
atgctgaaccttaacttggagc

SEQ ID NO: 7825826 - DNA, 22 bp, Homo sapiens
atgctgaagaatcacagggact

SEQ ID NO: 7825827 - DNA, 22 bp, Homo sapiens
atgctgaagagagaactactca

SEQ ID NO: 7825828 - DNA, 22 bp, Homo sapiens
atgctgaagaatcacagggact

SEQ ID NO: 7825829 - DNA, 21 bp, Homo sapiens
atgctgaatcttgttgtgctc

SEQ ID NO: 7825830 - DNA, 22 bp, Homo sapiens
atgctgaatattagcctcatga

SEQ ID NO: 7825831 - DNA, 22 bp, Homo sapiens
atgctgaatagttcactcttct

SEQ ID NO: 7825832 - DNA, 22 bp, Homo sapiens
atgctgaattgatgcgagggag

SEQ ID NO: 7825833 - DNA, 22 bp, Homo sapiens
atgctgaatgaaagaaattagt

SEQ ID NO: 7825834 - DNA, 22 bp, Homo sapiens
atgctgaattgatgcgagggag

SEQ ID NO: 7825835 - DNA, 22 bp, Homo sapiens
atgctgacagactattaactat

SEQ ID NO: 7825836 - DNA, 22 bp, Homo sapiens
atgctgacttctctctgcagtg

SEQ ID NO: 7825837 - DNA, 22 bp, Homo sapiens
atgctgaccaagcaggacatgg

SEQ ID NO: 7825838 - DNA, 22 bp, Homo sapiens
atgctgaaggccatcctgcatc

SEQ ID NO: 7825839 - DNA, 22 bp, Homo sapiens
atgctgaagagttcatgattat

SEQ ID NO: 7825840 - DNA, 22 bp, Homo sapiens
atgctgaaggccatcctgcatc

SEQ ID NO: 7825841 - DNA, 22 bp, Homo sapiens
atgctgaaggtgaattgacaat

SEQ ID NO: 7825842 - DNA, 22 bp, Homo sapiens
atgctgaagtgtgtttgaagta

SEQ ID NO: 7825843 - DNA, 22 bp, Homo sapiens
atgctgaagagagaactactca

SEQ ID NO: 7825844 - DNA, 22 bp, Homo sapiens
atgctgaagagtgcacaggcta

SEQ ID NO: 7825845 - DNA, 22 bp, Homo sapiens
atgctgaagagtgcacaggcta

SEQ ID NO: 7825846 - DNA, 22 bp, Homo sapiens
atgctgaagagtgcacaggcta

SEQ ID NO: 7825847 - DNA, 22 bp, Homo sapiens
agagaaacaggtcagctgggag

SEQ ID NO: 7825848 - DNA, 22 bp, Homo sapiens
agagaacaaattaaaggtggtt

SEQ ID NO: 7825849 - DNA, 22 bp, Homo sapiens
agagaacacgtgcatctgcaat

SEQ ID NO: 7825850 - DNA, 22 bp, Homo sapiens
agagaacagcattgcagctttg

SEQ ID NO: 7825851 - DNA, 22 bp, Homo sapiens
agagaacagacagatgcaatga

SEQ ID NO: 7825852 - DNA, 22 bp, Homo sapiens
agagaacagacagatgcaatga

SEQ ID NO: 7825853 - DNA, 22 bp, Homo sapiens
agagaacagacagatgcaatga

SEQ ID NO: 7825854 - DNA, 22 bp, Homo sapiens
agagaacagacagatgcaatga

SEQ ID NO: 7825855 - DNA, 22 bp, Homo sapiens
agagaacagacagatgcaatga

SEQ ID NO: 7825856 - DNA, 22 bp, Homo sapiens
agagaacagacagatgcaatga

SEQ ID NO: 7825857 - DNA, 22 bp, Homo sapiens
agagaaacaggtcagctgggag

SEQ ID NO: 7825858 - DNA, 22 bp, Homo sapiens
agagaaaagccatcccagccaa

SEQ ID NO: 7825859 - DNA, 22 bp, Homo sapiens
agagaaaagccatcccagccaa

SEQ ID NO: 7825860 - DNA, 22 bp, Homo sapiens
agagaaatttccctgccttctg

SEQ ID NO: 7825861 - DNA, 22 bp, Homo sapiens
agagaacaaattaaaggtggtt

SEQ ID NO: 7825862 - DNA, 20 bp, Homo sapiens
atgcttgagatcacaatcct

SEQ ID NO: 7825863 - DNA, 22 bp, Homo sapiens
agagaaaagccatcccagccaa

SEQ ID NO: 7825864 - DNA, 22 bp, Homo sapiens
atgcttctggtataagaaaaat

SEQ ID NO: 7825865 - DNA, 22 bp, Homo sapiens
atgcttctgtaatgtgggaatg

SEQ ID NO: 7825866 - DNA, 22 bp, Homo sapiens
atgcttctggtataagaaaaat

SEQ ID NO: 7825867 - DNA, 22 bp, Homo sapiens
atgcttctgtgtatgtttcagg

SEQ ID NO: 7825868 - DNA, 22 bp, Homo sapiens
atgcttctgttgcttaggaggt

SEQ ID NO: 7825869 - DNA, 22 bp, Homo sapiens
atgcttcttgtatttggctgac

SEQ ID NO: 7825870 - DNA, 22 bp, Homo sapiens
atgcttcttgagatagaaacac

SEQ ID NO: 7825871 - DNA, 22 bp, Homo sapiens
atgcttctgttgcttaggaggt

SEQ ID NO: 7825872 - DNA, 22 bp, Homo sapiens
atgcttcttgagatagaaacac

SEQ ID NO: 7825873 - DNA, 22 bp, Homo sapiens
atgcttcttgagatagaaacac

SEQ ID NO: 7825874 - DNA, 22 bp, Homo sapiens
atgcttcagtgctaccttcaaa

SEQ ID NO: 7825875 - DNA, 22 bp, Homo sapiens
atgcttccctttgctccacatg

SEQ ID NO: 7825876 - DNA, 22 bp, Homo sapiens
atgcttcctaaccatggccgtg

SEQ ID NO: 7825877 - DNA, 22 bp, Homo sapiens
atgcttccctcacatatcctgg

SEQ ID NO: 7825878 - DNA, 22 bp, Homo sapiens
atgcttctgctcatatttcatt

SEQ ID NO: 7825879 - DNA, 18 bp, Homo sapiens
atgcttctgatagaagca

SEQ ID NO: 7825880 - DNA, 22 bp, Homo sapiens
atgcttctgctcatatttcatt

SEQ ID NO: 7825881 - DNA, 22 bp, Homo sapiens
atgcttctgctcatatttcatt

SEQ ID NO: 7825882 - DNA, 22 bp, Homo sapiens
atgcttctggtataagaaaaat

SEQ ID NO: 7825883 - DNA, 18 bp, Homo sapiens
atgcttctgatagaagca

SEQ ID NO: 7825884 - DNA, 22 bp, Homo sapiens
atgcttctgaagaagaaaagac

SEQ ID NO: 7825885 - DNA, 22 bp, Homo sapiens
atgcttctgaagaagaaaagac

SEQ ID NO: 7825886 - DNA, 18 bp, Homo sapiens
atgcttctgatagaagca

SEQ ID NO: 7825887 - DNA, 22 bp, Homo sapiens
atgcttctgaagaagaaaagac

SEQ ID NO: 7825888 - DNA, 22 bp, Homo sapiens
atgcttctcctgaacatccctg

SEQ ID NO: 7825889 - DNA, 22 bp, Homo sapiens
atgcttctgaagaagaaaagac

SEQ ID NO: 7825890 - DNA, 22 bp, Homo sapiens
atgcttcctcccttccactcaa

SEQ ID NO: 7825891 - DNA, 22 bp, Homo sapiens
atgcttcctctacggcctctga

SEQ ID NO: 7825892 - DNA, 22 bp, Homo sapiens
atgccaggagatggagcagagt

SEQ ID NO: 7825893 - DNA, 22 bp, Homo sapiens
atgccaggagatggagcagagt

SEQ ID NO: 7825894 - DNA, 23 bp, Homo sapiens
atgccaggctgcctggccagcct

SEQ ID NO: 7825895 - DNA, 22 bp, Homo sapiens
atgccaggctgtttggcctcag

SEQ ID NO: 7825896 - DNA, 22 bp, Homo sapiens
atgccaggaacaaacagtggtg

SEQ ID NO: 7825897 - DNA, 22 bp, Homo sapiens
atgccagcctctaagcacttta

SEQ ID NO: 7825898 - DNA, 22 bp, Homo sapiens
atgccagacattaacgactatg

SEQ ID NO: 7825899 - DNA, 22 bp, Homo sapiens
atgccaggagatggagcagagt

SEQ ID NO: 7825900 - DNA, 22 bp, Homo sapiens
atgccaggaacaaacagtggtg

SEQ ID NO: 7825901 - DNA, 22 bp, Homo sapiens
atgccaggaacaaacagtggtg

SEQ ID NO: 7825902 - DNA, 22 bp, Homo sapiens
atgccaggaacaaacagtggtg

SEQ ID NO: 7825903 - DNA, 22 bp, Homo sapiens
atgccaggaacaaacagtggtg

SEQ ID NO: 7825904 - DNA, 22 bp, Homo sapiens
atgccacttctctaagtcatgt

SEQ ID NO: 7825905 - DNA, 22 bp, Homo sapiens
atgccagaaaatgatggctgca

SEQ ID NO: 7825906 - DNA, 22 bp, Homo sapiens
atgccactgcactccagcctag

SEQ ID NO: 7825907 - DNA, 22 bp, Homo sapiens
atgccacttcattccagcctcg

SEQ ID NO: 7825908 - DNA, 22 bp, Homo sapiens
atgccacttcattccagcctcg

SEQ ID NO: 7825909 - DNA, 22 bp, Homo sapiens
atgccactgcactccagcctag

SEQ ID NO: 7825910 - DNA, 19 bp, Homo sapiens
atgcaacaaaagtgtaaga

SEQ ID NO: 7825911 - DNA, 22 bp, Homo sapiens
atgcaacaaattgtgtgcaata

SEQ ID NO: 7825912 - DNA, 22 bp, Homo sapiens
atgcaaattctttgcttcttct

SEQ ID NO: 7825913 - DNA, 22 bp, Homo sapiens
atgcaaattctttgcttcttct

SEQ ID NO: 7825914 - DNA, 22 bp, Homo sapiens
atgcaaattctttgcttcttct

SEQ ID NO: 7825915 - DNA, 22 bp, Homo sapiens
atgcaaattgccataaagtggg

SEQ ID NO: 7825916 - DNA, 22 bp, Homo sapiens
atgcaaattgccataaagtggg

SEQ ID NO: 7825917 - DNA, 22 bp, Homo sapiens
atgcaaattgccataaagtggg

SEQ ID NO: 7825918 - DNA, 22 bp, Homo sapiens
atgcaacacccctatggatgga

SEQ ID NO: 7825919 - DNA, 22 bp, Homo sapiens
atgcaacacccctatggatgga

SEQ ID NO: 7825920 - DNA, 22 bp, Homo sapiens
atgcaacagctgggaatatgta

SEQ ID NO: 7825921 - DNA, 22 bp, Homo sapiens
atgccatttcaaaataagattt

SEQ ID NO: 7825922 - DNA, 22 bp, Homo sapiens
atgccatcttttattcttctag

SEQ ID NO: 7825923 - DNA, 22 bp, Homo sapiens
atgccattgctttaaaattaag

SEQ ID NO: 7825924 - DNA, 22 bp, Homo sapiens
atgccattgtatattcattgat

SEQ ID NO: 7825925 - DNA, 22 bp, Homo sapiens
atgccatcgtgaagtaagacat

SEQ ID NO: 7825926 - DNA, 22 bp, Homo sapiens
atgccatcttcattctcacact

SEQ ID NO: 7825927 - DNA, 22 bp, Homo sapiens
atgccatctgaaatctgtcata

SEQ ID NO: 7825928 - DNA, 22 bp, Homo sapiens
atgccatctgaaatctgtcata

SEQ ID NO: 7825929 - DNA, 22 bp, Homo sapiens
atgccatcttcattctcacact

SEQ ID NO: 7825930 - DNA, 22 bp, Homo sapiens
agacagtggatcgggatgcact

SEQ ID NO: 7825931 - DNA, 22 bp, Homo sapiens
agacagtggatcgggatgcact

SEQ ID NO: 7825932 - DNA, 22 bp, Homo sapiens
agacagtggatcgggatgcact

SEQ ID NO: 7825933 - DNA, 19 bp, Homo sapiens
agacagtggctaggactta

SEQ ID NO: 7825934 - DNA, 23 bp, Homo sapiens
agacagtggccgagaggtactag

SEQ ID NO: 7825935 - DNA, 23 bp, Homo sapiens
agacagtggccgagaggtactag

SEQ ID NO: 7825936 - DNA, 22 bp, Homo sapiens
atgccagtaagtctcagctagg

SEQ ID NO: 7825937 - DNA, 22 bp, Homo sapiens
atgccaggtacaggggtagggt

SEQ ID NO: 7825938 - DNA, 22 bp, Homo sapiens
atgccaggtacaggggtagggt

SEQ ID NO: 7825939 - DNA, 22 bp, Homo sapiens
atgccagtgttataaatagata

SEQ ID NO: 7825940 - DNA, 22 bp, Homo sapiens
atgccatctcttcattttatag

SEQ ID NO: 7825941 - DNA, 22 bp, Homo sapiens
atgccatcctaattacgttgaa

SEQ ID NO: 7825942 - DNA, 22 bp, Homo sapiens
atgccatcaatgacagagttag

SEQ ID NO: 7825943 - DNA, 22 bp, Homo sapiens
atgccatcacttttccttttgt

SEQ ID NO: 7825944 - DNA, 22 bp, Homo sapiens
atgccagggtcatcccctgggt

SEQ ID NO: 7825945 - DNA, 22 bp, Homo sapiens
atgccagggtcacagtcatatt

SEQ ID NO: 7825946 - DNA, 22 bp, Homo sapiens
atgccaggctgtttggcctcag

SEQ ID NO: 7825947 - DNA, 22 bp, Homo sapiens
atgccaggctgtttggcctcag

SEQ ID NO: 7825948 - DNA, 22 bp, Homo sapiens
atgccagggtcccttcagagat

SEQ ID NO: 7825949 - DNA, 22 bp, Homo sapiens
atgccagggtcccttcagagat

SEQ ID NO: 7825950 - DNA, 22 bp, Homo sapiens
agacagtgtggttggtggttcc

SEQ ID NO: 7825951 - DNA, 20 bp, Homo sapiens
agacagtgtggagattcctt

SEQ ID NO: 7825952 - DNA, 22 bp, Homo sapiens
agacagtgtgagttcagggtgg

SEQ ID NO: 7825953 - DNA, 20 bp, Homo sapiens
agacagtgtggagattcctt

SEQ ID NO: 7825954 - DNA, 22 bp, Homo sapiens
agacagtgtgagttcagggtgg

SEQ ID NO: 7825955 - DNA, 20 bp, Homo sapiens
agacagtggggagctcctag

SEQ ID NO: 7825956 - DNA, 20 bp, Homo sapiens
agacagtggggagctcctag

SEQ ID NO: 7825957 - DNA, 22 bp, Homo sapiens
agacagtgtgagttcagggtgg

SEQ ID NO: 7825958 - DNA, 19 bp, Homo sapiens
agacataaagagtttgcaa

SEQ ID NO: 7825959 - DNA, 19 bp, Homo sapiens
agacataaagagtttgcaa

SEQ ID NO: 7825960 - DNA, 22 bp, Homo sapiens
agacataaacttactgaaatac

SEQ ID NO: 7825961 - DNA, 22 bp, Homo sapiens
agacagtgtgtgtatatatggt

SEQ ID NO: 7825962 - DNA, 22 bp, Homo sapiens
agacagtgtgtgtatatatggt

SEQ ID NO: 7825963 - DNA, 22 bp, Homo sapiens
agacagtgtgtgtatatatggt

SEQ ID NO: 7825964 - DNA, 22 bp, Homo sapiens
agacagttgatatactataaaa

SEQ ID NO: 7825965 - DNA, 22 bp, Homo sapiens
agacataagtgctatgacattg

SEQ ID NO: 7825966 - DNA, 22 bp, Homo sapiens
agacataagtgctatgacattg

SEQ ID NO: 7825967 - DNA, 22 bp, Homo sapiens
agacataagtgctatgacattg

SEQ ID NO: 7825968 - DNA, 19 bp, Homo sapiens
agacataaagagtttgcaa

SEQ ID NO: 7825969 - DNA, 22 bp, Homo sapiens
agacataagcgagcatcacagg

SEQ ID NO: 7825970 - DNA, 22 bp, Homo sapiens
agacataagcgagcatcacagg

SEQ ID NO: 7825971 - DNA, 22 bp, Homo sapiens
agacatagataggcactgattg

SEQ ID NO: 7825972 - DNA, 22 bp, Homo sapiens
agacatagactttctactgtgt

SEQ ID NO: 7825973 - DNA, 22 bp, Homo sapiens
agacatagactttctactgtgt

SEQ ID NO: 7825974 - DNA, 22 bp, Homo sapiens
agacatagaaaatcattaggaa

SEQ ID NO: 7825975 - DNA, 22 bp, Homo sapiens
agacataattaattagttctac

SEQ ID NO: 7825976 - DNA, 22 bp, Homo sapiens
agacataagtggcattttccaa

SEQ ID NO: 7825977 - DNA, 22 bp, Homo sapiens
agacataattaattagttctac

SEQ ID NO: 7825978 - DNA, 22 bp, Homo sapiens
agacataagtgctatgacattg

SEQ ID NO: 7825979 - DNA, 22 bp, Homo sapiens
agattggtgttgcagaaccatg

SEQ ID NO: 7825980 - DNA, 22 bp, Homo sapiens
agattggttccttgctttgaaa

SEQ ID NO: 7825981 - DNA, 19 bp, Homo sapiens
agattggttccttttgagg

SEQ ID NO: 7825982 - DNA, 22 bp, Homo sapiens
agattggttgaactgatttgca

SEQ ID NO: 7825983 - DNA, 22 bp, Homo sapiens
agattgggctccagttaaaacg

SEQ ID NO: 7825984 - DNA, 22 bp, Homo sapiens
agattgacaaaacagaagattt

SEQ ID NO: 7825985 - DNA, 22 bp, Homo sapiens
agattgaatatagagattcttg

SEQ ID NO: 7825986 - DNA, 23 bp, Homo sapiens
agattgaagtattgaccagagct

SEQ ID NO: 7825987 - DNA, 22 bp, Homo sapiens
agattgaataaccacctttttc

SEQ ID NO: 7825988 - DNA, 22 bp, Homo sapiens
agattgaatatagagattcttg

SEQ ID NO: 7825989 - DNA, 22 bp, Homo sapiens
agattccaggcctggggccaag

SEQ ID NO: 7825990 - DNA, 22 bp, Homo sapiens
agattccagggggacattggag

SEQ ID NO: 7825991 - DNA, 22 bp, Homo sapiens
agattcctaaagtaagatatca

SEQ ID NO: 7825992 - DNA, 22 bp, Homo sapiens
agattccttgagcaggttacaa

SEQ ID NO: 7825993 - DNA, 22 bp, Homo sapiens
agattccttatctgtccaatgg

SEQ ID NO: 7825994 - DNA, 22 bp, Homo sapiens
agattcctgttgtatggagggg

SEQ ID NO: 7825995 - DNA, 22 bp, Homo sapiens
agattcctgaaactgccattgg

SEQ ID NO: 7825996 - DNA, 22 bp, Homo sapiens
agattcctgaaactgccattgg

SEQ ID NO: 7825997 - DNA, 22 bp, Homo sapiens
agattcctgaaactgccattgg

SEQ ID NO: 7825998 - DNA, 22 bp, Homo sapiens
agattcctcagtcatgaagcct

SEQ ID NO: 7825999 - DNA, 22 bp, Homo sapiens
agattctactctagatccatgg

SEQ ID NO: 7826000 - DNA, 22 bp, Homo sapiens
agattctcaacaaagagtagca

SEQ ID NO: 7826001 - DNA, 22 bp, Homo sapiens
agattcctagtgttatttctgt

SEQ ID NO: 7826002 - DNA, 22 bp, Homo sapiens
agattctccaaatgcacttcta

SEQ ID NO: 7826003 - DNA, 22 bp, Homo sapiens
agattcttgagtagctgtgctt

SEQ ID NO: 7826004 - DNA, 22 bp, Homo sapiens
agattgaagactggtggagctg

SEQ ID NO: 7826005 - DNA, 22 bp, Homo sapiens
agattgaagactggtggagctg

SEQ ID NO: 7826006 - DNA, 22 bp, Homo sapiens
agattctaaacttgattctgct

SEQ ID NO: 7826007 - DNA, 22 bp, Homo sapiens
agattcgaaacctttaggtctt

SEQ ID NO: 7826008 - DNA, 20 bp, Homo sapiens
agattccttggggatagtgc

SEQ ID NO: 7826009 - DNA, 22 bp, Homo sapiens
agattctaccagagctagtttg

SEQ ID NO: 7826010 - DNA, 22 bp, Homo sapiens
agatgagtaggtagcattagta

SEQ ID NO: 7826011 - DNA, 22 bp, Homo sapiens
agatgagtacagagctgtactc

SEQ ID NO: 7826012 - DNA, 22 bp, Homo sapiens
agatgagtaggtagcattagta

SEQ ID NO: 7826013 - DNA, 22 bp, Homo sapiens
agatgagtgagagcatcaactt

SEQ ID NO: 7826014 - DNA, 22 bp, Homo sapiens
agatgatggccatgtcctctcc

SEQ ID NO: 7826015 - DNA, 22 bp, Homo sapiens
agatgatgataattgaaaggca

SEQ ID NO: 7826016 - DNA, 22 bp, Homo sapiens
agatgatcccaagaagatgctg

SEQ ID NO: 7826017 - DNA, 22 bp, Homo sapiens
agatgatgaccatgggaatgga

SEQ ID NO: 7826018 - DNA, 22 bp, Homo sapiens
agatgtttgtaaacacactgct

SEQ ID NO: 7826019 - DNA, 22 bp, Homo sapiens
agatgatggccatgtcctctcc

SEQ ID NO: 7826020 - DNA, 22 bp, Homo sapiens
agatgatgttggagtctgtgct

SEQ ID NO: 7826021 - DNA, 22 bp, Homo sapiens
agatgtttcagtaatttatctt

SEQ ID NO: 7826022 - DNA, 22 bp, Homo sapiens
agatgtttataactcatgagtg

SEQ ID NO: 7826023 - DNA, 22 bp, Homo sapiens
agattcatgggaaagctttagg

SEQ ID NO: 7826024 - DNA, 22 bp, Homo sapiens
agattcatgggaaagctttagg

SEQ ID NO: 7826025 - DNA, 21 bp, Homo sapiens
agattcataatctgtaaaatg

SEQ ID NO: 7826026 - DNA, 22 bp, Homo sapiens
agattcagttaaggctggtaga

SEQ ID NO: 7826027 - DNA, 22 bp, Homo sapiens
agattcaggactggccacagcc

SEQ ID NO: 7826028 - DNA, 22 bp, Homo sapiens
agattcaggactggccacagcc

SEQ ID NO: 7826029 - DNA, 22 bp, Homo sapiens
agattcatgggaaagctttagg

SEQ ID NO: 7826030 - DNA, 22 bp, Homo sapiens
agattcatgggtctaaccagtg

SEQ ID NO: 7826031 - DNA, 22 bp, Homo sapiens
agattcattaggagacattcag

SEQ ID NO: 7826032 - DNA, 22 bp, Homo sapiens
agattcattaggagacattcag

SEQ ID NO: 7826033 - DNA, 22 bp, Homo sapiens
agattcattatcttctttgtac

SEQ ID NO: 7826034 - DNA, 22 bp, Homo sapiens
agattcattattaatgtgatct

SEQ ID NO: 7826035 - DNA, 22 bp, Homo sapiens
agattcattgctttaggcattg

SEQ ID NO: 7826036 - DNA, 22 bp, Homo sapiens
agatttcaatggatattgcaag

SEQ ID NO: 7826037 - DNA, 22 bp, Homo sapiens
agatttcaatgtgagcattagt

SEQ ID NO: 7826038 - DNA, 22 bp, Homo sapiens
agatttcaatgtgagcattagt

SEQ ID NO: 7826039 - DNA, 22 bp, Homo sapiens
agatttcaatggatattgcaag

SEQ ID NO: 7826040 - DNA, 22 bp, Homo sapiens
agatttatgtggtcacactcag

SEQ ID NO: 7826041 - DNA, 22 bp, Homo sapiens
agatttatgtggtcacactcag

SEQ ID NO: 7826042 - DNA, 22 bp, Homo sapiens
agatttatgtggtcacactcag

SEQ ID NO: 7826043 - DNA, 22 bp, Homo sapiens
agatttatgtggtcacactcag

SEQ ID NO: 7826044 - DNA, 22 bp, Homo sapiens
agatttatgtggtcacactcag

SEQ ID NO: 7826045 - DNA, 22 bp, Homo sapiens
agatttatgtggtcacactcag

SEQ ID NO: 7826046 - DNA, 22 bp, Homo sapiens
agatttatgtggtcacactcag

SEQ ID NO: 7826047 - DNA, 22 bp, Homo sapiens
agatttatgtggtcacactcag

SEQ ID NO: 7826048 - DNA, 22 bp, Homo sapiens
attttgctttatgtaaatatgt

SEQ ID NO: 7826049 - DNA, 22 bp, Homo sapiens
attttggcaacagccatgagcc

SEQ ID NO: 7826050 - DNA, 22 bp, Homo sapiens
attttctgtgtgcagataaata

SEQ ID NO: 7826051 - DNA, 22 bp, Homo sapiens
attttctgtaactatttctata

SEQ ID NO: 7826052 - DNA, 22 bp, Homo sapiens
agatttcaatgtgagcattagt

SEQ ID NO: 7826053 - DNA, 21 bp, Homo sapiens
attttgtacatagaatttgtc

SEQ ID NO: 7826054 - DNA, 21 bp, Homo sapiens
attttgtacatagaatttgtc

SEQ ID NO: 7826055 - DNA, 21 bp, Homo sapiens
attttgtacatagaatttgtc

SEQ ID NO: 7826056 - DNA, 21 bp, Homo sapiens
attttgtacatagaatttgtc

SEQ ID NO: 7826057 - DNA, 22 bp, Homo sapiens
attttggtggtatattaggatt

SEQ ID NO: 7826058 - DNA, 20 bp, Homo sapiens
attttggtgaacacagcttc

SEQ ID NO: 7826059 - DNA, 23 bp, Homo sapiens
agattgttattcccagttcatgt

SEQ ID NO: 7826060 - DNA, 22 bp, Homo sapiens
agattgtcattgacgatgagca

SEQ ID NO: 7826061 - DNA, 22 bp, Homo sapiens
agattgtcactgttgacagggt

SEQ ID NO: 7826062 - DNA, 22 bp, Homo sapiens
agattgtctctttttcagaaga

SEQ ID NO: 7826063 - DNA, 22 bp, Homo sapiens
agattgtagaaactgtagcatt

SEQ ID NO: 7826064 - DNA, 22 bp, Homo sapiens
agatttaaatttgctacaattc

SEQ ID NO: 7826065 - DNA, 22 bp, Homo sapiens
agatttaaagcagtattcgcaa

SEQ ID NO: 7826066 - DNA, 22 bp, Homo sapiens
agatttaaatttgctacaattc

SEQ ID NO: 7826067 - DNA, 19 bp, Homo sapiens
agatttacctcatatagtt

SEQ ID NO: 7826068 - DNA, 19 bp, Homo sapiens
agatttacctcatatagtt

SEQ ID NO: 7826069 - DNA, 19 bp, Homo sapiens
agatttacctcatatagtt

SEQ ID NO: 7826070 - DNA, 22 bp, Homo sapiens
agatttacaaaggatttgcttt

SEQ ID NO: 7826071 - DNA, 22 bp, Homo sapiens
agatttacaaaggatttgcttt

SEQ ID NO: 7826072 - DNA, 22 bp, Homo sapiens
agatttacaaaggatttgcttt

SEQ ID NO: 7826073 - DNA, 22 bp, Homo sapiens
agatttactccctgcttccgcc

SEQ ID NO: 7826074 - DNA, 22 bp, Homo sapiens
agatttactcagctcctggaaa

SEQ ID NO: 7826075 - DNA, 22 bp, Homo sapiens
agatttactcagctcctggaaa

SEQ ID NO: 7826076 - DNA, 22 bp, Homo sapiens
agatttactcagctcctggaaa

SEQ ID NO: 7826077 - DNA, 20 bp, Homo sapiens
agatttacctttgagccttc

SEQ ID NO: 7826078 - DNA, 20 bp, Homo sapiens
agatttacctttgagccttc

SEQ ID NO: 7826079 - DNA, 20 bp, Homo sapiens
agatttacctttgagccttc

SEQ ID NO: 7826080 - DNA, 22 bp, Homo sapiens
agatttactggagtctttggtg

SEQ ID NO: 7826081 - DNA, 22 bp, Homo sapiens
agatttactggagtctttggtg

SEQ ID NO: 7826082 - DNA, 22 bp, Homo sapiens
agatttactgagaactgattac

SEQ ID NO: 7826083 - DNA, 22 bp, Homo sapiens
agatttactgagaactgattac

SEQ ID NO: 7826084 - DNA, 22 bp, Homo sapiens
agatttactgagaactgattac

SEQ ID NO: 7826085 - DNA, 22 bp, Homo sapiens
agatttactccctgcttccgcc

SEQ ID NO: 7826086 - DNA, 22 bp, Homo sapiens
agatttactccctgcttccgcc

SEQ ID NO: 7826087 - DNA, 22 bp, Homo sapiens
agatttacaaaggatttgcttt

SEQ ID NO: 7826088 - DNA, 22 bp, Homo sapiens
agatttagctgtgaacagcttg

SEQ ID NO: 7826089 - DNA, 22 bp, Homo sapiens
agatgacatggttcaagtttcc

SEQ ID NO: 7826090 - DNA, 22 bp, Homo sapiens
agatgagaatttttagagtgct

SEQ ID NO: 7826091 - DNA, 22 bp, Homo sapiens
agatgacatgggagcaagcact

SEQ ID NO: 7826092 - DNA, 22 bp, Homo sapiens
agatgacatgggagcaagcact

SEQ ID NO: 7826093 - DNA, 22 bp, Homo sapiens
agatgacagctacgggatgaaa

SEQ ID NO: 7826094 - DNA, 22 bp, Homo sapiens
agatgacaggtttttttggctt

SEQ ID NO: 7826095 - DNA, 22 bp, Homo sapiens
agatgacagtagctcccccatt

SEQ ID NO: 7826096 - DNA, 22 bp, Homo sapiens
agatgacagccaaggagatgaa

SEQ ID NO: 7826097 - DNA, 22 bp, Homo sapiens
agatgacagctacgggatgaaa

SEQ ID NO: 7826098 - DNA, 22 bp, Homo sapiens
agatgacagccaaggagatgaa

SEQ ID NO: 7826099 - DNA, 22 bp, Homo sapiens
agatgacacacacgcacccgga

SEQ ID NO: 7826100 - DNA, 22 bp, Homo sapiens
agatgacacacacgcacccgga

SEQ ID NO: 7826101 - DNA, 22 bp, Homo sapiens
agatgacacaccatttttactt

SEQ ID NO: 7826102 - DNA, 22 bp, Homo sapiens
agatgacaatgaggttgttatt

SEQ ID NO: 7826103 - DNA, 22 bp, Homo sapiens
agatgagaatttttagagtgct

SEQ ID NO: 7826104 - DNA, 22 bp, Homo sapiens
agatgagaatttttagagtgct

SEQ ID NO: 7826105 - DNA, 21 bp, Homo sapiens
agatgaggatactgaggccta

SEQ ID NO: 7826106 - DNA, 21 bp, Homo sapiens
agatgaggatactgaggccta

SEQ ID NO: 7826107 - DNA, 22 bp, Homo sapiens
agatgagtaaatggagtcttcc

SEQ ID NO: 7826108 - DNA, 22 bp, Homo sapiens
atttgaaatcccttctactgta

SEQ ID NO: 7826109 - DNA, 22 bp, Homo sapiens
atttgaaatctgggttactctg

SEQ ID NO: 7826110 - DNA, 22 bp, Homo sapiens
atttgaaatctgggttactctg

SEQ ID NO: 7826111 - DNA, 22 bp, Homo sapiens
atttgaaatcccttctactgta

SEQ ID NO: 7826112 - DNA, 22 bp, Homo sapiens
atttgaaatcccttctactgta

SEQ ID NO: 7826113 - DNA, 19 bp, Homo sapiens
atttgaaagctgtgcttgc

SEQ ID NO: 7826114 - DNA, 22 bp, Homo sapiens
atttgaatgcaggtagctgagt

SEQ ID NO: 7826115 - DNA, 22 bp, Homo sapiens
atttgaatgcaggtagctgagt

SEQ ID NO: 7826116 - DNA, 22 bp, Homo sapiens
atttgaatggcttaacacaacg

SEQ ID NO: 7826117 - DNA, 22 bp, Homo sapiens
agatgacaatgaaggaaaatgt

SEQ ID NO: 7826118 - DNA, 22 bp, Homo sapiens
agatgacaagagcttgctgcag

SEQ ID NO: 7826119 - DNA, 22 bp, Homo sapiens
agatgacaagagcttgctgcag

SEQ ID NO: 7826120 - DNA, 22 bp, Homo sapiens
atttacaggacagcttggcatt

SEQ ID NO: 7826121 - DNA, 22 bp, Homo sapiens
atttacaggacagcttggcatt

SEQ ID NO: 7826122 - DNA, 22 bp, Homo sapiens
atttacaggacagcttggcatt

SEQ ID NO: 7826123 - DNA, 22 bp, Homo sapiens
atttacaggtagaattttaagt

SEQ ID NO: 7826124 - DNA, 22 bp, Homo sapiens
atttacaggtagaattttaagt

SEQ ID NO: 7826125 - DNA, 22 bp, Homo sapiens
atttacaggtagaattttaagt

SEQ ID NO: 7826126 - DNA, 22 bp, Homo sapiens
atttacaggacagcttggcatt

SEQ ID NO: 7826127 - DNA, 22 bp, Homo sapiens
atttacaggtagaattttaagt

SEQ ID NO: 7826128 - DNA, 23 bp, Homo sapiens
atttacagctgtgtgagcaagtt

SEQ ID NO: 7826129 - DNA, 22 bp, Homo sapiens
atttacaggacagcttggcatt

SEQ ID NO: 7826130 - DNA, 22 bp, Homo sapiens
atttacaggacagcttggcatt

SEQ ID NO: 7826131 - DNA, 22 bp, Homo sapiens
atttacaggacagcttggcatt

SEQ ID NO: 7826132 - DNA, 22 bp, Homo sapiens
atttacaggacagcttggcatt

SEQ ID NO: 7826133 - DNA, 22 bp, Homo sapiens
atttacagatgatgctatttga

SEQ ID NO: 7826134 - DNA, 22 bp, Homo sapiens
atttacagccttgaaaacagca

SEQ ID NO: 7826135 - DNA, 22 bp, Homo sapiens
atttacagccttgaaaacagca

SEQ ID NO: 7826136 - DNA, 22 bp, Homo sapiens
atttacagccttgaaaacagca

SEQ ID NO: 7826137 - DNA, 22 bp, Homo sapiens
atttacagatgatgctatttga

SEQ ID NO: 7826138 - DNA, 22 bp, Homo sapiens
atttacagccttgaaaacagca

SEQ ID NO: 7826139 - DNA, 22 bp, Homo sapiens
atttacagccttgaaaacagca

SEQ ID NO: 7826140 - DNA, 22 bp, Homo sapiens
atttacagccttgccatctata

SEQ ID NO: 7826141 - DNA, 23 bp, Homo sapiens
atttacagctgtgtgagcaagtt

SEQ ID NO: 7826142 - DNA, 23 bp, Homo sapiens
atttacagctgtgtgagcaagtt

SEQ ID NO: 7826143 - DNA, 23 bp, Homo sapiens
atttacagctgtgtgagcaagtt

SEQ ID NO: 7826144 - DNA, 23 bp, Homo sapiens
atttacagctgtgtgagcaagtt

SEQ ID NO: 7826145 - DNA, 22 bp, Homo sapiens
atttacagccttgccatctata

SEQ ID NO: 7826146 - DNA, 22 bp, Homo sapiens
atttctttctggccacggtttt

SEQ ID NO: 7826147 - DNA, 22 bp, Homo sapiens
atttctttctggccacggtttt

SEQ ID NO: 7826148 - DNA, 23 bp, Homo sapiens
atttgaaactttcttgtttccag

SEQ ID NO: 7826149 - DNA, 22 bp, Homo sapiens
atttcttttcaagagggtgctt

SEQ ID NO: 7826150 - DNA, 22 bp, Homo sapiens
atttgaaaacctgagcctcccg

SEQ ID NO: 7826151 - DNA, 22 bp, Homo sapiens
atttcttgcccctgctccctga

SEQ ID NO: 7826152 - DNA, 22 bp, Homo sapiens
atttctgataaacgtaagctgc

SEQ ID NO: 7826153 - DNA, 22 bp, Homo sapiens
atttctcttcctcctagggttg

SEQ ID NO: 7826154 - DNA, 22 bp, Homo sapiens
atttctcttcctcctagggttg

SEQ ID NO: 7826155 - DNA, 22 bp, Homo sapiens
atttcttgtgggaaatgcagca

SEQ ID NO: 7826156 - DNA, 22 bp, Homo sapiens
atttcttgtgggaaatgcagca

SEQ ID NO: 7826157 - DNA, 23 bp, Homo sapiens
atttacaggttaaatgaaatcag

SEQ ID NO: 7826158 - DNA, 23 bp, Homo sapiens
atttacaggttaaatgaaatcag

SEQ ID NO: 7826159 - DNA, 22 bp, Homo sapiens
atttctcttagcaagacattac

SEQ ID NO: 7826160 - DNA, 22 bp, Homo sapiens
atttacaggtagaattttaagt

SEQ ID NO: 7826161 - DNA, 22 bp, Homo sapiens
agcaaggctgggtctaatgggg

SEQ ID NO: 7826162 - DNA, 17 bp, Homo sapiens
agcaaggcttaagtaaa

SEQ ID NO: 7826163 - DNA, 17 bp, Homo sapiens
agcaaggcttaagtaaa

SEQ ID NO: 7826164 - DNA, 22 bp, Homo sapiens
agcaaggcttcagagctgtctg

SEQ ID NO: 7826165 - DNA, 22 bp, Homo sapiens
agcaaggcttcagagctgtctg

SEQ ID NO: 7826166 - DNA, 22 bp, Homo sapiens
agcaaggcttcagagctgtctg

SEQ ID NO: 7826167 - DNA, 22 bp, Homo sapiens
agcaaggggcagtgaaagtgtg

SEQ ID NO: 7826168 - DNA, 22 bp, Homo sapiens
agcaaggggcagtgaaagtgtg

SEQ ID NO: 7826169 - DNA, 19 bp, Homo sapiens
agcaaggtgcctcctcccc

SEQ ID NO: 7826170 - DNA, 22 bp, Homo sapiens
agcaaggtggagaaggatgggt

SEQ ID NO: 7826171 - DNA, 23 bp, Homo sapiens
agcaataagaagggatacatgtg

SEQ ID NO: 7826172 - DNA, 23 bp, Homo sapiens
agcaataagaagggatacatgtg

SEQ ID NO: 7826173 - DNA, 22 bp, Homo sapiens
agcaataacagaaaactttcct

SEQ ID NO: 7826174 - DNA, 22 bp, Homo sapiens
agcaataaccactctaatttat

SEQ ID NO: 7826175 - DNA, 22 bp, Homo sapiens
agcaataaccactctaatttat

SEQ ID NO: 7826176 - DNA, 22 bp, Homo sapiens
agcaataaccactctaatttat

SEQ ID NO: 7826177 - DNA, 22 bp, Homo sapiens
agcaagtgtaagaatgcagaat

SEQ ID NO: 7826178 - DNA, 22 bp, Homo sapiens
agcaataaatgtaaaggttaag

SEQ ID NO: 7826179 - DNA, 22 bp, Homo sapiens
attttttgttaactcaggatag

SEQ ID NO: 7826180 - DNA, 22 bp, Homo sapiens
attttttgttaactcaggatag

SEQ ID NO: 7826181 - DNA, 22 bp, Homo sapiens
attttttgttaactcaggatag

SEQ ID NO: 7826182 - DNA, 20 bp, Homo sapiens
agcaagagtgtacctggcca

SEQ ID NO: 7826183 - DNA, 22 bp, Homo sapiens
agcaagatgaaggattcaagac

SEQ ID NO: 7826184 - DNA, 22 bp, Homo sapiens
agcaagatgaaggattcaagac

SEQ ID NO: 7826185 - DNA, 22 bp, Homo sapiens
agcaagatgcattatttcttat

SEQ ID NO: 7826186 - DNA, 22 bp, Homo sapiens
agcaagatgcattatttcttat

SEQ ID NO: 7826187 - DNA, 22 bp, Homo sapiens
agcaagatgcaaacatccgtcc

SEQ ID NO: 7826188 - DNA, 22 bp, Homo sapiens
agcaaggcctacagagaggggc

SEQ ID NO: 7826189 - DNA, 22 bp, Homo sapiens
agcaaggctcggtcagggtgat

SEQ ID NO: 7826190 - DNA, 22 bp, Homo sapiens
agcaaggctcggtcagggtgat

SEQ ID NO: 7826191 - DNA, 22 bp, Homo sapiens
agcaaggctaaatttcagttat

SEQ ID NO: 7826192 - DNA, 23 bp, Homo sapiens
attttttgtctttgtaactagat

SEQ ID NO: 7826193 - DNA, 22 bp, Homo sapiens
attttttctgtaaactggcctt

SEQ ID NO: 7826194 - DNA, 23 bp, Homo sapiens
attttttgtctttgtaactagat

SEQ ID NO: 7826195 - DNA, 23 bp, Homo sapiens
attttttgtctttgtaactagat

SEQ ID NO: 7826196 - DNA, 23 bp, Homo sapiens
attttttgtctttgtaactagat

SEQ ID NO: 7826197 - DNA, 22 bp, Homo sapiens
attttttcccagttagccagga

SEQ ID NO: 7826198 - DNA, 22 bp, Homo sapiens
attttttcccagttagccagga

SEQ ID NO: 7826199 - DNA, 22 bp, Homo sapiens
attttttcccagttagccagga

SEQ ID NO: 7826200 - DNA, 22 bp, Homo sapiens
attttttctgtaaactggcctt

SEQ ID NO: 7826201 - DNA, 22 bp, Homo sapiens
attttttcccagttagccagga

SEQ ID NO: 7826202 - DNA, 22 bp, Homo sapiens
attttttctgtaaactggcctt

SEQ ID NO: 7826203 - DNA, 22 bp, Homo sapiens
attttttctgtaaactggcctt

SEQ ID NO: 7826204 - DNA, 21 bp, Homo sapiens
attttgtacatagaatttgtc

SEQ ID NO: 7826205 - DNA, 22 bp, Homo sapiens
attttgtgaaccctcaagcaat

SEQ ID NO: 7826206 - DNA, 22 bp, Homo sapiens
attttgtggcagatgcagaacc

SEQ ID NO: 7826207 - DNA, 22 bp, Homo sapiens
attttgtggcagatgcagaacc

SEQ ID NO: 7826208 - DNA, 22 bp, Homo sapiens
attttgtgaaccctcaagcaat

SEQ ID NO: 7826209 - DNA, 22 bp, Homo sapiens
attttgtgggttctgctgatgt

SEQ ID NO: 7826210 - DNA, 22 bp, Homo sapiens
attttgttaatgtcaccgtgct

SEQ ID NO: 7826211 - DNA, 22 bp, Homo sapiens
attttgttaatgtcaccgtgct

SEQ ID NO: 7826212 - DNA, 22 bp, Homo sapiens
attttgtggcagatgcagaacc

SEQ ID NO: 7826213 - DNA, 22 bp, Homo sapiens
attttgtgggttctgctgatgt

SEQ ID NO: 7826214 - DNA, 22 bp, Homo sapiens
attttgttatagaactctgtga

SEQ ID NO: 7826215 - DNA, 22 bp, Homo sapiens
attttgttatagaactctgtga

SEQ ID NO: 7826216 - DNA, 22 bp, Homo sapiens
attttgttatagaactctgtga

SEQ ID NO: 7826217 - DNA, 22 bp, Homo sapiens
attttgttatagaactctgtga

SEQ ID NO: 7826218 - DNA, 22 bp, Homo sapiens
attttgttgaggtaattgtcaa

SEQ ID NO: 7826219 - DNA, 22 bp, Homo sapiens
attttgttgaggtaattgtcaa

SEQ ID NO: 7826220 - DNA, 22 bp, Homo sapiens
attttgttgaggtaattgtcaa

SEQ ID NO: 7826221 - DNA, 22 bp, Homo sapiens
attttgttatcagggctttgca

SEQ ID NO: 7826222 - DNA, 22 bp, Homo sapiens
attttgttatcagggctttgca

SEQ ID NO: 7826223 - DNA, 22 bp, Homo sapiens
attttgttatcagggctttgca

SEQ ID NO: 7826224 - DNA, 22 bp, Homo sapiens
attttgttgaggtaattgtcaa

SEQ ID NO: 7826225 - DNA, 22 bp, Homo sapiens
attttgttataggagctgaaat

SEQ ID NO: 7826226 - DNA, 22 bp, Homo sapiens
attttgttataggagctgaaat

SEQ ID NO: 7826227 - DNA, 22 bp, Homo sapiens
attttgttataggagctgaaat

SEQ ID NO: 7826228 - DNA, 22 bp, Homo sapiens
attttgttatagaactctgtga

SEQ ID NO: 7826229 - DNA, 22 bp, Homo sapiens
attttgttatagaactctgtga

SEQ ID NO: 7826230 - DNA, 22 bp, Homo sapiens
attttgttatagaactctgtga

SEQ ID NO: 7826231 - DNA, 22 bp, Homo sapiens
attttgttataggagctgaaat

SEQ ID NO: 7826232 - DNA, 22 bp, Homo sapiens
attttgttataggagctgaaat

SEQ ID NO: 7826233 - DNA, 22 bp, Homo sapiens
attttgttataggagctgaaat

SEQ ID NO: 7826234 - DNA, 22 bp, Homo sapiens
attttgttataggagctgaaat

SEQ ID NO: 7826235 - DNA, 22 bp, Homo sapiens
attttgttatcagggctttgca

SEQ ID NO: 7826236 - DNA, 22 bp, Homo sapiens
attttttagccaagactctgca

SEQ ID NO: 7826237 - DNA, 22 bp, Homo sapiens
attttttagccaagactctgca

SEQ ID NO: 7826238 - DNA, 22 bp, Homo sapiens
attttttagccaagactctgca

SEQ ID NO: 7826239 - DNA, 22 bp, Homo sapiens
attttttagccaagactctgca

SEQ ID NO: 7826240 - DNA, 22 bp, Homo sapiens
attttttagccaagactctgca

SEQ ID NO: 7826241 - DNA, 22 bp, Homo sapiens
attttttagccaagactctgca

SEQ ID NO: 7826242 - DNA, 22 bp, Homo sapiens
attttttagaacctggcctgat

SEQ ID NO: 7826243 - DNA, 20 bp, Homo sapiens
attttgtttatgttcctctc

SEQ ID NO: 7826244 - DNA, 20 bp, Homo sapiens
attttgtttatgttcctctc

SEQ ID NO: 7826245 - DNA, 22 bp, Homo sapiens
attttgttgatggtggagtagc

SEQ ID NO: 7826246 - DNA, 20 bp, Homo sapiens
attttgtttatgttcctctc

SEQ ID NO: 7826247 - DNA, 22 bp, Homo sapiens
attttgttgatggtggagtagc

SEQ ID NO: 7826248 - DNA, 22 bp, Homo sapiens
attttgttgatggtggagtagc

SEQ ID NO: 7826249 - DNA, 22 bp, Homo sapiens
attttgttgatggtggagtagc

SEQ ID NO: 7826250 - DNA, 22 bp, Homo sapiens
attttgttgaggtaattgtcaa

SEQ ID NO: 7826251 - DNA, 22 bp, Homo sapiens
attttttatataccaaggtggg

SEQ ID NO: 7826252 - DNA, 22 bp, Homo sapiens
attttttatataccaaggtggg

SEQ ID NO: 7826253 - DNA, 22 bp, Homo sapiens
attttttatataccaaggtggg

SEQ ID NO: 7826254 - DNA, 22 bp, Homo sapiens
attttttagccaagactctgca

SEQ ID NO: 7826255 - DNA, 22 bp, Homo sapiens
attttttcagattgagtgttaa

SEQ ID NO: 7826256 - DNA, 22 bp, Homo sapiens
attttttcagattgagtgttaa

SEQ ID NO: 7826257 - DNA, 22 bp, Homo sapiens
attttttatataccaaggtggg

SEQ ID NO: 7826258 - DNA, 22 bp, Homo sapiens
attttttatataccaaggtggg

SEQ ID NO: 7826259 - DNA, 22 bp, Homo sapiens
attttttcagattgagtgttaa

SEQ ID NO: 7826260 - DNA, 22 bp, Homo sapiens
attttttagccaagactctgca

SEQ ID NO: 7826261 - DNA, 22 bp, Homo sapiens
attttttcagattgagtgttaa

SEQ ID NO: 7826262 - DNA, 22 bp, Homo sapiens
caaacatttgttggaacccctg

SEQ ID NO: 7826263 - DNA, 22 bp, Homo sapiens
caaacatttgttggaacccctg

SEQ ID NO: 7826264 - DNA, 22 bp, Homo sapiens
caaacatttgttggaacccctg

SEQ ID NO: 7826265 - DNA, 22 bp, Homo sapiens
caaacattttctacttccagga

SEQ ID NO: 7826266 - DNA, 22 bp, Homo sapiens
caaacattttctacttccagga

SEQ ID NO: 7826267 - DNA, 22 bp, Homo sapiens
caaacattttctacttccagga

SEQ ID NO: 7826268 - DNA, 22 bp, Homo sapiens
caaacattttctacttccagga

SEQ ID NO: 7826269 - DNA, 22 bp, Homo sapiens
caaacattttgagtggtttctg

SEQ ID NO: 7826270 - DNA, 22 bp, Homo sapiens
caaacattttgagtggtttctg

SEQ ID NO: 7826271 - DNA, 22 bp, Homo sapiens
caaacattttgagtggtttctg

SEQ ID NO: 7826272 - DNA, 22 bp, Homo sapiens
caaagggctctagactcagcag

SEQ ID NO: 7826273 - DNA, 22 bp, Homo sapiens
caaagtgctgggattacaggtg

SEQ ID NO: 7826274 - DNA, 22 bp, Homo sapiens
caaagtgctgggattacaggtg

SEQ ID NO: 7826275 - DNA, 22 bp, Homo sapiens
caaagtgctgggattataggca

SEQ ID NO: 7826276 - DNA, 22 bp, Homo sapiens
caaagtgctgggattagtgctg

SEQ ID NO: 7826277 - DNA, 22 bp, Homo sapiens
caaagtgctgggattagtgctg

SEQ ID NO: 7826278 - DNA, 22 bp, Homo sapiens
caaagtgctgggattacaggct

SEQ ID NO: 7826279 - DNA, 22 bp, Homo sapiens
caaagtgctgggattacaggct

SEQ ID NO: 7826280 - DNA, 22 bp, Homo sapiens
caaacattgcactttctgctat

SEQ ID NO: 7826281 - DNA, 22 bp, Homo sapiens
caaacattgctaccagaggttt

SEQ ID NO: 7826282 - DNA, 22 bp, Homo sapiens
agcaatatttcagctagcaggt

SEQ ID NO: 7826283 - DNA, 22 bp, Homo sapiens
agcaatcaccacctctatattt

SEQ ID NO: 7826284 - DNA, 16 bp, Homo sapiens
agcaatcagaaatatc

SEQ ID NO: 7826285 - DNA, 22 bp, Homo sapiens
agcaatcagcttctttgtgttt

SEQ ID NO: 7826286 - DNA, 22 bp, Homo sapiens
agcaatcaaataaatgtcctgg

SEQ ID NO: 7826287 - DNA, 22 bp, Homo sapiens
agcaatatttcagctagcaggt

SEQ ID NO: 7826288 - DNA, 22 bp, Homo sapiens
agcaataatttaggcctttcct

SEQ ID NO: 7826289 - DNA, 22 bp, Homo sapiens
agcaataagggatcctctataa

SEQ ID NO: 7826290 - DNA, 22 bp, Homo sapiens
agcaataatttaggcctttcct

SEQ ID NO: 7826291 - DNA, 22 bp, Homo sapiens
agcaatagacacaagatggata

SEQ ID NO: 7826292 - DNA, 22 bp, Homo sapiens
agcaatagacacaagatggata

SEQ ID NO: 7826293 - DNA, 22 bp, Homo sapiens
agcaatatgacattgctacatc

SEQ ID NO: 7826294 - DNA, 22 bp, Homo sapiens
agcaatagataaaacatttacc

SEQ ID NO: 7826295 - DNA, 22 bp, Homo sapiens
agcaatagataaaacatttacc

SEQ ID NO: 7826296 - DNA, 22 bp, Homo sapiens
caaacattgggggcttcaacac

SEQ ID NO: 7826297 - DNA, 22 bp, Homo sapiens
caaacatttaggaggagggagg

SEQ ID NO: 7826298 - DNA, 22 bp, Homo sapiens
caaacatttgacttctctcagg

SEQ ID NO: 7826299 - DNA, 22 bp, Homo sapiens
caaacatttgacttctctcagg

SEQ ID NO: 7826300 - DNA, 22 bp, Homo sapiens
caaacatttgacttctctcagg

SEQ ID NO: 7826301 - DNA, 22 bp, Homo sapiens
caaacatttgacttctctcagg

SEQ ID NO: 7826302 - DNA, 22 bp, Homo sapiens
caaacatttgacttctctcagg

SEQ ID NO: 7826303 - DNA, 22 bp, Homo sapiens
caaacattgggggcttcaacac

SEQ ID NO: 7826304 - DNA, 22 bp, Homo sapiens
caaacattgggggcttcaacac

SEQ ID NO: 7826305 - DNA, 22 bp, Homo sapiens
caaacattgggggcttcaacac

SEQ ID NO: 7826306 - DNA, 22 bp, Homo sapiens
caaacattgggggcttcaacac

SEQ ID NO: 7826307 - DNA, 22 bp, Homo sapiens
caaacattgctaccagaggttt

SEQ ID NO: 7826308 - DNA, 22 bp, Homo sapiens
caaacattgctaccagaggttt

SEQ ID NO: 7826309 - DNA, 22 bp, Homo sapiens
agcaatgactttgaaatcatga

SEQ ID NO: 7826310 - DNA, 22 bp, Homo sapiens
agcaatgatgttttcaagtagg

SEQ ID NO: 7826311 - DNA, 22 bp, Homo sapiens
agcaatgactttgaaatcatga

SEQ ID NO: 7826312 - DNA, 22 bp, Homo sapiens
agcaatgactggctatatgatt

SEQ ID NO: 7826313 - DNA, 22 bp, Homo sapiens
agcaatgactggctatatgatt

SEQ ID NO: 7826314 - DNA, 22 bp, Homo sapiens
agcaatgactttgaaatcatga

SEQ ID NO: 7826315 - DNA, 22 bp, Homo sapiens
agcaatgaccagtgatcttgta

SEQ ID NO: 7826316 - DNA, 22 bp, Homo sapiens
agcaatgaccagtgatcttgta

SEQ ID NO: 7826317 - DNA, 23 bp, Homo sapiens
agcaatctgtgtttcagcaagcc

SEQ ID NO: 7826318 - DNA, 22 bp, Homo sapiens
agcaatgaaatgaaatcagtct

SEQ ID NO: 7826319 - DNA, 22 bp, Homo sapiens
agcaatcatgacaaattatctt

SEQ ID NO: 7826320 - DNA, 22 bp, Homo sapiens
caaataattactatcctcactt

SEQ ID NO: 7826321 - DNA, 22 bp, Homo sapiens
caaataattactatcctcactt

SEQ ID NO: 7826322 - DNA, 22 bp, Homo sapiens
agcaatcatgacaaattatctt

SEQ ID NO: 7826323 - DNA, 23 bp, Homo sapiens
agcaatctgtgtttcagcaagcc

SEQ ID NO: 7826324 - DNA, 22 bp, Homo sapiens
agcaatgaaaacaataaggtga

SEQ ID NO: 7826325 - DNA, 23 bp, Homo sapiens
agcaatgctgggagactctgtaa

SEQ ID NO: 7826326 - DNA, 23 bp, Homo sapiens
agcaatgctgggagactctgtaa

SEQ ID NO: 7826327 - DNA, 22 bp, Homo sapiens
agcaatgcttattgctgactat

SEQ ID NO: 7826328 - DNA, 22 bp, Homo sapiens
agcaatgctaccgggtgattcg

SEQ ID NO: 7826329 - DNA, 22 bp, Homo sapiens
agcaatgcaatcttaaccttga

SEQ ID NO: 7826330 - DNA, 22 bp, Homo sapiens
agcaatgcaatcttaaccttga

SEQ ID NO: 7826331 - DNA, 22 bp, Homo sapiens
agcaatgtggaccagctcaggg

SEQ ID NO: 7826332 - DNA, 22 bp, Homo sapiens
agcaatgttggggttagaggac

SEQ ID NO: 7826333 - DNA, 22 bp, Homo sapiens
agcaatgtctttttggccatct

SEQ ID NO: 7826334 - DNA, 22 bp, Homo sapiens
agcaatgtaaaccctgaagttg

SEQ ID NO: 7826335 - DNA, 22 bp, Homo sapiens
agcaatgtgacccctgacagca

SEQ ID NO: 7826336 - DNA, 23 bp, Homo sapiens
agcaatgctgggagactctgtaa

SEQ ID NO: 7826337 - DNA, 22 bp, Homo sapiens
agcaatgtaaaccctgaagttg

SEQ ID NO: 7826338 - DNA, 22 bp, Homo sapiens
agcaatgcttattgctgactat

SEQ ID NO: 7826339 - DNA, 22 bp, Homo sapiens
caaagttttagtaaacatatat

SEQ ID NO: 7826340 - DNA, 22 bp, Homo sapiens
caaagttttagtaaacatatat

SEQ ID NO: 7826341 - DNA, 22 bp, Homo sapiens
caaataagaaccacaggggagt

SEQ ID NO: 7826342 - DNA, 22 bp, Homo sapiens
caaataagcaattccattcttc

SEQ ID NO: 7826343 - DNA, 22 bp, Homo sapiens
caaataagaaccacaggggagt

SEQ ID NO: 7826344 - DNA, 22 bp, Homo sapiens
caaataagcaattccattcttc

SEQ ID NO: 7826345 - DNA, 22 bp, Homo sapiens
caaagttttagtaaacatatat

SEQ ID NO: 7826346 - DNA, 22 bp, Homo sapiens
caaagttttagtaaacatatat

SEQ ID NO: 7826347 - DNA, 22 bp, Homo sapiens
caaagttttagtaaacatatat

SEQ ID NO: 7826348 - DNA, 22 bp, Homo sapiens
caaagtttggctctcatgacat

SEQ ID NO: 7826349 - DNA, 22 bp, Homo sapiens
caaagtttaaagtagatttcag

SEQ ID NO: 7826350 - DNA, 22 bp, Homo sapiens
caaagtttggctctcatgacat

SEQ ID NO: 7826351 - DNA, 22 bp, Homo sapiens
caaagtttaaagtagatttcag

SEQ ID NO: 7826352 - DNA, 22 bp, Homo sapiens
caaagtgggtgccctgatgctc

SEQ ID NO: 7826353 - DNA, 22 bp, Homo sapiens
caaagttatcaactgcaacatt

SEQ ID NO: 7826354 - DNA, 22 bp, Homo sapiens
caaagttatgaatgataagatt

SEQ ID NO: 7826355 - DNA, 22 bp, Homo sapiens
caaagtggaggctctggggcca

SEQ ID NO: 7826356 - DNA, 22 bp, Homo sapiens
attgaaaataaggccagaaaca

SEQ ID NO: 7826357 - DNA, 22 bp, Homo sapiens
attgaaaataaggccagaaaca

SEQ ID NO: 7826358 - DNA, 22 bp, Homo sapiens
attgaaaaattcacaattctgg

SEQ ID NO: 7826359 - DNA, 22 bp, Homo sapiens
attgaaaaattcacaattctgg

SEQ ID NO: 7826360 - DNA, 22 bp, Homo sapiens
attgaaaaattcacaattctgg

SEQ ID NO: 7826361 - DNA, 22 bp, Homo sapiens
attgaaaaatgactattgctta

SEQ ID NO: 7826362 - DNA, 22 bp, Homo sapiens
attgaaaaatgactattgctta

SEQ ID NO: 7826363 - DNA, 22 bp, Homo sapiens
attgaaaaattcacaattctgg

SEQ ID NO: 7826364 - DNA, 22 bp, Homo sapiens
attgaaaatataattctaggag

SEQ ID NO: 7826365 - DNA, 22 bp, Homo sapiens
attgaaaatataattctaggag

SEQ ID NO: 7826366 - DNA, 22 bp, Homo sapiens
attgaaaatataattctaggag

SEQ ID NO: 7826367 - DNA, 22 bp, Homo sapiens
attgaaagcacaaagaacaagt

SEQ ID NO: 7826368 - DNA, 22 bp, Homo sapiens
attgaaagcatggatttggatt

SEQ ID NO: 7826369 - DNA, 22 bp, Homo sapiens
attgaaagcacaaagaacaagt

SEQ ID NO: 7826370 - DNA, 22 bp, Homo sapiens
attgaaatacataaaattgcca

SEQ ID NO: 7826371 - DNA, 22 bp, Homo sapiens
attgaaatacataaaattgcca

SEQ ID NO: 7826372 - DNA, 22 bp, Homo sapiens
attgagaagcttgcagattttt

SEQ ID NO: 7826373 - DNA, 22 bp, Homo sapiens
attgagaagaaaatctaatata

SEQ ID NO: 7826374 - DNA, 22 bp, Homo sapiens
attgagaaaggcttatgtttgc

SEQ ID NO: 7826375 - DNA, 22 bp, Homo sapiens
attgagaaaggcttatgtttgc

SEQ ID NO: 7826376 - DNA, 22 bp, Homo sapiens
attgagaaaattcgagcaagtt

SEQ ID NO: 7826377 - DNA, 22 bp, Homo sapiens
attgtataagtctatttacaat

SEQ ID NO: 7826378 - DNA, 22 bp, Homo sapiens
attgtataagtctatttacaat

SEQ ID NO: 7826379 - DNA, 22 bp, Homo sapiens
attgtataagtctatttacaat

SEQ ID NO: 7826380 - DNA, 22 bp, Homo sapiens
attgtataagtctatttacaat

SEQ ID NO: 7826381 - DNA, 22 bp, Homo sapiens
attgtataagtctatttacaat

SEQ ID NO: 7826382 - DNA, 22 bp, Homo sapiens
attgtataagtctatttacaat

SEQ ID NO: 7826383 - DNA, 22 bp, Homo sapiens
attgtataagtctatttacaat

SEQ ID NO: 7826384 - DNA, 22 bp, Homo sapiens
attgtataacagcatgtatttt

SEQ ID NO: 7826385 - DNA, 22 bp, Homo sapiens
attgtataacagcatgtatttt

SEQ ID NO: 7826386 - DNA, 22 bp, Homo sapiens
attgtataagtctatttacaat

SEQ ID NO: 7826387 - DNA, 22 bp, Homo sapiens
attgtataacagcatgtatttt

SEQ ID NO: 7826388 - DNA, 22 bp, Homo sapiens
attggtggtgaggacatgccag

SEQ ID NO: 7826389 - DNA, 22 bp, Homo sapiens
attgtataacagcatgtatttt

SEQ ID NO: 7826390 - DNA, 22 bp, Homo sapiens
attggtgcatgtaggtgatgct

SEQ ID NO: 7826391 - DNA, 22 bp, Homo sapiens
attggtgcaatagtcaggagct

SEQ ID NO: 7826392 - DNA, 22 bp, Homo sapiens
attggtggtgaggacatgccag

SEQ ID NO: 7826393 - DNA, 22 bp, Homo sapiens
attgtataagtctatttacaat

SEQ ID NO: 7826394 - DNA, 22 bp, Homo sapiens
attgtataagtctatttacaat

SEQ ID NO: 7826395 - DNA, 22 bp, Homo sapiens
attgtataatcagttactggaa

SEQ ID NO: 7826396 - DNA, 22 bp, Homo sapiens
attgtataattgtattgccaaa

SEQ ID NO: 7826397 - DNA, 22 bp, Homo sapiens
attgtataagtctatttacaat

SEQ ID NO: 7826398 - DNA, 22 bp, Homo sapiens
attgtatgcagcattaagcaat

SEQ ID NO: 7826399 - DNA, 22 bp, Homo sapiens
attgtatcttgtcattatgcat

SEQ ID NO: 7826400 - DNA, 22 bp, Homo sapiens
attgtatcttgtcattatgcat

SEQ ID NO: 7826401 - DNA, 22 bp, Homo sapiens
attgtatgatgtgcttcacttt

SEQ ID NO: 7826402 - DNA, 22 bp, Homo sapiens
attgtatacaagcttaattgtt

SEQ ID NO: 7826403 - DNA, 22 bp, Homo sapiens
attgtatacaagcttaattgtt

SEQ ID NO: 7826404 - DNA, 22 bp, Homo sapiens
attgtatacaagcttaattgtt

SEQ ID NO: 7826405 - DNA, 22 bp, Homo sapiens
attgtatacaagcttaattgtt

SEQ ID NO: 7826406 - DNA, 23 bp, Homo sapiens
attgagaaggatacattgttctc

SEQ ID NO: 7826407 - DNA, 22 bp, Homo sapiens
attgagaatatgatttagtata

SEQ ID NO: 7826408 - DNA, 22 bp, Homo sapiens
attgagaatccatttgagatga

SEQ ID NO: 7826409 - DNA, 22 bp, Homo sapiens
attgagaatgcaatctactatg

SEQ ID NO: 7826410 - DNA, 22 bp, Homo sapiens
attgagaattgtgagtttggag

SEQ ID NO: 7826411 - DNA, 22 bp, Homo sapiens
attgagcaggcaaagtatcata

SEQ ID NO: 7826412 - DNA, 22 bp, Homo sapiens
attgagcacctacagtattacc

SEQ ID NO: 7826413 - DNA, 22 bp, Homo sapiens
attgagcacctacagtattacc

SEQ ID NO: 7826414 - DNA, 22 bp, Homo sapiens
attgagctgaaggaagatagtg

SEQ ID NO: 7826415 - DNA, 22 bp, Homo sapiens
attgagctgaaggaagatagtg

SEQ ID NO: 7826416 - DNA, 22 bp, Homo sapiens
attgaggagcagagatggggta

SEQ ID NO: 7826417 - DNA, 22 bp, Homo sapiens
attgagctgttttgtaggataa

SEQ ID NO: 7826418 - DNA, 22 bp, Homo sapiens
attgagctgttttgtaggataa

SEQ ID NO: 7826419 - DNA, 22 bp, Homo sapiens
attgttaaaaaggtggaaatgc

SEQ ID NO: 7826420 - DNA, 22 bp, Homo sapiens
attgttaaaaaggtggaaatgc

SEQ ID NO: 7826421 - DNA, 22 bp, Homo sapiens
attgttaaactgaagcattact

SEQ ID NO: 7826422 - DNA, 22 bp, Homo sapiens
attgttaaactgaagcattact

SEQ ID NO: 7826423 - DNA, 22 bp, Homo sapiens
attgttaactatagcatctggt

SEQ ID NO: 7826424 - DNA, 22 bp, Homo sapiens
attgttaaagtaataaccatgg

SEQ ID NO: 7826425 - DNA, 22 bp, Homo sapiens
attgttaaactgaagcattact

SEQ ID NO: 7826426 - DNA, 22 bp, Homo sapiens
attgttaaagtaataaccatgg

SEQ ID NO: 7826427 - DNA, 22 bp, Homo sapiens
attgttaaagtaataaccatgg

SEQ ID NO: 7826428 - DNA, 22 bp, Homo sapiens
attgtgtagtagtattctgttt

SEQ ID NO: 7826429 - DNA, 22 bp, Homo sapiens
attgtgtaattttcagctcata

SEQ ID NO: 7826430 - DNA, 19 bp, Homo sapiens
attgtgtcaatggtgttca

SEQ ID NO: 7826431 - DNA, 22 bp, Homo sapiens
attgtgtatcacagagcagctg

SEQ ID NO: 7826432 - DNA, 22 bp, Homo sapiens
attgtgtatgttaattctgtaa

SEQ ID NO: 7826433 - DNA, 22 bp, Homo sapiens
attgtgtcctcattgaccttca

SEQ ID NO: 7826434 - DNA, 22 bp, Homo sapiens
attgtgtcctcattgaccttca

SEQ ID NO: 7826435 - DNA, 22 bp, Homo sapiens
attgtgtatgtatgagacagct

SEQ ID NO: 7826436 - DNA, 22 bp, Homo sapiens
attgtggtgtcagttataggca

SEQ ID NO: 7826437 - DNA, 22 bp, Homo sapiens
attgtggctagacagtcacaat

SEQ ID NO: 7826438 - DNA, 22 bp, Homo sapiens
attgtggtgtcagttataggca

SEQ ID NO: 7826439 - DNA, 22 bp, Homo sapiens
attgtggccacagagatccaat

SEQ ID NO: 7826440 - DNA, 22 bp, Homo sapiens
attgtattagcacaatacaatt

SEQ ID NO: 7826441 - DNA, 22 bp, Homo sapiens
attgtattagcacaatacaatt

SEQ ID NO: 7826442 - DNA, 22 bp, Homo sapiens
attgtattagcacaatacaatt

SEQ ID NO: 7826443 - DNA, 22 bp, Homo sapiens
attgtattagcacaatacaatt

SEQ ID NO: 7826444 - DNA, 22 bp, Homo sapiens
attgtattataattaggccaaa

SEQ ID NO: 7826445 - DNA, 22 bp, Homo sapiens
attgtattataattaggccaaa

SEQ ID NO: 7826446 - DNA, 22 bp, Homo sapiens
attgtattagcacaatacaatt

SEQ ID NO: 7826447 - DNA, 22 bp, Homo sapiens
attgtatttaggagaaaagggt

SEQ ID NO: 7826448 - DNA, 22 bp, Homo sapiens
attgtatttccagcttgaatgt

SEQ ID NO: 7826449 - DNA, 22 bp, Homo sapiens
attgtattctgcacctttgtta

SEQ ID NO: 7826450 - DNA, 22 bp, Homo sapiens
attgtatttccagcttgaatgt

SEQ ID NO: 7826451 - DNA, 22 bp, Homo sapiens
attgtgctaagcccaggaggga

SEQ ID NO: 7826452 - DNA, 22 bp, Homo sapiens
attgtgctaagcccaggaggga

SEQ ID NO: 7826453 - DNA, 22 bp, Homo sapiens
attgtgctataagcgtggttct

SEQ ID NO: 7826454 - DNA, 22 bp, Homo sapiens
attgtatttccagcttgaatgt

SEQ ID NO: 7826455 - DNA, 22 bp, Homo sapiens
attgtatttccagcttgaatgt

SEQ ID NO: 7826456 - DNA, 22 bp, Homo sapiens
attgtgctttagatcacagtct

SEQ ID NO: 7826457 - DNA, 22 bp, Homo sapiens
attgtgctgcctcatggaagca

SEQ ID NO: 7826458 - DNA, 22 bp, Homo sapiens
attgtgctgctgctgacgttta

SEQ ID NO: 7826459 - DNA, 22 bp, Homo sapiens
agataattatttacttcaaagt

SEQ ID NO: 7826460 - DNA, 22 bp, Homo sapiens
agataattatttacttcaaagt

SEQ ID NO: 7826461 - DNA, 22 bp, Homo sapiens
agataattatttacttcaaagt

SEQ ID NO: 7826462 - DNA, 22 bp, Homo sapiens
agataattatgtcaatttcttg

SEQ ID NO: 7826463 - DNA, 22 bp, Homo sapiens
agataaattcctaagatttcag

SEQ ID NO: 7826464 - DNA, 22 bp, Homo sapiens
agataaattcctaagatttcag

SEQ ID NO: 7826465 - DNA, 22 bp, Homo sapiens
agataaattcctaagatttcag

SEQ ID NO: 7826466 - DNA, 22 bp, Homo sapiens
attgttaataactattacattg

SEQ ID NO: 7826467 - DNA, 22 bp, Homo sapiens
attgttaataactattacattg

SEQ ID NO: 7826468 - DNA, 22 bp, Homo sapiens
attgttaataactattacattg

SEQ ID NO: 7826469 - DNA, 22 bp, Homo sapiens
agatacaaaggcctacagagca

SEQ ID NO: 7826470 - DNA, 22 bp, Homo sapiens
agatacaaaggcctacagagca

SEQ ID NO: 7826471 - DNA, 22 bp, Homo sapiens
agatacaaaggcctacagagca

SEQ ID NO: 7826472 - DNA, 22 bp, Homo sapiens
agatacaaaggcctacagagca

SEQ ID NO: 7826473 - DNA, 22 bp, Homo sapiens
agatacaactcagaagtgtggt

SEQ ID NO: 7826474 - DNA, 22 bp, Homo sapiens
agatacaactgtttaaacatta

SEQ ID NO: 7826475 - DNA, 22 bp, Homo sapiens
agatacaactgtttaaacatta

SEQ ID NO: 7826476 - DNA, 22 bp, Homo sapiens
agatacaactgtttaaacatta

SEQ ID NO: 7826477 - DNA, 22 bp, Homo sapiens
agatacaactgtttaaacatta

SEQ ID NO: 7826478 - DNA, 22 bp, Homo sapiens
agatacaactcagaagtgtggt

SEQ ID NO: 7826479 - DNA, 22 bp, Homo sapiens
agatacaactgtttaaacatta

SEQ ID NO: 7826480 - DNA, 22 bp, Homo sapiens
agataatttgagtaaattaatt

SEQ ID NO: 7826481 - DNA, 22 bp, Homo sapiens
agatacaaaaagggagaagatt

SEQ ID NO: 7826482 - DNA, 22 bp, Homo sapiens
agatacaaaaagggagaagatt

SEQ ID NO: 7826483 - DNA, 22 bp, Homo sapiens
agatacaaaaagggagaagatt

SEQ ID NO: 7826484 - DNA, 22 bp, Homo sapiens
agataatttgagtaaattaatt

SEQ ID NO: 7826485 - DNA, 22 bp, Homo sapiens
agatacaaaagataagatttag

SEQ ID NO: 7826486 - DNA, 22 bp, Homo sapiens
agatacaaaagataagatttag

SEQ ID NO: 7826487 - DNA, 22 bp, Homo sapiens
agatacaaaggcctacagagca

SEQ ID NO: 7826488 - DNA, 22 bp, Homo sapiens
agatacaaaggcctacagagca

SEQ ID NO: 7826489 - DNA, 22 bp, Homo sapiens
agatacaaaagataagatttag

SEQ ID NO: 7826490 - DNA, 22 bp, Homo sapiens
agatacacagccctgccatcac

SEQ ID NO: 7826491 - DNA, 22 bp, Homo sapiens
agatacacagaggtaaagatga

SEQ ID NO: 7826492 - DNA, 22 bp, Homo sapiens
agatacacagaggtaaagatga

SEQ ID NO: 7826493 - DNA, 22 bp, Homo sapiens
agatacagacctcttattaagg

SEQ ID NO: 7826494 - DNA, 22 bp, Homo sapiens
agatacagacctcttattaagg

SEQ ID NO: 7826495 - DNA, 22 bp, Homo sapiens
agatacagcctgccaggttctt

SEQ ID NO: 7826496 - DNA, 22 bp, Homo sapiens
atttacagatgatgctatttga

SEQ ID NO: 7826497 - DNA, 22 bp, Homo sapiens
atttacagatgatgctatttga

SEQ ID NO: 7826498 - DNA, 22 bp, Homo sapiens
atttacagacgtggattagtgc

SEQ ID NO: 7826499 - DNA, 22 bp, Homo sapiens
agatacaactgtttaaacatta

SEQ ID NO: 7826500 - DNA, 22 bp, Homo sapiens
agatacaactgtttaaacatta

SEQ ID NO: 7826501 - DNA, 22 bp, Homo sapiens
agatacaactgtttaaacatta

SEQ ID NO: 7826502 - DNA, 22 bp, Homo sapiens
agatacaactgtttaaacatta

SEQ ID NO: 7826503 - DNA, 22 bp, Homo sapiens
agatacaagttaagagaaagga

SEQ ID NO: 7826504 - DNA, 22 bp, Homo sapiens
agatacaaggcagagatgtgca

SEQ ID NO: 7826505 - DNA, 22 bp, Homo sapiens
agatacaaggcagagatgtgca

SEQ ID NO: 7826506 - DNA, 22 bp, Homo sapiens
agatacaagttaagagaaagga

SEQ ID NO: 7826507 - DNA, 22 bp, Homo sapiens
agatacaagttaagagaaagga

SEQ ID NO: 7826508 - DNA, 22 bp, Homo sapiens
agatacaagttaagagaaagga

SEQ ID NO: 7826509 - DNA, 22 bp, Homo sapiens
attctctgctgcactgataaca

SEQ ID NO: 7826510 - DNA, 22 bp, Homo sapiens
attctctgccattgcggtggat

SEQ ID NO: 7826511 - DNA, 22 bp, Homo sapiens
attctctggaagaagataaaaa

SEQ ID NO: 7826512 - DNA, 20 bp, Homo sapiens
attctctgctcaagtggcac

SEQ ID NO: 7826513 - DNA, 22 bp, Homo sapiens
attctctgaagtctttcagggc

SEQ ID NO: 7826514 - DNA, 22 bp, Homo sapiens
attctctgaagtcaatggaaat

SEQ ID NO: 7826515 - DNA, 22 bp, Homo sapiens
attctctgatgcaggtggaaga

SEQ ID NO: 7826516 - DNA, 22 bp, Homo sapiens
attctctgatgcaggtggaaga

SEQ ID NO: 7826517 - DNA, 20 bp, Homo sapiens
attctctgacaccgcccccg

SEQ ID NO: 7826518 - DNA, 22 bp, Homo sapiens
attctctgaagtctttcagggc

SEQ ID NO: 7826519 - DNA, 22 bp, Homo sapiens
attctctgggttccagtaaatg

SEQ ID NO: 7826520 - DNA, 22 bp, Homo sapiens
attctctggctaaaacctgaag

SEQ ID NO: 7826521 - DNA, 22 bp, Homo sapiens
attctctgggttccagtaaatg

SEQ ID NO: 7826522 - DNA, 22 bp, Homo sapiens
attctctgggttccagtaaatg

SEQ ID NO: 7826523 - DNA, 22 bp, Homo sapiens
attctctggctaaaacctgaag

SEQ ID NO: 7826524 - DNA, 22 bp, Homo sapiens
attctctggtcattgagcatat

SEQ ID NO: 7826525 - DNA, 22 bp, Homo sapiens
attctctggtcattgagcatat

SEQ ID NO: 7826526 - DNA, 19 bp, Homo sapiens
attctctggtttgctggct

SEQ ID NO: 7826527 - DNA, 19 bp, Homo sapiens
attctctggtttgctggct

SEQ ID NO: 7826528 - DNA, 22 bp, Homo sapiens
attctctggtcattgagtataa

SEQ ID NO: 7826529 - DNA, 21 bp, Homo sapiens
attctctgtgatgggattagg

SEQ ID NO: 7826530 - DNA, 22 bp, Homo sapiens
attctctgtgcagatttaagac

SEQ ID NO: 7826531 - DNA, 22 bp, Homo sapiens
attctctgtacagaaggtaccg

SEQ ID NO: 7826532 - DNA, 22 bp, Homo sapiens
attctctgtctttttgaaaaca

SEQ ID NO: 7826533 - DNA, 22 bp, Homo sapiens
attctctggtcattgagtataa

SEQ ID NO: 7826534 - DNA, 22 bp, Homo sapiens
attctctgtagatggcttgaga

SEQ ID NO: 7826535 - DNA, 22 bp, Homo sapiens
attctctgtgcagatttaagac

SEQ ID NO: 7826536 - DNA, 22 bp, Homo sapiens
attctctgtgcagatttaagac

SEQ ID NO: 7826537 - DNA, 19 bp, Homo sapiens
attcttctcttcctgctgt

SEQ ID NO: 7826538 - DNA, 22 bp, Homo sapiens
attcttctgcctactttcatcc

SEQ ID NO: 7826539 - DNA, 22 bp, Homo sapiens
attcttctgcctactttcatcc

SEQ ID NO: 7826540 - DNA, 22 bp, Homo sapiens
attcttctgcctactttcatcc

SEQ ID NO: 7826541 - DNA, 22 bp, Homo sapiens
attgaaaaatgactattgctta

SEQ ID NO: 7826542 - DNA, 20 bp, Homo sapiens
attctacaagaataagcatg

SEQ ID NO: 7826543 - DNA, 20 bp, Homo sapiens
attctacaagaataagcatg

SEQ ID NO: 7826544 - DNA, 22 bp, Homo sapiens
attctacaatcatgtagatcct

SEQ ID NO: 7826545 - DNA, 20 bp, Homo sapiens
attctacaagaataagcatg

SEQ ID NO: 7826546 - DNA, 20 bp, Homo sapiens
attctacaagaataagcatg

SEQ ID NO: 7826547 - DNA, 22 bp, Homo sapiens
attctacaacccaataataatt

SEQ ID NO: 7826548 - DNA, 22 bp, Homo sapiens
attctacaatcatgtagatcct

SEQ ID NO: 7826549 - DNA, 22 bp, Homo sapiens
attctacaatcatgtagatcct

SEQ ID NO: 7826550 - DNA, 22 bp, Homo sapiens
attctccagctcactgtccata

SEQ ID NO: 7826551 - DNA, 22 bp, Homo sapiens
attctccagtagtcattctatc

SEQ ID NO: 7826552 - DNA, 19 bp, Homo sapiens
attctccctagaattttga

SEQ ID NO: 7826553 - DNA, 22 bp, Homo sapiens
attctctctagaagctgagatg

SEQ ID NO: 7826554 - DNA, 19 bp, Homo sapiens
attctctagtggtgcaatg

SEQ ID NO: 7826555 - DNA, 22 bp, Homo sapiens
attctctcatttatctgtccta

SEQ ID NO: 7826556 - DNA, 22 bp, Homo sapiens
attctctctctatgaaaactga

SEQ ID NO: 7826557 - DNA, 22 bp, Homo sapiens
attctctcttctgctgcccgtg

SEQ ID NO: 7826558 - DNA, 22 bp, Homo sapiens
attctccctgttcctcgacacc

SEQ ID NO: 7826559 - DNA, 19 bp, Homo sapiens
attctccctagaattttga

SEQ ID NO: 7826560 - DNA, 20 bp, Homo sapiens
attctccctatactcacttt

SEQ ID NO: 7826561 - DNA, 22 bp, Homo sapiens
attctccttattctgaaaaaag

SEQ ID NO: 7826562 - DNA, 22 bp, Homo sapiens
attctccttctattaagttatt

SEQ ID NO: 7826563 - DNA, 22 bp, Homo sapiens
attctccttctattaagttatt

SEQ ID NO: 7826564 - DNA, 22 bp, Homo sapiens
attctccttctattaagttatt

SEQ ID NO: 7826565 - DNA, 22 bp, Homo sapiens
attctctagtctcttccataaa

SEQ ID NO: 7826566 - DNA, 22 bp, Homo sapiens
attctaagtcttgttcacattc

SEQ ID NO: 7826567 - DNA, 22 bp, Homo sapiens
attctaagcacgctgaagtctt

SEQ ID NO: 7826568 - DNA, 21 bp, Homo sapiens
attctaaccaggagaggctga

SEQ ID NO: 7826569 - DNA, 23 bp, Homo sapiens
attctaagatgtgatcttataac

SEQ ID NO: 7826570 - DNA, 22 bp, Homo sapiens
attctaatgccctggccccagc

SEQ ID NO: 7826571 - DNA, 22 bp, Homo sapiens
attctaatggcagagactcctg

SEQ ID NO: 7826572 - DNA, 22 bp, Homo sapiens
attctacaacccaataataatt

SEQ ID NO: 7826573 - DNA, 22 bp, Homo sapiens
attctacaacccaataataatt

SEQ ID NO: 7826574 - DNA, 22 bp, Homo sapiens
attctacaaaagaactggatct

SEQ ID NO: 7826575 - DNA, 22 bp, Homo sapiens
attctacaaaagaactggatct

SEQ ID NO: 7826576 - DNA, 22 bp, Homo sapiens
attctaattagttctacatgtt

SEQ ID NO: 7826577 - DNA, 22 bp, Homo sapiens
attctaattagttctacatgtt

SEQ ID NO: 7826578 - DNA, 22 bp, Homo sapiens
attctaattagttctacatgtt

SEQ ID NO: 7826579 - DNA, 22 bp, Homo sapiens
attctaaatcagagagctctgt

SEQ ID NO: 7826580 - DNA, 22 bp, Homo sapiens
attctaaatcagagagctctgt

SEQ ID NO: 7826581 - DNA, 22 bp, Homo sapiens
attctaaatgtaatttagaatt

SEQ ID NO: 7826582 - DNA, 22 bp, Homo sapiens
attctaaatgtaatttagaatt

SEQ ID NO: 7826583 - DNA, 22 bp, Homo sapiens
attctaaatgtaatttagaatt

SEQ ID NO: 7826584 - DNA, 22 bp, Homo sapiens
attctaaatgtaatttagaatt

SEQ ID NO: 7826585 - DNA, 22 bp, Homo sapiens
attctaaatgtaatttagaatt

SEQ ID NO: 7826586 - DNA, 20 bp, Homo sapiens
attctaaagctctgctcttt

SEQ ID NO: 7826587 - DNA, 20 bp, Homo sapiens
attctaaagctctgctcttt

SEQ ID NO: 7826588 - DNA, 22 bp, Homo sapiens
attcgctgacttgcacatttgg

SEQ ID NO: 7826589 - DNA, 20 bp, Homo sapiens
attctaaagctctgctcttt

SEQ ID NO: 7826590 - DNA, 20 bp, Homo sapiens
attctaaagctctgctcttt

SEQ ID NO: 7826591 - DNA, 22 bp, Homo sapiens
attctaaagcttgtggagctta

SEQ ID NO: 7826592 - DNA, 22 bp, Homo sapiens
attctaaagcttgtggagctta

SEQ ID NO: 7826593 - DNA, 22 bp, Homo sapiens
attcaaaagaccatgcagactc

SEQ ID NO: 7826594 - DNA, 22 bp, Homo sapiens
attcaaaagaccatgcagactc

SEQ ID NO: 7826595 - DNA, 22 bp, Homo sapiens
attcaaaagaccatgcagactc

SEQ ID NO: 7826596 - DNA, 22 bp, Homo sapiens
attcaaaagaccatgcagactc

SEQ ID NO: 7826597 - DNA, 22 bp, Homo sapiens
attcaaaagaccatgcagactc

SEQ ID NO: 7826598 - DNA, 22 bp, Homo sapiens
attcaaaagaccatgcagactc

SEQ ID NO: 7826599 - DNA, 22 bp, Homo sapiens
attcaaacaggccaattgacct

SEQ ID NO: 7826600 - DNA, 22 bp, Homo sapiens
attcaaacaggaagaaatcatt

SEQ ID NO: 7826601 - DNA, 22 bp, Homo sapiens
attcaaacaggaagaaatcatt

SEQ ID NO: 7826602 - DNA, 22 bp, Homo sapiens
attcaaacaggaagaaatcatt

SEQ ID NO: 7826603 - DNA, 22 bp, Homo sapiens
attcaaacactttgagaagttc

SEQ ID NO: 7826604 - DNA, 22 bp, Homo sapiens
attcaaaccccatagacaactt

SEQ ID NO: 7826605 - DNA, 22 bp, Homo sapiens
attcaaaccccatagacaactt

SEQ ID NO: 7826606 - DNA, 22 bp, Homo sapiens
attcaaacaggccaattgacct

SEQ ID NO: 7826607 - DNA, 22 bp, Homo sapiens
attcaaacctcatttattgttc

SEQ ID NO: 7826608 - DNA, 22 bp, Homo sapiens
attcaaactgtgttaggcagca

SEQ ID NO: 7826609 - DNA, 22 bp, Homo sapiens
attcctttggactcctccttgc

SEQ ID NO: 7826610 - DNA, 22 bp, Homo sapiens
attcctttggactcctccttgc

SEQ ID NO: 7826611 - DNA, 22 bp, Homo sapiens
attcccatttgtgtggtctgga

SEQ ID NO: 7826612 - DNA, 22 bp, Homo sapiens
attcccatgtctttacctgttg

SEQ ID NO: 7826613 - DNA, 22 bp, Homo sapiens
attcccatgtctttacctgttg

SEQ ID NO: 7826614 - DNA, 22 bp, Homo sapiens
attcccatctctgagtggaagg

SEQ ID NO: 7826615 - DNA, 22 bp, Homo sapiens
attcccagatttatattgatag

SEQ ID NO: 7826616 - DNA, 22 bp, Homo sapiens
attcccaggtaaaagtagagct

SEQ ID NO: 7826617 - DNA, 22 bp, Homo sapiens
attcccaggtaaaagtagagct

SEQ ID NO: 7826618 - DNA, 22 bp, Homo sapiens
attcccatatatgtttgtcgct

SEQ ID NO: 7826619 - DNA, 22 bp, Homo sapiens
attcccataggcaatgcgtgat

SEQ ID NO: 7826620 - DNA, 22 bp, Homo sapiens
attcccactagctctttataga

SEQ ID NO: 7826621 - DNA, 22 bp, Homo sapiens
attcccactagctctttataga

SEQ ID NO: 7826622 - DNA, 22 bp, Homo sapiens
attcccacctgaaaaaggtagg

SEQ ID NO: 7826623 - DNA, 22 bp, Homo sapiens
attcaaagagctgccagaactg

SEQ ID NO: 7826624 - DNA, 22 bp, Homo sapiens
attcaaagaacctttagcattg

SEQ ID NO: 7826625 - DNA, 22 bp, Homo sapiens
attcaaagaacctttagcattg

SEQ ID NO: 7826626 - DNA, 22 bp, Homo sapiens
agaggcctctgttgttcagacg

SEQ ID NO: 7826627 - DNA, 22 bp, Homo sapiens
agaggcctctttgcaagtaggt

SEQ ID NO: 7826628 - DNA, 22 bp, Homo sapiens
attatttgacttgagaacaggt

SEQ ID NO: 7826629 - DNA, 22 bp, Homo sapiens
attatttctcactcacataata

SEQ ID NO: 7826630 - DNA, 22 bp, Homo sapiens
attatttctcactcacataata

SEQ ID NO: 7826631 - DNA, 22 bp, Homo sapiens
attatttctcactcacataata

SEQ ID NO: 7826632 - DNA, 22 bp, Homo sapiens
attatttctcactcacataata

SEQ ID NO: 7826633 - DNA, 22 bp, Homo sapiens
attatttctcactcacataata

SEQ ID NO: 7826634 - DNA, 22 bp, Homo sapiens
attattttatgtgcggcctgat

SEQ ID NO: 7826635 - DNA, 22 bp, Homo sapiens
attattttatgtgcggcctgat

SEQ ID NO: 7826636 - DNA, 22 bp, Homo sapiens
attattttatgtgcggcctgat

SEQ ID NO: 7826637 - DNA, 22 bp, Homo sapiens
attattttatgtgcggcctgat

SEQ ID NO: 7826638 - DNA, 22 bp, Homo sapiens
attattttatgtgcggcctgat

SEQ ID NO: 7826639 - DNA, 22 bp, Homo sapiens
attattttatgtgcggcctgat

SEQ ID NO: 7826640 - DNA, 22 bp, Homo sapiens
attatttgcttggctcatctaa

SEQ ID NO: 7826641 - DNA, 22 bp, Homo sapiens
attatttggaataggcattgca

SEQ ID NO: 7826642 - DNA, 22 bp, Homo sapiens
attatttgagttcctctctacc

SEQ ID NO: 7826643 - DNA, 22 bp, Homo sapiens
attatttgacttgagaacaggt

SEQ ID NO: 7826644 - DNA, 22 bp, Homo sapiens
attatttgtgtccacagaatac

SEQ ID NO: 7826645 - DNA, 22 bp, Homo sapiens
attatttgtgtccacagaatac

SEQ ID NO: 7826646 - DNA, 15 bp, Homo sapiens
attatttgtgctcag

SEQ ID NO: 7826647 - DNA, 22 bp, Homo sapiens
agaggcctcaaaccagacctga

SEQ ID NO: 7826648 - DNA, 22 bp, Homo sapiens
agaggcctcaaaccagacctga

SEQ ID NO: 7826649 - DNA, 22 bp, Homo sapiens
agaggcctaaccaagatgtcct

SEQ ID NO: 7826650 - DNA, 22 bp, Homo sapiens
agaggcctaaccaagatgtcct

SEQ ID NO: 7826651 - DNA, 22 bp, Homo sapiens
agaggcctaaccaagatgtcct

SEQ ID NO: 7826652 - DNA, 19 bp, Homo sapiens
agaggcctcagcagctggc

SEQ ID NO: 7826653 - DNA, 19 bp, Homo sapiens
agaggcctcagcagctggc

SEQ ID NO: 7826654 - DNA, 19 bp, Homo sapiens
agaggcctcagcagctggc

SEQ ID NO: 7826655 - DNA, 19 bp, Homo sapiens
agaggcctcagcagctggc

SEQ ID NO: 7826656 - DNA, 22 bp, Homo sapiens
agaggccggccgagcccatggg

SEQ ID NO: 7826657 - DNA, 22 bp, Homo sapiens
agaggccctgggctggtgtgct

SEQ ID NO: 7826658 - DNA, 22 bp, Homo sapiens
agaggccggccgagcccatggg

SEQ ID NO: 7826659 - DNA, 22 bp, Homo sapiens
agaggccctggctagagcagct

SEQ ID NO: 7826660 - DNA, 22 bp, Homo sapiens
agaggccctgggctggtgtgct

SEQ ID NO: 7826661 - DNA, 22 bp, Homo sapiens
agaggccctggctagagcagct

SEQ ID NO: 7826662 - DNA, 22 bp, Homo sapiens
agaggccctggctagagcagct

SEQ ID NO: 7826663 - DNA, 22 bp, Homo sapiens
agaggccggccgagcccatggg

SEQ ID NO: 7826664 - DNA, 22 bp, Homo sapiens
agaggccggccgagcccatggg

SEQ ID NO: 7826665 - DNA, 22 bp, Homo sapiens
agaggccggccgagcccatggg

SEQ ID NO: 7826666 - DNA, 22 bp, Homo sapiens
agaggccgggtgcctgctcaga

SEQ ID NO: 7826667 - DNA, 22 bp, Homo sapiens
agaggccggccgagcccatggg

SEQ ID NO: 7826668 - DNA, 22 bp, Homo sapiens
agaggccggccgagcccatggg

SEQ ID NO: 7826669 - DNA, 22 bp, Homo sapiens
agaggccggccgagcccatggg

SEQ ID NO: 7826670 - DNA, 22 bp, Homo sapiens
agaggccggccgagcccatggg

SEQ ID NO: 7826671 - DNA, 22 bp, Homo sapiens
agaggaaaatgagttccagaat

SEQ ID NO: 7826672 - DNA, 22 bp, Homo sapiens
agagctttttgacatctctcta

SEQ ID NO: 7826673 - DNA, 22 bp, Homo sapiens
agagcttttgggaattcaggta

SEQ ID NO: 7826674 - DNA, 22 bp, Homo sapiens
agagctttttgacatctctcta

SEQ ID NO: 7826675 - DNA, 21 bp, Homo sapiens
agaggaagaagagtgtattat

SEQ ID NO: 7826676 - DNA, 21 bp, Homo sapiens
agaggaagaagagtgtattat

SEQ ID NO: 7826677 - DNA, 21 bp, Homo sapiens
agaggaagaagagtgtattat

SEQ ID NO: 7826678 - DNA, 21 bp, Homo sapiens
agaggaagaagagtgtattat

SEQ ID NO: 7826679 - DNA, 22 bp, Homo sapiens
agaggaaatggataaagggtga

SEQ ID NO: 7826680 - DNA, 22 bp, Homo sapiens
agaggaaatggataaagggtga

SEQ ID NO: 7826681 - DNA, 22 bp, Homo sapiens
agaggaagattttattaaccag

SEQ ID NO: 7826682 - DNA, 21 bp, Homo sapiens
agaggaagaagagtgtattat

SEQ ID NO: 7826683 - DNA, 22 bp, Homo sapiens
agaggaagccattgcttactga

SEQ ID NO: 7826684 - DNA, 22 bp, Homo sapiens
agaggccagggacactgctcaa

SEQ ID NO: 7826685 - DNA, 22 bp, Homo sapiens
agaggccagggacactgctcaa

SEQ ID NO: 7826686 - DNA, 22 bp, Homo sapiens
agaggccagggacactgctcaa

SEQ ID NO: 7826687 - DNA, 22 bp, Homo sapiens
agaggaagccattgcttactga

SEQ ID NO: 7826688 - DNA, 22 bp, Homo sapiens
agaggaagccattgcttactga

SEQ ID NO: 7826689 - DNA, 22 bp, Homo sapiens
agaggaagccattgcttactga

SEQ ID NO: 7826690 - DNA, 22 bp, Homo sapiens
agaggaagccattgcttactga

SEQ ID NO: 7826691 - DNA, 22 bp, Homo sapiens
agaggccagggacactgctcaa

SEQ ID NO: 7826692 - DNA, 22 bp, Homo sapiens
agaggccagggacactgctcaa

SEQ ID NO: 7826693 - DNA, 22 bp, Homo sapiens
agaggccagggacactgctcaa

SEQ ID NO: 7826694 - DNA, 22 bp, Homo sapiens
agaggccaggtccagagtttgt

SEQ ID NO: 7826695 - DNA, 22 bp, Homo sapiens
agaggccctctctgctcagtct

SEQ ID NO: 7826696 - DNA, 22 bp, Homo sapiens
agaggccaggtccagagtttgt

SEQ ID NO: 7826697 - DNA, 22 bp, Homo sapiens
agagctttagctgctggtctgg

SEQ ID NO: 7826698 - DNA, 22 bp, Homo sapiens
agagctttagctgctggtctgg

SEQ ID NO: 7826699 - DNA, 22 bp, Homo sapiens
agagctttagctgctggtctgg

SEQ ID NO: 7826700 - DNA, 23 bp, Homo sapiens
agagctttccagtttcttggtga

SEQ ID NO: 7826701 - DNA, 23 bp, Homo sapiens
agagctttccagtttcttggtga

SEQ ID NO: 7826702 - DNA, 22 bp, Homo sapiens
agagcttgtaattgagtcaggt

SEQ ID NO: 7826703 - DNA, 22 bp, Homo sapiens
agagcttcactggagagcacat

SEQ ID NO: 7826704 - DNA, 22 bp, Homo sapiens
agagctttgggacatttgctag

SEQ ID NO: 7826705 - DNA, 22 bp, Homo sapiens
agagctttgggacatttgctag

SEQ ID NO: 7826706 - DNA, 22 bp, Homo sapiens
agagctttgggacatttgctag

SEQ ID NO: 7826707 - DNA, 22 bp, Homo sapiens
agagctttgggacatttgctag

SEQ ID NO: 7826708 - DNA, 23 bp, Homo sapiens
agagctttctaaaatgtaaatct

SEQ ID NO: 7826709 - DNA, 23 bp, Homo sapiens
agagctttctaaaatgtaaatct

SEQ ID NO: 7826710 - DNA, 23 bp, Homo sapiens
agagctttccagtttcttggtga

SEQ ID NO: 7826711 - DNA, 23 bp, Homo sapiens
agagctttctaaaatgtaaatct

SEQ ID NO: 7826712 - DNA, 22 bp, Homo sapiens
agagctttgtttgattgtcaga

SEQ ID NO: 7826713 - DNA, 22 bp, Homo sapiens
agagctttgtttgattgtcaga

SEQ ID NO: 7826714 - DNA, 22 bp, Homo sapiens
agagcttttacttacattctat

SEQ ID NO: 7826715 - DNA, 22 bp, Homo sapiens
agagcttttacttacattctat

SEQ ID NO: 7826716 - DNA, 22 bp, Homo sapiens
agagcttttctgtaataacatc

SEQ ID NO: 7826717 - DNA, 22 bp, Homo sapiens
agagcttttgggaattcaggta

SEQ ID NO: 7826718 - DNA, 22 bp, Homo sapiens
agagcttttgggaattcaggta

SEQ ID NO: 7826719 - DNA, 22 bp, Homo sapiens
agagcttttgggaattcaggta

SEQ ID NO: 7826720 - DNA, 22 bp, Homo sapiens
attaataaaataccactttgtt

SEQ ID NO: 7826721 - DNA, 22 bp, Homo sapiens
attaataaaataccactttgtt

SEQ ID NO: 7826722 - DNA, 22 bp, Homo sapiens
attaataaaataccactttgtt

SEQ ID NO: 7826723 - DNA, 22 bp, Homo sapiens
attaataaaataccactttgtt

SEQ ID NO: 7826724 - DNA, 22 bp, Homo sapiens
attaataaaataccactttgtt

SEQ ID NO: 7826725 - DNA, 22 bp, Homo sapiens
attaataaaataccactttgtt

SEQ ID NO: 7826726 - DNA, 22 bp, Homo sapiens
attaatacattatagggattgt

SEQ ID NO: 7826727 - DNA, 22 bp, Homo sapiens
attaataaaataccactttgtt

SEQ ID NO: 7826728 - DNA, 22 bp, Homo sapiens
agagcttcactggagagcacat

SEQ ID NO: 7826729 - DNA, 22 bp, Homo sapiens
agagcttatatcttggccatcc

SEQ ID NO: 7826730 - DNA, 23 bp, Homo sapiens
agagcttagggaattcacatgag

SEQ ID NO: 7826731 - DNA, 22 bp, Homo sapiens
agagcttagaatttcagatgat

SEQ ID NO: 7826732 - DNA, 22 bp, Homo sapiens
agagctgtttgtctagagagtg

SEQ ID NO: 7826733 - DNA, 22 bp, Homo sapiens
agagctgtttgtctagagagtg

SEQ ID NO: 7826734 - DNA, 22 bp, Homo sapiens
cagctgggtgatcttgggcagg

SEQ ID NO: 7826735 - DNA, 22 bp, Homo sapiens
cagctgggtgatcttgggcagg

SEQ ID NO: 7826736 - DNA, 22 bp, Homo sapiens
cagctgggtgatcttgggcagg

SEQ ID NO: 7826737 - DNA, 22 bp, Homo sapiens
cagctgggtggctcttctgctc

SEQ ID NO: 7826738 - DNA, 22 bp, Homo sapiens
cagctgggtggctcttctgctc

SEQ ID NO: 7826739 - DNA, 22 bp, Homo sapiens
cagctgggtggctcttctgctc

SEQ ID NO: 7826740 - DNA, 22 bp, Homo sapiens
cagctgggtggctcttctgctc

SEQ ID NO: 7826741 - DNA, 22 bp, Homo sapiens
cagctgggtggctcttctgctc

SEQ ID NO: 7826742 - DNA, 22 bp, Homo sapiens
cagctggcagccctggccctgc

SEQ ID NO: 7826743 - DNA, 22 bp, Homo sapiens
cagctggcagccctggccctgc

SEQ ID NO: 7826744 - DNA, 22 bp, Homo sapiens
cagctggcagccctggccctgc

SEQ ID NO: 7826745 - DNA, 22 bp, Homo sapiens
cagctggcagccctggccctgc

SEQ ID NO: 7826746 - DNA, 22 bp, Homo sapiens
cagctggcagccctggccctgc

SEQ ID NO: 7826747 - DNA, 22 bp, Homo sapiens
cagctggcagccctggccctgc

SEQ ID NO: 7826748 - DNA, 22 bp, Homo sapiens
cagctggcatacctgggcccgg

SEQ ID NO: 7826749 - DNA, 22 bp, Homo sapiens
cagctggcatacctgggcccgg

SEQ ID NO: 7826750 - DNA, 22 bp, Homo sapiens
cagctggcatacctgggcccgg

SEQ ID NO: 7826751 - DNA, 22 bp, Homo sapiens
cagctggcaagtggagcagggt

SEQ ID NO: 7826752 - DNA, 22 bp, Homo sapiens
cagctggcaagtggagcagggt

SEQ ID NO: 7826753 - DNA, 22 bp, Homo sapiens
cagctggcagaacctgcatcca

SEQ ID NO: 7826754 - DNA, 22 bp, Homo sapiens
cagctggcagaacctgcatcca

SEQ ID NO: 7826755 - DNA, 22 bp, Homo sapiens
cagctggcagaacctgcatcca

SEQ ID NO: 7826756 - DNA, 22 bp, Homo sapiens
cagctggcagaacctgcatcca

SEQ ID NO: 7826757 - DNA, 22 bp, Homo sapiens
cagctggcaagtggagcagggt

SEQ ID NO: 7826758 - DNA, 22 bp, Homo sapiens
cagctggcaagtggagcagggt

SEQ ID NO: 7826759 - DNA, 22 bp, Homo sapiens
cagctggcaagtggagcagggt

SEQ ID NO: 7826760 - DNA, 22 bp, Homo sapiens
cagctggcaagtggagcagggt

SEQ ID NO: 7826761 - DNA, 22 bp, Homo sapiens
cagctggatgggagaccatgtt

SEQ ID NO: 7826762 - DNA, 22 bp, Homo sapiens
cagctggatgggagaccatgtt

SEQ ID NO: 7826763 - DNA, 22 bp, Homo sapiens
cagctggatgggagaccatgtt

SEQ ID NO: 7826764 - DNA, 22 bp, Homo sapiens
cagctggatctgcctcgagcca

SEQ ID NO: 7826765 - DNA, 22 bp, Homo sapiens
cagctggcaagtggagcagggt

SEQ ID NO: 7826766 - DNA, 20 bp, Homo sapiens
agctgaggcacctgaggtta

SEQ ID NO: 7826767 - DNA, 20 bp, Homo sapiens
agctgaggcacctgaggtta

SEQ ID NO: 7826768 - DNA, 20 bp, Homo sapiens
agctgaggcacctgaggtta

SEQ ID NO: 7826769 - DNA, 20 bp, Homo sapiens
agctgaggcacctgaggtta

SEQ ID NO: 7826770 - DNA, 22 bp, Homo sapiens
cagctgctttcagcaggaggga

SEQ ID NO: 7826771 - DNA, 22 bp, Homo sapiens
cagctgctttcagcaggaggga

SEQ ID NO: 7826772 - DNA, 22 bp, Homo sapiens
cagctgctttcagcaggaggga

SEQ ID NO: 7826773 - DNA, 22 bp, Homo sapiens
cagctgctttcagcaggaggga

SEQ ID NO: 7826774 - DNA, 22 bp, Homo sapiens
cagctgctttagttttccatcc

SEQ ID NO: 7826775 - DNA, 22 bp, Homo sapiens
cagctgctttcagcaggaggga

SEQ ID NO: 7826776 - DNA, 22 bp, Homo sapiens
cagctgctttcagcaggaggga

SEQ ID NO: 7826777 - DNA, 22 bp, Homo sapiens
cagctgctttcagcaggaggga

SEQ ID NO: 7826778 - DNA, 22 bp, Homo sapiens
cagctggatccctgcagaactt

SEQ ID NO: 7826779 - DNA, 22 bp, Homo sapiens
cagctggatccctgcagaactt

SEQ ID NO: 7826780 - DNA, 22 bp, Homo sapiens
cagctggatccctgcagaactt

SEQ ID NO: 7826781 - DNA, 22 bp, Homo sapiens
cagctggaggagcagcttccag

SEQ ID NO: 7826782 - DNA, 22 bp, Homo sapiens
cagctggatctgcctcgagcca

SEQ ID NO: 7826783 - DNA, 22 bp, Homo sapiens
cagctggatctgcctcgagcca

SEQ ID NO: 7826784 - DNA, 22 bp, Homo sapiens
cagctggatctgcctcgagcca

SEQ ID NO: 7826785 - DNA, 22 bp, Homo sapiens
cagctggatccctgcagaactt

SEQ ID NO: 7826786 - DNA, 22 bp, Homo sapiens
cagctggatctgcctcgagcca

SEQ ID NO: 7826787 - DNA, 22 bp, Homo sapiens
cagctggactgggatgtagcga

SEQ ID NO: 7826788 - DNA, 22 bp, Homo sapiens
cagctggactgggatgtagcga

SEQ ID NO: 7826789 - DNA, 19 bp, Homo sapiens
cagctggaatcatctgagg

SEQ ID NO: 7826790 - DNA, 19 bp, Homo sapiens
cagctggaatcatctgagg

SEQ ID NO: 7826791 - DNA, 22 bp, Homo sapiens
agctgaggaggaatgatgggta

SEQ ID NO: 7826792 - DNA, 22 bp, Homo sapiens
agctgaggaggaatgatgggta

SEQ ID NO: 7826793 - DNA, 22 bp, Homo sapiens
agctgaggaggaatgatgggta

SEQ ID NO: 7826794 - DNA, 22 bp, Homo sapiens
agctgaggaggaatgatgggta

SEQ ID NO: 7826795 - DNA, 22 bp, Homo sapiens
agctgaggaggaatgatgggta

SEQ ID NO: 7826796 - DNA, 22 bp, Homo sapiens
agctgaggaggaatgatgggta

SEQ ID NO: 7826797 - DNA, 17 bp, Homo sapiens
agctgagctggccaggg

SEQ ID NO: 7826798 - DNA, 22 bp, Homo sapiens
agctgaggaataataacaaggt

SEQ ID NO: 7826799 - DNA, 22 bp, Homo sapiens
agctgaggacgtgaagggcggc

SEQ ID NO: 7826800 - DNA, 17 bp, Homo sapiens
agctgagctggccaggg

SEQ ID NO: 7826801 - DNA, 17 bp, Homo sapiens
agctgagctggccaggg

SEQ ID NO: 7826802 - DNA, 22 bp, Homo sapiens
agctgagctgcagatgactgta

SEQ ID NO: 7826803 - DNA, 22 bp, Homo sapiens
agctgagctgcagatgactgta

SEQ ID NO: 7826804 - DNA, 22 bp, Homo sapiens
agctgagctgcagatgactgta

SEQ ID NO: 7826805 - DNA, 17 bp, Homo sapiens
agctgagctggccaggg

SEQ ID NO: 7826806 - DNA, 21 bp, Homo sapiens
agctgagcccagaagactggt

SEQ ID NO: 7826807 - DNA, 21 bp, Homo sapiens
agctgagcccagaagactggt

SEQ ID NO: 7826808 - DNA, 22 bp, Homo sapiens
agctgagctagtagttccagtg

SEQ ID NO: 7826809 - DNA, 22 bp, Homo sapiens
agctgagctcaggctgatgtaa

SEQ ID NO: 7826810 - DNA, 22 bp, Homo sapiens
agctgagctcaggctgatgtaa

SEQ ID NO: 7826811 - DNA, 20 bp, Homo sapiens
agctgaagatctggatgggg

SEQ ID NO: 7826812 - DNA, 20 bp, Homo sapiens
agctgaagatctggatgggg

SEQ ID NO: 7826813 - DNA, 22 bp, Homo sapiens
agctgagcatttgatccacctc

SEQ ID NO: 7826814 - DNA, 22 bp, Homo sapiens
agctgaagcaacaacaggatgg

SEQ ID NO: 7826815 - DNA, 22 bp, Homo sapiens
agctgagccagcagcaacagga

SEQ ID NO: 7826816 - DNA, 22 bp, Homo sapiens
agctgagcatttgatccacctc

SEQ ID NO: 7826817 - DNA, 22 bp, Homo sapiens
agctctgggagtagttccacct

SEQ ID NO: 7826818 - DNA, 22 bp, Homo sapiens
agctctggctaagctgataaat

SEQ ID NO: 7826819 - DNA, 22 bp, Homo sapiens
agctctgggattctcaggccac

SEQ ID NO: 7826820 - DNA, 22 bp, Homo sapiens
agctctgggattctcaggccac

SEQ ID NO: 7826821 - DNA, 22 bp, Homo sapiens
agctctgggagtagttccacct

SEQ ID NO: 7826822 - DNA, 22 bp, Homo sapiens
agctgaagatccagggttgggg

SEQ ID NO: 7826823 - DNA, 22 bp, Homo sapiens
agctgaagatccagggttgggg

SEQ ID NO: 7826824 - DNA, 23 bp, Homo sapiens
agctctggcgttggggaggtagt

SEQ ID NO: 7826825 - DNA, 18 bp, Homo sapiens
agctctggcatacttgaa

SEQ ID NO: 7826826 - DNA, 23 bp, Homo sapiens
agctctggcgttggggaggtagt

SEQ ID NO: 7826827 - DNA, 22 bp, Homo sapiens
agctctggctaagctgataaat

SEQ ID NO: 7826828 - DNA, 22 bp, Homo sapiens
agctctgggagtagttccacct

SEQ ID NO: 7826829 - DNA, 22 bp, Homo sapiens
agctctggctaagctgataaat

SEQ ID NO: 7826830 - DNA, 22 bp, Homo sapiens
agctctggcactggcgcgggat

SEQ ID NO: 7826831 - DNA, 22 bp, Homo sapiens
agctctggcactggcgcgggat

SEQ ID NO: 7826832 - DNA, 22 bp, Homo sapiens
agctctggcactggcgcgggat

SEQ ID NO: 7826833 - DNA, 19 bp, Homo sapiens
agctctggattaaatttct

SEQ ID NO: 7826834 - DNA, 19 bp, Homo sapiens
agctctggattaaatttct

SEQ ID NO: 7826835 - DNA, 22 bp, Homo sapiens
agctctggcactggcgcgggat

SEQ ID NO: 7826836 - DNA, 18 bp, Homo sapiens
agctctggcatacttgaa

SEQ ID NO: 7826837 - DNA, 18 bp, Homo sapiens
agctctggcatacttgaa

SEQ ID NO: 7826838 - DNA, 22 bp, Homo sapiens
agctctggagccggaggatttc

SEQ ID NO: 7826839 - DNA, 22 bp, Homo sapiens
agctctggagccggaggatttc

SEQ ID NO: 7826840 - DNA, 22 bp, Homo sapiens
agctctggagccggaggatttc

SEQ ID NO: 7826841 - DNA, 21 bp, Homo sapiens
agctctggagcagcaatcaag

SEQ ID NO: 7826842 - DNA, 21 bp, Homo sapiens
agctctggagcagcaatcaag

SEQ ID NO: 7826843 - DNA, 22 bp, Homo sapiens
agctctggagccggaggatttc

SEQ ID NO: 7826844 - DNA, 22 bp, Homo sapiens
agctctggaataatgatgtgat

SEQ ID NO: 7826845 - DNA, 22 bp, Homo sapiens
agctctggaagccctggtagtt

SEQ ID NO: 7826846 - DNA, 22 bp, Homo sapiens
agctctggaataatgatgtgat

SEQ ID NO: 7826847 - DNA, 22 bp, Homo sapiens
agctctggaataatgatgtgat

SEQ ID NO: 7826848 - DNA, 22 bp, Homo sapiens
agctctggacctgacatctggt

SEQ ID NO: 7826849 - DNA, 22 bp, Homo sapiens
agctctggacctgacatctggt

SEQ ID NO: 7826850 - DNA, 21 bp, Homo sapiens
agctctggagcagcaatcaag

SEQ ID NO: 7826851 - DNA, 21 bp, Homo sapiens
agctctggagcagcaatcaag

SEQ ID NO: 7826852 - DNA, 22 bp, Homo sapiens
cagctgccccgctggctgacca

SEQ ID NO: 7826853 - DNA, 22 bp, Homo sapiens
cagctgccccgctggctgacca

SEQ ID NO: 7826854 - DNA, 22 bp, Homo sapiens
cagctgccccgctggctgacca

SEQ ID NO: 7826855 - DNA, 22 bp, Homo sapiens
cagctgcccctccagggctggg

SEQ ID NO: 7826856 - DNA, 22 bp, Homo sapiens
cagctgccccgctggctgacca

SEQ ID NO: 7826857 - DNA, 22 bp, Homo sapiens
cagctgcccaggccacctggag

SEQ ID NO: 7826858 - DNA, 22 bp, Homo sapiens
cagctgcccaggccacctggag

SEQ ID NO: 7826859 - DNA, 22 bp, Homo sapiens
cagctgccccgctggctgacca

SEQ ID NO: 7826860 - DNA, 22 bp, Homo sapiens
cagctgccccataaatcacagt

SEQ ID NO: 7826861 - DNA, 22 bp, Homo sapiens
cagctgcccatcctgggaaatg

SEQ ID NO: 7826862 - DNA, 18 bp, Homo sapiens
cagctgccagctcatgga

SEQ ID NO: 7826863 - DNA, 18 bp, Homo sapiens
cagctgccagctcatgga

SEQ ID NO: 7826864 - DNA, 18 bp, Homo sapiens
cagctgccagctcatgga

SEQ ID NO: 7826865 - DNA, 22 bp, Homo sapiens
cagctgccacttgctctcggct

SEQ ID NO: 7826866 - DNA, 22 bp, Homo sapiens
cagctgagcatcactagtctgg

SEQ ID NO: 7826867 - DNA, 22 bp, Homo sapiens
cagctgagcatcactagtctgg

SEQ ID NO: 7826868 - DNA, 22 bp, Homo sapiens
cagctgagagtagaaatggagg

SEQ ID NO: 7826869 - DNA, 22 bp, Homo sapiens
cagctgagcatcactagtctgg

SEQ ID NO: 7826870 - DNA, 22 bp, Homo sapiens
cagctgccagcttctctccatc

SEQ ID NO: 7826871 - DNA, 22 bp, Homo sapiens
cagctgccagcttctctccatc

SEQ ID NO: 7826872 - DNA, 22 bp, Homo sapiens
cagctgccagcttctctccatc

SEQ ID NO: 7826873 - DNA, 18 bp, Homo sapiens
cagctgccagctcatgga

SEQ ID NO: 7826874 - DNA, 18 bp, Homo sapiens
cagctgccagctcatgga

SEQ ID NO: 7826875 - DNA, 18 bp, Homo sapiens
cagctgccagctcatgga

SEQ ID NO: 7826876 - DNA, 22 bp, Homo sapiens
cagctgcccaggccacctggag

SEQ ID NO: 7826877 - DNA, 22 bp, Homo sapiens
cagctgcccaggccacctggag

SEQ ID NO: 7826878 - DNA, 22 bp, Homo sapiens
cagctgcccaggccacctggag

SEQ ID NO: 7826879 - DNA, 22 bp, Homo sapiens
cagctgcccaagccccagatgt

SEQ ID NO: 7826880 - DNA, 22 bp, Homo sapiens
cagctgcccaagccccagatgt

SEQ ID NO: 7826881 - DNA, 22 bp, Homo sapiens
cagctgcccaagccccagatgt

SEQ ID NO: 7826882 - DNA, 22 bp, Homo sapiens
cagctgcccaagccccagatgt

SEQ ID NO: 7826883 - DNA, 22 bp, Homo sapiens
cagctgccatgacatgtcctgc

SEQ ID NO: 7826884 - DNA, 22 bp, Homo sapiens
cagctgccatgacatgtcctgc

SEQ ID NO: 7826885 - DNA, 22 bp, Homo sapiens
cagctgccatgacatgtcctgc

SEQ ID NO: 7826886 - DNA, 22 bp, Homo sapiens
cagctgccatgacatgtcctgc

SEQ ID NO: 7826887 - DNA, 22 bp, Homo sapiens
cagctgccatgacatgtcctgc

SEQ ID NO: 7826888 - DNA, 22 bp, Homo sapiens
cagctgccagcttctctccatc

SEQ ID NO: 7826889 - DNA, 22 bp, Homo sapiens
cagctgccagcttctctccatc

SEQ ID NO: 7826890 - DNA, 22 bp, Homo sapiens
cagctgccatgacatgtcctgc

SEQ ID NO: 7826891 - DNA, 22 bp, Homo sapiens
cagctgccagcttctctccatc

SEQ ID NO: 7826892 - DNA, 22 bp, Homo sapiens
cagctgccagcttctctccatc

SEQ ID NO: 7826893 - DNA, 22 bp, Homo sapiens
cagctgccagcttctctccatc

SEQ ID NO: 7826894 - DNA, 22 bp, Homo sapiens
cagcgtctcgttgtgggcctcg

SEQ ID NO: 7826895 - DNA, 22 bp, Homo sapiens
cagcggtggcaaggtgactgtg

SEQ ID NO: 7826896 - DNA, 22 bp, Homo sapiens
cagcgtctcgttgtgggcctcg

SEQ ID NO: 7826897 - DNA, 22 bp, Homo sapiens
cagctgagagtagaaatggagg

SEQ ID NO: 7826898 - DNA, 22 bp, Homo sapiens
cagcggggcctgtgctggggag

SEQ ID NO: 7826899 - DNA, 22 bp, Homo sapiens
cagcggccggtgaggaagggga

SEQ ID NO: 7826900 - DNA, 22 bp, Homo sapiens
cagcggccggtgaggaagggga

SEQ ID NO: 7826901 - DNA, 22 bp, Homo sapiens
cagcgctgtgggaacagggcta

SEQ ID NO: 7826902 - DNA, 22 bp, Homo sapiens
cagcggaggacagatgggagct

SEQ ID NO: 7826903 - DNA, 22 bp, Homo sapiens
cagcggaggacagatgggagct

SEQ ID NO: 7826904 - DNA, 22 bp, Homo sapiens
cagcggaggacagatgggagct

SEQ ID NO: 7826905 - DNA, 22 bp, Homo sapiens
cagcggaggacagatgggagct

SEQ ID NO: 7826906 - DNA, 22 bp, Homo sapiens
cagcgctgtgggaacagggcta

SEQ ID NO: 7826907 - DNA, 22 bp, Homo sapiens
cagcgctggggtaggagcacct

SEQ ID NO: 7826908 - DNA, 22 bp, Homo sapiens
cagcgctggggtaggagcacct

SEQ ID NO: 7826909 - DNA, 22 bp, Homo sapiens
cagcgctggggtaggagcacct

SEQ ID NO: 7826910 - DNA, 22 bp, Homo sapiens
cagcgcaggcgtgtgaaggcgc

SEQ ID NO: 7826911 - DNA, 22 bp, Homo sapiens
cagcgagagacaaagagctgtg

SEQ ID NO: 7826912 - DNA, 22 bp, Homo sapiens
cagcgcctcctggacctcctct

SEQ ID NO: 7826913 - DNA, 22 bp, Homo sapiens
cagcgctggggtaggagcacct

SEQ ID NO: 7826914 - DNA, 22 bp, Homo sapiens
cagcctttgggtcagaagattc

SEQ ID NO: 7826915 - DNA, 22 bp, Homo sapiens
cagcctttgggtcagaagattc

SEQ ID NO: 7826916 - DNA, 22 bp, Homo sapiens
cagcctttgtgaacatcaggtg

SEQ ID NO: 7826917 - DNA, 22 bp, Homo sapiens
cagccttttcttaaaatgcaag

SEQ ID NO: 7826918 - DNA, 22 bp, Homo sapiens
cagcctttatggaaaggcctgg

SEQ ID NO: 7826919 - DNA, 22 bp, Homo sapiens
cagcctttatggaaaggcctgg

SEQ ID NO: 7826920 - DNA, 22 bp, Homo sapiens
cagcctttctgtttcctaaggt

SEQ ID NO: 7826921 - DNA, 22 bp, Homo sapiens
cagcctttctgtttcctaaggt

SEQ ID NO: 7826922 - DNA, 22 bp, Homo sapiens
cagccttgatggatgaggaagt

SEQ ID NO: 7826923 - DNA, 22 bp, Homo sapiens
cagcctttagcattaattccaa

SEQ ID NO: 7826924 - DNA, 22 bp, Homo sapiens
cagcctcttgcactttgaaggc

SEQ ID NO: 7826925 - DNA, 22 bp, Homo sapiens
cagcctcttgcactttgaaggc

SEQ ID NO: 7826926 - DNA, 22 bp, Homo sapiens
cagcctctgtggctgccacacc

SEQ ID NO: 7826927 - DNA, 22 bp, Homo sapiens
cagccttcgacagttggagtag

SEQ ID NO: 7826928 - DNA, 22 bp, Homo sapiens
cagccttcgacagttggagtag

SEQ ID NO: 7826929 - DNA, 22 bp, Homo sapiens
cagcctctgacaccacagtcgt

SEQ ID NO: 7826930 - DNA, 22 bp, Homo sapiens
cagcctctgagccttggcagat

SEQ ID NO: 7826931 - DNA, 22 bp, Homo sapiens
cagcctctgagccttggcagat

SEQ ID NO: 7826932 - DNA, 22 bp, Homo sapiens
cagcctctgacaccacagtcgt

SEQ ID NO: 7826933 - DNA, 22 bp, Homo sapiens
cagcctctctgtatctcaggat

SEQ ID NO: 7826934 - DNA, 22 bp, Homo sapiens
cagcctctgacaccacagtcgt

SEQ ID NO: 7826935 - DNA, 22 bp, Homo sapiens
cagcctctctgtatctcaggat

SEQ ID NO: 7826936 - DNA, 18 bp, Homo sapiens
cagcctctgattggttgc

SEQ ID NO: 7826937 - DNA, 22 bp, Homo sapiens
cagcctctgtggctgccacacc

SEQ ID NO: 7826938 - DNA, 22 bp, Homo sapiens
cagcctctgtggctgccacacc

SEQ ID NO: 7826939 - DNA, 22 bp, Homo sapiens
cagcctctgtggctgccacacc

SEQ ID NO: 7826940 - DNA, 22 bp, Homo sapiens
cagcctctgagccttggcagat

SEQ ID NO: 7826941 - DNA, 22 bp, Homo sapiens
cagcctctgagccttggcagat

SEQ ID NO: 7826942 - DNA, 22 bp, Homo sapiens
cagcctctgagccttggcagat

SEQ ID NO: 7826943 - DNA, 22 bp, Homo sapiens
cagcacttgagctttcatgtaa

SEQ ID NO: 7826944 - DNA, 22 bp, Homo sapiens
cagcacttggtgccattgagtg

SEQ ID NO: 7826945 - DNA, 22 bp, Homo sapiens
cagcacttggtgccattgagtg

SEQ ID NO: 7826946 - DNA, 22 bp, Homo sapiens
cagcagaaaatacctgtaactc

SEQ ID NO: 7826947 - DNA, 22 bp, Homo sapiens
cagcactttgagggctcttaat

SEQ ID NO: 7826948 - DNA, 22 bp, Homo sapiens
cagcactttgagggctcttaat

SEQ ID NO: 7826949 - DNA, 22 bp, Homo sapiens
cagcacttcaatgagcatttca

SEQ ID NO: 7826950 - DNA, 22 bp, Homo sapiens
cagcactgttcccagaccactg

SEQ ID NO: 7826951 - DNA, 22 bp, Homo sapiens
cagcactgttcccagaccactg

SEQ ID NO: 7826952 - DNA, 22 bp, Homo sapiens
cagcactgtgataactgagcca

SEQ ID NO: 7826953 - DNA, 22 bp, Homo sapiens
cagcactgttcccagaccactg

SEQ ID NO: 7826954 - DNA, 22 bp, Homo sapiens
cagcactggggccactggagtt

SEQ ID NO: 7826955 - DNA, 22 bp, Homo sapiens
cagcactggggccactggagtt

SEQ ID NO: 7826956 - DNA, 22 bp, Homo sapiens
cagcactggggccactggagtt

SEQ ID NO: 7826957 - DNA, 22 bp, Homo sapiens
cagcactggggccactggagtt

SEQ ID NO: 7826958 - DNA, 22 bp, Homo sapiens
cagcactggggccactggagtt

SEQ ID NO: 7826959 - DNA, 22 bp, Homo sapiens
cagcactggggccactggagtt

SEQ ID NO: 7826960 - DNA, 22 bp, Homo sapiens
cagcactgtgataactgagcca

SEQ ID NO: 7826961 - DNA, 22 bp, Homo sapiens
cagcactgtgataactgagcca

SEQ ID NO: 7826962 - DNA, 22 bp, Homo sapiens
cagcactgtgataactgagcca

SEQ ID NO: 7826963 - DNA, 22 bp, Homo sapiens
cagcactgtgataactgagcca

SEQ ID NO: 7826964 - DNA, 22 bp, Homo sapiens
cagcactgtgataactgagcca

SEQ ID NO: 7826965 - DNA, 22 bp, Homo sapiens
cagcactgtgataactgagcca

SEQ ID NO: 7826966 - DNA, 22 bp, Homo sapiens
cagcactggggggattcggagc

SEQ ID NO: 7826967 - DNA, 22 bp, Homo sapiens
cagcactggggggattcggagc

SEQ ID NO: 7826968 - DNA, 22 bp, Homo sapiens
cagcactgggaccactagaaca

SEQ ID NO: 7826969 - DNA, 22 bp, Homo sapiens
cagcactgggaccactagaaca

SEQ ID NO: 7826970 - DNA, 22 bp, Homo sapiens
cagcactggggccactggagtt

SEQ ID NO: 7826971 - DNA, 22 bp, Homo sapiens
cagcactggggccactggagtt

SEQ ID NO: 7826972 - DNA, 22 bp, Homo sapiens
cagcactgcttcgcagccaggg

SEQ ID NO: 7826973 - DNA, 22 bp, Homo sapiens
cagcactgcttcgcagccaggg

SEQ ID NO: 7826974 - DNA, 22 bp, Homo sapiens
cagcactgcttcgcagccaggg

SEQ ID NO: 7826975 - DNA, 22 bp, Homo sapiens
cagcatggacaggggtggcgtt

SEQ ID NO: 7826976 - DNA, 22 bp, Homo sapiens
cagcatggacaggggtggcgtt

SEQ ID NO: 7826977 - DNA, 22 bp, Homo sapiens
cagcatggacaggggtggcgtt

SEQ ID NO: 7826978 - DNA, 22 bp, Homo sapiens
cagcatcagcctggctcaggcc

SEQ ID NO: 7826979 - DNA, 22 bp, Homo sapiens
cagcatcaccaacttgagcaat

SEQ ID NO: 7826980 - DNA, 22 bp, Homo sapiens
cagcatcaccgccatttctgat

SEQ ID NO: 7826981 - DNA, 22 bp, Homo sapiens
cagcagaaaatacctgtaactc

SEQ ID NO: 7826982 - DNA, 22 bp, Homo sapiens
cagcagaaaatacctgtaactc

SEQ ID NO: 7826983 - DNA, 22 bp, Homo sapiens
cagcagaaaatgtgggtgattt

SEQ ID NO: 7826984 - DNA, 22 bp, Homo sapiens
cagcagaaaatacctgtaactc

SEQ ID NO: 7826985 - DNA, 22 bp, Homo sapiens
cagcagaaaatgtgggtgattt

SEQ ID NO: 7826986 - DNA, 22 bp, Homo sapiens
cagcagaaacccagcaaagcca

SEQ ID NO: 7826987 - DNA, 22 bp, Homo sapiens
cagcagaaaatgtgggtgattt

SEQ ID NO: 7826988 - DNA, 22 bp, Homo sapiens
cagcatggggatcactgtaggc

SEQ ID NO: 7826989 - DNA, 22 bp, Homo sapiens
cagcatggggatcactgtaggc

SEQ ID NO: 7826990 - DNA, 22 bp, Homo sapiens
cagcatggccatttctcgctgc

SEQ ID NO: 7826991 - DNA, 22 bp, Homo sapiens
cagcatggacccatcgctgagt

SEQ ID NO: 7826992 - DNA, 22 bp, Homo sapiens
cagcatggacaggggtggcgtt

SEQ ID NO: 7826993 - DNA, 22 bp, Homo sapiens
cagcatggacccatcgctgagt

SEQ ID NO: 7826994 - DNA, 22 bp, Homo sapiens
cagcatggacccatcgctgagt

SEQ ID NO: 7826995 - DNA, 22 bp, Homo sapiens
cagcatggacccatcgctgagt

SEQ ID NO: 7826996 - DNA, 22 bp, Homo sapiens
cagcatggagacaaagtgggca

SEQ ID NO: 7826997 - DNA, 22 bp, Homo sapiens
cagcatggagacaaagtgggca

SEQ ID NO: 7826998 - DNA, 22 bp, Homo sapiens
cagcatggacccatcgctgagt

SEQ ID NO: 7826999 - DNA, 22 bp, Homo sapiens
cagcatggagacaaagtgggca

SEQ ID NO: 7827000 - DNA, 22 bp, Homo sapiens
agcgccactgcactccagcctg

SEQ ID NO: 7827001 - DNA, 22 bp, Homo sapiens
agcgccactgcactccagcctg

SEQ ID NO: 7827002 - DNA, 22 bp, Homo sapiens
agcgccactgcactccagcctg

SEQ ID NO: 7827003 - DNA, 22 bp, Homo sapiens
agcgccactgcactccagcctg

SEQ ID NO: 7827004 - DNA, 22 bp, Homo sapiens
agcgccctgtgaggttggcagg

SEQ ID NO: 7827005 - DNA, 21 bp, Homo sapiens
agcgcctgcaacaaggcagat

SEQ ID NO: 7827006 - DNA, 22 bp, Homo sapiens
agcgcctgcaccactctgcggc

SEQ ID NO: 7827007 - DNA, 22 bp, Homo sapiens
agcgcctgcaccactctgcggc

SEQ ID NO: 7827008 - DNA, 22 bp, Homo sapiens
agcgcctgcggtgtgagcctgc

SEQ ID NO: 7827009 - DNA, 22 bp, Homo sapiens
agcgctggctggcgctccttcc

SEQ ID NO: 7827010 - DNA, 22 bp, Homo sapiens
agcgcggctcagcctggaaacc

SEQ ID NO: 7827011 - DNA, 22 bp, Homo sapiens
agcgctggctggcgctccttcc

SEQ ID NO: 7827012 - DNA, 22 bp, Homo sapiens
agcgctggctggcgctccttcc

SEQ ID NO: 7827013 - DNA, 22 bp, Homo sapiens
agcgctgtgggcgtgcgaggag

SEQ ID NO: 7827014 - DNA, 22 bp, Homo sapiens
agcgccactgcactccagcctg

SEQ ID NO: 7827015 - DNA, 22 bp, Homo sapiens
agcgccactgcactccagcctg

SEQ ID NO: 7827016 - DNA, 22 bp, Homo sapiens
agcgccactgcactccagcctg

SEQ ID NO: 7827017 - DNA, 22 bp, Homo sapiens
agcgccactgcactccagcctg

SEQ ID NO: 7827018 - DNA, 22 bp, Homo sapiens
agcgccactgcactccagcctg

SEQ ID NO: 7827019 - DNA, 22 bp, Homo sapiens
agcgccactgcactccagcctg

SEQ ID NO: 7827020 - DNA, 22 bp, Homo sapiens
agcgccactgcactccagcctg

SEQ ID NO: 7827021 - DNA, 22 bp, Homo sapiens
agcgcaggaacacgtctgcctt

SEQ ID NO: 7827022 - DNA, 22 bp, Homo sapiens
agcgccactgcactccagcctg

SEQ ID NO: 7827023 - DNA, 22 bp, Homo sapiens
agcgccactgcactccagcctg

SEQ ID NO: 7827024 - DNA, 22 bp, Homo sapiens
agcgagtgggtcagcgttgcag

SEQ ID NO: 7827025 - DNA, 22 bp, Homo sapiens
agcgaggttttgcagatacagc

SEQ ID NO: 7827026 - DNA, 22 bp, Homo sapiens
agcgagagattcaacagcaagt

SEQ ID NO: 7827027 - DNA, 22 bp, Homo sapiens
agcgagggaggtctgaggacag

SEQ ID NO: 7827028 - DNA, 22 bp, Homo sapiens
cagcatggttgggttctgggga

SEQ ID NO: 7827029 - DNA, 22 bp, Homo sapiens
cagcatgtaagccactgccctg

SEQ ID NO: 7827030 - DNA, 22 bp, Homo sapiens
cagcatggtgccagtgagtcca

SEQ ID NO: 7827031 - DNA, 22 bp, Homo sapiens
cagcatggtgccagtgagtcca

SEQ ID NO: 7827032 - DNA, 22 bp, Homo sapiens
agcgagagattcaacagcaagt

SEQ ID NO: 7827033 - DNA, 22 bp, Homo sapiens
agcgagcacattgagtgaagaa

SEQ ID NO: 7827034 - DNA, 22 bp, Homo sapiens
agcgagcacattgagtgaagaa

SEQ ID NO: 7827035 - DNA, 22 bp, Homo sapiens
cagcatgtggattcctcccact

SEQ ID NO: 7827036 - DNA, 22 bp, Homo sapiens
cagcatgtatctttcaggtgtg

SEQ ID NO: 7827037 - DNA, 22 bp, Homo sapiens
agcgaaattatttcaggtttgg

SEQ ID NO: 7827038 - DNA, 22 bp, Homo sapiens
agccttttggagttattctggg

SEQ ID NO: 7827039 - DNA, 22 bp, Homo sapiens
agcgaacacatcctctcctctt

SEQ ID NO: 7827040 - DNA, 22 bp, Homo sapiens
agcgacagaaaccaaggacaag

SEQ ID NO: 7827041 - DNA, 22 bp, Homo sapiens
cagcatgggttccgggggcctg

SEQ ID NO: 7827042 - DNA, 22 bp, Homo sapiens
cagcatgggttccgggggcctg

SEQ ID NO: 7827043 - DNA, 22 bp, Homo sapiens
cagcatgggggcaattcaggtg

SEQ ID NO: 7827044 - DNA, 22 bp, Homo sapiens
cagcatgggttccgggggcctg

SEQ ID NO: 7827045 - DNA, 22 bp, Homo sapiens
cagcatggtgccagtgagtcca

SEQ ID NO: 7827046 - DNA, 22 bp, Homo sapiens
cagcatgggttccgggggcctg

SEQ ID NO: 7827047 - DNA, 22 bp, Homo sapiens
cagcatggtgccagtgagtcca

SEQ ID NO: 7827048 - DNA, 22 bp, Homo sapiens
cagcatggtgccagtgagtcca

SEQ ID NO: 7827049 - DNA, 22 bp, Homo sapiens
cagcatggggcttggagtcagc

SEQ ID NO: 7827050 - DNA, 22 bp, Homo sapiens
cagcatggggcttggagtcagc

SEQ ID NO: 7827051 - DNA, 22 bp, Homo sapiens
cagcatggggcttggagtcagc

SEQ ID NO: 7827052 - DNA, 22 bp, Homo sapiens
cagcatggggcttggagtcagc

SEQ ID NO: 7827053 - DNA, 22 bp, Homo sapiens
cagcatggggcttggagtcagc

SEQ ID NO: 7827054 - DNA, 22 bp, Homo sapiens
cagcatggggcttggagtcagc

SEQ ID NO: 7827055 - DNA, 22 bp, Homo sapiens
cagcatggggcttggagtcagc

SEQ ID NO: 7827056 - DNA, 22 bp, Homo sapiens
cagcccacttcccagcacctac

SEQ ID NO: 7827057 - DNA, 22 bp, Homo sapiens
cagcccacttcccagcacctac

SEQ ID NO: 7827058 - DNA, 22 bp, Homo sapiens
cagcccacttcccagcacctac

SEQ ID NO: 7827059 - DNA, 22 bp, Homo sapiens
cagcccactgcctctgtggtag

SEQ ID NO: 7827060 - DNA, 22 bp, Homo sapiens
cagcccagaactcacgtctcca

SEQ ID NO: 7827061 - DNA, 22 bp, Homo sapiens
cagcccacttcccagcacctac

SEQ ID NO: 7827062 - DNA, 22 bp, Homo sapiens
cagcccagacaccatcattcta

SEQ ID NO: 7827063 - DNA, 22 bp, Homo sapiens
cagcccagacaccatcattcta

SEQ ID NO: 7827064 - DNA, 22 bp, Homo sapiens
cagcccagagaaggggcccgtg

SEQ ID NO: 7827065 - DNA, 22 bp, Homo sapiens
cagcccagaactcacgtctcca

SEQ ID NO: 7827066 - DNA, 22 bp, Homo sapiens
cagcccagaactcacgtctcca

SEQ ID NO: 7827067 - DNA, 21 bp, Homo sapiens
cagcccagagcagtggggcca

SEQ ID NO: 7827068 - DNA, 21 bp, Homo sapiens
cagcccagagcagtggggcca

SEQ ID NO: 7827069 - DNA, 21 bp, Homo sapiens
cagcccagagcagtggggcca

SEQ ID NO: 7827070 - DNA, 16 bp, Homo sapiens
cagcccaggggcgggc

SEQ ID NO: 7827071 - DNA, 19 bp, Homo sapiens
cagcccagggtgctaccaa

SEQ ID NO: 7827072 - DNA, 22 bp, Homo sapiens
cagcccagagaaggggcccgtg

SEQ ID NO: 7827073 - DNA, 22 bp, Homo sapiens
cagcccagagaaggggcccgtg

SEQ ID NO: 7827074 - DNA, 22 bp, Homo sapiens
cagcccagagatgttatctagt

SEQ ID NO: 7827075 - DNA, 22 bp, Homo sapiens
cagcccagagaaggggcccgtg

SEQ ID NO: 7827076 - DNA, 22 bp, Homo sapiens
cagcccagagaaggggcccgtg

SEQ ID NO: 7827077 - DNA, 22 bp, Homo sapiens
cagcccacgtcagggccactca

SEQ ID NO: 7827078 - DNA, 22 bp, Homo sapiens
cagcccacgtcagggccactca

SEQ ID NO: 7827079 - DNA, 22 bp, Homo sapiens
cagcccaaagccccaggctaga

SEQ ID NO: 7827080 - DNA, 22 bp, Homo sapiens
cagcccaaagccccaggctaga

SEQ ID NO: 7827081 - DNA, 22 bp, Homo sapiens
cagcccacgtcagggccactca

SEQ ID NO: 7827082 - DNA, 22 bp, Homo sapiens
cagccatcagtaaagacagctt

SEQ ID NO: 7827083 - DNA, 22 bp, Homo sapiens
cagccatcccagcctgtggttc

SEQ ID NO: 7827084 - DNA, 22 bp, Homo sapiens
cagccatcagtaaagacagctt

SEQ ID NO: 7827085 - DNA, 22 bp, Homo sapiens
cagccatcagtaaagacagctt

SEQ ID NO: 7827086 - DNA, 22 bp, Homo sapiens
cagccatactgacatcaacaaa

SEQ ID NO: 7827087 - DNA, 22 bp, Homo sapiens
cagccatcagtaaagacagctt

SEQ ID NO: 7827088 - DNA, 22 bp, Homo sapiens
cagcccaaagccccaggctaga

SEQ ID NO: 7827089 - DNA, 22 bp, Homo sapiens
cagccatgagtctaagcagttt

SEQ ID NO: 7827090 - DNA, 22 bp, Homo sapiens
cagccatcccagcctgtggttc

SEQ ID NO: 7827091 - DNA, 22 bp, Homo sapiens
cagccagctggcactgtgagta

SEQ ID NO: 7827092 - DNA, 22 bp, Homo sapiens
cagccagctggcactgtgagta

SEQ ID NO: 7827093 - DNA, 22 bp, Homo sapiens
cagccagtggttgaagatgcag

SEQ ID NO: 7827094 - DNA, 22 bp, Homo sapiens
cagccagctggcactgtgagta

SEQ ID NO: 7827095 - DNA, 22 bp, Homo sapiens
cagccagctggcactgtgagta

SEQ ID NO: 7827096 - DNA, 22 bp, Homo sapiens
cagccagctggcactgtgagta

SEQ ID NO: 7827097 - DNA, 22 bp, Homo sapiens
cagccagtgtgaccgaggagga

SEQ ID NO: 7827098 - DNA, 22 bp, Homo sapiens
cagccagtgtgaccgaggagga

SEQ ID NO: 7827099 - DNA, 22 bp, Homo sapiens
agcgctgtgggcgtgcgaggag

SEQ ID NO: 7827100 - DNA, 22 bp, Homo sapiens
agcgcttgccgcactccaagca

SEQ ID NO: 7827101 - DNA, 22 bp, Homo sapiens
agcgctgtgggcgtgcgaggag

SEQ ID NO: 7827102 - DNA, 22 bp, Homo sapiens
cagcctctctgtatctcaggat

SEQ ID NO: 7827103 - DNA, 22 bp, Homo sapiens
cagcctctaagcacagcctctc

SEQ ID NO: 7827104 - DNA, 22 bp, Homo sapiens
cagcctctaagcacagcctctc

SEQ ID NO: 7827105 - DNA, 22 bp, Homo sapiens
cagcctctaagcacagcctctc

SEQ ID NO: 7827106 - DNA, 22 bp, Homo sapiens
cagcctcctgggacactcaccg

SEQ ID NO: 7827107 - DNA, 22 bp, Homo sapiens
cagcctcctgggacactcaccg

SEQ ID NO: 7827108 - DNA, 22 bp, Homo sapiens
cagcctcctgggacactcaccg

SEQ ID NO: 7827109 - DNA, 22 bp, Homo sapiens
cagcctctaagcacagcctctc

SEQ ID NO: 7827110 - DNA, 22 bp, Homo sapiens
cagccctggtgaggttggctat

SEQ ID NO: 7827111 - DNA, 22 bp, Homo sapiens
cagcctcctgggacactcaccg

SEQ ID NO: 7827112 - DNA, 22 bp, Homo sapiens
cagccccacacggtctagctct

SEQ ID NO: 7827113 - DNA, 22 bp, Homo sapiens
cagccctggtgaggttggctat

SEQ ID NO: 7827114 - DNA, 22 bp, Homo sapiens
cagccctggtgaggttggctat

SEQ ID NO: 7827115 - DNA, 22 bp, Homo sapiens
cagccctggtgaggttggctat

SEQ ID NO: 7827116 - DNA, 22 bp, Homo sapiens
cagccctggtgaggttggctat

SEQ ID NO: 7827117 - DNA, 22 bp, Homo sapiens
cagcccatttctgggacctgag

SEQ ID NO: 7827118 - DNA, 22 bp, Homo sapiens
cagcccatttctgggacctgag

SEQ ID NO: 7827119 - DNA, 22 bp, Homo sapiens
cagcccattccttcctgggggt

SEQ ID NO: 7827120 - DNA, 22 bp, Homo sapiens
cagcccattcctgccatgccgc

SEQ ID NO: 7827121 - DNA, 22 bp, Homo sapiens
cagcccattcctgccatgccgc

SEQ ID NO: 7827122 - DNA, 22 bp, Homo sapiens
cagccccacacggtctagctct

SEQ ID NO: 7827123 - DNA, 22 bp, Homo sapiens
cagccccacacggtctagctct

SEQ ID NO: 7827124 - DNA, 22 bp, Homo sapiens
cagcccagtaccaagcagttgg

SEQ ID NO: 7827125 - DNA, 22 bp, Homo sapiens
cagcccagtaccaagcagttgg

SEQ ID NO: 7827126 - DNA, 22 bp, Homo sapiens
cagcccagtaccaagcagttgg

SEQ ID NO: 7827127 - DNA, 22 bp, Homo sapiens
cagcccagtgcacgcccgtttc

SEQ ID NO: 7827128 - DNA, 22 bp, Homo sapiens
cagcccagtgcacgcccgtttc

SEQ ID NO: 7827129 - DNA, 22 bp, Homo sapiens
cagcccagtgcacgcccgtttc

SEQ ID NO: 7827130 - DNA, 22 bp, Homo sapiens
cagcccagtgcatttgtgtact

SEQ ID NO: 7827131 - DNA, 22 bp, Homo sapiens
cagcccagtgcatttgtgtact

SEQ ID NO: 7827132 - DNA, 22 bp, Homo sapiens
cagcccataccagaagtggagt

SEQ ID NO: 7827133 - DNA, 22 bp, Homo sapiens
cagcccataccagaagtggagt

SEQ ID NO: 7827134 - DNA, 22 bp, Homo sapiens
cagcccatccaaggcttggcat

SEQ ID NO: 7827135 - DNA, 22 bp, Homo sapiens
cagcccatccaaggcttggcat

SEQ ID NO: 7827136 - DNA, 23 bp, Homo sapiens
cagcccatggcattttttacagt

SEQ ID NO: 7827137 - DNA, 22 bp, Homo sapiens
cagcccatctagctttagagat

SEQ ID NO: 7827138 - DNA, 22 bp, Homo sapiens
cagcccatggtttgtggccagt

SEQ ID NO: 7827139 - DNA, 22 bp, Homo sapiens
cagcccatggtttgtggccagt

SEQ ID NO: 7827140 - DNA, 22 bp, Homo sapiens
cagcccaggtctctcttccagt

SEQ ID NO: 7827141 - DNA, 22 bp, Homo sapiens
cagcccaggtggcggaggttgc

SEQ ID NO: 7827142 - DNA, 22 bp, Homo sapiens
cagcccaggtctctcttccagt

SEQ ID NO: 7827143 - DNA, 22 bp, Homo sapiens
cagcccaggtctctcttccagt

SEQ ID NO: 7827144 - DNA, 22 bp, Homo sapiens
cagcccaggtctctcttccagt

SEQ ID NO: 7827145 - DNA, 22 bp, Homo sapiens
cagcccaggtctctcttccagt

SEQ ID NO: 7827146 - DNA, 22 bp, Homo sapiens
cagcccaggtctctcttccagt

SEQ ID NO: 7827147 - DNA, 22 bp, Homo sapiens
cagcccaggtctctcttccagt

SEQ ID NO: 7827148 - DNA, 22 bp, Homo sapiens
cagcccaggtctctcttccagt

SEQ ID NO: 7827149 - DNA, 22 bp, Homo sapiens
cagcccaggtctctcttccagt

SEQ ID NO: 7827150 - DNA, 19 bp, Homo sapiens
cagcccagggtgctaccaa

SEQ ID NO: 7827151 - DNA, 19 bp, Homo sapiens
cagcccagggtgctaccaa

SEQ ID NO: 7827152 - DNA, 19 bp, Homo sapiens
cagcccagggtgctaccaa

SEQ ID NO: 7827153 - DNA, 19 bp, Homo sapiens
cagcccagggtgctaccaa

SEQ ID NO: 7827154 - DNA, 22 bp, Homo sapiens
agccagggaggtggaggttgca

SEQ ID NO: 7827155 - DNA, 22 bp, Homo sapiens
agccagggaggtggaggttgca

SEQ ID NO: 7827156 - DNA, 22 bp, Homo sapiens
agccagggaggattacacccca

SEQ ID NO: 7827157 - DNA, 22 bp, Homo sapiens
agccagggaggtggaggttgca

SEQ ID NO: 7827158 - DNA, 22 bp, Homo sapiens
agccagggaggtggaggttgca

SEQ ID NO: 7827159 - DNA, 22 bp, Homo sapiens
agccagggaggtggaggttgca

SEQ ID NO: 7827160 - DNA, 22 bp, Homo sapiens
agccagggatgcagcacagtga

SEQ ID NO: 7827161 - DNA, 22 bp, Homo sapiens
agccagggatgcagcacagtga

SEQ ID NO: 7827162 - DNA, 22 bp, Homo sapiens
agccagggatgcagcacagtga

SEQ ID NO: 7827163 - DNA, 22 bp, Homo sapiens
agccagggatgcagcacagtga

SEQ ID NO: 7827164 - DNA, 22 bp, Homo sapiens
agccagggatgcagcacagtga

SEQ ID NO: 7827165 - DNA, 22 bp, Homo sapiens
agccagggatgcagcacagtga

SEQ ID NO: 7827166 - DNA, 22 bp, Homo sapiens
agccagggacgctgcaggctac

SEQ ID NO: 7827167 - DNA, 22 bp, Homo sapiens
agccagggacgctgcaggctac

SEQ ID NO: 7827168 - DNA, 22 bp, Homo sapiens
agccagggaggtggaggttgca

SEQ ID NO: 7827169 - DNA, 22 bp, Homo sapiens
agccagggaggattacacccca

SEQ ID NO: 7827170 - DNA, 22 bp, Homo sapiens
agccagggacgctgcaggctac

SEQ ID NO: 7827171 - DNA, 22 bp, Homo sapiens
agccagggacgctgcaggctac

SEQ ID NO: 7827172 - DNA, 22 bp, Homo sapiens
agccagggacgctgcaggctac

SEQ ID NO: 7827173 - DNA, 22 bp, Homo sapiens
agccagggacgctgcaggctac

SEQ ID NO: 7827174 - DNA, 22 bp, Homo sapiens
agccagggatggcagtgcccag

SEQ ID NO: 7827175 - DNA, 22 bp, Homo sapiens
agccagggatgcagcacagtga

SEQ ID NO: 7827176 - DNA, 22 bp, Homo sapiens
agccagggatgcagcacagtga

SEQ ID NO: 7827177 - DNA, 22 bp, Homo sapiens
agccagggatgcagcacagtga

SEQ ID NO: 7827178 - DNA, 22 bp, Homo sapiens
agccagggatggcagtgcccag

SEQ ID NO: 7827179 - DNA, 22 bp, Homo sapiens
agccagggatggcagtgcccag

SEQ ID NO: 7827180 - DNA, 22 bp, Homo sapiens
agccagggatggcagtgcccag

SEQ ID NO: 7827181 - DNA, 22 bp, Homo sapiens
agccagggatggcagtgcccag

SEQ ID NO: 7827182 - DNA, 22 bp, Homo sapiens
agccagggatggcagtgcccag

SEQ ID NO: 7827183 - DNA, 22 bp, Homo sapiens
agccagggatggcagtgcccag

SEQ ID NO: 7827184 - DNA, 22 bp, Homo sapiens
agccagggctctccttcgcgtg

SEQ ID NO: 7827185 - DNA, 23 bp, Homo sapiens
agccagggcactggtggagattg

SEQ ID NO: 7827186 - DNA, 23 bp, Homo sapiens
agccagggcactggtggagattg

SEQ ID NO: 7827187 - DNA, 23 bp, Homo sapiens
agccagggcactggtggagattg

SEQ ID NO: 7827188 - DNA, 23 bp, Homo sapiens
agccagggcactggtggagattg

SEQ ID NO: 7827189 - DNA, 23 bp, Homo sapiens
agccagggcactggtggagattg

SEQ ID NO: 7827190 - DNA, 22 bp, Homo sapiens
agccaggggagtcagctgctgg

SEQ ID NO: 7827191 - DNA, 22 bp, Homo sapiens
agccaggggagtcagctgctgg

SEQ ID NO: 7827192 - DNA, 22 bp, Homo sapiens
agccaggggagtcagctgctgg

SEQ ID NO: 7827193 - DNA, 22 bp, Homo sapiens
agccaggggagtcagctgctgg

SEQ ID NO: 7827194 - DNA, 22 bp, Homo sapiens
agccaggggagtcagctgctgg

SEQ ID NO: 7827195 - DNA, 22 bp, Homo sapiens
agccaggggagtcagctgctgg

SEQ ID NO: 7827196 - DNA, 22 bp, Homo sapiens
agccaggggagtcagctgctgg

SEQ ID NO: 7827197 - DNA, 22 bp, Homo sapiens
agccaggggagtcagctgctgg

SEQ ID NO: 7827198 - DNA, 22 bp, Homo sapiens
agccagggctgcgagcagacag

SEQ ID NO: 7827199 - DNA, 22 bp, Homo sapiens
agccagggctgcgagcagacag

SEQ ID NO: 7827200 - DNA, 22 bp, Homo sapiens
agccagggctgcgagcagacag

SEQ ID NO: 7827201 - DNA, 22 bp, Homo sapiens
agccagggctgcaggttccttg

SEQ ID NO: 7827202 - DNA, 22 bp, Homo sapiens
agccagggctctccttcgcgtg

SEQ ID NO: 7827203 - DNA, 22 bp, Homo sapiens
agccagggctgcaggttccttg

SEQ ID NO: 7827204 - DNA, 22 bp, Homo sapiens
agccagggctgcgagcagacag

SEQ ID NO: 7827205 - DNA, 22 bp, Homo sapiens
agccagggctgcgagcagacag

SEQ ID NO: 7827206 - DNA, 22 bp, Homo sapiens
agccagggctgcgagcagacag

SEQ ID NO: 7827207 - DNA, 22 bp, Homo sapiens
agccagggctgcaggttccttg

SEQ ID NO: 7827208 - DNA, 22 bp, Homo sapiens
agccagggctgcaggttccttg

SEQ ID NO: 7827209 - DNA, 22 bp, Homo sapiens
agccagggctgcgagcagacag

SEQ ID NO: 7827210 - DNA, 22 bp, Homo sapiens
cagagcagggtgcaccttgggc

SEQ ID NO: 7827211 - DNA, 22 bp, Homo sapiens
cagagcagggtgcaccttgggc

SEQ ID NO: 7827212 - DNA, 22 bp, Homo sapiens
cagagcaggggtttcccaggtt

SEQ ID NO: 7827213 - DNA, 22 bp, Homo sapiens
cagagcaggggtttcccaggtt

SEQ ID NO: 7827214 - DNA, 22 bp, Homo sapiens
cagagcaggggtttcccaggtt

SEQ ID NO: 7827215 - DNA, 22 bp, Homo sapiens
cagagcaggtatctttggtgaa

SEQ ID NO: 7827216 - DNA, 22 bp, Homo sapiens
cagagcaggtatctttggtgaa

SEQ ID NO: 7827217 - DNA, 22 bp, Homo sapiens
cagagcagggtgcaccttgggc

SEQ ID NO: 7827218 - DNA, 22 bp, Homo sapiens
cagagcagggtgcaccttgggc

SEQ ID NO: 7827219 - DNA, 22 bp, Homo sapiens
cagagcaggggtttcccaggtt

SEQ ID NO: 7827220 - DNA, 22 bp, Homo sapiens
cagagcacccaaggagcatttg

SEQ ID NO: 7827221 - DNA, 22 bp, Homo sapiens
cagagcacccaaggagcatttg

SEQ ID NO: 7827222 - DNA, 22 bp, Homo sapiens
cagagcaccagtgggagacaag

SEQ ID NO: 7827223 - DNA, 22 bp, Homo sapiens
cagagcaccagtgggagacaag

SEQ ID NO: 7827224 - DNA, 22 bp, Homo sapiens
agccaggggagtcagctgctgg

SEQ ID NO: 7827225 - DNA, 22 bp, Homo sapiens
agccaggggagtcagctgctgg

SEQ ID NO: 7827226 - DNA, 22 bp, Homo sapiens
agccaggctgcagttggctggc

SEQ ID NO: 7827227 - DNA, 22 bp, Homo sapiens
agccaggctgcagttggctggc

SEQ ID NO: 7827228 - DNA, 22 bp, Homo sapiens
agccaggctgcagttggctggc

SEQ ID NO: 7827229 - DNA, 22 bp, Homo sapiens
agccaggctgcagttggctggc

SEQ ID NO: 7827230 - DNA, 22 bp, Homo sapiens
agccaggctgcagttggctggc

SEQ ID NO: 7827231 - DNA, 22 bp, Homo sapiens
agccaggctgcagttggctggc

SEQ ID NO: 7827232 - DNA, 16 bp, Homo sapiens
agccaggctgcctcgg

SEQ ID NO: 7827233 - DNA, 16 bp, Homo sapiens
agccaggctgcctcgg

SEQ ID NO: 7827234 - DNA, 16 bp, Homo sapiens
agccaggctgcctcgg

SEQ ID NO: 7827235 - DNA, 16 bp, Homo sapiens
agccaggctgcctcgg

SEQ ID NO: 7827236 - DNA, 16 bp, Homo sapiens
agccaggctgcctcgg

SEQ ID NO: 7827237 - DNA, 22 bp, Homo sapiens
agccagggaagaggcctacctc

SEQ ID NO: 7827238 - DNA, 22 bp, Homo sapiens
agccagggaagaggcctacctc

SEQ ID NO: 7827239 - DNA, 22 bp, Homo sapiens
agccagggaagaggcctacctc

SEQ ID NO: 7827240 - DNA, 22 bp, Homo sapiens
agccagggacgctgcaggctac

SEQ ID NO: 7827241 - DNA, 22 bp, Homo sapiens
agccagggacgctgcaggctac

SEQ ID NO: 7827242 - DNA, 22 bp, Homo sapiens
agccagggacgctgcaggctac

SEQ ID NO: 7827243 - DNA, 22 bp, Homo sapiens
agccagggacgctgcaggctac

SEQ ID NO: 7827244 - DNA, 22 bp, Homo sapiens
agccagggacgctgcaggctac

SEQ ID NO: 7827245 - DNA, 22 bp, Homo sapiens
agccagggacgctgcaggctac

SEQ ID NO: 7827246 - DNA, 22 bp, Homo sapiens
agccagggacgctgcaggctac

SEQ ID NO: 7827247 - DNA, 22 bp, Homo sapiens
agccagggaaggataacaagaa

SEQ ID NO: 7827248 - DNA, 22 bp, Homo sapiens
agccagggacgctgcaggctac

SEQ ID NO: 7827249 - DNA, 22 bp, Homo sapiens
agccagggaaggataacaagaa

SEQ ID NO: 7827250 - DNA, 22 bp, Homo sapiens
agccagggaagaggcctacctc

SEQ ID NO: 7827251 - DNA, 22 bp, Homo sapiens
agccagggaagaggcctacctc

SEQ ID NO: 7827252 - DNA, 22 bp, Homo sapiens
agccaagacatttagaaaagct

SEQ ID NO: 7827253 - DNA, 22 bp, Homo sapiens
agccaagagacagatgcccacc

SEQ ID NO: 7827254 - DNA, 22 bp, Homo sapiens
agccaagagacagatgcccacc

SEQ ID NO: 7827255 - DNA, 22 bp, Homo sapiens
agccaagagatgaggctgcagg

SEQ ID NO: 7827256 - DNA, 22 bp, Homo sapiens
agccaagagatgaggctgcagg

SEQ ID NO: 7827257 - DNA, 22 bp, Homo sapiens
agccaagagatgaggctgcagg

SEQ ID NO: 7827258 - DNA, 22 bp, Homo sapiens
agccaagaatcatgagctaata

SEQ ID NO: 7827259 - DNA, 20 bp, Homo sapiens
agccaagaacaggcagaacc

SEQ ID NO: 7827260 - DNA, 22 bp, Homo sapiens
agccaacttggaaagtcagatt

SEQ ID NO: 7827261 - DNA, 22 bp, Homo sapiens
agccaacacatgtaaatgcacc

SEQ ID NO: 7827262 - DNA, 22 bp, Homo sapiens
agccaagaggagcctaaagcga

SEQ ID NO: 7827263 - DNA, 22 bp, Homo sapiens
agccaagagctcacctcgtgtg

SEQ ID NO: 7827264 - DNA, 22 bp, Homo sapiens
agccaagcaccactggcactcg

SEQ ID NO: 7827265 - DNA, 22 bp, Homo sapiens
agccaagcactcaactcctgga

SEQ ID NO: 7827266 - DNA, 22 bp, Homo sapiens
agccaagcactcaactcctgga

SEQ ID NO: 7827267 - DNA, 22 bp, Homo sapiens
agccaggccttttctcaaggtt

SEQ ID NO: 7827268 - DNA, 22 bp, Homo sapiens
agccaggctcaaggcctgctcc

SEQ ID NO: 7827269 - DNA, 22 bp, Homo sapiens
agccaggctcaaggcctgctcc

SEQ ID NO: 7827270 - DNA, 22 bp, Homo sapiens
agccaggctcaaggcctgctcc

SEQ ID NO: 7827271 - DNA, 22 bp, Homo sapiens
agccaggcgcagtggcttatgc

SEQ ID NO: 7827272 - DNA, 22 bp, Homo sapiens
agccaggccttttctcaaggtt

SEQ ID NO: 7827273 - DNA, 20 bp, Homo sapiens
cagagccagggttttgtttt

SEQ ID NO: 7827274 - DNA, 22 bp, Homo sapiens
cagagccagggttgcacccctg

SEQ ID NO: 7827275 - DNA, 22 bp, Homo sapiens
cagagccaggtctaggagtctc

SEQ ID NO: 7827276 - DNA, 22 bp, Homo sapiens
cagagccaggtctaggagtctc

SEQ ID NO: 7827277 - DNA, 22 bp, Homo sapiens
cagagccaggtggtgttggggc

SEQ ID NO: 7827278 - DNA, 22 bp, Homo sapiens
cagagccagtcagtcagaaact

SEQ ID NO: 7827279 - DNA, 22 bp, Homo sapiens
cagagccaggtctaggagtctc

SEQ ID NO: 7827280 - DNA, 22 bp, Homo sapiens
cagagccaggtctaggagtctc

SEQ ID NO: 7827281 - DNA, 22 bp, Homo sapiens
cagagccaggcctgccctcttt

SEQ ID NO: 7827282 - DNA, 22 bp, Homo sapiens
cagagccaggcctgccctcttt

SEQ ID NO: 7827283 - DNA, 22 bp, Homo sapiens
cagagccaggcctgccctcttt

SEQ ID NO: 7827284 - DNA, 22 bp, Homo sapiens
cagagccagggctaggaactgg

SEQ ID NO: 7827285 - DNA, 22 bp, Homo sapiens
cagagccagggctaggaactgg

SEQ ID NO: 7827286 - DNA, 19 bp, Homo sapiens
cagagccaggcctttggcc

SEQ ID NO: 7827287 - DNA, 22 bp, Homo sapiens
cagagccagggctaggaactgg

SEQ ID NO: 7827288 - DNA, 22 bp, Homo sapiens
cagagcagtctggagatccagc

SEQ ID NO: 7827289 - DNA, 22 bp, Homo sapiens
cagagcagtctggagatccagc

SEQ ID NO: 7827290 - DNA, 22 bp, Homo sapiens
cagagcagtctggagatccagc

SEQ ID NO: 7827291 - DNA, 22 bp, Homo sapiens
cagagcagtctggagatccagc

SEQ ID NO: 7827292 - DNA, 22 bp, Homo sapiens
cagagcagtctggagatccagc

SEQ ID NO: 7827293 - DNA, 22 bp, Homo sapiens
cagagcagtctggagatccagc

SEQ ID NO: 7827294 - DNA, 22 bp, Homo sapiens
cagagcagtctggagatccagc

SEQ ID NO: 7827295 - DNA, 18 bp, Homo sapiens
cagagcagtatgaatgtt

SEQ ID NO: 7827296 - DNA, 18 bp, Homo sapiens
cagagcagtatgaatgtt

SEQ ID NO: 7827297 - DNA, 22 bp, Homo sapiens
cagagcagtagaaaacagcctt

SEQ ID NO: 7827298 - DNA, 22 bp, Homo sapiens
cagagcagtagaaaacagcctt

SEQ ID NO: 7827299 - DNA, 22 bp, Homo sapiens
cagagcagtagaaaacagcctt

SEQ ID NO: 7827300 - DNA, 18 bp, Homo sapiens
cagagcagtatgaatgtt

SEQ ID NO: 7827301 - DNA, 18 bp, Homo sapiens
cagagcagtatgaatgtt

SEQ ID NO: 7827302 - DNA, 18 bp, Homo sapiens
cagagcagtatgaatgtt

SEQ ID NO: 7827303 - DNA, 18 bp, Homo sapiens
cagagcagtatgaatgtt

SEQ ID NO: 7827304 - DNA, 18 bp, Homo sapiens
cagagcagtatgaatgtt

SEQ ID NO: 7827305 - DNA, 22 bp, Homo sapiens
cagagcagtctggagatccagc

SEQ ID NO: 7827306 - DNA, 22 bp, Homo sapiens
cagagcagtctggagatccagc

SEQ ID NO: 7827307 - DNA, 22 bp, Homo sapiens
cagagcagtctggagatccagc

SEQ ID NO: 7827308 - DNA, 22 bp, Homo sapiens
cagagcagtccttgtcaatcag

SEQ ID NO: 7827309 - DNA, 22 bp, Homo sapiens
cagagcagtccttgtcaatcag

SEQ ID NO: 7827310 - DNA, 22 bp, Homo sapiens
cagagcagtctggagatccagc

SEQ ID NO: 7827311 - DNA, 22 bp, Homo sapiens
cagagcagtccttgtcaatcag

SEQ ID NO: 7827312 - DNA, 22 bp, Homo sapiens
cagagcagtccttgtcaatcag

SEQ ID NO: 7827313 - DNA, 22 bp, Homo sapiens
cagagcagtccttgtcaatcag

SEQ ID NO: 7827314 - DNA, 22 bp, Homo sapiens
cagagcagtccttgtcaatcag

SEQ ID NO: 7827315 - DNA, 22 bp, Homo sapiens
cagagcagtaaatctggggcac

SEQ ID NO: 7827316 - DNA, 22 bp, Homo sapiens
cagagcagtaaatctggggcac

SEQ ID NO: 7827317 - DNA, 22 bp, Homo sapiens
cagagcagtaaatctggggcac

SEQ ID NO: 7827318 - DNA, 22 bp, Homo sapiens
cagagcagtaaatctggggcac

SEQ ID NO: 7827319 - DNA, 22 bp, Homo sapiens
cagagcagtaaatctggggcac

SEQ ID NO: 7827320 - DNA, 22 bp, Homo sapiens
cagagcagtaaatctggggcac

SEQ ID NO: 7827321 - DNA, 22 bp, Homo sapiens
cagagcagtaaatctggggcac

SEQ ID NO: 7827322 - DNA, 22 bp, Homo sapiens
cagagcaggtatctttggtgaa

SEQ ID NO: 7827323 - DNA, 22 bp, Homo sapiens
cagagcagtagaaaacagcctt

SEQ ID NO: 7827324 - DNA, 22 bp, Homo sapiens
cagagcagtagaaaacagcctt

SEQ ID NO: 7827325 - DNA, 22 bp, Homo sapiens
cagagcagtagaaaacagcctt

SEQ ID NO: 7827326 - DNA, 22 bp, Homo sapiens
cagagcagtagaaaacagcctt

SEQ ID NO: 7827327 - DNA, 22 bp, Homo sapiens
cagagcagtagaaaacagcctt

SEQ ID NO: 7827328 - DNA, 22 bp, Homo sapiens
cagagcagtaaatctggggcac

SEQ ID NO: 7827329 - DNA, 22 bp, Homo sapiens
cagagcagtaaatctggggcac

SEQ ID NO: 7827330 - DNA, 22 bp, Homo sapiens
cagagctgtgataaatagatat

SEQ ID NO: 7827331 - DNA, 22 bp, Homo sapiens
cagagctgtgataaatagatat

SEQ ID NO: 7827332 - DNA, 22 bp, Homo sapiens
cagagctgtgataaatagatat

SEQ ID NO: 7827333 - DNA, 22 bp, Homo sapiens
cagagctgttactattcatgaa

SEQ ID NO: 7827334 - DNA, 22 bp, Homo sapiens
cagagctgttactattcatgaa

SEQ ID NO: 7827335 - DNA, 22 bp, Homo sapiens
cagagctgtccaaaccctgaca

SEQ ID NO: 7827336 - DNA, 22 bp, Homo sapiens
cagagctgtccaaaccctgaca

SEQ ID NO: 7827337 - DNA, 22 bp, Homo sapiens
cagagctgtccaaaccctgaca

SEQ ID NO: 7827338 - DNA, 22 bp, Homo sapiens
cagagctgtccaaaccctgaca

SEQ ID NO: 7827339 - DNA, 22 bp, Homo sapiens
cagagctgtccaaaccctgaca

SEQ ID NO: 7827340 - DNA, 22 bp, Homo sapiens
cagagctgttgcggggcttggc

SEQ ID NO: 7827341 - DNA, 22 bp, Homo sapiens
cagagctgttgcggggcttggc

SEQ ID NO: 7827342 - DNA, 22 bp, Homo sapiens
cagagctgttgcggggcttggc

SEQ ID NO: 7827343 - DNA, 22 bp, Homo sapiens
cagagctgttgcggggcttggc

SEQ ID NO: 7827344 - DNA, 22 bp, Homo sapiens
cagagcttaaaactccatggaa

SEQ ID NO: 7827345 - DNA, 22 bp, Homo sapiens
cagagctgttgcggggcttggc

SEQ ID NO: 7827346 - DNA, 22 bp, Homo sapiens
cagagctgttgcggggcttggc

SEQ ID NO: 7827347 - DNA, 22 bp, Homo sapiens
cagagctgttgcggggcttggc

SEQ ID NO: 7827348 - DNA, 20 bp, Homo sapiens
cagagctgttatggatgatg

SEQ ID NO: 7827349 - DNA, 20 bp, Homo sapiens
cagagctgttatggatgatg

SEQ ID NO: 7827350 - DNA, 20 bp, Homo sapiens
cagagctgttatggatgatg

SEQ ID NO: 7827351 - DNA, 20 bp, Homo sapiens
cagagctgttatggatgatg

SEQ ID NO: 7827352 - DNA, 20 bp, Homo sapiens
cagagctgttatggatgatg

SEQ ID NO: 7827353 - DNA, 22 bp, Homo sapiens
cagagctgttactattcatgaa

SEQ ID NO: 7827354 - DNA, 22 bp, Homo sapiens
cagagctgttactattcatgaa

SEQ ID NO: 7827355 - DNA, 20 bp, Homo sapiens
cagagctgttatggatgatg

SEQ ID NO: 7827356 - DNA, 20 bp, Homo sapiens
cagagctgttatggatgatg

SEQ ID NO: 7827357 - DNA, 22 bp, Homo sapiens
cagagccatcccagcctgtggt

SEQ ID NO: 7827358 - DNA, 22 bp, Homo sapiens
cagagccatcccagcctgtggt

SEQ ID NO: 7827359 - DNA, 22 bp, Homo sapiens
cagagccatcccagcctgtggt

SEQ ID NO: 7827360 - DNA, 22 bp, Homo sapiens
cagagccatccaggtgcctgtt

SEQ ID NO: 7827361 - DNA, 22 bp, Homo sapiens
cagagccatcccagcctgtggt

SEQ ID NO: 7827362 - DNA, 22 bp, Homo sapiens
cagagccatccaggtgcctgtt

SEQ ID NO: 7827363 - DNA, 22 bp, Homo sapiens
cagagccataaaggtgaaagag

SEQ ID NO: 7827364 - DNA, 22 bp, Homo sapiens
cagagccataaaggtgaaagag

SEQ ID NO: 7827365 - DNA, 22 bp, Homo sapiens
cagagccatcatgatatggagt

SEQ ID NO: 7827366 - DNA, 22 bp, Homo sapiens
cagagccatccaggtgcctgtt

SEQ ID NO: 7827367 - DNA, 22 bp, Homo sapiens
cagagccatcatgatatggagt

SEQ ID NO: 7827368 - DNA, 22 bp, Homo sapiens
cagagctgtcatttgccagtga

SEQ ID NO: 7827369 - DNA, 21 bp, Homo sapiens
cagagctgtccaaaccctgac

SEQ ID NO: 7827370 - DNA, 21 bp, Homo sapiens
cagagctgtccaaaccctgac

SEQ ID NO: 7827371 - DNA, 21 bp, Homo sapiens
cagagctgtccaaaccctgac

SEQ ID NO: 7827372 - DNA, 21 bp, Homo sapiens
cagagctgtccaaaccctgac

SEQ ID NO: 7827373 - DNA, 23 bp, Homo sapiens
cagagctggctcagagctgcctg

SEQ ID NO: 7827374 - DNA, 23 bp, Homo sapiens
cagagctggctcagagctgcctg

SEQ ID NO: 7827375 - DNA, 23 bp, Homo sapiens
cagagctggctcagagctgcctg

SEQ ID NO: 7827376 - DNA, 22 bp, Homo sapiens
cagagccatcccagcctgtggt

SEQ ID NO: 7827377 - DNA, 22 bp, Homo sapiens
cagagccatggtatgggcttgt

SEQ ID NO: 7827378 - DNA, 22 bp, Homo sapiens
cagagccattatggagacttgc

SEQ ID NO: 7827379 - DNA, 22 bp, Homo sapiens
cagagccatggtatgggcttgt

SEQ ID NO: 7827380 - DNA, 22 bp, Homo sapiens
agccctcctggggccacgctgg

SEQ ID NO: 7827381 - DNA, 22 bp, Homo sapiens
agccctcctggggccacgctgg

SEQ ID NO: 7827382 - DNA, 22 bp, Homo sapiens
cagagtggcgaccccctcagct

SEQ ID NO: 7827383 - DNA, 22 bp, Homo sapiens
cagagtggcgaccccctcagct

SEQ ID NO: 7827384 - DNA, 22 bp, Homo sapiens
cagagtggcgaccccctcagct

SEQ ID NO: 7827385 - DNA, 18 bp, Homo sapiens
cagagtgggccaagagac

SEQ ID NO: 7827386 - DNA, 18 bp, Homo sapiens
cagagtgggccaagagac

SEQ ID NO: 7827387 - DNA, 22 bp, Homo sapiens
agccctcctttgttcatgctgc

SEQ ID NO: 7827388 - DNA, 22 bp, Homo sapiens
agccctcctttgttcatgctgc

SEQ ID NO: 7827389 - DNA, 22 bp, Homo sapiens
agccctctaaaaatgataacta

SEQ ID NO: 7827390 - DNA, 22 bp, Homo sapiens
agccctcgtttctgcatcctgt

SEQ ID NO: 7827391 - DNA, 22 bp, Homo sapiens
agccctcgtttctgcatcctgt

SEQ ID NO: 7827392 - DNA, 22 bp, Homo sapiens
cagagtggagatgtgtgtggaa

SEQ ID NO: 7827393 - DNA, 22 bp, Homo sapiens
cagagtggagatgtgtgtggaa

SEQ ID NO: 7827394 - DNA, 22 bp, Homo sapiens
cagagtggagtttttcagcggg

SEQ ID NO: 7827395 - DNA, 22 bp, Homo sapiens
cagagtggagtttttcagcggg

SEQ ID NO: 7827396 - DNA, 22 bp, Homo sapiens
cagagtggcatgaatgaagcct

SEQ ID NO: 7827397 - DNA, 22 bp, Homo sapiens
cagagtggcagtcccaggccca

SEQ ID NO: 7827398 - DNA, 22 bp, Homo sapiens
cagagtggcatgaatgaagcct

SEQ ID NO: 7827399 - DNA, 22 bp, Homo sapiens
cagagtggagatgtgtgtggaa

SEQ ID NO: 7827400 - DNA, 22 bp, Homo sapiens
cagagtggcactctgctggatg

SEQ ID NO: 7827401 - DNA, 22 bp, Homo sapiens
cagagtggcactctgctggatg

SEQ ID NO: 7827402 - DNA, 22 bp, Homo sapiens
cagagtggcagtcccaggccca

SEQ ID NO: 7827403 - DNA, 22 bp, Homo sapiens
agccctcttcccagatgcctca

SEQ ID NO: 7827404 - DNA, 20 bp, Homo sapiens
agccctcttccagatgaagg

SEQ ID NO: 7827405 - DNA, 22 bp, Homo sapiens
agccctcttccagccagcacag

SEQ ID NO: 7827406 - DNA, 22 bp, Homo sapiens
agccctcttccagccagcacag

SEQ ID NO: 7827407 - DNA, 22 bp, Homo sapiens
agccctcttccagccagcacag

SEQ ID NO: 7827408 - DNA, 22 bp, Homo sapiens
agccctcttccagccagcacag

SEQ ID NO: 7827409 - DNA, 22 bp, Homo sapiens
agccctgaagctggccatgtcc

SEQ ID NO: 7827410 - DNA, 20 bp, Homo sapiens
agccctcttgctttagggta

SEQ ID NO: 7827411 - DNA, 22 bp, Homo sapiens
agccctcttcccagatgcctca

SEQ ID NO: 7827412 - DNA, 22 bp, Homo sapiens
agccctgagccagcctggtcag

SEQ ID NO: 7827413 - DNA, 22 bp, Homo sapiens
agccctgggctgtagataagca

SEQ ID NO: 7827414 - DNA, 21 bp, Homo sapiens
agcccttaggacataagagag

SEQ ID NO: 7827415 - DNA, 22 bp, Homo sapiens
agcccttagtacatttctcaag

SEQ ID NO: 7827416 - DNA, 22 bp, Homo sapiens
agccctgggctgtagataagca

SEQ ID NO: 7827417 - DNA, 22 bp, Homo sapiens
agccctgggctgtagataagca

SEQ ID NO: 7827418 - DNA, 22 bp, Homo sapiens
agccctgggctgtagataagca

SEQ ID NO: 7827419 - DNA, 22 bp, Homo sapiens
agccctgagccagcctggtcag

SEQ ID NO: 7827420 - DNA, 22 bp, Homo sapiens
agccctgggctgtagataagca

SEQ ID NO: 7827421 - DNA, 22 bp, Homo sapiens
agccctctctttagagatctga

SEQ ID NO: 7827422 - DNA, 22 bp, Homo sapiens
agccctctctttagagatctga

SEQ ID NO: 7827423 - DNA, 22 bp, Homo sapiens
agccctctctatggccctcttg

SEQ ID NO: 7827424 - DNA, 22 bp, Homo sapiens
agccctctctatggccctcttg

SEQ ID NO: 7827425 - DNA, 21 bp, Homo sapiens
agccctctccaattccctttt

SEQ ID NO: 7827426 - DNA, 22 bp, Homo sapiens
agccctctaagcaagagaggaa

SEQ ID NO: 7827427 - DNA, 22 bp, Homo sapiens
agccctctaagcaagagaggaa

SEQ ID NO: 7827428 - DNA, 22 bp, Homo sapiens
agccctctccctttcttcttag

SEQ ID NO: 7827429 - DNA, 22 bp, Homo sapiens
agccctctccaccttcgaaaaa

SEQ ID NO: 7827430 - DNA, 22 bp, Homo sapiens
agccctctctatggccctcttg

SEQ ID NO: 7827431 - DNA, 22 bp, Homo sapiens
agccctctgctgttctagtctc

SEQ ID NO: 7827432 - DNA, 22 bp, Homo sapiens
agccctctgctgttctagtctc

SEQ ID NO: 7827433 - DNA, 22 bp, Homo sapiens
agccctctgctgttctagtctc

SEQ ID NO: 7827434 - DNA, 22 bp, Homo sapiens
agccctctgcaaacacctgata

SEQ ID NO: 7827435 - DNA, 22 bp, Homo sapiens
agccctctgagctagtcaccat

SEQ ID NO: 7827436 - DNA, 22 bp, Homo sapiens
agccctctgagctagtcaccat

SEQ ID NO: 7827437 - DNA, 22 bp, Homo sapiens
agccctctgagctagtcaccat

SEQ ID NO: 7827438 - DNA, 22 bp, Homo sapiens
agccctctgagcctgggttgta

SEQ ID NO: 7827439 - DNA, 22 bp, Homo sapiens
agccctctgagctagtcaccat

SEQ ID NO: 7827440 - DNA, 22 bp, Homo sapiens
cagagcttcctgctgggcttct

SEQ ID NO: 7827441 - DNA, 22 bp, Homo sapiens
cagagcttaaaactccatggaa

SEQ ID NO: 7827442 - DNA, 18 bp, Homo sapiens
cagaggagagacattcag

SEQ ID NO: 7827443 - DNA, 18 bp, Homo sapiens
cagaggagagacattcag

SEQ ID NO: 7827444 - DNA, 18 bp, Homo sapiens
cagaggagagacattcag

SEQ ID NO: 7827445 - DNA, 17 bp, Homo sapiens
cagaggagctttggggg

SEQ ID NO: 7827446 - DNA, 22 bp, Homo sapiens
cagaggaggcggtatacactgc

SEQ ID NO: 7827447 - DNA, 22 bp, Homo sapiens
cagaggaggcggtatacactgc

SEQ ID NO: 7827448 - DNA, 17 bp, Homo sapiens
cagaggagctttggggg

SEQ ID NO: 7827449 - DNA, 17 bp, Homo sapiens
cagaggagctttggggg

SEQ ID NO: 7827450 - DNA, 22 bp, Homo sapiens
cagaggaggccaccgcataggc

SEQ ID NO: 7827451 - DNA, 22 bp, Homo sapiens
cagaggaggccaccgcataggc

SEQ ID NO: 7827452 - DNA, 22 bp, Homo sapiens
cagaggaggccaccgcataggc

SEQ ID NO: 7827453 - DNA, 22 bp, Homo sapiens
cagagtgataaatatagaaatt

SEQ ID NO: 7827454 - DNA, 22 bp, Homo sapiens
cagagtgagggcctgcacctgc

SEQ ID NO: 7827455 - DNA, 22 bp, Homo sapiens
cagagtgaacagtgggatgtgc

SEQ ID NO: 7827456 - DNA, 22 bp, Homo sapiens
cagagtgaacagtgggatgtgc

SEQ ID NO: 7827457 - DNA, 22 bp, Homo sapiens
cagagtgaaataggggatcaag

SEQ ID NO: 7827458 - DNA, 22 bp, Homo sapiens
cagagtgaaataggggatcaag

SEQ ID NO: 7827459 - DNA, 22 bp, Homo sapiens
cagagtgattatggaggattgc

SEQ ID NO: 7827460 - DNA, 22 bp, Homo sapiens
cagagtgatggcacctgctggg

SEQ ID NO: 7827461 - DNA, 22 bp, Homo sapiens
cagagtgcatggtgctgttcat

SEQ ID NO: 7827462 - DNA, 22 bp, Homo sapiens
cagagtggagaaacgcttcgtc

SEQ ID NO: 7827463 - DNA, 22 bp, Homo sapiens
cagagtgcatggtgctgttcat

SEQ ID NO: 7827464 - DNA, 22 bp, Homo sapiens
cagagtgaaataggggatcaag

SEQ ID NO: 7827465 - DNA, 22 bp, Homo sapiens
cagaggtgctggagtgagtcct

SEQ ID NO: 7827466 - DNA, 22 bp, Homo sapiens
cagaggagttcagtacacagcc

SEQ ID NO: 7827467 - DNA, 22 bp, Homo sapiens
cagaggagttcagtacacagcc

SEQ ID NO: 7827468 - DNA, 20 bp, Homo sapiens
cagaggagtacatatgttca

SEQ ID NO: 7827469 - DNA, 20 bp, Homo sapiens
cagaggagtacatatgttca

SEQ ID NO: 7827470 - DNA, 22 bp, Homo sapiens
cagaggagtgggccgttatggt

SEQ ID NO: 7827471 - DNA, 22 bp, Homo sapiens
cagaggagtgggccgttatggt

SEQ ID NO: 7827472 - DNA, 22 bp, Homo sapiens
cagaggagtgggccgttatggt

SEQ ID NO: 7827473 - DNA, 22 bp, Homo sapiens
cagatctctgtgtagttcagtc

SEQ ID NO: 7827474 - DNA, 22 bp, Homo sapiens
cagatctgctcctctgtccatg

SEQ ID NO: 7827475 - DNA, 22 bp, Homo sapiens
cagatctctgtgtagttcagtc

SEQ ID NO: 7827476 - DNA, 22 bp, Homo sapiens
cagatctgagccaagctcgatg

SEQ ID NO: 7827477 - DNA, 22 bp, Homo sapiens
cagatctgctcctctgtccatg

SEQ ID NO: 7827478 - DNA, 21 bp, Homo sapiens
cagatctgtaggtactaccat

SEQ ID NO: 7827479 - DNA, 21 bp, Homo sapiens
cagatctgtaggtactaccat

SEQ ID NO: 7827480 - DNA, 22 bp, Homo sapiens
cagatctgtagtaaaagatctc

SEQ ID NO: 7827481 - DNA, 22 bp, Homo sapiens
cagatctgtagtaaaagatctc

SEQ ID NO: 7827482 - DNA, 22 bp, Homo sapiens
cagatgaactgtgactgaaaat

SEQ ID NO: 7827483 - DNA, 22 bp, Homo sapiens
cagatgaactgtgactgaaaat

SEQ ID NO: 7827484 - DNA, 22 bp, Homo sapiens
cagatgaactgtgactgaaaat

SEQ ID NO: 7827485 - DNA, 22 bp, Homo sapiens
cagatcttgtactcattattga

SEQ ID NO: 7827486 - DNA, 22 bp, Homo sapiens
cagatctgtttgccagatcagc

SEQ ID NO: 7827487 - DNA, 22 bp, Homo sapiens
agcctgcttgagagtcctggct

SEQ ID NO: 7827488 - DNA, 22 bp, Homo sapiens
agcctgcttcctcagggaacaa

SEQ ID NO: 7827489 - DNA, 22 bp, Homo sapiens
agcctgcttgagagtcctggct

SEQ ID NO: 7827490 - DNA, 22 bp, Homo sapiens
agcctggaagaacctgaagtct

SEQ ID NO: 7827491 - DNA, 22 bp, Homo sapiens
agcctggaattaaggaaatgca

SEQ ID NO: 7827492 - DNA, 22 bp, Homo sapiens
agcctggaagaacctgaagtct

SEQ ID NO: 7827493 - DNA, 22 bp, Homo sapiens
agcctgagtgcttaggactgtt

SEQ ID NO: 7827494 - DNA, 22 bp, Homo sapiens
agcctgagctgcctgccgcctc

SEQ ID NO: 7827495 - DNA, 22 bp, Homo sapiens
agcctgagtgcttaggactgtt

SEQ ID NO: 7827496 - DNA, 22 bp, Homo sapiens
cagatgaagatcatagaatagt

SEQ ID NO: 7827497 - DNA, 19 bp, Homo sapiens
agcctggagggctggtcac

SEQ ID NO: 7827498 - DNA, 18 bp, Homo sapiens
agcctggagggttgaagt

SEQ ID NO: 7827499 - DNA, 19 bp, Homo sapiens
agcctggagggctggtcac

SEQ ID NO: 7827500 - DNA, 19 bp, Homo sapiens
agcctggagggctggtcac

SEQ ID NO: 7827501 - DNA, 18 bp, Homo sapiens
agcctggagggttgaagt

SEQ ID NO: 7827502 - DNA, 22 bp, Homo sapiens
cagcactgctgctgtacacaca

SEQ ID NO: 7827503 - DNA, 22 bp, Homo sapiens
agcctggaggtaatgaggaaac

SEQ ID NO: 7827504 - DNA, 22 bp, Homo sapiens
cagcactgcttcgcagccaggg

SEQ ID NO: 7827505 - DNA, 22 bp, Homo sapiens
cagcactgcttcgcagccaggg

SEQ ID NO: 7827506 - DNA, 22 bp, Homo sapiens
cagcactgcttcgcagccaggg

SEQ ID NO: 7827507 - DNA, 22 bp, Homo sapiens
agcctggaggaggagttgagca

SEQ ID NO: 7827508 - DNA, 22 bp, Homo sapiens
agcctggaggccaggagacagt

SEQ ID NO: 7827509 - DNA, 22 bp, Homo sapiens
agcctggaggaggagttgagca

SEQ ID NO: 7827510 - DNA, 22 bp, Homo sapiens
agcctggaggccaggagacagt

SEQ ID NO: 7827511 - DNA, 22 bp, Homo sapiens
agcctggaggccaggagacagt

SEQ ID NO: 7827512 - DNA, 19 bp, Homo sapiens
agcctggagggctggtcac

SEQ ID NO: 7827513 - DNA, 22 bp, Homo sapiens
agcctggacagctacggagaac

SEQ ID NO: 7827514 - DNA, 22 bp, Homo sapiens
agcctggacagctacggagaac

SEQ ID NO: 7827515 - DNA, 22 bp, Homo sapiens
agcctggaccaggggcctcaga

SEQ ID NO: 7827516 - DNA, 22 bp, Homo sapiens
agcctggaccaggggcctcaga

SEQ ID NO: 7827517 - DNA, 22 bp, Homo sapiens
agcctggagaggcgccatacac

SEQ ID NO: 7827518 - DNA, 22 bp, Homo sapiens
agcctggagaggcgccatacac

SEQ ID NO: 7827519 - DNA, 22 bp, Homo sapiens
agcctggaggaggagttgagca

SEQ ID NO: 7827520 - DNA, 22 bp, Homo sapiens
agcccttagtacatttctcaag

SEQ ID NO: 7827521 - DNA, 22 bp, Homo sapiens
agcccttagtacatttctcaag

SEQ ID NO: 7827522 - DNA, 22 bp, Homo sapiens
agcccttcaacctgcctactcc

SEQ ID NO: 7827523 - DNA, 22 bp, Homo sapiens
agcccttcaacctgcctactcc

SEQ ID NO: 7827524 - DNA, 22 bp, Homo sapiens
agcccttcaagagctctgtcct

SEQ ID NO: 7827525 - DNA, 22 bp, Homo sapiens
agcccttcaagagctctgtcct

SEQ ID NO: 7827526 - DNA, 22 bp, Homo sapiens
agcccttgcagactgtcagcat

SEQ ID NO: 7827527 - DNA, 22 bp, Homo sapiens
agccctttccaatttgatttat

SEQ ID NO: 7827528 - DNA, 22 bp, Homo sapiens
agccctttccaatttgatttat

SEQ ID NO: 7827529 - DNA, 17 bp, Homo sapiens
agccgcctgggtcctgt

SEQ ID NO: 7827530 - DNA, 22 bp, Homo sapiens
agcctagggggtcctgggccac

SEQ ID NO: 7827531 - DNA, 22 bp, Homo sapiens
agcctagggggtcctgggccac

SEQ ID NO: 7827532 - DNA, 22 bp, Homo sapiens
agcctagggggtcctgggccac

SEQ ID NO: 7827533 - DNA, 22 bp, Homo sapiens
agcctaggaggttggggctgca

SEQ ID NO: 7827534 - DNA, 22 bp, Homo sapiens
agcctaggaggttggggctgca

SEQ ID NO: 7827535 - DNA, 22 bp, Homo sapiens
agcctagggggtcctgggccac

SEQ ID NO: 7827536 - DNA, 22 bp, Homo sapiens
agccggccatgtggtcttgtgc

SEQ ID NO: 7827537 - DNA, 22 bp, Homo sapiens
agcctaatgcttttcccaaagt

SEQ ID NO: 7827538 - DNA, 22 bp, Homo sapiens
agccgtgggcaggcccaggaca

SEQ ID NO: 7827539 - DNA, 22 bp, Homo sapiens
cagatcatgggactgtctcagc

SEQ ID NO: 7827540 - DNA, 22 bp, Homo sapiens
cagatcatgggactgtctcagc

SEQ ID NO: 7827541 - DNA, 22 bp, Homo sapiens
cagatcataacagatacataga

SEQ ID NO: 7827542 - DNA, 23 bp, Homo sapiens
cagatcatatatccagctgtaag

SEQ ID NO: 7827543 - DNA, 22 bp, Homo sapiens
cagatccatagagttctggaga

SEQ ID NO: 7827544 - DNA, 22 bp, Homo sapiens
cagatccatctctcagaaagag

SEQ ID NO: 7827545 - DNA, 22 bp, Homo sapiens
cagatccatctctcagaaagag

SEQ ID NO: 7827546 - DNA, 22 bp, Homo sapiens
cagatcgctaaattgaccaaat

SEQ ID NO: 7827547 - DNA, 22 bp, Homo sapiens
cagatcctttatagcagtgtcc

SEQ ID NO: 7827548 - DNA, 18 bp, Homo sapiens
cagatccaggcagctatt

SEQ ID NO: 7827549 - DNA, 22 bp, Homo sapiens
cagatccagccgctcctgggaa

SEQ ID NO: 7827550 - DNA, 22 bp, Homo sapiens
cagatccacccttgtagtgaca

SEQ ID NO: 7827551 - DNA, 18 bp, Homo sapiens
cagatccaggcagctatt

SEQ ID NO: 7827552 - DNA, 22 bp, Homo sapiens
cagatccatagagttctggaga

SEQ ID NO: 7827553 - DNA, 22 bp, Homo sapiens
agcctattccaggatgagctca

SEQ ID NO: 7827554 - DNA, 22 bp, Homo sapiens
agcctaggtctgggtctagcag

SEQ ID NO: 7827555 - DNA, 22 bp, Homo sapiens
agcctaggtctgggtctagcag

SEQ ID NO: 7827556 - DNA, 22 bp, Homo sapiens
agcctaggtctgggtctagcag

SEQ ID NO: 7827557 - DNA, 22 bp, Homo sapiens
agcctagggttctgatgtcact

SEQ ID NO: 7827558 - DNA, 22 bp, Homo sapiens
agcctattccaggatgagctca

SEQ ID NO: 7827559 - DNA, 22 bp, Homo sapiens
cagatatgtggattctattagc

SEQ ID NO: 7827560 - DNA, 22 bp, Homo sapiens
agcctattccaggatgagctca

SEQ ID NO: 7827561 - DNA, 22 bp, Homo sapiens
agcctattcatctgatcttgaa

SEQ ID NO: 7827562 - DNA, 22 bp, Homo sapiens
agcctattccaggatgagctca

SEQ ID NO: 7827563 - DNA, 22 bp, Homo sapiens
cagatcaagctgtatggtcaga

SEQ ID NO: 7827564 - DNA, 22 bp, Homo sapiens
cagatattaggagctcaataat

SEQ ID NO: 7827565 - DNA, 22 bp, Homo sapiens
caattacatttattgagcattc

SEQ ID NO: 7827566 - DNA, 21 bp, Homo sapiens
caattacagatggctcagggg

SEQ ID NO: 7827567 - DNA, 22 bp, Homo sapiens
caattaaagaagacctgcctca

SEQ ID NO: 7827568 - DNA, 21 bp, Homo sapiens
caattacagatggctcagggg

SEQ ID NO: 7827569 - DNA, 22 bp, Homo sapiens
caattaaagaagacctgcctca

SEQ ID NO: 7827570 - DNA, 22 bp, Homo sapiens
caattaaagaagacctgcctca

SEQ ID NO: 7827571 - DNA, 22 bp, Homo sapiens
caattaaagaagacctgcctca

SEQ ID NO: 7827572 - DNA, 22 bp, Homo sapiens
caattacatttattgagcattc

SEQ ID NO: 7827573 - DNA, 22 bp, Homo sapiens
caattacatttattgagcattc

SEQ ID NO: 7827574 - DNA, 22 bp, Homo sapiens
caattacatttattgagcattc

SEQ ID NO: 7827575 - DNA, 22 bp, Homo sapiens
caattactggtccacagaaatt

SEQ ID NO: 7827576 - DNA, 22 bp, Homo sapiens
caattaccagtaattgaggttt

SEQ ID NO: 7827577 - DNA, 22 bp, Homo sapiens
caattatatttagaatgataca

SEQ ID NO: 7827578 - DNA, 22 bp, Homo sapiens
caattatatttagaatgataca

SEQ ID NO: 7827579 - DNA, 22 bp, Homo sapiens
caattatatttagaatgataca

SEQ ID NO: 7827580 - DNA, 22 bp, Homo sapiens
caattatatttagaatgataca

SEQ ID NO: 7827581 - DNA, 22 bp, Homo sapiens
caattacttttgcaccaatata

SEQ ID NO: 7827582 - DNA, 22 bp, Homo sapiens
caattacttttgcaccaatata

SEQ ID NO: 7827583 - DNA, 22 bp, Homo sapiens
caattagctggtactgacagga

SEQ ID NO: 7827584 - DNA, 22 bp, Homo sapiens
caattattcagtgacttaagag

SEQ ID NO: 7827585 - DNA, 22 bp, Homo sapiens
caattattcagtgacttaagag

SEQ ID NO: 7827586 - DNA, 22 bp, Homo sapiens
caattatatttagaatgataca

SEQ ID NO: 7827587 - DNA, 22 bp, Homo sapiens
caatgattgctatttacataaa

SEQ ID NO: 7827588 - DNA, 22 bp, Homo sapiens
caatgtttttccttccttaata

SEQ ID NO: 7827589 - DNA, 22 bp, Homo sapiens
caatgattgctatttacataaa

SEQ ID NO: 7827590 - DNA, 22 bp, Homo sapiens
caatgatggctaggcagctgct

SEQ ID NO: 7827591 - DNA, 22 bp, Homo sapiens
caatgatagattttacaaatta

SEQ ID NO: 7827592 - DNA, 22 bp, Homo sapiens
caatgatagattttacaaatta

SEQ ID NO: 7827593 - DNA, 22 bp, Homo sapiens
caagtctgacctctgggtgaag

SEQ ID NO: 7827594 - DNA, 22 bp, Homo sapiens
caagtctgtctgctcctgtgtg

SEQ ID NO: 7827595 - DNA, 22 bp, Homo sapiens
caagtgaagatatacagaaaat

SEQ ID NO: 7827596 - DNA, 22 bp, Homo sapiens
caagtctgtctgctcctgtgtg

SEQ ID NO: 7827597 - DNA, 22 bp, Homo sapiens
caagtccttttcttggctcagg

SEQ ID NO: 7827598 - DNA, 22 bp, Homo sapiens
caagtccttagatggttctttg

SEQ ID NO: 7827599 - DNA, 22 bp, Homo sapiens
caagtcctcgcttctagctgtg

SEQ ID NO: 7827600 - DNA, 22 bp, Homo sapiens
caagtcctcaaagggctctgct

SEQ ID NO: 7827601 - DNA, 22 bp, Homo sapiens
caagtctgacctctgggtgaag

SEQ ID NO: 7827602 - DNA, 22 bp, Homo sapiens
caagtctgacctctgggtgaag

SEQ ID NO: 7827603 - DNA, 22 bp, Homo sapiens
caagtctagcttggtcacttgg

SEQ ID NO: 7827604 - DNA, 22 bp, Homo sapiens
caagtccttttcttggctcagg

SEQ ID NO: 7827605 - DNA, 22 bp, Homo sapiens
caagtccttttcttggctcagg

SEQ ID NO: 7827606 - DNA, 22 bp, Homo sapiens
caagggccctcggatgatgatg

SEQ ID NO: 7827607 - DNA, 22 bp, Homo sapiens
caagggccctcggatgatgatg

SEQ ID NO: 7827608 - DNA, 22 bp, Homo sapiens
caagggcctccaccttgctcgt

SEQ ID NO: 7827609 - DNA, 22 bp, Homo sapiens
caagggctcacggtctgctggg

SEQ ID NO: 7827610 - DNA, 22 bp, Homo sapiens
caagggctcacggtctgctggg

SEQ ID NO: 7827611 - DNA, 22 bp, Homo sapiens
caagggctcacggtctgctggg

SEQ ID NO: 7827612 - DNA, 22 bp, Homo sapiens
caagggctcacggtctgctggg

SEQ ID NO: 7827613 - DNA, 22 bp, Homo sapiens
caagggccctgtctatgtatcc

SEQ ID NO: 7827614 - DNA, 22 bp, Homo sapiens
caagggcagatagctggtccaa

SEQ ID NO: 7827615 - DNA, 22 bp, Homo sapiens
caagggcaggagaggatggatg

SEQ ID NO: 7827616 - DNA, 22 bp, Homo sapiens
caagggcagcagcctcaagcgg

SEQ ID NO: 7827617 - DNA, 22 bp, Homo sapiens
caagggcattgcttgggacctt

SEQ ID NO: 7827618 - DNA, 22 bp, Homo sapiens
caagggccatctgagggcactg

SEQ ID NO: 7827619 - DNA, 21 bp, Homo sapiens
caagggccagtgagatgggat

SEQ ID NO: 7827620 - DNA, 22 bp, Homo sapiens
caagggagttactgagggcggg

SEQ ID NO: 7827621 - DNA, 22 bp, Homo sapiens
caagggcagatagctggtccaa

SEQ ID NO: 7827622 - DNA, 22 bp, Homo sapiens
caagggcagaggcagggccccg

SEQ ID NO: 7827623 - DNA, 22 bp, Homo sapiens
caagggagttgctgcatgcagg

SEQ ID NO: 7827624 - DNA, 22 bp, Homo sapiens
caagggagttactgagggcggg

SEQ ID NO: 7827625 - DNA, 22 bp, Homo sapiens
caagggacagttatgagaccct

SEQ ID NO: 7827626 - DNA, 22 bp, Homo sapiens
caagggaattgtgtgtgagagg

SEQ ID NO: 7827627 - DNA, 22 bp, Homo sapiens
caagggaattgtgtgtgagagg

SEQ ID NO: 7827628 - DNA, 22 bp, Homo sapiens
caagtcattactgaaatgtcac

SEQ ID NO: 7827629 - DNA, 22 bp, Homo sapiens
caagtcattactgaaatgtcac

SEQ ID NO: 7827630 - DNA, 23 bp, Homo sapiens
caagtcatggattggagtttcag

SEQ ID NO: 7827631 - DNA, 22 bp, Homo sapiens
caagtcatcatagaagttcccc

SEQ ID NO: 7827632 - DNA, 22 bp, Homo sapiens
caagtcatcatagaagttcccc

SEQ ID NO: 7827633 - DNA, 22 bp, Homo sapiens
caagtcacttatgtgcagatat

SEQ ID NO: 7827634 - DNA, 22 bp, Homo sapiens
caagggctgctatcagctactg

SEQ ID NO: 7827635 - DNA, 22 bp, Homo sapiens
caagggctgctatcagctactg

SEQ ID NO: 7827636 - DNA, 22 bp, Homo sapiens
caagggctgaacacaggtttca

SEQ ID NO: 7827637 - DNA, 22 bp, Homo sapiens
caagtccaagatcaagaagcca

SEQ ID NO: 7827638 - DNA, 22 bp, Homo sapiens
caagtccaacagtttttcagac

SEQ ID NO: 7827639 - DNA, 22 bp, Homo sapiens
caagtcattgtttagtcatgtt

SEQ ID NO: 7827640 - DNA, 22 bp, Homo sapiens
caagtcattgtttagtcatgtt

SEQ ID NO: 7827641 - DNA, 22 bp, Homo sapiens
caagtccaggtcaatttaaagc

SEQ ID NO: 7827642 - DNA, 22 bp, Homo sapiens
caagtccaagatcaagaagcca

SEQ ID NO: 7827643 - DNA, 22 bp, Homo sapiens
caagtccaacagtttttcagac

SEQ ID NO: 7827644 - DNA, 22 bp, Homo sapiens
caagtccaggtgggcaaataaa

SEQ ID NO: 7827645 - DNA, 22 bp, Homo sapiens
caagtccatataagtctgtttc

SEQ ID NO: 7827646 - DNA, 22 bp, Homo sapiens
caagtccatataagtctgtttc

SEQ ID NO: 7827647 - DNA, 22 bp, Homo sapiens
caagtccatcagataagcaaga

SEQ ID NO: 7827648 - DNA, 22 bp, Homo sapiens
caagtccatcctactgccttct

SEQ ID NO: 7827649 - DNA, 22 bp, Homo sapiens
caagtccatcagataagcaaga

SEQ ID NO: 7827650 - DNA, 22 bp, Homo sapiens
caagtccatcagataagcaaga

SEQ ID NO: 7827651 - DNA, 22 bp, Homo sapiens
caagtccatcagataagcaaga

SEQ ID NO: 7827652 - DNA, 22 bp, Homo sapiens
caagtccatgttagatgctggc

SEQ ID NO: 7827653 - DNA, 22 bp, Homo sapiens
caagtccatgttagatgctggc

SEQ ID NO: 7827654 - DNA, 22 bp, Homo sapiens
caagtccatgttagatgctggc

SEQ ID NO: 7827655 - DNA, 22 bp, Homo sapiens
caagtccatcctactgccttct

SEQ ID NO: 7827656 - DNA, 22 bp, Homo sapiens
caagctgggtcccaacaattac

SEQ ID NO: 7827657 - DNA, 22 bp, Homo sapiens
caagctggctgggagaggcacg

SEQ ID NO: 7827658 - DNA, 22 bp, Homo sapiens
caagctggagttcctcagagtg

SEQ ID NO: 7827659 - DNA, 22 bp, Homo sapiens
caagctggaggttggagctact

SEQ ID NO: 7827660 - DNA, 22 bp, Homo sapiens
caagcagagaggttagaacaca

SEQ ID NO: 7827661 - DNA, 22 bp, Homo sapiens
caagcagagaggttagaacaca

SEQ ID NO: 7827662 - DNA, 22 bp, Homo sapiens
agcaattttctaagcaaaatac

SEQ ID NO: 7827663 - DNA, 22 bp, Homo sapiens
caagcagaggtttatgtattag

SEQ ID NO: 7827664 - DNA, 22 bp, Homo sapiens
caagcagatattttagtcaaga

SEQ ID NO: 7827665 - DNA, 22 bp, Homo sapiens
caagcagatattttagtcaaga

SEQ ID NO: 7827666 - DNA, 22 bp, Homo sapiens
caagctggaggttggagctact

SEQ ID NO: 7827667 - DNA, 22 bp, Homo sapiens
caagcagaggtttatgtattag

SEQ ID NO: 7827668 - DNA, 22 bp, Homo sapiens
caagcagatattttagtcaaga

SEQ ID NO: 7827669 - DNA, 21 bp, Homo sapiens
agcaatttcatttggtttaac

SEQ ID NO: 7827670 - DNA, 22 bp, Homo sapiens
agcaattatgataaggccgctg

SEQ ID NO: 7827671 - DNA, 21 bp, Homo sapiens
agcaatttttcctcctctgca

SEQ ID NO: 7827672 - DNA, 22 bp, Homo sapiens
agcaattttctaagcaaaatac

SEQ ID NO: 7827673 - DNA, 22 bp, Homo sapiens
agcaatttcccatctcttctgc

SEQ ID NO: 7827674 - DNA, 22 bp, Homo sapiens
agcaatttcccatctcttctgc

SEQ ID NO: 7827675 - DNA, 22 bp, Homo sapiens
agcaatttctcgcaccagacgc

SEQ ID NO: 7827676 - DNA, 22 bp, Homo sapiens
agcaatttctcgcaccagacgc

SEQ ID NO: 7827677 - DNA, 22 bp, Homo sapiens
agcaatttctcgcaccagacgc

SEQ ID NO: 7827678 - DNA, 22 bp, Homo sapiens
agcaattttcccttagtctttg

SEQ ID NO: 7827679 - DNA, 22 bp, Homo sapiens
caaggaaaagaagtatttcaga

SEQ ID NO: 7827680 - DNA, 22 bp, Homo sapiens
caaggaaaagaagtatttcaga

SEQ ID NO: 7827681 - DNA, 22 bp, Homo sapiens
caaggaaacatgaaatgcattg

SEQ ID NO: 7827682 - DNA, 22 bp, Homo sapiens
caaggaaacatgaaatgcattg

SEQ ID NO: 7827683 - DNA, 22 bp, Homo sapiens
caaggaaacatgaaatgcattg

SEQ ID NO: 7827684 - DNA, 22 bp, Homo sapiens
caaggaaacatgaaatgcattg

SEQ ID NO: 7827685 - DNA, 22 bp, Homo sapiens
caaggaaacatgaaatgcattg

SEQ ID NO: 7827686 - DNA, 22 bp, Homo sapiens
caaggaaaacagatgatcaaca

SEQ ID NO: 7827687 - DNA, 22 bp, Homo sapiens
caaggaaaacagatgatcaaca

SEQ ID NO: 7827688 - DNA, 22 bp, Homo sapiens
caaggaaaacagatgatcaaca

SEQ ID NO: 7827689 - DNA, 22 bp, Homo sapiens
caaggaaaacagatgatcaaca

SEQ ID NO: 7827690 - DNA, 22 bp, Homo sapiens
caaggaaaagaagtatttcaga

SEQ ID NO: 7827691 - DNA, 22 bp, Homo sapiens
caaggaaaagaagtatttcaga

SEQ ID NO: 7827692 - DNA, 22 bp, Homo sapiens
caaggaaaagaagtatttcaga

SEQ ID NO: 7827693 - DNA, 22 bp, Homo sapiens
caagctttatccgccatgtagg

SEQ ID NO: 7827694 - DNA, 22 bp, Homo sapiens
caagcttgtttctcctgggggt

SEQ ID NO: 7827695 - DNA, 22 bp, Homo sapiens
caagcttgtttctcctgggggt

SEQ ID NO: 7827696 - DNA, 22 bp, Homo sapiens
caagctggtatcagctagagcg

SEQ ID NO: 7827697 - DNA, 22 bp, Homo sapiens
caagctggtatcagctagagcg

SEQ ID NO: 7827698 - DNA, 22 bp, Homo sapiens
caagcttaagacagaagaggca

SEQ ID NO: 7827699 - DNA, 22 bp, Homo sapiens
caagctttccattacacacatt

SEQ ID NO: 7827700 - DNA, 22 bp, Homo sapiens
caagcttgtttctcctgggggt

SEQ ID NO: 7827701 - DNA, 22 bp, Homo sapiens
caaggaaaaagcgagctcgggg

SEQ ID NO: 7827702 - DNA, 22 bp, Homo sapiens
caaggaaaaagcgagctcgggg

SEQ ID NO: 7827703 - DNA, 22 bp, Homo sapiens
caaggaaaaagcgagctcgggg

SEQ ID NO: 7827704 - DNA, 22 bp, Homo sapiens
caaggaaaacagatgatcaaca

SEQ ID NO: 7827705 - DNA, 22 bp, Homo sapiens
caaggaaacatgaaatgcattg

SEQ ID NO: 7827706 - DNA, 22 bp, Homo sapiens
caaggaagacccacgcagatat

SEQ ID NO: 7827707 - DNA, 22 bp, Homo sapiens
caaggaaggagagatgatgggt

SEQ ID NO: 7827708 - DNA, 22 bp, Homo sapiens
caaggaaggagagatgatgggt

SEQ ID NO: 7827709 - DNA, 22 bp, Homo sapiens
caaggaaggagagatgatgggt

SEQ ID NO: 7827710 - DNA, 22 bp, Homo sapiens
caaggaagttttaggagaggaa

SEQ ID NO: 7827711 - DNA, 22 bp, Homo sapiens
caaggaaggagagatgatgggt

SEQ ID NO: 7827712 - DNA, 21 bp, Homo sapiens
agcagacacttgtgaccttcc

SEQ ID NO: 7827713 - DNA, 21 bp, Homo sapiens
agcagacagatgcacgcacac

SEQ ID NO: 7827714 - DNA, 21 bp, Homo sapiens
agcagacagatgcacgcacac

SEQ ID NO: 7827715 - DNA, 21 bp, Homo sapiens
agcagacagatgcacgcacac

SEQ ID NO: 7827716 - DNA, 21 bp, Homo sapiens
agcagacagatgcacgcacac

SEQ ID NO: 7827717 - DNA, 22 bp, Homo sapiens
agcagacatatctcatgtcaca

SEQ ID NO: 7827718 - DNA, 22 bp, Homo sapiens
agcagacatatctcatgtcaca

SEQ ID NO: 7827719 - DNA, 22 bp, Homo sapiens
agcagacatggcttggatgtgg

SEQ ID NO: 7827720 - DNA, 22 bp, Homo sapiens
agcagacatatctcatgtcaca

SEQ ID NO: 7827721 - DNA, 22 bp, Homo sapiens
agcagacaggtaggaggataaa

SEQ ID NO: 7827722 - DNA, 22 bp, Homo sapiens
agcagacaggctgccacagtgc

SEQ ID NO: 7827723 - DNA, 22 bp, Homo sapiens
agcagacaggctgccacagtgc

SEQ ID NO: 7827724 - DNA, 22 bp, Homo sapiens
agcagacaggctgccacagtgc

SEQ ID NO: 7827725 - DNA, 22 bp, Homo sapiens
agcagacaggtaggaggataaa

SEQ ID NO: 7827726 - DNA, 21 bp, Homo sapiens
agcagacagcccaagaaaatc

SEQ ID NO: 7827727 - DNA, 21 bp, Homo sapiens
agcagacagcccaagaaaatc

SEQ ID NO: 7827728 - DNA, 21 bp, Homo sapiens
agcagacagatgcacgcacac

SEQ ID NO: 7827729 - DNA, 22 bp, Homo sapiens
caaggccaaagggccactgtca

SEQ ID NO: 7827730 - DNA, 22 bp, Homo sapiens
caagggaaggctaagggcaaca

SEQ ID NO: 7827731 - DNA, 22 bp, Homo sapiens
caagggaaggctaagggcaaca

SEQ ID NO: 7827732 - DNA, 22 bp, Homo sapiens
caagggaaggctaagggcaaca

SEQ ID NO: 7827733 - DNA, 22 bp, Homo sapiens
caagggaaggctaagggcaaca

SEQ ID NO: 7827734 - DNA, 22 bp, Homo sapiens
caagggaaggctaagggcaaca

SEQ ID NO: 7827735 - DNA, 22 bp, Homo sapiens
agcagagacatgaaatatgctt

SEQ ID NO: 7827736 - DNA, 22 bp, Homo sapiens
agcagagaccatatagcccaga

SEQ ID NO: 7827737 - DNA, 22 bp, Homo sapiens
agcagagaccatatagcccaga

SEQ ID NO: 7827738 - DNA, 22 bp, Homo sapiens
caaggcattcttgcaggtaggg

SEQ ID NO: 7827739 - DNA, 22 bp, Homo sapiens
agcagagaccatatagcccaga

SEQ ID NO: 7827740 - DNA, 22 bp, Homo sapiens
agcagacatggcttggatgtgg

SEQ ID NO: 7827741 - DNA, 22 bp, Homo sapiens
agcagacatggcttggatgtgg

SEQ ID NO: 7827742 - DNA, 22 bp, Homo sapiens
agcagacatggcttggatgtgg

SEQ ID NO: 7827743 - DNA, 22 bp, Homo sapiens
agcagacatggcttggatgtgg

SEQ ID NO: 7827744 - DNA, 22 bp, Homo sapiens
agcagaccaggagtgcacaggt

SEQ ID NO: 7827745 - DNA, 22 bp, Homo sapiens
agcagaccaggagtgcacaggt

SEQ ID NO: 7827746 - DNA, 22 bp, Homo sapiens
agcagacatggcttggatgtgg

SEQ ID NO: 7827747 - DNA, 22 bp, Homo sapiens
agcagagaagacacaggcttca

SEQ ID NO: 7827748 - DNA, 22 bp, Homo sapiens
agcagagaagacacaggcttca

SEQ ID NO: 7827749 - DNA, 22 bp, Homo sapiens
agcagacatatctcatgtcaca

SEQ ID NO: 7827750 - DNA, 22 bp, Homo sapiens
agcagagaagacacaggcttca

SEQ ID NO: 7827751 - DNA, 22 bp, Homo sapiens
agcagagaagacacaggcttca

SEQ ID NO: 7827752 - DNA, 22 bp, Homo sapiens
agcagagacatgaaatatgctt

SEQ ID NO: 7827753 - DNA, 22 bp, Homo sapiens
agcagagacatgaaatatgctt

SEQ ID NO: 7827754 - DNA, 22 bp, Homo sapiens
agcagagacatgaaatatgctt

SEQ ID NO: 7827755 - DNA, 22 bp, Homo sapiens
caattttattggtccaaataca

SEQ ID NO: 7827756 - DNA, 22 bp, Homo sapiens
caattttattggtccaaataca

SEQ ID NO: 7827757 - DNA, 22 bp, Homo sapiens
caattttactcttcctcttcca

SEQ ID NO: 7827758 - DNA, 22 bp, Homo sapiens
caatttttaaactatgaagttg

SEQ ID NO: 7827759 - DNA, 22 bp, Homo sapiens
caatttttaaactatgaagttg

SEQ ID NO: 7827760 - DNA, 18 bp, Homo sapiens
caattttacccagtccct

SEQ ID NO: 7827761 - DNA, 22 bp, Homo sapiens
caattttactcttcctcttcca

SEQ ID NO: 7827762 - DNA, 18 bp, Homo sapiens
caattttacccagtccct

SEQ ID NO: 7827763 - DNA, 22 bp, Homo sapiens
caattttactcttcctcttcca

SEQ ID NO: 7827764 - DNA, 22 bp, Homo sapiens
caattttattggtccaaataca

SEQ ID NO: 7827765 - DNA, 22 bp, Homo sapiens
caattttattggtccaaataca

SEQ ID NO: 7827766 - DNA, 22 bp, Homo sapiens
caatttttgtacttatagtact

SEQ ID NO: 7827767 - DNA, 22 bp, Homo sapiens
cacacagaaccgctcgccactt

SEQ ID NO: 7827768 - DNA, 22 bp, Homo sapiens
caatttttgtacttatagtact

SEQ ID NO: 7827769 - DNA, 22 bp, Homo sapiens
cacacatcaacctagacattgt

SEQ ID NO: 7827770 - DNA, 22 bp, Homo sapiens
cacacagaaccgctcgccactt

SEQ ID NO: 7827771 - DNA, 22 bp, Homo sapiens
cacacatcttatcccagttatt

SEQ ID NO: 7827772 - DNA, 22 bp, Homo sapiens
cacacatcttatcccagttatt

SEQ ID NO: 7827773 - DNA, 22 bp, Homo sapiens
cacacatcttatcccagttatt

SEQ ID NO: 7827774 - DNA, 22 bp, Homo sapiens
cacacatcaacctagacattgt

SEQ ID NO: 7827775 - DNA, 19 bp, Homo sapiens
caatttggcagattctccc

SEQ ID NO: 7827776 - DNA, 22 bp, Homo sapiens
caatttgattaataccatactt

SEQ ID NO: 7827777 - DNA, 22 bp, Homo sapiens
caatttcttgttaattctcagg

SEQ ID NO: 7827778 - DNA, 22 bp, Homo sapiens
caatttcttgttaattctcagg

SEQ ID NO: 7827779 - DNA, 22 bp, Homo sapiens
caatttctgggcctcacacaag

SEQ ID NO: 7827780 - DNA, 22 bp, Homo sapiens
caatttcttgttaattctcagg

SEQ ID NO: 7827781 - DNA, 22 bp, Homo sapiens
caatttctgggcctcacacaag

SEQ ID NO: 7827782 - DNA, 22 bp, Homo sapiens
caatttctggaactaattctga

SEQ ID NO: 7827783 - DNA, 22 bp, Homo sapiens
caatttctgggcctcacacaag

SEQ ID NO: 7827784 - DNA, 22 bp, Homo sapiens
caatttctggaactaattctga

SEQ ID NO: 7827785 - DNA, 22 bp, Homo sapiens
caattcaatggcaaagtattgt

SEQ ID NO: 7827786 - DNA, 22 bp, Homo sapiens
caattcaatggcaaagtattgt

SEQ ID NO: 7827787 - DNA, 22 bp, Homo sapiens
caatttctggaactaattctga

SEQ ID NO: 7827788 - DNA, 22 bp, Homo sapiens
caattcaaaccagtctgtctct

SEQ ID NO: 7827789 - DNA, 22 bp, Homo sapiens
cacactttgtgctaatctattt

SEQ ID NO: 7827790 - DNA, 22 bp, Homo sapiens
cacacttttggcatgtttggtt

SEQ ID NO: 7827791 - DNA, 22 bp, Homo sapiens
cacacttttctggctcaggctc

SEQ ID NO: 7827792 - DNA, 22 bp, Homo sapiens
cacagaaaaaggcttgaaaatc

SEQ ID NO: 7827793 - DNA, 22 bp, Homo sapiens
cacagaaaaaggcttgaaaatc

SEQ ID NO: 7827794 - DNA, 22 bp, Homo sapiens
cacagaaaaaggcttgaaaatc

SEQ ID NO: 7827795 - DNA, 22 bp, Homo sapiens
cacagaaaaaggcttgaaaatc

SEQ ID NO: 7827796 - DNA, 22 bp, Homo sapiens
cacagaaaggctcaaatcccaa

SEQ ID NO: 7827797 - DNA, 22 bp, Homo sapiens
cacagaaaggctcaaatcccaa

SEQ ID NO: 7827798 - DNA, 22 bp, Homo sapiens
cacagaaaaaggcttgaaaatc

SEQ ID NO: 7827799 - DNA, 22 bp, Homo sapiens
cacagaaaaaggcttgaaaatc

SEQ ID NO: 7827800 - DNA, 22 bp, Homo sapiens
cacactttcaggtcctctttgc

SEQ ID NO: 7827801 - DNA, 22 bp, Homo sapiens
cacactgttgaggacgagatgt

SEQ ID NO: 7827802 - DNA, 22 bp, Homo sapiens
cacacatgtgtgcagcttagaa

SEQ ID NO: 7827803 - DNA, 22 bp, Homo sapiens
cacactgttgaggacgagatgt

SEQ ID NO: 7827804 - DNA, 22 bp, Homo sapiens
cacacatgtctctccatgctct

SEQ ID NO: 7827805 - DNA, 22 bp, Homo sapiens
cacacatgtctctccatgctct

SEQ ID NO: 7827806 - DNA, 22 bp, Homo sapiens
cacacatgtctctccatgctct

SEQ ID NO: 7827807 - DNA, 22 bp, Homo sapiens
cacacatgtgagcagagaggcg

SEQ ID NO: 7827808 - DNA, 22 bp, Homo sapiens
cacacatgtgagcagagaggcg

SEQ ID NO: 7827809 - DNA, 22 bp, Homo sapiens
cacacatgtgagcagagaggcg

SEQ ID NO: 7827810 - DNA, 22 bp, Homo sapiens
cacacatgtgggatccgcaggg

SEQ ID NO: 7827811 - DNA, 22 bp, Homo sapiens
cacacatgtgggatccgcaggg

SEQ ID NO: 7827812 - DNA, 22 bp, Homo sapiens
cacacatgtctctccatgctct

SEQ ID NO: 7827813 - DNA, 22 bp, Homo sapiens
cacacatgtctctccatgctct

SEQ ID NO: 7827814 - DNA, 22 bp, Homo sapiens
cacacatgtctctccatgctct

SEQ ID NO: 7827815 - DNA, 22 bp, Homo sapiens
cacacatggtcagtggctactc

SEQ ID NO: 7827816 - DNA, 22 bp, Homo sapiens
cacacatggttccgcaggatgc

SEQ ID NO: 7827817 - DNA, 22 bp, Homo sapiens
cacacatggttccgcaggatgc

SEQ ID NO: 7827818 - DNA, 22 bp, Homo sapiens
cacacatggttccgcaggatgc

SEQ ID NO: 7827819 - DNA, 22 bp, Homo sapiens
cacacatggtagcaggtacaag

SEQ ID NO: 7827820 - DNA, 22 bp, Homo sapiens
cacacatggtagcaggtacaag

SEQ ID NO: 7827821 - DNA, 22 bp, Homo sapiens
cacacatggtagcaggtacaag

SEQ ID NO: 7827822 - DNA, 22 bp, Homo sapiens
cacacatggtagcaggtacaag

SEQ ID NO: 7827823 - DNA, 22 bp, Homo sapiens
cacacatggctgccagggaggt

SEQ ID NO: 7827824 - DNA, 22 bp, Homo sapiens
cacacatggctgccagggaggt

SEQ ID NO: 7827825 - DNA, 22 bp, Homo sapiens
cacacatggtagcaggtacaag

SEQ ID NO: 7827826 - DNA, 22 bp, Homo sapiens
cacacatgacccacttttaccg

SEQ ID NO: 7827827 - DNA, 22 bp, Homo sapiens
cacacatgacccacttttaccg

SEQ ID NO: 7827828 - DNA, 22 bp, Homo sapiens
cacacatgagtctccccattgg

SEQ ID NO: 7827829 - DNA, 22 bp, Homo sapiens
cacacatgcatgtaagacctct

SEQ ID NO: 7827830 - DNA, 22 bp, Homo sapiens
cacacatgcatgtaagacctct

SEQ ID NO: 7827831 - DNA, 22 bp, Homo sapiens
cacacatggctgccagggaggt

SEQ ID NO: 7827832 - DNA, 22 bp, Homo sapiens
cacacatggctgccagggaggt

SEQ ID NO: 7827833 - DNA, 22 bp, Homo sapiens
cacacatgaatccctagtacct

SEQ ID NO: 7827834 - DNA, 22 bp, Homo sapiens
cacacatgaagttgctgagcta

SEQ ID NO: 7827835 - DNA, 22 bp, Homo sapiens
cacacatgaagttgctgagcta

SEQ ID NO: 7827836 - DNA, 22 bp, Homo sapiens
cacacatgaagttgctgagcta

SEQ ID NO: 7827837 - DNA, 22 bp, Homo sapiens
cacacatgaagttgctgagcta

SEQ ID NO: 7827838 - DNA, 22 bp, Homo sapiens
cacagctggggaagctgaggcc

SEQ ID NO: 7827839 - DNA, 22 bp, Homo sapiens
cacagctggggaagctgaggcc

SEQ ID NO: 7827840 - DNA, 22 bp, Homo sapiens
cacagctggggaagctgaggcc

SEQ ID NO: 7827841 - DNA, 22 bp, Homo sapiens
cacagctggtgacagagcccag

SEQ ID NO: 7827842 - DNA, 22 bp, Homo sapiens
cacaggaaaaatgggtccttta

SEQ ID NO: 7827843 - DNA, 22 bp, Homo sapiens
cacaggaaaaatgggtccttta

SEQ ID NO: 7827844 - DNA, 22 bp, Homo sapiens
cacagctggggaagctgaggcc

SEQ ID NO: 7827845 - DNA, 22 bp, Homo sapiens
cacagctgggaaaatttgtaca

SEQ ID NO: 7827846 - DNA, 19 bp, Homo sapiens
cacagctggcgctgaccgc

SEQ ID NO: 7827847 - DNA, 22 bp, Homo sapiens
cacagctggaatggggtacctg

SEQ ID NO: 7827848 - DNA, 22 bp, Homo sapiens
cacagctggaatggggtacctg

SEQ ID NO: 7827849 - DNA, 19 bp, Homo sapiens
cacagctggcgctgaccgc

SEQ ID NO: 7827850 - DNA, 19 bp, Homo sapiens
cacagctggcgctgaccgc

SEQ ID NO: 7827851 - DNA, 19 bp, Homo sapiens
cacagctggcgctgaccgc

SEQ ID NO: 7827852 - DNA, 20 bp, Homo sapiens
cacaggaaagctactcagtt

SEQ ID NO: 7827853 - DNA, 20 bp, Homo sapiens
cacaggaaagctactcagtt

SEQ ID NO: 7827854 - DNA, 20 bp, Homo sapiens
cacaggaaagctactcagtt

SEQ ID NO: 7827855 - DNA, 22 bp, Homo sapiens
cacaggaaaataaaagatctaa

SEQ ID NO: 7827856 - DNA, 22 bp, Homo sapiens
cacaggaaaataaaagatctaa

SEQ ID NO: 7827857 - DNA, 22 bp, Homo sapiens
cacaggaaaataaaagatctaa

SEQ ID NO: 7827858 - DNA, 22 bp, Homo sapiens
cacaggaaaataaaagatctaa

SEQ ID NO: 7827859 - DNA, 22 bp, Homo sapiens
cacaggaaagtcagccagaaga

SEQ ID NO: 7827860 - DNA, 22 bp, Homo sapiens
cacaggaaagtcagccagaaga

SEQ ID NO: 7827861 - DNA, 22 bp, Homo sapiens
cacaggaaagtcagccagaaga

SEQ ID NO: 7827862 - DNA, 22 bp, Homo sapiens
cacaggaaagtcagccagaaga

SEQ ID NO: 7827863 - DNA, 22 bp, Homo sapiens
cacaggaaatattaggagggat

SEQ ID NO: 7827864 - DNA, 22 bp, Homo sapiens
cacaggaaatattaggagggat

SEQ ID NO: 7827865 - DNA, 20 bp, Homo sapiens
cacaggaaagctactcagtt

SEQ ID NO: 7827866 - DNA, 22 bp, Homo sapiens
agcaggccactgcagctggagc

SEQ ID NO: 7827867 - DNA, 22 bp, Homo sapiens
agcaggccactgcagctggagc

SEQ ID NO: 7827868 - DNA, 22 bp, Homo sapiens
agcaggcaggctgccagtgaat

SEQ ID NO: 7827869 - DNA, 22 bp, Homo sapiens
cacaggaagcaagcctggggcc

SEQ ID NO: 7827870 - DNA, 22 bp, Homo sapiens
agcaggcaggcccagcggctgg

SEQ ID NO: 7827871 - DNA, 22 bp, Homo sapiens
agcaggcaggcccagcggctgg

SEQ ID NO: 7827872 - DNA, 22 bp, Homo sapiens
cacaggaagaggtatacaattc

SEQ ID NO: 7827873 - DNA, 22 bp, Homo sapiens
cacaggaagaggtatacaattc

SEQ ID NO: 7827874 - DNA, 22 bp, Homo sapiens
cacaggaagaggtatacaattc

SEQ ID NO: 7827875 - DNA, 22 bp, Homo sapiens
cacaggaagatctcccagaggt

SEQ ID NO: 7827876 - DNA, 22 bp, Homo sapiens
cacaggaagatctcccagaggt

SEQ ID NO: 7827877 - DNA, 22 bp, Homo sapiens
cacaggaagatctcccagaggt

SEQ ID NO: 7827878 - DNA, 22 bp, Homo sapiens
cacaggaaatgattctgcagca

SEQ ID NO: 7827879 - DNA, 22 bp, Homo sapiens
cacaggaaatgattctgcagca

SEQ ID NO: 7827880 - DNA, 22 bp, Homo sapiens
cacaggaaatgattctgcagca

SEQ ID NO: 7827881 - DNA, 22 bp, Homo sapiens
cacaggaacaaagaagacaatt

SEQ ID NO: 7827882 - DNA, 22 bp, Homo sapiens
cacaggaaatgattctgcagca

SEQ ID NO: 7827883 - DNA, 22 bp, Homo sapiens
cacaggaaatgattctgcagca

SEQ ID NO: 7827884 - DNA, 22 bp, Homo sapiens
cacaggaacaaagaagacaatt

SEQ ID NO: 7827885 - DNA, 22 bp, Homo sapiens
cacaggaacaaagaagacaatt

SEQ ID NO: 7827886 - DNA, 22 bp, Homo sapiens
cacaggaacaaagaagacaatt

SEQ ID NO: 7827887 - DNA, 22 bp, Homo sapiens
cacaggaacaaagaagacaatt

SEQ ID NO: 7827888 - DNA, 22 bp, Homo sapiens
cacaggaacttactggccactt

SEQ ID NO: 7827889 - DNA, 22 bp, Homo sapiens
cacaggaacttactggccactt

SEQ ID NO: 7827890 - DNA, 22 bp, Homo sapiens
cacaggaacttactggccactt

SEQ ID NO: 7827891 - DNA, 22 bp, Homo sapiens
cacagctgccctactccatgtg

SEQ ID NO: 7827892 - DNA, 22 bp, Homo sapiens
cacagctgccctactccatgtg

SEQ ID NO: 7827893 - DNA, 22 bp, Homo sapiens
cacagctgccctactccatgtg

SEQ ID NO: 7827894 - DNA, 22 bp, Homo sapiens
cacagctgcttgttagaatagc

SEQ ID NO: 7827895 - DNA, 22 bp, Homo sapiens
cacagctgccctactccatgtg

SEQ ID NO: 7827896 - DNA, 22 bp, Homo sapiens
cacagctgccccctctctaact

SEQ ID NO: 7827897 - DNA, 22 bp, Homo sapiens
cacagctgccccctctctaact

SEQ ID NO: 7827898 - DNA, 22 bp, Homo sapiens
cacagctgccctaactgtactc

SEQ ID NO: 7827899 - DNA, 22 bp, Homo sapiens
cacagctgccctaactgtactc

SEQ ID NO: 7827900 - DNA, 22 bp, Homo sapiens
cacagctgccctactccatgtg

SEQ ID NO: 7827901 - DNA, 22 bp, Homo sapiens
cacagctgccctactccatgtg

SEQ ID NO: 7827902 - DNA, 22 bp, Homo sapiens
cacagctgccctaactgtactc

SEQ ID NO: 7827903 - DNA, 22 bp, Homo sapiens
cacagctgccccctctctaact

SEQ ID NO: 7827904 - DNA, 22 bp, Homo sapiens
cacagctgccatgcagtcagtg

SEQ ID NO: 7827905 - DNA, 22 bp, Homo sapiens
cacagctgccatgcagtcagtg

SEQ ID NO: 7827906 - DNA, 22 bp, Homo sapiens
cacagctgccatgcagtcagtg

SEQ ID NO: 7827907 - DNA, 22 bp, Homo sapiens
cacagctgccatgcagtcagtg

SEQ ID NO: 7827908 - DNA, 22 bp, Homo sapiens
cacagctgcacagaggaggtgc

SEQ ID NO: 7827909 - DNA, 22 bp, Homo sapiens
cacagctgccatgcagtcagtg

SEQ ID NO: 7827910 - DNA, 22 bp, Homo sapiens
cacagctgccatggctgcactt

SEQ ID NO: 7827911 - DNA, 22 bp, Homo sapiens
cacagctgccatggctgcactt

SEQ ID NO: 7827912 - DNA, 22 bp, Homo sapiens
cacagctgccatgcagtcagtg

SEQ ID NO: 7827913 - DNA, 22 bp, Homo sapiens
cacagctgccatgcagtcagtg

SEQ ID NO: 7827914 - DNA, 22 bp, Homo sapiens
cacagctgccatggctgcactt

SEQ ID NO: 7827915 - DNA, 22 bp, Homo sapiens
cacagctgccatggctgcactt

SEQ ID NO: 7827916 - DNA, 22 bp, Homo sapiens
cacagctgccatggctgcactt

SEQ ID NO: 7827917 - DNA, 22 bp, Homo sapiens
cacagctgccatggctgcactt

SEQ ID NO: 7827918 - DNA, 22 bp, Homo sapiens
cacagctgaccaccctgctccc

SEQ ID NO: 7827919 - DNA, 22 bp, Homo sapiens
cacagctgaccaccctgctccc

SEQ ID NO: 7827920 - DNA, 22 bp, Homo sapiens
cacagcaggcactatacagggc

SEQ ID NO: 7827921 - DNA, 22 bp, Homo sapiens
cacagctgaccaccctgctccc

SEQ ID NO: 7827922 - DNA, 22 bp, Homo sapiens
cacagctgaccaccctgctccc

SEQ ID NO: 7827923 - DNA, 22 bp, Homo sapiens
cacagcagccagaacatttttg

SEQ ID NO: 7827924 - DNA, 22 bp, Homo sapiens
cacagcagcgttcctccgtgtg

SEQ ID NO: 7827925 - DNA, 22 bp, Homo sapiens
cacagcagcgttcctccgtgtg

SEQ ID NO: 7827926 - DNA, 22 bp, Homo sapiens
cacagcagcgttcctccgtgtg

SEQ ID NO: 7827927 - DNA, 22 bp, Homo sapiens
cacagaacaccaaagaaccttc

SEQ ID NO: 7827928 - DNA, 22 bp, Homo sapiens
cacagcagcatcatttatctgg

SEQ ID NO: 7827929 - DNA, 22 bp, Homo sapiens
cacagcagccagaacatttttg

SEQ ID NO: 7827930 - DNA, 22 bp, Homo sapiens
cacagaacaccaaagaaccttc

SEQ ID NO: 7827931 - DNA, 20 bp, Homo sapiens
cacagaacaaattgcaggac

SEQ ID NO: 7827932 - DNA, 22 bp, Homo sapiens
cacagaacaccaaagaaccttc

SEQ ID NO: 7827933 - DNA, 22 bp, Homo sapiens
cacagaaaggctcaaatcccaa

SEQ ID NO: 7827934 - DNA, 22 bp, Homo sapiens
cacagaaaggctcaaatcccaa

SEQ ID NO: 7827935 - DNA, 22 bp, Homo sapiens
cacagaaatattgtgtcccttg

SEQ ID NO: 7827936 - DNA, 22 bp, Homo sapiens
cacagaaatattgtgtcccttg

SEQ ID NO: 7827937 - DNA, 22 bp, Homo sapiens
cacagaaatattgtgtcccttg

SEQ ID NO: 7827938 - DNA, 22 bp, Homo sapiens
cacagaaatattgtgtcccttg

SEQ ID NO: 7827939 - DNA, 22 bp, Homo sapiens
cacagaaatattgtgtcccttg

SEQ ID NO: 7827940 - DNA, 22 bp, Homo sapiens
cacagaaatattgtgtcccttg

SEQ ID NO: 7827941 - DNA, 22 bp, Homo sapiens
cacagaaatattgtgtcccttg

SEQ ID NO: 7827942 - DNA, 22 bp, Homo sapiens
cacagaaattattaggatgctt

SEQ ID NO: 7827943 - DNA, 22 bp, Homo sapiens
cacagaaatattgtgtcccttg

SEQ ID NO: 7827944 - DNA, 22 bp, Homo sapiens
cacagaaattattaggatgctt

SEQ ID NO: 7827945 - DNA, 22 bp, Homo sapiens
cacagaaattattaggatgctt

SEQ ID NO: 7827946 - DNA, 22 bp, Homo sapiens
cacagaaattattaggatgctt

SEQ ID NO: 7827947 - DNA, 20 bp, Homo sapiens
cacagaacaaattgcaggac

SEQ ID NO: 7827948 - DNA, 20 bp, Homo sapiens
cacagaacaaattgcaggac

SEQ ID NO: 7827949 - DNA, 22 bp, Homo sapiens
cacagaaattattaggatgctt

SEQ ID NO: 7827950 - DNA, 22 bp, Homo sapiens
cacagaaattattaggatgctt

SEQ ID NO: 7827951 - DNA, 18 bp, Homo sapiens
agcaggcgttgcctggga

SEQ ID NO: 7827952 - DNA, 20 bp, Homo sapiens
agcaggccttggggagagga

SEQ ID NO: 7827953 - DNA, 20 bp, Homo sapiens
agcaggccttggggagagga

SEQ ID NO: 7827954 - DNA, 20 bp, Homo sapiens
agcaggccttggggagagga

SEQ ID NO: 7827955 - DNA, 20 bp, Homo sapiens
agcaggccttggggagagga

SEQ ID NO: 7827956 - DNA, 20 bp, Homo sapiens
agcaggccttggggagagga

SEQ ID NO: 7827957 - DNA, 22 bp, Homo sapiens
agcaggctaatcttgctgaaca

SEQ ID NO: 7827958 - DNA, 22 bp, Homo sapiens
agcaggctactcctgtgttcgt

SEQ ID NO: 7827959 - DNA, 21 bp, Homo sapiens
agcaggcccaatggagggggc

SEQ ID NO: 7827960 - DNA, 22 bp, Homo sapiens
agcaggcccagggcttctcagc

SEQ ID NO: 7827961 - DNA, 22 bp, Homo sapiens
agcaggcctcatgcaccagcta

SEQ ID NO: 7827962 - DNA, 22 bp, Homo sapiens
agcaggcctgccacctcggggt

SEQ ID NO: 7827963 - DNA, 22 bp, Homo sapiens
agcaggcctcatgcaccagcta

SEQ ID NO: 7827964 - DNA, 22 bp, Homo sapiens
agcaggcctcatgcaccagcta

SEQ ID NO: 7827965 - DNA, 22 bp, Homo sapiens
agcaggcccaagctggggggaa

SEQ ID NO: 7827966 - DNA, 22 bp, Homo sapiens
agcaggcccaagctggggggaa

SEQ ID NO: 7827967 - DNA, 21 bp, Homo sapiens
agcaggcccaatggagggggc

SEQ ID NO: 7827968 - DNA, 19 bp, Homo sapiens
agcaggccaggcaggtggc

SEQ ID NO: 7827969 - DNA, 19 bp, Homo sapiens
agcaggccaggcaggtggc

SEQ ID NO: 7827970 - DNA, 19 bp, Homo sapiens
agcaggccaggcaggtggc

SEQ ID NO: 7827971 - DNA, 22 bp, Homo sapiens
agcaggcaggcccagcggctgg

SEQ ID NO: 7827972 - DNA, 19 bp, Homo sapiens
agcaggccaggcaggtggc

SEQ ID NO: 7827973 - DNA, 19 bp, Homo sapiens
agcaggccaggcaggtggc

SEQ ID NO: 7827974 - DNA, 19 bp, Homo sapiens
agcaggccaggcaggtggc

SEQ ID NO: 7827975 - DNA, 22 bp, Homo sapiens
cacaggctccggccttgcagcc

SEQ ID NO: 7827976 - DNA, 22 bp, Homo sapiens
cacaggctccggccttgcagcc

SEQ ID NO: 7827977 - DNA, 22 bp, Homo sapiens
cacaggctccggccttgcagcc

SEQ ID NO: 7827978 - DNA, 22 bp, Homo sapiens
cacaggctccggccttgcagcc

SEQ ID NO: 7827979 - DNA, 22 bp, Homo sapiens
cacaggctccggccttgcagcc

SEQ ID NO: 7827980 - DNA, 18 bp, Homo sapiens
cacaggctcccagtgagg

SEQ ID NO: 7827981 - DNA, 20 bp, Homo sapiens
cacaggctatatgagagcca

SEQ ID NO: 7827982 - DNA, 18 bp, Homo sapiens
cacaggctcccagtgagg

SEQ ID NO: 7827983 - DNA, 20 bp, Homo sapiens
cacaggctatatgagagcca

SEQ ID NO: 7827984 - DNA, 19 bp, Homo sapiens
agcaggctaggctgcctct

SEQ ID NO: 7827985 - DNA, 19 bp, Homo sapiens
agcaggctaggctgcctct

SEQ ID NO: 7827986 - DNA, 22 bp, Homo sapiens
agcaggctaggaacctcactgc

SEQ ID NO: 7827987 - DNA, 22 bp, Homo sapiens
agcaggctaggaacctcactgc

SEQ ID NO: 7827988 - DNA, 22 bp, Homo sapiens
agcaggctaggaacctcactgc

SEQ ID NO: 7827989 - DNA, 20 bp, Homo sapiens
cacaggctatatgagagcca

SEQ ID NO: 7827990 - DNA, 19 bp, Homo sapiens
agcaggctaggctgcctct

SEQ ID NO: 7827991 - DNA, 19 bp, Homo sapiens
agcaggctaggctgcctct

SEQ ID NO: 7827992 - DNA, 22 bp, Homo sapiens
cacatggcctgtgtggccagac

SEQ ID NO: 7827993 - DNA, 22 bp, Homo sapiens
cacatggcctgtgtggccagac

SEQ ID NO: 7827994 - DNA, 22 bp, Homo sapiens
cacatgggcacagagaacttgg

SEQ ID NO: 7827995 - DNA, 22 bp, Homo sapiens
cacatggcctgtgtggccagac

SEQ ID NO: 7827996 - DNA, 22 bp, Homo sapiens
cacatgggcacagagaacttgg

SEQ ID NO: 7827997 - DNA, 22 bp, Homo sapiens
cacatgggcgtaatgtccatgg

SEQ ID NO: 7827998 - DNA, 22 bp, Homo sapiens
cacatgggcttagcaggcaggg

SEQ ID NO: 7827999 - DNA, 22 bp, Homo sapiens
cacatgggtggatggatgcatg

SEQ ID NO: 7828000 - DNA, 22 bp, Homo sapiens
cacatggggcgctgcattggcc

SEQ ID NO: 7828001 - DNA, 22 bp, Homo sapiens
cacatggggcgctgcattggcc

SEQ ID NO: 7828002 - DNA, 22 bp, Homo sapiens
cacatgggcttagcaggcaggg

SEQ ID NO: 7828003 - DNA, 22 bp, Homo sapiens
cacatgggcttagcaggcaggg

SEQ ID NO: 7828004 - DNA, 22 bp, Homo sapiens
cacatgggtgtgcctggaggaa

SEQ ID NO: 7828005 - DNA, 22 bp, Homo sapiens
cacatggtggtgcttgataagc

SEQ ID NO: 7828006 - DNA, 22 bp, Homo sapiens
cacatggttatatttgtaaagc

SEQ ID NO: 7828007 - DNA, 22 bp, Homo sapiens
cacatgtacagaagcaggctgg

SEQ ID NO: 7828008 - DNA, 22 bp, Homo sapiens
cacatgtacagaagcaggctgg

SEQ ID NO: 7828009 - DNA, 22 bp, Homo sapiens
cacatgtagtaagcaggcaatg

SEQ ID NO: 7828010 - DNA, 22 bp, Homo sapiens
cacatgtagtaagcaggcaatg

SEQ ID NO: 7828011 - DNA, 17 bp, Homo sapiens
cacatgtctacatggat

SEQ ID NO: 7828012 - DNA, 22 bp, Homo sapiens
cacatgtcctgggaaaataact

SEQ ID NO: 7828013 - DNA, 22 bp, Homo sapiens
cacatgtcctggcgctgagccc

SEQ ID NO: 7828014 - DNA, 22 bp, Homo sapiens
cacatgtcctggcgctgagccc

SEQ ID NO: 7828015 - DNA, 22 bp, Homo sapiens
cacatgtagtaagcaggcaatg

SEQ ID NO: 7828016 - DNA, 22 bp, Homo sapiens
cacaggctgcccgcagctggga

SEQ ID NO: 7828017 - DNA, 22 bp, Homo sapiens
cacaggctgcccgcagctggga

SEQ ID NO: 7828018 - DNA, 22 bp, Homo sapiens
cacaggctgcccgcagctggga

SEQ ID NO: 7828019 - DNA, 22 bp, Homo sapiens
cacaggctgcccgcagctggga

SEQ ID NO: 7828020 - DNA, 22 bp, Homo sapiens
cacaggctgcccgcagctggga

SEQ ID NO: 7828021 - DNA, 22 bp, Homo sapiens
cacaggctctccagggcctgga

SEQ ID NO: 7828022 - DNA, 22 bp, Homo sapiens
cacaggctctccagggcctgga

SEQ ID NO: 7828023 - DNA, 22 bp, Homo sapiens
cacatgaagagagtctagtaat

SEQ ID NO: 7828024 - DNA, 22 bp, Homo sapiens
cacatgcttcttttgattatga

SEQ ID NO: 7828025 - DNA, 23 bp, Homo sapiens
cacatggaatcttcagagtcacc

SEQ ID NO: 7828026 - DNA, 23 bp, Homo sapiens
cacatggaatcttcagagtcacc

SEQ ID NO: 7828027 - DNA, 22 bp, Homo sapiens
cacatggaagagatacagtgag

SEQ ID NO: 7828028 - DNA, 23 bp, Homo sapiens
cacatggattaaatgagaccaca

SEQ ID NO: 7828029 - DNA, 22 bp, Homo sapiens
cacatggcagaatcatgcatct

SEQ ID NO: 7828030 - DNA, 22 bp, Homo sapiens
cacatggcagaatcatgcatct

SEQ ID NO: 7828031 - DNA, 22 bp, Homo sapiens
cacatggcagaatcatgcatct

SEQ ID NO: 7828032 - DNA, 22 bp, Homo sapiens
agcaggtggatttagacgggag

SEQ ID NO: 7828033 - DNA, 22 bp, Homo sapiens
agcaggtggccacgaggaggag

SEQ ID NO: 7828034 - DNA, 22 bp, Homo sapiens
agcaggtggccacgaggaggag

SEQ ID NO: 7828035 - DNA, 22 bp, Homo sapiens
agcaggtggcctcctgtctgtc

SEQ ID NO: 7828036 - DNA, 22 bp, Homo sapiens
agcaggtggcctcctgtctgtc

SEQ ID NO: 7828037 - DNA, 22 bp, Homo sapiens
agcaggtggccacgaggaggag

SEQ ID NO: 7828038 - DNA, 22 bp, Homo sapiens
agcaggtggccacgaggaggag

SEQ ID NO: 7828039 - DNA, 22 bp, Homo sapiens
agcaggtggccacgaggaggag

SEQ ID NO: 7828040 - DNA, 22 bp, Homo sapiens
agcaggtgggatcaagctggca

SEQ ID NO: 7828041 - DNA, 22 bp, Homo sapiens
agcaggtgggatcaagctggca

SEQ ID NO: 7828042 - DNA, 22 bp, Homo sapiens
agcaggtgggatcaagctggca

SEQ ID NO: 7828043 - DNA, 18 bp, Homo sapiens
agcaggtggcgtctgcag

SEQ ID NO: 7828044 - DNA, 22 bp, Homo sapiens
agcaggtggcctcctgtctgtc

SEQ ID NO: 7828045 - DNA, 22 bp, Homo sapiens
cactgaaatcgaaaaatgtagg

SEQ ID NO: 7828046 - DNA, 22 bp, Homo sapiens
agcaggtgggatcaagctggca

SEQ ID NO: 7828047 - DNA, 22 bp, Homo sapiens
agcaggtgggcatgaaagctga

SEQ ID NO: 7828048 - DNA, 22 bp, Homo sapiens
cactagaaccaatgacatttct

SEQ ID NO: 7828049 - DNA, 22 bp, Homo sapiens
cactagaaccaatgacatttct

SEQ ID NO: 7828050 - DNA, 22 bp, Homo sapiens
cactagaaaggtacagattatg

SEQ ID NO: 7828051 - DNA, 22 bp, Homo sapiens
cactagaaaggtacagattatg

SEQ ID NO: 7828052 - DNA, 22 bp, Homo sapiens
cactagaaaggtacagattatg

SEQ ID NO: 7828053 - DNA, 22 bp, Homo sapiens
agcaggtggacagaggaagaaa

SEQ ID NO: 7828054 - DNA, 22 bp, Homo sapiens
agcaggtggatttagacgggag

SEQ ID NO: 7828055 - DNA, 22 bp, Homo sapiens
cactaggctggagtgcagtggc

SEQ ID NO: 7828056 - DNA, 22 bp, Homo sapiens
agcaggtggacagaggaagaaa

SEQ ID NO: 7828057 - DNA, 22 bp, Homo sapiens
cactagatgataatcagctgga

SEQ ID NO: 7828058 - DNA, 22 bp, Homo sapiens
cactaggaagggatcagcctca

SEQ ID NO: 7828059 - DNA, 22 bp, Homo sapiens
cactaagttggtgttaattagt

SEQ ID NO: 7828060 - DNA, 22 bp, Homo sapiens
cactaattaacacgtcgtctct

SEQ ID NO: 7828061 - DNA, 22 bp, Homo sapiens
cactaattaatgaaattccagg

SEQ ID NO: 7828062 - DNA, 22 bp, Homo sapiens
cactaattaatgaaattccagg

SEQ ID NO: 7828063 - DNA, 22 bp, Homo sapiens
cactaattctggagacaactca

SEQ ID NO: 7828064 - DNA, 22 bp, Homo sapiens
cactacaggggtccacagctga

SEQ ID NO: 7828065 - DNA, 22 bp, Homo sapiens
cactacaggggtccacagctga

SEQ ID NO: 7828066 - DNA, 22 bp, Homo sapiens
cactaattacaaagagatggga

SEQ ID NO: 7828067 - DNA, 22 bp, Homo sapiens
cactaattctggagacaactca

SEQ ID NO: 7828068 - DNA, 22 bp, Homo sapiens
cacatttaagtgcttgttcaga

SEQ ID NO: 7828069 - DNA, 22 bp, Homo sapiens
cacatttaagtgcttgttcaga

SEQ ID NO: 7828070 - DNA, 22 bp, Homo sapiens
cacatttaagtgcttgttcaga

SEQ ID NO: 7828071 - DNA, 22 bp, Homo sapiens
cacatttaagtgcttgttcaga

SEQ ID NO: 7828072 - DNA, 22 bp, Homo sapiens
cacatttaagtgcttgttcaga

SEQ ID NO: 7828073 - DNA, 22 bp, Homo sapiens
cacctgcagggggagtcaagag

SEQ ID NO: 7828074 - DNA, 22 bp, Homo sapiens
cacctgcagggggagtcaagag

SEQ ID NO: 7828075 - DNA, 22 bp, Homo sapiens
cacggcctgtaaggacccagga

SEQ ID NO: 7828076 - DNA, 22 bp, Homo sapiens
cacctgccaaatggggatgctg

SEQ ID NO: 7828077 - DNA, 22 bp, Homo sapiens
cacctgcaaggagctttcattt

SEQ ID NO: 7828078 - DNA, 22 bp, Homo sapiens
cacctgagtgtcagtattctca

SEQ ID NO: 7828079 - DNA, 22 bp, Homo sapiens
cacctgagcactggggccgccc

SEQ ID NO: 7828080 - DNA, 22 bp, Homo sapiens
cactaaaactacattggaaaca

SEQ ID NO: 7828081 - DNA, 22 bp, Homo sapiens
cacgttaacagctaacagatga

SEQ ID NO: 7828082 - DNA, 22 bp, Homo sapiens
cactaaaactacattggaaaca

SEQ ID NO: 7828083 - DNA, 22 bp, Homo sapiens
cactaaaactacattggaaaca

SEQ ID NO: 7828084 - DNA, 22 bp, Homo sapiens
cacgtgagaccttgcagaggtg

SEQ ID NO: 7828085 - DNA, 22 bp, Homo sapiens
cacgttaacagctaacagatga

SEQ ID NO: 7828086 - DNA, 22 bp, Homo sapiens
cacgtttgcatagctgatgttg

SEQ ID NO: 7828087 - DNA, 22 bp, Homo sapiens
cacgtccacccaggctgcccag

SEQ ID NO: 7828088 - DNA, 22 bp, Homo sapiens
cacgggcagtgagcacagcctg

SEQ ID NO: 7828089 - DNA, 22 bp, Homo sapiens
cacgggagacgtgatcttggac

SEQ ID NO: 7828090 - DNA, 22 bp, Homo sapiens
cacgggtggaatcagggactcc

SEQ ID NO: 7828091 - DNA, 22 bp, Homo sapiens
cacgggtggaatcagggactcc

SEQ ID NO: 7828092 - DNA, 22 bp, Homo sapiens
cacgggcagtgagcacagcctg

SEQ ID NO: 7828093 - DNA, 22 bp, Homo sapiens
cacgggctgtttccatgcaaaa

SEQ ID NO: 7828094 - DNA, 22 bp, Homo sapiens
cacattggcaaacggggttgca

SEQ ID NO: 7828095 - DNA, 22 bp, Homo sapiens
cacattgctcatggctggatgc

SEQ ID NO: 7828096 - DNA, 22 bp, Homo sapiens
cacattgctccacagggttaac

SEQ ID NO: 7828097 - DNA, 22 bp, Homo sapiens
cacattgctaggctcttcctca

SEQ ID NO: 7828098 - DNA, 21 bp, Homo sapiens
cacattgcccctccacctcct

SEQ ID NO: 7828099 - DNA, 22 bp, Homo sapiens
cacattgcaggttgagaaggtg

SEQ ID NO: 7828100 - DNA, 22 bp, Homo sapiens
cacattgcagacgtatattatt

SEQ ID NO: 7828101 - DNA, 22 bp, Homo sapiens
cacattgcagcttcttttggct

SEQ ID NO: 7828102 - DNA, 22 bp, Homo sapiens
cacattgtagagattagaaaga

SEQ ID NO: 7828103 - DNA, 22 bp, Homo sapiens
cacattgtagagattagaaaga

SEQ ID NO: 7828104 - DNA, 22 bp, Homo sapiens
cacattgtaggtctcagctctt

SEQ ID NO: 7828105 - DNA, 22 bp, Homo sapiens
cacattgtaggtctcagctctt

SEQ ID NO: 7828106 - DNA, 21 bp, Homo sapiens
cacattgttccaggtttgggt

SEQ ID NO: 7828107 - DNA, 22 bp, Homo sapiens
cacatttaaaaaatccacgatc

SEQ ID NO: 7828108 - DNA, 22 bp, Homo sapiens
cacatttaaaggttgaagctga

SEQ ID NO: 7828109 - DNA, 22 bp, Homo sapiens
cacatttaaaggttgaagctga

SEQ ID NO: 7828110 - DNA, 22 bp, Homo sapiens
cacatttaagcagatgtggacc

SEQ ID NO: 7828111 - DNA, 22 bp, Homo sapiens
cacatttaagcagatgtggacc

SEQ ID NO: 7828112 - DNA, 22 bp, Homo sapiens
cacatttaaaggttgaagctga

SEQ ID NO: 7828113 - DNA, 22 bp, Homo sapiens
cactgcactccatcctgggaaa

SEQ ID NO: 7828114 - DNA, 22 bp, Homo sapiens
cactgcactccatcctgggaaa

SEQ ID NO: 7828115 - DNA, 22 bp, Homo sapiens
cactgcactccatcctgggaaa

SEQ ID NO: 7828116 - DNA, 22 bp, Homo sapiens
cactgcactccatcctgggaaa

SEQ ID NO: 7828117 - DNA, 22 bp, Homo sapiens
cactgcactccatcctgggaaa

SEQ ID NO: 7828118 - DNA, 22 bp, Homo sapiens
cactgcactccatcctgggaaa

SEQ ID NO: 7828119 - DNA, 22 bp, Homo sapiens
cactgcactccatcctgggaaa

SEQ ID NO: 7828120 - DNA, 22 bp, Homo sapiens
cactgcactccatcctgggaaa

SEQ ID NO: 7828121 - DNA, 22 bp, Homo sapiens
cactgcactccatcctgggaaa

SEQ ID NO: 7828122 - DNA, 22 bp, Homo sapiens
cactgcactccatcctgggaaa

SEQ ID NO: 7828123 - DNA, 22 bp, Homo sapiens
cactgcactccatcctgggaaa

SEQ ID NO: 7828124 - DNA, 22 bp, Homo sapiens
cactgcactccagcccgggcaa

SEQ ID NO: 7828125 - DNA, 22 bp, Homo sapiens
cactgcactccagcccgggcaa

SEQ ID NO: 7828126 - DNA, 22 bp, Homo sapiens
cactgcactccagcccgggcaa

SEQ ID NO: 7828127 - DNA, 22 bp, Homo sapiens
cactgcactccagcccgggcaa

SEQ ID NO: 7828128 - DNA, 22 bp, Homo sapiens
cactgcactccagcccgggcaa

SEQ ID NO: 7828129 - DNA, 22 bp, Homo sapiens
cactgcactccatcctgggaaa

SEQ ID NO: 7828130 - DNA, 22 bp, Homo sapiens
cactgcactccagcccgggcaa

SEQ ID NO: 7828131 - DNA, 22 bp, Homo sapiens
cactgcactccagcccgggcaa

SEQ ID NO: 7828132 - DNA, 22 bp, Homo sapiens
cactgcactccagcactccagc

SEQ ID NO: 7828133 - DNA, 22 bp, Homo sapiens
cactgcactccagcccgggcaa

SEQ ID NO: 7828134 - DNA, 22 bp, Homo sapiens
cactgcactccagcccgggcaa

SEQ ID NO: 7828135 - DNA, 22 bp, Homo sapiens
cactgcactccagcccgggcaa

SEQ ID NO: 7828136 - DNA, 22 bp, Homo sapiens
cactgcactccagcccgggcaa

SEQ ID NO: 7828137 - DNA, 22 bp, Homo sapiens
cactgcacaatgtagcaaagaa

SEQ ID NO: 7828138 - DNA, 22 bp, Homo sapiens
cactgcaagctctgccacctgg

SEQ ID NO: 7828139 - DNA, 22 bp, Homo sapiens
cactgcactccagcactccagc

SEQ ID NO: 7828140 - DNA, 22 bp, Homo sapiens
cactgcaacctctgccacctgg

SEQ ID NO: 7828141 - DNA, 22 bp, Homo sapiens
cactgcaacctccatcttctgg

SEQ ID NO: 7828142 - DNA, 22 bp, Homo sapiens
cactgcaacctccatcttctgg

SEQ ID NO: 7828143 - DNA, 22 bp, Homo sapiens
cactgcaacctccacctcctgg

SEQ ID NO: 7828144 - DNA, 22 bp, Homo sapiens
cactgcaacctccacctcctgg

SEQ ID NO: 7828145 - DNA, 22 bp, Homo sapiens
cactgcaacctccacctcctgg

SEQ ID NO: 7828146 - DNA, 22 bp, Homo sapiens
cactgcaacctccacctcctgg

SEQ ID NO: 7828147 - DNA, 22 bp, Homo sapiens
agcatttagtctttattgcagc

SEQ ID NO: 7828148 - DNA, 22 bp, Homo sapiens
agcatttagttagtaaatgttt

SEQ ID NO: 7828149 - DNA, 22 bp, Homo sapiens
agcatttagttagtaaatgttt

SEQ ID NO: 7828150 - DNA, 22 bp, Homo sapiens
agcatttatcttttgtttgagt

SEQ ID NO: 7828151 - DNA, 22 bp, Homo sapiens
agcatttatgactaatgtaaaa

SEQ ID NO: 7828152 - DNA, 22 bp, Homo sapiens
agcatttatgactaatgtaaaa

SEQ ID NO: 7828153 - DNA, 22 bp, Homo sapiens
agcatttatgactaatgtaaaa

SEQ ID NO: 7828154 - DNA, 22 bp, Homo sapiens
agcatttatcttttgtttgagt

SEQ ID NO: 7828155 - DNA, 22 bp, Homo sapiens
agcatttatagataccctatgg

SEQ ID NO: 7828156 - DNA, 22 bp, Homo sapiens
agcatttatttcttagaaattg

SEQ ID NO: 7828157 - DNA, 22 bp, Homo sapiens
agcatttatttcttagaaattg

SEQ ID NO: 7828158 - DNA, 22 bp, Homo sapiens
agcatttgatatgtttaaaaag

SEQ ID NO: 7828159 - DNA, 22 bp, Homo sapiens
agcatttgaaaactatttaatt

SEQ ID NO: 7828160 - DNA, 22 bp, Homo sapiens
agcatttcttggcccattgtag

SEQ ID NO: 7828161 - DNA, 22 bp, Homo sapiens
agcatttccgccctcttctgcc

SEQ ID NO: 7828162 - DNA, 22 bp, Homo sapiens
agcatttccgccctcttctgcc

SEQ ID NO: 7828163 - DNA, 22 bp, Homo sapiens
agcatttccgccctcttctgcc

SEQ ID NO: 7828164 - DNA, 22 bp, Homo sapiens
agcattcaagtaattcacttgg

SEQ ID NO: 7828165 - DNA, 21 bp, Homo sapiens
agcattcaaaagatgccataa

SEQ ID NO: 7828166 - DNA, 22 bp, Homo sapiens
agcatttaggagaatttgagaa

SEQ ID NO: 7828167 - DNA, 22 bp, Homo sapiens
agcattcaagtaattcacttgg

SEQ ID NO: 7828168 - DNA, 22 bp, Homo sapiens
cactgcacttcagcctgggtga

SEQ ID NO: 7828169 - DNA, 22 bp, Homo sapiens
cactgcacttcagcctgggtga

SEQ ID NO: 7828170 - DNA, 22 bp, Homo sapiens
cactgcacttcagcctgggtga

SEQ ID NO: 7828171 - DNA, 22 bp, Homo sapiens
agcattaggtgtgtttcagagg

SEQ ID NO: 7828172 - DNA, 22 bp, Homo sapiens
agcattatgtccatgctaaatt

SEQ ID NO: 7828173 - DNA, 22 bp, Homo sapiens
cactgcacttcagcctgggtga

SEQ ID NO: 7828174 - DNA, 22 bp, Homo sapiens
cactgcacttcagcctgggtga

SEQ ID NO: 7828175 - DNA, 22 bp, Homo sapiens
cactgcacttcagcctgggtga

SEQ ID NO: 7828176 - DNA, 22 bp, Homo sapiens
cactgcacttcagcctgggtga

SEQ ID NO: 7828177 - DNA, 22 bp, Homo sapiens
cactgcacttcagcctgggtga

SEQ ID NO: 7828178 - DNA, 22 bp, Homo sapiens
cactgcacttcagcctgggtga

SEQ ID NO: 7828179 - DNA, 22 bp, Homo sapiens
cactgcacttcagcctgggtga

SEQ ID NO: 7828180 - DNA, 22 bp, Homo sapiens
cactgcacttcagcctgggtga

SEQ ID NO: 7828181 - DNA, 22 bp, Homo sapiens
cactgcactccatcctgggaaa

SEQ ID NO: 7828182 - DNA, 20 bp, Homo sapiens
agccaaaggagaacagtgct

SEQ ID NO: 7828183 - DNA, 22 bp, Homo sapiens
agccaaagatcagtgtgcaagt

SEQ ID NO: 7828184 - DNA, 22 bp, Homo sapiens
agccaaagatcagtgtgcaagt

SEQ ID NO: 7828185 - DNA, 22 bp, Homo sapiens
agccaaagatcagtgtgcaagt

SEQ ID NO: 7828186 - DNA, 20 bp, Homo sapiens
agccaaaggagaacagtgct

SEQ ID NO: 7828187 - DNA, 22 bp, Homo sapiens
agccaaaggcaccagagacact

SEQ ID NO: 7828188 - DNA, 22 bp, Homo sapiens
agccaaagatcagtgtgcaagt

SEQ ID NO: 7828189 - DNA, 22 bp, Homo sapiens
agccaaaggcaccagagacact

SEQ ID NO: 7828190 - DNA, 22 bp, Homo sapiens
agccaactaattaaacaacttt

SEQ ID NO: 7828191 - DNA, 22 bp, Homo sapiens
agccaacagccagcatcaacca

SEQ ID NO: 7828192 - DNA, 22 bp, Homo sapiens
agccaaagtccaaatgcagtgt

SEQ ID NO: 7828193 - DNA, 22 bp, Homo sapiens
agccaaaggcaccagagacact

SEQ ID NO: 7828194 - DNA, 22 bp, Homo sapiens
agccaaagtccaaatgcagtgt

SEQ ID NO: 7828195 - DNA, 22 bp, Homo sapiens
agccaaagtccaaatgcagtgt

SEQ ID NO: 7828196 - DNA, 22 bp, Homo sapiens
agccaaagtggtatatagggaa

SEQ ID NO: 7828197 - DNA, 22 bp, Homo sapiens
agccaaagatcagtgtgcaagt

SEQ ID NO: 7828198 - DNA, 22 bp, Homo sapiens
cagaaagacctgggctcaagag

SEQ ID NO: 7828199 - DNA, 22 bp, Homo sapiens
cagaaagacctgggctcaagag

SEQ ID NO: 7828200 - DNA, 22 bp, Homo sapiens
cagaaagacctgggctcaagag

SEQ ID NO: 7828201 - DNA, 22 bp, Homo sapiens
cagaaagacctgggctcaagag

SEQ ID NO: 7828202 - DNA, 22 bp, Homo sapiens
cagaaagacctgggctcaagag

SEQ ID NO: 7828203 - DNA, 22 bp, Homo sapiens
cagaaagacctgattggcagtt

SEQ ID NO: 7828204 - DNA, 22 bp, Homo sapiens
cagaaagacctgattggcagtt

SEQ ID NO: 7828205 - DNA, 22 bp, Homo sapiens
cagaaagacctgattggcagtt

SEQ ID NO: 7828206 - DNA, 22 bp, Homo sapiens
cagaaagacctgattggcagtt

SEQ ID NO: 7828207 - DNA, 22 bp, Homo sapiens
cagaaagacctgattggcagtt

SEQ ID NO: 7828208 - DNA, 22 bp, Homo sapiens
cagaaagacctgattggcagtt

SEQ ID NO: 7828209 - DNA, 20 bp, Homo sapiens
cagaaagaaggtagattttt

SEQ ID NO: 7828210 - DNA, 20 bp, Homo sapiens
cagaaagaaggtagattttt

SEQ ID NO: 7828211 - DNA, 20 bp, Homo sapiens
cagaaagaaggtagattttt

SEQ ID NO: 7828212 - DNA, 22 bp, Homo sapiens
cagaaactatgtaagaaagtga

SEQ ID NO: 7828213 - DNA, 22 bp, Homo sapiens
cagaaactgcttgtggtcatct

SEQ ID NO: 7828214 - DNA, 22 bp, Homo sapiens
cagaaactagatttagacacaa

SEQ ID NO: 7828215 - DNA, 22 bp, Homo sapiens
cagaaactgcttgtggtcatct

SEQ ID NO: 7828216 - DNA, 22 bp, Homo sapiens
cagaaactgctcccctggtagg

SEQ ID NO: 7828217 - DNA, 22 bp, Homo sapiens
cagaaactagatttagacacaa

SEQ ID NO: 7828218 - DNA, 22 bp, Homo sapiens
cagaaactagatttagacacaa

SEQ ID NO: 7828219 - DNA, 22 bp, Homo sapiens
cagaaaccaaatgggatgggga

SEQ ID NO: 7828220 - DNA, 22 bp, Homo sapiens
cagaaaccaaatgggatgggga

SEQ ID NO: 7828221 - DNA, 22 bp, Homo sapiens
cagaaacatgtataaagttgta

SEQ ID NO: 7828222 - DNA, 22 bp, Homo sapiens
cagaaacatgtataaagttgta

SEQ ID NO: 7828223 - DNA, 22 bp, Homo sapiens
cagaaacatgtataaagttgta

SEQ ID NO: 7828224 - DNA, 22 bp, Homo sapiens
cagaaacctccctgaatatttt

SEQ ID NO: 7828225 - DNA, 22 bp, Homo sapiens
cagaaacctgtctggagtggga

SEQ ID NO: 7828226 - DNA, 22 bp, Homo sapiens
cagaaacctccctgaatatttt

SEQ ID NO: 7828227 - DNA, 22 bp, Homo sapiens
cagaaacctgtctggagtggga

SEQ ID NO: 7828228 - DNA, 22 bp, Homo sapiens
cagaaactagatttagacacaa

SEQ ID NO: 7828229 - DNA, 22 bp, Homo sapiens
cagaaactgcttgtggtcatct

SEQ ID NO: 7828230 - DNA, 22 bp, Homo sapiens
cagaaactgtttgttaatattt

SEQ ID NO: 7828231 - DNA, 22 bp, Homo sapiens
cagaaacttctggtgtcaaata

SEQ ID NO: 7828232 - DNA, 22 bp, Homo sapiens
cagaaactttctttactgagca

SEQ ID NO: 7828233 - DNA, 21 bp, Homo sapiens
cagaaacttgctttgccttct

SEQ ID NO: 7828234 - DNA, 20 bp, Homo sapiens
cagaaagaaggtagattttt

SEQ ID NO: 7828235 - DNA, 20 bp, Homo sapiens
cagaaagaaggtagattttt

SEQ ID NO: 7828236 - DNA, 20 bp, Homo sapiens
cagaaagaaggtagattttt

SEQ ID NO: 7828237 - DNA, 22 bp, Homo sapiens
cagaaacttttgatgagtgtat

SEQ ID NO: 7828238 - DNA, 22 bp, Homo sapiens
cagaaacttttgatgagtgtat

SEQ ID NO: 7828239 - DNA, 22 bp, Homo sapiens
cagaaacttttgatgagtgtat

SEQ ID NO: 7828240 - DNA, 22 bp, Homo sapiens
cagaaactttggccctcaagcc

SEQ ID NO: 7828241 - DNA, 22 bp, Homo sapiens
cagaaactttctttactgagca

SEQ ID NO: 7828242 - DNA, 22 bp, Homo sapiens
cagaaactttctttactgagca

SEQ ID NO: 7828243 - DNA, 22 bp, Homo sapiens
cagaaactttctttactgagca

SEQ ID NO: 7828244 - DNA, 22 bp, Homo sapiens
cactgggcgccagctgctgagc

SEQ ID NO: 7828245 - DNA, 23 bp, Homo sapiens
cactgggcccagggtgtggaggc

SEQ ID NO: 7828246 - DNA, 22 bp, Homo sapiens
cactgggcgtgtcctgggtgag

SEQ ID NO: 7828247 - DNA, 22 bp, Homo sapiens
cactgggcgtgtcctgggtgag

SEQ ID NO: 7828248 - DNA, 22 bp, Homo sapiens
cactgggctgataccaggcttc

SEQ ID NO: 7828249 - DNA, 22 bp, Homo sapiens
cactgggctgataccaggcttc

SEQ ID NO: 7828250 - DNA, 20 bp, Homo sapiens
cactgggctggagtcagggc

SEQ ID NO: 7828251 - DNA, 20 bp, Homo sapiens
cactgggctggagtcagggc

SEQ ID NO: 7828252 - DNA, 22 bp, Homo sapiens
cactgggctttgtagttagcat

SEQ ID NO: 7828253 - DNA, 22 bp, Homo sapiens
agcattttctgagagtatagat

SEQ ID NO: 7828254 - DNA, 22 bp, Homo sapiens
agcattttctgagagtatagat

SEQ ID NO: 7828255 - DNA, 22 bp, Homo sapiens
agccaaaacatgtgagttttga

SEQ ID NO: 7828256 - DNA, 22 bp, Homo sapiens
cactgggcaattctgagcctaa

SEQ ID NO: 7828257 - DNA, 17 bp, Homo sapiens
agcatttgtgttaacag

SEQ ID NO: 7828258 - DNA, 17 bp, Homo sapiens
agcatttgtgttaacag

SEQ ID NO: 7828259 - DNA, 22 bp, Homo sapiens
agcattttctgagagtatagat

SEQ ID NO: 7828260 - DNA, 22 bp, Homo sapiens
cactgggtcaggatagagccca

SEQ ID NO: 7828261 - DNA, 22 bp, Homo sapiens
cactggtacactgaatggcgtt

SEQ ID NO: 7828262 - DNA, 22 bp, Homo sapiens
cactgggtaaatttgaggctga

SEQ ID NO: 7828263 - DNA, 21 bp, Homo sapiens
cactggtagatggcccgcagg

SEQ ID NO: 7828264 - DNA, 22 bp, Homo sapiens
cactggtagagagaagacaagg

SEQ ID NO: 7828265 - DNA, 22 bp, Homo sapiens
cactggtacgtaggttggggca

SEQ ID NO: 7828266 - DNA, 22 bp, Homo sapiens
cactgggtcaggatagagccca

SEQ ID NO: 7828267 - DNA, 23 bp, Homo sapiens
cactgggggctgctacagagagg

SEQ ID NO: 7828268 - DNA, 23 bp, Homo sapiens
cactgggggctgctacagagagg

SEQ ID NO: 7828269 - DNA, 22 bp, Homo sapiens
cactggggtgggcctggtagag

SEQ ID NO: 7828270 - DNA, 22 bp, Homo sapiens
cactggggtgggcctggtagag

SEQ ID NO: 7828271 - DNA, 22 bp, Homo sapiens
cactggtagtttcagcaaccag

SEQ ID NO: 7828272 - DNA, 22 bp, Homo sapiens
cactggtagcagttaagttagg

SEQ ID NO: 7828273 - DNA, 21 bp, Homo sapiens
cactggtagatggcccgcagg

SEQ ID NO: 7828274 - DNA, 22 bp, Homo sapiens
cactggtatttgaaaatagatg

SEQ ID NO: 7828275 - DNA, 22 bp, Homo sapiens
cactggtagcagttaagttagg

SEQ ID NO: 7828276 - DNA, 22 bp, Homo sapiens
cactggtagagagaagacaagg

SEQ ID NO: 7828277 - DNA, 22 bp, Homo sapiens
cactggtagagagaagacaagg

SEQ ID NO: 7828278 - DNA, 22 bp, Homo sapiens
cactggtatttgaaaatagatg

SEQ ID NO: 7828279 - DNA, 22 bp, Homo sapiens
cactggtcagcatggtagacca

SEQ ID NO: 7828280 - DNA, 22 bp, Homo sapiens
cactggtcagtcggtcagtctc

SEQ ID NO: 7828281 - DNA, 22 bp, Homo sapiens
cactttgatgcagggctcagta

SEQ ID NO: 7828282 - DNA, 22 bp, Homo sapiens
cactttgatgcagggctcagta

SEQ ID NO: 7828283 - DNA, 22 bp, Homo sapiens
cactttgatgcagggctcagta

SEQ ID NO: 7828284 - DNA, 22 bp, Homo sapiens
cactggtgaaagtttaattgtt

SEQ ID NO: 7828285 - DNA, 22 bp, Homo sapiens
cactttgcttagagaacaaggc

SEQ ID NO: 7828286 - DNA, 20 bp, Homo sapiens
cactttggacctgatgtatc

SEQ ID NO: 7828287 - DNA, 22 bp, Homo sapiens
cactggtgaaagtttaattgtt

SEQ ID NO: 7828288 - DNA, 22 bp, Homo sapiens
cactttgcagggtggtgggagg

SEQ ID NO: 7828289 - DNA, 22 bp, Homo sapiens
aatgcacaaaaattgtatgtaa

SEQ ID NO: 7828290 - DNA, 22 bp, Homo sapiens
aatgcacaaaaattgtatgtaa

SEQ ID NO: 7828291 - DNA, 22 bp, Homo sapiens
agaaggacccggtgggagatga

SEQ ID NO: 7828292 - DNA, 22 bp, Homo sapiens
agaaggaaggctgagtgctgat

SEQ ID NO: 7828293 - DNA, 22 bp, Homo sapiens
agaaggaaggctgagtgctgat

SEQ ID NO: 7828294 - DNA, 22 bp, Homo sapiens
agaaggaaggctgagtgctgat

SEQ ID NO: 7828295 - DNA, 22 bp, Homo sapiens
agaaggaaggctgagtgctgat

SEQ ID NO: 7828296 - DNA, 22 bp, Homo sapiens
agaaggaaggctgagtgctgat

SEQ ID NO: 7828297 - DNA, 22 bp, Homo sapiens
agaaggaaggctgagtgctgat

SEQ ID NO: 7828298 - DNA, 22 bp, Homo sapiens
agaaggaaggataactgcatta

SEQ ID NO: 7828299 - DNA, 22 bp, Homo sapiens
agaaggaaggctgagtgctgat

SEQ ID NO: 7828300 - DNA, 22 bp, Homo sapiens
agaaggaagccaggagggtgca

SEQ ID NO: 7828301 - DNA, 22 bp, Homo sapiens
agaaggaagccaggagggtgca

SEQ ID NO: 7828302 - DNA, 22 bp, Homo sapiens
agaaggaagccaggagggtgca

SEQ ID NO: 7828303 - DNA, 22 bp, Homo sapiens
agaaggaagccaggagggtgca

SEQ ID NO: 7828304 - DNA, 22 bp, Homo sapiens
agaaggaaggaagcattctgtt

SEQ ID NO: 7828305 - DNA, 22 bp, Homo sapiens
agaaggaaggaagcattctgtt

SEQ ID NO: 7828306 - DNA, 22 bp, Homo sapiens
agaaggaaggaagcattctgtt

SEQ ID NO: 7828307 - DNA, 22 bp, Homo sapiens
agaaggaaggaagcattctgtt

SEQ ID NO: 7828308 - DNA, 22 bp, Homo sapiens
agaaggaaggaagcattctgtt

SEQ ID NO: 7828309 - DNA, 22 bp, Homo sapiens
agaaggaaggaagcattctgtt

SEQ ID NO: 7828310 - DNA, 22 bp, Homo sapiens
agaaggaaggataactgcatta

SEQ ID NO: 7828311 - DNA, 22 bp, Homo sapiens
agaaggaagccaggagggtgca

SEQ ID NO: 7828312 - DNA, 22 bp, Homo sapiens
agaaggaaggataactgcatta

SEQ ID NO: 7828313 - DNA, 22 bp, Homo sapiens
agaaggaaggataactgcatta

SEQ ID NO: 7828314 - DNA, 22 bp, Homo sapiens
agaaggaaaacctgtcttatgt

SEQ ID NO: 7828315 - DNA, 22 bp, Homo sapiens
agaaggaaaacctgtcttatgt

SEQ ID NO: 7828316 - DNA, 22 bp, Homo sapiens
agaaggaaaacctgtcttatgt

SEQ ID NO: 7828317 - DNA, 22 bp, Homo sapiens
agaaggaaaacctgtcttatgt

SEQ ID NO: 7828318 - DNA, 22 bp, Homo sapiens
agaaggaaaacctgtcttatgt

SEQ ID NO: 7828319 - DNA, 22 bp, Homo sapiens
agaaggaaaacctgtcttatgt

SEQ ID NO: 7828320 - DNA, 22 bp, Homo sapiens
agaaggaaacagctgtgctttg

SEQ ID NO: 7828321 - DNA, 22 bp, Homo sapiens
agaagcttcctacattgttctt

SEQ ID NO: 7828322 - DNA, 22 bp, Homo sapiens
agaagcttcctacattgttctt

SEQ ID NO: 7828323 - DNA, 22 bp, Homo sapiens
agaagcttccacggatgtgtct

SEQ ID NO: 7828324 - DNA, 22 bp, Homo sapiens
agaagcttgaaggagcagtgac

SEQ ID NO: 7828325 - DNA, 22 bp, Homo sapiens
agaagcttgaaggagcagtgac

SEQ ID NO: 7828326 - DNA, 22 bp, Homo sapiens
agaagcttgaaggagcagtgac

SEQ ID NO: 7828327 - DNA, 22 bp, Homo sapiens
agaagctgttgcattcctggcg

SEQ ID NO: 7828328 - DNA, 22 bp, Homo sapiens
agaagccagtcgctctcccgca

SEQ ID NO: 7828329 - DNA, 22 bp, Homo sapiens
agaagcttcaagatatttggta

SEQ ID NO: 7828330 - DNA, 22 bp, Homo sapiens
agaagctgttgcattcctggcg

SEQ ID NO: 7828331 - DNA, 22 bp, Homo sapiens
agaagcttcaagatatttggta

SEQ ID NO: 7828332 - DNA, 22 bp, Homo sapiens
agaagccagccttgcctccttt

SEQ ID NO: 7828333 - DNA, 22 bp, Homo sapiens
agaagccagattgtagtgggac

SEQ ID NO: 7828334 - DNA, 22 bp, Homo sapiens
agaagccagccttgcctccttt

SEQ ID NO: 7828335 - DNA, 22 bp, Homo sapiens
agaagccagaggcagtgggtac

SEQ ID NO: 7828336 - DNA, 22 bp, Homo sapiens
agaagccagaggcagtgggtac

SEQ ID NO: 7828337 - DNA, 22 bp, Homo sapiens
agaagccagattgtagtgggac

SEQ ID NO: 7828338 - DNA, 22 bp, Homo sapiens
agaagccagattgtagtgggac

SEQ ID NO: 7828339 - DNA, 22 bp, Homo sapiens
agaagccagattgtagtgggac

SEQ ID NO: 7828340 - DNA, 22 bp, Homo sapiens
agaagccagcttcagctgcccg

SEQ ID NO: 7828341 - DNA, 22 bp, Homo sapiens
agaagccagccttgcctccttt

SEQ ID NO: 7828342 - DNA, 22 bp, Homo sapiens
agaagccagcttcagctgcccg

SEQ ID NO: 7828343 - DNA, 22 bp, Homo sapiens
agaagccagtcgctctcccgca

SEQ ID NO: 7828344 - DNA, 22 bp, Homo sapiens
agaagccagcttcagctgcccg

SEQ ID NO: 7828345 - DNA, 22 bp, Homo sapiens
aatgcattttattatatgtgac

SEQ ID NO: 7828346 - DNA, 18 bp, Homo sapiens
aatgcatttatggagatg

SEQ ID NO: 7828347 - DNA, 22 bp, Homo sapiens
aatgccaacttggatatacatt

SEQ ID NO: 7828348 - DNA, 21 bp, Homo sapiens
aatgccagtcccagggaatgc

SEQ ID NO: 7828349 - DNA, 22 bp, Homo sapiens
aatgccaatgggcagaactaga

SEQ ID NO: 7828350 - DNA, 22 bp, Homo sapiens
aatgccatccctctgtcaccaa

SEQ ID NO: 7828351 - DNA, 22 bp, Homo sapiens
aatgccaacttggatatacatt

SEQ ID NO: 7828352 - DNA, 23 bp, Homo sapiens
aatgccatattggatttcttcag

SEQ ID NO: 7828353 - DNA, 19 bp, Homo sapiens
aatgcctcaaattgggaga

SEQ ID NO: 7828354 - DNA, 19 bp, Homo sapiens
aatgcctcaaattgggaga

SEQ ID NO: 7828355 - DNA, 19 bp, Homo sapiens
aatgcctcagagacttaag

SEQ ID NO: 7828356 - DNA, 22 bp, Homo sapiens
aatgcccccaggcctggaggag

SEQ ID NO: 7828357 - DNA, 22 bp, Homo sapiens
aatgccatctggtgatgtatta

SEQ ID NO: 7828358 - DNA, 22 bp, Homo sapiens
aatgccattttaggcatgtcct

SEQ ID NO: 7828359 - DNA, 22 bp, Homo sapiens
aatgccttcccatttatacttt

SEQ ID NO: 7828360 - DNA, 22 bp, Homo sapiens
aatgccttcaagtatctgagga

SEQ ID NO: 7828361 - DNA, 22 bp, Homo sapiens
aatgccttcaagtatctgagga

SEQ ID NO: 7828362 - DNA, 22 bp, Homo sapiens
aatgcctctttggagttatttc

SEQ ID NO: 7828363 - DNA, 22 bp, Homo sapiens
aatgcctcttttctccagtcca

SEQ ID NO: 7828364 - DNA, 22 bp, Homo sapiens
aatgcctaagtaattattttga

SEQ ID NO: 7828365 - DNA, 22 bp, Homo sapiens
aatgcctcttggaagaagactt

SEQ ID NO: 7828366 - DNA, 22 bp, Homo sapiens
aatgcctcagcagttattattc

SEQ ID NO: 7828367 - DNA, 22 bp, Homo sapiens
aatgcctcgccttatttatttt

SEQ ID NO: 7828368 - DNA, 22 bp, Homo sapiens
aatgcacaaaggtgtctattgc

SEQ ID NO: 7828369 - DNA, 22 bp, Homo sapiens
aatgcatacgtgtttgtggcaa

SEQ ID NO: 7828370 - DNA, 22 bp, Homo sapiens
aatgcatacgtgtttgtggcaa

SEQ ID NO: 7828371 - DNA, 22 bp, Homo sapiens
aatgcataccatgtcatctttg

SEQ ID NO: 7828372 - DNA, 22 bp, Homo sapiens
aatgcataccatgtcatctttg

SEQ ID NO: 7828373 - DNA, 22 bp, Homo sapiens
aatgcatcagaaatgtgtataa

SEQ ID NO: 7828374 - DNA, 22 bp, Homo sapiens
aatgcatccctgccaatgcttt

SEQ ID NO: 7828375 - DNA, 22 bp, Homo sapiens
aatgcattaaagttagagactt

SEQ ID NO: 7828376 - DNA, 22 bp, Homo sapiens
aatgcatgtttcctctcagcag

SEQ ID NO: 7828377 - DNA, 22 bp, Homo sapiens
aatgcattccactgagatttgt

SEQ ID NO: 7828378 - DNA, 22 bp, Homo sapiens
aatgcattctcggtttgtgtgt

SEQ ID NO: 7828379 - DNA, 22 bp, Homo sapiens
aatgcattagctacatatgtct

SEQ ID NO: 7828380 - DNA, 22 bp, Homo sapiens
aatgcattagctacatatgtct

SEQ ID NO: 7828381 - DNA, 21 bp, Homo sapiens
aatgcattaacataaagctga

SEQ ID NO: 7828382 - DNA, 21 bp, Homo sapiens
aatgcattaacataaagctga

SEQ ID NO: 7828383 - DNA, 22 bp, Homo sapiens
agaagaaatgaggccgttctgc

SEQ ID NO: 7828384 - DNA, 22 bp, Homo sapiens
agaagaaatgaggccgttctgc

SEQ ID NO: 7828385 - DNA, 22 bp, Homo sapiens
aatgaagaaatggacatcttta

SEQ ID NO: 7828386 - DNA, 22 bp, Homo sapiens
aatgaagaaatggacatcttta

SEQ ID NO: 7828387 - DNA, 22 bp, Homo sapiens
agaagaaactgtcggggatatt

SEQ ID NO: 7828388 - DNA, 22 bp, Homo sapiens
agaagaaagattgaaggttcct

SEQ ID NO: 7828389 - DNA, 22 bp, Homo sapiens
agaagaaagattgaaggttcct

SEQ ID NO: 7828390 - DNA, 22 bp, Homo sapiens
agaagaaagattgaaggttcct

SEQ ID NO: 7828391 - DNA, 22 bp, Homo sapiens
agaagaaagattgaaggttcct

SEQ ID NO: 7828392 - DNA, 22 bp, Homo sapiens
agaacttaggaacaacagctta

SEQ ID NO: 7828393 - DNA, 20 bp, Homo sapiens
agaactgttgtttgggtcct

SEQ ID NO: 7828394 - DNA, 22 bp, Homo sapiens
agaactgtgccaaaaattttgt

SEQ ID NO: 7828395 - DNA, 22 bp, Homo sapiens
agaactgtgccaaaaattttgt

SEQ ID NO: 7828396 - DNA, 22 bp, Homo sapiens
agaactgtgaagtatgtgaaat

SEQ ID NO: 7828397 - DNA, 22 bp, Homo sapiens
agaactgtccttggaggagagt

SEQ ID NO: 7828398 - DNA, 22 bp, Homo sapiens
agaactgtccttggaggagagt

SEQ ID NO: 7828399 - DNA, 22 bp, Homo sapiens
agaacttttggagacttttagt

SEQ ID NO: 7828400 - DNA, 22 bp, Homo sapiens
agaacttttggagacttttagt

SEQ ID NO: 7828401 - DNA, 22 bp, Homo sapiens
agaacttttggagacttttagt

SEQ ID NO: 7828402 - DNA, 22 bp, Homo sapiens
agaagaaactgtcggggatatt

SEQ ID NO: 7828403 - DNA, 22 bp, Homo sapiens
agaagaaactgtcggggatatt

SEQ ID NO: 7828404 - DNA, 22 bp, Homo sapiens
agaagaaactgtcggggatatt

SEQ ID NO: 7828405 - DNA, 21 bp, Homo sapiens
agaactaagactcagcagtac

SEQ ID NO: 7828406 - DNA, 22 bp, Homo sapiens
agaacgtggaatgtggctcctt

SEQ ID NO: 7828407 - DNA, 22 bp, Homo sapiens
agaacgctattcagaacactgg

SEQ ID NO: 7828408 - DNA, 22 bp, Homo sapiens
agaacgctattcagaacactgg

SEQ ID NO: 7828409 - DNA, 22 bp, Homo sapiens
agaactattgcaataacaagaa

SEQ ID NO: 7828410 - DNA, 21 bp, Homo sapiens
agaactaagactcagcagtac

SEQ ID NO: 7828411 - DNA, 22 bp, Homo sapiens
agaacacactgggggaaacaag

SEQ ID NO: 7828412 - DNA, 22 bp, Homo sapiens
agaacacactgggggaaacaag

SEQ ID NO: 7828413 - DNA, 22 bp, Homo sapiens
agaacacactgggggaaacaag

SEQ ID NO: 7828414 - DNA, 22 bp, Homo sapiens
agaacacacgtcagagtttcct

SEQ ID NO: 7828415 - DNA, 22 bp, Homo sapiens
aatctatatgcttttcacatac

SEQ ID NO: 7828416 - DNA, 22 bp, Homo sapiens
agaactctttatctgtggaatg

SEQ ID NO: 7828417 - DNA, 21 bp, Homo sapiens
agaactgattaaataagcagt

SEQ ID NO: 7828418 - DNA, 21 bp, Homo sapiens
agaactgattaaataagcagt

SEQ ID NO: 7828419 - DNA, 22 bp, Homo sapiens
agaactctatattcatgaacaa

SEQ ID NO: 7828420 - DNA, 22 bp, Homo sapiens
agaactctaggattggctggat

SEQ ID NO: 7828421 - DNA, 22 bp, Homo sapiens
agaactctatattcatgaacaa

SEQ ID NO: 7828422 - DNA, 22 bp, Homo sapiens
agaactctcgctggatcagact

SEQ ID NO: 7828423 - DNA, 22 bp, Homo sapiens
agaactctgaacactgtctgga

SEQ ID NO: 7828424 - DNA, 22 bp, Homo sapiens
agaactctgaacactgtctgga

SEQ ID NO: 7828425 - DNA, 19 bp, Homo sapiens
agaactgggtccatggctt

SEQ ID NO: 7828426 - DNA, 17 bp, Homo sapiens
agaactgtagtagctcc

SEQ ID NO: 7828427 - DNA, 17 bp, Homo sapiens
agaactgtagtagctcc

SEQ ID NO: 7828428 - DNA, 22 bp, Homo sapiens
agaactgtcacgagtgacaaag

SEQ ID NO: 7828429 - DNA, 17 bp, Homo sapiens
agaactgtagtagctcc

SEQ ID NO: 7828430 - DNA, 22 bp, Homo sapiens
agaactgtccccagagagcact

SEQ ID NO: 7828431 - DNA, 22 bp, Homo sapiens
agaactgtcacgagtgacaaag

SEQ ID NO: 7828432 - DNA, 22 bp, Homo sapiens
agaagccactggaggttgagat

SEQ ID NO: 7828433 - DNA, 22 bp, Homo sapiens
agaagccactggaggttgagat

SEQ ID NO: 7828434 - DNA, 22 bp, Homo sapiens
agaagccagaatattcatggat

SEQ ID NO: 7828435 - DNA, 22 bp, Homo sapiens
agaagccagaatattcatggat

SEQ ID NO: 7828436 - DNA, 22 bp, Homo sapiens
agaagccactggaggttgagat

SEQ ID NO: 7828437 - DNA, 22 bp, Homo sapiens
agaagccagaggcagtgggtac

SEQ ID NO: 7828438 - DNA, 22 bp, Homo sapiens
agaagccactggaggttgagat

SEQ ID NO: 7828439 - DNA, 22 bp, Homo sapiens
agaagccactgctcccagtgag

SEQ ID NO: 7828440 - DNA, 18 bp, Homo sapiens
agaagccacgaggagtcc

SEQ ID NO: 7828441 - DNA, 18 bp, Homo sapiens
agaagccacgaggagtcc

SEQ ID NO: 7828442 - DNA, 22 bp, Homo sapiens
agaagcagctttcaaggtgatt

SEQ ID NO: 7828443 - DNA, 22 bp, Homo sapiens
agaagcagctttcaaggtgatt

SEQ ID NO: 7828444 - DNA, 22 bp, Homo sapiens
agaagcagctttcaaggtgatt

SEQ ID NO: 7828445 - DNA, 22 bp, Homo sapiens
agaagcagctttcaaggtgatt

SEQ ID NO: 7828446 - DNA, 22 bp, Homo sapiens
agaagccaccagctgaggaaga

SEQ ID NO: 7828447 - DNA, 22 bp, Homo sapiens
agaagccaccagctgaggaaga

SEQ ID NO: 7828448 - DNA, 22 bp, Homo sapiens
agaagccaccagctgaggaaga

SEQ ID NO: 7828449 - DNA, 22 bp, Homo sapiens
aatgaatgaaccacatataaca

SEQ ID NO: 7828450 - DNA, 22 bp, Homo sapiens
aatgaatgaaccacatataaca

SEQ ID NO: 7828451 - DNA, 22 bp, Homo sapiens
aatgaatgaaccacatataaca

SEQ ID NO: 7828452 - DNA, 22 bp, Homo sapiens
agaagcagctttcaaggtgatt

SEQ ID NO: 7828453 - DNA, 22 bp, Homo sapiens
agaagcagctttcaaggtgatt

SEQ ID NO: 7828454 - DNA, 22 bp, Homo sapiens
aatgaatgggtttaatatttta

SEQ ID NO: 7828455 - DNA, 22 bp, Homo sapiens
agaagcagctttcaaggtgatt

SEQ ID NO: 7828456 - DNA, 22 bp, Homo sapiens
aatgaatgggtttaatatttta

SEQ ID NO: 7828457 - DNA, 22 bp, Homo sapiens
aatgaatgggtttaatatttta

SEQ ID NO: 7828458 - DNA, 17 bp, Homo sapiens
aatgaatgaattctttg

SEQ ID NO: 7828459 - DNA, 22 bp, Homo sapiens
aatgaagttctattcattttct

SEQ ID NO: 7828460 - DNA, 20 bp, Homo sapiens
aatgaagttattaatgatgt

SEQ ID NO: 7828461 - DNA, 22 bp, Homo sapiens
aatgaagtgttatttagtttca

SEQ ID NO: 7828462 - DNA, 21 bp, Homo sapiens
aatgaagtggctattttgagg

SEQ ID NO: 7828463 - DNA, 22 bp, Homo sapiens
aatgaagccactgaagacaatc

SEQ ID NO: 7828464 - DNA, 22 bp, Homo sapiens
aatgaagccactgaagacaatc

SEQ ID NO: 7828465 - DNA, 22 bp, Homo sapiens
aatgaagaaatggacatcttta

SEQ ID NO: 7828466 - DNA, 22 bp, Homo sapiens
aatgaagaaatggacatcttta

SEQ ID NO: 7828467 - DNA, 22 bp, Homo sapiens
aatgaagataaaatgggatgga

SEQ ID NO: 7828468 - DNA, 22 bp, Homo sapiens
aatgaagacacatctttctcat

SEQ ID NO: 7828469 - DNA, 22 bp, Homo sapiens
aatgaagataaaatgggatgga

SEQ ID NO: 7828470 - DNA, 22 bp, Homo sapiens
aatgaagataaaatgggatgga

SEQ ID NO: 7828471 - DNA, 22 bp, Homo sapiens
aatgaagacacatctttctcat

SEQ ID NO: 7828472 - DNA, 22 bp, Homo sapiens
aatgaagattatggtgattaag

SEQ ID NO: 7828473 - DNA, 22 bp, Homo sapiens
aatagcttatgggatagatgtt

SEQ ID NO: 7828474 - DNA, 22 bp, Homo sapiens
aatagcttattgacagtgaatt

SEQ ID NO: 7828475 - DNA, 22 bp, Homo sapiens
aatagcttgcctaatcctcatg

SEQ ID NO: 7828476 - DNA, 22 bp, Homo sapiens
aatagcttttgtatgatgaaat

SEQ ID NO: 7828477 - DNA, 22 bp, Homo sapiens
aatagcttttgtatgatgaaat

SEQ ID NO: 7828478 - DNA, 22 bp, Homo sapiens
aataggaaaatatttaacaaga

SEQ ID NO: 7828479 - DNA, 22 bp, Homo sapiens
aataggaaaatatttaacaaga

SEQ ID NO: 7828480 - DNA, 22 bp, Homo sapiens
aatagtaaaagatacagctaat

SEQ ID NO: 7828481 - DNA, 22 bp, Homo sapiens
aatagtacaatctacagacata

SEQ ID NO: 7828482 - DNA, 22 bp, Homo sapiens
aatagtaaaagatacagctaat

SEQ ID NO: 7828483 - DNA, 22 bp, Homo sapiens
aataggcagttggatatgcaag

SEQ ID NO: 7828484 - DNA, 22 bp, Homo sapiens
aataggcattacatttcctgca

SEQ ID NO: 7828485 - DNA, 22 bp, Homo sapiens
aataggcagttggatatgcaag

SEQ ID NO: 7828486 - DNA, 22 bp, Homo sapiens
aataggaagcaccaaattctcc

SEQ ID NO: 7828487 - DNA, 22 bp, Homo sapiens
aataggcagcttagcaggggct

SEQ ID NO: 7828488 - DNA, 22 bp, Homo sapiens
aataggactttggtcctagctc

SEQ ID NO: 7828489 - DNA, 22 bp, Homo sapiens
aatagcatgtaagtttaaaaga

SEQ ID NO: 7828490 - DNA, 22 bp, Homo sapiens
aatagcatgtaagtttaaaaga

SEQ ID NO: 7828491 - DNA, 22 bp, Homo sapiens
aatagcatgcatcctgcataga

SEQ ID NO: 7828492 - DNA, 22 bp, Homo sapiens
aatagccactttagagcaggtg

SEQ ID NO: 7828493 - DNA, 22 bp, Homo sapiens
aatagcatgttcatgataaaat

SEQ ID NO: 7828494 - DNA, 22 bp, Homo sapiens
aatagcatgttcatgataaaat

SEQ ID NO: 7828495 - DNA, 22 bp, Homo sapiens
aatagcatgttcatgataaaat

SEQ ID NO: 7828496 - DNA, 22 bp, Homo sapiens
aatagcttagtcctgattctgt

SEQ ID NO: 7828497 - DNA, 22 bp, Homo sapiens
aatagcttagtcctgattctgt

SEQ ID NO: 7828498 - DNA, 22 bp, Homo sapiens
aatagcttatgggatagatgtt

SEQ ID NO: 7828499 - DNA, 22 bp, Homo sapiens
aatagccactttagagcaggtg

SEQ ID NO: 7828500 - DNA, 22 bp, Homo sapiens
aatagctcactgatttctcttt

SEQ ID NO: 7828501 - DNA, 22 bp, Homo sapiens
aatagctcactgatttctcttt

SEQ ID NO: 7828502 - DNA, 22 bp, Homo sapiens
aatagctgattaatgtactacc

SEQ ID NO: 7828503 - DNA, 22 bp, Homo sapiens
aatagctgattaatgtactacc

SEQ ID NO: 7828504 - DNA, 22 bp, Homo sapiens
aatagctgggacctgaattagc

SEQ ID NO: 7828505 - DNA, 22 bp, Homo sapiens
actttgttttcatgaaacagct

SEQ ID NO: 7828506 - DNA, 22 bp, Homo sapiens
acttttaaatgagtttcagttg

SEQ ID NO: 7828507 - DNA, 22 bp, Homo sapiens
acttttaaatgagtttcagttg

SEQ ID NO: 7828508 - DNA, 22 bp, Homo sapiens
acttttaaatgagtttcagttg

SEQ ID NO: 7828509 - DNA, 22 bp, Homo sapiens
acttttaaatgagtttcagttg

SEQ ID NO: 7828510 - DNA, 22 bp, Homo sapiens
actttgttttatagcacataag

SEQ ID NO: 7828511 - DNA, 22 bp, Homo sapiens
actttgttttcatgaaacagct

SEQ ID NO: 7828512 - DNA, 22 bp, Homo sapiens
actttgtttggctattagagtc

SEQ ID NO: 7828513 - DNA, 22 bp, Homo sapiens
actttgtttccatatttgtagc

SEQ ID NO: 7828514 - DNA, 22 bp, Homo sapiens
actttgtttccatatttgtagc

SEQ ID NO: 7828515 - DNA, 22 bp, Homo sapiens
actttgttgttccttgtctaaa

SEQ ID NO: 7828516 - DNA, 22 bp, Homo sapiens
actttgttgttccttgtctaaa

SEQ ID NO: 7828517 - DNA, 22 bp, Homo sapiens
actttgtttccatatttgtagc

SEQ ID NO: 7828518 - DNA, 22 bp, Homo sapiens
actttgttgatgaaatagtttt

SEQ ID NO: 7828519 - DNA, 22 bp, Homo sapiens
actttgttgatgaaatagtttt

SEQ ID NO: 7828520 - DNA, 22 bp, Homo sapiens
actttgttgatgaaatagtttt

SEQ ID NO: 7828521 - DNA, 22 bp, Homo sapiens
actttgttgatgaaatagtttt

SEQ ID NO: 7828522 - DNA, 22 bp, Homo sapiens
actttgttgaagaatatgttag

SEQ ID NO: 7828523 - DNA, 22 bp, Homo sapiens
actttgttgaagaatatgttag

SEQ ID NO: 7828524 - DNA, 22 bp, Homo sapiens
actttgttgaagaatatgttag

SEQ ID NO: 7828525 - DNA, 22 bp, Homo sapiens
actttgttgaagaatatgttag

SEQ ID NO: 7828526 - DNA, 22 bp, Homo sapiens
actttgttctaatagtatctct

SEQ ID NO: 7828527 - DNA, 22 bp, Homo sapiens
actttgttctaatagtatctct

SEQ ID NO: 7828528 - DNA, 22 bp, Homo sapiens
actttgttctaatagtatctct

SEQ ID NO: 7828529 - DNA, 22 bp, Homo sapiens
actttgcaaaataatgctgatt

SEQ ID NO: 7828530 - DNA, 22 bp, Homo sapiens
actttgttcctttcacaaagaa

SEQ ID NO: 7828531 - DNA, 22 bp, Homo sapiens
actttgcaaaaggaaatcacct

SEQ ID NO: 7828532 - DNA, 22 bp, Homo sapiens
actttgatcctttgaatatttg

SEQ ID NO: 7828533 - DNA, 22 bp, Homo sapiens
actttgatagtttaatctagga

SEQ ID NO: 7828534 - DNA, 22 bp, Homo sapiens
acttttaaggggccttgattta

SEQ ID NO: 7828535 - DNA, 22 bp, Homo sapiens
acttttaaggggccttgattta

SEQ ID NO: 7828536 - DNA, 22 bp, Homo sapiens
acttttatcaaggaagtgatct

SEQ ID NO: 7828537 - DNA, 22 bp, Homo sapiens
acttttatcaaggaagtgatct

SEQ ID NO: 7828538 - DNA, 22 bp, Homo sapiens
acttttatcaaggaagtgatct

SEQ ID NO: 7828539 - DNA, 22 bp, Homo sapiens
acttttatgataatcaatgttc

SEQ ID NO: 7828540 - DNA, 22 bp, Homo sapiens
acttttatgataatcaatgttc

SEQ ID NO: 7828541 - DNA, 22 bp, Homo sapiens
acttttatgataatcaatgttc

SEQ ID NO: 7828542 - DNA, 22 bp, Homo sapiens
acttttatcaaggaagtgatct

SEQ ID NO: 7828543 - DNA, 22 bp, Homo sapiens
aatcaagtcaaccatcatgtgc

SEQ ID NO: 7828544 - DNA, 22 bp, Homo sapiens
aatcaagtattttccagtggca

SEQ ID NO: 7828545 - DNA, 22 bp, Homo sapiens
aatcaagagttgtgtaatattt

SEQ ID NO: 7828546 - DNA, 22 bp, Homo sapiens
aatcaagagttgtgtaatattt

SEQ ID NO: 7828547 - DNA, 22 bp, Homo sapiens
aatcaagagttgtgtaatattt

SEQ ID NO: 7828548 - DNA, 22 bp, Homo sapiens
aatcacaaacgaattgatggaa

SEQ ID NO: 7828549 - DNA, 22 bp, Homo sapiens
aatcacaaacgaattgatggaa

SEQ ID NO: 7828550 - DNA, 22 bp, Homo sapiens
aatcacaaacgaattgatggaa

SEQ ID NO: 7828551 - DNA, 22 bp, Homo sapiens
aatcaatgttagtcatgaattt

SEQ ID NO: 7828552 - DNA, 22 bp, Homo sapiens
aatcaagagttgtgtaatattt

SEQ ID NO: 7828553 - DNA, 22 bp, Homo sapiens
aatcaagagttgtgtaatattt

SEQ ID NO: 7828554 - DNA, 22 bp, Homo sapiens
acttttatgataatcaatgttc

SEQ ID NO: 7828555 - DNA, 22 bp, Homo sapiens
acttttatcaaggaagtgatct

SEQ ID NO: 7828556 - DNA, 22 bp, Homo sapiens
agaaaggcagggatgaggattg

SEQ ID NO: 7828557 - DNA, 22 bp, Homo sapiens
agaaaggcaatattaactacac

SEQ ID NO: 7828558 - DNA, 22 bp, Homo sapiens
agaaaggcaatattaactacac

SEQ ID NO: 7828559 - DNA, 22 bp, Homo sapiens
agaaaggattagtttggtataa

SEQ ID NO: 7828560 - DNA, 22 bp, Homo sapiens
agaaaggattagtttggtataa

SEQ ID NO: 7828561 - DNA, 22 bp, Homo sapiens
agaaaggaggaagaatgacctc

SEQ ID NO: 7828562 - DNA, 22 bp, Homo sapiens
agaaaggaggaagaatgacctc

SEQ ID NO: 7828563 - DNA, 22 bp, Homo sapiens
agaaaggacatctccctttaag

SEQ ID NO: 7828564 - DNA, 22 bp, Homo sapiens
agaaaggacatctccctttaag

SEQ ID NO: 7828565 - DNA, 22 bp, Homo sapiens
agaaaggagaccagctctgccc

SEQ ID NO: 7828566 - DNA, 22 bp, Homo sapiens
agaaaggagaccagctctgccc

SEQ ID NO: 7828567 - DNA, 22 bp, Homo sapiens
agaaaggagaccagctctgccc

SEQ ID NO: 7828568 - DNA, 22 bp, Homo sapiens
agaaagctggagtcaagcagag

SEQ ID NO: 7828569 - DNA, 22 bp, Homo sapiens
agaaagcttatgaatgggcaag

SEQ ID NO: 7828570 - DNA, 22 bp, Homo sapiens
agaaagcttatgaatgggcaag

SEQ ID NO: 7828571 - DNA, 22 bp, Homo sapiens
agaaaggaagggaggagtttat

SEQ ID NO: 7828572 - DNA, 22 bp, Homo sapiens
agaaaggaagggaggagtttat

SEQ ID NO: 7828573 - DNA, 22 bp, Homo sapiens
agaaagctggagtcaagcagag

SEQ ID NO: 7828574 - DNA, 22 bp, Homo sapiens
agaaactgacaggaaatgaatt

SEQ ID NO: 7828575 - DNA, 22 bp, Homo sapiens
aatcacatctcattcaacagcc

SEQ ID NO: 7828576 - DNA, 22 bp, Homo sapiens
agaaactgaacacaagagtcgg

SEQ ID NO: 7828577 - DNA, 22 bp, Homo sapiens
agaaactgaattatttctgagg

SEQ ID NO: 7828578 - DNA, 22 bp, Homo sapiens
aatcacatagccatctctttga

SEQ ID NO: 7828579 - DNA, 22 bp, Homo sapiens
aatcacagtttcaagtaatgca

SEQ ID NO: 7828580 - DNA, 22 bp, Homo sapiens
aatcacagtttcaagtaatgca

SEQ ID NO: 7828581 - DNA, 22 bp, Homo sapiens
aatcacagtttcaagtaatgca

SEQ ID NO: 7828582 - DNA, 22 bp, Homo sapiens
aatcacagttagtaagggagaa

SEQ ID NO: 7828583 - DNA, 20 bp, Homo sapiens
aatcacagttaactctttct

SEQ ID NO: 7828584 - DNA, 22 bp, Homo sapiens
aatcacagttagtaagggagaa

SEQ ID NO: 7828585 - DNA, 22 bp, Homo sapiens
aatcacagttagtaagggagaa

SEQ ID NO: 7828586 - DNA, 22 bp, Homo sapiens
aatcacagtgggtactagattg

SEQ ID NO: 7828587 - DNA, 22 bp, Homo sapiens
aatcacagtgggtactagattg

SEQ ID NO: 7828588 - DNA, 20 bp, Homo sapiens
aatcacagttaactctttct

SEQ ID NO: 7828589 - DNA, 22 bp, Homo sapiens
aatcacagtgggtactagattg

SEQ ID NO: 7828590 - DNA, 22 bp, Homo sapiens
aatcacaggcatagattgctcc

SEQ ID NO: 7828591 - DNA, 22 bp, Homo sapiens
aatcacaggcatagattgctcc

SEQ ID NO: 7828592 - DNA, 22 bp, Homo sapiens
aatcacaggcatagattgctcc

SEQ ID NO: 7828593 - DNA, 22 bp, Homo sapiens
aatcacagccacaacctggggg

SEQ ID NO: 7828594 - DNA, 22 bp, Homo sapiens
aatcacagccagcttccgctat

SEQ ID NO: 7828595 - DNA, 22 bp, Homo sapiens
aatcacagagtccagcagatga

SEQ ID NO: 7828596 - DNA, 22 bp, Homo sapiens
aatcacagagtccagcagatga

SEQ ID NO: 7828597 - DNA, 22 bp, Homo sapiens
aatcacagagtccagcagatga

SEQ ID NO: 7828598 - DNA, 22 bp, Homo sapiens
aatcacagagtccagcagatga

SEQ ID NO: 7828599 - DNA, 22 bp, Homo sapiens
aatcacacaaaggcaacttttg

SEQ ID NO: 7828600 - DNA, 23 bp, Homo sapiens
aatcacacgtttggccaggatgc

SEQ ID NO: 7828601 - DNA, 22 bp, Homo sapiens
aatcacagaaggcagtcttcta

SEQ ID NO: 7828602 - DNA, 22 bp, Homo sapiens
aatcacaaatttagacagagct

SEQ ID NO: 7828603 - DNA, 22 bp, Homo sapiens
aatcacaattacttttgcacca

SEQ ID NO: 7828604 - DNA, 22 bp, Homo sapiens
aatcacaaatttagacagagct

SEQ ID NO: 7828605 - DNA, 22 bp, Homo sapiens
aatcacaaatttagacagagct

SEQ ID NO: 7828606 - DNA, 22 bp, Homo sapiens
aatcacaaatgcaagttgtcac

SEQ ID NO: 7828607 - DNA, 22 bp, Homo sapiens
aatcacaaatgcaagttgtcac

SEQ ID NO: 7828608 - DNA, 22 bp, Homo sapiens
aatcctgtagattctaattcct

SEQ ID NO: 7828609 - DNA, 22 bp, Homo sapiens
aatcctggcctagctgggctca

SEQ ID NO: 7828610 - DNA, 20 bp, Homo sapiens
aatcctgggacagaggcagg

SEQ ID NO: 7828611 - DNA, 22 bp, Homo sapiens
aatcctggctgcgttggccagc

SEQ ID NO: 7828612 - DNA, 22 bp, Homo sapiens
agaaagggatgaggtagctgct

SEQ ID NO: 7828613 - DNA, 22 bp, Homo sapiens
agaaagggatgaggtagctgct

SEQ ID NO: 7828614 - DNA, 22 bp, Homo sapiens
agaaagggatgaggtagctgct

SEQ ID NO: 7828615 - DNA, 22 bp, Homo sapiens
agaaagggatgaggtagctgct

SEQ ID NO: 7828616 - DNA, 22 bp, Homo sapiens
aatcgcttggtaattttaaaag

SEQ ID NO: 7828617 - DNA, 22 bp, Homo sapiens
aatcgcttggtaattttaaaag

SEQ ID NO: 7828618 - DNA, 22 bp, Homo sapiens
aatcctgtgtgactctggggag

SEQ ID NO: 7828619 - DNA, 22 bp, Homo sapiens
aatcctgtcttgccatccaata

SEQ ID NO: 7828620 - DNA, 22 bp, Homo sapiens
aatcctgtgtgactctggggag

SEQ ID NO: 7828621 - DNA, 21 bp, Homo sapiens
aatccttaatgaggagttggt

SEQ ID NO: 7828622 - DNA, 22 bp, Homo sapiens
aatccttactgaatgagaaaaa

SEQ ID NO: 7828623 - DNA, 22 bp, Homo sapiens
aatccttactgaatgagaaaaa

SEQ ID NO: 7828624 - DNA, 22 bp, Homo sapiens
aatccttaggcagaccgtgatg

SEQ ID NO: 7828625 - DNA, 22 bp, Homo sapiens
aatccttatataatgccttcca

SEQ ID NO: 7828626 - DNA, 22 bp, Homo sapiens
aatccttatttgtctagttcca

SEQ ID NO: 7828627 - DNA, 22 bp, Homo sapiens
agaaagggaactggcaaagcca

SEQ ID NO: 7828628 - DNA, 22 bp, Homo sapiens
agaaagggaactggcaaagcca

SEQ ID NO: 7828629 - DNA, 22 bp, Homo sapiens
agaaagggaactggcaaagcca

SEQ ID NO: 7828630 - DNA, 17 bp, Homo sapiens
agaaaggcagttcctct

SEQ ID NO: 7828631 - DNA, 22 bp, Homo sapiens
agaaagggagcgtggatcaatt

SEQ ID NO: 7828632 - DNA, 22 bp, Homo sapiens
agaaagggagcgtggatcaatt

SEQ ID NO: 7828633 - DNA, 22 bp, Homo sapiens
agaaagggagagccagcacacg

SEQ ID NO: 7828634 - DNA, 22 bp, Homo sapiens
agaaagggagagccagcacacg

SEQ ID NO: 7828635 - DNA, 22 bp, Homo sapiens
agaaagggagcgtggatcaatt

SEQ ID NO: 7828636 - DNA, 22 bp, Homo sapiens
aatctacatgcaatatttttag

SEQ ID NO: 7828637 - DNA, 22 bp, Homo sapiens
aatctacatttcagttttgccc

SEQ ID NO: 7828638 - DNA, 22 bp, Homo sapiens
aatctaccttattcgatattta

SEQ ID NO: 7828639 - DNA, 19 bp, Homo sapiens
aatctagaaatatgtgttc

SEQ ID NO: 7828640 - DNA, 19 bp, Homo sapiens
aatctagaaatatgtgttc

SEQ ID NO: 7828641 - DNA, 19 bp, Homo sapiens
aatctagaaatatgtgttc

SEQ ID NO: 7828642 - DNA, 22 bp, Homo sapiens
aatctacatgcaatatttttag

SEQ ID NO: 7828643 - DNA, 22 bp, Homo sapiens
aatctacatgcaatatttttag

SEQ ID NO: 7828644 - DNA, 22 bp, Homo sapiens
aatctaaggacttagcattgct

SEQ ID NO: 7828645 - DNA, 22 bp, Homo sapiens
aatctaaggacttagcattgct

SEQ ID NO: 7828646 - DNA, 22 bp, Homo sapiens
aatctaaggacttagcattgct

SEQ ID NO: 7828647 - DNA, 22 bp, Homo sapiens
aatctaagccaccagtagtttc

SEQ ID NO: 7828648 - DNA, 22 bp, Homo sapiens
aatctaagccaccagtagtttc

SEQ ID NO: 7828649 - DNA, 22 bp, Homo sapiens
aatctaagccaccagtagtttc

SEQ ID NO: 7828650 - DNA, 22 bp, Homo sapiens
aatctacatagagatcaaatga

SEQ ID NO: 7828651 - DNA, 22 bp, Homo sapiens
aatctaagggaaattggagatg

SEQ ID NO: 7828652 - DNA, 22 bp, Homo sapiens
aatctagagttcccagcataaa

SEQ ID NO: 7828653 - DNA, 22 bp, Homo sapiens
aatctagattcggatcaaaggg

SEQ ID NO: 7828654 - DNA, 22 bp, Homo sapiens
aatctagattcggatcaaaggg

SEQ ID NO: 7828655 - DNA, 22 bp, Homo sapiens
aatctagattcggatcaaaggg

SEQ ID NO: 7828656 - DNA, 22 bp, Homo sapiens
aatctagattcggatcaaaggg

SEQ ID NO: 7828657 - DNA, 22 bp, Homo sapiens
aatctagagttcccagcataaa

SEQ ID NO: 7828658 - DNA, 22 bp, Homo sapiens
aatctagagttcccagcataaa

SEQ ID NO: 7828659 - DNA, 22 bp, Homo sapiens
aatctagagttcccagcataaa

SEQ ID NO: 7828660 - DNA, 22 bp, Homo sapiens
aatctagtttaatatgtttaaa

SEQ ID NO: 7828661 - DNA, 22 bp, Homo sapiens
aatctagtttaatatgtttaaa

SEQ ID NO: 7828662 - DNA, 23 bp, Homo sapiens
aatctatacttaggctggtaata

SEQ ID NO: 7828663 - DNA, 22 bp, Homo sapiens
aatctagtttcagactttgagt

SEQ ID NO: 7828664 - DNA, 22 bp, Homo sapiens
aatctagtttcagactttgagt

SEQ ID NO: 7828665 - DNA, 22 bp, Homo sapiens
aatctagagtgctaggtctgtg

SEQ ID NO: 7828666 - DNA, 22 bp, Homo sapiens
aatctagagtgctaggtctgtg

SEQ ID NO: 7828667 - DNA, 22 bp, Homo sapiens
aatctagagacaatttgaatat

SEQ ID NO: 7828668 - DNA, 22 bp, Homo sapiens
aatctagagtgctaggtctgtg

SEQ ID NO: 7828669 - DNA, 22 bp, Homo sapiens
aatctagagttcccagcataaa

SEQ ID NO: 7828670 - DNA, 23 bp, Homo sapiens
aatctagaatgacctactcatct

SEQ ID NO: 7828671 - DNA, 23 bp, Homo sapiens
aatctagaatgacctactcatct

SEQ ID NO: 7828672 - DNA, 23 bp, Homo sapiens
aatctagaatgacctactcatct

SEQ ID NO: 7828673 - DNA, 22 bp, Homo sapiens
aatctagaattttaggggtata

SEQ ID NO: 7828674 - DNA, 22 bp, Homo sapiens
aatctagaattttaggggtata

SEQ ID NO: 7828675 - DNA, 22 bp, Homo sapiens
aatctagagaactgtggggcag

SEQ ID NO: 7828676 - DNA, 22 bp, Homo sapiens
aatctagagaactgtggggcag

SEQ ID NO: 7828677 - DNA, 22 bp, Homo sapiens
aatctagagacaatttgaatat

SEQ ID NO: 7828678 - DNA, 22 bp, Homo sapiens
aagtgtttacttaaagtcatgg

SEQ ID NO: 7828679 - DNA, 22 bp, Homo sapiens
aagtgtttacttaaagtcatgg

SEQ ID NO: 7828680 - DNA, 22 bp, Homo sapiens
aagtgtttaggtttgcagtcga

SEQ ID NO: 7828681 - DNA, 22 bp, Homo sapiens
aagtgtttatggttattgttaa

SEQ ID NO: 7828682 - DNA, 22 bp, Homo sapiens
aagtgtttatggttattgttaa

SEQ ID NO: 7828683 - DNA, 22 bp, Homo sapiens
aagtgtttatttataacgatct

SEQ ID NO: 7828684 - DNA, 22 bp, Homo sapiens
aagtgtttcaataatttggacc

SEQ ID NO: 7828685 - DNA, 22 bp, Homo sapiens
aagtgtttaaattatttgcagg

SEQ ID NO: 7828686 - DNA, 22 bp, Homo sapiens
aagtgtttaaattatttgcagg

SEQ ID NO: 7828687 - DNA, 22 bp, Homo sapiens
aagtgttatgtaggatttcaga

SEQ ID NO: 7828688 - DNA, 22 bp, Homo sapiens
actcttgtctcaacttttgtat

SEQ ID NO: 7828689 - DNA, 22 bp, Homo sapiens
actctttaacagactttgatct

SEQ ID NO: 7828690 - DNA, 20 bp, Homo sapiens
actctttagaagggaaaaca

SEQ ID NO: 7828691 - DNA, 20 bp, Homo sapiens
actctttagaagggaaaaca

SEQ ID NO: 7828692 - DNA, 22 bp, Homo sapiens
actctttacttaaactctaagt

SEQ ID NO: 7828693 - DNA, 22 bp, Homo sapiens
actctttacttaaactctaagt

SEQ ID NO: 7828694 - DNA, 22 bp, Homo sapiens
actcttggccactcttggtgtc

SEQ ID NO: 7828695 - DNA, 22 bp, Homo sapiens
actcttgattgatttagtcttt

SEQ ID NO: 7828696 - DNA, 22 bp, Homo sapiens
actcttgactccatggtgttag

SEQ ID NO: 7828697 - DNA, 20 bp, Homo sapiens
actcttgagaaattctctgt

SEQ ID NO: 7828698 - DNA, 22 bp, Homo sapiens
actcttgactccatggtgttag

SEQ ID NO: 7828699 - DNA, 22 bp, Homo sapiens
actcttgacgggtgaggatatg

SEQ ID NO: 7828700 - DNA, 22 bp, Homo sapiens
actcttgaaggtggtgggagtg

SEQ ID NO: 7828701 - DNA, 22 bp, Homo sapiens
actcttgaaaatagatccacat

SEQ ID NO: 7828702 - DNA, 22 bp, Homo sapiens
actcttgaactgattaagaatg

SEQ ID NO: 7828703 - DNA, 22 bp, Homo sapiens
actcttgaactgattaagaatg

SEQ ID NO: 7828704 - DNA, 22 bp, Homo sapiens
actctggcttgaggaccaggtc

SEQ ID NO: 7828705 - DNA, 22 bp, Homo sapiens
actctggcttgaggaccaggtc

SEQ ID NO: 7828706 - DNA, 22 bp, Homo sapiens
actctggcttgaggaccaggtc

SEQ ID NO: 7828707 - DNA, 22 bp, Homo sapiens
actctgggaatcctcaccttcc

SEQ ID NO: 7828708 - DNA, 18 bp, Homo sapiens
actctgggacctgttatt

SEQ ID NO: 7828709 - DNA, 16 bp, Homo sapiens
actcttcatttagggt

SEQ ID NO: 7828710 - DNA, 22 bp, Homo sapiens
actcttcttgctgctcattaat

SEQ ID NO: 7828711 - DNA, 22 bp, Homo sapiens
aagtgtttggggatcattttaa

SEQ ID NO: 7828712 - DNA, 22 bp, Homo sapiens
aagtgttttctccccaccaggc

SEQ ID NO: 7828713 - DNA, 22 bp, Homo sapiens
actctggctgccttgtgagcat

SEQ ID NO: 7828714 - DNA, 22 bp, Homo sapiens
aagtgggtcagggacagatctt

SEQ ID NO: 7828715 - DNA, 19 bp, Homo sapiens
aagtgggtagcacattcac

SEQ ID NO: 7828716 - DNA, 22 bp, Homo sapiens
acctgcctctaagcagcaggtg

SEQ ID NO: 7828717 - DNA, 22 bp, Homo sapiens
acctgcctcagtgcagctggat

SEQ ID NO: 7828718 - DNA, 22 bp, Homo sapiens
acctgcctctaagcagcaggtg

SEQ ID NO: 7828719 - DNA, 22 bp, Homo sapiens
acctgcctatggagccacatgg

SEQ ID NO: 7828720 - DNA, 22 bp, Homo sapiens
acctgcctatggagccacatgg

SEQ ID NO: 7828721 - DNA, 22 bp, Homo sapiens
acctgcctcagtgcagctggat

SEQ ID NO: 7828722 - DNA, 22 bp, Homo sapiens
acctgcctcagtgcagctggat

SEQ ID NO: 7828723 - DNA, 22 bp, Homo sapiens
aagtgtctgcaaaatgacagag

SEQ ID NO: 7828724 - DNA, 22 bp, Homo sapiens
aagtgtctgctggctctaccct

SEQ ID NO: 7828725 - DNA, 22 bp, Homo sapiens
aagtgtctgctggctctaccct

SEQ ID NO: 7828726 - DNA, 22 bp, Homo sapiens
aagtgtctgctggctctaccct

SEQ ID NO: 7828727 - DNA, 22 bp, Homo sapiens
aagtgtcttctgatggggtgtg

SEQ ID NO: 7828728 - DNA, 22 bp, Homo sapiens
aagtgtcttaactccttttggg

SEQ ID NO: 7828729 - DNA, 22 bp, Homo sapiens
aagtgtcttctgatggggtgtg

SEQ ID NO: 7828730 - DNA, 22 bp, Homo sapiens
aagtgtctgacacaaaatatgt

SEQ ID NO: 7828731 - DNA, 22 bp, Homo sapiens
aagtgggtcataaaaaattgca

SEQ ID NO: 7828732 - DNA, 22 bp, Homo sapiens
aagtgggtgcactcaactttat

SEQ ID NO: 7828733 - DNA, 22 bp, Homo sapiens
aagtgggttcatgtggcattat

SEQ ID NO: 7828734 - DNA, 22 bp, Homo sapiens
aagtgtctgacacaaaatatgt

SEQ ID NO: 7828735 - DNA, 22 bp, Homo sapiens
aagtgtctgatggagcgaaatg

SEQ ID NO: 7828736 - DNA, 22 bp, Homo sapiens
aagtgtctgcaaaatgacagag

SEQ ID NO: 7828737 - DNA, 22 bp, Homo sapiens
aagtgtctgcaaaatgacagag

SEQ ID NO: 7828738 - DNA, 19 bp, Homo sapiens
aagtgtgttgagccaggat

SEQ ID NO: 7828739 - DNA, 19 bp, Homo sapiens
aagtgtgttgagccaggat

SEQ ID NO: 7828740 - DNA, 22 bp, Homo sapiens
aagtgtgtgagcctgtcaggct

SEQ ID NO: 7828741 - DNA, 22 bp, Homo sapiens
aagtgtgtgagcctgtcaggct

SEQ ID NO: 7828742 - DNA, 22 bp, Homo sapiens
aagtgtgtgggcaggcagtggt

SEQ ID NO: 7828743 - DNA, 22 bp, Homo sapiens
aagtgtgtgggcaggcagtggt

SEQ ID NO: 7828744 - DNA, 22 bp, Homo sapiens
aagtgtgtatttttcttcagtg

SEQ ID NO: 7828745 - DNA, 22 bp, Homo sapiens
aagtgtgtctggcggcccagtg

SEQ ID NO: 7828746 - DNA, 22 bp, Homo sapiens
aagtgtgtcttgggaagggagg

SEQ ID NO: 7828747 - DNA, 22 bp, Homo sapiens
aagtgtgtattgtttatgctgc

SEQ ID NO: 7828748 - DNA, 22 bp, Homo sapiens
aagtgtggggtctcagagctga

SEQ ID NO: 7828749 - DNA, 22 bp, Homo sapiens
aagtgtgggaagtaggtggcga

SEQ ID NO: 7828750 - DNA, 22 bp, Homo sapiens
aagtgtgatttgtagaatgcct

SEQ ID NO: 7828751 - DNA, 22 bp, Homo sapiens
aagtgtgagacacacaaaatta

SEQ ID NO: 7828752 - DNA, 22 bp, Homo sapiens
aagtgtgagacacacaaaatta

SEQ ID NO: 7828753 - DNA, 22 bp, Homo sapiens
aagtgtgagccagccctttgca

SEQ ID NO: 7828754 - DNA, 22 bp, Homo sapiens
aagtgtgacactgtgttaatta

SEQ ID NO: 7828755 - DNA, 22 bp, Homo sapiens
aagtgtgagacacacaaaatta

SEQ ID NO: 7828756 - DNA, 22 bp, Homo sapiens
aagtgtgaattttagagtcagg

SEQ ID NO: 7828757 - DNA, 22 bp, Homo sapiens
aagtgtcttttagccactttta

SEQ ID NO: 7828758 - DNA, 22 bp, Homo sapiens
aagtgtctttatatttgagaaa

SEQ ID NO: 7828759 - DNA, 22 bp, Homo sapiens
aagtgtgaattttagagtcagg

SEQ ID NO: 7828760 - DNA, 22 bp, Homo sapiens
aagtgtcttttagccactttta

SEQ ID NO: 7828761 - DNA, 20 bp, Homo sapiens
aagttttctccaaatacagt

SEQ ID NO: 7828762 - DNA, 22 bp, Homo sapiens
aagttttcctgtgtccaagatg

SEQ ID NO: 7828763 - DNA, 22 bp, Homo sapiens
actgcatgtaaggcaatatgtt

SEQ ID NO: 7828764 - DNA, 22 bp, Homo sapiens
actgcattatcaccaagatgta

SEQ ID NO: 7828765 - DNA, 21 bp, Homo sapiens
actgcatctgaagtcccagga

SEQ ID NO: 7828766 - DNA, 22 bp, Homo sapiens
actgcatctgaactgtgaatgg

SEQ ID NO: 7828767 - DNA, 22 bp, Homo sapiens
actgcatgataataatagcaga

SEQ ID NO: 7828768 - DNA, 22 bp, Homo sapiens
actgcatgctttacatgacatg

SEQ ID NO: 7828769 - DNA, 22 bp, Homo sapiens
actgcaggccttggtgccagca

SEQ ID NO: 7828770 - DNA, 22 bp, Homo sapiens
actgcaggccttggtgccagca

SEQ ID NO: 7828771 - DNA, 19 bp, Homo sapiens
actgcagggaggaggtgtg

SEQ ID NO: 7828772 - DNA, 19 bp, Homo sapiens
actgcagggaggaggtgtg

SEQ ID NO: 7828773 - DNA, 22 bp, Homo sapiens
actgcaggccttggtgccagca

SEQ ID NO: 7828774 - DNA, 19 bp, Homo sapiens
actgcagggaggaggtgtg

SEQ ID NO: 7828775 - DNA, 19 bp, Homo sapiens
actgcagggaggaggtgtg

SEQ ID NO: 7828776 - DNA, 22 bp, Homo sapiens
actgcagggcatcctggccaag

SEQ ID NO: 7828777 - DNA, 22 bp, Homo sapiens
actgcatagaggtccctgcgtc

SEQ ID NO: 7828778 - DNA, 22 bp, Homo sapiens
actgcagttggtgacaataacc

SEQ ID NO: 7828779 - DNA, 23 bp, Homo sapiens
actgcagtcttgatctcctgggc

SEQ ID NO: 7828780 - DNA, 22 bp, Homo sapiens
actgcagtcatcatctccctgg

SEQ ID NO: 7828781 - DNA, 22 bp, Homo sapiens
actgcagtggcaggaacttatc

SEQ ID NO: 7828782 - DNA, 22 bp, Homo sapiens
actgcaggtggatggcacttta

SEQ ID NO: 7828783 - DNA, 22 bp, Homo sapiens
actgcagtcatcatctccctgg

SEQ ID NO: 7828784 - DNA, 22 bp, Homo sapiens
aagttcctgggtgatcctgatg

SEQ ID NO: 7828785 - DNA, 22 bp, Homo sapiens
aagttcctgggccaagtccagg

SEQ ID NO: 7828786 - DNA, 22 bp, Homo sapiens
aagttcctgggtgatcctgatg

SEQ ID NO: 7828787 - DNA, 22 bp, Homo sapiens
aagttccttgaatgaagctagg

SEQ ID NO: 7828788 - DNA, 22 bp, Homo sapiens
actgcactccagcctgggtgac

SEQ ID NO: 7828789 - DNA, 22 bp, Homo sapiens
actgcactccagcctgggtgac

SEQ ID NO: 7828790 - DNA, 22 bp, Homo sapiens
aagttctaacatctacgtggaa

SEQ ID NO: 7828791 - DNA, 22 bp, Homo sapiens
actgcactccagcctgggtgac

SEQ ID NO: 7828792 - DNA, 22 bp, Homo sapiens
actgcactccagcctgggtgac

SEQ ID NO: 7828793 - DNA, 22 bp, Homo sapiens
actgcagctggtggtggctctg

SEQ ID NO: 7828794 - DNA, 22 bp, Homo sapiens
actgcagcctttgggctcataa

SEQ ID NO: 7828795 - DNA, 22 bp, Homo sapiens
actgcagcctttgggctcataa

SEQ ID NO: 7828796 - DNA, 22 bp, Homo sapiens
actgcagcctttgggctcataa

SEQ ID NO: 7828797 - DNA, 22 bp, Homo sapiens
actgcagctggtggtggctctg

SEQ ID NO: 7828798 - DNA, 22 bp, Homo sapiens
actgcagctggtggtggctctg

SEQ ID NO: 7828799 - DNA, 22 bp, Homo sapiens
actgcaggagacacagctgctg

SEQ ID NO: 7828800 - DNA, 22 bp, Homo sapiens
actgcaggagacacagctgctg

SEQ ID NO: 7828801 - DNA, 18 bp, Homo sapiens
actgcaggagaggtgagg

SEQ ID NO: 7828802 - DNA, 18 bp, Homo sapiens
actgcaggagaggtgagg

SEQ ID NO: 7828803 - DNA, 22 bp, Homo sapiens
actgcaggagacacagctgctg

SEQ ID NO: 7828804 - DNA, 18 bp, Homo sapiens
actgcaggagaggtgagg

SEQ ID NO: 7828805 - DNA, 22 bp, Homo sapiens
actgcaggccttggtgccagca

SEQ ID NO: 7828806 - DNA, 22 bp, Homo sapiens
actgcaggccttggtgccagca

SEQ ID NO: 7828807 - DNA, 22 bp, Homo sapiens
actctttattgtttgtggctag

SEQ ID NO: 7828808 - DNA, 22 bp, Homo sapiens
actctttatggtaagccgacca

SEQ ID NO: 7828809 - DNA, 22 bp, Homo sapiens
actctttattgtttgtggctag

SEQ ID NO: 7828810 - DNA, 22 bp, Homo sapiens
actctttagaggtacatctctt

SEQ ID NO: 7828811 - DNA, 22 bp, Homo sapiens
actctttagaggtacatctctt

SEQ ID NO: 7828812 - DNA, 18 bp, Homo sapiens
actctttctgcccacagg

SEQ ID NO: 7828813 - DNA, 18 bp, Homo sapiens
actctttctgcccacagg

SEQ ID NO: 7828814 - DNA, 18 bp, Homo sapiens
actctttctgcccacagg

SEQ ID NO: 7828815 - DNA, 18 bp, Homo sapiens
actctttctgcccacagg

SEQ ID NO: 7828816 - DNA, 22 bp, Homo sapiens
actcttttataaagcatcttga

SEQ ID NO: 7828817 - DNA, 22 bp, Homo sapiens
actcttttataaagcatcttga

SEQ ID NO: 7828818 - DNA, 19 bp, Homo sapiens
actcttttccttttgaatc

SEQ ID NO: 7828819 - DNA, 19 bp, Homo sapiens
actcttttccttttgaatc

SEQ ID NO: 7828820 - DNA, 19 bp, Homo sapiens
actcttttccttttgaatc

SEQ ID NO: 7828821 - DNA, 22 bp, Homo sapiens
actcttttatgcattccttcag

SEQ ID NO: 7828822 - DNA, 22 bp, Homo sapiens
actgaaaatgaattagaaacag

SEQ ID NO: 7828823 - DNA, 22 bp, Homo sapiens
aagttcaagtagtgttacatgg

SEQ ID NO: 7828824 - DNA, 22 bp, Homo sapiens
aagttcaaggtgatagtggcag

SEQ ID NO: 7828825 - DNA, 22 bp, Homo sapiens
actgaaaaagtatgattcactg

SEQ ID NO: 7828826 - DNA, 22 bp, Homo sapiens
actgaaaatgaattagaaacag

SEQ ID NO: 7828827 - DNA, 22 bp, Homo sapiens
actgaaaaagacatcttggtaa

SEQ ID NO: 7828828 - DNA, 22 bp, Homo sapiens
aagttcaatcagatgaaaaagc

SEQ ID NO: 7828829 - DNA, 22 bp, Homo sapiens
aagttcaatcagatgaaaaagc

SEQ ID NO: 7828830 - DNA, 22 bp, Homo sapiens
aagttcaagtctcctgagtata

SEQ ID NO: 7828831 - DNA, 22 bp, Homo sapiens
aagttcacagaagattccaatt

SEQ ID NO: 7828832 - DNA, 22 bp, Homo sapiens
aagttcagcctggttttaatgc

SEQ ID NO: 7828833 - DNA, 22 bp, Homo sapiens
aagttcatcttacctagatttt

SEQ ID NO: 7828834 - DNA, 22 bp, Homo sapiens
aagttcatcaaagagtaaatat

SEQ ID NO: 7828835 - DNA, 22 bp, Homo sapiens
aagttcatcttacctagatttt

SEQ ID NO: 7828836 - DNA, 22 bp, Homo sapiens
aagttcatcaaagagtaaatat

SEQ ID NO: 7828837 - DNA, 22 bp, Homo sapiens
aagttcatggtaggttggaagg

SEQ ID NO: 7828838 - DNA, 22 bp, Homo sapiens
aagttcatcaaagagtaaatat

SEQ ID NO: 7828839 - DNA, 22 bp, Homo sapiens
aagttcatcaaagagtaaatat

SEQ ID NO: 7828840 - DNA, 22 bp, Homo sapiens
aagttcatcaaagagtaaatat

SEQ ID NO: 7828841 - DNA, 22 bp, Homo sapiens
aagttcccgaggaccacagttg

SEQ ID NO: 7828842 - DNA, 22 bp, Homo sapiens
aagttccctttctttgccagga

SEQ ID NO: 7828843 - DNA, 22 bp, Homo sapiens
aagttccctttctttgccagga

SEQ ID NO: 7828844 - DNA, 22 bp, Homo sapiens
aagttcctgagctcatatagca

SEQ ID NO: 7828845 - DNA, 22 bp, Homo sapiens
aagttcctatatccaaatacag

SEQ ID NO: 7828846 - DNA, 22 bp, Homo sapiens
actgtacatatggattctaaga

SEQ ID NO: 7828847 - DNA, 22 bp, Homo sapiens
actgtacatatggattctaaga

SEQ ID NO: 7828848 - DNA, 22 bp, Homo sapiens
actgtacatatggattctaaga

SEQ ID NO: 7828849 - DNA, 22 bp, Homo sapiens
actgtacacgtgtcatttacag

SEQ ID NO: 7828850 - DNA, 22 bp, Homo sapiens
actgtacacattcgtcaagact

SEQ ID NO: 7828851 - DNA, 22 bp, Homo sapiens
actgtacacattcgtcaagact

SEQ ID NO: 7828852 - DNA, 22 bp, Homo sapiens
actgtacacgtgtcatttacag

SEQ ID NO: 7828853 - DNA, 22 bp, Homo sapiens
actgtacacgtgtcatttacag

SEQ ID NO: 7828854 - DNA, 22 bp, Homo sapiens
actgtcatgcattatggcatgt

SEQ ID NO: 7828855 - DNA, 22 bp, Homo sapiens
actgtacatgcatcttgtctat

SEQ ID NO: 7828856 - DNA, 21 bp, Homo sapiens
actgtcatttgcttagggagg

SEQ ID NO: 7828857 - DNA, 22 bp, Homo sapiens
actgtcctagaacctgcagctc

SEQ ID NO: 7828858 - DNA, 22 bp, Homo sapiens
actgtacacacttctctgtctt

SEQ ID NO: 7828859 - DNA, 22 bp, Homo sapiens
actgtacaactgctgagcagaa

SEQ ID NO: 7828860 - DNA, 22 bp, Homo sapiens
actgtacaacctctgcccctgt

SEQ ID NO: 7828861 - DNA, 22 bp, Homo sapiens
actgtacaaatattgcaaaata

SEQ ID NO: 7828862 - DNA, 22 bp, Homo sapiens
actgtacaaatattgcaaaata

SEQ ID NO: 7828863 - DNA, 22 bp, Homo sapiens
actgtacaaatattgcaaaata

SEQ ID NO: 7828864 - DNA, 22 bp, Homo sapiens
actgtacaaatattgcaaaata

SEQ ID NO: 7828865 - DNA, 22 bp, Homo sapiens
actgtaatatggttcttttgat

SEQ ID NO: 7828866 - DNA, 22 bp, Homo sapiens
actgtaatggtggatccatgtc

SEQ ID NO: 7828867 - DNA, 22 bp, Homo sapiens
actgtaatggtggatccatgtc

SEQ ID NO: 7828868 - DNA, 22 bp, Homo sapiens
actgtaatgttttaaagcagag

SEQ ID NO: 7828869 - DNA, 22 bp, Homo sapiens
actgtaatgttttaaagcagag

SEQ ID NO: 7828870 - DNA, 22 bp, Homo sapiens
actgtaattggattgtctgact

SEQ ID NO: 7828871 - DNA, 22 bp, Homo sapiens
actgtaatatggttcttttgat

SEQ ID NO: 7828872 - DNA, 22 bp, Homo sapiens
actgtaatattttaagatgtct

SEQ ID NO: 7828873 - DNA, 22 bp, Homo sapiens
actgtaatattttaagatgtct

SEQ ID NO: 7828874 - DNA, 22 bp, Homo sapiens
actggggagagtcatgccagca

SEQ ID NO: 7828875 - DNA, 22 bp, Homo sapiens
aatagcatcctaaaacatactt

SEQ ID NO: 7828876 - DNA, 22 bp, Homo sapiens
aatagcatagagttaaaatgca

SEQ ID NO: 7828877 - DNA, 19 bp, Homo sapiens
aatagcaggagcagttccc

SEQ ID NO: 7828878 - DNA, 22 bp, Homo sapiens
aatagcacttcctgaacacatt

SEQ ID NO: 7828879 - DNA, 22 bp, Homo sapiens
aatagcagaagactagtagaca

SEQ ID NO: 7828880 - DNA, 22 bp, Homo sapiens
aatagcataagatgtcaaatag

SEQ ID NO: 7828881 - DNA, 22 bp, Homo sapiens
aatagcaattacccttcaactc

SEQ ID NO: 7828882 - DNA, 22 bp, Homo sapiens
aatagcaattacccttcaactc

SEQ ID NO: 7828883 - DNA, 22 bp, Homo sapiens
aatagcaaatgctcatttgaaa

SEQ ID NO: 7828884 - DNA, 22 bp, Homo sapiens
aatagcaaatgctcatttgaaa

SEQ ID NO: 7828885 - DNA, 22 bp, Homo sapiens
aatagcaaagttatcaaattaa

SEQ ID NO: 7828886 - DNA, 22 bp, Homo sapiens
aatagcaaagttatcaaattaa

SEQ ID NO: 7828887 - DNA, 22 bp, Homo sapiens
aatagcaaagttatcaaattaa

SEQ ID NO: 7828888 - DNA, 22 bp, Homo sapiens
aatagaatttaaatgcagtggc

SEQ ID NO: 7828889 - DNA, 22 bp, Homo sapiens
aatagaatttaaatgcagtggc

SEQ ID NO: 7828890 - DNA, 22 bp, Homo sapiens
aatagcaaagttatcaaattaa

SEQ ID NO: 7828891 - DNA, 22 bp, Homo sapiens
aatagcaaagttatcaaattaa

SEQ ID NO: 7828892 - DNA, 22 bp, Homo sapiens
actgtctcctcatcatgcctgg

SEQ ID NO: 7828893 - DNA, 22 bp, Homo sapiens
actgtctctctagcagttcagg

SEQ ID NO: 7828894 - DNA, 22 bp, Homo sapiens
actgtctctctagcagttcagg

SEQ ID NO: 7828895 - DNA, 18 bp, Homo sapiens
actgtctctgagagtggt

SEQ ID NO: 7828896 - DNA, 22 bp, Homo sapiens
actgtctctctagcagttcagg

SEQ ID NO: 7828897 - DNA, 22 bp, Homo sapiens
actgtctgagctgattgagcta

SEQ ID NO: 7828898 - DNA, 18 bp, Homo sapiens
actgtctctgagagtggt

SEQ ID NO: 7828899 - DNA, 22 bp, Homo sapiens
aatagaatgtaatctaatacat

SEQ ID NO: 7828900 - DNA, 22 bp, Homo sapiens
aatagaacaataattgtaaact

SEQ ID NO: 7828901 - DNA, 23 bp, Homo sapiens
actgtctgatatgttttccatca

SEQ ID NO: 7828902 - DNA, 22 bp, Homo sapiens
actgtctcctcatcatgcctgg

SEQ ID NO: 7828903 - DNA, 22 bp, Homo sapiens
actgtctcctcatcatgcctgg

SEQ ID NO: 7828904 - DNA, 22 bp, Homo sapiens
actgtcgattatgatgagtcag

SEQ ID NO: 7828905 - DNA, 22 bp, Homo sapiens
actgtccttttaatgcagccgt

SEQ ID NO: 7828906 - DNA, 22 bp, Homo sapiens
actgtcctcagatattcttctg

SEQ ID NO: 7828907 - DNA, 22 bp, Homo sapiens
actgtcctcagatattcttctg

SEQ ID NO: 7828908 - DNA, 22 bp, Homo sapiens
actgtcctagaacctgcagctc

SEQ ID NO: 7828909 - DNA, 22 bp, Homo sapiens
actgtcctagaacctgcagctc

SEQ ID NO: 7828910 - DNA, 22 bp, Homo sapiens
actgtcctagaacctgcagctc

SEQ ID NO: 7828911 - DNA, 22 bp, Homo sapiens
actgtcctgaatactgcatgac

SEQ ID NO: 7828912 - DNA, 22 bp, Homo sapiens
actgtcctgaatactgcatgac

SEQ ID NO: 7828913 - DNA, 22 bp, Homo sapiens
actgtcctgaatactgcatgac

SEQ ID NO: 7828914 - DNA, 22 bp, Homo sapiens
aataatagcagagtttacaatc

SEQ ID NO: 7828915 - DNA, 22 bp, Homo sapiens
aataatagcagagtttacaatc

SEQ ID NO: 7828916 - DNA, 22 bp, Homo sapiens
aataatagcagagtttacaatc

SEQ ID NO: 7828917 - DNA, 22 bp, Homo sapiens
aataatagcagagtttacaatc

SEQ ID NO: 7828918 - DNA, 22 bp, Homo sapiens
aataatacttcgtaaagttgtt

SEQ ID NO: 7828919 - DNA, 22 bp, Homo sapiens
aataatacttcgtaaagttgtt

SEQ ID NO: 7828920 - DNA, 22 bp, Homo sapiens
aataatagcagagtttacaatc

SEQ ID NO: 7828921 - DNA, 22 bp, Homo sapiens
aataatagcagagtttacaatc

SEQ ID NO: 7828922 - DNA, 22 bp, Homo sapiens
aataatagcagagtttacaatc

SEQ ID NO: 7828923 - DNA, 22 bp, Homo sapiens
actggggagagtcatgccagca

SEQ ID NO: 7828924 - DNA, 22 bp, Homo sapiens
actggggagagtcatgccagca

SEQ ID NO: 7828925 - DNA, 22 bp, Homo sapiens
actggggactctggccttttga

SEQ ID NO: 7828926 - DNA, 22 bp, Homo sapiens
actggggaatggaactgggaat

SEQ ID NO: 7828927 - DNA, 22 bp, Homo sapiens
actggggaatggaactgggaat

SEQ ID NO: 7828928 - DNA, 22 bp, Homo sapiens
aataatagcagagtttacaatc

SEQ ID NO: 7828929 - DNA, 22 bp, Homo sapiens
aataatacatgagattaatgtt

SEQ ID NO: 7828930 - DNA, 22 bp, Homo sapiens
aataatacatgagattaatgtt

SEQ ID NO: 7828931 - DNA, 22 bp, Homo sapiens
aataatacatgagattaatgtt

SEQ ID NO: 7828932 - DNA, 22 bp, Homo sapiens
aataatacttcgtaaagttgtt

SEQ ID NO: 7828933 - DNA, 22 bp, Homo sapiens
aataatacatgagattaatgtt

SEQ ID NO: 7828934 - DNA, 22 bp, Homo sapiens
aataatacttcgtaaagttgtt

SEQ ID NO: 7828935 - DNA, 22 bp, Homo sapiens
aataatactgcatgtaaggtgc

SEQ ID NO: 7828936 - DNA, 22 bp, Homo sapiens
aataatactgcatgtaaggtgc

SEQ ID NO: 7828937 - DNA, 22 bp, Homo sapiens
aataatacatgagattaatgtt

SEQ ID NO: 7828938 - DNA, 22 bp, Homo sapiens
aataatacatgagattaatgtt

SEQ ID NO: 7828939 - DNA, 22 bp, Homo sapiens
aataatacatgagattaatgtt

SEQ ID NO: 7828940 - DNA, 22 bp, Homo sapiens
aataatacatgagattaatgtt

SEQ ID NO: 7828941 - DNA, 22 bp, Homo sapiens
aataatacatgagattaatgtt

SEQ ID NO: 7828942 - DNA, 22 bp, Homo sapiens
aataataagatactaagggagt

SEQ ID NO: 7828943 - DNA, 22 bp, Homo sapiens
actgggattacaggtgggagtc

SEQ ID NO: 7828944 - DNA, 22 bp, Homo sapiens
actgggcaaggatatgatgggt

SEQ ID NO: 7828945 - DNA, 22 bp, Homo sapiens
actgggcaccatcatgagatgg

SEQ ID NO: 7828946 - DNA, 22 bp, Homo sapiens
actgggcaccatcatgagatag

SEQ ID NO: 7828947 - DNA, 22 bp, Homo sapiens
actgggcaccatcatgagatag

SEQ ID NO: 7828948 - DNA, 22 bp, Homo sapiens
actgggcaataaattcagagaa

SEQ ID NO: 7828949 - DNA, 22 bp, Homo sapiens
actgggcaataaattcagagaa

SEQ ID NO: 7828950 - DNA, 23 bp, Homo sapiens
aataaggccaaactatctggtct

SEQ ID NO: 7828951 - DNA, 19 bp, Homo sapiens
aataagcttgggtaaaact

SEQ ID NO: 7828952 - DNA, 22 bp, Homo sapiens
aataagccagcccatgtgaccc

SEQ ID NO: 7828953 - DNA, 22 bp, Homo sapiens
aataagcaagcctgtgtgcaag

SEQ ID NO: 7828954 - DNA, 22 bp, Homo sapiens
aataagttgcctgttgaatcat

SEQ ID NO: 7828955 - DNA, 22 bp, Homo sapiens
aataagtacttggggataactt

SEQ ID NO: 7828956 - DNA, 22 bp, Homo sapiens
aataataagatactaagggagt

SEQ ID NO: 7828957 - DNA, 22 bp, Homo sapiens
aagtttttggtagagaaaagta

SEQ ID NO: 7828958 - DNA, 21 bp, Homo sapiens
aataaaacagttggtgtcaat

SEQ ID NO: 7828959 - DNA, 22 bp, Homo sapiens
aagtttttggtagagaaaagta

SEQ ID NO: 7828960 - DNA, 22 bp, Homo sapiens
aagtttttggtagagaaaagta

SEQ ID NO: 7828961 - DNA, 22 bp, Homo sapiens
aagtttttcacattgctgttgt

SEQ ID NO: 7828962 - DNA, 22 bp, Homo sapiens
aagtttttgattctaagagaga

SEQ ID NO: 7828963 - DNA, 22 bp, Homo sapiens
aataaaatgaactggtagagtt

SEQ ID NO: 7828964 - DNA, 22 bp, Homo sapiens
aataaaatgaactggtagagtt

SEQ ID NO: 7828965 - DNA, 22 bp, Homo sapiens
aataaaatgaactggtagagtt

SEQ ID NO: 7828966 - DNA, 22 bp, Homo sapiens
aataaaatgaactggtagagtt

SEQ ID NO: 7828967 - DNA, 22 bp, Homo sapiens
aataaaatgaactggtagagtt

SEQ ID NO: 7828968 - DNA, 21 bp, Homo sapiens
aataaaacagttggtgtcaat

SEQ ID NO: 7828969 - DNA, 21 bp, Homo sapiens
aataaaacagttggtgtcaat

SEQ ID NO: 7828970 - DNA, 20 bp, Homo sapiens
aataaaagaagccttcaccc

SEQ ID NO: 7828971 - DNA, 20 bp, Homo sapiens
aataaaagaagccttcaccc

SEQ ID NO: 7828972 - DNA, 22 bp, Homo sapiens
aataaaatgaactggtagagtt

SEQ ID NO: 7828973 - DNA, 22 bp, Homo sapiens
actgggagggtcttgaagaggg

SEQ ID NO: 7828974 - DNA, 22 bp, Homo sapiens
actgggagggtcttgaagaggg

SEQ ID NO: 7828975 - DNA, 22 bp, Homo sapiens
actgggagggtcttgaagaggg

SEQ ID NO: 7828976 - DNA, 22 bp, Homo sapiens
actgggagggtcttgaagaggg

SEQ ID NO: 7828977 - DNA, 22 bp, Homo sapiens
actgggagggtcttgaagaggg

SEQ ID NO: 7828978 - DNA, 22 bp, Homo sapiens
actgggagtcatgaggaaggag

SEQ ID NO: 7828979 - DNA, 22 bp, Homo sapiens
actgggagtcatgaggaaggag

SEQ ID NO: 7828980 - DNA, 22 bp, Homo sapiens
actgggagtcatgaggaaggag

SEQ ID NO: 7828981 - DNA, 22 bp, Homo sapiens
actgggagtcatgaggaaggag

SEQ ID NO: 7828982 - DNA, 22 bp, Homo sapiens
actgggagttctccatgtccct

SEQ ID NO: 7828983 - DNA, 22 bp, Homo sapiens
actgggagtcatgaggaaggag

SEQ ID NO: 7828984 - DNA, 22 bp, Homo sapiens
actgggaggcatctggagctga

SEQ ID NO: 7828985 - DNA, 22 bp, Homo sapiens
actgggaggcatctggagctga

SEQ ID NO: 7828986 - DNA, 22 bp, Homo sapiens
actgggaggcatctggagctga

SEQ ID NO: 7828987 - DNA, 22 bp, Homo sapiens
actgggaggcaaagagcaagga

SEQ ID NO: 7828988 - DNA, 22 bp, Homo sapiens
actggctgatatggctaggaag

SEQ ID NO: 7828989 - DNA, 22 bp, Homo sapiens
actgggaggcaaagagcaagga

SEQ ID NO: 7828990 - DNA, 22 bp, Homo sapiens
actggctgatatggctaggaag

SEQ ID NO: 7828991 - DNA, 22 bp, Homo sapiens
actggctgagtttatgttcaca

SEQ ID NO: 7828992 - DNA, 22 bp, Homo sapiens
actggctgagttgcttcagcaa

SEQ ID NO: 7828993 - DNA, 22 bp, Homo sapiens
acatgcatatacttaaatatgt

SEQ ID NO: 7828994 - DNA, 19 bp, Homo sapiens
acatgcatatggacagttg

SEQ ID NO: 7828995 - DNA, 21 bp, Homo sapiens
acatgcatagagagatttctg

SEQ ID NO: 7828996 - DNA, 21 bp, Homo sapiens
acatgcatagagagatttctg

SEQ ID NO: 7828997 - DNA, 22 bp, Homo sapiens
acatgcatatacttaaatatgt

SEQ ID NO: 7828998 - DNA, 22 bp, Homo sapiens
acatgcatgtcatcagcccttt

SEQ ID NO: 7828999 - DNA, 19 bp, Homo sapiens
acatgacaacaggggaggc

SEQ ID NO: 7829000 - DNA, 19 bp, Homo sapiens
acatgacaacaggggaggc

SEQ ID NO: 7829001 - DNA, 22 bp, Homo sapiens
acatgacaaggtttataaggct

SEQ ID NO: 7829002 - DNA, 22 bp, Homo sapiens
acatgacaaggtttataaggct

SEQ ID NO: 7829003 - DNA, 22 bp, Homo sapiens
acatgacaaggtttataaggct

SEQ ID NO: 7829004 - DNA, 22 bp, Homo sapiens
acatgacacaggcctggccaat

SEQ ID NO: 7829005 - DNA, 22 bp, Homo sapiens
acatgacacaggcctggccaat

SEQ ID NO: 7829006 - DNA, 22 bp, Homo sapiens
acatgacacaggcctggccaat

SEQ ID NO: 7829007 - DNA, 22 bp, Homo sapiens
acatgacacctctggctgggtg

SEQ ID NO: 7829008 - DNA, 22 bp, Homo sapiens
acatgacacctctggctgggtg

SEQ ID NO: 7829009 - DNA, 22 bp, Homo sapiens
acatgacagtgactttataaga

SEQ ID NO: 7829010 - DNA, 22 bp, Homo sapiens
acatgacagtgactttataaga

SEQ ID NO: 7829011 - DNA, 22 bp, Homo sapiens
acatgacagggaatgaggtgaa

SEQ ID NO: 7829012 - DNA, 22 bp, Homo sapiens
acatgacagggaatgaggtgaa

SEQ ID NO: 7829013 - DNA, 22 bp, Homo sapiens
acatgacagtgcttagcaaact

SEQ ID NO: 7829014 - DNA, 22 bp, Homo sapiens
acatgacagtgcttagcaaact

SEQ ID NO: 7829015 - DNA, 22 bp, Homo sapiens
acatgacagtgcttagcaaact

SEQ ID NO: 7829016 - DNA, 22 bp, Homo sapiens
acatgacatagtagaaaagccc

SEQ ID NO: 7829017 - DNA, 22 bp, Homo sapiens
acatgacatagtagaaaagccc

SEQ ID NO: 7829018 - DNA, 22 bp, Homo sapiens
acatgacatagtagaaaagccc

SEQ ID NO: 7829019 - DNA, 22 bp, Homo sapiens
acatgacagtgcttagcaaact

SEQ ID NO: 7829020 - DNA, 22 bp, Homo sapiens
acatgacagtgcttagcaaact

SEQ ID NO: 7829021 - DNA, 22 bp, Homo sapiens
acatgacagtgcttagcaaact

SEQ ID NO: 7829022 - DNA, 22 bp, Homo sapiens
acatgacagtgcttagcaaact

SEQ ID NO: 7829023 - DNA, 22 bp, Homo sapiens
acatgcatacacgtacatacct

SEQ ID NO: 7829024 - DNA, 22 bp, Homo sapiens
acatgcatacacgtacatacct

SEQ ID NO: 7829025 - DNA, 17 bp, Homo sapiens
acatgactgcacaaagt

SEQ ID NO: 7829026 - DNA, 22 bp, Homo sapiens
acatgactataattacttaaat

SEQ ID NO: 7829027 - DNA, 22 bp, Homo sapiens
acatgcatactgctgccaacgc

SEQ ID NO: 7829028 - DNA, 22 bp, Homo sapiens
acatcctcccgatctactggct

SEQ ID NO: 7829029 - DNA, 22 bp, Homo sapiens
acatcctcccgatctactggct

SEQ ID NO: 7829030 - DNA, 22 bp, Homo sapiens
acatcctcccgatctactggct

SEQ ID NO: 7829031 - DNA, 22 bp, Homo sapiens
acatcctcccgatctactggct

SEQ ID NO: 7829032 - DNA, 22 bp, Homo sapiens
acatcctcccgatctactggct

SEQ ID NO: 7829033 - DNA, 22 bp, Homo sapiens
acatcctcccgatctactggct

SEQ ID NO: 7829034 - DNA, 22 bp, Homo sapiens
acatccctcagtcagactgtaa

SEQ ID NO: 7829035 - DNA, 22 bp, Homo sapiens
acatcccatgcgcatctggcaa

SEQ ID NO: 7829036 - DNA, 22 bp, Homo sapiens
acatcccatgcgcatctggcaa

SEQ ID NO: 7829037 - DNA, 22 bp, Homo sapiens
acatcccacagaaacatacata

SEQ ID NO: 7829038 - DNA, 22 bp, Homo sapiens
acatcctgaagtcagtcatttg

SEQ ID NO: 7829039 - DNA, 22 bp, Homo sapiens
acatcctgaagtcagtcatttg

SEQ ID NO: 7829040 - DNA, 22 bp, Homo sapiens
acatcctgaagtcagtcatttg

SEQ ID NO: 7829041 - DNA, 22 bp, Homo sapiens
acatcctcccgatctactggct

SEQ ID NO: 7829042 - DNA, 22 bp, Homo sapiens
acatcctcccgatctactggct

SEQ ID NO: 7829043 - DNA, 22 bp, Homo sapiens
acatcctcggggaaaggcactg

SEQ ID NO: 7829044 - DNA, 22 bp, Homo sapiens
acatctcaaattccaggctcca

SEQ ID NO: 7829045 - DNA, 22 bp, Homo sapiens
acatctcacttctttgaaggct

SEQ ID NO: 7829046 - DNA, 22 bp, Homo sapiens
acatctagactcttgccctctt

SEQ ID NO: 7829047 - DNA, 22 bp, Homo sapiens
acatctagactcttgccctctt

SEQ ID NO: 7829048 - DNA, 22 bp, Homo sapiens
acatctagaagatctgggagat

SEQ ID NO: 7829049 - DNA, 22 bp, Homo sapiens
acatctatgaacatttaagtag

SEQ ID NO: 7829050 - DNA, 22 bp, Homo sapiens
acatctatttttttctgtccat

SEQ ID NO: 7829051 - DNA, 22 bp, Homo sapiens
acatccttagggcagcagccag

SEQ ID NO: 7829052 - DNA, 22 bp, Homo sapiens
acatccttgattatgtaaggat

SEQ ID NO: 7829053 - DNA, 22 bp, Homo sapiens
acatccttaaggttagggtttc

SEQ ID NO: 7829054 - DNA, 22 bp, Homo sapiens
acatccttaaggttagggtttc

SEQ ID NO: 7829055 - DNA, 22 bp, Homo sapiens
acatccttatataggccaatga

SEQ ID NO: 7829056 - DNA, 22 bp, Homo sapiens
acatccttgattatgtaaggat

SEQ ID NO: 7829057 - DNA, 22 bp, Homo sapiens
acatccttggttgattaatcaa

SEQ ID NO: 7829058 - DNA, 22 bp, Homo sapiens
acatccttggttgattaatcaa

SEQ ID NO: 7829059 - DNA, 22 bp, Homo sapiens
acatctagaagatctgggagat

SEQ ID NO: 7829060 - DNA, 22 bp, Homo sapiens
acatctagaagatctgggagat

SEQ ID NO: 7829061 - DNA, 22 bp, Homo sapiens
acatcgtgtatcactgaacctt

SEQ ID NO: 7829062 - DNA, 22 bp, Homo sapiens
acatgaagtggtcagatcaaac

SEQ ID NO: 7829063 - DNA, 22 bp, Homo sapiens
acatgaatgcagccataacact

SEQ ID NO: 7829064 - DNA, 22 bp, Homo sapiens
acatgaatgcagccataacact

SEQ ID NO: 7829065 - DNA, 22 bp, Homo sapiens
acatgaatgcagccataacact

SEQ ID NO: 7829066 - DNA, 22 bp, Homo sapiens
acatgacaaaatgcacaggatt

SEQ ID NO: 7829067 - DNA, 22 bp, Homo sapiens
acatgacaaaatgcacaggatt

SEQ ID NO: 7829068 - DNA, 22 bp, Homo sapiens
acatgacaaaatgcacaggatt

SEQ ID NO: 7829069 - DNA, 22 bp, Homo sapiens
acatgaagtggtcagatcaaac

SEQ ID NO: 7829070 - DNA, 22 bp, Homo sapiens
acatgaagcaagaaagatgcta

SEQ ID NO: 7829071 - DNA, 22 bp, Homo sapiens
acatgaatatatgaagttcaac

SEQ ID NO: 7829072 - DNA, 22 bp, Homo sapiens
acatgaagtggtcagatcaaac

SEQ ID NO: 7829073 - DNA, 22 bp, Homo sapiens
acatgaacatgctcaaataact

SEQ ID NO: 7829074 - DNA, 22 bp, Homo sapiens
acatgaacatgctcaaataact

SEQ ID NO: 7829075 - DNA, 20 bp, Homo sapiens
acatgaacagggctacagca

SEQ ID NO: 7829076 - DNA, 20 bp, Homo sapiens
acatgaacagggctacagca

SEQ ID NO: 7829077 - DNA, 22 bp, Homo sapiens
acatctcagaactgagtaaccg

SEQ ID NO: 7829078 - DNA, 22 bp, Homo sapiens
acatctcagaactgagtaaccg

SEQ ID NO: 7829079 - DNA, 22 bp, Homo sapiens
acatgaaatgcagcctgtaacc

SEQ ID NO: 7829080 - DNA, 22 bp, Homo sapiens
acatctcatgaatgataaatca

SEQ ID NO: 7829081 - DNA, 22 bp, Homo sapiens
acatctcatgaatgataaatca

SEQ ID NO: 7829082 - DNA, 22 bp, Homo sapiens
acatctcagaactgagtaaccg

SEQ ID NO: 7829083 - DNA, 22 bp, Homo sapiens
acatctcatgaatgataaatca

SEQ ID NO: 7829084 - DNA, 22 bp, Homo sapiens
aaggcattgagcagttacagta

SEQ ID NO: 7829085 - DNA, 22 bp, Homo sapiens
aaggccagagcagactggagtt

SEQ ID NO: 7829086 - DNA, 22 bp, Homo sapiens
aaggccagagcagactggagtt

SEQ ID NO: 7829087 - DNA, 22 bp, Homo sapiens
aaggccagagcagactggagtt

SEQ ID NO: 7829088 - DNA, 22 bp, Homo sapiens
aaggcaccataggcaaatccag

SEQ ID NO: 7829089 - DNA, 22 bp, Homo sapiens
aaggcacattcctgaaaacaat

SEQ ID NO: 7829090 - DNA, 22 bp, Homo sapiens
aaggcatgtgtcctcagagaga

SEQ ID NO: 7829091 - DNA, 22 bp, Homo sapiens
aaggcaccatgagatgctggtt

SEQ ID NO: 7829092 - DNA, 22 bp, Homo sapiens
aaggcacatgacctaggcctgg

SEQ ID NO: 7829093 - DNA, 22 bp, Homo sapiens
aaggcacatgacctaggcctgg

SEQ ID NO: 7829094 - DNA, 22 bp, Homo sapiens
aaggcacatattttagagtcac

SEQ ID NO: 7829095 - DNA, 22 bp, Homo sapiens
aaggccagagtactagaggctg

SEQ ID NO: 7829096 - DNA, 22 bp, Homo sapiens
aaggccagagcgtgtcctgcct

SEQ ID NO: 7829097 - DNA, 22 bp, Homo sapiens
aaggccagagtactagaggctg

SEQ ID NO: 7829098 - DNA, 22 bp, Homo sapiens
aaggccagagtactagaggctg

SEQ ID NO: 7829099 - DNA, 22 bp, Homo sapiens
aaggccagagcgtgtcctgcct

SEQ ID NO: 7829100 - DNA, 22 bp, Homo sapiens
aaggccagagcgtgtcctgcct

SEQ ID NO: 7829101 - DNA, 22 bp, Homo sapiens
aaggccagagcgtgtcctgcct

SEQ ID NO: 7829102 - DNA, 22 bp, Homo sapiens
aaggccagccctaatgatgctc

SEQ ID NO: 7829103 - DNA, 22 bp, Homo sapiens
aaggccagccctaatgatgctc

SEQ ID NO: 7829104 - DNA, 22 bp, Homo sapiens
aaggccagccctaatgatgctc

SEQ ID NO: 7829105 - DNA, 22 bp, Homo sapiens
aaggccagcctgagagctaaca

SEQ ID NO: 7829106 - DNA, 22 bp, Homo sapiens
aaggccagcctgagagctaaca

SEQ ID NO: 7829107 - DNA, 22 bp, Homo sapiens
acatccattttgttcaaaagca

SEQ ID NO: 7829108 - DNA, 22 bp, Homo sapiens
acatcccacagaaacatacata

SEQ ID NO: 7829109 - DNA, 22 bp, Homo sapiens
aaggccagccttggaaccctga

SEQ ID NO: 7829110 - DNA, 22 bp, Homo sapiens
aaggccagcctgagagctaaca

SEQ ID NO: 7829111 - DNA, 22 bp, Homo sapiens
acatccatttgtcagctcttga

SEQ ID NO: 7829112 - DNA, 22 bp, Homo sapiens
aaggccagattctctctagggg

SEQ ID NO: 7829113 - DNA, 22 bp, Homo sapiens
aaggccagattctctctagggg

SEQ ID NO: 7829114 - DNA, 22 bp, Homo sapiens
aaggccagattctctctagggg

SEQ ID NO: 7829115 - DNA, 22 bp, Homo sapiens
aaggccagcagtttgagaccag

SEQ ID NO: 7829116 - DNA, 22 bp, Homo sapiens
aaggccagattctctctagggg

SEQ ID NO: 7829117 - DNA, 22 bp, Homo sapiens
aaggccagagttgaactgctcc

SEQ ID NO: 7829118 - DNA, 22 bp, Homo sapiens
aaggccagagttgaactgctcc

SEQ ID NO: 7829119 - DNA, 22 bp, Homo sapiens
aaggccagagtactagaggctg

SEQ ID NO: 7829120 - DNA, 22 bp, Homo sapiens
aaggccagattcactttacaat

SEQ ID NO: 7829121 - DNA, 22 bp, Homo sapiens
aaggccagagttgaactgctcc

SEQ ID NO: 7829122 - DNA, 22 bp, Homo sapiens
aaggccagattcactttacaat

SEQ ID NO: 7829123 - DNA, 22 bp, Homo sapiens
aaggccagagttgaactgctcc

SEQ ID NO: 7829124 - DNA, 22 bp, Homo sapiens
aaggcacagccacttgatcatc

SEQ ID NO: 7829125 - DNA, 22 bp, Homo sapiens
aaggcacagccacttgatcatc

SEQ ID NO: 7829126 - DNA, 18 bp, Homo sapiens
aaggcacaggagaacatt

SEQ ID NO: 7829127 - DNA, 18 bp, Homo sapiens
aaggcacaggagaacatt

SEQ ID NO: 7829128 - DNA, 18 bp, Homo sapiens
aaggcacaggagaacatt

SEQ ID NO: 7829129 - DNA, 17 bp, Homo sapiens
aaggcacagggcactgg

SEQ ID NO: 7829130 - DNA, 22 bp, Homo sapiens
aaggcacatattgcagatcttg

SEQ ID NO: 7829131 - DNA, 22 bp, Homo sapiens
aaggcacatattgcagatcttg

SEQ ID NO: 7829132 - DNA, 17 bp, Homo sapiens
aaggcacagggcactgg

SEQ ID NO: 7829133 - DNA, 17 bp, Homo sapiens
aaggcacagggcactgg

SEQ ID NO: 7829134 - DNA, 22 bp, Homo sapiens
aaggcacatattttagagtcac

SEQ ID NO: 7829135 - DNA, 22 bp, Homo sapiens
aaggcacatattttagagtcac

SEQ ID NO: 7829136 - DNA, 22 bp, Homo sapiens
aaggcacatattttagagtcac

SEQ ID NO: 7829137 - DNA, 22 bp, Homo sapiens
aaggcacacagttagatagagc

SEQ ID NO: 7829138 - DNA, 22 bp, Homo sapiens
aaggcacacagttagatagagc

SEQ ID NO: 7829139 - DNA, 22 bp, Homo sapiens
aaggcacacagttagatagagc

SEQ ID NO: 7829140 - DNA, 22 bp, Homo sapiens
aaggcacacagttagatagagc

SEQ ID NO: 7829141 - DNA, 22 bp, Homo sapiens
aaggcacacagttagatagagc

SEQ ID NO: 7829142 - DNA, 22 bp, Homo sapiens
aaggcacaacacaagagggtga

SEQ ID NO: 7829143 - DNA, 22 bp, Homo sapiens
aaggcacagaggcagggcactt

SEQ ID NO: 7829144 - DNA, 22 bp, Homo sapiens
aaggcacagaggcagggcactt

SEQ ID NO: 7829145 - DNA, 22 bp, Homo sapiens
aaggcaatttgttgtgaggatt

SEQ ID NO: 7829146 - DNA, 22 bp, Homo sapiens
aaggcaatttcagggctctcta

SEQ ID NO: 7829147 - DNA, 22 bp, Homo sapiens
aaggcaatttggaagaggcaga

SEQ ID NO: 7829148 - DNA, 22 bp, Homo sapiens
aaggcaattggcttgtataaga

SEQ ID NO: 7829149 - DNA, 22 bp, Homo sapiens
aaggcaattggcttgtataaga

SEQ ID NO: 7829150 - DNA, 22 bp, Homo sapiens
aaggcaattggcttgtataaga

SEQ ID NO: 7829151 - DNA, 22 bp, Homo sapiens
aaggcaattgcagtttttgcca

SEQ ID NO: 7829152 - DNA, 22 bp, Homo sapiens
aaggcaattggcttgtataaga

SEQ ID NO: 7829153 - DNA, 22 bp, Homo sapiens
aaggcaagttttagttttctgg

SEQ ID NO: 7829154 - DNA, 22 bp, Homo sapiens
aaggcaaggcttccagctcccc

SEQ ID NO: 7829155 - DNA, 22 bp, Homo sapiens
aaggcaaggttcaccgtgctat

SEQ ID NO: 7829156 - DNA, 22 bp, Homo sapiens
aaggcaaggccaagccatcagt

SEQ ID NO: 7829157 - DNA, 22 bp, Homo sapiens
aaggcaactgtaaaacatgcac

SEQ ID NO: 7829158 - DNA, 22 bp, Homo sapiens
aaggcaaatgtgttcttttagt

SEQ ID NO: 7829159 - DNA, 22 bp, Homo sapiens
aaggcaaatgtgttcttttagt

SEQ ID NO: 7829160 - DNA, 22 bp, Homo sapiens
aaggcaatagtattaaactgga

SEQ ID NO: 7829161 - DNA, 22 bp, Homo sapiens
aaggcaatatcaagagaattcg

SEQ ID NO: 7829162 - DNA, 22 bp, Homo sapiens
aaggcaatgactgatttagaat

SEQ ID NO: 7829163 - DNA, 22 bp, Homo sapiens
aaggcaatgactgatttagaat

SEQ ID NO: 7829164 - DNA, 22 bp, Homo sapiens
aaggcaatattgagtttccctt

SEQ ID NO: 7829165 - DNA, 22 bp, Homo sapiens
aaggcaatgaatactgtttttg

SEQ ID NO: 7829166 - DNA, 22 bp, Homo sapiens
aaggcaatgactgatttagaat

SEQ ID NO: 7829167 - DNA, 22 bp, Homo sapiens
aaggcaatgttagcaacataat

SEQ ID NO: 7829168 - DNA, 22 bp, Homo sapiens
aaggcaatgtcatggctcttgc

SEQ ID NO: 7829169 - DNA, 22 bp, Homo sapiens
aaggcaatgtaaattacagctt

SEQ ID NO: 7829170 - DNA, 22 bp, Homo sapiens
aaggcaatgttagcaacataat

SEQ ID NO: 7829171 - DNA, 22 bp, Homo sapiens
aaggcaattgagaagaaacaga

SEQ ID NO: 7829172 - DNA, 22 bp, Homo sapiens
aaggcaattgagaagaaacaga

SEQ ID NO: 7829173 - DNA, 22 bp, Homo sapiens
aaggcaattgattatttttcct

SEQ ID NO: 7829174 - DNA, 22 bp, Homo sapiens
aaggcaatggcaagagaaagca

SEQ ID NO: 7829175 - DNA, 22 bp, Homo sapiens
aaggcaatgggatggatcatgt

SEQ ID NO: 7829176 - DNA, 22 bp, Homo sapiens
aaggcaatggtttctgtgcctt

SEQ ID NO: 7829177 - DNA, 22 bp, Homo sapiens
aaggcaatgtaaattacagctt

SEQ ID NO: 7829178 - DNA, 22 bp, Homo sapiens
aaggcaatgagggagatagagt

SEQ ID NO: 7829179 - DNA, 22 bp, Homo sapiens
aaggcaatgctaagaggtttgg

SEQ ID NO: 7829180 - DNA, 22 bp, Homo sapiens
aaggcaatgagggagatagagt

SEQ ID NO: 7829181 - DNA, 22 bp, Homo sapiens
aaggacagaaacagattgctgg

SEQ ID NO: 7829182 - DNA, 22 bp, Homo sapiens
aaggacacctgcagagggacca

SEQ ID NO: 7829183 - DNA, 22 bp, Homo sapiens
aaggacacctgcagagggacca

SEQ ID NO: 7829184 - DNA, 22 bp, Homo sapiens
aaggacacctgcagagggacca

SEQ ID NO: 7829185 - DNA, 22 bp, Homo sapiens
aaggacacctgcagagggacca

SEQ ID NO: 7829186 - DNA, 22 bp, Homo sapiens
aaggacaatgaagacagccaca

SEQ ID NO: 7829187 - DNA, 22 bp, Homo sapiens
aaggacacaaaacagcagcagt

SEQ ID NO: 7829188 - DNA, 19 bp, Homo sapiens
aaggacacaacagagatag

SEQ ID NO: 7829189 - DNA, 22 bp, Homo sapiens
aaggacaatgaagacagccaca

SEQ ID NO: 7829190 - DNA, 22 bp, Homo sapiens
aaggacaagtagtatttgcatc

SEQ ID NO: 7829191 - DNA, 22 bp, Homo sapiens
aaggacaagtagtatttgcatc

SEQ ID NO: 7829192 - DNA, 22 bp, Homo sapiens
aaggacaagtagtatttgcatc

SEQ ID NO: 7829193 - DNA, 22 bp, Homo sapiens
aaggacaggagaaaacgggatc

SEQ ID NO: 7829194 - DNA, 22 bp, Homo sapiens
aaggacaggcacagtggtggag

SEQ ID NO: 7829195 - DNA, 22 bp, Homo sapiens
aaggacaggcacagtggtggag

SEQ ID NO: 7829196 - DNA, 22 bp, Homo sapiens
aaggacaggagaaaacgggatc

SEQ ID NO: 7829197 - DNA, 22 bp, Homo sapiens
aaggacaggagaaaacgggatc

SEQ ID NO: 7829198 - DNA, 22 bp, Homo sapiens
aaggacaggcacagtggtggag

SEQ ID NO: 7829199 - DNA, 22 bp, Homo sapiens
aaggacaggcacagtggtggag

SEQ ID NO: 7829200 - DNA, 22 bp, Homo sapiens
aaggacaggcacagtggtggag

SEQ ID NO: 7829201 - DNA, 22 bp, Homo sapiens
aaggacaggcacagtggtggag

SEQ ID NO: 7829202 - DNA, 22 bp, Homo sapiens
aaggacagaaacagattgctgg

SEQ ID NO: 7829203 - DNA, 22 bp, Homo sapiens
aaggacagagagccattccaga

SEQ ID NO: 7829204 - DNA, 22 bp, Homo sapiens
aaggacagagagccattccaga

SEQ ID NO: 7829205 - DNA, 22 bp, Homo sapiens
aaggacagagagccattccaga

SEQ ID NO: 7829206 - DNA, 22 bp, Homo sapiens
aaggacagagagccattccaga

SEQ ID NO: 7829207 - DNA, 22 bp, Homo sapiens
aaggacagagagccattccaga

SEQ ID NO: 7829208 - DNA, 22 bp, Homo sapiens
aaggacaggagaaaacgggatc

SEQ ID NO: 7829209 - DNA, 22 bp, Homo sapiens
aaggacaggagaaaacgggatc

SEQ ID NO: 7829210 - DNA, 22 bp, Homo sapiens
aaggacagagagccattccaga

SEQ ID NO: 7829211 - DNA, 22 bp, Homo sapiens
aaggacagagagccattccaga

SEQ ID NO: 7829212 - DNA, 22 bp, Homo sapiens
aaggagggaaagcagtgcttct

SEQ ID NO: 7829213 - DNA, 22 bp, Homo sapiens
aaggatcatgtatatgtttaag

SEQ ID NO: 7829214 - DNA, 23 bp, Homo sapiens
aaggatctctgagatcatggctt

SEQ ID NO: 7829215 - DNA, 23 bp, Homo sapiens
aaggatctctgagatcatggctt

SEQ ID NO: 7829216 - DNA, 22 bp, Homo sapiens
aaggaggcctggcagatgaaga

SEQ ID NO: 7829217 - DNA, 22 bp, Homo sapiens
aaggaggcctggcagatgaaga

SEQ ID NO: 7829218 - DNA, 22 bp, Homo sapiens
aaggaggcctgcgagaaggggc

SEQ ID NO: 7829219 - DNA, 22 bp, Homo sapiens
aaggatctgacagactatagaa

SEQ ID NO: 7829220 - DNA, 22 bp, Homo sapiens
aaggatgaacattaatacatca

SEQ ID NO: 7829221 - DNA, 22 bp, Homo sapiens
aaggatctttctttttaccatt

SEQ ID NO: 7829222 - DNA, 22 bp, Homo sapiens
aaggatctgacagactatagaa

SEQ ID NO: 7829223 - DNA, 22 bp, Homo sapiens
aaggatgattggtaatgacact

SEQ ID NO: 7829224 - DNA, 22 bp, Homo sapiens
aaggatgtcagtcattttggat

SEQ ID NO: 7829225 - DNA, 22 bp, Homo sapiens
aaggatgattggtaatgacact

SEQ ID NO: 7829226 - DNA, 22 bp, Homo sapiens
aaggcaaaagaggtgtcatcac

SEQ ID NO: 7829227 - DNA, 22 bp, Homo sapiens
aaggcaaaagaggtgtcatcac

SEQ ID NO: 7829228 - DNA, 22 bp, Homo sapiens
aaggcaaaagaggtgtcatcac

SEQ ID NO: 7829229 - DNA, 22 bp, Homo sapiens
aaggcaaatgtgttcttttagt

SEQ ID NO: 7829230 - DNA, 22 bp, Homo sapiens
aaggcaaaagaggtgtcatcac

SEQ ID NO: 7829231 - DNA, 22 bp, Homo sapiens
aaggcaaaagaggtgtcatcac

SEQ ID NO: 7829232 - DNA, 22 bp, Homo sapiens
aaggatttgtccaaagtcacac

SEQ ID NO: 7829233 - DNA, 20 bp, Homo sapiens
aaggattgttggaagcatcc

SEQ ID NO: 7829234 - DNA, 22 bp, Homo sapiens
aaggattgtctggctatttatg

SEQ ID NO: 7829235 - DNA, 22 bp, Homo sapiens
aaggattggtctggaagcatga

SEQ ID NO: 7829236 - DNA, 22 bp, Homo sapiens
aaggattccagttttacttgcc

SEQ ID NO: 7829237 - DNA, 22 bp, Homo sapiens
aaggatgtggcatttttcatat

SEQ ID NO: 7829238 - DNA, 22 bp, Homo sapiens
aaggatgtgactcagtcagcta

SEQ ID NO: 7829239 - DNA, 22 bp, Homo sapiens
aaggatgttctagtttgctgag

SEQ ID NO: 7829240 - DNA, 22 bp, Homo sapiens
aaggatgtttaagttttgcagt

SEQ ID NO: 7829241 - DNA, 22 bp, Homo sapiens
aaggatgtttaagttttgcagt

SEQ ID NO: 7829242 - DNA, 22 bp, Homo sapiens
aaggaatcacttctttaaatga

SEQ ID NO: 7829243 - DNA, 22 bp, Homo sapiens
aaggaatgctctaggagggcag

SEQ ID NO: 7829244 - DNA, 21 bp, Homo sapiens
aaggaatgaatggatggatga

SEQ ID NO: 7829245 - DNA, 19 bp, Homo sapiens
aaggaatggctttaagtag

SEQ ID NO: 7829246 - DNA, 22 bp, Homo sapiens
aaggaatgctctaggagggcag

SEQ ID NO: 7829247 - DNA, 17 bp, Homo sapiens
aaggaatgtcagaagtt

SEQ ID NO: 7829248 - DNA, 17 bp, Homo sapiens
aaggaatgtcagaagtt

SEQ ID NO: 7829249 - DNA, 19 bp, Homo sapiens
aaggaatggctttaagtag

SEQ ID NO: 7829250 - DNA, 22 bp, Homo sapiens
aaggacaaagcagagctggatg

SEQ ID NO: 7829251 - DNA, 22 bp, Homo sapiens
aaggaatttgaggctgcagtga

SEQ ID NO: 7829252 - DNA, 22 bp, Homo sapiens
aaggacaaagcagagctggatg

SEQ ID NO: 7829253 - DNA, 22 bp, Homo sapiens
aaggaattctagaaggttttgt

SEQ ID NO: 7829254 - DNA, 17 bp, Homo sapiens
aaggaatgtcagaagtt

SEQ ID NO: 7829255 - DNA, 17 bp, Homo sapiens
aaggaatgtcagaagtt

SEQ ID NO: 7829256 - DNA, 17 bp, Homo sapiens
aaggaatgtcagaagtt

SEQ ID NO: 7829257 - DNA, 16 bp, Homo sapiens
aaggaatgtcattctg

SEQ ID NO: 7829258 - DNA, 22 bp, Homo sapiens
aaggaaggttcatagtcaaaga

SEQ ID NO: 7829259 - DNA, 22 bp, Homo sapiens
aaggaaggttcatagtcaaaga

SEQ ID NO: 7829260 - DNA, 22 bp, Homo sapiens
aaggaaggttcatagtcaaaga

SEQ ID NO: 7829261 - DNA, 22 bp, Homo sapiens
aaggaaggtactcagtgattct

SEQ ID NO: 7829262 - DNA, 22 bp, Homo sapiens
aaggaaggtactcagtgattct

SEQ ID NO: 7829263 - DNA, 22 bp, Homo sapiens
aaggaaggtactcagtgattct

SEQ ID NO: 7829264 - DNA, 22 bp, Homo sapiens
aaggaaggtactcagtgattct

SEQ ID NO: 7829265 - DNA, 22 bp, Homo sapiens
aaggaaggttcatagtcaaaga

SEQ ID NO: 7829266 - DNA, 21 bp, Homo sapiens
aaggaagtgactttagtggtt

SEQ ID NO: 7829267 - DNA, 20 bp, Homo sapiens
aaggaatatttgtatctggg

SEQ ID NO: 7829268 - DNA, 22 bp, Homo sapiens
aaggaatcacttctttaaatga

SEQ ID NO: 7829269 - DNA, 22 bp, Homo sapiens
aaggaaggaattgatcatgcgc

SEQ ID NO: 7829270 - DNA, 22 bp, Homo sapiens
aaggaagggaaatagtgatgtc

SEQ ID NO: 7829271 - DNA, 22 bp, Homo sapiens
aaggaagggaaatagtgatgtc

SEQ ID NO: 7829272 - DNA, 22 bp, Homo sapiens
aaggaaggaattgatcatgcgc

SEQ ID NO: 7829273 - DNA, 22 bp, Homo sapiens
aaggaagggaaatagtgatgtc

SEQ ID NO: 7829274 - DNA, 22 bp, Homo sapiens
aaggaagggaaatagtgatgtc

SEQ ID NO: 7829275 - DNA, 22 bp, Homo sapiens
aaggaagggaaatagtgatgtc

SEQ ID NO: 7829276 - DNA, 22 bp, Homo sapiens
aaggaagcagcaatgcatgatt

SEQ ID NO: 7829277 - DNA, 22 bp, Homo sapiens
aaggaagcagcaatgcatgatt

SEQ ID NO: 7829278 - DNA, 22 bp, Homo sapiens
aaggaagatgctggcctgggga

SEQ ID NO: 7829279 - DNA, 22 bp, Homo sapiens
aaggaagcagcaatgcatgatt

SEQ ID NO: 7829280 - DNA, 22 bp, Homo sapiens
aaggaagaatcatcacgttggg

SEQ ID NO: 7829281 - DNA, 22 bp, Homo sapiens
aaggaagaatcatcacgttggg

SEQ ID NO: 7829282 - DNA, 22 bp, Homo sapiens
aaggaagatgaggtgctgctta

SEQ ID NO: 7829283 - DNA, 22 bp, Homo sapiens
aaggaagaatcatcacgttggg

SEQ ID NO: 7829284 - DNA, 22 bp, Homo sapiens
aaggaagatgctggcctgggga

SEQ ID NO: 7829285 - DNA, 22 bp, Homo sapiens
aaggaagatgctggcctgggga

SEQ ID NO: 7829286 - DNA, 22 bp, Homo sapiens
aaggaagatgctggcctgggga

SEQ ID NO: 7829287 - DNA, 21 bp, Homo sapiens
aagcttccctgctctccaggg

SEQ ID NO: 7829288 - DNA, 21 bp, Homo sapiens
aagcttccctgctctccaggg

SEQ ID NO: 7829289 - DNA, 22 bp, Homo sapiens
aagcttcttagaatgcatgtgc

SEQ ID NO: 7829290 - DNA, 23 bp, Homo sapiens
aagcttctagggtgggcaagatg

SEQ ID NO: 7829291 - DNA, 23 bp, Homo sapiens
aagcttctatctctgcagaagga

SEQ ID NO: 7829292 - DNA, 23 bp, Homo sapiens
aagcttccttgactggcccctag

SEQ ID NO: 7829293 - DNA, 23 bp, Homo sapiens
aagcttccttcacgtctcctggg

SEQ ID NO: 7829294 - DNA, 20 bp, Homo sapiens
aagcttccttgggcgcccgg

SEQ ID NO: 7829295 - DNA, 22 bp, Homo sapiens
aagcttctttacaggagagatt

SEQ ID NO: 7829296 - DNA, 22 bp, Homo sapiens
aagcttctttacaggagagatt

SEQ ID NO: 7829297 - DNA, 22 bp, Homo sapiens
aagcttctttacaggagagatt

SEQ ID NO: 7829298 - DNA, 22 bp, Homo sapiens
aagcttgggaaccacggtaatc

SEQ ID NO: 7829299 - DNA, 21 bp, Homo sapiens
aagcttggctgatgttattgg

SEQ ID NO: 7829300 - DNA, 22 bp, Homo sapiens
aagcttgcagggcataatttgc

SEQ ID NO: 7829301 - DNA, 22 bp, Homo sapiens
aagcttgattgtagtctagaca

SEQ ID NO: 7829302 - DNA, 22 bp, Homo sapiens
aagcttggaagtcttcctttca

SEQ ID NO: 7829303 - DNA, 22 bp, Homo sapiens
aaggaagaagggaagttactta

SEQ ID NO: 7829304 - DNA, 22 bp, Homo sapiens
aaggaagaagggaagttactta

SEQ ID NO: 7829305 - DNA, 22 bp, Homo sapiens
aagctgttctccagtgactcag

SEQ ID NO: 7829306 - DNA, 22 bp, Homo sapiens
aagctgttctctaagtttcatg

SEQ ID NO: 7829307 - DNA, 22 bp, Homo sapiens
aagctgttctccagtgactcag

SEQ ID NO: 7829308 - DNA, 22 bp, Homo sapiens
aagctgttctgaatcagtaagt

SEQ ID NO: 7829309 - DNA, 22 bp, Homo sapiens
aagctgttctgaatcagtaagt

SEQ ID NO: 7829310 - DNA, 22 bp, Homo sapiens
aagctgttctgaatcagtaagt

SEQ ID NO: 7829311 - DNA, 22 bp, Homo sapiens
aagctgttagggagtggtaggt

SEQ ID NO: 7829312 - DNA, 22 bp, Homo sapiens
aagctgttaatggcttgcagct

SEQ ID NO: 7829313 - DNA, 22 bp, Homo sapiens
aagctgttaatggcttgcagct

SEQ ID NO: 7829314 - DNA, 22 bp, Homo sapiens
aagctgttatcttctggcggac

SEQ ID NO: 7829315 - DNA, 22 bp, Homo sapiens
aagctgttctccagtgactcag

SEQ ID NO: 7829316 - DNA, 22 bp, Homo sapiens
aagctgttagggagtggtaggt

SEQ ID NO: 7829317 - DNA, 22 bp, Homo sapiens
aagctgttatcttctggcggac

SEQ ID NO: 7829318 - DNA, 22 bp, Homo sapiens
aagctgtttgcagtggatggag

SEQ ID NO: 7829319 - DNA, 22 bp, Homo sapiens
aagctgttttggccttagttga

SEQ ID NO: 7829320 - DNA, 22 bp, Homo sapiens
aagctgtttgcagtggatggag

SEQ ID NO: 7829321 - DNA, 22 bp, Homo sapiens
aagctgtttgcagtggatggag

SEQ ID NO: 7829322 - DNA, 22 bp, Homo sapiens
aagctgttgaagtaattcagcc

SEQ ID NO: 7829323 - DNA, 22 bp, Homo sapiens
aagctgttgccctgctctttct

SEQ ID NO: 7829324 - DNA, 22 bp, Homo sapiens
aagctgttgttcatcctgaatt

SEQ ID NO: 7829325 - DNA, 22 bp, Homo sapiens
aagctgttgaagtaattcagcc

SEQ ID NO: 7829326 - DNA, 22 bp, Homo sapiens
aagcttcaatgagataattgtt

SEQ ID NO: 7829327 - DNA, 20 bp, Homo sapiens
aagcttcacttcatttgatc

SEQ ID NO: 7829328 - DNA, 22 bp, Homo sapiens
aagcttcacattgaacttgggt

SEQ ID NO: 7829329 - DNA, 22 bp, Homo sapiens
aagctgtttttaggtggaggta

SEQ ID NO: 7829330 - DNA, 22 bp, Homo sapiens
aagcttaggtacagaagttaag

SEQ ID NO: 7829331 - DNA, 22 bp, Homo sapiens
aagcttcagtgtgagcatgtaa

SEQ ID NO: 7829332 - DNA, 22 bp, Homo sapiens
aagcttcaggcccacccatgtc

SEQ ID NO: 7829333 - DNA, 22 bp, Homo sapiens
aagctgtggcttggaggaaaca

SEQ ID NO: 7829334 - DNA, 22 bp, Homo sapiens
aagctgtggcttggaggaaaca

SEQ ID NO: 7829335 - DNA, 22 bp, Homo sapiens
aagctgtggcttggaggaaaca

SEQ ID NO: 7829336 - DNA, 22 bp, Homo sapiens
aagctgtggcttggaggaaaca

SEQ ID NO: 7829337 - DNA, 22 bp, Homo sapiens
aagctgtgcctttgcctagaat

SEQ ID NO: 7829338 - DNA, 22 bp, Homo sapiens
aagctgtgcctttgcctagaat

SEQ ID NO: 7829339 - DNA, 22 bp, Homo sapiens
aagctgtgcaggaactgcttgc

SEQ ID NO: 7829340 - DNA, 22 bp, Homo sapiens
aagctgtgcctttgcctagaat

SEQ ID NO: 7829341 - DNA, 22 bp, Homo sapiens
aagctgtgcaggaactgcttgc

SEQ ID NO: 7829342 - DNA, 22 bp, Homo sapiens
aagctgtgcaggaactgcttgc

SEQ ID NO: 7829343 - DNA, 22 bp, Homo sapiens
aagctgtgcaggaactgcttgc

SEQ ID NO: 7829344 - DNA, 22 bp, Homo sapiens
aagctgtgagctggatgctcca

SEQ ID NO: 7829345 - DNA, 22 bp, Homo sapiens
aagctgtgagctggatgctcca

SEQ ID NO: 7829346 - DNA, 22 bp, Homo sapiens
aagctgtgaaatctctagtgca

SEQ ID NO: 7829347 - DNA, 22 bp, Homo sapiens
aagctgtgaaatctctagtgca

SEQ ID NO: 7829348 - DNA, 22 bp, Homo sapiens
aagctgtgaaatctctagtgca

SEQ ID NO: 7829349 - DNA, 22 bp, Homo sapiens
aagctgtgaagagcaagtgagg

SEQ ID NO: 7829350 - DNA, 22 bp, Homo sapiens
aagctgtgaaatctctagtgca

SEQ ID NO: 7829351 - DNA, 22 bp, Homo sapiens
aagctgtgaagagcaagtgagg

SEQ ID NO: 7829352 - DNA, 22 bp, Homo sapiens
aagctgtgagctggatgctcca

SEQ ID NO: 7829353 - DNA, 22 bp, Homo sapiens
aagctgtgagctggatgctcca

SEQ ID NO: 7829354 - DNA, 22 bp, Homo sapiens
aagctgtgagctggatgctcca

SEQ ID NO: 7829355 - DNA, 22 bp, Homo sapiens
aagctgtgaagagcaagtgagg

SEQ ID NO: 7829356 - DNA, 22 bp, Homo sapiens
aagctgtgtattacagaatatt

SEQ ID NO: 7829357 - DNA, 22 bp, Homo sapiens
aagctgtgtattacagaatatt

SEQ ID NO: 7829358 - DNA, 22 bp, Homo sapiens
aagctgtgtcctagaggtgtaa

SEQ ID NO: 7829359 - DNA, 22 bp, Homo sapiens
aagctgtgtgactatttctgag

SEQ ID NO: 7829360 - DNA, 22 bp, Homo sapiens
aagctgtgtaagttgcttggtt

SEQ ID NO: 7829361 - DNA, 22 bp, Homo sapiens
aagctgtgtaagttgcttggtt

SEQ ID NO: 7829362 - DNA, 22 bp, Homo sapiens
aagctgtgtaagttgcttggtt

SEQ ID NO: 7829363 - DNA, 22 bp, Homo sapiens
aagctgtgtaagttgcttggtt

SEQ ID NO: 7829364 - DNA, 22 bp, Homo sapiens
aagctgtggtaaagggtagagg

SEQ ID NO: 7829365 - DNA, 22 bp, Homo sapiens
aagctgtggtaaagggtagagg

SEQ ID NO: 7829366 - DNA, 21 bp, Homo sapiens
aagctgtgttccactgatagc

SEQ ID NO: 7829367 - DNA, 22 bp, Homo sapiens
aagctgtgtgcagatgatctca

SEQ ID NO: 7829368 - DNA, 21 bp, Homo sapiens
aagctgtgttccactgatagc

SEQ ID NO: 7829369 - DNA, 22 bp, Homo sapiens
aagctgtgtgcagatgatctca

SEQ ID NO: 7829370 - DNA, 22 bp, Homo sapiens
aagctgtgtgcagatgatctca

SEQ ID NO: 7829371 - DNA, 21 bp, Homo sapiens
aagctgtgttccactgatagc

SEQ ID NO: 7829372 - DNA, 22 bp, Homo sapiens
aagctgtgtgcagatgatctca

SEQ ID NO: 7829373 - DNA, 22 bp, Homo sapiens
aagctgtgtgcagatgatctca

SEQ ID NO: 7829374 - DNA, 22 bp, Homo sapiens
aagctgtgtgactatttctgag

SEQ ID NO: 7829375 - DNA, 22 bp, Homo sapiens
aagctgtgtcctagaggtgtaa

SEQ ID NO: 7829376 - DNA, 22 bp, Homo sapiens
aagctgtgtattacagaatatt

SEQ ID NO: 7829377 - DNA, 22 bp, Homo sapiens
aagctgtgtgactatttctgag

SEQ ID NO: 7829378 - DNA, 22 bp, Homo sapiens
aagctgtgtgactatttctgag

SEQ ID NO: 7829379 - DNA, 22 bp, Homo sapiens
acagctggagtgaggatggagt

SEQ ID NO: 7829380 - DNA, 22 bp, Homo sapiens
acagctggagtgaggatggagt

SEQ ID NO: 7829381 - DNA, 22 bp, Homo sapiens
acagctggagtgttggtgaggt

SEQ ID NO: 7829382 - DNA, 22 bp, Homo sapiens
aagctggagagtttcacagatg

SEQ ID NO: 7829383 - DNA, 22 bp, Homo sapiens
acagctggagtgttggtgaggt

SEQ ID NO: 7829384 - DNA, 22 bp, Homo sapiens
acagctggagtgaggatggagt

SEQ ID NO: 7829385 - DNA, 22 bp, Homo sapiens
aagctgtgaaatctctagtgca

SEQ ID NO: 7829386 - DNA, 22 bp, Homo sapiens
aagctggcaaacaagcatcatt

SEQ ID NO: 7829387 - DNA, 22 bp, Homo sapiens
aagctgtgaaatctctagtgca

SEQ ID NO: 7829388 - DNA, 22 bp, Homo sapiens
aagctggatgtaggatccccct

SEQ ID NO: 7829389 - DNA, 22 bp, Homo sapiens
aagctggatgccttcctcccaa

SEQ ID NO: 7829390 - DNA, 22 bp, Homo sapiens
aagctggagagtttcacagatg

SEQ ID NO: 7829391 - DNA, 22 bp, Homo sapiens
aagctggaggctgagatcacca

SEQ ID NO: 7829392 - DNA, 22 bp, Homo sapiens
aagctggagtgcagtgcaatgg

SEQ ID NO: 7829393 - DNA, 22 bp, Homo sapiens
acagctggaggtctgtgagcac

SEQ ID NO: 7829394 - DNA, 22 bp, Homo sapiens
acagctggaggggctgcagagg

SEQ ID NO: 7829395 - DNA, 22 bp, Homo sapiens
acagctggaggggctgcagagg

SEQ ID NO: 7829396 - DNA, 22 bp, Homo sapiens
acagctggaggccccattgtcc

SEQ ID NO: 7829397 - DNA, 22 bp, Homo sapiens
acagctggaggggctgcagagg

SEQ ID NO: 7829398 - DNA, 22 bp, Homo sapiens
acagctggaggccccattgtcc

SEQ ID NO: 7829399 - DNA, 22 bp, Homo sapiens
acagctggaggccccattgtcc

SEQ ID NO: 7829400 - DNA, 22 bp, Homo sapiens
acagctggagccctatggctgg

SEQ ID NO: 7829401 - DNA, 22 bp, Homo sapiens
acagctggagccctatggctgg

SEQ ID NO: 7829402 - DNA, 22 bp, Homo sapiens
acagctggagccctatggctgg

SEQ ID NO: 7829403 - DNA, 22 bp, Homo sapiens
acagctggacaggggagagttt

SEQ ID NO: 7829404 - DNA, 22 bp, Homo sapiens
acagctggacaggggagagttt

SEQ ID NO: 7829405 - DNA, 22 bp, Homo sapiens
aagtataagctattcttcatga

SEQ ID NO: 7829406 - DNA, 22 bp, Homo sapiens
aagtagttggaaataagacaga

SEQ ID NO: 7829407 - DNA, 22 bp, Homo sapiens
aagtagttaggaacattctctc

SEQ ID NO: 7829408 - DNA, 22 bp, Homo sapiens
aagtagtgtgctccagcggtga

SEQ ID NO: 7829409 - DNA, 22 bp, Homo sapiens
aagtagtgtgctccagcggtga

SEQ ID NO: 7829410 - DNA, 22 bp, Homo sapiens
aagtatactgaaggtatccagg

SEQ ID NO: 7829411 - DNA, 22 bp, Homo sapiens
aagtataatcaaagcagggcta

SEQ ID NO: 7829412 - DNA, 22 bp, Homo sapiens
aagtataagctattcttcatga

SEQ ID NO: 7829413 - DNA, 22 bp, Homo sapiens
aagtataagctattcttcatga

SEQ ID NO: 7829414 - DNA, 19 bp, Homo sapiens
aagtatagtcagccttcta

SEQ ID NO: 7829415 - DNA, 22 bp, Homo sapiens
aagtatatactaaatgttaatc

SEQ ID NO: 7829416 - DNA, 22 bp, Homo sapiens
aagtagcattttcaaaatgtat

SEQ ID NO: 7829417 - DNA, 22 bp, Homo sapiens
aagtaggaatccgaatgagtag

SEQ ID NO: 7829418 - DNA, 22 bp, Homo sapiens
aagtaggaatccgaatgagtag

SEQ ID NO: 7829419 - DNA, 22 bp, Homo sapiens
aagtagcaaggaagattatgat

SEQ ID NO: 7829420 - DNA, 22 bp, Homo sapiens
aagtagcatcaaggaggatcca

SEQ ID NO: 7829421 - DNA, 22 bp, Homo sapiens
aagtagcatcaaggaggatcca

SEQ ID NO: 7829422 - DNA, 22 bp, Homo sapiens
aagtagacttttgcatcaagga

SEQ ID NO: 7829423 - DNA, 22 bp, Homo sapiens
aagtagacagtcatctactttg

SEQ ID NO: 7829424 - DNA, 22 bp, Homo sapiens
aagtagacttttgcatcaagga

SEQ ID NO: 7829425 - DNA, 22 bp, Homo sapiens
aagtccagtgatactggcagga

SEQ ID NO: 7829426 - DNA, 22 bp, Homo sapiens
aagtcatcactcctctgaactt

SEQ ID NO: 7829427 - DNA, 22 bp, Homo sapiens
aagtcatctgaaactggcttat

SEQ ID NO: 7829428 - DNA, 22 bp, Homo sapiens
aagtccagtttttccaggtggt

SEQ ID NO: 7829429 - DNA, 22 bp, Homo sapiens
aagtccagtttttccaggtggt

SEQ ID NO: 7829430 - DNA, 22 bp, Homo sapiens
aagtccagtttcatttgaggtc

SEQ ID NO: 7829431 - DNA, 22 bp, Homo sapiens
aagtccagtgctttagattcca

SEQ ID NO: 7829432 - DNA, 22 bp, Homo sapiens
aagtccagtgctttagattcca

SEQ ID NO: 7829433 - DNA, 22 bp, Homo sapiens
aagtccatgatcaagatgtggc

SEQ ID NO: 7829434 - DNA, 22 bp, Homo sapiens
aagtccattcttccagccagct

SEQ ID NO: 7829435 - DNA, 22 bp, Homo sapiens
aagtccataggtttcatgaggg

SEQ ID NO: 7829436 - DNA, 22 bp, Homo sapiens
aagtccagtttttccaggtggt

SEQ ID NO: 7829437 - DNA, 22 bp, Homo sapiens
aagtatctcaaaaacagtaatc

SEQ ID NO: 7829438 - DNA, 22 bp, Homo sapiens
aagtatctcaaaaacagtaatc

SEQ ID NO: 7829439 - DNA, 22 bp, Homo sapiens
aagtatctcaaaaacagtaatc

SEQ ID NO: 7829440 - DNA, 22 bp, Homo sapiens
aagtatctcaaaaacagtaatc

SEQ ID NO: 7829441 - DNA, 22 bp, Homo sapiens
aagtatcaaatggtagcatatg

SEQ ID NO: 7829442 - DNA, 22 bp, Homo sapiens
aagtcatagtcgggaaagacat

SEQ ID NO: 7829443 - DNA, 22 bp, Homo sapiens
aagtcatcactcctctgaactt

SEQ ID NO: 7829444 - DNA, 22 bp, Homo sapiens
aagtatatactaaatgttaatc

SEQ ID NO: 7829445 - DNA, 22 bp, Homo sapiens
aagtatatactaaatgttaatc

SEQ ID NO: 7829446 - DNA, 22 bp, Homo sapiens
aagtatattttttgaagcatat

SEQ ID NO: 7829447 - DNA, 22 bp, Homo sapiens
aagtatattttttgaagcatat

SEQ ID NO: 7829448 - DNA, 22 bp, Homo sapiens
aagtatatttagctgagcttgt

SEQ ID NO: 7829449 - DNA, 22 bp, Homo sapiens
acctgcctatggagccacatgg

SEQ ID NO: 7829450 - DNA, 22 bp, Homo sapiens
acctgcctatggagccacatgg

SEQ ID NO: 7829451 - DNA, 22 bp, Homo sapiens
acctgcctagttggttctgccc

SEQ ID NO: 7829452 - DNA, 22 bp, Homo sapiens
acctgcctatcagctgcctgct

SEQ ID NO: 7829453 - DNA, 22 bp, Homo sapiens
acctgcctatcagctgcctgct

SEQ ID NO: 7829454 - DNA, 22 bp, Homo sapiens
acctgcctatcagctgcctgct

SEQ ID NO: 7829455 - DNA, 22 bp, Homo sapiens
acctgcctatcagctgcctgct

SEQ ID NO: 7829456 - DNA, 22 bp, Homo sapiens
aagtccttgaagaaacagttct

SEQ ID NO: 7829457 - DNA, 22 bp, Homo sapiens
aagtccttgaagaaacagttct

SEQ ID NO: 7829458 - DNA, 22 bp, Homo sapiens
aagtccttctttatatgagagt

SEQ ID NO: 7829459 - DNA, 22 bp, Homo sapiens
aagtccttctttatatgagagt

SEQ ID NO: 7829460 - DNA, 22 bp, Homo sapiens
aagtcctgttcctcatacttcc

SEQ ID NO: 7829461 - DNA, 22 bp, Homo sapiens
aagtccttcccaagcatgtacc

SEQ ID NO: 7829462 - DNA, 18 bp, Homo sapiens
aagtccttcctttgcttt

SEQ ID NO: 7829463 - DNA, 22 bp, Homo sapiens
aagtcctttaatatcacatagt

SEQ ID NO: 7829464 - DNA, 22 bp, Homo sapiens
aagtcctttaatatcacatagt

SEQ ID NO: 7829465 - DNA, 22 bp, Homo sapiens
acctgcccggggacattccttt

SEQ ID NO: 7829466 - DNA, 22 bp, Homo sapiens
aagtcccatctgcctccatgta

SEQ ID NO: 7829467 - DNA, 20 bp, Homo sapiens
aagtccctaagtctctggcc

SEQ ID NO: 7829468 - DNA, 22 bp, Homo sapiens
aagtccctggtgctggctgcgc

SEQ ID NO: 7829469 - DNA, 20 bp, Homo sapiens
aagtccctaagtctctggcc

SEQ ID NO: 7829470 - DNA, 17 bp, Homo sapiens
aagtcccagctaacaca

SEQ ID NO: 7829471 - DNA, 22 bp, Homo sapiens
aagtcccatctgcctccatgta

SEQ ID NO: 7829472 - DNA, 22 bp, Homo sapiens
aagtcccaaagtcactctgctt

SEQ ID NO: 7829473 - DNA, 22 bp, Homo sapiens
aagtcccaaagtcactctgctt

SEQ ID NO: 7829474 - DNA, 22 bp, Homo sapiens
aagtcccaatccctggcctgct

SEQ ID NO: 7829475 - DNA, 22 bp, Homo sapiens
aagtccctggttcctagcaaaa

SEQ ID NO: 7829476 - DNA, 22 bp, Homo sapiens
aagtccctggtgctggctgcgc

SEQ ID NO: 7829477 - DNA, 20 bp, Homo sapiens
aagtccctaagtctctggcc

SEQ ID NO: 7829478 - DNA, 22 bp, Homo sapiens
aagtccctggttcctagcaaaa

SEQ ID NO: 7829479 - DNA, 22 bp, Homo sapiens
aagtccctttaatcagtgcctt

SEQ ID NO: 7829480 - DNA, 22 bp, Homo sapiens
aagtccctgtggggtggaggct

SEQ ID NO: 7829481 - DNA, 22 bp, Homo sapiens
aagtccctgtggggtggaggct

SEQ ID NO: 7829482 - DNA, 22 bp, Homo sapiens
aagtccctttaatcagtgcctt

SEQ ID NO: 7829483 - DNA, 20 bp, Homo sapiens
aagtcctgacctagtctaaa

SEQ ID NO: 7829484 - DNA, 22 bp, Homo sapiens
aagtcctgagaccagaaaatgg

SEQ ID NO: 7829485 - DNA, 22 bp, Homo sapiens
aagtcctggatattaaattgat

SEQ ID NO: 7829486 - DNA, 22 bp, Homo sapiens
aagtcctgccacctataagcct

SEQ ID NO: 7829487 - DNA, 22 bp, Homo sapiens
aagtcctgccagcaaatgtata

SEQ ID NO: 7829488 - DNA, 22 bp, Homo sapiens
aagtcctgggcatttgaacagg

SEQ ID NO: 7829489 - DNA, 22 bp, Homo sapiens
aagtcctgggtgagaactgtcc

SEQ ID NO: 7829490 - DNA, 22 bp, Homo sapiens
aagtcctgtgctagagacacct

SEQ ID NO: 7829491 - DNA, 22 bp, Homo sapiens
aagtcctgtgtgcttacacttg

SEQ ID NO: 7829492 - DNA, 22 bp, Homo sapiens
aagtcctgaataggggccctgg

SEQ ID NO: 7829493 - DNA, 22 bp, Homo sapiens
aagtcctgaataggggccctgg

SEQ ID NO: 7829494 - DNA, 20 bp, Homo sapiens
aagtcctgacctagtctaaa

SEQ ID NO: 7829495 - DNA, 22 bp, Homo sapiens
aagtcctgaaacttctttctga

SEQ ID NO: 7829496 - DNA, 22 bp, Homo sapiens
aagtcctgaaacttctttctga

SEQ ID NO: 7829497 - DNA, 22 bp, Homo sapiens
aagtcctgaagacacagaaaag

SEQ ID NO: 7829498 - DNA, 22 bp, Homo sapiens
aagtcctcaattttctctgcta

SEQ ID NO: 7829499 - DNA, 22 bp, Homo sapiens
aagtcctaattttaggaggaga

SEQ ID NO: 7829500 - DNA, 22 bp, Homo sapiens
aagtccctttaatcagtgcctt

SEQ ID NO: 7829501 - DNA, 22 bp, Homo sapiens
aaggtggtgcttctgctcctct

SEQ ID NO: 7829502 - DNA, 22 bp, Homo sapiens
aaggtggttgtaggctggtctg

SEQ ID NO: 7829503 - DNA, 22 bp, Homo sapiens
aaggtggttgtaggctggtctg

SEQ ID NO: 7829504 - DNA, 22 bp, Homo sapiens
acccaggggcgaagctggccac

SEQ ID NO: 7829505 - DNA, 22 bp, Homo sapiens
acccaggggcgaagctggccac

SEQ ID NO: 7829506 - DNA, 22 bp, Homo sapiens
acccaggggcgaagctggccac

SEQ ID NO: 7829507 - DNA, 22 bp, Homo sapiens
acccaggggcagccttgctgtg

SEQ ID NO: 7829508 - DNA, 22 bp, Homo sapiens
acccagggtagaacctcagagc

SEQ ID NO: 7829509 - DNA, 22 bp, Homo sapiens
acccagggtagaacctcagagc

SEQ ID NO: 7829510 - DNA, 22 bp, Homo sapiens
acccagggtagaacctcagagc

SEQ ID NO: 7829511 - DNA, 22 bp, Homo sapiens
acccagggcagccagcggggag

SEQ ID NO: 7829512 - DNA, 22 bp, Homo sapiens
acccagggcagccagcggggag

SEQ ID NO: 7829513 - DNA, 22 bp, Homo sapiens
acccagggcagccagcggggag

SEQ ID NO: 7829514 - DNA, 22 bp, Homo sapiens
acccagggccacagcccgcagt

SEQ ID NO: 7829515 - DNA, 22 bp, Homo sapiens
acccagggctcaagcgtaggca

SEQ ID NO: 7829516 - DNA, 22 bp, Homo sapiens
acccagggctcaagcgtaggca

SEQ ID NO: 7829517 - DNA, 22 bp, Homo sapiens
acccagggcagccagcggggag

SEQ ID NO: 7829518 - DNA, 22 bp, Homo sapiens
acccagggcagccagcggggag

SEQ ID NO: 7829519 - DNA, 22 bp, Homo sapiens
acccaggccattggcaagagtc

SEQ ID NO: 7829520 - DNA, 22 bp, Homo sapiens
acccaggccattggcaagagtc

SEQ ID NO: 7829521 - DNA, 22 bp, Homo sapiens
acccagggctcaagcgtaggca

SEQ ID NO: 7829522 - DNA, 22 bp, Homo sapiens
acccagggctcaagcgtaggca

SEQ ID NO: 7829523 - DNA, 22 bp, Homo sapiens
acccagggctcaagcgtaggca

SEQ ID NO: 7829524 - DNA, 22 bp, Homo sapiens
acccagggcttaaggcggtgca

SEQ ID NO: 7829525 - DNA, 22 bp, Homo sapiens
acccagggcttaaggcggtgca

SEQ ID NO: 7829526 - DNA, 22 bp, Homo sapiens
acccagggctcaagcgtaggca

SEQ ID NO: 7829527 - DNA, 22 bp, Homo sapiens
acccagggctcaagcgtaggca

SEQ ID NO: 7829528 - DNA, 21 bp, Homo sapiens
acccaggggaagcagaaactg

SEQ ID NO: 7829529 - DNA, 22 bp, Homo sapiens
acccagggcttaaggcggtgca

SEQ ID NO: 7829530 - DNA, 21 bp, Homo sapiens
acccaggggaagcagaaactg

SEQ ID NO: 7829531 - DNA, 22 bp, Homo sapiens
acccaggggcagccttgctgtg

SEQ ID NO: 7829532 - DNA, 20 bp, Homo sapiens
acctcctggaagcaggtgcc

SEQ ID NO: 7829533 - DNA, 20 bp, Homo sapiens
acctcctggaagcaggtgcc

SEQ ID NO: 7829534 - DNA, 21 bp, Homo sapiens
acctcctggcatcctgttccc

SEQ ID NO: 7829535 - DNA, 20 bp, Homo sapiens
acctcctggaagcaggtgcc

SEQ ID NO: 7829536 - DNA, 22 bp, Homo sapiens
acctatttatgcaattatgaaa

SEQ ID NO: 7829537 - DNA, 22 bp, Homo sapiens
acctatttatgcaattatgaaa

SEQ ID NO: 7829538 - DNA, 17 bp, Homo sapiens
acctattgatctgtcac

SEQ ID NO: 7829539 - DNA, 17 bp, Homo sapiens
acctattgatctgtcac

SEQ ID NO: 7829540 - DNA, 17 bp, Homo sapiens
acctattgatctgtcac

SEQ ID NO: 7829541 - DNA, 22 bp, Homo sapiens
aaggtgtcaccagattggcagg

SEQ ID NO: 7829542 - DNA, 22 bp, Homo sapiens
aaggtgtcactgggacaggaaa

SEQ ID NO: 7829543 - DNA, 22 bp, Homo sapiens
acctagtttttcagcaaataca

SEQ ID NO: 7829544 - DNA, 22 bp, Homo sapiens
acctcctggcttatcatggaca

SEQ ID NO: 7829545 - DNA, 22 bp, Homo sapiens
acctcctggtgcccaagtgttt

SEQ ID NO: 7829546 - DNA, 22 bp, Homo sapiens
acctcctggtgcccaagtgttt

SEQ ID NO: 7829547 - DNA, 22 bp, Homo sapiens
acctcctggcttatcatggaca

SEQ ID NO: 7829548 - DNA, 22 bp, Homo sapiens
acctcctggtgcccaagtgttt

SEQ ID NO: 7829549 - DNA, 22 bp, Homo sapiens
acctctcaggtcttcctcatat

SEQ ID NO: 7829550 - DNA, 22 bp, Homo sapiens
acctctaaaaaattagaagcct

SEQ ID NO: 7829551 - DNA, 22 bp, Homo sapiens
acctcctggctgctcatggaac

SEQ ID NO: 7829552 - DNA, 22 bp, Homo sapiens
acctcctggctgctcatggaac

SEQ ID NO: 7829553 - DNA, 22 bp, Homo sapiens
acctcctggcctcaagcaatcc

SEQ ID NO: 7829554 - DNA, 22 bp, Homo sapiens
acctcctggcctcaagcaatcc

SEQ ID NO: 7829555 - DNA, 21 bp, Homo sapiens
acctcctggcatcctgttccc

SEQ ID NO: 7829556 - DNA, 22 bp, Homo sapiens
acctctggacactgcatccttc

SEQ ID NO: 7829557 - DNA, 22 bp, Homo sapiens
acctctggacactgcatccttc

SEQ ID NO: 7829558 - DNA, 22 bp, Homo sapiens
acctctggacactgcatccttc

SEQ ID NO: 7829559 - DNA, 22 bp, Homo sapiens
acctctggacactgcatccttc

SEQ ID NO: 7829560 - DNA, 22 bp, Homo sapiens
acctctgcttcccgggttcaag

SEQ ID NO: 7829561 - DNA, 22 bp, Homo sapiens
acctctggcaccccctggcttg

SEQ ID NO: 7829562 - DNA, 22 bp, Homo sapiens
acctctggccaagactcgtgtt

SEQ ID NO: 7829563 - DNA, 22 bp, Homo sapiens
acctctggcaccccctggcttg

SEQ ID NO: 7829564 - DNA, 22 bp, Homo sapiens
acctctggcaccccctggcttg

SEQ ID NO: 7829565 - DNA, 19 bp, Homo sapiens
acctctgcagagatgttta

SEQ ID NO: 7829566 - DNA, 22 bp, Homo sapiens
acctctgccaagatgtgctccc

SEQ ID NO: 7829567 - DNA, 22 bp, Homo sapiens
acctctgccactttctaactct

SEQ ID NO: 7829568 - DNA, 22 bp, Homo sapiens
acctctgaggtgaggaggagct

SEQ ID NO: 7829569 - DNA, 22 bp, Homo sapiens
acctctgacctctgagagagaa

SEQ ID NO: 7829570 - DNA, 20 bp, Homo sapiens
acctctgacccagagcaggc

SEQ ID NO: 7829571 - DNA, 19 bp, Homo sapiens
acctctgagaatgccagtc

SEQ ID NO: 7829572 - DNA, 22 bp, Homo sapiens
acctctcaggtcttcctcatat

SEQ ID NO: 7829573 - DNA, 22 bp, Homo sapiens
acctctcagggccttggtttcc

SEQ ID NO: 7829574 - DNA, 22 bp, Homo sapiens
acctctctgggcctgcttcctg

SEQ ID NO: 7829575 - DNA, 22 bp, Homo sapiens
acctctctgggcctgcttcctg

SEQ ID NO: 7829576 - DNA, 22 bp, Homo sapiens
acctctgaagggccaagcaatg

SEQ ID NO: 7829577 - DNA, 22 bp, Homo sapiens
aaggggtgagcagaggcttcgc

SEQ ID NO: 7829578 - DNA, 22 bp, Homo sapiens
aaggggtgagcagaggcttcgc

SEQ ID NO: 7829579 - DNA, 22 bp, Homo sapiens
aagggggcggcagccagtggaa

SEQ ID NO: 7829580 - DNA, 22 bp, Homo sapiens
aagggggcggcagccagtggaa

SEQ ID NO: 7829581 - DNA, 22 bp, Homo sapiens
aagggggcgaagacgtgattga

SEQ ID NO: 7829582 - DNA, 22 bp, Homo sapiens
aagggggcggcagccagtggaa

SEQ ID NO: 7829583 - DNA, 22 bp, Homo sapiens
aagggggcggcagccagtggaa

SEQ ID NO: 7829584 - DNA, 19 bp, Homo sapiens
aaggggtgagggaagcaga

SEQ ID NO: 7829585 - DNA, 22 bp, Homo sapiens
aaggggtgcaagttaatcagca

SEQ ID NO: 7829586 - DNA, 22 bp, Homo sapiens
aaggggtgcaagttaatcagca

SEQ ID NO: 7829587 - DNA, 22 bp, Homo sapiens
aaggggtgctgttggaaaccca

SEQ ID NO: 7829588 - DNA, 22 bp, Homo sapiens
aaggggtgctgttggaaaccca

SEQ ID NO: 7829589 - DNA, 22 bp, Homo sapiens
aaggggtgctgttggaaaccca

SEQ ID NO: 7829590 - DNA, 19 bp, Homo sapiens
aaggggtgagggaagcaga

SEQ ID NO: 7829591 - DNA, 19 bp, Homo sapiens
aaggggtgagggaagcaga

SEQ ID NO: 7829592 - DNA, 19 bp, Homo sapiens
aaggggtgagggaagcaga

SEQ ID NO: 7829593 - DNA, 19 bp, Homo sapiens
aaggggtgagggaagcaga

SEQ ID NO: 7829594 - DNA, 22 bp, Homo sapiens
accagcaagattttgctttgca

SEQ ID NO: 7829595 - DNA, 23 bp, Homo sapiens
accagcaaaaatgacagcccagg

SEQ ID NO: 7829596 - DNA, 22 bp, Homo sapiens
accagcaagattttgctttgca

SEQ ID NO: 7829597 - DNA, 23 bp, Homo sapiens
accagcaaaaatgacagcccagg

SEQ ID NO: 7829598 - DNA, 23 bp, Homo sapiens
accagcaaaaatgacagcccagg

SEQ ID NO: 7829599 - DNA, 22 bp, Homo sapiens
aaggggaaaaagtgttaggagt

SEQ ID NO: 7829600 - DNA, 23 bp, Homo sapiens
accagcaaaaatgacagcccagg

SEQ ID NO: 7829601 - DNA, 22 bp, Homo sapiens
accagcaagattttgctttgca

SEQ ID NO: 7829602 - DNA, 22 bp, Homo sapiens
accagcacctgataggcagtaa

SEQ ID NO: 7829603 - DNA, 22 bp, Homo sapiens
aagggggccacacctggtgtga

SEQ ID NO: 7829604 - DNA, 22 bp, Homo sapiens
aagggggcccagcactaagttg

SEQ ID NO: 7829605 - DNA, 22 bp, Homo sapiens
aagggggcccagcactaagttg

SEQ ID NO: 7829606 - DNA, 22 bp, Homo sapiens
aagggggcgaagacgtgattga

SEQ ID NO: 7829607 - DNA, 22 bp, Homo sapiens
aagggggcacagtcactgtaat

SEQ ID NO: 7829608 - DNA, 22 bp, Homo sapiens
aagggggccacacctggtgtga

SEQ ID NO: 7829609 - DNA, 22 bp, Homo sapiens
aaggggaagagaccgcagagtc

SEQ ID NO: 7829610 - DNA, 22 bp, Homo sapiens
aaggggaaaaagtgttaggagt

SEQ ID NO: 7829611 - DNA, 22 bp, Homo sapiens
aaggggaagagaccgcagagtc

SEQ ID NO: 7829612 - DNA, 22 bp, Homo sapiens
accagaggcagtttcggctggt

SEQ ID NO: 7829613 - DNA, 22 bp, Homo sapiens
accagaggctctgccacctcca

SEQ ID NO: 7829614 - DNA, 22 bp, Homo sapiens
accagaggaggaattaccttcc

SEQ ID NO: 7829615 - DNA, 22 bp, Homo sapiens
accagaggaggaattaccttcc

SEQ ID NO: 7829616 - DNA, 22 bp, Homo sapiens
accagagtaatgtgtggaaatt

SEQ ID NO: 7829617 - DNA, 22 bp, Homo sapiens
accagagggcaaaccccagtgt

SEQ ID NO: 7829618 - DNA, 22 bp, Homo sapiens
accagagggcaaaccccagtgt

SEQ ID NO: 7829619 - DNA, 22 bp, Homo sapiens
accagagggcaaaccccagtgt

SEQ ID NO: 7829620 - DNA, 22 bp, Homo sapiens
accagagggagacttcctcttc

SEQ ID NO: 7829621 - DNA, 22 bp, Homo sapiens
accagagggagacttcctcttc

SEQ ID NO: 7829622 - DNA, 22 bp, Homo sapiens
accagaggaagggaatctcaag

SEQ ID NO: 7829623 - DNA, 20 bp, Homo sapiens
accagaggaaagagcagtga

SEQ ID NO: 7829624 - DNA, 22 bp, Homo sapiens
accagagcttacatgctagaaa

SEQ ID NO: 7829625 - DNA, 22 bp, Homo sapiens
accagagctggctctgagcacc

SEQ ID NO: 7829626 - DNA, 22 bp, Homo sapiens
accagagctggctctgagcacc

SEQ ID NO: 7829627 - DNA, 22 bp, Homo sapiens
accagagctggctctgagcacc

SEQ ID NO: 7829628 - DNA, 22 bp, Homo sapiens
accagagcttacatgctagaaa

SEQ ID NO: 7829629 - DNA, 22 bp, Homo sapiens
aagggttgcaaggtcagaggaa

SEQ ID NO: 7829630 - DNA, 22 bp, Homo sapiens
aagggttgaagataaataaggt

SEQ ID NO: 7829631 - DNA, 22 bp, Homo sapiens
aagggttagttggattatttat

SEQ ID NO: 7829632 - DNA, 22 bp, Homo sapiens
aagggtggtgtaggagatcaaa

SEQ ID NO: 7829633 - DNA, 20 bp, Homo sapiens
aaggtaagaaagccctgccc

SEQ ID NO: 7829634 - DNA, 22 bp, Homo sapiens
aaggtaatccataatagttact

SEQ ID NO: 7829635 - DNA, 22 bp, Homo sapiens
aaggtaatgaaacagcagctaa

SEQ ID NO: 7829636 - DNA, 22 bp, Homo sapiens
acccaggcagcaggagctaaag

SEQ ID NO: 7829637 - DNA, 22 bp, Homo sapiens
aaggtacagttttaagaataag

SEQ ID NO: 7829638 - DNA, 22 bp, Homo sapiens
aaggtacagttttaagaataag

SEQ ID NO: 7829639 - DNA, 22 bp, Homo sapiens
aaggtacagggaaggagcaaga

SEQ ID NO: 7829640 - DNA, 22 bp, Homo sapiens
aaggtacaccaaagttcaagtt

SEQ ID NO: 7829641 - DNA, 22 bp, Homo sapiens
aaggtacaaagttatacagcgt

SEQ ID NO: 7829642 - DNA, 22 bp, Homo sapiens
aaggtacagaaattaacaagga

SEQ ID NO: 7829643 - DNA, 22 bp, Homo sapiens
aaggtacagaaattaacaagga

SEQ ID NO: 7829644 - DNA, 22 bp, Homo sapiens
aagggtcttagaggttcatttt

SEQ ID NO: 7829645 - DNA, 23 bp, Homo sapiens
aagggtccatagctatcattaca

SEQ ID NO: 7829646 - DNA, 22 bp, Homo sapiens
aagggtgcaaagcactctagct

SEQ ID NO: 7829647 - DNA, 22 bp, Homo sapiens
aagggtgaagggtggtggccta

SEQ ID NO: 7829648 - DNA, 22 bp, Homo sapiens
aagggtgcaaagcactctagct

SEQ ID NO: 7829649 - DNA, 22 bp, Homo sapiens
aagggtgcgacctaggagtgag

SEQ ID NO: 7829650 - DNA, 22 bp, Homo sapiens
aagggtgcccaggagatggact

SEQ ID NO: 7829651 - DNA, 22 bp, Homo sapiens
aagggtgcaaagcactctagct

SEQ ID NO: 7829652 - DNA, 21 bp, Homo sapiens
aagggtgcatgcttacctctc

SEQ ID NO: 7829653 - DNA, 22 bp, Homo sapiens
aagggtgcattgcgcggggctg

SEQ ID NO: 7829654 - DNA, 22 bp, Homo sapiens
aagggtccaaggctttgcgttt

SEQ ID NO: 7829655 - DNA, 22 bp, Homo sapiens
aagggtccagcacctcggctcc

SEQ ID NO: 7829656 - DNA, 22 bp, Homo sapiens
aaggggtgggcattagagcagt

SEQ ID NO: 7829657 - DNA, 22 bp, Homo sapiens
aaggggtgggcattagagcagt

SEQ ID NO: 7829658 - DNA, 22 bp, Homo sapiens
aaggggtgggcattagagcagt

SEQ ID NO: 7829659 - DNA, 22 bp, Homo sapiens
aaggggtgggcattagagcagt

SEQ ID NO: 7829660 - DNA, 22 bp, Homo sapiens
aagggtgggccctggcagccat

SEQ ID NO: 7829661 - DNA, 22 bp, Homo sapiens
aagggtggtgtaggagatcaaa

SEQ ID NO: 7829662 - DNA, 22 bp, Homo sapiens
aagggtggtgtaggagatcaaa

SEQ ID NO: 7829663 - DNA, 22 bp, Homo sapiens
aagggtgggccctggcagccat

SEQ ID NO: 7829664 - DNA, 22 bp, Homo sapiens
aagggtgggccctggcagccat

SEQ ID NO: 7829665 - DNA, 22 bp, Homo sapiens
aagggtgggccctggcagccat

SEQ ID NO: 7829666 - DNA, 22 bp, Homo sapiens
aagggtgggcaccgccaggtca

SEQ ID NO: 7829667 - DNA, 22 bp, Homo sapiens
aagggtgggcaccgccaggtca

SEQ ID NO: 7829668 - DNA, 22 bp, Homo sapiens
aagggtggatttctgagctcta

SEQ ID NO: 7829669 - DNA, 22 bp, Homo sapiens
aagggtggatttctgagctcta

SEQ ID NO: 7829670 - DNA, 22 bp, Homo sapiens
aagggtggatttctgagctcta

SEQ ID NO: 7829671 - DNA, 22 bp, Homo sapiens
aagggtggatttctgagctcta

SEQ ID NO: 7829672 - DNA, 22 bp, Homo sapiens
aagggtgctgctatcaggaagc

SEQ ID NO: 7829673 - DNA, 22 bp, Homo sapiens
aagggtgggcaccgccaggtca

SEQ ID NO: 7829674 - DNA, 22 bp, Homo sapiens
aagggtgggcaccgccaggtca

SEQ ID NO: 7829675 - DNA, 22 bp, Homo sapiens
aagggtggatttctgagctcta

SEQ ID NO: 7829676 - DNA, 22 bp, Homo sapiens
aagggtgggcaccgccaggtca

SEQ ID NO: 7829677 - DNA, 22 bp, Homo sapiens
acatttcagatgtaatgtgatg

SEQ ID NO: 7829678 - DNA, 22 bp, Homo sapiens
acatttcagatgtaatgtgatg

SEQ ID NO: 7829679 - DNA, 22 bp, Homo sapiens
acatttcagattcatgaagtga

SEQ ID NO: 7829680 - DNA, 22 bp, Homo sapiens
acatttcagattcatgaagtga

SEQ ID NO: 7829681 - DNA, 22 bp, Homo sapiens
acatttcagattcatgaagtga

SEQ ID NO: 7829682 - DNA, 22 bp, Homo sapiens
aagggcagagggaatcccacat

SEQ ID NO: 7829683 - DNA, 22 bp, Homo sapiens
acatttcagatgtaatgtgatg

SEQ ID NO: 7829684 - DNA, 22 bp, Homo sapiens
acatttcagatgtaatgtgatg

SEQ ID NO: 7829685 - DNA, 20 bp, Homo sapiens
aagggcagagggaacagact

SEQ ID NO: 7829686 - DNA, 20 bp, Homo sapiens
aagggcagagggaacagact

SEQ ID NO: 7829687 - DNA, 22 bp, Homo sapiens
aagggcagaatagagaagatgg

SEQ ID NO: 7829688 - DNA, 22 bp, Homo sapiens
aagggcagaatagagaagatgg

SEQ ID NO: 7829689 - DNA, 22 bp, Homo sapiens
aagggcagaatagagaagatgg

SEQ ID NO: 7829690 - DNA, 20 bp, Homo sapiens
aagggcagagggaacagact

SEQ ID NO: 7829691 - DNA, 22 bp, Homo sapiens
aagggcagagggaatcccacat

SEQ ID NO: 7829692 - DNA, 22 bp, Homo sapiens
aagggcagagggaatcccacat

SEQ ID NO: 7829693 - DNA, 22 bp, Homo sapiens
aagggcagagggaatcccacat

SEQ ID NO: 7829694 - DNA, 20 bp, Homo sapiens
aagggcagagggaacagact

SEQ ID NO: 7829695 - DNA, 20 bp, Homo sapiens
aagggcagagggaacagact

SEQ ID NO: 7829696 - DNA, 20 bp, Homo sapiens
aagggcagagggaacagact

SEQ ID NO: 7829697 - DNA, 20 bp, Homo sapiens
aagggcagagggaacagact

SEQ ID NO: 7829698 - DNA, 22 bp, Homo sapiens
aagggaggtaaagctatttaaa

SEQ ID NO: 7829699 - DNA, 22 bp, Homo sapiens
aagggaggtaaagctatttaaa

SEQ ID NO: 7829700 - DNA, 22 bp, Homo sapiens
aagggaggtaaagctatttaaa

SEQ ID NO: 7829701 - DNA, 20 bp, Homo sapiens
aagggagaataatgattgta

SEQ ID NO: 7829702 - DNA, 22 bp, Homo sapiens
aagggagacagttgtgtgagga

SEQ ID NO: 7829703 - DNA, 22 bp, Homo sapiens
aagggatgtaaacatgaataag

SEQ ID NO: 7829704 - DNA, 22 bp, Homo sapiens
aagggatgcaggaaagaaggtt

SEQ ID NO: 7829705 - DNA, 22 bp, Homo sapiens
aagggatgcaggaaagaaggtt

SEQ ID NO: 7829706 - DNA, 22 bp, Homo sapiens
aagggattgatcttgacacagt

SEQ ID NO: 7829707 - DNA, 22 bp, Homo sapiens
aagggcacagggaaagagtgca

SEQ ID NO: 7829708 - DNA, 22 bp, Homo sapiens
aagggcaagatcctaagcatcc

SEQ ID NO: 7829709 - DNA, 22 bp, Homo sapiens
aagggcacagggaaagagtgca

SEQ ID NO: 7829710 - DNA, 22 bp, Homo sapiens
aagggcacagggaaagagtgca

SEQ ID NO: 7829711 - DNA, 22 bp, Homo sapiens
aagggcacagggaaagagtgca

SEQ ID NO: 7829712 - DNA, 22 bp, Homo sapiens
aagggcagaaagggacgctttg

SEQ ID NO: 7829713 - DNA, 22 bp, Homo sapiens
aagggcagaatagagaagatgg

SEQ ID NO: 7829714 - DNA, 22 bp, Homo sapiens
aagggcagaatagagaagatgg

SEQ ID NO: 7829715 - DNA, 22 bp, Homo sapiens
aagggcagaatagagaagatgg

SEQ ID NO: 7829716 - DNA, 22 bp, Homo sapiens
aagggcagaatagagaagatgg

SEQ ID NO: 7829717 - DNA, 22 bp, Homo sapiens
aagggcagaaagggacgctttg

SEQ ID NO: 7829718 - DNA, 22 bp, Homo sapiens
aagggatgtaaacatgaataag

SEQ ID NO: 7829719 - DNA, 22 bp, Homo sapiens
acatttcagcgtgcatgacatg

SEQ ID NO: 7829720 - DNA, 22 bp, Homo sapiens
acatttcagcgtgcatgacatg

SEQ ID NO: 7829721 - DNA, 22 bp, Homo sapiens
acatttcagtaagtgttaattt

SEQ ID NO: 7829722 - DNA, 22 bp, Homo sapiens
acatttcagtaagtgttaattt

SEQ ID NO: 7829723 - DNA, 22 bp, Homo sapiens
acatttcagcgtgcatgacatg

SEQ ID NO: 7829724 - DNA, 22 bp, Homo sapiens
acatttcagcgtgcatgacatg

SEQ ID NO: 7829725 - DNA, 22 bp, Homo sapiens
acatttcagcgtgcatgacatg

SEQ ID NO: 7829726 - DNA, 22 bp, Homo sapiens
acatttcagcgtgcatgacatg

SEQ ID NO: 7829727 - DNA, 22 bp, Homo sapiens
acatttcagattcatgaagtga

SEQ ID NO: 7829728 - DNA, 22 bp, Homo sapiens
acatttcagattcatgaagtga

SEQ ID NO: 7829729 - DNA, 22 bp, Homo sapiens
acatttcagtgagctattgaag

SEQ ID NO: 7829730 - DNA, 23 bp, Homo sapiens
acatttcatataaaagggatcag

SEQ ID NO: 7829731 - DNA, 22 bp, Homo sapiens
acatttcagtgagctattgaag

SEQ ID NO: 7829732 - DNA, 22 bp, Homo sapiens
acatttcagtgagctattgaag

SEQ ID NO: 7829733 - DNA, 22 bp, Homo sapiens
acatttcagtgagctattgaag

SEQ ID NO: 7829734 - DNA, 22 bp, Homo sapiens
acatttcagtgagctattgaag

SEQ ID NO: 7829735 - DNA, 22 bp, Homo sapiens
aagggctggagactgggtcttc

SEQ ID NO: 7829736 - DNA, 22 bp, Homo sapiens
aagggctggagaggaaaggttg

SEQ ID NO: 7829737 - DNA, 22 bp, Homo sapiens
aagggctggagaggaaaggttg

SEQ ID NO: 7829738 - DNA, 22 bp, Homo sapiens
aagggctggagactgggtcttc

SEQ ID NO: 7829739 - DNA, 22 bp, Homo sapiens
aagggctggagactgggtcttc

SEQ ID NO: 7829740 - DNA, 22 bp, Homo sapiens
aagggctggagactgggtcttc

SEQ ID NO: 7829741 - DNA, 22 bp, Homo sapiens
aagggctgcaatccaaaacact

SEQ ID NO: 7829742 - DNA, 22 bp, Homo sapiens
aagggctgatctcactttcttt

SEQ ID NO: 7829743 - DNA, 22 bp, Homo sapiens
aagggctgcaatccaaaacact

SEQ ID NO: 7829744 - DNA, 19 bp, Homo sapiens
aagggctgggcacctcact

SEQ ID NO: 7829745 - DNA, 22 bp, Homo sapiens
aagggctgggtctggttaaccc

SEQ ID NO: 7829746 - DNA, 18 bp, Homo sapiens
aagggctggcctttggag

SEQ ID NO: 7829747 - DNA, 18 bp, Homo sapiens
aagggctggcctttggag

SEQ ID NO: 7829748 - DNA, 19 bp, Homo sapiens
aagggctgggcacctcact

SEQ ID NO: 7829749 - DNA, 19 bp, Homo sapiens
aagggctgggcacctcact

SEQ ID NO: 7829750 - DNA, 22 bp, Homo sapiens
aagggctggccctgggaagagt

SEQ ID NO: 7829751 - DNA, 18 bp, Homo sapiens
aagggctggcctttggag

SEQ ID NO: 7829752 - DNA, 18 bp, Homo sapiens
aagggctggcctttggag

SEQ ID NO: 7829753 - DNA, 22 bp, Homo sapiens
aagggctggccctgggaagagt

SEQ ID NO: 7829754 - DNA, 22 bp, Homo sapiens
aagggctggccctgggaagagt

SEQ ID NO: 7829755 - DNA, 22 bp, Homo sapiens
aagggctggccctgggaagagt

SEQ ID NO: 7829756 - DNA, 22 bp, Homo sapiens
aagggctggccctgggaagagt

SEQ ID NO: 7829757 - DNA, 22 bp, Homo sapiens
aagggctggatctctctgagca

SEQ ID NO: 7829758 - DNA, 22 bp, Homo sapiens
aagggctggccacattctgggt

SEQ ID NO: 7829759 - DNA, 22 bp, Homo sapiens
aagggctggccacattctgggt

SEQ ID NO: 7829760 - DNA, 22 bp, Homo sapiens
aagggctggccacattctgggt

SEQ ID NO: 7829761 - DNA, 22 bp, Homo sapiens
aagggctggccacattctgggt

SEQ ID NO: 7829762 - DNA, 22 bp, Homo sapiens
aagggctggccacattctgggt

SEQ ID NO: 7829763 - DNA, 22 bp, Homo sapiens
aagggctggatctctctgagca

SEQ ID NO: 7829764 - DNA, 22 bp, Homo sapiens
aagggctggatctctctgagca

SEQ ID NO: 7829765 - DNA, 22 bp, Homo sapiens
aagggctggatctctctgagca

SEQ ID NO: 7829766 - DNA, 22 bp, Homo sapiens
aagggctggagaggaaaggttg

SEQ ID NO: 7829767 - DNA, 22 bp, Homo sapiens
aagggctggagaggaaaggttg

SEQ ID NO: 7829768 - DNA, 22 bp, Homo sapiens
aagggctggagaggaaaggttg

SEQ ID NO: 7829769 - DNA, 22 bp, Homo sapiens
aagggctggatctctctgagca

SEQ ID NO: 7829770 - DNA, 22 bp, Homo sapiens
agagaagggcctgtatgtaatc

SEQ ID NO: 7829771 - DNA, 22 bp, Homo sapiens
agagaagggcctgtatgtaatc

SEQ ID NO: 7829772 - DNA, 22 bp, Homo sapiens
agagaagggcctgtatgtaatc

SEQ ID NO: 7829773 - DNA, 22 bp, Homo sapiens
agagaagggcctgtatgtaatc

SEQ ID NO: 7829774 - DNA, 22 bp, Homo sapiens
agagaagggcctgtatgtaatc

SEQ ID NO: 7829775 - DNA, 22 bp, Homo sapiens
agagaagggggaaagatctcac

SEQ ID NO: 7829776 - DNA, 22 bp, Homo sapiens
agagaagggggaaagatctcac

SEQ ID NO: 7829777 - DNA, 22 bp, Homo sapiens
agagaagggggaaagatctcac

SEQ ID NO: 7829778 - DNA, 22 bp, Homo sapiens
agagaaggggtaaagagtcctg

SEQ ID NO: 7829779 - DNA, 22 bp, Homo sapiens
agagaagggggaaagatctcac

SEQ ID NO: 7829780 - DNA, 22 bp, Homo sapiens
agagaagggggaaagatctcac

SEQ ID NO: 7829781 - DNA, 22 bp, Homo sapiens
agagaaggggtaaagagtcctg

SEQ ID NO: 7829782 - DNA, 22 bp, Homo sapiens
agagaaggggtaaagagtcctg

SEQ ID NO: 7829783 - DNA, 22 bp, Homo sapiens
agagaaggggtaaagagtcctg

SEQ ID NO: 7829784 - DNA, 22 bp, Homo sapiens
agagaaggggtaaagagtcctg

SEQ ID NO: 7829785 - DNA, 22 bp, Homo sapiens
agagaaggggtaaagagtcctg

SEQ ID NO: 7829786 - DNA, 22 bp, Homo sapiens
agagaaggggtaaagagtcctg

SEQ ID NO: 7829787 - DNA, 22 bp, Homo sapiens
agagaaggggtaaagagtcctg

SEQ ID NO: 7829788 - DNA, 22 bp, Homo sapiens
agagaaggggtaaagagtcctg

SEQ ID NO: 7829789 - DNA, 22 bp, Homo sapiens
agagaaggggtaaagagtcctg

SEQ ID NO: 7829790 - DNA, 22 bp, Homo sapiens
agagaaggggtaaagagtcctg

SEQ ID NO: 7829791 - DNA, 22 bp, Homo sapiens
agagaaggggtaaagagtcctg

SEQ ID NO: 7829792 - DNA, 22 bp, Homo sapiens
aatgtgtacatgacagatagaa

SEQ ID NO: 7829793 - DNA, 22 bp, Homo sapiens
aatgtgtactttttcatgctca

SEQ ID NO: 7829794 - DNA, 22 bp, Homo sapiens
aatgtgtactttttcatgctca

SEQ ID NO: 7829795 - DNA, 22 bp, Homo sapiens
aatgtgtagcatttaatgcagt

SEQ ID NO: 7829796 - DNA, 22 bp, Homo sapiens
aatgtgtagcatttaatgcagt

SEQ ID NO: 7829797 - DNA, 22 bp, Homo sapiens
aatgtgtagcagaaccaggatt

SEQ ID NO: 7829798 - DNA, 22 bp, Homo sapiens
aatgtgtagcatttaatgcagt

SEQ ID NO: 7829799 - DNA, 22 bp, Homo sapiens
aatgtgtagggtgcctgttttt

SEQ ID NO: 7829800 - DNA, 22 bp, Homo sapiens
agagaaatttccctgccttctg

SEQ ID NO: 7829801 - DNA, 22 bp, Homo sapiens
agagaaatttccctgccttctg

SEQ ID NO: 7829802 - DNA, 19 bp, Homo sapiens
agagaaggatcctatggtt

SEQ ID NO: 7829803 - DNA, 22 bp, Homo sapiens
agagaaggcatagaacttgagt

SEQ ID NO: 7829804 - DNA, 22 bp, Homo sapiens
agagaaggcatagaacttgagt

SEQ ID NO: 7829805 - DNA, 22 bp, Homo sapiens
agagaaggcatagaacttgagt

SEQ ID NO: 7829806 - DNA, 22 bp, Homo sapiens
agagaaggcatagaacttgagt

SEQ ID NO: 7829807 - DNA, 22 bp, Homo sapiens
agagaaatgattcctgggcaga

SEQ ID NO: 7829808 - DNA, 22 bp, Homo sapiens
agagaaatgattcctgggcaga

SEQ ID NO: 7829809 - DNA, 22 bp, Homo sapiens
aatgtattcctcatgcaagagt

SEQ ID NO: 7829810 - DNA, 22 bp, Homo sapiens
aatgtattcctcatgcaagagt

SEQ ID NO: 7829811 - DNA, 22 bp, Homo sapiens
agagaaatggggtaatctttca

SEQ ID NO: 7829812 - DNA, 22 bp, Homo sapiens
agagaaattctcagtggaagat

SEQ ID NO: 7829813 - DNA, 22 bp, Homo sapiens
agagaaatggggtaatctttca

SEQ ID NO: 7829814 - DNA, 22 bp, Homo sapiens
agagaaattctcagtggaagat

SEQ ID NO: 7829815 - DNA, 21 bp, Homo sapiens
agagaagggactcttccagtc

SEQ ID NO: 7829816 - DNA, 22 bp, Homo sapiens
agagaagggaagggattcaccc

SEQ ID NO: 7829817 - DNA, 21 bp, Homo sapiens
agagaagggactcttccagtc

SEQ ID NO: 7829818 - DNA, 22 bp, Homo sapiens
agagaagggaagggattcaccc

SEQ ID NO: 7829819 - DNA, 22 bp, Homo sapiens
agagaagggaagggattcaccc

SEQ ID NO: 7829820 - DNA, 22 bp, Homo sapiens
agagaagggaagggattcaccc

SEQ ID NO: 7829821 - DNA, 21 bp, Homo sapiens
agagaagggactcttccagtc

SEQ ID NO: 7829822 - DNA, 21 bp, Homo sapiens
agagaagggactcttccagtc

SEQ ID NO: 7829823 - DNA, 22 bp, Homo sapiens
agagaagggcctgtatgtaatc

SEQ ID NO: 7829824 - DNA, 22 bp, Homo sapiens
agagaagggcctgtatgtaatc

SEQ ID NO: 7829825 - DNA, 21 bp, Homo sapiens
agagaagggattccaggccct

SEQ ID NO: 7829826 - DNA, 21 bp, Homo sapiens
agagaagggattccaggccct

SEQ ID NO: 7829827 - DNA, 21 bp, Homo sapiens
agagaagggattccaggccct

SEQ ID NO: 7829828 - DNA, 21 bp, Homo sapiens
agagaagggattccaggccct

SEQ ID NO: 7829829 - DNA, 21 bp, Homo sapiens
agagaagggattccaggccct

SEQ ID NO: 7829830 - DNA, 21 bp, Homo sapiens
agagaagggattccaggccct

SEQ ID NO: 7829831 - DNA, 22 bp, Homo sapiens
agagatgaaaagggtactgagg

SEQ ID NO: 7829832 - DNA, 22 bp, Homo sapiens
agagatgaaaagtggagactgg

SEQ ID NO: 7829833 - DNA, 22 bp, Homo sapiens
agagatgaaaagggtactgagg

SEQ ID NO: 7829834 - DNA, 22 bp, Homo sapiens
aatgtgtcccttatttcacagg

SEQ ID NO: 7829835 - DNA, 22 bp, Homo sapiens
aatgtgtcccttatttcacagg

SEQ ID NO: 7829836 - DNA, 22 bp, Homo sapiens
aatgtgtcccttatttcacagg

SEQ ID NO: 7829837 - DNA, 22 bp, Homo sapiens
aatgtgtcatttcccacaggtg

SEQ ID NO: 7829838 - DNA, 22 bp, Homo sapiens
aatgtgtatgaggaagagagaa

SEQ ID NO: 7829839 - DNA, 22 bp, Homo sapiens
aatgtgtatactggcaattaag

SEQ ID NO: 7829840 - DNA, 22 bp, Homo sapiens
aatgtgtatatgaacatacagg

SEQ ID NO: 7829841 - DNA, 22 bp, Homo sapiens
aatgtgtatatgaacatacagg

SEQ ID NO: 7829842 - DNA, 22 bp, Homo sapiens
aatgtgtatactggcaattaag

SEQ ID NO: 7829843 - DNA, 22 bp, Homo sapiens
aatgtgtataagggagagctaa

SEQ ID NO: 7829844 - DNA, 22 bp, Homo sapiens
agagcaatggcatccagctgat

SEQ ID NO: 7829845 - DNA, 21 bp, Homo sapiens
agagcaagttaaggcattaat

SEQ ID NO: 7829846 - DNA, 22 bp, Homo sapiens
agagcaattagcttaggtaaaa

SEQ ID NO: 7829847 - DNA, 22 bp, Homo sapiens
agagcaatggcatccagctgat

SEQ ID NO: 7829848 - DNA, 22 bp, Homo sapiens
agagcacaaattagttggtctt

SEQ ID NO: 7829849 - DNA, 22 bp, Homo sapiens
agagcaattctcaaggaggtgt

SEQ ID NO: 7829850 - DNA, 22 bp, Homo sapiens
agagcaatttcttctccaagtt

SEQ ID NO: 7829851 - DNA, 22 bp, Homo sapiens
agagcaatttcttctccaagtt

SEQ ID NO: 7829852 - DNA, 23 bp, Homo sapiens
agagcaaggaaatgaggtgtgat

SEQ ID NO: 7829853 - DNA, 23 bp, Homo sapiens
agagcaaggaaatgaggtgtgat

SEQ ID NO: 7829854 - DNA, 22 bp, Homo sapiens
agagcaagtgacagaaacaggg

SEQ ID NO: 7829855 - DNA, 22 bp, Homo sapiens
agagcaagtgacagaaacaggg

SEQ ID NO: 7829856 - DNA, 22 bp, Homo sapiens
agagcaagtgacagaaacaggg

SEQ ID NO: 7829857 - DNA, 22 bp, Homo sapiens
agagcaagtgacagaaacaggg

SEQ ID NO: 7829858 - DNA, 22 bp, Homo sapiens
agagcaagtgacagaaacaggg

SEQ ID NO: 7829859 - DNA, 22 bp, Homo sapiens
agagcaagtgacagaaacaggg

SEQ ID NO: 7829860 - DNA, 23 bp, Homo sapiens
agagcaaggaaatgaggtgtgat

SEQ ID NO: 7829861 - DNA, 23 bp, Homo sapiens
agagcaaggaaatgaggtgtgat

SEQ ID NO: 7829862 - DNA, 22 bp, Homo sapiens
agagcaaatagagaagccagct

SEQ ID NO: 7829863 - DNA, 22 bp, Homo sapiens
agagcaacgaggtgatactaga

SEQ ID NO: 7829864 - DNA, 22 bp, Homo sapiens
agagcaaatagagaagccagct

SEQ ID NO: 7829865 - DNA, 22 bp, Homo sapiens
agagcaaatagagaagccagct

SEQ ID NO: 7829866 - DNA, 22 bp, Homo sapiens
agagcaaagggacatggaagag

SEQ ID NO: 7829867 - DNA, 22 bp, Homo sapiens
agagcaaatagagaagccagct

SEQ ID NO: 7829868 - DNA, 22 bp, Homo sapiens
agagcaaatagagaagccagct

SEQ ID NO: 7829869 - DNA, 22 bp, Homo sapiens
agagcaaatagagaagccagct

SEQ ID NO: 7829870 - DNA, 22 bp, Homo sapiens
agagatttgtcaatgatttcca

SEQ ID NO: 7829871 - DNA, 22 bp, Homo sapiens
agagatttctactgcactcttt

SEQ ID NO: 7829872 - DNA, 22 bp, Homo sapiens
agagatttatactgcaccagaa

SEQ ID NO: 7829873 - DNA, 22 bp, Homo sapiens
agagatttgtcaatgatttcca

SEQ ID NO: 7829874 - DNA, 22 bp, Homo sapiens
agagcaaagggacatggaagag

SEQ ID NO: 7829875 - DNA, 22 bp, Homo sapiens
agagcaaagggacatggaagag

SEQ ID NO: 7829876 - DNA, 22 bp, Homo sapiens
agagcaaagggacatggaagag

SEQ ID NO: 7829877 - DNA, 22 bp, Homo sapiens
agagcaaagggacatggaagag

SEQ ID NO: 7829878 - DNA, 22 bp, Homo sapiens
aatgtatgtgattattcctcta

SEQ ID NO: 7829879 - DNA, 22 bp, Homo sapiens
aatgtatgtgcatcatttacat

SEQ ID NO: 7829880 - DNA, 22 bp, Homo sapiens
aatgtatgtgcatcatttacat

SEQ ID NO: 7829881 - DNA, 22 bp, Homo sapiens
aatgtatgtgcatcatttacat

SEQ ID NO: 7829882 - DNA, 22 bp, Homo sapiens
aatgtatgtgtatatcaaatca

SEQ ID NO: 7829883 - DNA, 22 bp, Homo sapiens
aatgtatgtgtatatcaaatca

SEQ ID NO: 7829884 - DNA, 22 bp, Homo sapiens
aatgtatgtgtatatcaaatca

SEQ ID NO: 7829885 - DNA, 23 bp, Homo sapiens
aatgtatgttagtatcttagaga

SEQ ID NO: 7829886 - DNA, 23 bp, Homo sapiens
aatgtatgttagtatcttagaga

SEQ ID NO: 7829887 - DNA, 23 bp, Homo sapiens
aatgtatgttagtatcttagaga

SEQ ID NO: 7829888 - DNA, 22 bp, Homo sapiens
aatgtattatacataatttgtg

SEQ ID NO: 7829889 - DNA, 22 bp, Homo sapiens
aatgtattatacataatttgtg

SEQ ID NO: 7829890 - DNA, 22 bp, Homo sapiens
aatgtattatacataatttgtg

SEQ ID NO: 7829891 - DNA, 22 bp, Homo sapiens
aatgtattatacataatttgtg

SEQ ID NO: 7829892 - DNA, 22 bp, Homo sapiens
aatgtattatacataatttgtg

SEQ ID NO: 7829893 - DNA, 21 bp, Homo sapiens
aatgtatgtttatctcacagt

SEQ ID NO: 7829894 - DNA, 21 bp, Homo sapiens
aatgtatgtttatctcacagt

SEQ ID NO: 7829895 - DNA, 21 bp, Homo sapiens
aatgtatgtttatctcacagt

SEQ ID NO: 7829896 - DNA, 22 bp, Homo sapiens
aatgtatgaaggttccagtttc

SEQ ID NO: 7829897 - DNA, 22 bp, Homo sapiens
aatgtatgaaggttccagtttc

SEQ ID NO: 7829898 - DNA, 22 bp, Homo sapiens
aatgtatgacagttctagtggt

SEQ ID NO: 7829899 - DNA, 22 bp, Homo sapiens
aatgtatgacagttctagtggt

SEQ ID NO: 7829900 - DNA, 22 bp, Homo sapiens
aatgtatgagcgtgaaagcact

SEQ ID NO: 7829901 - DNA, 22 bp, Homo sapiens
aatgtatgagcgtgaaagcact

SEQ ID NO: 7829902 - DNA, 22 bp, Homo sapiens
aatgtatgctgtggtatcttct

SEQ ID NO: 7829903 - DNA, 22 bp, Homo sapiens
aatgtatgctgtggtatcttct

SEQ ID NO: 7829904 - DNA, 22 bp, Homo sapiens
aatgtatgggtgagaaagttga

SEQ ID NO: 7829905 - DNA, 22 bp, Homo sapiens
aatgtatggattcatgtctgtg

SEQ ID NO: 7829906 - DNA, 22 bp, Homo sapiens
aatgtatggattcatgtctgtg

SEQ ID NO: 7829907 - DNA, 20 bp, Homo sapiens
aatgtatattttatgccagg

SEQ ID NO: 7829908 - DNA, 20 bp, Homo sapiens
aatgtatattttatgccagg

SEQ ID NO: 7829909 - DNA, 20 bp, Homo sapiens
aatgtatattttatgccagg

SEQ ID NO: 7829910 - DNA, 20 bp, Homo sapiens
aatgtatattttatgccagg

SEQ ID NO: 7829911 - DNA, 22 bp, Homo sapiens
aatgtataaccataggaaattt

SEQ ID NO: 7829912 - DNA, 22 bp, Homo sapiens
aatgtataaccataggaaattt

SEQ ID NO: 7829913 - DNA, 22 bp, Homo sapiens
aatgtataaccataggaaattt

SEQ ID NO: 7829914 - DNA, 22 bp, Homo sapiens
aatgtataatatttaatgcttt

SEQ ID NO: 7829915 - DNA, 22 bp, Homo sapiens
aatgtataatatttaatgcttt

SEQ ID NO: 7829916 - DNA, 22 bp, Homo sapiens
agacatttattcacacatttat

SEQ ID NO: 7829917 - DNA, 22 bp, Homo sapiens
agacatttatgtttctctagga

SEQ ID NO: 7829918 - DNA, 22 bp, Homo sapiens
agacatttagacccctgtagtt

SEQ ID NO: 7829919 - DNA, 22 bp, Homo sapiens
agacatgtcaccaattcttact

SEQ ID NO: 7829920 - DNA, 22 bp, Homo sapiens
agacatgtcaccaattcttact

SEQ ID NO: 7829921 - DNA, 23 bp, Homo sapiens
agacatggcaggaatacagcttc

SEQ ID NO: 7829922 - DNA, 22 bp, Homo sapiens
agacatggatttcttacataaa

SEQ ID NO: 7829923 - DNA, 22 bp, Homo sapiens
agacatggagaaggagccagtg

SEQ ID NO: 7829924 - DNA, 22 bp, Homo sapiens
agacattatgctgagtgaaaga

SEQ ID NO: 7829925 - DNA, 22 bp, Homo sapiens
agacatgtggtataatcagggg

SEQ ID NO: 7829926 - DNA, 22 bp, Homo sapiens
agacattatgctgagtgaaaga

SEQ ID NO: 7829927 - DNA, 21 bp, Homo sapiens
agacatgtgaactaaaggtga

SEQ ID NO: 7829928 - DNA, 22 bp, Homo sapiens
aatgccttggagagcctagagg

SEQ ID NO: 7829929 - DNA, 22 bp, Homo sapiens
aatgccttggagagcctagagg

SEQ ID NO: 7829930 - DNA, 22 bp, Homo sapiens
aatgccttggagagcctagagg

SEQ ID NO: 7829931 - DNA, 22 bp, Homo sapiens
aatgccttggagagcctagagg

SEQ ID NO: 7829932 - DNA, 22 bp, Homo sapiens
aatgccttggagagcctagagg

SEQ ID NO: 7829933 - DNA, 22 bp, Homo sapiens
aatgccttggagagcctagagg

SEQ ID NO: 7829934 - DNA, 22 bp, Homo sapiens
aatgccttgcctgctacaactt

SEQ ID NO: 7829935 - DNA, 22 bp, Homo sapiens
aatgccttgcctgctacaactt

SEQ ID NO: 7829936 - DNA, 22 bp, Homo sapiens
aatgccttgcctgctacaactt

SEQ ID NO: 7829937 - DNA, 22 bp, Homo sapiens
aatgccttgcctgctacaactt

SEQ ID NO: 7829938 - DNA, 22 bp, Homo sapiens
aatgccttggagagcctagagg

SEQ ID NO: 7829939 - DNA, 22 bp, Homo sapiens
aatgccttggagagcctagagg

SEQ ID NO: 7829940 - DNA, 22 bp, Homo sapiens
aatgcctttccactgggtatca

SEQ ID NO: 7829941 - DNA, 22 bp, Homo sapiens
aatgctaaaatggcactaaagt

SEQ ID NO: 7829942 - DNA, 22 bp, Homo sapiens
aatgctaaatgtgttatgttaa

SEQ ID NO: 7829943 - DNA, 22 bp, Homo sapiens
aatgctctctgccatagctaac

SEQ ID NO: 7829944 - DNA, 22 bp, Homo sapiens
aatgctgaatttagtatttatg

SEQ ID NO: 7829945 - DNA, 22 bp, Homo sapiens
aatgctctttgaatttgtcaga

SEQ ID NO: 7829946 - DNA, 22 bp, Homo sapiens
aatgctctttaacctattctga

SEQ ID NO: 7829947 - DNA, 22 bp, Homo sapiens
aatgctaacattggtttatatc

SEQ ID NO: 7829948 - DNA, 22 bp, Homo sapiens
aatgctagtgtgatatgtaagg

SEQ ID NO: 7829949 - DNA, 22 bp, Homo sapiens
aatgctcaaaatgtttcatcta

SEQ ID NO: 7829950 - DNA, 22 bp, Homo sapiens
agacatcttgcacacatatact

SEQ ID NO: 7829951 - DNA, 22 bp, Homo sapiens
agacatgacagatagttgctag

SEQ ID NO: 7829952 - DNA, 22 bp, Homo sapiens
agacatgaaaattccaaacatc

SEQ ID NO: 7829953 - DNA, 22 bp, Homo sapiens
agacatgaaaattccaaacatc

SEQ ID NO: 7829954 - DNA, 22 bp, Homo sapiens
agacatcttgcacacatatact

SEQ ID NO: 7829955 - DNA, 22 bp, Homo sapiens
agacatcttgcacacatatact

SEQ ID NO: 7829956 - DNA, 22 bp, Homo sapiens
agacatcttgcacacatatact

SEQ ID NO: 7829957 - DNA, 22 bp, Homo sapiens
agacatctctatgcaggatctc

SEQ ID NO: 7829958 - DNA, 22 bp, Homo sapiens
agacatctcccatgcattttta

SEQ ID NO: 7829959 - DNA, 22 bp, Homo sapiens
agacatctacctttcattcaaa

SEQ ID NO: 7829960 - DNA, 22 bp, Homo sapiens
agacatctacctttcattcaaa

SEQ ID NO: 7829961 - DNA, 22 bp, Homo sapiens
agacatctcccatgcattttta

SEQ ID NO: 7829962 - DNA, 22 bp, Homo sapiens
agacatgagaaacccaccagag

SEQ ID NO: 7829963 - DNA, 19 bp, Homo sapiens
agacatgagacacaggatg

SEQ ID NO: 7829964 - DNA, 19 bp, Homo sapiens
agacatgagacacaggatg

SEQ ID NO: 7829965 - DNA, 22 bp, Homo sapiens
agacatgccaagaaacccagtg

SEQ ID NO: 7829966 - DNA, 22 bp, Homo sapiens
agacatcagcttgtgtgcaggg

SEQ ID NO: 7829967 - DNA, 22 bp, Homo sapiens
agacatcatgttacagattaag

SEQ ID NO: 7829968 - DNA, 22 bp, Homo sapiens
agacatctacctttcattcaaa

SEQ ID NO: 7829969 - DNA, 20 bp, Homo sapiens
aatgctgcttctttttgcat

SEQ ID NO: 7829970 - DNA, 18 bp, Homo sapiens
aatttccatatgaattgc

SEQ ID NO: 7829971 - DNA, 22 bp, Homo sapiens
aatttcggttcaaggcccagtt

SEQ ID NO: 7829972 - DNA, 22 bp, Homo sapiens
aatttcggttcaaggcccagtt

SEQ ID NO: 7829973 - DNA, 22 bp, Homo sapiens
aatttcggttcaaggcccagtt

SEQ ID NO: 7829974 - DNA, 23 bp, Homo sapiens
aatttcccctgtctctgatttgg

SEQ ID NO: 7829975 - DNA, 23 bp, Homo sapiens
aatttcccctgtctctgatttgg

SEQ ID NO: 7829976 - DNA, 18 bp, Homo sapiens
aatttccatatgaattgc

SEQ ID NO: 7829977 - DNA, 22 bp, Homo sapiens
agaggattgttactgattagct

SEQ ID NO: 7829978 - DNA, 22 bp, Homo sapiens
agaggattttaaaagcatatgt

SEQ ID NO: 7829979 - DNA, 22 bp, Homo sapiens
agaggattttaacttatgcaac

SEQ ID NO: 7829980 - DNA, 22 bp, Homo sapiens
aatttcaattacttttgcacca

SEQ ID NO: 7829981 - DNA, 22 bp, Homo sapiens
agaggcaaaaatctatggcaac

SEQ ID NO: 7829982 - DNA, 22 bp, Homo sapiens
agaggattcttagaattctgag

SEQ ID NO: 7829983 - DNA, 22 bp, Homo sapiens
agaggattgaaggatttgttga

SEQ ID NO: 7829984 - DNA, 22 bp, Homo sapiens
agaggattgatcaaacactgca

SEQ ID NO: 7829985 - DNA, 22 bp, Homo sapiens
agaggatgttctaggcactcat

SEQ ID NO: 7829986 - DNA, 22 bp, Homo sapiens
agaggattatattttcaacaag

SEQ ID NO: 7829987 - DNA, 22 bp, Homo sapiens
agaggatgttctaggcactcat

SEQ ID NO: 7829988 - DNA, 22 bp, Homo sapiens
agaggagtgggaagcagtgcaa

SEQ ID NO: 7829989 - DNA, 22 bp, Homo sapiens
agaggatgattttaaggacact

SEQ ID NO: 7829990 - DNA, 22 bp, Homo sapiens
agaggatgattttaaggacact

SEQ ID NO: 7829991 - DNA, 22 bp, Homo sapiens
agaggatgattttaaggacact

SEQ ID NO: 7829992 - DNA, 22 bp, Homo sapiens
agaggatgattttaaggacact

SEQ ID NO: 7829993 - DNA, 22 bp, Homo sapiens
agaggatgattttaaggacact

SEQ ID NO: 7829994 - DNA, 22 bp, Homo sapiens
agaggaggtccttttctgatgt

SEQ ID NO: 7829995 - DNA, 22 bp, Homo sapiens
agaggaggtccttttctgatgt

SEQ ID NO: 7829996 - DNA, 22 bp, Homo sapiens
agaggacaaaatgagaagtgct

SEQ ID NO: 7829997 - DNA, 22 bp, Homo sapiens
agaggaggtccttttctgatgt

SEQ ID NO: 7829998 - DNA, 22 bp, Homo sapiens
agaggacaaaatgagaagtgct

SEQ ID NO: 7829999 - DNA, 22 bp, Homo sapiens
agaggaggtggtgatgctttaa

SEQ ID NO: 7830000 - DNA, 22 bp, Homo sapiens
agaggaggtggtgatgctttaa

SEQ ID NO: 7830001 - DNA, 22 bp, Homo sapiens
agaggaggtggtgatgctttaa

SEQ ID NO: 7830002 - DNA, 22 bp, Homo sapiens
aattccaacagacaaagttaga

SEQ ID NO: 7830003 - DNA, 22 bp, Homo sapiens
aattccaagagcttcctaagtg

SEQ ID NO: 7830004 - DNA, 22 bp, Homo sapiens
aattccagaggaggacagtcct

SEQ ID NO: 7830005 - DNA, 22 bp, Homo sapiens
aattccagaccacaagtgattt

SEQ ID NO: 7830006 - DNA, 22 bp, Homo sapiens
aattccagaccacaagtgattt

SEQ ID NO: 7830007 - DNA, 22 bp, Homo sapiens
agaggaaggatgcatatccaaa

SEQ ID NO: 7830008 - DNA, 22 bp, Homo sapiens
agaggaaggatgcatatccaaa

SEQ ID NO: 7830009 - DNA, 22 bp, Homo sapiens
agaggaaggatgcatatccaaa

SEQ ID NO: 7830010 - DNA, 22 bp, Homo sapiens
agagctgggtggtggtgactca

SEQ ID NO: 7830011 - DNA, 21 bp, Homo sapiens
agagctggtaggtaggtaggt

SEQ ID NO: 7830012 - DNA, 21 bp, Homo sapiens
agagctggtaggtaggtaggt

SEQ ID NO: 7830013 - DNA, 21 bp, Homo sapiens
agagctggtaggtaggtaggt

SEQ ID NO: 7830014 - DNA, 22 bp, Homo sapiens
agaggaaggatgcatatccaaa

SEQ ID NO: 7830015 - DNA, 22 bp, Homo sapiens
agaggaaggatgcatatccaaa

SEQ ID NO: 7830016 - DNA, 22 bp, Homo sapiens
agaggaagtaatcaggacctgc

SEQ ID NO: 7830017 - DNA, 22 bp, Homo sapiens
agagctgggtggtggtgactca

SEQ ID NO: 7830018 - DNA, 22 bp, Homo sapiens
agagctgggtggtggtgactca

SEQ ID NO: 7830019 - DNA, 22 bp, Homo sapiens
aattccagctgattgactttcc

SEQ ID NO: 7830020 - DNA, 22 bp, Homo sapiens
aattccagctgattgactttcc

SEQ ID NO: 7830021 - DNA, 20 bp, Homo sapiens
aattccagcatgatatttat

SEQ ID NO: 7830022 - DNA, 22 bp, Homo sapiens
aattccagctaggaaaagcttc

SEQ ID NO: 7830023 - DNA, 21 bp, Homo sapiens
agaggaagtgattggtctggc

SEQ ID NO: 7830024 - DNA, 21 bp, Homo sapiens
agaggaagtgattggtctggc

SEQ ID NO: 7830025 - DNA, 21 bp, Homo sapiens
agaggaagtgattggtctggc

SEQ ID NO: 7830026 - DNA, 22 bp, Homo sapiens
agaggaataaatttctgtagtg

SEQ ID NO: 7830027 - DNA, 21 bp, Homo sapiens
agaggaagtgattggtctggc

SEQ ID NO: 7830028 - DNA, 22 bp, Homo sapiens
agaggaatatgggtgcactaga

SEQ ID NO: 7830029 - DNA, 22 bp, Homo sapiens
agaggaatctgtctagacacaa

SEQ ID NO: 7830030 - DNA, 22 bp, Homo sapiens
agaggaatctgtctagacacaa

SEQ ID NO: 7830031 - DNA, 22 bp, Homo sapiens
agaggaatgtatttccctgcaa

SEQ ID NO: 7830032 - DNA, 22 bp, Homo sapiens
agaggaatttctggaaggaggc

SEQ ID NO: 7830033 - DNA, 22 bp, Homo sapiens
agaggaagtaatcaggacctgc

SEQ ID NO: 7830034 - DNA, 22 bp, Homo sapiens
agaggaagtaatcaggacctgc

SEQ ID NO: 7830035 - DNA, 22 bp, Homo sapiens
agaggaagtaatcaggacctgc

SEQ ID NO: 7830036 - DNA, 22 bp, Homo sapiens
agaggaagtaatcaggacctgc

SEQ ID NO: 7830037 - DNA, 21 bp, Homo sapiens
agaggaagtgattggtctggc

SEQ ID NO: 7830038 - DNA, 21 bp, Homo sapiens
agaggaagtgattggtctggc

SEQ ID NO: 7830039 - DNA, 22 bp, Homo sapiens
agaggaagtaatcaggacctgc

SEQ ID NO: 7830040 - DNA, 22 bp, Homo sapiens
agaggaagtaatcaggacctgc

SEQ ID NO: 7830041 - DNA, 22 bp, Homo sapiens
agaggaagtaatcaggacctgc

SEQ ID NO: 7830042 - DNA, 22 bp, Homo sapiens
agaggaagtaatcaggacctgc

SEQ ID NO: 7830043 - DNA, 22 bp, Homo sapiens
agaggaagtaatcaggacctgc

SEQ ID NO: 7830044 - DNA, 23 bp, Homo sapiens
aattacaaccaagaactggaagg

SEQ ID NO: 7830045 - DNA, 23 bp, Homo sapiens
aattacaaccaagaactggaagg

SEQ ID NO: 7830046 - DNA, 23 bp, Homo sapiens
aattacaaccaagaactggaagg

SEQ ID NO: 7830047 - DNA, 23 bp, Homo sapiens
aattacaaccaagaactggaagg

SEQ ID NO: 7830048 - DNA, 23 bp, Homo sapiens
aattacaaccaagaactggaagg

SEQ ID NO: 7830049 - DNA, 23 bp, Homo sapiens
aattacaaccaagaactggaagg

SEQ ID NO: 7830050 - DNA, 23 bp, Homo sapiens
aattacaaccaagaactggaagg

SEQ ID NO: 7830051 - DNA, 21 bp, Homo sapiens
aattacagatggaattacaga

SEQ ID NO: 7830052 - DNA, 21 bp, Homo sapiens
aattacagatggaattacaga

SEQ ID NO: 7830053 - DNA, 21 bp, Homo sapiens
aattacagatggaattacaga

SEQ ID NO: 7830054 - DNA, 21 bp, Homo sapiens
aattacagatggaattacaga

SEQ ID NO: 7830055 - DNA, 22 bp, Homo sapiens
aattacaaatgtagactctcat

SEQ ID NO: 7830056 - DNA, 22 bp, Homo sapiens
aattacaaatgtagactctcat

SEQ ID NO: 7830057 - DNA, 22 bp, Homo sapiens
aattacaaatgtagactctcat

SEQ ID NO: 7830058 - DNA, 23 bp, Homo sapiens
aattacaaccaagaactggaagg

SEQ ID NO: 7830059 - DNA, 22 bp, Homo sapiens
aattaattttgttcattcagtc

SEQ ID NO: 7830060 - DNA, 22 bp, Homo sapiens
aattaattttgttcattcagtc

SEQ ID NO: 7830061 - DNA, 22 bp, Homo sapiens
aattaattcagtttttaaggga

SEQ ID NO: 7830062 - DNA, 22 bp, Homo sapiens
aattaattttgttcattcagtc

SEQ ID NO: 7830063 - DNA, 22 bp, Homo sapiens
agagcctggctcccagctaccg

SEQ ID NO: 7830064 - DNA, 22 bp, Homo sapiens
agagcctggctcccagctaccg

SEQ ID NO: 7830065 - DNA, 22 bp, Homo sapiens
agagcctggctcccagctaccg

SEQ ID NO: 7830066 - DNA, 22 bp, Homo sapiens
agagctgaattcaagtgctggc

SEQ ID NO: 7830067 - DNA, 22 bp, Homo sapiens
agagcctggctcccagctaccg

SEQ ID NO: 7830068 - DNA, 22 bp, Homo sapiens
agagctgaattcaagtgctggc

SEQ ID NO: 7830069 - DNA, 22 bp, Homo sapiens
agagctgaattcaagtgctggc

SEQ ID NO: 7830070 - DNA, 22 bp, Homo sapiens
agagctgaattcaagtgctggc

SEQ ID NO: 7830071 - DNA, 22 bp, Homo sapiens
agagctgaatttgggtggtgga

SEQ ID NO: 7830072 - DNA, 21 bp, Homo sapiens
aattacagatggaattacaga
